United States Patent 8,362,325 (NUCLEOTIDE SEQUENCES AND CORRESPONDING POLYPEPTIDES CONFERRING MODULATED PLANT CHARACTERISTICS) - sequence listing, part 8

SEQ ID NO: 15316 - DNA, 1344 bp, Sorghum bicolor
  misc_feature: Ceres ANNOT ID no. 8640055
  misc_feature: Encodes the peptide sequence at SEQ ID NO 15317
atgacgaaggtggaggagctggcggggctggggcacctgctggtgttcgccttcctcttctgcttctccgccttcatggtggcccccgtgatgaccgacgtcaccatggcggcgctctgccccggccgcgacgagtgctccctcgccatctacctcactggcctccagcaagcggttactggtctgggcgcgctggtgctgacgccggtggtgggcaacctgtccgacaggtacggccggaaggcgttgctggcgctgccggccacggcgtccatcgttcctctcggaatcctggcgtacgggcggaccaaaggttacttctacgcgtactacgtaaccaagacgctgacggcgatggtcgccgaaggcaccatgatgtgcctctcgcttgcttacgtggctgacagggtgccggagacgcggcgcgcggcggccttcggcgtcttctccggcgtctgcagcgccggcttcgtcgccagcacagtggcagcccgcttcctccccgcctcatccacgtttcaggtctccgcagtggcagccgtggtgacggccgtctacatgaaggccttcctccaggagacggacggcggagcctccatatcctcctcctgcagcagcagcagcagcaatagcgacgaggaggcctcccggccgctctgccttccctccagcagcagcagcgaggaggcgtcgccgaggcttccgccacttcggaaggcgccgtcgctgtcggagttagcagccactcttaccagcagctcaaccttctctagggcggccgtcgtcacatttttccatggccttggtgagacaggcttactaagtacactactgtacttcctgaaggcaaaattccattatagcaaggaccagtatgccaatttgctacttatcattggcattacaggaagcttctcgcagctaactgtgatgccactcctagtggcaaagcttggtgaacagaagctacttgtcgtagcacttatagcgagctgcgggcaggcattcctatacagcatcgcatggtcgttctgggtcccttatcttgccgcaagcagtgtaatactaagcatgttggtcacaccttgtataagaagcattgtatcaaagaaagcggggccttttgagcagggaatggtccaagggtgcatcactggaataagctcaactgcaagtgtcatatctcctctaatttttactcctctcacagcctggtgtctgtcagaagctacgcctttctacttaaaaggtttcagccttgcctgtgctggatttgcaacgctggtagcgtttgcaacgagcataagtatgaggccaggtgaagtgcagactgataggaaatag

SEQ ID NO: 15317 - protein, 447 aa, Sorghum bicolor
  misc_feature: Useful for making plants with modulated cold sensitivity
  misc_feature: Useful for making plants with modulated salt sensitivity
  misc_feature: Functional homolog of the protein sequence given in SEQ ID NO 13474
  misc_feature: Ceres ANNOT ID no. 8640055
  misc_feature (13)..(396): Pfam ID: MFS_1 Pfam Description: Major Facilitator Superfamily
MTKVEELAGLGHLLVFAFLFCFSAFMVAPVMTDVTMAALCPGRDECSLAIYLTGLQQAVTGLGALVLTPVVGNLSDRYGRKALLALPATASIVPLGILAYGRTKGYFYAYYVTKTLTAMVAEGTMMCLSLAYVADRVPETRRAAAFGVFSGVCSAGFVASTVAARFLPASSTFQVSAVAAVVTAVYMKAFLQETDGGASISSSCSSSSSNSDEEASRPLCLPSSSSSEEASPRLPPLRKAPSLSELAATLTSSSTFSRAAVVTFFHGLGETGLLSTLLYFLKAKFHYSKDQYANLLLIIGITGSFSQLTVMPLLVAKLGEQKLLVVALIASCGQAFLYSIAWSFWVPYLAASSVILSMLVTPCIRSIVSKKAGPFEQGMVQGCITGISSTASVISPLIFTPLTAWCLSEATPFYLKGFSLACAGFATLVAFATSISMRPGEVQTDRK

SEQ ID NO: 15318 - DNA, 966 bp, Sorghum bicolor
  misc_feature: Ceres ANNOT ID no. 8640115
  misc_feature: Encodes the peptide sequence at SEQ ID NO 15319
atggcgctcgccgccgccattgtcttcttgcttccaggccttctcgtcccggcgatggcggccacgccgtacccttacggccgcggcggcggcgacccgctcgtgggcgcgtccaagaggtacgagggcagctccgacctggtggacctccgctaccacatgggccccgtcctctccgccgcgccgctccgcctctacgtgctctggtacggccgctgggaccccgcgcaccaggcccccgtccgcgacttcctcctctccctctccgacccgtccccgccgcagccctccgtcgccgactggtgggccaccgccgcgctctacgccgaccagaccctcgccaacgtcacccgccgcgtcgcgctggccggggaggccgccgacgagtccgcctcgctgggccgctcgctctccaggctcgacatccagtgcgtgctcgcctcggccgtcgccgcgggccgcctccccgccgacgcccgcggcggcgcctacctcgtgctcacggcgcccggcgtcggcgtccaggacttctgccgcgccgtctgcggcttccactacttcaccttcccgtcgctccggcggccgctgcgcgacgtctgcgcgtacccgttcgcgctgccatcctacatgtcccggaccggcatggcggcgctgcgcccgcccaacggcgacgcgggcgtcgacggcatggtcagcgtcatcgcgcacgagctggccgagctcgccaccaacccgctcgtcaacgcgtggtacgccggggaggaccccacggcgcccaccgagatcgccgacctgtgcgagggtgtgtacgggacgggcggtggcggcgggtacgccgggaaggtggcggtggacgcgcaggggaggagctggaatgtgaacgggaggaaggggaggaagttcttggtgcagtggctgtggagcccggaggctaaggcttgcgtagggcccaatgccagtgactag

SEQ ID NO: 15319 - protein, 321 aa, Sorghum bicolor
  misc_feature: Useful for biocontainment applications
  misc_feature: Functional homolog of the protein sequence given in SEQ ID NO 14166
  misc_feature: Ceres ANNOT ID no. 8640115
  misc_feature (50)..(318): Pfam ID: Phi_1 Pfam Description: Phosphate-induced protein 1 conserved region
MALAAAIVFLLPGLLVPAMAATPYPYGRGGGDPLVGASKRYEGSSDLVDLRYHMGPVLSAAPLRLYVLWYGRWDPAHQAPVRDFLLSLSDPSPPQPSVADWWATAALYADQTLANVTRRVALAGEAADESASLGRSLSRLDIQCVLASAVAAGRLPADARGGAYLVLTAPGVGVQDFCRAVCGFHYFTFPSLRRPLRDVCAYPFALPSYMSRTGMAALRPPNGDAGVDGMVSVIAHELAELATNPLVNAWYAGEDPTAPTEIADLCEGVYGTGGGGGYAGKVAVDAQGRSWNVNGRKGRKFLVQWLWSPEAKACVGPNASD

SEQ ID NO: 15320 - DNA, 681 bp, Sorghum bicolor
  misc_feature: Ceres ANNOT ID no. 8640047
  misc_feature: Encodes the peptide sequence at SEQ ID NO 15321
atggacctgtctcccagctcgccgtcgccgtcctccgtgccggtgccgtgccagtggtccggcgccgcggcgtgcggcctggccggcagggtgttgtgcgccgtcgccacctgcgtcttcgccgccgtggggtcgctggtcggggcggtgacggggtccatggtggggctggcgacggagagcgggatgctgcgcggcgccggcatcggcgccatctccggcgccgtcttctccatcgaggtcgccgagtcgtcacgcgacctctggcactcggccgactccggcgtctggtccctcctctacatggtggacatcatctcgggtctcctgagcggcaggctggtccgggagaaggtggggccggcggttcagagcgccgtgcagagtcagatcagcgccatcagctcgccgttcgaggagacgagcgacctgttcgagaccggcagcgtcaggggcctccccgaggacgcggtgcgccggctgccggagacggtgatcgcggcggacaccgccgtggacgcggcgggccaggcgctgtgctgctcggtgtgcctgcaggacttccgggtgggcgagcccgcgcggaggctgccggggtgccgccacctcttccacgtgccctgcatcgactgctggctcgtcaggcacggatcctgcccgctgtgccggcgagacatctga

SEQ ID NO: 15321 - protein, 226 aa, Sorghum bicolor
  misc_feature: The sequence is a functional homolog of SEQ ID NO 216 in the 10/225,068 US patent application
  misc_feature: The sequence is a functional homolog of SEQ ID NO 2322 in the 10/374,780 US patent application
  misc_feature: The sequence is a functional homolog of SEQ ID NO 242 in the 10/412,699 US patent application
  misc_feature: The sequence is a functional homolog of SEQ ID NO 515 in the 11/479,226 US patent application
  misc_feature: Useful for making plants with modulated nitrogen use efficiency
  misc_feature: Functional homolog of the protein sequence given in SEQ ID NO 12909
  misc_feature: Ceres ANNOT ID no. 8640047
  misc_feature (181)..(222): Pfam ID: zf-C3HC4 Pfam Description: Zinc finger, C3HC4 type (RING finger)
MDLSPSSPSPSSVPVPCQWSGAAACGLAGRVLCAVATCVFAAVGSLVGAVTGSMVGLATESGMLRGAGIGAISGAVFSIEVAESSRDLWHSADSGVWSLLYMVDIISGLLSGRLVREKVGPAVQSAVQSQISAISSPFEETSDLFETGSVRGLPEDAVRRLPETVIAADTAVDAAGQALCCSVCLQDFRVGEPARRLPGCRHLFHVPCIDCWLVRHGSCPLCRRDI

SEQ ID NO: 15322 - DNA, 849 bp, Sorghum bicolor
  misc_feature: Ceres ANNOT ID no. 8640101
  misc_feature: Encodes the peptide sequence at SEQ ID NO 15323
atggctgtcgtcaccagaggcgccgcgtccctgcccttcgtcttgctgctcccagtcctagtcgtcgtcgtcgtcttcgcggccccgtcgccggccaacggctgcgaccgctgcgtgcgccggtccaaggccacctaccaggcttcgtcgctagccctcaacgccggttcgtgcgggtacggctccctcgccgcgtccttcaacggcggcttcctcgccgccgccagccccgagctctacaggggcggcgtcgcctgcggtgcctgcttccaggtgcggtgcagggacagcgagctgtgcagcgcggcgggcgcgaaggtggtggtgacggaccaggcgcggacgtcgtcgaaccgcacgggcctggtgctgagcgccgcggcgtacgcggccatggccaccgcccgcgccggcaaggccgcgcgcctcagggaccgccgcgtcgtcgacgtcgagtacaagaggataccctgcgagtacgccaaggaccgcaacctgtcgatacgcgtggaggagaagagccggccgccgagcgacctctccatcaggttcctgtaccagggcggccagaccgacatcgtcgccgtcgacgtcgccaccgtcgggtcgtccaactggcggttcatgacgcgggaccacgggccggcgtggagcacggcgcaggcgccggcggggccgctgcagctgcggctggtggtgaccggcgggtacgacggcaagtgggtgtgggcggagtcggaggtgctgccgcgacggtgggaggccggccgcgtctacgacaccggggtgcaggtatccgacgtcgcgcaggaagggtgctacccctgcgacacgcaccagtggcagtaa

SEQ ID NO: 15323 - protein, 282 aa, Sorghum bicolor
  misc_feature: Useful for making plants with altered carbohydrate content
  misc_feature: Functional homolog of the protein sequence given in SEQ ID NO 14167
  misc_feature: Useful for making plants with altered cell wall content and/or composition
  misc_feature: Functional homolog of the protein sequence given in SEQ ID NO 14168
  misc_feature: Ceres ANNOT ID no. 8640101
  misc_feature (72)..(153): Pfam ID: DPBB_1 Pfam Description: Rare lipoprotein A (RlpA)-like double-psi beta-barrel
  misc_feature (166)..(250): Pfam ID: Pollen_allerg_1 Pfam Description: Pollen allergen
MAVVTRGAASLPFVLLLPVLVVVVVFAAPSPANGCDRCVRRSKATYQASSLALNAGSCGYGSLAASFNGGFLAAASPELYRGGVACGACFQVRCRDSELCSAAGAKVVVTDQARTSSNRTGLVLSAAAYAAMATARAGKAARLRDRRVVDVEYKRIPCEYAKDRNLSIRVEEKSRPPSDLSIRFLYQGGQTDIVAVDVATVGSSNWRFMTRDHGPAWSTAQAPAGPLQLRLVVTGGYDGKWVWAESEVLPRRWEAGRVYDTGVQVSDVAQEGCYPCDTHQWQ

SEQ ID NO: 15324 - DNA, 327 bp, Sorghum bicolor
  misc_feature: Ceres ANNOT ID no. 8640121
  misc_feature: Encodes the peptide sequence at SEQ ID NO 15325
atggagccttcacgggagaagctgtctgccgccgtcgtcctcctgctgacgctcctcgtcatggtcgccgagatgcgtccggttcaggcacgcgactgcctgacgcggagcacccggttaccgggggctctgtgcgtgcgttcggactactgcgcgatcgggtgcagggaggagggcaagggctacccggcggcaagtgcctcatctcccccaccccgcttgacggaattcgctgctactgcgtcaagccttgtgactcgacgcactgacgatcggccggagatccgagagcggtggtgctggccgtgggttatcaatcatggatga

SEQ ID NO: 15325 - protein, 108 aa, Sorghum bicolor
  misc_feature: The sequence is a functional homolog of SEQ ID NO 12 in US patent 7105720
  misc_feature: Ceres ANNOT ID no. 8640121
MEPSREKLSAAVVLLLTLLVMVAEMRPVQARDCLTRSTRLPGALCVRSDYCAIGCREEGKGYPAASASSPPPRLTEFAATASSLVTRRTDDRPEIRERWCWPWVINHG

SEQ ID NO: 15326 - DNA, 1524 bp, Sorghum bicolor
  misc_feature: Ceres ANNOT ID no. 8640152
  misc_feature: Encodes the peptide sequence at SEQ ID NO 15327
atgggaaatcaatgccaaaatggaacctatgggagcaattacaacaactacaaccactttcagaaggggcctttggcttctaggtactatgatggggacgattctgaggattgctgctcagggccatctagatcgagtgtagcagatcttatgcggcaaggactgagacgaaccttaacatccatctctgtccttggtcgaaagactcctaatgtaacagagcattatactctgggccggcagcttggagagggtctcactgggacaacctacctctgcactgagatcagcactggttgtcagtatgcatgcaagtccatcttgaaggcaaagttccggaacatgcaagatattgaagatgtgcgtcgtgagatccagataatgcactacctttcaggccaaaagcatacagtcaccatcaaggatgtgtatgaggatgaggaggccgtgcacattgtcatggagctctgtgaaggtggtgagctatatgaccggattaagaaggagaattacagtgagcagaaggctgcagatcttatcagaattattgttggcatcatagagaacttccattcacttggtgtgatgcaccgggatctcaagccagaaaacttcctcttacaggataaagacaatgatttgtcaataaaagtaattgactttggtctctctgtgttcttcaaaccaggtgaggttttcactgaaacagttggaagcccgtattatattgctccagaggtattgcagaagcattatggaccggaggctgatgtatggacagctggagtgatactctatgtattgctaagtggcgtgccacctttttgggcagatacacatgaaggagtacttgacaaagtgtgggatgggcattttgattttgaatcagaccagtggcacaggatttcggacagtgcaaaggatcttataagaaaaatgctctgcccttgtccatcggagagattgaaagcccatgaagttctaaagcatccctggatatgtgataatggagcggctactcatcaaactctagatccaactattctttctcacatcgacaagttatatgcagagaatagatcaaagaaattggttctacaggttattgctaagcatctttcagaagaggagattgctaggttaagaggaatgttcaaggcaatggacaatggaaacagtggtgcaattactttggctgagcttaaagaagggttgaggaaatctggttcagtgtttagaaatattgggattagtgatatcatggaagcggatgattatgacaacaacatcaatatcaattgggaagagtttattgctgcaacagtgcccctaagtaaaacagagcacaaagaacatttgatggaagactttacatatttcgacaaagatggaagtggttatatcactgttaacgagcctcaaaaggcttccatggaacaaaagttggaagatactttccttgaggacctcatttatgaggttgatcaaaacaattttcagaaatgccttggtgattgggactga

SEQ ID NO: 15327 - protein, 507 aa, Sorghum bicolor
  misc_feature: The sequence is a functional homolog of SEQ ID NO 2 in US patent 7084323
  misc_feature: Ceres ANNOT ID no. 8640152
  misc_feature (1)..(498): SWISSPROT Homolog: EC 2.7.11.1 Non-specific serine/threonine protein kinase
  misc_feature (76)..(333): Pfam ID: Pkinase Pfam Description: Protein kinase domain
MGNQCQNGTYGSNYNNYNHFQKGPLASRYYDGDDSEDCCSGPSRSSVADLMRQGLRRTLTSISVLGRKTPNVTEHYTLGRQLGEGLTGTTYLCTEISTGCQYACKSILKAKFRNMQDIEDVRREIQIMHYLSGQKHTVTIKDVYEDEEAVHIVMELCEGGELYDRIKKENYSEQKAADLIRIIVGIIENFHSLGVMHRDLKPENFLLQDKDNDLSIKVIDFGLSVFFKPGEVFTETVGSPYYIAPEVLQKHYGPEADVWTAGVILYVLLSGVPPFWADTHEGVLDKVWDGHFDFESDQWHRISDSAKDLIRKMLCPCPSERLKAHEVLKHPWICDNGAATHQTLDPTILSHIDKLYAENRSKKLVLQVIAKHLSEEEIARLRGMFKAMDNGNSGAITLAELKEGLRKSGSVFRNIGISDIMEADDYDNNININWEEFIAATVPLSKTEHKEHLMEDFTYFDKDGSGYITVNEPQKASMEQKLEDTFLEDLIYEVDQNNFQKCLGDWD

SEQ ID NO: 15328 - DNA, 423 bp, Sorghum bicolor
  misc_feature: Ceres ANNOT ID no. 8640178
  misc_feature: Encodes the peptide sequence at SEQ ID NO 15329
atggtgcgggggaagacggagctgaagcggatagagaacgcgacgagccggcaggtgaccttctccaagcgccgcaacgggctgctcaagaaggcctacgagctctccgtgctctgcgacgctgaggtcgggctcatcgtcttctccccgcgcggcaagctctacgagttcgccagcgccgccaggatagctgctccggctacaaacggagaaacatcgtcatgtgacttctggtcgcttgccttgttcctccggccagccaaaggcacttttttcttggtttgtaggagttttttggaaacaatcttttcttgctatggattagtggtggtgccaattgacttttcttgtttgtgttctccaatcacatcagttccggacgagggtatgatggcttgggactcaccggtcattttgctgtga

SEQ ID NO: 15329 - protein, 140 aa, Sorghum bicolor
  misc_feature: Useful for making plants with modulated flowering time
  misc_feature: Functional homolog of the protein sequence given in SEQ ID NO 13660
  misc_feature: Useful for making plants with modulated biomass
  misc_feature: Functional homolog of the protein sequence given in SEQ ID NO 13569
  misc_feature: The sequence is a functional homolog of SEQ ID NO 30 in the 10/666,642 US patent application
  misc_feature: The sequence is a functional homolog of SEQ ID NO 1243 in the 11/479,226 US patent application
  misc_feature: The sequence is a functional homolog of SEQ ID NO 1420 in the 10/666,642 US patent application
  misc_feature: The sequence is a functional homolog of SEQ ID NO 1814 in the 10/412,699 US patent application
  misc_feature: The sequence is a functional homolog of SEQ ID NO 570 in the 10/412,699 US patent application
  misc_feature: The sequence is a functional homolog of SEQ ID NO 1701 in the 10/412,699 US patent application
  misc_feature: Useful for making plants with altered lignin content
  misc_feature: Functional homolog of the protein sequence given in SEQ ID NO 12944
  misc_feature: The sequence is a functional homolog of SEQ ID NO 1963 in the 10/412,699 US patent application
  misc_feature: The sequence is a functional homolog of SEQ ID NO 1965 in the 10/412,699 US patent application
  misc_feature: Useful for making plants with altered alkaloid content
  misc_feature: Functional homolog of the protein sequence given in SEQ ID NO 13328
  misc_feature: The sequence is a functional homolog of SEQ ID NO 1967 in the 10/412,699 US patent application
  misc_feature: The sequence is a functional homolog of SEQ ID NO 1949 in the 10/412,699 US patent application
  misc_feature: The sequence is a functional homolog of SEQ ID NO 1957 in the 10/412,699 US patent application
  misc_feature: The sequence is a functional homolog of SEQ ID NO 1959 in the 10/412,699 US patent application
  misc_feature: Ceres ANNOT ID no. 8640178
  misc_feature (9)..(59): Pfam ID: SRF-TF Pfam Description: SRF-type transcription factor (DNA-binding and dimerisation domain)
MVRGKTELKRIENATSRQVTFSKRRNGLLKKAYELSVLCDAEVGLIVFSPRGKLYEFASAARIAAPATNGETSSCDFWSLALFLRPAKGTFFLVCRSFLETIFSCYGLVVVPIDFSCLCSPITSVPDEGMMAWDSPVILL

SEQ ID NO: 15330 - DNA, 960 bp, Sorghum bicolor
  misc_feature: Ceres ANNOT ID no. 8640172
  misc_feature: Encodes the peptide sequence at SEQ ID NO 15331
atggggaagcagcagggagcagggctgctgttcctcgtcgtcgttgcaggcctgctcctgcacgacacccgtgtcgccgatgcgcagactctccgggtcggctactacaaccagacgtgccgcaacgccgagtccatcgtcgccgacgaggtcctgaaggcgtcctacagggataagggcgtccttgccagcctcatccggctccacttccacgactgcttcgtcaatggctgcgacgggtcggtgctgctggagtctagcgaccggcaggcggagaagaacgccaagcccaacctgagcctgcgagggttcgacgtcatcgagcggatcaagcagaggttggaggccgcgtgcgcactgacggtctcctgcgccgacatcgtcgccttcgccgccagggacagcgttaagctgagcggtggtgttgggtacgccgtccccggcgggcggcaggacggcacggtgtcgcgggcgagcatgaccggcgacctcccgccgccgaaccagcggagcgtggaccagctcgcgcagtacttctaccgcaagggcctgacgctggacgacatgatcctcctcctgggcgcgcactcgctgggcgtcgcgcactgcggcaccttcgactaccggctgacgagcgaccaggacaagggcatggacgccgcgttccggaacagcctgcggagccagtgccggcacaacgccagcaacgccgtgcccttcgacgccggcagcccgtacgcgttcgacacaggctacttcgccaacgtgctcgccaaccgcaccgtgctcgagtccgacgccgcgctcgcctcgccgcgcgccgcgggcaaggtgaggcagtggaaggacaacccgggctggttcaggagcagcttcgcggccgccatggtcaagatgggcagcatccgcggcaccaacccaggcaaggtccgcctcagctgcaacagggtcaggatgtga

SEQ ID NO: 15331 - protein, 319 aa, Sorghum bicolor
  misc_feature: Useful for making plants with altered carbohydrate content
  misc_feature: Functional homolog of the protein sequence given in SEQ ID NO 13714
  misc_feature: Ceres ANNOT ID no. 8640172
  misc_feature (25)..(316): SWISSPROT Homolog: EC 1.11.1.7 Peroxidase
  misc_feature (47)..(284): Pfam ID: peroxidase Pfam Description: Peroxidase
MGKQQGAGLLFLVVVAGLLLHDTRVADAQTLRVGYYNQTCRNAESIVADEVLKASYRDKGVLASLIRLHFHDCFVNGCDGSVLLESSDRQAEKNAKPNLSLRGFDVIERIKQRLEAACALTVSCADIVAFAARDSVKLSGGVGYAVPGGRQDGTVSRASMTGDLPPPNQRSVDQLAQYFYRKGLTLDDMILLLGAHSLGVAHCGTFDYRLTSDQDKGMDAAFRNSLRSQCRHNASNAVPFDAGSPYAFDTGYFANVLANRTVLESDAALASPRAAGKVRQWKDNPGWFRSSFAAAMVKMGSIRGTNPGKVRLSCNRVRM

SEQ ID NO: 15332 - DNA, 1983 bp, Sorghum bicolor
  misc_feature: Ceres ANNOT ID no. 8640206
  misc_feature: Encodes the peptide sequence at SEQ ID NO 15333
atggccgccgcgactgcacgctccagccccgcaaagctatcaacgatgtcgtcggccatcgtgcggaaagtagaagagcatgcgcaccggagagagttcccctgcacctacctctccatcgcgctgccacgcaagtgctggccaccggcacaatggcccgccgagaggaaagcaacagagcatgcaccagagggggccgggagatgcaggttgcgcgaagcgatgtcagggccttggcagattgcggcagcgcaccggatccggaggagagcgatggaaaccggtggtttctcccccaacaaactcgtcagcatccaccatcgcgatttgctagcctcgacccatccagactacgacggcattggcatgaggggaggaggagctggagagaagctccaccacaaggaggccaatgccgcgcacggcggcgccggcgccacggggaagggggccgccgccaagacatctttcctcaacggcctcctcctctacgtcgtcctgccggtgctggtcctgtacttcgtcgtcattgccgcgtcgcagttctacaaccctcggtgctcgccggagggcaacgccatggcggcgacccatttcgtggtggctaataataagcccaacgcttcctcgttgaacgcttcgtcgtcgtcagctcctccaccaccggccggtccggcgtccaagacgacgaggctgacggcagaggaagcgcccaccgggctacgccacatcgtgttcggcatcggcgcgtcggcgtcgctgtgggagagccggaaggagtacatcaagctgtggtggcgtcccgggcggatgcgcggcttcgtctggatggacaagcccgtgggtgagttctactccaagagctcccgcacgggcctcccggcgatcatggtgagctcggacacgtccaagttcccctacacccacggcgccggcagccggtcggcgctccggatctcgcgcatcgtctcggagacgttccggctgggtctccccggcgtgcggtggttcgtgatgggcgacgacgacacggtgttcctgccggagaacctggtgcacgtgctgtcgcagtacgaccaccggcagccgtactacatcggttcgccgtcggagagccacatccagaacctcatcttctcgtacggcatggcgttcggcggcggcgggttcgccatcagccgcgcgctggcgtcggagctggcgaagatgcaggacgggtgcctgcaccggtacccggcgctgtacgggagcgacgaccgcatccacgcgtgcatgtcggagctgggggtgccgctgacccggcacccggggttccaccagtgcgacctgtggggcgacgtgctgggcctgctgggcgcgcaccccgtggcgccgctggtgacgctgcaccacctcgacttcctggagccggtgttcccgacgacgccgtcgcgtgcgggggcgctgcggaggctgttcgagggccccgtgcggctggactcggcggcggtggcgcagcagtcggtgtgctacgacgacgtgcaccagtggacggtgtccgtgtcgtgggggttcgcggtgatggtggtgcgcggggtgctgtcgccgagggagatggagacgccgatgcggagcttcctcaactggtacaagcgcgccgactacacggcctactcgttcaacacgcggcccgtggcgcggcagccgtgccagaagccgcacgtgtactacatgcgcgggagcaggatggaccggcgcaggaacgcgacggtgacggagtacgagcggcaccgggtgaagcaccccggatgcaggtggcggatcgccgaccccagcgcgctgctcgacagcatcgtcgtgctcaagaagcccgacccggaactctggaagaggtcgccgaggaggaactgctgcagggtggtgtcgtcgccgaagcaggggaaggaccggtcgatgaccatcgacgtcggtgtgtgcagggacggcgagttcgccaaggtttaa

SEQ ID NO: 15333 - protein, 660 aa, Sorghum bicolor
  misc_feature: Useful for making plants with altered carbohydrate content
  misc_feature: Functional homolog of the protein sequence given in SEQ ID NO 14169
  misc_feature: Ceres ANNOT ID no. 8640206
  misc_feature: Up-regulated in root tissues in response to methyl jasmonate treatment
  misc_feature: Up-regulated in shoot tissues in response to methyl jasmonate treatment
  misc_feature: Up-regulated in shoot tissues in response to salicylic acid treatment
  misc_feature: Up-regulated in root tissues in response to salicylic acid treatment
  misc_feature (311)..(439): SWISSPROT Homolog: EC 2.4.1.222 O-fucosylpeptide 3-beta-N-acetylglucosaminyltransferase
  misc_feature (237)..(478): Pfam ID: Fringe Pfam Description: Fringe-like
MAAATARSSPAKLSTMSSAIVRKVEEHAHRREFPCTYLSIALPRKCWPPAQWPAERKATEHAPEGAGRCRLREAMSGPWQIAAAHRIRRRAMETGGFSPNKLVSIHHRDLLASTHPDYDGIGMRGGGAGEKLHHKEANAAHGGAGATGKGAAAKTSFLNGLLLYVVLPVLVLYFVVIAASQFYNPRCSPEGNAMAATHFVVANNKPNASSLNASSSSAPPPPAGPASKTTRLTAEEAPTGLRHIVFGIGASASLWESRKEYIKLWWRPGRMRGFVWMDKPVGEFYSKSSRTGLPAIMVSSDTSKFPYTHGAGSRSALRISRIVSETFRLGLPGVRWFVMGDDDTVFLPENLVHVLSQYDHRQPYYIGSPSESHIQNLIFSYGMAFGGGGFAISRALASELAKMQDGCLHRYPALYGSDDRIHACMSELGVPLTRHPGFHQCDLWGDVLGLLGAHPVAPLVTLHHLDFLEPVFPTTPSRAGALRRLFEGPVRLDSAAVAQQSVCYDDVHQWTVSVSWGFAVMVVRGVLSPREMETPMRSFLNWYKRADYTAYSFNTRPVARQPCQKPHVYYMRGSRMDRRRNATVTEYERHRVKHPGCRWRIADPSALLDSIVVLKKPDPELWKRSPRRNCCRVVSSPKQGKDRSMTIDVGVCRDGEFAKV

SEQ ID NO: 15334 - DNA, 795 bp, Sorghum bicolor
  misc_feature: Ceres ANNOT ID no. 8640191
  misc_feature: Up-regulated in root tissues in response to methyl jasmonate treatment
  misc_feature: Up-regulated in shoot tissues in response to methyl jasmonate treatment
  misc_feature: Up-regulated in shoot tissues in response to salicylic acid treatment
  misc_feature: Up-regulated in root tissues in response to salicylic acid treatment
  misc_feature: Encodes the peptide sequence at SEQ ID NO 15335
atggcttctccctccacaggcacggccttcttggccctcgtcatcatcttcttggctttgctatgtgcggccaccacggcgaacgcgaggttcacggcgatgcagtggactccggcgcacgccaccttctacggcgacgagaccgcagcggagaccatgggtggggcgtgcggatatggcaacctgtacgcgaccgggtacggcacggacacggcggcgctgagcacgacgctgttcaaggacgggcacggttgcgggacgtgctaccagatccggtgcacgggttccccgtggtgctacgccggctcgccgtcgatcacggtgacggccaccaacctgtgcccgcccaactgggcgcaggacaccaacaacggcgggtggtgcaacccgccgcgcacccacttcgacctctccaagccggccttcatgaagatggcgcagtggcgcgccgggatcgtgcccgtcatgtaccgccgcgtgccctgcgtgcgcaggggcggcctccggttcgcgctccaggggaacccttactggctgctggcgtacgtgatgaacgtcggcggcgccggcgacgtcgtcgagatgtgggtgaagagcggcacgtcgtcctgcgcgtggatacggatgacccacaactggggcgccgcgtaccaggcgttcgcgcagctcggcggcaaggcgctcagcttcaaggtcacctcctacaccacccggcagaccatcgtcgccaccaacgtcgcgccggcgaactggggcctggggctcacgtaccaggcccgcgtcaacttctcctga

SEQ ID NO: 15335 - protein, 264 aa, Sorghum bicolor
  misc_feature: Useful for making plants with altered cell wall content and/or composition
  misc_feature: Functional homolog of the protein sequence given in SEQ ID NO 14170
  misc_feature: Useful for making plants with altered carbohydrate content
  misc_feature: Functional homolog of the protein sequence given in SEQ ID NO 14053
  misc_feature: Ceres ANNOT ID no. 8640191
  misc_feature (55)..(128): SWISSPROT Homolog: EC 3.2.1.4 Cellulase
  misc_feature (71)..(157): Pfam ID: DPBB_1 Pfam Description: Rare lipoprotein A (RlpA)-like double-psi beta-barrel
  misc_feature (168)..(248): Pfam ID: Pollen_allerg_1 Pfam Description: Pollen allergen
MASPSTGTAFLALVIIFLALLCAATTANARFTAMQWTPAHATFYGDETAAETMGGACGYGNLYATGYGTDTAALSTTLFKDGHGCGTCYQIRCTGSPWCYAGSPSITVTATNLCPPNWAQDTNNGGWCNPPRTHFDLSKPAFMKMAQWRAGIVPVMYRRVPCVRRGGLRFALQGNPYWLLAYVMNVGGAGDVVEMWVKSGTSSCAWIRMTHNWGAAYQAFAQLGGKALSFKVTSYTTRQTIVATNVAPANWGLGLTYQARVNFS

SEQ ID NO: 15336 - DNA, 795 bp, Sorghum bicolor; identical to SEQ ID NO: 15334
  misc_feature: Ceres ANNOT ID no. 8640195
  misc_feature: Encodes the peptide sequence at SEQ ID NO 15337

SEQ ID NO: 15337 - protein, 264 aa, Sorghum bicolor; identical to SEQ ID NO: 15335
  misc_feature: Useful for making plants with altered cell wall content and/or composition
  misc_feature: Functional homolog of the protein sequence given in SEQ ID NO 14170
  misc_feature: Useful for making plants with altered carbohydrate content
  misc_feature: Functional homolog of the protein sequence given in SEQ ID NO 14053
  misc_feature: Ceres ANNOT ID no. 8640195
  misc_feature (55)..(128): SWISSPROT Homolog: EC 3.2.1.4 Cellulase
  misc_feature (71)..(157): Pfam ID: DPBB_1 Pfam Description: Rare lipoprotein A (RlpA)-like double-psi beta-barrel
  misc_feature (168)..(248): Pfam ID: Pollen_allerg_1 Pfam Description: Pollen allergen

SEQ ID NO: 15338 - DNA, 501 bp, Sorghum bicolor
  misc_feature: Ceres ANNOT ID no. 8640240
  misc_feature: Encodes the peptide sequence at SEQ ID NO 15339
atggagtcatgcgtccctcctggttttaggtttcaccccacggacgaggagctcgtcggctactacctccggaagaaggtggcctcgcagaagatcgacctcgacgtcatccgcgacgttgacctctaccgcattgagccatgggatctccaagagcactgcaagattggttacgaggagcagagtgactggtacttcttcagctacaaggaccgcaagtacccgacggggacgcgcacgaaccgggcgacgctgacggggttctggaaggccaccggccgggacaaggcggtgcgcgacaccaagcacggcggcggcgggctcatcggcatgcgcaagacgctcgtcttctacacggggagggcgcccaacggccgcaagaccgactggatcatgcacgagtataggctggagaccgacgagaacgccgcacctcaggaagtggagcttattttgcccatcttggtatatggtaggagtaattgcgtatataaaagataa

SEQ ID NO: 15339 - protein, 166 aa, Sorghum bicolor
  misc_feature: The sequence is a functional homolog of SEQ ID NO 1729 in the 11/479,226 US patent application
  misc_feature: The sequence is a functional homolog of SEQ ID NO 2416 in the 10/374,780 US patent application
  misc_feature: The sequence is a functional homolog of SEQ ID NO 914 in the 10/225,066 US patent application
  misc_feature: Useful for biocontainment applications
  misc_feature: Functional homolog of the protein sequence given in SEQ ID NO 13623
  misc_feature: Useful for making plants with altered carbohydrate content
  misc_feature: Functional homolog of the protein sequence given in SEQ ID NO 13841
  misc_feature: Useful for making plants with altered cell wall content and/or composition
  misc_feature: Useful for making plants with altered lignin content
  misc_feature: Useful for making plants with modulated biomass
  misc_feature: Functional homolog of the protein sequence given in SEQ ID NO 12949
  misc_feature: The sequence is a functional homolog of SEQ ID NO 1270 in the 10/374,780 US patent application
  misc_feature: The sequence is a functional homolog of SEQ ID NO 1423 in the 10/412,699 US patent application
  misc_feature: The sequence is a functional homolog of SEQ ID NO 898 in the 10/666,642 US patent application
  misc_feature: The sequence is a functional homolog of SEQ ID NO 2590 in the 10/374,780 US patent application
  misc_feature: The sequence is a functional homolog of SEQ ID NO 286 in the 10/225,066 US patent application
  misc_feature: The sequence is a functional homolog of SEQ ID NO 160 in the 10/666,642 US patent application
  misc_feature: The sequence is a functional homolog of SEQ ID NO 634 in the 10/412,699 US patent application
  misc_feature: The sequence is a functional homolog of SEQ ID NO 638 in the 11/435,388 US patent application
  misc_feature: The sequence is a functional homolog of SEQ ID NO 194 in the 10/374,780 US patent application
  misc_feature: The sequence is a functional homolog of SEQ ID NO 898 in the 10/225,066 US patent application
  misc_feature: The sequence is a functional homolog of SEQ ID NO 132 in the 10/225,066 US patent application
  misc_feature: The sequence is a functional homolog of SEQ ID NO 1508 in the 10/666,642 US patent application
  misc_feature: The sequence is a functional homolog of SEQ ID NO 1924 in the 10/412,699 US patent application
  misc_feature: The sequence is a functional homolog of SEQ ID NO 2186 in the 10/374,780 US patent application
  misc_feature: The sequence is a functional homolog of SEQ ID NO 564 in the 11/435,388 US patent application
  misc_feature: The sequence is a functional homolog of SEQ ID NO 1198 in the 10/412,699 US patent application
  misc_feature: The sequence is a functional homolog of SEQ ID NO 867 in the 10/374,780 US patent application
  misc_feature: The sequence is a functional homolog of SEQ ID NO 2418 in the 10/374,780 US patent application
  misc_feature: The sequence is a functional homolog of SEQ ID NO 554 in the 10/225,066 US patent application
  misc_feature: The sequence is a functional homolog of SEQ ID NO 68 in the 10/286,264 US patent application
  misc_feature: The sequence is a functional homolog of SEQ ID NO 2840 in the 10/374,780 US patent application
  misc_feature: The sequence is a functional homolog of SEQ ID NO 450 in the 10/225,066 US patent application
  misc_feature: The sequence is a functional homolog of SEQ ID NO 476 in the 10/666,642 US patent application
  misc_feature: The sequence is a functional homolog of SEQ ID NO 2472 in the 10/374,780 US patent application
  misc_feature: The sequence is a functional homolog of SEQ ID NO 520 in the 11/435,388 US patent application
  misc_feature: The sequence is a functional homolog of SEQ ID NO 974 in the 10/225,066 US patent application
  misc_feature: The sequence is a functional homolog of SEQ ID NO 2478 in the 10/374,780 US patent application
  misc_feature: The sequence is a functional homolog of SEQ ID NO 572 in the 10/225,066 US patent application
  misc_feature: The sequence is a functional homolog of SEQ ID NO 2776 in the 10/374,780 US patent application
  misc_feature: The sequence is a functional homolog of SEQ ID NO 416 in the 10/225,066 US patent application
  misc_feature: The sequence is a functional homolog of SEQ ID NO 612 in the 11/435,388 US patent application
  misc_feature: The sequence is a functional homolog of SEQ ID NO 1196 in the 10/412,699 US patent application
  misc_feature: The sequence is a functional homolog of SEQ ID NO 865 in the 10/374,780 US patent application
  misc_feature: Useful for making plants with modulated light quality sensitivity
  misc_feature: Functional homolog of the protein sequence given in SEQ ID NO 13618
  misc_feature: The sequence is a functional homolog of SEQ ID NO 316 in the 10/412,699 US patent application
  misc_feature: The sequence is a functional homolog of SEQ ID NO 738 in the 11/479,226 US patent application
  misc_feature: Useful for making plants with altered terpenoid content
  misc_feature: Functional homolog of the protein sequence given in SEQ ID NO 13140
  misc_feature: The sequence is a functional homolog of SEQ ID NO 2470 in the 10/374,780 US patent application
  misc_feature: The sequence is a functional homolog of SEQ ID NO 798 in the 10/225,066 US patent application
  misc_feature: The sequence is a functional homolog of SEQ ID NO 853 in the 10/374,780 US patent application
  misc_feature: The sequence is a functional homolog of SEQ ID NO 1064 in the 10/225,066 US patent application
  misc_feature: The sequence is a functional homolog of SEQ ID NO 2838 in the 10/374,780 US patent application
  misc_feature: The sequence is a functional homolog of SEQ ID NO 682 in the 11/435,388 US patent application
  misc_feature: The sequence is a functional homolog of SEQ ID NO 2346 in the 10/374,780 US patent application
  misc_feature: The sequence is a functional homolog of SEQ ID NO 238 in the 10/225,068 US patent application
  misc_feature: The sequence is a functional homolog of SEQ ID NO 338 in the 10/412,699 US patent application
  misc_feature: The sequence is a functional homolog of SEQ ID NO 774 in the 11/479,226 US patent application
  misc_feature: The sequence is a functional homolog of SEQ ID NO 326 in the 10/412,699 US patent application
  misc_feature: The sequence is a functional homolog of SEQ ID NO 760 in the 11/479,226 US patent application
  misc_feature: Useful for making plants with altered alkaloid content
  misc_feature: Functional homolog of the protein sequence given in SEQ ID NO 14171
  misc_feature: The sequence is a functional homolog of SEQ ID NO 106 in the 10/225,068 US patent application
  misc_feature: The sequence is a functional homolog of SEQ ID NO 2348 in the 10/374,780 US patent application
  misc_feature: The sequence is a functional homolog of SEQ ID NO 340 in the 10/412,699 US patent application
  misc_feature: The sequence is a functional homolog of SEQ ID NO 778 in the 11/479,226 US patent application
  misc_feature: The sequence is a functional homolog of SEQ ID NO 492 in the 11/435,388 US patent application
  misc_feature: The sequence is a functional homolog of SEQ ID NO 741 in the 11/479,226 US patent application
  misc_feature: The sequence is a functional homolog of SEQ ID NO 851 in the 10/374,780 US patent application
  misc_feature: The sequence is a functional homolog of SEQ ID NO 854 in the 10/374,780 US patent application
  misc_feature: The sequence is a functional homolog of SEQ ID NO 2060 in the 10/374,780 US patent application
  misc_feature: The sequence is a functional homolog of SEQ ID NO 516 in the 10/412,699 US patent application
  misc_feature: The sequence is a functional homolog of SEQ ID NO 854 in the 11/435,388 US patent application
  misc_feature: The sequence is a functional homolog of SEQ ID NO 2110 in the 10/374,780 US patent application
  misc_feature: The sequence is a functional homolog of SEQ ID NO 304 in the 10/225,066 US patent application
  misc_feature: The sequence is a functional homolog of SEQ ID NO 954 in the 11/435,388 US patent application
  misc_feature: Useful for making plants with modulated oxidative stress sensitivity
  misc_feature: Functional homolog of the protein sequence given in SEQ ID NO 13621
  misc_feature: The sequence is a functional homolog of SEQ ID NO 102 in the 10/374,780 US patent application
  misc_feature: The sequence is a functional homolog of SEQ ID NO 886 in the 10/225,066 US patent application
  misc_feature: The sequence is a functional homolog of SEQ ID NO 2012 in the 10/374,780 US patent application
  misc_feature: The sequence is a functional homolog of SEQ ID NO 312 in the 10/412,699 US patent application
  misc_feature: The sequence is a functional homolog of SEQ ID NO 731 in the 11/479,226 US patent application
  misc_feature: The sequence is a functional homolog of SEQ ID NO 808 in the 10/225,066 US patent application
  misc_feature: The sequence is a functional homolog of SEQ ID NO 926 in the 11/435,388 US patent application
  misc_feature: The sequence is a functional homolog of SEQ ID NO 98 in the 10/374,780 US patent application
  misc_feature: The sequence is a functional homolog of SEQ ID NO 1036 in the 10/225,066 US patent application
  misc_feature: The sequence is a functional homolog of SEQ ID NO 216 in the 10/666,642 US patent application
  misc_feature: The sequence is a functional homolog of SEQ ID NO 2608 in the 10/374,780 US patent application
  misc_feature: The sequence is a functional homolog of SEQ ID NO 658 in the 11/435,388 US patent application
  misc_feature: The sequence is a functional homolog of SEQ ID NO 880 in the 10/412,699 US patent application
  misc_feature: Useful for making plants with modulated water use efficiency
  misc_feature: The sequence is a functional homolog of SEQ ID NO 344 in the 10/666,642 US patent application
  misc_feature: The sequence is a functional homolog of SEQ ID NO 1365 in the 11/479,226 US patent application
  misc_feature: The sequence is a functional homolog of SEQ ID NO 2474 in the 10/374,780 US patent application
  misc_feature: The sequence is a functional homolog of SEQ ID NO 744 in the 10/225,066 US patent application
  misc_feature: The sequence is a functional homolog of SEQ ID NO 1012 in the 11/435,388 US patent application
  misc_feature: The sequence is a functional homolog of SEQ ID NO 142 in the 10/286,264 US patent application
  misc_feature: The sequence is a functional homolog of SEQ ID NO 324 in the 10/412,699 US patent application
  misc_feature: The sequence is a functional homolog of SEQ ID NO 756 in the 11/479,226 US patent application
  misc_feature: The sequence is a functional homolog of SEQ ID NO 891 in the 10/374,780 US patent application
  misc_feature: The sequence is a functional homolog of SEQ ID NO 890 in the 10/374,780 US patent application
  misc_feature: The sequence is a functional homolog of SEQ ID NO 1157 in the 11/479,226 US patent application
  misc_feature: The sequence is a functional homolog of SEQ ID NO 1416 in the 10/666,642 US patent application
  misc_feature: The sequence is a functional homolog of SEQ ID NO 30 in the 10/286,264 US patent application
  misc_feature: The sequence is a functional homolog of SEQ ID NO 430 in the 11/435,388 US patent application
  misc_feature: The sequence is a functional homolog of SEQ ID NO 518 in the 10/412,699 US patent application
  misc_feature: Useful for making plants with modulated light quality response
  misc_feature: Functional homolog of the protein sequence given in SEQ ID NO 13870
  misc_feature: Useful for making plants with modulated nitrogen use efficiency
  misc_feature: Functional homolog of the protein sequence given in SEQ ID NO 13624
  misc_feature: The sequence is a functional homolog of SEQ ID NO 320 in the 10/374,780 US patent application
  misc_feature: The sequence is a functional homolog of SEQ ID NO 850 in the 10/225,066 US patent application
  misc_feature: The sequence is a functional homolog of SEQ ID NO 310 in the 10/666,642 US patent application
  misc_feature: Ceres ANNOT ID no. 8640240
  misc_feature (5)..(138): Pfam ID: NAM Pfam Description: No apical meristem (NAM) protein
MESCVPPGFRFHPTDEELVGYYLRKKVASQKIDLDVIRDVDLYRIEPWDLQEHCKIGYEEQSDWYFFSYKDRKYPTGTRTNRATLTGFWKATGRDKAVRDTKHGGGGLIGMRKTLVFYTGRAPNGRKTDWIMHEYRLETDENAAPQEVELILPILVYGRSNCVYKR

SEQ ID NO: 15340 - DNA, 243 bp, Sorghum bicolor
  misc_feature: Ceres ANNOT ID no. 8640256
  misc_feature: Encodes the peptide sequence at SEQ ID NO 15341
atggcgcccaggcaagccaaggaggatattgcgtccaaaataatggccttttctcaacaaggcccgcacactacatgcataatttcagcaaacgacgctctgtgcacggcgacactgcgtcaaccagcaaactctggtgggatagtgacatatgaggtatattcaggatcaactgcttggagcacaggcgatgcttttagtttactgctaggtcttttttttgaagcattaacacatgtttaa

SEQ ID NO: 15341 - protein, 80 aa, Sorghum bicolor
  misc_feature: The sequence is a functional homolog of SEQ ID NO 374 in the 10/374,780 US patent application
  misc_feature: The sequence is a functional homolog of SEQ ID NO 604 in the 10/225,066 US patent application
  misc_feature: The sequence is a functional homolog of SEQ ID NO 1012 in the 10/225,066 US patent application
  misc_feature: The sequence is a functional homolog of SEQ ID NO 124 in the 10/374,780 US patent application
  misc_feature: The sequence is a functional homolog of SEQ ID NO 1503 in the 11/479,226 US patent application
  misc_feature: The sequence is a functional homolog of SEQ ID NO 646 in the 11/435,388 US patent application
  misc_feature: The sequence is a functional homolog of SEQ ID NO 2536 in the 10/374,780 US patent application
  misc_feature: The sequence is a functional homolog of SEQ ID NO 264 in the 10/225,066 US patent application
  misc_feature: The sequence is a functional homolog of SEQ ID NO 462 in the 11/435,388 US patent application
  misc_feature: The sequence is a functional homolog of SEQ ID NO 1507 in the 11/479,226 US patent application
  misc_feature: The sequence is a functional homolog of SEQ ID NO 1446 in the 10/666,642 US patent application
  misc_feature: The sequence is a functional homolog of SEQ ID NO 2606 in the 10/374,780 US patent application
  misc_feature: The sequence is a functional homolog of SEQ ID NO 296 in the 10/225,066 US patent application
  misc_feature: The sequence is a functional homolog of SEQ ID NO 74 in the 11/375,241 US patent application
  misc_feature: The sequence is a functional homolog of SEQ ID NO 878 in the 10/412,699 US patent application
  misc_feature: The sequence is a functional homolog of SEQ ID NO 182 in the 10/666,642 US patent application
  misc_feature: The sequence is a functional homolog of SEQ ID NO 738 in the 10/412,699 US patent application
  misc_feature: Ceres ANNOT ID no. 8640256
MAPRQAKEDIASKIMAFSQQGPHTTCIISANDALCTATLRQPANSGGIVTYEVYSGSTAWSTGDAFSLLLGLFFEALTHV

SEQ ID NO: 15342 - DNA, 1233 bp, Sorghum bicolor
  misc_feature: Ceres ANNOT ID no. 8640315
  misc_feature: Encodes the peptide sequence at SEQ ID NO 15343
atgtcggcacctcctccttcccagcccccgccggacaaggcaccgcagtctcgtcctctcttcgtccccgtctccgcggctgccaacaagatcaatggtggcgttcacggacatcacgcgcccgagaagccggcgttgcccaacggcaaggcgccacagcacatcaacgggcacggcaacgggcacggcaagaagggcgtcaacgggcacgtcaacggccgccatgcgggcaacaaccggatccacctctcggtgagcacgggcggcggcgggggccaggacgggtccgggctccgcgtggcgttccagggcgcgccgggcgcctacagcgagttcgcggccaagacggcgctgcccgggtgcgagacggtcccgtgccgcgccttcgcggacgcgctggcggccgtggagcgcggcgccgccgaccgcgccgtgctccccgtggagtccaccatggaaggcaccgcgctgcggaactacgacctgctcctccggcacggcctggtggtggtgcaggagatcaacctcttcgtgcactactgcctgctggccatgcccggtgtccgcgccgccgaggtgcgccgcgtcatcagccacccgatggcgctggcgcactgcggccgcgcgctggcccggctcggggtggacccggagcccgtggaggacacggcgggcgccgtcgagatgctgcgctcgggacggatgctcgacaccgccgccatcgccagcccgcgcgccgccgacctgtacggcctcgacgtgctcgcgcacgggctccaggacgagtcctggaacgtcacgcgcttcctgctcctctcaaggccgtcggccgtcgccgcgctgcccgtggacgccgccgcaggcggtgccacaaagaccagcatggtggtcgcgcaccggggcggctccatgatggtggtgctcaaggtgctctccgccttctcctcccgcggcatcaacctcaccaagctggaggtcatcaacaacgacggcgccgcggctgccgacgccggatctggcgctggcgcgcgcccgcccgtggtgatcctggacacgagcgccaggggcaagccgacgctgcgcgcgttcccgcacgtcctgtacgtggactgcgagggcgccgcgcacgacccgcgcgtccacgaggccatccaggagatcgagacgttcgccgtcttcgtgcgcgtgctcggctgctacgccgccgactccaccgtctacgacctgcagtga

SEQ ID NO: 15343 - protein, 410 aa, Sorghum bicolor
  misc_feature: Useful for making plants with altered lignin content
  misc_feature: Functional homolog of the protein sequence given in SEQ ID NO 13139
  misc_feature: Ceres ANNOT ID no. 8640315
  misc_feature (99)..(325): SWISSPROT Homolog: EC 4.2.1.51 Prephenate dehydratase
  misc_feature (100)..(277): Pfam ID: PDT Pfam Description: Prephenate dehydratase
MSAPPPSQPPPDKAPQSRPLFVPVSAAANKINGGVHGHHAPEKPALPNGKAPQHINGHGNGHGKKGVNGHVNGRHAGNNRIHLSVSTGGGGGQDGSGLRVAFQGAPGAYSEFAAKTALPGCETVPCRAFADALAAVERGAADRAVLPVESTMEGTALRNYDLLLRHGLVVVQEINLFVHYCLLAMPGVRAAEVRRVISHPMALAHCGRALARLGVDPEPVEDTAGAVEMLRSGRMLDTAAIASPRAADLYGLDVLAHGLQDESWNVTRFLLLSRPSAVAALPVDAAAGGATKTSMVVAHRGGSMMVVLKVLSAFSSRGINLTKLEVINNDGAAAADAGSGAGARPPVVILDTSARGKPTLRAFPHVLYVDCEGAAHDPRVHEAIQEIETFAVFVRVLGCYAADSTVYDLQ

SEQ ID NO: 15344 - DNA, 1413 bp, Sorghum bicolor
  misc_feature: Ceres ANNOT ID no. 8640337
  misc_feature: Encodes the peptide sequence at SEQ ID NO 15345
atgcatatgatgcggcggctcaagagcatcgcctccggccgctcgtcagtctccgatccgggtggtgactctggctccaaaaggccaaaatttgagcaggatggagcaggagatattgttatcgagccacacttgactgaggaaaaacctgtgcggatagaccaagaatcatcgtcatcatctaatagggatgctgaggcaagcacatctactagcatgaagcctgctaaaactgaagaaccaggagcggatattcttcccaaagaaatgaatgatatgacaattagtgacgataaagctgatggccacaatgataaggaaggtgaaggtgttactcttgatgggaatggaactgagacagggcagataattgtgacaacaataggaggtcataatgggaagccaaagcagaaggtctcatacatggcagaacgggttgttggtactggttcgtttggtgttgttttccaggcaaaatgcttggaaactggtgagacagtggcgataaaaaaggtgttacaagataagcgctacaagaatagagagctccagactatgcagttacttgaccacccgaatgtagttcagctgaagcatcacttcttttcaacaactcaaaggggagaagtttacctcaaccttgtacttgaatttgtatctgagacagtttatcgtgttgccaaatactacaaccggatgaaccagcgtgtacccataatatatgttaagttgtatgcatatcagatgtgccgtgcacttgcttacatccatcgtgttgtcggtgtgtgtcatcgtgatattaaacctcaaaatctactggtcaatcctcatacacatcaacttaagatttgcgattttgggagcgctaagaaattggtccctggtgagcctaacatatcgtacatttgctcgcggtattatagggctcctgaactaatatttggagctacggagtataccactgcaatcgatatctggtctgttggctgtgtagtggctgagcttctgattggtcagcctttgtttcctggtgaaagtggtgttgatcaactggtggaaataataaagattttgggtactccaacaagagaggaaatcaggtgcatgaatccaaattattctgaattcaagttccctcagataaaagcccatccatggcacaagctttttggtaagcgcatgccacctgaagctgttgatcttgtgtcaaggctacttcagtactcaccaaatctgcgctgcactgcggttgatgcttgtgcccatccattctttgatgagctgcgggaccccaaggtctgcttgccaagtggacggccactgccaccgttgttcgacttcacagcagccgaactcgaagggctcccaattgagctggtccatcggattgttcctgaacacatgaggaagtga

SEQ ID NO: 15345 - protein, 470 aa, Sorghum bicolor
  misc_feature: Useful for making plants with modulated water use efficiency
  misc_feature: Functional homolog of the protein sequence given in SEQ ID NO 14073
  misc_feature: Useful for making plants with modulated biomass
  misc_feature: Functional homolog of the protein sequence given in SEQ ID NO 14074
  misc_feature: Ceres ANNOT ID no. 8640337
  misc_feature (1)..(467): SWISSPROT Homolog: EC 2.7.11.1 Non-specific serine/threonine protein kinase
  misc_feature (141)..(425): Pfam ID: Pkinase Pfam Description: Protein kinase domain
MHMMRRLKSIASGRSSVSDPGGDSGSKRPKFEQDGAGDIVIEPHLTEEKPVRIDQESSSSSNRDAEASTSTSMKPAKTEEPGADILPKEMNDMTISDDKADGHNDKEGEGVTLDGNGTETGQIIVTTIGGHNGKPKQKVSYMAERVVGTGSFGVVFQAKCLETGETVAIKKVLQDKRYKNRELQTMQLLDHPNVVQLKHHFFSTTQRGEVYLNLVLEFVSETVYRVAKYYNRMNQRVPIIYVKLYAYQMCRALAYIHRVVGVCHRDIKPQNLLVNPHTHQLKICDFGSAKKLVPGEPNISYICSRYYRAPELIFGATEYTTAIDIWSVGCVVAELLIGQPLFPGESGVDQLVEIIKILGTPTREEIRCMNPNYSEFKFPQIKAHPWHKLFGKRMPPEAVDLVSRLLQYSPNLRCTAVDACAHPFFDELRDPKVCLPSGRPLPPLFDFTAAELEGLPIELVHRIVPEHMRK

SEQ ID NO: 15346 - DNA, 234 bp, Sorghum bicolor
  misc_feature: Ceres ANNOT ID no. 8640369
  misc_feature: Encodes the peptide sequence at SEQ ID NO 15347
atggggtgcggaagcacccatgggctcggtacgtggcggagatctgggaccccacacggacaccagcagcagcacatgtggctgggcaccttccacacgccggagcaggccgcacgcgcctacgacgccgtcgcgcttaggctccacggtctacgtgtcaccataaactacaactactacgatggtagtcgcccagtcgtgtctgttatggacccgacgccggtgttgctttag

SEQ ID NO: 15347 - protein, 77 aa, Sorghum bicolor
  misc_feature: The sequence is a functional homolog of SEQ ID NO 1754 in the 10/374,780 US patent application
  misc_feature: The sequence is a functional homolog of SEQ ID NO 1232 in the 10/374,780 US patent application
  misc_feature: The sequence is a functional homolog of SEQ ID NO 718 in the 11/435,388 US patent application
  misc_feature: Useful for making plants with modulated water use efficiency
  misc_feature: Functional homolog of the protein sequence given in SEQ ID NO 13860
  misc_feature: The sequence is a functional homolog of SEQ ID NO 1223 in the 10/374,780 US patent application
  misc_feature: The sequence is a functional homolog of SEQ ID NO 1412 in the 10/412,699 US patent application
  misc_feature: The sequence is a functional homolog of SEQ ID NO 716 in the 11/435,388 US patent application
  misc_feature: Ceres ANNOT ID no. 8640369
MGCGSTHGLGTWRRSGTPHGHQQQHMWLGTFHTPEQAARAYDAVALRLHGLRVTINYNYYDGSRPVVSVMDPTPVLL

SEQ ID NO: 15348 - DNA, 141 bp, Sorghum bicolor
  misc_feature: Ceres ANNOT ID no. 8640382
  misc_feature: Encodes the peptide sequence at SEQ ID NO 15349
atgcacgagctcgcgcttgggctggagctcagcgggcagcgtttccggtgggtggcgcgcagccccagcgacgagggcacgctcagcgacaactactacgacgcggagagcaagaaggagcccccccttcgcctcctctag

SEQ ID NO: 15349 - protein, 46 aa, Sorghum bicolor
  misc_feature: Useful for making plants with altered carbohydrate content
  misc_feature: Functional homolog of the protein sequence given in SEQ ID NO 14172
  misc_feature: Useful for making plants with altered lignin content
  misc_feature: Functional homolog of the protein sequence given in SEQ ID NO 14173
  misc_feature: Ceres ANNOT ID no. 8640382
  misc_feature (3)..(40): SWISSPROT Homolog: EC 2.4.1.218 Hydroquinone glucosyltransferase
MHELALGLELSGQRFRWVARSPSDEGTLSDNYYDAESKKEPPLRLL

SEQ ID NO: 15350 - DNA, 1035 bp, Sorghum bicolor
  misc_feature: Ceres ANNOT ID no. 8640441
  misc_feature: Encodes the peptide sequence at SEQ ID NO 15351
atgacacccctcgactgcgacatgcctcctgcagcttcctgcaagaagcgcctctcgccgtcgcggcctctccctaaccgctgcttgctgatcttgatcgttgcactggcggccgccgccgcggtggccagcgcgcagctgtcgtcggaggactactacgacgcctcctgccccgccgccctcttcaccatccggaccgccgtctcgacggccgtgctcctggaccgccgcatgggggcctcccttctccgcctccacttccacgactgcttcgtgcagggttgtgacgcgtcggtgctgctagacgacacggcgagcttcaccggcgagaagggggcggggccgaacgcggggtcgcttcgcggcttcgacgtgatcgacaacatcaagatgctgctggagctgctgtgcccgcagaccgtctcctgcgccgacatccttgccgtcgccgcccgcgactccgttgcacaactgggaggaccatcgtggtcggttcccttgggcaggagggacgccaccacggcgagcgcgtccctggccaacagcgacctgcccggacctaccagcaacctcaacggccttctcaacgctttctccaacaagggtttgagcagcaccgacatggttgccctctcaggtgcccacaccgtcggccgggcgcagtgcaagaacatccggtcgcggatctacaacgacaccgacattgacgccacctacgcggcgtcgctgcgggcaagctgccccgcgcaggccggcggcgccagcgacggcgcgctcgagccgctcgacgacgccacgccggacgccttcgacaacgcctacttcggcaacctgctctcccagcgcggcctgctccactccgaccaggcgctcttcggcggcggcggcgcgacggacggcctggtcagcacctacgcgtccagcgccgaccagtgggggagcgacttcgccgcggccatggtcaagatgggcaacattagcccgctcaccggcaccgacggcgagatcagggtcaactgccggagagtgaattaa

SEQ ID NO: 15351 - protein, 344 aa, Sorghum bicolor
  misc_feature: Useful for making plants with altered cell wall content and/or composition
  misc_feature: Functional homolog of the protein sequence given in SEQ ID NO 13605
  misc_feature: Useful for making plants with altered carbohydrate content
  misc_feature: Functional homolog of the protein sequence given in SEQ ID NO 13606
  misc_feature: Useful for making plants with modulated nitrogen use efficiency
  misc_feature: Functional homolog of the protein sequence given in SEQ ID NO 13820
  misc_feature: Useful for making plants with modulated light quality response
  misc_feature: Functional homolog of the protein sequence given in SEQ ID NO 13816
  misc_feature: Ceres ANNOT ID no. 8640441
  misc_feature (49)..(344): SWISSPROT Homolog: EC 1.11.1.7 Peroxidase
  misc_feature (64)..(308): Pfam ID: peroxidase Pfam Description: Peroxidase
MTPLDCDMPPAASCKKRLSPSRPLPNRCLLILIVALAAAAAVASAQLSSEDYYDASCPAALFTIRTAVSTAVLLDRRMGASLLRLHFHDCFVQGCDASVLLDDTASFTGEKGAGPNAGSLRGFDVIDNIKMLLELLCPQTVSCADILAVAARDSVAQLGGPSWSVPLGRRDATTASASLANSDLPGPTSNLNGLLNAFSNKGLSSTDMVALSGAHTVGRAQCKNIRSRIYNDTDIDATYAASLRASCPAQAGGASDGALEPLDDATPDAFDNAYFGNLLSQRGLLHSDQALFGGGGATDGLVSTYASSADQWGSDFAAAMVKMGNISPLTGTDGEIRVNCRRVN

SEQ ID NO: 15352 - DNA, 702 bp, Sorghum bicolor
  misc_feature: Ceres ANNOT ID no. 8640481
  misc_feature: Encodes the peptide sequence at SEQ ID NO 15353
atggccgccggttccgaagctcttcttgacgccaccgcgctctccctctccctcgcgctgccgacgacgacgccggcgcccggcctggtggcggggctcaagatcaacaaggaggactacctcgccatctgcctcgccgcgctcgccggtacccgaggaaccggcctcagcaacaagcagcagtggtgcccaccgccggcggcgctggcgcacgaggagcagctccggttccggtgcgcggtgtgcgggaaggccttcgcgtcgtaccaggcgctcggcggccacaagtccagccaccgcaagccgcccacgccggagcagtacgccgccgccgcggcggcgcagcagcaggaggcggtttccgcgcccgactccgaggagacgacgacgacgacgacgtcgtcgtcgggagggacgacttctaccggtgggccgcaccggtgcaccatctgccggaaggggttcgccacgggccaggcgctcggcggccacaagcgctgccactactgggacggcacgtcgtcggtgtccgtctccatgtcggcgtcggcgtccgctacggggtcgtcgtcggccgtcaccgtcaggaactttgacctcaacctgatgcctgtgccggagaacgccggcatgaagagatgggtcgaggaggaggaggtgcagagtccactgcccatcaagaagcgcaggatcttggattag

SEQ ID NO: 15353 - protein, 233 aa, Sorghum bicolor
  misc_feature: The sequence is a functional homolog of SEQ ID NO 1215 in the 10/412,699 US patent application
  misc_feature: The sequence is a functional homolog of SEQ ID NO 906 in the 10/374,780 US patent application
  misc_feature: Ceres ANNOT ID no. 8640481
MAAGSEALLDATALSLSLALPTTTPAPGLVAGLKINKEDYLAICLAALAGTRGTGLSNKQQWCPPPAALAHEEQLRFRCAVCGKAFASYQALGGHKSSHRKPPTPEQYAAAAAAQQQEAVSAPDSEETTTTTTSSSGGTTSTGGPHRCTICRKGFATGQALGGHKRCHYWDGTSSVSVSMSASASATGSSSAVTVRNFDLNLMPVPENAGMKRWVEEEEVQSPLPIKKRRILD

SEQ ID NO: 15354 - DNA, 762 bp, Sorghum bicolor
  misc_feature: Ceres ANNOT ID no. 8640477
  misc_feature: Encodes the peptide sequence at SEQ ID NO 15355
atggccgccgccgccgcgctgaggtccccgtcctccgtcagggtcgtctcgggcccttcctccgccgcaggggcggggctcgccaaggcgcgtcgtcagcaggcgcccagggtcgccatccgcggcgccgccggggccgggcagcagccgcggagtcgccgtggcgccgccgccgccgtcgtccgggcgtcgctgttctcgcccaagcccgcggcggccaaggacgcgcggccgaccaaggtgcaggagctctacgtgtacgagatcaacgagcgggaccgcgagagccccgcctacctccgcctcagcgccaagcagtccgagaacgcgctcggcgacctcgtccccttcaccaacaaggtgtacagcggcagcctggacaagcggctggggatcacggcggggatctgcgtgctgatccagcacgtcccggaccggaacggcgaccggtacgaggccatctacagcttctacttcggcgactacggccacatctcggtgcagggcccgtacctgacctacgaggagtcgtacctggcggtcaccggcgggtcgggcgtcttcgagggcgcctacggccaggtcaagctcaaccagatcgtcttccccttcaagatcttctacaccttctacctcaagggcatcccggacctgcccagggacctgctctgcacgcccgtcccgccgtcacccaccgtcgagcccacccccgccgccaaggccgccgagccgcacgcctccatcaacaactacaccaactga

SEQ ID NO: 15355 - protein, 253 aa, Sorghum bicolor
  misc_feature: Useful for making plants with modulated nitrogen use efficiency
  misc_feature: Functional homolog of the protein sequence given in SEQ ID NO 14174
  misc_feature: Ceres ANNOT ID no. 8640477
  misc_feature (76)..(253): SWISSPROT Homolog: EC 5.3.99.6 Allene-oxide cyclase
  misc_feature (74)..(253): Pfam ID: Allene_ox_cyc Pfam Description: Allene oxide cyclase
MAAAAALRSPSSVRVVSGPSSAAGAGLAKARRQQAPRVAIRGAAGAGQQPRSRRGAAAAVVRASLFSPKPAAAKDARPTKVQELYVYEINERDRESPAYLRLSAKQSENALGDLVPFTNKVYSGSLDKRLGITAGICVLIQHVPDRNGDRYEAIYSFYFGDYGHISVQGPYLTYEESYLAVTGGSGVFEGAYGQVKLNQIVFPFKIFYTFYLKGIPDLPRDLLCTPVPPSPTVEPTPAAKAAEPHASINNYTN

SEQ ID NO: 15356 - DNA, 3387 bp, Sorghum bicolor
  misc_feature: Ceres ANNOT ID no. 8640529
  misc_feature: Encodes the peptide sequence at SEQ ID NO 15357
atggcgcagcggcaacaagcaaggagaggagagagaggagatagcatggatggcacagttcaaggcagaggcagaggcagccatccccttccgagttccgcccgccccactcttcctccccagcttcctcctttttgcccccctaccttccaaccatccaagaaacccccacaaagccagcgcccacgccgcgccacgccaaaaggaacccaagaagctgtgatcctgctgccccggaagaagctgcgtagcagtaccaagtacgaacaaattggacgcttggccatggagggtgaggcggcggtggccaagaacgagaggaaggttggcggcggaggaggaggcgttagcaatgacggtggcgcgaatgcgaggaggaggtgcaagggcggcggccccggcaggcatcacccgatcatccaggcctacccggcgctcctgccgttgccgctacacgccgccgcccacgcgcgccgcagcggcgccgtcgcgctgccgctgccgctgccgccgcccgtgctggtctacctgcaccagccgccgccgccgctgttgttccctaaggtgccggcgtgctacgggaagcccagtgggcccccgctgctgagggggccgccgtggagatcgaggaagccgccgccgccgccgcacgccgtcaccgccgcgctcctgccgctaccgcacgataccgagctgattcagcacagaaagtgtttcattcatgagaaccaaacatctgaaatgaaagcaaatcatctgagcacccatcacaattcatctatcaccatgcatggagttaacattgcaacaagacctgatggtggtgggattggggggactgcaattcctctctatgcaaaccatttccttgtgtgttttgatcctgggcagaagatttttcattatgatgtcgacatatccccacacccgtcaaaagaaacagcaagaatgatcaagaacaagctagttgaagaaaattcagatatcctctcaggcgcccttccagcctttgatggccgcaagaatctatttagtcccattcagtttcaacaggacaggcttgaattctttgttagtcttccagcagctgcatcgacacgatttatagaagctaaagataatgcccacatgattgacaagcagaatcataaggttttcagggtgaaccttcgattggtttcaaagctaagtggcgaggagttgaacaagtatttgaatgaagacaaggatggtattcctcttcctcaagaataccttcatgcattggatgtcatcctgcgggaaggtgctatggaaaactctattcccatgggccggtctttgtatccacgttcaatgggagaagcaaaggagattggtggtggagctgtcatgttacgaggtttcttccagagcttgagaccaacaaagcaaggtcttgccctcaatgttgacctctcacttacagctttccatgaaaacacgggcataattgcatacttgcagaagcgctgtgactttatgaaggacctttcacaggtgaagagtagggctttgacagtagatgagaggagggaggtggaaaaagcattgaagaatatccgagtgttcgtgtgccaccgtgaaactgaccaaaggtaccatgtgcatggcttgactgaggagacaacagagaacctcaagtttcgagatcgcagtgggaaggattatacggtcgtagattacttcaaagagcactacaaccatgatattaaattcaggaacctgccctgcttgcagattggtaagagcaagccatgctatgtgccaatggagctttgcatggtttgtgagggccagaagtttcttggcaagctctcagatgaacagacctccaaaatgctcagaatgggctgccaaagaccaagcgaaagaaagggaatcataaagggtgttgttgaaggagcatttggtacaagaagcaattcgtatgctgatcaattcaaccttcaagtgtccaaggacatgactcagctcttggggagggttctcttgccaccaaaactgaagcttggcaatggggggcgcatcaaggacataacaccagacagatttgaccggcaatggagtttgatggacagccatgttgctgagggttccaagatcaagagctgggccttgataagttttggtggcagcccagagcatcaatcattcattccaaagtttatcaaccagctatcaagccgctgtgagcaacttgggattttactcaacaagaaaactgtcgttagcccattgtttgagcggattcaaatcctgaacaatgtgggcattttggagagcaagctgaagaaaatccaggaagccgcatcaggcaatttacagctgctaatctgcgtcatggagcggaggcaccggggctacgctgatctgaagcgtattgcagaaacatccattggtgtcttgacacagtgttgcctgtattccaacctaagcaagctgagctttcagttcttggccaacttagcactgaagataaatgcgaaggttggtggaagcaacgttgccctctacaacagcttgccatgccaaattcctagggtgttttcagacaaggagccagtgatgttcatgggtgctgacgtgacacacccacatcccctagatgactcaagcccgtccgtggtcgctgtagttgcgagcatgaattggccttcagcaaacaagtacatctccaggatgagatcacagacgcaccgtaaagagatcatcgagcgccttgatgtaatgaccggtgaactgctcgaggagtttgtgaaagaagtcggcaagctccctagcagaatcatattcttcagagatggtgttagtgagacgctgttctacaaggtgttgacagaggagctgcaggcagtgcgactggcatgctcgaggtacccgggctacaagccagcgatcacgttcgtggtggttcagaagaggcagcacaccaggctcttccacagggagaagaatggcggctccacgcactacgccgaccagaacgtaccaccgggaacggtggtggacaccgtgatcacgcacccaagggagtttgatttctacctgtgcagtcactggggcaccaaggggacgagcaggccgacgcactaccgcgtgctgtgggatgagaacaacttcaagtctgacgagatgcagcagctgatacacaacctttgctacacgtttgcccggtgcaccaagcctgtttctctcgtcccaccggcatactacgcacacctggccgcatatagaggaaggctataccttgagagatcggactcgacggcgaccagccggacaactctgtacagggccacgccattgcagactgcaccgctccctaagctcagagatagtgtgaaggggctcatgttctactgctga

SEQ ID NO: 15357 - protein, 1128 aa, Sorghum bicolor
  misc_feature: Useful for making plants with modulated biomass
  misc_feature: Functional homolog of the protein sequence given in SEQ ID NO 14175
  misc_feature: The sequence is a functional homolog of SEQ ID NO 188 in the 10/666,642 US patent application
  misc_feature: Ceres ANNOT ID no. 8640529
  misc_feature: Down-regulated in shoot tissues in response to salicylic acid treatment
  misc_feature (783)..(1091): Pfam ID: Piwi Pfam Description: Piwi domain
  misc_feature (495)..(627): Pfam ID: PAZ Pfam Description: PAZ domain
MAQRQQARRGERGDSMDGTVQGRGRGSHPLPSSARPTLPPQLPPFCPPTFQPSKKPPQSQRPRRATPKGTQEAVILLPRKKLRSSTKYEQIGRLAMEGEAAVAKNERKVGGGGGGVSNDGGANARRRCKGGGPGRHHPIIQAYPALLPLPLHAAAHARRSGAVALPLPLPPPVLVYLHQPPPPLLFPKVPACYGKPSGPPLLRGPPWRSRKPPPPPHAVTAALLPLPHDTELIQHRKCFIHENQTSEMKANHLSTHHNSSITMHGVNIATRPDGGGIGGTAIPLYANHFLVCFDPGQKIFHYDVDISPHPSKETARMIKNKLVEENSDILSGALPAFDGRKNLFSPIQFQQDRLEFFVSLPAAASTRFIEAKDNAHMIDKQNHKVFRVNLRLVSKLSGEELNKYLNEDKDGIPLPQEYLHALDVILREGAMENSIPMGRSLYPRSMGEAKEIGGGAVMLRGFFQSLRPTKQGLALNVDLSLTAFHENTGIIAYLQKRCDFMKDLSQVKSRALTVDERREVEKALKNIRVFVCHRETDQRYHVHGLTEETTENLKFRDRSGKDYTVVDYFKEHYNHDIKFRNLPCLQIGKSKPCYVPMELCMVCEGQKFLGKLSDEQTSKMLRMGCQRPSERKGIIKGVVEGAFGTRSNSYADQFNLQVSKDMTQLLGRVLLPPKLKLGNGGRIKDITPDRFDRQWSLMDSHVAEGSKIKSWALISFGGSPEHQSFIPKFINQLSSRCEQLGILLNKKTVVSPLFERIQILNNVGILESKLKKIQEAASGNLQLLICVMERRHRGYADLKRIAETSIGVLTQCCLYSNLSKLSFQFLANLALKINAKVGGSNVALYNSLPCQIPRVFSDKEPVMFMGADVTHPHPLDDSSPSVVAVVASMNWPSANKYISRMRSQTHRKEIIERLDVMTGELLEEFVKEVGKLPSRIIFFRDGVSETLFYKVLTEELQAVRLACSRYPGYKPAITFVVVQKRQHTRLFHREKNGGSTHYADQNVPPGTVVDTVITHPREFDFYLCSHWGTKGTSRPTHYRVLWDENNFKSDEMQQLIHNLCYTFARCTKPVSLVPPAYYAHLAAYRGRLYLERSDSTATSRTTLYRATPLQTAPLPKLRDSVKGLMFYC

SEQ ID NO: 15358 - DNA, 540 bp, Sorghum bicolor
  misc_feature: Ceres ANNOT ID no. 8640565
  misc_feature: Down-regulated in shoot tissues in response to salicylic acid treatment
  misc_feature: Encodes the peptide sequence at SEQ ID NO 15359
atggcggcgtttccgaagcatagtagtagcctagcggctgccttcttcgctgtgtccatggccatagccgcaatcaccaccaccgccttggcgcagaacacgccgcaggacttcgtggacctgcacaaccgcgcgcgcgcggcggacggcgtgggtccggtggcgtgggacgccacggtggccaagtacgcgcgggactacgccgcgaagcgcgccggcgactgcaagctccagcactccggcgggcccttcggggagaacatcttctggggctcggcggggcgggcgtggggcgccgccgacgcggtcaagtcgtgggtggacgagaagaagcactaccacctgagcagcaacagctgcgacccgggcaaggtgtgcgggcactacacgcaggtggtgtggcgcaagtccacccgcctcggctgcgcgcgcgtcgtctgcgccgccaaccgcggcgtcttcgtcgtctgcagctacgaccctcccggcaacttcaacggcgagcgcccgttcctcactcttgacgccgctgccaagtaa

SEQ ID NO: 15359 - protein, 179 aa, Sorghum bicolor
  misc_feature: Useful for making plants with modulated biotic stress sensitivity
  misc_feature: Functional homolog of the protein sequence given in SEQ ID NO 13804
  misc_feature: Ceres ANNOT ID no. 8640565
  misc_feature (39)..(159): Pfam ID: SCP Pfam Description: SCP-like extracellular protein
MAAFPKHSSSLAAAFFAVSMAIAAITTTALAQNTPQDFVDLHNRARAADGVGPVAWDATVAKYARDYAAKRAGDCKLQHSGGPFGENIFWGSAGRAWGAADAVKSWVDEKKHYHLSSNSCDPGKVCGHYTQVVWRKSTRLGCARVVCAANRGVFVVCSYDPPGNFNGERPFLTLDAAAK

SEQ ID NO: 15360 - DNA, 1341 bp, Sorghum bicolor
  misc_feature: Ceres ANNOT ID no. 8640603
  misc_feature: Encodes the peptide sequence at SEQ ID NO 15361
atggggctccgcgactcctccgtgctgctggccgctctgtccctcgcgctcgcctactgctccgtttcagtggtggcctacgatcccctggaccctcggggcaacatcacgataaagtgggacgtgatctcatggacgcccgacgggtacgtggcgatggtgacgatgagcaactaccagatgtaccggcacatcatgtccccgggctggacggtgggctggtcgtgggcgaagaaggaggtgatctggtccatcgtcggcgcgcaggccacggagcagggcgactgctccaagttcaaaggcggcatccctcactgctgcaagcgcacccccgccgtggtcgacctcctccccggggtgccctacaaccagcagatcgccaactgctgcaaggccggcgtcgtgtcggcgtacggccaggaccaggccggctccgtctccgcgttccaggtctccgtcggcctcgccggcaccaccaacaagacggtcaagctccccaagaacttcaccctcatgggtccggggccagggtacacctgcgggccggcgaccgtcgtcccgtccaccgtgtactggacgcccgaccaccggcgacggacgcaggcgctcatgacctggaccgtcacctgcacctactcgcagcagctggcgtccaagtacccgtcctgctgcgtctccttctcctccttctacaacgacaccatcgtgccctgcgccaagtgcgcctgcggctgcggccatggcggccacgccggaccgggaggctgcatcgagggggactccaagcgcgcgctgtcgccgggagtgaacacgccgcggaaggacgggcaggcgctgctgcagtgcacgccgcacatgtgccctgtccgtgtgcactggcatgtcaagctcaactacaaggactactggcgcgccaagatcgccatcaccaacttcaactacaggatgaactacacgcagtggacgctggtggcgcagcacccaaacctggacaatgtcaccgaggtcttcagcttccagtacaagccgctgctaccatacggcagcatcaatgacactggcatgttctacgggctcaagttctacaacgattttctgatggaggccgggccgttcgggaacgtgcagtcggaggtgctcatgcgcaaggacgccaggacattcaccttcagccagggatgggccttcccgcgcaagatctacttcaacggcgacgagtgcaagatgccgccgccggactcgtacccgtacctgcccaacgccgcgcccgtcgccgcctcgcagctggtcgtgtccgccgccgcctcagcgttcctactggcgctgctcctggtggcatga

SEQ ID NO: 15361 - protein, 446 aa, Sorghum bicolor
  misc_feature: Useful for making plants with altered carbohydrate content
  misc_feature: Functional homolog of the protein sequence given in SEQ ID NO 14176
  misc_feature: Useful for making plants with altered cell wall content and/or composition
  misc_feature: Functional homolog of the protein sequence given in SEQ ID NO 14021
  misc_feature: The sequence is a functional homolog of SEQ ID NO 4 in US patent 7109001
  misc_feature: Useful for making plants with altered lignin content
  misc_feature: Functional homolog of the protein sequence given in SEQ ID NO 13349
  misc_feature: Ceres ANNOT ID no. 8640603
  misc_feature (50)..(214): Pfam ID: Phytochel_synth Pfam Description: Phytochelatin synthetase-like conserved region
MGLRDSSVLLAALSLALAYCSVSVVAYDPLDPRGNITIKWDVISWTPDGYVAMVTMSNYQMYRHIMSPGWTVGWSWAKKEVIWSIVGAQATEQGDCSKFKGGIPHCCKRTPAVVDLLPGVPYNQQIANCCKAGVVSAYGQDQAGSVSAFQVSVGLAGTTNKTVKLPKNFTLMGPGPGYTCGPATVVPSTVYWTPDHRRRTQALMTWTVTCTYSQQLASKYPSCCVSFSSFYNDTIVPCAKCACGCGHGGHAGPGGCIEGDSKRALSPGVNTPRKDGQALLQCTPHMCPVRVHWHVKLNYKDYWRAKIAITNFNYRMNYTQWTLVAQHPNLDNVTEVFSFQYKPLLPYGSINDTGMFYGLKFYNDFLMEAGPFGNVQSEVLMRKDARTFTFSQGWAFPRKIYFNGDECKMPPPDSYPYLPNAAPVAASQLVVSAAASAFLLALLLVA

SEQ ID NO: 15362 - DNA, 1380 bp, Sorghum bicolor
  misc_feature: Ceres ANNOT ID no. 8640602
  misc_feature: Encodes the peptide sequence at SEQ ID NO 15363
atggcgaggctgcgactcctactgctccggcatctggctgccgccgctgctctgctcgccggcttctcttctctgccacctttggcagaagcatatgatcctcttgatccaaatgggaatatcacaataaaatgggatatcattcagtggacttcagatggttatgttgctgttgtttccatatacaattaccataaataccgacatatccaagcacccgggtggaaccttggatgggtgtgggcaaagaaggagatcatctggaccatagttggcgggcagaccacagagcaaggggattgctctcagttcaaaggcagtataccacactgctgcaagagggatccagcagttgttgacttgcttcctgggacaccttacaacatgcaggatgcaaattgttgcaaaggaggagtgcttaactcatgggttcaagacccagtcagtgcagtggcatcgtttcagatcagtgtcggccgatctggtactaccaactacacagtgaaagcgccactaaacttcactctgaaggccccaggaccaggatacagttgtggagtagctcatgtggtgaagcctcctacgaagttcatttcccaggacggaaggagaaccactcaagctcatgtgacatggaacgtgacatgtacatattcccaatttgttgctcagcgggctccaacttgttgtgtttcactctcatcattttacaatgaaaccatagttaactgcccaaaatgttcatgtggctgtcagaataccagaccgggaagttgtgttgagggtgattcaccttatttggcttctgtcgtgaatggaccgggcaagagcagcatgactcctctagttcagtgcacgccccatatgtgcccgataagagtgcattggcatgttaagctcaactacagggaatactggagggtgaagatcacggttacaaactggaattaccggatgaattactcacaatggaacttggtagttcagcacccaaatttcgacaaagttaccactattttcagcttcaactacaagcctctgaacccctatggagtaataaatgatactggaatgctgtggggtatcaagtactacaatgacctgctcatggtggctgggccagatggaaatgtgcaatctgagcttctgttccggaaggacccgtcgacattcactttcgagaaaggctgggcgttcccaaggcggatatacttcaatggcgacagctgtgtcatgcctccaccagatgcgtacccatggctaccaaactcttcccctgtactcctactgaagagctcatccctcgttctgcccatcgtgatttggacggcgatgctgttcttacggcttggtatgtactcaatccatcccaaattgtaa

SEQ ID NO: 15363 - protein, 459 aa, Sorghum bicolor
  misc_feature: Useful for making plants with altered carbohydrate content
  misc_feature: Functional homolog of the protein sequence given in SEQ ID NO 13944
  misc_feature: Useful for making plants with altered cell wall content and/or composition
  misc_feature: Useful for making plants with altered lignin content
  misc_feature: Functional homolog of the protein sequence given in SEQ ID NO 13349
  misc_feature: The sequence is a functional homolog of SEQ ID NO 4 in US patent 7109001
  misc_feature: Ceres ANNOT ID no. 8640602
  misc_feature (55)..(220): Pfam ID: Phytochel_synth Pfam Description: Phytochelatin synthetase-like conserved region
MARLRLLLLRHLAAAAALLAGFSSLPPLAEAYDPLDPNGNITIKWDIIQWTSDGYVAVVSIYNYHKYRHIQAPGWNLGWVWAKKEIIWTIVGGQTTEQGDCSQFKGSIPHCCKRDPAVVDLLPGTPYNMQDANCCKGGVLNSWVQDPVSAVASFQISVGRSGTTNYTVKAPLNFTLKAPGPGYSCGVAHVVKPPTKFISQDGRRTTQAHVTWNVTCTYSQFVAQRAPTCCVSLSSFYNETIVNCPKCSCGCQNTRPGSCVEGDSPYLASVVNGPGKSSMTPLVQCTPHMCPIRVHWHVKLNYREYWRVKITVTNWNYRMNYSQWNLVVQHPNFDKVTTIFSFNYKPLNPYGVINDTGMLWGIKYYNDLLMVAGPDGNVQSELLFRKDPSTFTFEKGWAFPRRIYFNGDSCVMPPPDAYPWLPNSSPVLLLKSSSLVLPIVIWTAMLFLRLGMYSIHPKL

SEQ ID NO: 15364 - DNA, 678 bp, Sorghum bicolor
  misc_feature: Ceres ANNOT ID no. 8640628
  misc_feature: Encodes the peptide sequence at SEQ ID NO 15365
atgccggactcggacaacgactccggcgggccgagcaacgcgggcggagagctgtcgtcgccgcgggagcaggacaggttcctgccgatcgccaacgtgagccggatcatgaagaaggcgctgccggccaacgccaagatcagcaaggacgccaaggagacggtgcaggagtgcgtctccgagttcatctccttcatcacgggggaggcctccgacaagtgccagcgcgagaagcgcaagaccatcaacggcgacgacctgctctgggccatgaccacgctcggcttcgaggactacgtcgacccgctcaagcactacctccacaagttccgcgagatcgagggcgagagggccgccgcgtccgccggcgcctcgggctccaacaccgccgttcagcaccagcagcagggcgatgtggtgcagagaggcgccgccaatgccggcgggtacgccgggtacggcggcgcgcccggcgccgccggcatgatgatgatgatggggcagcccatgtacggctcgccgcagcagcagcagccgccgccgccgccgccgtcacagcagcagcagcagcagcatcacatggcaatgggaggcagagggggtttcggccatcaaggcggtggcggcggcggcggctcctcgtcgtcgtcagggcttggccggcaagacagagcgtga

SEQ ID NO: 15365 - protein, 225 aa, Sorghum bicolor
  misc_feature: The sequence is a functional homolog of SEQ ID NO 2151 in the 10/666,642 US patent application
  misc_feature: The sequence is a functional homolog of SEQ ID NO 364 in the 11/435,388 US patent application
  misc_feature: The sequence is a functional homolog of SEQ ID NO 366 in the 10/714,887 US patent application
  misc_feature: The sequence is a functional homolog of SEQ ID NO 48 in the 10/675,852 US patent application
  misc_feature: The sequence is a functional homolog of SEQ ID NO 804 in the 10/374,780 US patent application
  misc_feature: The sequence is a functional homolog of SEQ ID NO 2141 in the 10/666,642 US patent application
  misc_feature: The sequence is a functional homolog of SEQ ID NO 336 in the 11/435,388 US patent application
  misc_feature: The sequence is a functional homolog of SEQ ID NO 338 in the 10/714,887 US patent application
  misc_feature: The sequence is a functional homolog of SEQ ID NO 794 in the 10/374,780 US patent application
  misc_feature: The sequence is a functional homolog of SEQ ID NO 92 in the 10/675,852 US patent application
  misc_feature: The sequence is a functional homolog of SEQ ID NO 62 in the 10/675,852 US patent application
  misc_feature: The sequence is a functional homolog of SEQ ID NO 2153 in the 10/666,642 US patent application
  misc_feature: The sequence is a functional homolog of SEQ ID NO 366 in the 11/435,388 US patent application
  misc_feature: The sequence is a functional homolog of SEQ ID NO 368 in the 10/714,887 US patent application
  misc_feature: The sequence is a functional homolog of SEQ ID NO 50 in the 10/675,852 US patent application
  misc_feature: The sequence is a functional homolog of SEQ ID NO 805 in the 10/374,780 US patent application
  misc_feature: The sequence is a functional homolog of SEQ ID NO 2143 in the 10/666,642 US patent application
  misc_feature: The sequence is a functional homolog of SEQ ID NO 338 in the 11/435,388 US patent application
  misc_feature: The sequence is a functional homolog of SEQ ID NO 340 in the 10/714,887 US patent application
  misc_feature: The sequence is a functional homolog of SEQ ID NO 76 in the 10/675,852 US patent application
  misc_feature: The sequence is a functional homolog of SEQ ID NO 796 in the 10/374,780 US patent application
  misc_feature: The sequence is a functional homolog of SEQ ID NO 1164 in the 10/412,699 US patent application
  misc_feature: The sequence is a functional homolog of SEQ ID NO 29 in the 10/675,852 US patent application
  misc_feature: The sequence is a functional homolog of SEQ ID NO 780 in the 10/374,780 US patent application
  misc_feature: The sequence is a functional homolog of SEQ ID NO 807 in the 10/666,642 US patent application
  misc_feature: The sequence is a functional homolog of SEQ ID NO 20 in the 10/675,852 US patent application
  misc_feature: The sequence is a functional homolog of SEQ ID NO 2181 in the 10/666,642 US patent application
  misc_feature: The sequence is a functional homolog of SEQ ID NO 404 in the 11/435,388 US patent application
  misc_feature: The sequence is a functional homolog of SEQ ID NO 406 in the 10/714,887 US patent application
  misc_feature: The sequence is a functional homolog of SEQ ID NO 800 in the 10/374,780 US patent application
  misc_feature: The sequence is a functional homolog of SEQ ID NO 18 in the 10/675,852 US patent application
  misc_feature: The sequence is a functional homolog of SEQ ID NO 2183 in the 10/666,642 US patent application
  misc_feature: The sequence is a functional homolog of SEQ ID NO 406 in the 11/435,388 US patent application
  misc_feature: The sequence is a functional homolog of SEQ ID NO 408 in the 10/714,887 US patent application
  misc_feature: The sequence is a functional homolog of SEQ ID NO 798 in the 10/374,780 US patent application
  misc_feature: The sequence is a functional homolog of SEQ ID NO 2187 in the 10/666,642 US patent application
  misc_feature: The sequence is a functional homolog of SEQ ID NO 410 in the 11/435,388 US patent application
  misc_feature: The sequence is a functional homolog of SEQ ID NO 412 in the 10/714,887 US patent application
  misc_feature: The sequence is a functional homolog of SEQ ID NO 86 in the 10/675,852 US patent application
  misc_feature: The sequence is a functional homolog of SEQ ID NO 16 in the 10/675,852 US patent application
  misc_feature: The sequence is a functional homolog of SEQ ID NO 2179 in the 10/666,642 US patent application
  misc_feature: The sequence is a functional homolog of SEQ ID NO 402 in the 11/435,388 US patent application
  misc_feature: The sequence is a functional homolog of SEQ ID NO 404 in the 10/714,887 US patent application
  misc_feature: The sequence is a functional homolog of SEQ ID NO 797 in the 10/374,780 US patent application
  misc_feature: The sequence is a functional homolog of SEQ ID NO 82 in the 10/675,852 US patent application
  misc_feature: The sequence is a functional homolog of SEQ ID NO 106 in the 10/666,642 US patent application
  misc_feature: The sequence is a functional homolog of SEQ ID NO 1784 in the 10/412,699 US patent application
  misc_feature: The sequence is a functional homolog of SEQ ID NO 2010 in the 10/374,780 US patent application
  misc_feature: The sequence is a functional homolog of SEQ ID NO 292 in the 11/435,388 US patent application
  misc_feature: The sequence is a functional homolog of SEQ ID NO 294 in the 10/714,887 US patent application
  misc_feature: The sequence is a functional homolog of SEQ ID NO 6 in the 10/675,852 US patent application
  misc_feature: The sequence is a functional homolog of SEQ ID NO 719 in the 11/479,226 US patent application
  misc_feature: The sequence is a functional homolog of SEQ ID NO 134 in the 10/225,068 US patent application
  misc_feature: The sequence is a functional homolog of SEQ ID NO 1398 in the 10/666,642 US patent application
  misc_feature: The sequence is a functional homolog of SEQ ID NO 14 in the 10/286,264 US patent application
  misc_feature: The sequence is a functional homolog of SEQ ID NO 290 in the 11/435,388 US patent application
  misc_feature: The sequence is a functional homolog of SEQ ID NO 292 in the 10/714,887 US patent application
  misc_feature: The sequence is a functional homolog of SEQ ID NO 306 in the 10/412,699 US patent application
  misc_feature: The sequence is a functional homolog of SEQ ID NO 4 in the 10/675,852 US patent application
  misc_feature: The sequence is a functional homolog of SEQ ID NO 708 in the 11/479,226 US patent application
  misc_feature: The sequence is a functional homolog of SEQ ID NO 90 in the 10/374,780 US patent application
  misc_feature: The sequence is a functional homolog of SEQ ID NO 22 in the 10/675,852 US patent application
  misc_feature: The sequence is a functional homolog of SEQ ID NO 2175 in the 10/666,642 US patent application
  misc_feature: The sequence is a functional homolog of SEQ ID NO 398 in the 11/435,388 US patent application
  misc_feature: The sequence is a functional homolog of SEQ ID NO 400 in the 10/714,887 US patent application
  misc_feature: The sequence is a functional homolog of SEQ ID NO 80 in the 10/675,852 US patent application
  misc_feature: The sequence is a functional homolog of SEQ ID NO 801 in the 10/374,780 US patent application
  misc_feature: The sequence is a functional homolog of SEQ ID NO 66 in the 10/675,852 US patent application
  misc_feature: The sequence is a functional homolog of SEQ ID NO 2177 in the 10/666,642 US patent application
  misc_feature: The sequence is a functional homolog of SEQ ID NO 400 in the 11/435,388 US patent application
  misc_feature: The sequence is a functional homolog of SEQ ID NO 402 in the 10/714,887 US patent application
  misc_feature: The sequence is a functional homolog of SEQ ID NO 52 in the 10/675,852 US patent application
  misc_feature: The sequence is a functional homolog of SEQ ID NO 799 in the 10/374,780 US patent application
  misc_feature: The sequence is a functional homolog of SEQ ID NO 46 in the 10/675,852 US patent application
  misc_feature: The sequence is a functional homolog of SEQ ID NO 56 in the 10/675,852 US patent application
  misc_feature: The sequence is a functional homolog of SEQ ID NO 785 in the 10/374,780 US patent application
  misc_feature: The sequence is a functional homolog of SEQ ID NO 786 in the 10/374,780 US patent application
  misc_feature: Useful for making plants with modulated biomass
  misc_feature: Functional homolog of the protein sequence given in SEQ ID NO 13228
  misc_feature: The sequence is a functional homolog of SEQ ID NO 791 in the 10/374,780 US patent application
  misc_feature: The sequence is a functional homolog of SEQ ID NO 64 in the 10/675,852 US patent application
  misc_feature: The sequence is a functional homolog of SEQ ID NO 12 in the 10/675,852 US patent application
  misc_feature: The sequence is a functional homolog of SEQ ID NO 38 in the 10/675,852 US patent application
  misc_feature: The sequence is a functional homolog of SEQ ID NO 34 in the 10/675,852 US patent application
  misc_feature: The sequence is a functional homolog of SEQ ID NO 807 in the 10/374,780 US patent application
  misc_feature: The sequence is a functional homolog of SEQ ID NO 44 in the 10/675,852 US patent application
  misc_feature: The sequence is a functional homolog of SEQ ID NO 60 in the 10/675,852 US patent application
  misc_feature: The sequence is a functional homolog of SEQ ID NO 14 in the 10/675,852 US patent application
  misc_feature: The sequence is a functional homolog of SEQ ID NO 1166 in the 10/412,699 US patent application
  misc_feature: The sequence is a functional homolog of SEQ ID NO 31 in the 10/675,852 US patent application
  misc_feature: The sequence is a functional homolog of SEQ ID NO 782 in the 10/374,780 US patent application
  misc_feature: The sequence is a functional homolog of SEQ ID NO 809 in the 10/666,642 US patent application
  misc_feature: The sequence is a functional homolog of SEQ ID NO 2137 in the 10/666,642 US patent application
  misc_feature: The sequence is a functional homolog of SEQ ID NO 332 in the 11/435,388 US patent application
  misc_feature: The sequence is a functional homolog of SEQ ID NO 334 in the 10/714,887 US patent application
  misc_feature: The sequence is a functional homolog of SEQ ID NO 54 in the 10/675,852 US patent application
  misc_feature: The sequence is a functional homolog of SEQ ID NO 74 in the 10/675,852 US patent application
  misc_feature: The sequence is a functional homolog of SEQ ID NO 790 in the 10/374,780 US patent application
  misc_feature: The sequence is a functional homolog of SEQ ID NO 787 in the 10/374,780 US patent application
  misc_feature: The sequence is a functional homolog of SEQ ID NO 1168 in the 10/412,699 US patent application
  misc_feature: The sequence is a functional homolog of SEQ ID NO 32 in the 10/675,852 US patent application
  misc_feature: The sequence is a functional homolog of SEQ ID NO 784 in the 10/374,780 US patent application
  misc_feature: The sequence is a functional homolog of SEQ ID NO 811 in the 10/666,642 US patent application
  misc_feature: The sequence is a functional homolog of SEQ ID NO 2135 in the 10/666,642 US patent application
  misc_feature: The sequence is a functional homolog of SEQ ID NO 28 in the 10/675,852 US patent application
  misc_feature: The sequence is a functional homolog of SEQ ID NO 330 in the 11/435,388 US patent application
  misc_feature: The sequence is a functional homolog of SEQ ID NO 332 in the 10/714,887 US patent application
  misc_feature: The sequence is a functional homolog of SEQ ID NO 792 in the 10/374,780 US patent application
  misc_feature: The sequence is a functional homolog of SEQ ID NO 88 in the 10/675,852 US patent application
  misc_feature: The sequence is a functional homolog of SEQ ID NO 2171 in the 10/666,642 US patent application
  misc_feature: The sequence is a functional homolog of SEQ ID NO 2173 in the 10/666,642 US patent application
  misc_feature: The sequence is a functional homolog of SEQ ID NO 2185 in the 10/666,642 US patent application
  misc_feature: The sequence is a functional homolog of SEQ ID NO 24 in the 10/675,852 US patent application
  misc_feature: The sequence is a functional homolog of SEQ ID NO 394 in the 11/435,388 US patent application
  misc_feature: The sequence is a functional homolog of SEQ ID NO 396 in the 10/714,887 US patent application
  misc_feature: The sequence is a functional homolog of SEQ ID NO 396 in the 11/435,388 US patent application
  misc_feature: The sequence is a functional homolog of SEQ ID NO 398 in the 10/714,887 US patent application
  misc_feature: The sequence is a functional homolog of SEQ ID NO 408 in the 11/435,388 US patent application
  misc_feature: The sequence is a functional homolog of SEQ ID NO 410 in the 10/714,887 US patent application
  misc_feature: The sequence is a functional homolog of SEQ ID NO 84 in the 10/675,852 US patent application
  misc_feature: The sequence is a functional homolog of SEQ ID NO 42 in the 10/675,852 US patent application
  misc_feature: The sequence is a functional homolog of SEQ ID NO 36 in the 10/675,852 US patent application
  misc_feature: The sequence is a functional homolog of SEQ ID NO 2149 in the 10/666,642 US patent application
  misc_feature: The sequence is a functional homolog of SEQ ID NO 362 in the 11/435,388 US patent application
  misc_feature: The sequence is a functional homolog of SEQ ID NO 364 in the 10/714,887 US patent application
  misc_feature: The sequence is a functional homolog of SEQ ID NO 40 in the 10/675,852 US patent application
  misc_feature: The sequence is a functional homolog of SEQ ID NO 58 in the 10/675,852 US patent application
  misc_feature: The sequence is a functional homolog of SEQ ID NO 78 in the 10/675,852 US patent application
  misc_feature: The sequence is a functional homolog of SEQ ID NO 806 in the 10/374,780 US patent application
  misc_feature: The sequence is a functional homolog of SEQ ID NO 310 in the 11/435,388 US patent application
  misc_feature: The sequence is a functional homolog of SEQ ID NO 312 in the 10/714,887 US patent application
  misc_feature: The sequence is a functional homolog of SEQ ID NO 72 in the 10/675,852 US patent application
  misc_feature: Useful for making plants with modulated drought sensitivity
  misc_feature: Functional homolog of the protein sequence given in SEQ ID NO 13743
  misc_feature: Useful for making plants with altered alkaloid content
  misc_feature: Useful for making plants with altered terpenoid content
  misc_feature: Functional homolog of the protein sequence given in SEQ ID NO 13247
  misc_feature: The sequence is a functional homolog of SEQ ID NO 26 in the 10/675,852 US patent application
  misc_feature: The sequence is a functional homolog of SEQ ID NO 802 in the 10/374,780 US patent application
  misc_feature: The sequence is a functional homolog of SEQ ID NO 308 in the 11/435,388 US patent application
  misc_feature: The sequence is a functional homolog of SEQ ID NO 310 in the 10/714,887 US patent application
  misc_feature: The sequence is a functional homolog of SEQ ID NO 418 in the 11/435,388 US patent application
  misc_feature: The sequence is a functional homolog of SEQ ID NO 420 in the 10/714,887 US patent application
  misc_feature: The sequence is a functional homolog of SEQ ID NO 803 in the 10/374,780 US patent application
  misc_feature: The sequence is a functional homolog of SEQ ID NO 1440 in the 10/666,642 US patent application
  misc_feature: The sequence is a functional homolog of SEQ ID NO 1856 in the 10/412,699 US patent application
  misc_feature: The sequence is a functional homolog of SEQ ID NO 2102 in the 10/374,780 US patent application
  misc_feature: The sequence is a functional homolog of SEQ ID NO 290 in the 10/225,066 US patent application
  misc_feature: The sequence is a functional homolog of SEQ ID NO 8 in the 10/675,852 US patent application
  misc_feature: The sequence is a functional homolog of SEQ ID NO 416 in the 11/435,388 US patent application
  misc_feature: The sequence is a functional homolog of SEQ ID NO 418 in the 10/714,887 US patent application
  misc_feature: The sequence is a functional homolog of SEQ ID NO 789 in the 10/374,780 US patent application
  misc_feature: The sequence is a functional homolog of SEQ ID NO 2139 in the 10/666,642 US patent application
  misc_feature: The sequence is a functional homolog of SEQ ID NO 334 in the 11/435,388 US patent application
  misc_feature: The sequence is a functional homolog of SEQ ID NO 336 in the 10/714,887 US patent application
  misc_feature: The sequence is a functional homolog of SEQ ID NO 90 in the 10/675,852 US patent application
  misc_feature: The sequence is a functional homolog of SEQ ID NO 306 in the 11/435,388 US patent application
  misc_feature: The sequence is a functional homolog of SEQ ID NO 308 in the 10/714,887 US patent application
  misc_feature: The sequence is a functional homolog of SEQ ID NO 70 in the 10/675,852 US patent application
  misc_feature: The sequence is a functional homolog of SEQ ID NO 134 in US patent 7294759
  misc_feature: The sequence is a functional homolog of SEQ ID NO 2 in US patent 7220894
  misc_feature: The sequence is a functional homolog of SEQ ID NO 793 in the 10/374,780 US patent application
  misc_feature: The sequence is a functional homolog of SEQ ID NO 1167 in the 10/412,699 US patent application
  misc_feature: The sequence is a functional homolog of SEQ ID NO 783 in the 10/374,780 US patent application
  misc_feature: The sequence is a functional homolog of SEQ ID NO 810 in the 10/666,642 US patent application
  misc_feature: The sequence is a functional homolog of SEQ ID NO 294 in the 11/435,388 US patent application
  misc_feature: The sequence is a functional homolog of SEQ ID NO 296 in the 10/714,887 US patent application
  misc_feature: The sequence is a functional homolog of SEQ ID NO 308 in the 10/412,699 US patent application
  misc_feature: The sequence is a functional homolog of SEQ ID NO 723 in the 11/479,226 US patent application
  misc_feature: The sequence is a functional homolog of SEQ ID NO 788 in the 10/374,780 US patent application
  misc_feature: The sequence is a functional homolog of SEQ ID NO 414 in the 11/435,388 US patent application
  misc_feature: The sequence is a functional homolog of SEQ ID NO 416 in the 10/714,887 US patent application
  misc_feature: Ceres ANNOT ID no. 8640628
  misc_feature (22)..(117): SWISSPROT Homolog: EC 2.7.7.7 DNA-directed DNA polymerase
  misc_feature (26)..(91): Pfam ID: CBFD_NFYB_HMF Pfam Description: Histone-like transcription factor (CBF/NF-Y) and archaeal histone
MPDSDNDSGGPSNAGGELSSPREQDRFLPIANVSRIMKKALPANAKISKDAKETVQECVSEFISFITGEASDKCQREKRKTINGDDLLWAMTTLGFEDYVDPLKHYLHKFREIEGERAAASAGASGSNTAVQHQQQGDVVQRGAANAGGYAGYGGAPGAAGMMMMMGQPMYGSPQQQQPPPPPPSQQQQQQHHMAMGGRGGFGHQGGGGGGGSSSSSGLGRQDRA

SEQ ID NO: 15366 - DNA, 933 bp, Sorghum bicolor
  misc_feature: Ceres ANNOT ID no. 8640652
  misc_feature: Encodes the peptide sequence at SEQ ID NO 15367
atggatggtgatccattccatcccatgcccaactatgatttcctgtctgggaatggctattcattaaagcagttagttcgtagcaactctgatatagactcttcatcatccaaatctgagcagtctcggcaagacttatctgacagtagtctcaatggacaacgcacaccaacacaatctggtttgttctccctctcagataacaacgatatttgtggaaagcgggaccagggcatggtgaagtctttgttgtcctttggtagcccggaagctgccttttcccctcacaagtttgactacagccagtctttcgcttgtgcttcttatactgctgatccatatcacggtggggtgttggcaggatacacttcaaatggaagtgttcatccccaaattaatggtgcagcaaacactagggtaccattgcctgttgggcctgcagcagaggaacccatatttgtcaatgcaaagcaatacaatgctatcctccggaggaggcaaatacgcgcaaaattggaggctcaaaataaactggtgaaaggtcggaagccatatctccatgaatctcggcatcgtcatgcaatgaagcgagtccgcggaccaggaggccgtttcctcaacaaaaaggagctccaggagcagcagcagcagcagcagaaggctctgccttcacttcagactccaacaggcagagtcagcatcagcaaaatggccttcggcagggacctgtgcactgaaagcagcacatctcactcgccttcgacaagctctgggatctcaagtgtttcaaacgggagtggcatgctggctcatcaagagcacatcagctttgcatctgctaacttcctccccagcatgaacttccgcgtggagaacggaggtgaaaagatggctgtcaatggcgtccgccaccacacccctgtcgtgaggtga

SEQ ID NO: 15367 - protein, 310 aa, Sorghum bicolor
  misc_feature: The sequence is a functional homolog of SEQ ID NO 2852 in the 10/374,780 US patent application
  misc_feature: The sequence is a functional homolog of SEQ ID NO 696 in the 10/225,066 US patent application
  misc_feature: Ceres ANNOT ID no. 8640652
  misc_feature (149)..(205): Pfam ID: CBFB_NFYA Pfam Description: CCAAT-binding transcription factor (CBF-B/NF-YA) subunit B
MDGDPFHPMPNYDFLSGNGYSLKQLVRSNSDIDSSSSKSEQSRQDLSDSSLNGQRTPTQSGLFSLSDNNDICGKRDQGMVKSLLSFGSPEAAFSPHKFDYSQSFACASYTADPYHGGVLAGYTSNGSVHPQINGAANTRVPLPVGPAAEEPIFVNAKQYNAILRRRQIRAKLEAQNKLVKGRKPYLHESRHRHAMKRVRGPGGRFLNKKELQEQQQQQQKALPSLQTPTGRVSISKMAFGRDLCTESSTSHSPSTSSGISSVSNGSGMLAHQEHISFASANFLPSMNFRVENGGEKMAVNGVRHHTPVVR

SEQ ID NO: 15368 - DNA, 1077 bp, Sorghum bicolor
  misc_feature: Ceres ANNOT ID no. 8640646
  misc_feature: Encodes the peptide sequence at SEQ ID NO 15369
atggcccgcgccaccaacgcccactaccacctccacctcctcctcctcctctgcctctccctcgcggccgccgcgtgggcgcacggcggaggaggcggggacggggacggggactccgacgacgccgacgccgacgcccccaggccggacctgcgggcgcgggggctggtggaggcgaagctgtggtgcctggcggtggtgttcgcggggacgctgctgggcggggtgtccccctacttcctccgctggaacgaggcgttcctcgcgctgggcacgcagttcgcgggcggcgtcttcctcggcaccgcgctcatgcacttcctcagcgacgccgacgagacgttcggggacctgctccccgacagcggctacccctgggcgttcatgctcgcctgcgccggctacgtcgtcaccatgttcgccgacgtcgccatctcctacgtcgtctcacggagccgcaccgccggcagttcttccggctccgctgctgcagggctggaggagggcaagatgggagccacaaatggcacaatctctgatcccacaccacctgagacgcatggatctgatcactcggccgcgtccatgctgcgcaacgccagcaccctcggtgacagcgtgctgctcatagtcgccctctgcttccactccgtcttcgagggcatcgccatcggggtcgccgagaccaaggctgacgcatggaaggcgctgtggaccatcagcctgcacaagatcttcgcggccatcgccatgggcatcgcgctgctccggatgctccccaaccggcccctcctctcctgcttcgcctacgccttcgcgttcgccatctccagccccatcggcgtcggcatcggcatcgtcatcgacgccaccacgcagggccgggtggccgactggatcttcgccgtctccatgggcctcgccacgggcgtcttcgtctacgtctccatcagccacctcctctccaaagggtacaagccccggaggcctgtcgccgtcgacacgcccgtcgggaggtggctcgccgtcgtgctcggcgtggctgtcatcgccgtcgtcatgatatgggacacctga

SEQ ID NO: 15369 - protein, 358 aa, Sorghum bicolor
  misc_feature: Useful for making plants with altered lignin content
  misc_feature: Functional homolog of the protein sequence given in SEQ ID NO 14177
  misc_feature: Ceres ANNOT ID no. 8640646
  misc_feature (57)..(354): Pfam ID: Zip Pfam Description: ZIP Zinc transporter
MARATNAHYHLHLLLLLCLSLAAAAWAHGGGGGDGDGDSDDADADAPRPDLRARGLVEAKLWCLAVVFAGTLLGGVSPYFLRWNEAFLALGTQFAGGVFLGTALMHFLSDADETFGDLLPDSGYPWAFMLACAGYVVTMFADVAISYVVSRSRTAGSSSGSAAAGLEEGKMGATNGTISDPTPPETHGSDHSAASMLRNASTLGDSVLLIVALCFHSVFEGIAIGVAETKADAWKALWTISLHKIFAAIAMGIALLRMLPNRPLLSCFAYAFAFAISSPIGVGIGIVIDATTQGRVADWIFAVSMGLATGVFVYVSISHLLSKGYKPRRPVAVDTPVGRWLAVVLGVAVIAVVMIWDT

SEQ ID NO: 15370 - DNA, 1446 bp, Sorghum bicolor
  misc_feature: Ceres ANNOT ID no. 8640671
  misc_feature: Encodes the peptide sequence at SEQ ID NO 15371
atggcgaggtcgtcgtccaagaagaagtcgcagcagctgaagcagaagccggtgtcagcgtggcagttcctcttccgcggctgcctcggcggcgccgcggcggggagcaggcgaaacaaggtccagccacgcagcacgacgccgcaggggcgggcgccgtccccggccccgtcgtcgttcccgtccccgtcgccggcgacgacgacggggctgcagcaccagcgcctgtctctgacggacgtgatgagcgtggcttccgaccaggacctgtcggtgtcgctggtggggtcgaacctgcaggtattcaccgtcggggagctcaagacggcgacgcaggggttcgtggacagcaacttcctcggcgagggggggttcggcccggtctaccgcggcgccgtcgccgagggcgccaagccggggctccgcgcgcagcagatcgccgtcaagctgtgggaccccgagggcacgcagggacacaaggagtggctgtccgaggtcatcttcctcggccagctccgccaccggaacctcgtcaagctcgtcgggtactgcagcgaggaggagcaccggttgctggtgtatgagtacatgcccaaagggagcctcgagaaccacctcttcaagaagttcccgcccgtgctgtcgtgggcaacgcgtctcaacatcgcggtgggcgccgccaggggcctcgcgttccttcacaaccacgagaaacccgtcatctaccgcgacttcaagacttccaacatcttgctcgacccggactacgaggcgaagctctcggacttcgggctagccaaggacgggccagaaggggacgacacccacgtgtcgacgcgggtgatgggcacgcacgggtacgcggcgccggagtacatcctgacgggccacctgacggcgaagagcgacgtgtacagcttcggcgtggtgctgctggagatcctctccggccgccgcgccgtcgacaaggcccgccccagccgggagcagcacctggtggagcacatgcgcgggtggctcaaggacccgcacaggctcgccagggtcatggacccggcgctcgagggcaagtaccccgccgcggcggcgcacagggcggcgatggtcgcgtaccagtgcctcagcggtagccccaagaaccgaccggacatgtcccgcgtcgtgcaggacctggagccgctgctcacggccaccgacgacgacgtgcccgcggcggcgtgcgtggacgaggcggcgaggaaggagaggacgacacggagaagcgacggcggcggcggcgaccggagagagagagacaaggcgcggcggcacgagaaagcggcggcggcggcgcccaggtcgccgaacccgaagagggccgttaggaggcgggcgccgggacagagcgaggagttctgggagtggcacatgcctactgcggccggagctggacagggaaaagcgtag

SEQ ID NO: 15371 - protein, 481 aa, Sorghum bicolor
  misc_feature: Useful for making plants with modulated drought sensitivity
  misc_feature: Functional homolog of the protein sequence given in SEQ ID NO 14078
  misc_feature: Useful for making plants with modulated heat sensitivity
  misc_feature: Functional homolog of the protein sequence given in SEQ ID NO 14079
  misc_feature: Ceres ANNOT ID no. 8640671
  misc_feature (94)..(399): SWISSPROT Homolog: EC 2.7.11.1 Non-specific serine/threonine protein kinase
  misc_feature (114)..(391): Pfam ID: Pkinase Pfam Description: Protein kinase domain
MARSSSKKKSQQLKQKPVSAWQFLFRGCLGGAAAGSRRNKVQPRSTTPQGRAPSPAPSSFPSPSPATTTGLQHQRLSLTDVMSVASDQDLSVSLVGSNLQVFTVGELKTATQGFVDSNFLGEGGFGPVYRGAVAEGAKPGLRAQQIAVKLWDPEGTQGHKEWLSEVIFLGQLRHRNLVKLVGYCSEEEHRLLVYEYMPKGSLENHLFKKFPPVLSWATRLNIAVGAARGLAFLHNHEKPVIYRDFKTSNILLDPDYEAKLSDFGLAKDGPEGDDTHVSTRVMGTHGYAAPEYILTGHLTAKSDVYSFGVVLLEILSGRRAVDKARPSREQHLVEHMRGWLKDPHRLARVMDPALEGKYPAAAAHRAAMVAYQCLSGSPKNRPDMSRVVQDLEPLLTATDDDVPAAACVDEAARKERTTRRSDGGGGDRRERDKARRHEKAAAAAPRSPNPKRAVRRRAPGQSEEFWEWHMPTAAGAGQGKA

SEQ ID NO: 15372 - DNA, 708 bp, Sorghum bicolor
  misc_feature: Ceres ANNOT ID no. 8640778
  misc_feature: Encodes the peptide sequence at SEQ ID NO 15373
atggggtcaacggcggaggacgtggcggcggtggcggacgaggaggcgtgcatgtacgcgatgcagctggcgtcgtcgtcgatcctccccatgacgctgaagaacgcgctggagctgggcctgctggaggtgctgcagaaggacgccggcaaggcgctggcggcagaggaggtggtggcgcagctacccgtggcgccgaccaaccccggcgcggcggacatggtggaccggatgctccgcctcctcgcctcctacgacgtcgtcaagtgccagatggaggacaaggacgggaggcggagcgccaggtcgggaggttgggttctgtggatgcggcgccccggccgcggccacggccgcagggaactcggggagtgtggagaggcggcggaggccgagcccaagccggcacaggacggcagcgaacggagaggcggcggaggccgagcccaagccggcacaggacggcggctgacagatgcgggagcgctccagatgcggcgtcatgtcggggaggtagctgccgctcgccggcgctcccgtgactatttaagggcaaaaaggatatttttctacacaggacccacgtatcagacgctccagatgcggcgtcatgtcggggaggtagctgccgctcgccggcgctcccgtgactatttaagggcaaaaaggatatttttctacacaggacccacgtatcagacatgttaa

SEQ ID NO: 15373 - protein, 235 aa, Sorghum bicolor
  misc_feature: Useful for making plants with altered carbohydrate content
  misc_feature: Functional homolog of the protein sequence given in SEQ ID NO 14135
  misc_feature: Ceres ANNOT ID no. 8640778
  misc_feature (1)..(102): SWISSPROT Homolog: EC 2.1.1.68 Caffeate O-methyltransferase
  misc_feature (31)..(83): Pfam ID: Dimerisation Pfam Description: Dimerisation domain
MGSTAEDVAAVADEEACMYAMQLASSSILPMTLKNALELGLLEVLQKDAGKALAAEEVVAQLPVAPTNPGAADMVDRMLRLLASYDVVKCQMEDKDGRRSARSGGWVLWMRRPGRGHGRRELGECGEAAEAEPKPAQDGSERRGGGGRAQAGTGRRLTDAGALQMRRHVGEVAAARRRSRDYLRAKRIFFYTGPTYQTLQMRRHVGEVAAARRRSRDYLRAKRIFFYTGPTYQTC

SEQ ID NO: 15374 - DNA, 1188 bp, Sorghum bicolor
  misc_feature: Ceres ANNOT ID no. 8640811
  misc_feature: Encodes the peptide sequence at SEQ ID NO 15375
atggcgacctactactcttcgcggcgtccatgcaacgcctgcagcacgaaggcgatggccgggagcgtggtcggcgagcccgtcgtgctggggcagagggtgacggtgctgacggtggacggcggcggcatccgtggtctcatccccggaaccatccttgccttcctcgaggcccggctgcaggagctggacgggccggaggttaggctcgcggactacttcgactacatcgccgggacgagcaccggcgggctcatcaccgccatgctcaccgcgcccggcaaggacaggcggcctctctacgctgccaaggacatcaaccaattctacatggagaattgccctcgcatcttccctcaaaagagcagcaggcttgcggccgccatgtccgcgctgaggaagccaaggtacaacggcaagtgcctccgtaacctgatcatgagcatgctcggcgagacgagggccaagagcatgcctctgaagaacgcgctgctctccgacgtgtgcatcggcacgtccgccgcgccgacctacctcccggcgcactacttccagaccaaggacgccggcagtggcaaggaacgcgagtacaacctcatcgacggcgatcaccaagaagatgcttgccagcaaggagaaggccgaggagctgtacccagtgaagccgtggaactgccgcaagttcctggtgctgtccatcgggacggggtcgacgtcggagcagggcctgtacacggcgcggcagtgctcgcggtggggcatctgccggtggatccggaacaacggcatggcccccatcatcgacatcttcatggcggcgagctcggacctggtggacatccacgtcgccgcgatgttccagtcgctccacagacaactcgctgcacggcgccgcggccaccgtggacgcggcgacgccggagaacatgcggacgctcgtcgggatcggggagcggatgctggcgcagcgggtgtccagggtcaacgtggagacagggaggtacgaaccggtgcctggggaaggaagcaacgctgatgcgctcgctgggatcgcaaggcagctctcggaggagaggaggacaaggctcgcgcgccgcacctccgccatcgtcagctccggtggtgcctctagacgtacgtgtgcctcaaaggtctccaatgtctaagagaagtgaatttgttgcctga

SEQ ID NO: 15375 - protein, 395 aa, Sorghum bicolor
  misc_feature: Useful for making plants with modulated heat sensitivity
  misc_feature: Functional homolog of the protein sequence given in SEQ ID NO 13256
  misc_feature: Ceres ANNOT ID no. 8640811
  misc_feature (37)..(209): Pfam ID: Patatin Pfam Description: Patatin-like phospholipase
MATYYSSRRPCNACSTKAMAGSVVGEPVVLGQRVTVLTVDGGGIRGLIPGTILAFLEARLQELDGPEVRLADYFDYIAGTSTGGLITAMLTAPGKDRRPLYAAKDINQFYMENCPRIFPQKSSRLAAAMSALRKPRYNGKCLRNLIMSMLGETRAKSMPLKNALLSDVCIGTSAAPTYLPAHYFQTKDAGSGKEREYNLIDGDHQEDACQQGEGRGAVPSEAVELPQVPGAVHRDGVDVGAGPVHGAAVLAVGHLPVDPEQRHGPHHRHLHGGELGPGGHPRRRDVPVAPQTTRCTAPRPPWTRRRRRTCGRSSGSGSGCWRSGCPGSTWRQGGTNRCLGKEATLMRSLGSQGSSRRRGGQGSRAAPPPSSAPVVPLDVRVPQRSPMSKRSEFVA

SEQ ID NO: 15376 - DNA, 1083 bp, Sorghum bicolor
  misc_feature: Ceres ANNOT ID no. 8640854
  misc_feature: Encodes the peptide sequence at SEQ ID NO 15377
atgaacatgggcggcaggaccccggcggcggcgacgacgacgatccggtgcaagtactgcagcgcgtgcctcaccgtgtgccccggcgagcgcgccgtccagtgcacgcaatgctgcggcgtcacgcgcatccggcggtccttgtcctcgcggatcccgctgccgccggcgatgacgaggccggcggcgcccatgggcgccttcccgtgctcccgcggcaagaagcgcgccgtcctgatcggcatctcgtacgccagcgtgcgccggggctgcggccagctgaggggacccatcaacgacgtcaagtgcatgaggcagctcctctgccagcgcttcgccttccccagcgactccatcatcatgctcactgatgagcagaaggacccgttgaggctgccgaccaaggacaacatccggatggcgatgcgatggctggtgcaggggtgcagcagcggcgactccctggtgttccatttctccgggcgaggctcgcaggtcgccgacgaggactgcgacgagctggacgggtacgacgaggccatctgcccgctggactcgttcgacaagggccccatcctggacgacgagatcaacgagaccatcgtccgcccgctggtgtacggcgccaagctccacgccgtcgtcgacgcctgccacagcgccaccgtcctcgacctccccttcctctgcaacatgtccaggaccgggaactggcagtgggaggatcaccgtcccccgtcgggcgtctgcaagggcaccagcggcggccaggcggtgctcatcagcggctacagcgacggcaaaaccaagttcagcgtgacgccggaggcctgcgcgacggtgggggccatgacgcacagcttcctcaaggcggtggagtgcgagcagcagggggtcacctacggccgcctgctcacctccatgaaagccttcatgaccaacgccggcggctgcaaccagctgcagggtcctatctgcgcgggcgtgcccgcccgcaaggtcgccaacttcagcggcgtgcaggaacctaacctgtcctgctcggagatgttcgacgtctatcgcaagccctttgcgctgtaa

SEQ ID NO: 15377 - protein, 360 aa, Sorghum bicolor
  misc_feature: The sequence is a functional homolog of SEQ ID NO 1888 in the 10/412,699 US patent application
  misc_feature: Ceres ANNOT ID no. 8640854
  misc_feature (75)..(356): Pfam ID: Peptidase_C14 Pfam Description: Caspase domain
MNMGGRTPAAATTTIRCKYCSACLTVCPGERAVQCTQCCGVTRIRRSLSSRIPLPPAMTRPAAPMGAFPCSRGKKRAVLIGISYASVRRGCGQLRGPINDVKCMRQLLCQRFAFPSDSIIMLTDEQKDPLRLPTKDNIRMAMRWLVQGCSSGDSLVFHFSGRGSQVADEDCDELDGYDEAICPLDSFDKGPILDDEINETIVRPLVYGAKLHAVVDACHSATVLDLPFLCNMSRTGNWQWEDHRPPSGVCKGTSGGQAVLISGYSDGKTKFSVTPEACATVGAMTHSFLKAVECEQQGVTYGRLLTSMKAFMTNAGGCNQLQGPICAGVPARKVANFSGVQEPNLSCSEMFDVYRKPFAL

SEQ ID NO: 15378 - DNA, 2736 bp, Sorghum bicolor
  misc_feature: Ceres ANNOT ID no. 8640856
  misc_feature: Encodes the peptide sequence at SEQ ID NO 15379
atggccacaactggagaaagaaaaaggatgggaagactgtcaaagaagctcatgagaaacttaaacattgatgtactccattgctactatgcccatggagaggagaatgaaaactttcaaaggcgaacatattggctgttggaagaggatttcactcatattgttcttgtacattacctagaagtcaagggatgcaagcaaagtttcaatcgtgtgaaagaagaatttatgcaattatccaatgtcgatagtccttcatgttcaaattctatcactagtcagaaccagatgggcccacaaaacatggaggctgatgaaagcccaataagtggacagatttcagaatatgaagacactgaatcaggttatcatggtgaaatgctgccaataacagataacttagatagccgttcattttctcaccatgacatagctagaatgcttgatggtgccaacattgggctaagtgatgtttccagcactccgtttgattcagtgccattcaacgagcccttcacaaattattcagctggattcagagagccaacactccattcttcatttgcctgcttagaggctaacaatctggatgatagctcttgtttgcagacatttacatctgaggctctatacactaaccacctcagccagaaggaagctgatgcactgggtttcactggcatattaacatcagaggtgaacggagatagatataatgatgatagcatcaaacatccactcttgaagcagtcatcattagatctattgacgattgagactcctggtttgaagaaacatgacagcttttcaagatggatgagtaaagaacttgaagaggtggttgatttgggtattaaatccacttctgatgctttctggagtagcattgagacagtgaaggtgcctgatggttctaatgtgctgagtaatgaacagctgggtgcttatgtagtgagcccttcactttctcaagatcaactattcagcattctcgatgtttcaccaagttgtgcatatattggtacaaatacaaaggtttcggttactggtacattcttggtgaataaggaacatgtggaaaatcagaagtggtcatgtatgtttggggatgttgaagtaccagctgaggttttgactgatggcaccctacgctgctatgcaccagcacatcaatcaggaagagtcccattttatgtgacctgttcaaacagggtggcttgtagtgaagtgcgagaatttgagtatcgtgattctgatgctcagtacatggagacttctcgttcccaagccaatggtgtaaatgaaatgcatctacatattcgtcttgagaagctactcactttggggccagatgaccatcatatgcttgctataagcagtggtaatgagaaatatgagatagtgaatgctataaatgccttaatgcttgatgggaaatggtcaaatcaagaatcttctgtcaaggaagtagtttccactgctaggggccaaagtataaagaaactggtgaaagagaagctgcatcaatggctcatctgcaaagtaaatgatgatggaaagggacccaatgttctgtgcaaggaaggacagggtgtaattcatttagtagcagcactggattatgattgggctataagaccaataatggttgctggtgtaaatgtgaacttccgggatgctcatggatggactgcactccactgggctgcatctttgggaagagagcggacagttagtgttctcatagcaaatggagccgctgcaggagcactgactgatccaacttctgagttcccttctggaagaagtccagccgatttagcttcagtaaatggacacaaggggattgctggttttctcgcagaatctgctttgacaagccatctgtcagcacttactattagagaatcaaatgatagcactgtagaagtgtgtgggttaccagttgctgaagatctcactggcactgattctgcccagctcgctggagagggtcctcatgctgaatcacttgaaggttctttaagtgctgttcgaaaatccactcaagctgcagctcgtatatttcaagccttccgagtggagtcattccacagaaagaaagtcgtggaatacggagacgacgactgtggattatctgatgaacgcacgctttcacttgtgtctcttaaaaatgtcaaaccaggacaacatgatacacatctgcattctgctgctgttcgtatacagaacaagtttcgtggatggaagggaagaaaggagtttatgatcattcgccagagaattgtcaagttacaggctcatgtacgaggacatcaagtgaggaagaactatcggaaggtagtctggtcagttggtatcgtcgagaaagtcatactgagatggaggagaaagaggcctgggttacgcaattttcagcctcagaaacaactagaaggtccatcacaaatccagcctgcgaaggctgaggatgaatacgatttcttgcacgacggcaggaggcaggccgaagccaggcttcagagagcacttgcccgggtgcactctatgtcacagtatccagaagcaagggagcagtaccacaggctcacaacctgcgttgctgaaatgaaacagtccaggatgatgcaggatgagatgctaagtgaggcggctggtggtggtgtggacgatttcatggctggactggaggacctgatctgcattgatgatgccgcgatgtctgccatttggtga

SEQ ID NO: 15379 - protein, 911 aa, Sorghum bicolor
  misc_feature: The sequence is a functional homolog of SEQ ID NO 1309 in the 10/666,642 US patent application
  misc_feature: Ceres ANNOT ID no. 8640856
  misc_feature: Up-regulated in root tissues in response to methyl jasmonate treatment
  misc_feature: Up-regulated in shoot tissues in response to methyl jasmonate treatment
  misc_feature: Up-regulated in shoot tissues in response to salicylic acid treatment
  misc_feature (759)..(779): Pfam ID: IQ Pfam Description: IQ calmodulin-binding motif
  misc_feature (1)..(63): Pfam ID: CG-1 Pfam Description: CG-1 domain
  misc_feature (561)..(593): Pfam ID: Ank Pfam Description: Ankyrin repeat
  misc_feature (329)..(415): Pfam ID: TIG Pfam Description: IPT/TIG domain
MATTGERKRMGRLSKKLMRNLNIDVLHCYYAHGEENENFQRRTYWLLEEDFTHIVLVHYLEVKGCKQSFNRVKEEFMQLSNVDSPSCSNSITSQNQMGPQNMEADESPISGQISEYEDTESGYHGEMLPITDNLDSRSFSHHDIARMLDGANIGLSDVSSTPFDSVPFNEPFTNYSAGFREPTLHSSFACLEANNLDDSSCLQTFTSEALYTNHLSQKEADALGFTGILTSEVNGDRYNDDSIKHPLLKQSSLDLLTIETPGLKKHDSFSRWMSKELEEVVDLGIKSTSDAFWSSIETVKVPDGSNVLSNEQLGAYVVSPSLSQDQLFSILDVSPSCAYIGTNTKVSVTGTFLVNKEHVENQKWSCMFGDVEVPAEVLTDGTLRCYAPAHQSGRVPFYVTCSNRVACSEVREFEYRDSDAQYMETSRSQANGVNEMHLHIRLEKLLTLGPDDHHMLAISSGNEKYEIVNAINALMLDGKWSNQESSVKEVVSTARGQSIKKLVKEKLHQWLICKVNDDGKGPNVLCKEGQGVIHLVAALDYDWAIRPIMVAGVNVNFRDAHGWTALHWAASLGRERTVSVLIANGAAAGALTDPTSEFPSGRSPADLASVNGHKGIAGFLAESALTSHLSALTIRESNDSTVEVCGLPVAEDLTGTDSAQLAGEGPHAESLEGSLSAVRKSTQAAARIFQAFRVESFHRKKVVEYGDDDCGLSDERTLSLVSLKNVKPGQHDTHLHSAAVRIQNKFRGWKGRKEFMIIRQRIVKLQAHVRGHQVRKNYRKVVWSVGIVEKVILRWRRKRPGLRNFQPQKQLEGPSQIQPAKAEDEYDFLHDGRRQAEARLQRALARVHSMSQYPEAREQYHRLTTCVAEMKQSRMMQDEMLSEAAGGGVDDFMAGLEDLICIDDAAMSAIW

SEQ ID NO: 15380 - DNA, 1164 bp, Sorghum bicolor
  misc_feature: Ceres ANNOT ID no. 8640850
  misc_feature: Up-regulated in root tissues in response to methyl jasmonate treatment
  misc_feature: Up-regulated in shoot tissues in response to methyl jasmonate treatment
  misc_feature: Up-regulated in shoot tissues in response to salicylic acid treatment
  misc_feature: Encodes the peptide sequence at SEQ ID NO 15381
atggcgagcgggaactggaaggcggcggcgacgtcgtggtgcggccactgcggcatgggcctcgcggcggcggcgcctcagcccgggcccggcggctctagcgtccggtgcgcgttctgccacggggtgacgcgtatcgagcatcaccagcaccagcgcggcggcggccgcgtgggcgagagcgccacgacgacgacgaggacgctcgcggcggaagcctcgctgccgcggccgccgccgccgccggtctccgcggggctcctcgagatcccggcgagctaccccaggagggtgagcggaggcggcgggagcaagcgggcgctcctggtcggggtcagctacacgggcaccaagcatgagctccggggcaccgtcaacgacgtcaaggagatgaggagcctcctctgcgacaggttcgggttcccgagcgcctgcatcctggaactcaccgagaaggagagtgacctcacgagggtgccgacgagggagaacctgctgcgggcgatgcggtggctggtggacggcgccagcgccggggactcgctggtgttccacttctccggccacggcgtgcagaagctggacatgaacgacgacgaggtggacgggtacaacgaggcgctgtgccccatggacttcgagcggagcggcaagatcctggacgacgagatcaacgccaccatcgtgcggccgctggggaagggcgtgaagctgcacgccatcgtggacacctgccacagcggcaccatcctcgacctcccctacctctgccgcatgtccagaactgggtactggcagtgggagaatcactcccggccttcgggcatgttggcgaagcgcaccaacggaggcctggccatctccatcagcggctgcagcgacgaccagaagtccgccgacgccagcggattttctgacgagtcgtcttcgatcggcgccatgacggacagcttcatcaaggccgtgaaggccgagccggggacgacgtacgggcggctgctgagcgcgatgaggacgaggatccgcgacggccaggggagccgccgcctccccggcaggctcggctccttcgtccgctggatgatcccgtccagcggcgtgcaggagcctcagctgtgctcttcggagatgtttgacatctacaggaagccattcctgctctga

SEQ ID NO: 15381 - protein, 387 aa, Sorghum bicolor
  misc_feature: The sequence is a functional homolog of SEQ ID NO 110 in the 11/479,226 US patent application
  misc_feature: The sequence is a functional homolog of SEQ ID NO 1289 in the 11/479,226 US patent application
  misc_feature: The sequence is a functional homolog of SEQ ID NO 180 in the 10/374,780 US patent application
  misc_feature: The sequence is a functional homolog of SEQ ID NO 234 in the 10/225,068 US patent application
  misc_feature: The sequence is a functional homolog of SEQ ID NO 596 in the 10/412,699 US patent application
  misc_feature: The sequence is a functional homolog of SEQ ID NO 1715 in the 11/479,226 US patent application
  misc_feature: The sequence is a functional homolog of SEQ ID NO 1854 in the 10/412,699 US patent application
  misc_feature: The sequence is a functional homolog of SEQ ID NO 2098 in the 10/374,780 US patent application
  misc_feature: The sequence is a functional homolog of SEQ ID NO 1888 in the 10/412,699 US patent application
  misc_feature: Ceres ANNOT ID no. 8640850
  misc_feature (105)..(382): Pfam ID: Peptidase_C14 Pfam Description: Caspase domain
MASGNWKAAATSWCGHCGMGLAAAAPQPGPGGSSVRCAFCHGVTRIEHHQHQRGGGRVGESATTTTRTLAAEASLPRPPPPPVSAGLLEIPASYPRRVSGGGGSKRALLVGVSYTGTKHELRGTVNDVKEMRSLLCDRFGFPSACILELTEKESDLTRVPTRENLLRAMRWLVDGASAGDSLVFHFSGHGVQKLDMNDDEVDGYNEALCPMDFERSGKILDDEINATIVRPLGKGVKLHAIVDTCHSGTILDLPYLCRMSRTGYWQWENHSRPSGMLAKRTNGGLAISISGCSDDQKSADASGFSDESSSIGAMTDSFIKAVKAEPGTTYGRLLSAMRTRIRDGQGSRRLPGRLGSFVRWMIPSSGVQEPQLCSSEMFDIYRKPFLL

SEQ ID NO: 15382 - DNA, 1035 bp, Sorghum bicolor
  misc_feature: Ceres ANNOT ID no. 8640844
  misc_feature: Encodes the peptide sequence at SEQ ID NO 15383
atggagcggtacgaggtgattagggacatcgggtcgggcaacttcggggtggccaagctcgtccgggacgtcaccaccaaggagctcttcgccgtcaagttcatcgagagagggcagaagattgatgaacatgttcagagggagattatgaaccaccggtccctgaagcacccaaacataattagattcaaggaggtcgtgctaactcccacacatttggcaatagttatggaatatgctgctgggggtgaactatttgaaaggatttgtaatgcggggagattcagtgagaatgaggcaaggttcttcttccaacaactgatttcgggagtgagctattgtcattccatgcaagtatgtcatagagacctgaaactagaaaacactctcttagatggtagtgttgcacctcggctcaagatctgcgatttcggttactccaagtcttctgttcttcactctcaaccaaaatcaactgttggcacacctgcatatattgctcccgaggtcctctctagaaaagagtatgatggaaaggttgctgatgtttggtcttgcggagtcacactatatgtgatgcttgtcggcgcatatccttttgaagaccctgatgacccaaagaacttccgcaagacgatcactagaatactcagcgtacagtactcaattccagactatgttcgtgtttcaacggagtgcagacatctgctgtctcggatatttgttggaaatcctgagcagagaataaccattcctgagatcaagaaccacccgtggttcctcaagaacctgcccgtggagatgaccgacgagtaccagcagagcatgcagcagctggcagacatgaacaccccggggcagagcctggaggaggtcatggcgatcatccaggaggcgcagaagccaggggacgccgtgagcctcgccgggcagctgccctcctgcctggggagcatggaccttgatgacattgatttggacgatatcgatgacattgacatcgagaacagcggcgacttcgtttgtgcggtgtga

SEQ ID NO: 15383 - protein, 344 aa, Sorghum bicolor
  misc_feature: Useful for making plants with modulated water use efficiency
  misc_feature: Functional homolog of the protein sequence given in SEQ ID NO 14094
  misc_feature: Useful for making plants with modulated biomass
  misc_feature: Functional homolog of the protein sequence given in SEQ ID NO 14178
  misc_feature: Useful for biocontainment applications
  misc_feature: Useful for making plants with modulated time to senescence
  misc_feature: Functional homolog of the protein sequence given in SEQ ID NO 14093
  misc_feature: Ceres ANNOT ID no. 8640844
  misc_feature (1)..(344): SWISSPROT Homolog: EC 2.7.11.1 Non-specific serine/threonine protein kinase
  misc_feature (4)..(260): Pfam ID: Pkinase Pfam Description: Protein kinase domain
MERYEVIRDIGSGNFGVAKLVRDVTTKELFAVKFIERGQKIDEHVQREIMNHRSLKHPNIIRFKEVVLTPTHLAIVMEYAAGGELFERICNAGRFSENEARFFFQQLISGVSYCHSMQVCHRDLKLENTLLDGSVAPRLKICDFGYSKSSVLHSQPKSTVGTPAYIAPEVLSRKEYDGKVADVWSCGVTLYVMLVGAYPFEDPDDPKNFRKTITRILSVQYSIPDYVRVSTECRHLLSRIFVGNPEQRITIPEIKNHPWFLKNLPVEMTDEYQQSMQQLADMNTPGQSLEEVMAIIQEAQKPGDAVSLAGQLPSCLGSMDLDDIDLDDIDDIDIENSGDFVCAV

SEQ ID NO: 15384 - DNA, 1629 bp, Sorghum bicolor
  misc_feature: Ceres ANNOT ID no. 8640884
  misc_feature: Encodes the peptide sequence at SEQ ID NO 15385
atgacgaagcacggcgtggtgctcgaggacgtcgcggcggcgcggcatttctcgttcccgccgccgaggacgacgacgccgacggcgggcggcggcgactcgttcaggaagcttgccgcgcaggtggacctcggcgccgccgtcgtgggctcctggctcgactccatgaaggcctcgtcgcccaggcacaggctcatggcgcccctgcctggcgccgccgacgcggagcacgacgactggatggagcgacacccgtcggcattggaccggttcgacgcgctggcggcggcggctaaagggaagcaggtggcggtgttcctggactacgacggcacgctgtctccgatcgtggaggaccccgaccgcgccgtcatgaccgacgagatgagggaggcggtgcgcggcgtggcggcgcgcttcccgacagcgatcgtcagcgggcggtgccgggacaaggtgttcagcttcgtgcggctggcggagctctactacgccggcagccacgggatggacatccgagggcccaccgccgaccccaaccaccacggcaaggcggcggattcgtcgtcgtcggtgctgtgccagccggcgagcgagttcctgccggtgatggaggaggtgtacgcggcgctggtgtcgcgggtggagccgtccatcccgggcgccaaggtggagaacaacaagttctgcctgtcggtgcacttccggtgcgtggaggaggcggcctgggcgccgctcttcgagctggtccgcgccgtgctcagggactacccgggcctgcgcctcacgcagggccgcaaggtgctcgaggtccgccccatgatccgctgggacaagggcaaggcgctcgagttcctcctcaccgccctcggcttcgccgacgccgacaaagacgacgtcttccccatctacgtcggcgacgaccgcaccgacgaggacgcgttccgggtgctgcgcgcgcgcgggcagggcgccgggatcctcgtgtccaggttccccaaggagacctccgcgtccttcacgctccgcgaccccgccgaggtcaaggacttcctccgcaagctcgtcgtcgtcaacgccgacgccgacaccaacaacagcagcagacaggcgcagcatcacgcgagacgagagcattcacgtacggtacggggaggagaggagaggagaggatggggatggggatggggatgggacggggcgcgtcgtactagtagcccgctacagagaagaaagcgaggtggtcctcggctatgccgcggtggcgtgacccggcgtccttgccggcgtagtggccacgcacgccggcgaaaaaggcgggcgcccggtcggtcggtcggtcggccggccggcggcccggccgcgcgactaaaagcgtcagggacgagcagcgagcgcgactgcatgcaggaaattaggccacggccggcggcgcatgcctctttttggggtgttgcttcgacctgctttccttgctgcgtctgcgtgtacgcgatccagacggatatgataccccaagtgttgcgacacatcagtgatacgcagacagtccagttcgattcatgtccaaaagaaacatttggaaaaggtgatggatacgtggtactgttgtctagctttggttggtga

SEQ ID NO: 15385 - protein, 542 aa, Sorghum bicolor
  misc_feature: Useful for making plants with modulated drought sensitivity
  misc_feature: Functional homolog of the protein sequence given in SEQ ID NO 13424
  misc_feature: Useful for making plants with modulated flowering time
  misc_feature: Useful for making plants with modulated low light sensitivity
  misc_feature: Functional homolog of the protein sequence given in SEQ ID NO 13725
  misc_feature: Useful for making plants with modulated water use efficiency
  misc_feature: Functional homolog of the protein sequence given in SEQ ID NO 13348
  misc_feature: The sequence is a functional homolog of SEQ ID NO 16 in US patent 7214858
  misc_feature: Ceres ANNOT ID no. 8640884
  misc_feature (203)..(369): SWISSPROT Homolog: EC 3.1.3.12 Trehalose-phosphatase
  misc_feature (106)..(346): Pfam ID: Trehalose_PPase Pfam Description: Trehalose-phosphatase
MTKHGVVLEDVAAARHFSFPPPRTTTPTAGGGDSFRKLAAQVDLGAAVVGSWLDSMKASSPRHRLMAPLPGAADAEHDDWMERHPSALDRFDALAAAAKGKQVAVFLDYDGTLSPIVEDPDRAVMTDEMREAVRGVAARFPTAIVSGRCRDKVFSFVRLAELYYAGSHGMDIRGPTADPNHHGKAADSSSSVLCQPASEFLPVMEEVYAALVSRVEPSIPGAKVENNKFCLSVHFRCVEEAAWAPLFELVRAVLRDYPGLRLTQGRKVLEVRPMIRWDKGKALEFLLTALGFADADKDDVFPIYVGDDRTDEDAFRVLRARGQGAGILVSRFPKETSASFTLRDPAEVKDFLRKLVVVNADADTNNSSRQAQHHARREHSRTVRGGEERRGWGWGWGWDGARRTSSPLQRRKRGGPRLCRGGVTRRPCRRSGHARRRKRRAPGRSVGRPAGGPAARLKASGTSSERDCMQEIRPRPAAHASFWGVASTCFPCCVCVYAIQTDMIPQVLRHISDTQTVQFDSCPKETFGKGDGYVVLLSSFGW

SEQ ID NO: 15386 - DNA, 1116 bp, Sorghum bicolor
  misc_feature: Ceres ANNOT ID no. 8640923
  misc_feature: Encodes the peptide sequence at SEQ ID NO 15387
atggccggaggaggagcgaagagagtcctgctgctgtgcctgtgcgtggccgtcgtgttggtggcggtcggcagtggcggcgcggaggcgaggaagcgaggcaagcagtcgctggggttctacgagctgcggcggggcgagttctccatgatcgtcaccaactggggcgccaccatcctcgccgtcaggcttcccgacaagaacgggcacatcgacgacgtcgttcttggctacaaggacatcggatcctacgtgaacgacacgacctacttcggcgcgctggtggggcgggtggcgaaccggatcgccggcgggcggttcaccatcaaggaccggccctaccacacgtaccagaacgacggcaacaacacgctgcacggcggccaccgcgggttcaaccaggtgttctggtcggtccgggagcgcgtcacgggggagtttccccacatcaccttcgcctaccggagctacgacggcgagcaggggttcccggggaacctggacgtgctggtcacctacaagatcgacggcgactactcgtacagcgtcaccatgtacgcgcggccggtggacaagccgacgcccatcaacctggcgcagcacacgtactggaacctccgcggccacggccacggcgacgtcctgcggcacgccgtccagatcttcgcgagcgcggtgacgcccgtgggcggggacctcatcccgacgggcgccgtcacccccgtcgccggcacgcccttcgacttccgcgccccggcggcgcccggcgcgcgcatcgcgcaggtcgagggcggcgtcgggtacgacatcaactacgtgctggacggcgagacggacgggcagggcgtgcgcaaggtggccgtcgtcagcgaggacgagtccggccgcgtcatggagctgtgggggaaccagccgggcctgcagttctacacgggcaacttcctcgacggcgaccagggaaaggacggcgccgtctacgccaagtacggcgggatgtgcctggagacgcaggactacccggacgccgtgcacgagccgggcttcccggcagaggtctaccgccctggacaggtctacaagcactacatgctctacaagttctccatcaacaagtag

SEQ ID NO: 15387 - protein, 371 aa, Sorghum bicolor
  misc_feature: Useful for making plants with altered oil content
  misc_feature: Functional homolog of the protein sequence given in SEQ ID NO 13360
  misc_feature: Ceres ANNOT ID no. 8640923
  misc_feature (41)..(369): SWISSPROT Homolog: EC 5.1.3.3 Aldose 1-epimerase
  misc_feature (39)..(366): Pfam ID: Aldose_epim Pfam Description: Aldose 1-epimerase
MAGGGAKRVLLLCLCVAVVLVAVGSGGAEARKRGKQSLGFYELRRGEFSMIVTNWGATILAVRLPDKNGHIDDVVLGYKDIGSYVNDTTYFGALVGRVANRIAGGRFTIKDRPYHTYQNDGNNTLHGGHRGFNQVFWSVRERVTGEFPHITFAYRSYDGEQGFPGNLDVLVTYKIDGDYSYSVTMYARPVDKPTPINLAQHTYWNLRGHGHGDVLRHAVQIFASAVTPVGGDLIPTGAVTPVAGTPFDFRAPAAPGARIAQVEGGVGYDINYVLDGETDGQGVRKVAVVSEDESGRVMELWGNQPGLQFYTGNFLDGDQGKDGAVYAKYGGMCLETQDYPDAVHEPGFPAEVYRPGQVYKHYMLYKFSINK

SEQ ID NO: 15388 - DNA, 306 bp, Sorghum bicolor
  misc_feature: Ceres ANNOT ID no. 8640918
  misc_feature: Encodes the peptide sequence at SEQ ID NO 15389
atgagcaactccttctgccccgactgcaagaagcagacggaggtggcgttcgaccactcggcgggggcgcactccgtcgacgagacctccgaatggcgcaccctggccaacgagtccaacgacaacgaccccgtccgtgtcggcggccccaccaacccgctcctcaccgatggcggcctctccaacgtcatcgccaagcccaacggcgcgcagggcgagttcctctcctcctccctcggcaggtggcagaaccgcggctccaaccccaaccgatccctcatcctcgccttccgcaccatcgcctaa

SEQ ID NO: 15389 - protein, 101 aa, Sorghum bicolor
  misc_feature: Useful for making plants with altered terpenoid content
  misc_feature: Functional homolog of the protein sequence given in SEQ ID NO 14179
  misc_feature: Ceres ANNOT ID no. 8640918
MSNSFCPDCKKQTEVAFDHSAGAHSVDETSEWRTLANESNDNDPVRVGGPTNPLLTDGGLSNVIAKPNGAQGEFLSSSLGRWQNRGSNPNRSLILAFRTIA

SEQ ID NO: 15390 - DNA, 786 bp, Sorghum bicolor
  misc_feature: Ceres ANNOT ID no. 8640934
  misc_feature: Encodes the peptide sequence at SEQ ID NO 15391
atggcatcgctcgcggtgctactcttgcttgccctgctctccatgacgttctcctcttcagcgcaaggctatggcgtcggccgatggatcaatgcgcacgccaccttctacggcggcgccgacgcttccggcaccatgggtggcgcgtgcgggtacggcgacctgtacagccaggggtacggcacggcgacgacggcgctgagcacggcgctgttcagcggcgggcagacctgcggcgcgtgcttcgagctgcggtgcgccggcggcggcgaccgcggctcgtgcgtgccatcgtcatccgtcgtggtgacggccaccaacctgtgcccgcccaactacgcgctcccgagcgacgccggcgggtggtgcaacccgccgctgcggcacttcgacctgtcgcagccggcgttcctccgcatcgcccgttaccgcgcgggcgtcgtgcccgtcgcctaccgcagggtgccgtgccggaggcggggcggcatccggttcaccgtcaacggccacgcctacttcaacctggttctggtcgccaacgtgggcggcgccggcgacgtgcgcgcgctcgccgtcggggcgggcggcgcccggcggcggaggacgcggtggctggccatggcgcggaactggggacagaactggcagagcgccgcgcgcctcgaccacggccagccgctctccttcagggtcaccaccagcgaccgccgctccgtcgtgtcttacaacgccgcgcccgccgggtgggccttcggccagacattcaccggcgcccagttcccgtag

SEQ ID NO: 15391 - protein, 261 aa, Sorghum bicolor
  misc_feature: Useful for making plants with altered carbohydrate content
  misc_feature: Functional homolog of the protein sequence given in SEQ ID NO 14012
  misc_feature: Useful for making plants with altered cell wall content and/or composition
  misc_feature: Functional homolog of the protein sequence given in SEQ ID NO 14180
  misc_feature: Ceres ANNOT ID no. 8640934
  misc_feature (64)..(152): Pfam ID: DPBB_1 Pfam Description: Rare lipoprotein A (RlpA)-like double-psi beta-barrel
  misc_feature (163)..(246): Pfam ID: Pollen_allerg_1 Pfam Description: Pollen allergen
MASLAVLLLLALLSMTFSSSAQGYGVGRWINAHATFYGGADASGTMGGACGYGDLYSQGYGTATTALSTALFSGGQTCGACFELRCAGGGDRGSCVPSSSVVVTATNLCPPNYALPSDAGGWCNPPLRHFDLSQPAFLRIARYRAGVVPVAYRRVPCRRRGGIRFTVNGHAYFNLVLVANVGGAGDVRALAVGAGGARRRRTRWLAMARNWGQNWQSAARLDHGQPLSFRVTTSDRRSVVSYNAAPAGWAFGQTFTGAQFP

SEQ ID NO: 15392 - DNA, 645 bp, Sorghum bicolor
  misc_feature: Ceres ANNOT ID no. 8640957
  misc_feature: Encodes the peptide sequence at SEQ ID NO 15393
atggccacgcgcgtccgcgggtgcctcctgctcgtcctcctcgcgaccgcggcccccgccggcgccctgcgcttcgacctgctctcgggccacaccaagtgcatctccgacgacatcaaggtcggtgccatggccgtcggtaagtaccacgtcacgggccccgactcccagacccagcagcagctcccggactcccaccgcatctcgctgcgggtcacctcgccctacggcaacagcctgcactacgcggagaacgtgcactcgggcaacttcgccttcacggcctccgagaacggcgactacctcgcctgcttctgggcgcccgatcaccgcccgcccgccaccgtcgcgttcgagttcgactggcgcagtggcgtctccgccaaggattggagcgccatcgccaagaagagtcaggtcgaaatgatggaattggagctcaggaagctggaggaaaacatcagatctatccatgaagaaatgtattaccttcgtgaaagggaagaagaaatgcaggaactgaacaggagaacaaactcaaggatggcttggcttggtttcctctcgctcaccatctgcctatcagtggcgggcttgcagttatggcacctgaagaatttctttgaaagaaagaagctactataa

SEQ ID NO: 15393 - protein, 214 aa, Sorghum bicolor
  misc_feature: Useful for making plants with altered carbohydrate content
  misc_feature: Functional homolog of the protein sequence given in SEQ ID NO 14181
  misc_feature: Useful for making plants with altered cell wall content and/or composition
  misc_feature: Functional homolog of the protein sequence given in SEQ ID NO 14182
  misc_feature: Ceres ANNOT ID no. 8640957
  misc_feature (61)..(122): Pfam ID: EMP24_GP25L Pfam Description: emp24/gp25L/p24 family/GOLD
MATRVRGCLLLVLLATAAPAGALRFDLLSGHTKCISDDIKVGAMAVGKYHVTGPDSQTQQQLPDSHRISLRVTSPYGNSLHYAENVHSGNFAFTASENGDYLACFWAPDHRPPATVAFEFDWRSGVSAKDWSAIAKKSQVEMMELELRKLEENIRSIHEEMYYLREREEEMQELNRRTNSRMAWLGFLSLTICLSVAGLQLWHLKNFFERKKLL

SEQ ID NO: 15394 - DNA, 396 bp, Sorghum bicolor
  misc_feature: Ceres ANNOT ID no. 8640942
  misc_feature: Encodes the peptide sequence at SEQ ID NO 15395
atggagcatcatcatcatcaggagctggaccttgagctcagcctccagcccttctcggcggatgcggcggcggcggcggatgaccctcccggcttcttcgtctgcacctactgcgaccgcaagttctacagctcgcaggcgctcggcggccaccagaacgcgcacaagtacgagcgcaccctcgccaagcgccgccgggagatcgccgccgccatgcgcgcgcacggcgcccggcaggtcgacgccgccgccgcatccacctgcagcaggccaggcggggaccgagcgcccgcggtgcagtctgccgccgccttgctgcgcggcaagagcagctctctggagcgcggcggcgtcgagcgcgccgccgccgagttggacttgtctctcaggctatga

SEQ ID NO: 15395 - protein, 131 aa, Sorghum bicolor; identical to SEQ ID NO: 6518
  misc_feature: Useful for biocontainment applications
  misc_feature: Useful for making plants with modulated biomass
  misc_feature: Functional homolog of the protein sequence given in SEQ ID NO 13581
  misc_feature: Ceres ANNOT ID no. 8640942

SEQ ID NO: 15396 - DNA, 1323 bp, Sorghum bicolor
  misc_feature: Ceres ANNOT ID no. 8640963
  misc_feature: Encodes the peptide sequence at SEQ ID NO 15397
atgttgcagaaacgatggaaaggatgcatcttcttctccctcgccttccttctctgcaacgcatcagaaaactctccgtcggagctcgccaagatcgttcagtctaagcagacgaggcaagctcgcgtgtgcggaccggaccctgcgctgctgcgctccctggcaggcatcgacggcgcggaggtgatggtcaccatccccaacgcgcagctggagcacgtcgccgagttccaggaggaggccgacctctgggtcgccgccaacgtcgcgccgttcctcccggcgaccaggatcacgcacgtcctggcgggcgacgacgtgctggtggcgagctcccctggcggcagcgccagcgcctacttcctggtcccggcgatgcggaacctccggtccgcgctcgccgccgcgggcctcggcggccgcgtcaaggtgtccagcgcgctgtccggcgaggcgctggccgacccggcgtggtcgggcgtcgtggcccacgtcctgcggttcctcgagtcgtcggggtcgccgctgttcctcaagtcacgaccgtcggaggccagcgacgccaaggtcgacgccgcgatgcgcgccctgggcgtctcgcgcgtccccgtgatcgcggcggacctcgcggccggcggcgacgtcgtgccatactactactactacgggtacggctacccgggtgagggtggtcagcggcggtcgctggcgacggggacgttctgcgtggcgctgcagaacgcggacccgacggcgctgcaggccgggctcaactgggcgtgcgggcaaggccaagccgactgctccgccatccagcccggcggcgcctgctaccagcagaacaacctggcggcgctcgcgtcctacgcctacaacgactactaccagaagatggccagcaccggcgccacctgctccttcaacggcaccgccaccaccaccaccaacgacccaagtaatcatttctcgacggcgggcggctccaactcgagcgcgccggtgggcacgaccccgccgaccagcctctcccctccgacgggcttcacgcctccagtcggctccagccccccgtcgtcgtcggagttcagtcctccgtccggcttcaccccgccgtccggtttcaccccgccggccggaggcggctttggacccagcttcggcaccccgccgggttccttcaatggcaccggttcgttcggcccgagcggcacgctaaacccttacaacggcgtgtcccgtgggttgtcgttctcgcgcgccggcttgacggctctgtccgccgccgcggtcgccgttctcctcgtgtccatggatgccatgtga

SEQ ID NO: 15397 - protein, 440 aa, Sorghum bicolor
  misc_feature: Useful for making plants with altered carbohydrate content
  misc_feature: Functional homolog of the protein sequence given in SEQ ID NO 14016
  misc_feature: Ceres ANNOT ID no. 8640963
  misc_feature (239)..(319): SWISSPROT Homolog: EC 3.2.1.39 Glucan endo-1,3-beta-D-glucosidase
  misc_feature (27)..(148): SWISSPROT Homolog: EC 3.2.1.73 Licheninase
  misc_feature (240)..(322): Pfam ID: X8 Pfam Description: X8 domain
  misc_feature (14)..(268): Pfam ID: Glyco_hydro_17 Pfam Description: Glycosyl hydrolases family 17
MLQKRWKGCIFFSLAFLLCNASENSPSELAKIVQSKQTRQARVCGPDPALLRSLAGIDGAEVMVTIPNAQLEHVAEFQEEADLWVAANVAPFLPATRITHVLAGDDVLVASSPGGSASAYFLVPAMRNLRSALAAAGLGGRVKVSSALSGEALADPAWSGVVAHVLRFLESSGSPLFLKSRPSEASDAKVDAAMRALGVSRVPVIAADLAAGGDVVPYYYYYGYGYPGEGGQRRSLATGTFCVALQNADPTALQAGLNWACGQGQADCSAIQPGGACYQQNNLAALASYAYNDYYQKMASTGATCSFNGTATTTTNDPSNHFSTAGGSNSSAPVGTTPPTSLSPPTGFTPPVGSSPPSSSEFSPPSGFTPPSGFTPPAGGGFGPSFGTPPGSFNGTGSFGPSGTLNPYNGVSRGLSFSRAGLTALSAAAVAVLLVSMDAM

SEQ ID NO: 15398 - DNA, 987 bp, Sorghum bicolor
  misc_feature: Ceres ANNOT ID no. 8640996
  misc_feature: Encodes the peptide sequence at SEQ ID NO 15399
atgtcgtccgttttagccgcacttagcttgctgctcctagccgttgcgtgccaggccagcccttactaccctctggagctagggtactaccgttacaagtgtccccaggctgaggccatcgtgaaggccatcatggagaaggccatcgcccagaaccctggcaatggcgctggtctcatccgtatgctcttccatgactgtttcgtcgagggctgtgatgcttccgtgcttctggacccgaccccgttcagcccgacgccggagaagacaagcccgcccaacaacccaagcctacgcgggttcgagctgatcgacgccatcaaggacgccctggaggccgcgtgccccggggtcgtctcctgcgccgacatcatcgccttcgcggcccgcgacgcgtcctacttcctgagcggcggcaaggtccgcttcgacatgccggcgggccgcctggacggcaccttctccaacgcctccgagtcgctcaagttcctggtcccgccgacgtccaacctcagcaccctcgtctccagcttcgccgtcaaggggatgtcggtggaggacctggtcgtgctctccggcgcgcacaccgtcggccgctcccactgctcctccttcgtctccgaccgcctcaatgcctcggtcccctccgacatcagccccgggctagccggcttcctcaagagccgctgcccggccaacccgacgagcagcggcaacgaccccacggtgatgcaggacgtggtgacgcccaacgccatggacaaccagtactacaagaacgtgctgtcgcacaccgtgctcttcacctccgacgccgatctcctcacgtcggcgcagacggccaagctggtgctggacaacgccaatatccccgggtggtgggaggacaagttcgagaaggccatggtgaagatggccagcatcgaagtcaagaccggctaccaaggccaggtgaggaagaactgcagggcgatcaatcactactag

SEQ ID NO: 15399 - protein, 328 aa, Sorghum bicolor
  misc_feature: Useful for making plants with altered carbohydrate content
  misc_feature: Functional homolog of the protein sequence given in SEQ ID NO 13714
  misc_feature: Useful for making plants with altered cell wall content and/or composition
  misc_feature: Functional homolog of the protein sequence given in SEQ ID NO 13958
  misc_feature: Useful for making plants with modulated oxidative stress sensitivity
  misc_feature: Functional homolog of the protein sequence given in SEQ ID NO 13607
  misc_feature: Ceres ANNOT ID no. 8640996
  misc_feature (25)..(326): SWISSPROT Homolog: EC 1.11.1.7 Peroxidase
  misc_feature (41)..(290): Pfam ID: peroxidase Pfam Description: Peroxidase
MSSVLAALSLLLLAVACQASPYYPLELGYYRYKCPQAEAIVKAIMEKAIAQNPGNGAGLIRMLFHDCFVEGCDASVLLDPTPFSPTPEKTSPPNNPSLRGFELIDAIKDALEAACPGVVSCADIIAFAARDASYFLSGGKVRFDMPAGRLDGTFSNASESLKFLVPPTSNLSTLVSSFAVKGMSVEDLVVLSGAHTVGRSHCSSFVSDRLNASVPSDISPGLAGFLKSRCPANPTSSGNDPTVMQDVVTPNAMDNQYYKNVLSHTVLFTSDADLLTSAQTAKLVLDNANIPGWWEDKFEKAMVKMASIEVKTGYQGQVRKNCRAINHY

SEQ ID NO: 15400 - DNA, 1779 bp, Sorghum bicolor
  misc_feature: Ceres ANNOT ID no. 8641009
  misc_feature: Encodes the peptide sequence at SEQ ID NO 15401
atgggcctctgctacggcaagtcggcagcggtccaggagccggcggtggcggaggagaacgacgtagccgacggcgcggcggcgggccgcggcgacgatgggccgccggcgtcgccggtgaaggcgcctcggacgcccaagcagggcaagttctccttctacctgccgagcccgctcccgccctccagctacaagggctcgccggccaactccaactccagcgtcgcgtccacgccggcgcgcggcgggttcaagcgcccgttcccgccgccgtcgcccgccaagcacatccgtgcgctgctggcgcggcgccacggctcggtcaagcccaacgaggcgtccatccccgagggcggcgagccagacctggggctggacaagagcttcggctactccaggcacttcgccgccaagtacgaccttggccgggaggtggggcgcggccactttggcttcacctgcgctgccaagtgcaagaagggcgacctcaagggcgaggacgtcgccgtcaaggttattcccaaggccaagatgactactgctattgccattgaagatgtcagaagagaagtcagaatattgagttctttgacaggccacagcaacctagtgcagttttatgatgcttttgaggatgaagaaaatgtgtatgttgttatggagttatgcaaaggaggtgagctgctggacaggattttggctagaggtggaaaatattctgaggaagatgctaaggttgttattcaccaaattctgagtgttgcttcattttgccatcttcagggtgttgttcatcgagatctgaaaccagagaattttcttttcatgtcaaaggatgagaattctgccttgaaagtcatagactttggtttgtctgactttgttaaaccagatgaaagacttaatgacattgttggaagtgcatattatgttgctcctgaagttctccatcgatcttacagcactgaggcagatatgtggagcattggagtaattgcatatattttgctttgtggaagccgccctttctgggcacgaactgagtcaggaatttttcgagctgttctaaaagccgagcctagctttgatgaaatcccatggcctaccctttctgctgaagcgaaagactttgtaagaaggctactcaataaggattaccggaagcggatgactgctgcacaagccctctgccatccatggatccgtggcacacaggaagttaagattaatctagacatgataatctacaggcttatgagggcgtacttaagttcatcttctctaaggaagtcggctttgagggctcttgcaaagacactgacgacagatcaaatcttctacctaagagagcagtttatattgttaggtccaaacaagagtggccatatatccttgcaaaatatgaaggcggccttgatgaaaaattcctcgggtgaaatgaatgattctaggattcttgactttgttaattcaatatgcaatatcccatatggaaagtttgattttgaagagttctctgctgcggccattagtgtatatcaaatggaaggcctggagacctgggaacaacatgctcaacaagcatatgaattgtttgacaaggagggcaaccgaccaattgtgattgaagaacttgcatcggaacttggacttggcccttcggttccacttcatgttgttctcaaagattggatcagacattcagatggaaacctcagtttcctcgggttcataaaactattgcatggagtttcttcacgcacaatccctaaagtctaa

SEQ ID NO: 15401 - protein, 592 aa, Sorghum bicolor
  misc_feature: The sequence is a functional homolog of SEQ ID NO 2 in US patent 7084323
  misc_feature: Ceres ANNOT ID no. 8641009
  misc_feature: Up-regulated in root tissues in response to salicylic acid treatment
  misc_feature (70)..(591): SWISSPROT Homolog: EC 2.7.11.1 Non-specific serine/threonine protein kinase
  misc_feature (139)..(401): Pfam ID: Pkinase Pfam Description: Protein kinase domain
MGLCYGKSAAVQEPAVAEENDVADGAAAGRGDDGPPASPVKAPRTPKQGKFSFYLPSPLPPSSYKGSPANSNSSVASTPARGGFKRPFPPPSPAKHIRALLARRHGSVKPNEASIPEGGEPDLGLDKSFGYSRHFAAKYDLGREVGRGHFGFTCAAKCKKGDLKGEDVAVKVIPKAKMTTAIAIEDVRREVRILSSLTGHSNLVQFYDAFEDEENVYVVMELCKGGELLDRILARGGKYSEEDAKVVIHQILSVASFCHLQGVVHRDLKPENFLFMSKDENSALKVIDFGLSDFVKPDERLNDIVGSAYYVAPEVLHRSYSTEADMWSIGVIAYILLCGSRPFWARTESGIFRAVLKAEPSFDEIPWPTLSAEAKDFVRRLLNKDYRKRMTAAQALCHPWIRGTQEVKINLDMIIYRLMRAYLSSSSLRKSALRALAKTLTTDQIFYLREQFILLGPNKSGHISLQNMKAALMKNSSGEMNDSRILDFVNSICNIPYGKFDFEEFSAAAISVYQMEGLETWEQHAQQAYELFDKEGNRPIVIEELASELGLGPSVPLHVVLKDWIRHSDGNLSFLGFIKLLHGVSSRTIPKV

SEQ ID NO: 15402 - DNA, 1314 bp, Sorghum bicolor
  misc_feature: Ceres ANNOT ID no. 8641020
  misc_feature: Up-regulated in root tissues in response to salicylic acid treatment
  misc_feature: Encodes the peptide sequence at SEQ ID NO 15403
atgcccaagccgtggaggccggtgctggcgtcggcaaccaagtgctgcgcggcggaggacgcggcggtggcccccgacgggctggcgcggtgcaggccgcagcagtcggagctctcgcgccggctcgcgtccttcaggcggctctcgtcgctggccaacagcccggcgtcgggtggcaccaccgtggtggtggacaaggacggcagcgtcaagcagcagcagggagaggagatggtggagggcccgctgcagctgcactcgttcggcctcggcgagctccgcggcgtcacgcacgacttctccagcagcttcctcctcggcgagggcggcttcggcgccgtctacaagggcttcgtcgacgccggcatgcgccctggcctctcctcccagcccgtcgccgtcaagcagctcaacgccgccggcttccagggccaccgcgagtggctcgccgaggtcatcttcctcggccagttccgccacccccacctcgtccgcctcctcggctactgctgcgaggacgaggagcgcctcctcgtctacgagttcatgccgcgcggcagcctcgagaaccacctcttcaggaggatctcggcgacgctgccatggggcacccgtctgaaggtggcgatcggcgccgccaagggcctagcgttcctgcacgccgccgccacgccggtgatctaccgcgacttcaaggcgtccaacatcctcctcgactccgacttcacggcgaagctctccgacttcgggctggccaagatgggtcccgagggcgaggacacgcacgtgacgacgcgggtgatgggcacgcacgggtacgcggcgcccgagtacgtgcagacgggccacctcaacgtgaggagcgacgtgtacagcttcggcgtcgtgctcctggagctcctcacgggccgccgcgccatggagcacgtccggggccgcgccgcgcacgccgaccagcaggtgaagctcgtcgactggacgcgcccgtacctcagcggcggcagccgccggctgcgctgcatcatggaccagaggctcgccgggcactactccgtcaagggcgcgcgcgccgtcgcgcagctcgccgtgcagtgcacggcgacgcagccgagggacaggcccaggatggtggccgtcgtcgaggcgctggagaagctgcaggggctcaaggacatggccgtcaccgtcgggctctggcccgccgccgcgcctgtcgctggcaggaacgccatctcggcgaagatccgcgccgaggtcaagggcgccggcggcgctgggtcgcggcggaggagcgcgtcctccaagctgccgtag

SEQ ID NO: 15403 - protein, 437 aa, Sorghum bicolor
  misc_feature: Useful for making plants with modulated drought sensitivity
  misc_feature: Functional homolog of the protein sequence given in SEQ ID NO 14078
  misc_feature: Useful for making plants with modulated heat sensitivity
  misc_feature: Functional homolog of the protein sequence given in SEQ ID NO 14079
  misc_feature: Ceres ANNOT ID no. 8641020
  misc_feature (77)..(389): SWISSPROT Homolog: EC 2.7.11.1 Non-specific serine/threonine protein kinase
  misc_feature (100)..(383): Pfam ID: Pkinase_Tyr Pfam Description: Protein tyrosine kinase
MPKPWRPVLASATKCCAAEDAAVAPDGLARCRPQQSELSRRLASFRRLSSLANSPASGGTTVVVDKDGSVKQQQGEEMVEGPLQLHSFGLGELRGVTHDFSSSFLLGEGGFGAVYKGFVDAGMRPGLSSQPVAVKQLNAAGFQGHREWLAEVIFLGQFRHPHLVRLLGYCCEDEERLLVYEFMPRGSLENHLFRRISATLPWGTRLKVAIGAAKGLAFLHAAATPVIYRDFKASNILLDSDFTAKLSDFGLAKMGPEGEDTHVTTRVMGTHGYAAPEYVQTGHLNVRSDVYSFGVVLLELLTGRRAMEHVRGRAAHADQQVKLVDWTRPYLSGGSRRLRCIMDQRLAGHYSVKGARAVAQLAVQCTATQPRDRPRMVAVVEALEKLQGLKDMAVTVGLWPAAAPVAGRNAISAKIRAEVKGAGGAGSRRRSASSKLP

SEQ ID NO: 15404 - DNA, 1614 bp, Sorghum bicolor
  misc_feature: Ceres ANNOT ID no. 8641041
  misc_feature: Encodes the peptide sequence at SEQ ID NO 15405
atggagctagcaccgtcgtcggcgtccttcctcgccgtcgtagtggctgctgccgccgctctcttcctcgcaaccattctccggctccgcccgcgctccacgcgcaacaagtacaggctcccaccgggcccccggccgtggccggtgatcggcaacctgaacctgatcggccggctccctcaccgctccatccacgagctctccaagaggtatggcccgctcatgtccctgcggttcggctccttccccgtcgtcgtcgggtcgtcggtcgacacggcgaggctcttcctcaggacccacgacctggccttcatcgaccgtcctcagacggcggccggcaagtacaccacctacaactgcggtggcctcttctaccagccctacggtgcgtactggcgtcagggccgcaagctctgccaggcggagctcttcaacgagaggcggctcacgtcgctcgagcacgtccgcggcgaggaggtgcgcgccatggtgagagatctgcacgccgcggcgtcggcggcggcggccggttgttctggtggtggtggtggtggcggccgcgcggtggtggcgctcaaggagcacctctacatggtgaacctccacgtcatctcgcgcatgttgctagggaagaagtacatcgtcgacgggtctggctcgccggcgacgcctgaggagttcaggtggctcatcgacgagcatttctttctcaacggcgtgctcaacgtcgcggacatgatcccgtggctcagctgcctggacccgcacgggtacatcaagaggatgaagaggtcggccaagatgtgggaccggttcctggagcacgtgctggacgagcacaaccggcgacggcggcgagaaggcaaggatttcgttgccatggacatgatggacgtgcttttggagctcgctgacgaccccaacctcgaggttccgatcaagcgggataatgtgaaggcgttcattctagacctgatgggcggcgggaccgatacctcggcggtgactgtagagtgggccatgtcagagctcctaaggaatccagacgtccttgccaaggccaccgaggagctagaccgtgtcattgggcaggaccgtctggtggcagagcgggacattccaaacctcccatacatggaggccatcgtgaaggagaccctgcgcctgcacccagtcgcgccgcttctgacgccgcggctgtcccgggaggacgtgtccgccggcggctacgacatcccggcaggcacgcgcgtcttcgtcaacacctggtccatcggccgcgaccccgcggtgtgggaggctcccatggagttccgcccggagcgcttcgtcgtcgggagcagaggcggcggcgtggacctgaaagggcagcacttcgagctgctgccgttcggctccggccgccggatgtgccccggcatgggcctcgccctcaggatggtgccgatgatcttggccaacctgctgcacgccttcgcgtggaggctccccgacggcgtggcggccgaggagctgagcatggaggagacgttcgggatcaccgtgccgcgcctggtcccgctcgaggccatcgctgagcccaagctcccggctcgcctatatgcaggcccgtga

SEQ ID NO: 15405 - protein, 537 aa, Sorghum bicolor
  misc_feature: Useful for making plants with altered carbohydrate content
  misc_feature: Functional homolog of the protein sequence given in SEQ ID NO 14183
  misc_feature: Ceres ANNOT ID no. 8641041
  misc_feature: Up-regulated in shoot tissues in response to methyl jasmonate treatment
  misc_feature: Up-regulated in root tissues in response to methyl jasmonate treatment
  misc_feature: Up-regulated in root tissues in response to salicylic acid treatment
  misc_feature: Up-regulated in shoot tissues in response to salicylic acid treatment
  misc_feature (190)..(534): SWISSPROT Homolog: EC 1.14.13.21 Flavonoid 3'-monooxygenase
  misc_feature (41)..(523): Pfam ID: p450 Pfam Description: Cytochrome P450
MELAPSSASFLAVVVAAAAALFLATILRLRPRSTRNKYRLPPGPRPWPVIGNLNLIGRLPHRSIHELSKRYGPLMSLRFGSFPVVVGSSVDTARLFLRTHDLAFIDRPQTAAGKYTTYNCGGLFYQPYGAYWRQGRKLCQAELFNERRLTSLEHVRGEEVRAMVRDLHAAASAAAAGCSGGGGGGGRAVVALKEHLYMVNLHVISRMLLGKKYIVDGSGSPATPEEFRWLIDEHFFLNGVLNVADMIPWLSCLDPHGYIKRMKRSAKMWDRFLEHVLDEHNRRRRREGKDFVAMDMMDVLLELADDPNLEVPIKRDNVKAFILDLMGGGTDTSAVTVEWAMSELLRNPDVLAKATEELDRVIGQDRLVAERDIPNLPYMEAIVKETLRLHPVAPLLTPRLSREDVSAGGYDIPAGTRVFVNTWSIGRDPAVWEAPMEFRPERFVVGSRGGGVDLKGQHFELLPFGSGRRMCPGMGLALRMVPMILANLLHAFAWRLPDGVAAEELSMEETFGITVPRLVPLEAIAEPKLPARLYAGP

SEQ ID NO: 15406 - DNA, 1590 bp, Sorghum bicolor
  misc_feature: Ceres ANNOT ID no. 8641046
  misc_feature: Up-regulated in shoot tissues in response to methyl jasmonate treatment
  misc_feature: Up-regulated in root tissues in response to methyl jasmonate treatment
  misc_feature: Up-regulated in root tissues in response to salicylic acid treatment
  misc_feature: Up-regulated in shoot tissues in response to salicylic acid treatment
  misc_feature: Encodes the peptide sequence at SEQ ID NO 15407
atggagacggaactactccccttcctggtcggcgtcgtcctcgccaccgctcttctcgtcgtcgccgccctccgccaccgcaagcgcagctccacctccaccagcaagcacaggcggctcccacccggccctcgcccgtggccgatcatcggcaacctcaacctgatcggcgcgctcccgcaccgctccatccacgcgctctcggcgcggtacggcccgttcatgtccctccgcttcggctccgtccccgtcgtcgtcggctcgtcggtggacgccgccaggttcttcctcaagaccaacgacgcgtccttcatcgaccgccccaagatggcgtccgggaagcacaccgcctacgactactccgacatcgtctggtccccctacggcgcctactggcgccaggcgcgcaagctgtggaaggcccatctcttcagcgaccggcagctcaggtcgcaggagcacgtccgcagcgaggagctgcgcgccctgctgcgcgacctgtccctgtcctcctccgcggcggcggggcgcggcggggtcgtcgtcgtgctcaaggagcacctgctcatgttcagcctcaacgtgatctcgcgcatggcgctgggcggcaagtacgtcggcgagggcggcactgatgctggctcgccgatctcgccggccgagttcaggtggatggtcgacgagctgtttctcctcaacggcgtgttctgcgtcggggacttcatcccgtggctcagctggctggacattcagggctacgtcgggaggatgaagaggctgggcaagatgttcgaccgattcttggagcacgtggtggaggagcacagccagcgacggcggcgagagggcgacaagttcgtcgccgccgacatggtggacctgctgctagagctcgccgacgaccccaaactcgaggtgcccatcaaacgggatggcgtcaagggattcgctctggatctcatcgctggcggcacggactcgtcagcggtgaccatcgaatgggccatgtcggagctgctgcggaagccagaggtcctcgccaaggccgtcgaggagctggacggcgtcatcggccatggccgtctcgtcaccgagcaggacattcggagcctgccgtacgtggaggccatcgtgaaggagaccatgcgcctgcaccccgtgacgccgctgctggcgccgcggctgtgccgcgaggacgcgtccacgggcagctacgacatcccgcggggcacgctcgtgttcgtgaacgtctgggccatcggccgcgaccccgccgtgtggggcggcgacgcggaggagttccgcccggagaggttcgccggcagcgccgtggacgtgaaggggcaggacctggagctgctcccgttcgggtccggccgccggatgtgcccgggctacgtcctcgggctcaagatggtgcaggtgaccctggccaacctgctgcacgccttcgcgtggcggctgccggacggcgtggcgccggagaagctgagcatgcaggagaagttcgggctggccgttccgcgcgtggtccctctcgaggccgtcgccgtgcccaggctgcctgcacacctctacgccgggccctga

SEQ ID NO: 15407 - protein, 529 aa, Sorghum bicolor
  misc_feature: Useful for making plants with altered carbohydrate content
  misc_feature: Functional homolog of the protein sequence given in SEQ ID NO 14183
  misc_feature: Ceres ANNOT ID no. 8641046
  misc_feature (40)..(528): SWISSPROT Homolog: EC 1.14.13.21 Flavonoid 3'-monooxygenase
  misc_feature (41)..(514): Pfam ID: p450 Pfam Description: Cytochrome P450
METELLPFLVGVVLATALLVVAALRHRKRSSTSTSKHRRLPPGPRPWPIIGNLNLIGALPHRSIHALSARYGPFMSLRFGSVPVVVGSSVDAARFFLKTNDASFIDRPKMASGKHTAYDYSDIVWSPYGAYWRQARKLWKAHLFSDRQLRSQEHVRSEELRALLRDLSLSSSAAAGRGGVVVVLKEHLLMFSLNVISRMALGGKYVGEGGTDAGSPISPAEFRWMVDELFLLNGVFCVGDFIPWLSWLDIQGYVGRMKRLGKMFDRFLEHVVEEHSQRRRREGDKFVAADMVDLLLELADDPKLEVPIKRDGVKGFALDLIAGGTDSSAVTIEWAMSELLRKPEVLAKAVEELDGVIGHGRLVTEQDIRSLPYVEAIVKETMRLHPVTPLLAPRLCREDASTGSYDIPRGTLVFVNVWAIGRDPAVWGGDAEEFRPERFAGSAVDVKGQDLELLPFGSGRRMCPGYVLGLKMVQVTLANLLHAFAWRLPDGVAPEKLSMQEKFGLAVPRVVPLEAVAVPRLPAHLYAGP

SEQ ID NO: 15408 - DNA, 111 bp, Sorghum bicolor
  misc_feature: Ceres ANNOT ID no. 8641050
  misc_feature: Encodes the peptide sequence at SEQ ID NO 15409
atggcgtcgggtgacaacagcaagcagaggagcgaggaggagtggcgcgccgtgctctcccccgagcagttccgcatcatccgccagaagggcaccgagtcagtactctag

SEQ ID NO: 15409 - protein, 36 aa, Sorghum bicolor
  misc_feature: Useful for making plants with modulated heat sensitivity
  misc_feature: Functional homolog of the protein sequence given in SEQ ID NO 12940
  misc_feature: Ceres ANNOT ID no. 8641050
  misc_feature (10)..(33): SWISSPROT Homolog: EC 1.8.4.12 Peptide-methionine (R)-S-oxide reductase
MASGDNSKQRSEEEWRAVLSPEQFRIIRQKGTESVL

SEQ ID NO: 15410 - DNA, 1596 bp, Sorghum bicolor
  misc_feature: Ceres ANNOT ID no. 8641049
  misc_feature: Encodes the peptide sequence at SEQ ID NO 15411
atggagacggaactagtagtctctttcatgggcgtcgtgctcgccaccgctcttctcgtcgtcaccgtcctccgccgcaagcgctgctccagctccagctccagccgcgagtacaggctcccacccggccctcgcccgtggccggtgatcggcaacctcaacctgctcggctcgctcccgcaccgctccatccacgcgctctcggcgcggcacggcccgttcatgtcgctccgcttcggctccgtccccgtcgtcgtcggctcgtcggtggacgccgccaggttcttcctcaagaccaacgacgcgtccttcatcgaccgccccaagatggcgtccgggaagcacaccgcctacgactactccgacatcgtctggtccccctacggcgcctactggcgccaggcgcgcaagctgtggaaggccaacctcttcaacgacaggcagctcaggtcgctggagcacgtccgcagcgaggagctgcgcgtgctcctgcgcgacctgcgcgccctgtccctgtcctcctcctcctccgcgtccgccgggcgcggcgggggcgtcgtcgcgctcaaggagcacctgctcatgctgagcctcaacgtgatctcgcgcatggcgctgggcgggaaatacgtcggcgagggcggcaccgctggctcgccgatctcgccggccgagttcaggtggatggtcgacgagctgtttctcctcaacggcgtgttctgcgtcggggacttcatcccctggctcagctggctggacattcatggctacgtcgggaggatgaagaagctgggcaagatgttcgatcgcttcttggagcacatggtggaggagcacagccagcgacggcggcgagaaggcgataagttcgttgccgcggacatggtggacctgctgctggagctcgccgacgaccccaaacttgaggtgcccatcaaacgggatggcgtcaagggattcgctctggacctcatcgctggcggcacggactcctcggcggtgaccatcgaatgggccatgtcggagctcctgcggaatcccgatgtgctctccaaggccaccgaggagctggacggcgtcgtcggccgcgaacgccttgtcaccgagcaggacattccgaacctgccgtacctggaggccatcgtgaaggaggccttccgcctgcaccccgtgacgccgctgctggcgccgcggctgtgccgcgaggacgcttccacgggcagctacgacatcccacggggcacgctcgtgttcgtgaacgtctggaccatcggccgcgaccccgccgtgtggggcgacgacgcggagttcttccgcccggagaggttcgtcggcagcggcgtggacgtgaaggggcaggacctggagctgctcccgttcgggtccggccgccgaatgtgcccgggctacgtcctcgggctcaagatggtgcaggtgaccctggccaacctgctgcacgccttcgcgtggcggctgccggatggcgtggccccggagaagctgagcatgcaggagaaattcggcctggccgttccgcgcttcgtccctctcgaggccgtcgccgtgcccaggctgcctgcacacctctacgcctga

SEQ ID NO: 15411 - protein, 531 aa, Sorghum bicolor
  misc_feature: Useful for making plants with altered carbohydrate content
  misc_feature: Functional homolog of the protein sequence given in SEQ ID NO 14183
  misc_feature: Ceres ANNOT ID no. 8641049
  misc_feature (193)..(530): SWISSPROT Homolog: EC 1.14.13.21 Flavonoid 3'-monooxygenase
  misc_feature (41)..(518): Pfam ID: p450 Pfam Description: Cytochrome P450
METELVVSFMGVVLATALLVVTVLRRKRCSSSSSSREYRLPPGPRPWPVIGNLNLLGSLPHRSIHALSARHGPFMSLRFGSVPVVVGSSVDAARFFLKTNDASFIDRPKMASGKHTAYDYSDIVWSPYGAYWRQARKLWKANLFNDRQLRSLEHVRSEELRVLLRDLRALSLSSSSSASAGRGGGVVALKEHLLMLSLNVISRMALGGKYVGEGGTAGSPISPAEFRWMVDELFLLNGVFCVGDFIPWLSWLDIHGYVGRMKKLGKMFDRFLEHMVEEHSQRRRREGDKFVAADMVDLLLELADDPKLEVPIKRDGVKGFALDLIAGGTDSSAVTIEWAMSELLRNPDVLSKATEELDGVVGRERLVTEQDIPNLPYLEAIVKEAFRLHPVTPLLAPRLCREDASTGSYDIPRGTLVFVNVWTIGRDPAVWGDDAEFFRPERFVGSGVDVKGQDLELLPFGSGRRMCPGYVLGLKMVQVTLANLLHAFAWRLPDGVAPEKLSMQEKFGLAVPRFVPLEAVAVPRLPAHLYA

SEQ ID NO: 15412 - DNA, 861 bp, Sorghum bicolor
  misc_feature: Ceres ANNOT ID no. 8641052
  misc_feature: Encodes the peptide sequence at SEQ ID NO 15413
atgacgctggacgccaactacctccgcggcaccatggcggcggtgctgtccatcctgcagcacacggcgtgccccgagagcgtggcgttccacttcctgaccgccgacgccgacgccgacgaccacgtcggcctcgccgccgcgctgcgcgcctcgttcccgttcctcgacctccgggtgtaccgcttcgacccgtcccgcgtccgcgaccgcatctcccggtccgtccggcaggagctggaccagccgctcaactacgcgcgcgtctacctcgccgacacgctcccgccggacgtgcgccgggtcacctacctcgactccgacgtgatcgtggtggacgacgtccggacgctggcgtccgtcgacctcgcggggcacgtggtggcggcgcccgagtactgccacgccaacttcagcaactacttcacggacgccttctggtcgcacccggcgctcaacggcaccttccacggccgccggccctgctacttcaacacgggcgtcatggtcatggacgtcgacaagtggcgcgccggcgggtacacgcgcagggtggaggagtggatggccgtgcagaagcgccgccggatctaccacctcggctcgctgccgccgttcctgctcgtcttcgcggggcacatcagggcggtggaccaccggtggaaccagcacgggctcggcggcgacaacgtcgagggccgctgccggggcctccacccgggccccatcagcctcctgcactggagcggcaagggtaagccgtggctccgcctcgacgcccggcggccgtgctccgtcgactacctctgggcgccctacgacctataccgttactcgtcgccggtgatcgacgagtggtga

SEQ ID NO: 15413 - protein, 286 aa, Sorghum bicolor
  misc_feature: Useful for making plants with altered cell wall content and/or composition
  misc_feature: Functional homolog of the protein sequence given in SEQ ID NO 14184
  misc_feature: Useful for making plants with altered carbohydrate content
  misc_feature: Functional homolog of the protein sequence given in SEQ ID NO 14185
  misc_feature: Ceres ANNOT ID no. 8641052
  misc_feature (3)..(255): SWISSPROT Homolog: EC 2.4.1.44 Lipopolysaccharide 3-alpha-galactosyltransferase
  misc_feature (1)..(259): Pfam ID: Glyco_transf_8 Pfam Description: Glycosyl transferase family 8
MTLDANYLRGTMAAVLSILQHTACPESVAFHFLTADADADDHVGLAAALRASFPFLDLRVYRFDPSRVRDRISRSVRQELDQPLNYARVYLADTLPPDVRRVTYLDSDVIVVDDVRTLASVDLAGHVVAAPEYCHANFSNYFTDAFWSHPALNGTFHGRRPCYFNTGVMVMDVDKWRAGGYTRRVEEWMAVQKRRRIYHLGSLPPFLLVFAGHIRAVDHRWNQHGLGGDNVEGRCRGLHPGPISLLHWSGKGKPWLRLDARRPCSVDYLWAPYDLYRYSSPVIDEW

SEQ ID NO: 15414 - DNA, 504 bp, Sorghum bicolor
  misc_feature: Ceres ANNOT ID no. 8641079
  misc_feature: Encodes the peptide sequence at SEQ ID NO 15415
atggctcattccaacaacgcggccgccactgcccttgcgccggcgcggaaggtggcgctgatcacgagcatcacggggctgctcctatccaagaggtacgaggtgctggaccacatccgccgctcctccaacttcaacacgcagcgactggaccacatctaccacgacctgcacgcggtgtcgtcgtcgccgcggcccccgatgcggctccactacgctgacctctccgactcctcgtccctccgctgcgcgctcgacgccatttgccccgacaaggtctacaacctcgccgcgcagtcgcacgtcgccatctccttcgaggtccccgactacactgccgacgtcaccgccacgagggcgctccacatgctcgtggtcgtccgcctctcgtgcaactccacgccgccaccgcagagcaaggacacacccttccacccgcgctccccctacgccgctgccaaggtcgtcgtgcactggtacaccgtcaactaccggcggtgctag

SEQ ID NO: 15415 - protein, 167 aa, Sorghum bicolor
  misc_feature: Useful for making plants with altered carbohydrate content
  misc_feature: Functional homolog of the protein sequence given in SEQ ID NO 13802
  misc_feature: Useful for making plants with altered cell wall content and/or composition
  misc_feature: Functional homolog of the protein sequence given in SEQ ID NO 13803
  misc_feature: Ceres ANNOT ID no. 8641079
  misc_feature (20)..(128): SWISSPROT Homolog: EC 4.2.1.47 GDP-mannose 4,6-dehydratase
  misc_feature (19)..(167): Pfam ID: Epimerase Pfam Description: NAD dependent epimerase/dehydratase family
MAHSNNAAATALAPARKVALITSITGLLLSKRYEVLDHIRRSSNFNTQRLDHIYHDLHAVSSSPRPPMRLHYADLSDSSSLRCALDAICPDKVYNLAAQSHVAISFEVPDYTADVTATRALHMLVVVRLSCNSTPPPQSKDTPFHPRSPYAAAKVVVHWYTVNYRRC

SEQ ID NO: 15416 - DNA, 750 bp, Sorghum bicolor
  misc_feature: Ceres ANNOT ID no. 8641089
  misc_feature: Encodes the peptide sequence at SEQ ID NO 15417
atggcagcagcggccgccgccgactccgatcccgccgcagctgtggccgccatgtccacctgcgcccactgcacgacatttggacttagcagggataggaacatgaattctggcgacttcctactcttagattgtgtttggatactcgacgaatggagtggtctaattggtacgagcatgagtcagcgcgagatcccatcttcaaacatcgacttgcattctgtacattgtgcccgcaaccttcaaaaatgccagcactgtggcgaaatgattcctaggaaacttatggatgaacactatgatgaaagccatgccccgatcaattgctccctctgcaaagaaacaatagaacgtgagagttgggatattcataaaggtgaaaagtgtccacaaagaatggtcgcctgtgaatattgtgagtttgaattgcctgcagttgatctccatgaacatcaggatgtatgcggaaaccgaacagaactctgccaaacatgcagaaagtatattagattgcgtgaatggatagggcatgaaatacagtgccatacgaactcaaatggttctgcagacacatccagtgccagagcaattccagagagagaactacgaccgccgccaccagtgcgacctgcacgaccagcacgtcctgctcatgcttcaccacacaagcggctcctcttcacaattgctgtcactggaatagcagttatgattggctccatactgttccaaagggacgagagtttctag

SEQ ID NO: 15417 - protein, 249 aa, Sorghum bicolor
  misc_feature: Useful for making plants with altered terpenoid content
  misc_feature: Functional homolog of the protein sequence given in SEQ ID NO 13324
  misc_feature: Ceres ANNOT ID no. 8641089
  misc_feature (73)..(124): Pfam ID: zf-TRAF Pfam Description: TRAF-type zinc finger
MAAAAAADSDPAAAVAAMSTCAHCTTFGLSRDRNMNSGDFLLLDCVWILDEWSGLIGTSMSQREIPSSNIDLHSVHCARNLQKCQHCGEMIPRKLMDEHYDESHAPINCSLCKETIERESWDIHKGEKCPQRMVACEYCEFELPAVDLHEHQDVCGNRTELCQTCRKYIRLREWIGHEIQCHTNSNGSADTSSARAIPERELRPPPPVRPARPARPAHASPHKRLLFTIAVTGIAVMIGSILFQRDESF

SEQ ID NO: 15418 - DNA, 1200 bp, Sorghum bicolor
  misc_feature: Ceres ANNOT ID no. 8641156
  misc_feature: Encodes the peptide sequence at SEQ ID NO 15419
atgtctttcaggagcctgattcaggacatgagggacgagttcgggagcatctcgcggcacagcctgcggtcccggtctcaccggtccgccgggaacgcgtcgcgggcggcggccgcggggccgtcggaggcgatggaccagagctgctgggcgcagctgccccccgagctcctgcgggaggtgctggtgaggatcgaggcgtcggagagctggtggccagcgcgcagggacgtggtgtcatgcgccggcgtctgccggacctggaggggcatcatgaaggaggccgtgcgcgtcccggaggtgtcagggaagctcacgttccccatctcgcttaagcagcctggcccaagggatggcactcttaaatgtttcatcaggaggaatcgaactactcagacatattatctgtatattggattaacagaagcattggctgatgatgggaagttcctacttgctgcacgcaagtgtcgtaagcccacatgcacagactacctaatttctcttgataaggttgatatgtcaaagggaagcagcacctatattggcaagctaagatcaaacttccttggaacaaagttcactgtctatgatgctcatccaccatatgatggagctgtggtctcaaagagtcgctctgcacgtgtggttggtttgaaccaggtctcccctagagttccggctgggaattatcctgtttcacatatttcttacgagctgaatgttctgggctccagaggtccaagaaggatgaactgtgttatggattccatcccggcatcagctgtcgaggaaggagggaaagctcctacacagactgaatttccacttagcagtcttgactctttcccatcaattccattcttcagatctaaatcagctcggatagacagttcaacatcgcagtcatccagatcggataggttggtgctgaagaacaagtctcctaggtggcatgaacaactgcagtgttggtgcctgaatttccgtggacgggtcactgttgcttctgttaaaaactttcagttggtagcttctgatgacaatggaccagggaaccaagataataacaaggtcattctccaatttggaaagattggaaaagacttgttcaccatggactaccgttatccaatatcagcatttcaagcttttgcaatttgtctgagcagttttgatacaaaaattgcctgcgaatga

SEQ ID NO: 15419 - protein, 399 aa, Sorghum bicolor
  misc_feature: The sequence is a functional homolog of SEQ ID NO 462 in the 10/666,642 US patent application
  misc_feature: Ceres ANNOT ID no. 8641156
  misc_feature (114)..(393): Pfam ID: Tub Pfam Description: Tub family
MSFRSLIQDMRDEFGSISRHSLRSRSHRSAGNASRAAAAGPSEAMDQSCWAQLPPELLREVLVRIEASESWWPARRDVVSCAGVCRTWRGIMKEAVRVPEVSGKLTFPISLKQPGPRDGTLKCFIRRNRTTQTYYLYIGLTEALADDGKFLLAARKCRKPTCTDYLISLDKVDMSKGSSTYIGKLRSNFLGTKFTVYDAHPPYDGAVVSKSRSARVVGLNQVSPRVPAGNYPVSHISYELNVLGSRGPRRMNCVMDSIPASAVEEGGKAPTQTEFPLSSLDSFPSIPFFRSKSARIDSSTSQSSRSDRLVLKNKSPRWHEQLQCWCLNFRGRVTVASVKNFQLVASDDNGPGNQDNNKVILQFGKIGKDLFTMDYRYPISAFQAFAICLSSFDTKIACE

SEQ ID NO: 15420 - DNA, 777 bp, Sorghum bicolor
  misc_feature: Ceres ANNOT ID no. 8641222
  misc_feature: Encodes the peptide sequence at SEQ ID NO 15421
atgagcaggcgctggagccgcacgatctacgtcggcaacctccccggcgacatccgggagagggaggtggaggatctgttctacaagtatggtagaattgttgacattgacctgaaggtccccccaaggccacctggttatgcttttgttgagtttgaagatgctcgtgatgctgaggatgcaattgctgggcgggatggatacaactttgatggacaccgtctaagagtggaggctgctcatggtggtagaggtaatacttcctcgtatgatcgttcaagtggctttggtggtggcggtggtggagcacgtcgtggtgtgtcgagacactcagagtatcgtgttcttgtcactggactgccttcttctgcatcatggcaggatttaaaggatcatatgcggaaggctggtgatgtctgtttctctgaagtgtatcgcgaaggcggtggcaccgtaggaattgtggactacacaaattatgatgatatgaaatatgctataaagaagctggatgatactgaattcaggaacgcctttgggcgagcctatataagggtgaaggaatatgatggcaaacgtggtcgctcctactcacgtagccgaagcccaagccgtagctacagtaaaagcaggagcccgagcaaatcacccaagactcgccgttcatcatctagatcccggtcgaggtctgtttcttcccgttcaaggtctgcatcaaaaggacgttctccgtcaagactcaattatctcgcccttttaactgggattgtgtggtga

SEQ ID NO: 15421 - protein, 258 aa, Sorghum bicolor
  misc_feature: Useful for making plants with altered alkaloid content
  misc_feature: Useful for making plants with altered lignin content
  misc_feature: Functional homolog of the protein sequence given in SEQ ID NO 13245
  misc_feature: Ceres ANNOT ID no. 8641222
  misc_feature (7)..(80): SWISSPROT Homolog: EC 5.2.1.8 Peptidylprolyl isomerase
  misc_feature (9)..(77): Pfam ID: RRM_1 Pfam Description: RNA recognition motif. (a.k.a. RRM, RBD, or RNP domain)
  misc_feature (115)..(182): Pfam ID: RRM_1 Pfam Description: RNA recognition motif. (a.k.a. RRM, RBD, or RNP domain)
MSRRWSRTIYVGNLPGDIREREVEDLFYKYGRIVDIDLKVPPRPPGYAFVEFEDARDAEDAIAGRDGYNFDGHRLRVEAAHGGRGNTSSYDRSSGFGGGGGGARRGVSRHSEYRVLVTGLPSSASWQDLKDHMRKAGDVCFSEVYREGGGTVGIVDYTNYDDMKYAIKKLDDTEFRNAFGRAYIRVKEYDGKRGRSYSRSRSPSRSYSKSRSPSKSPKTRRSSSRSRSRSVSSRSRSASKGRSPSRLNYLALLTGIVW

SEQ ID NO: 15422 - DNA, 1350 bp, Sorghum bicolor
  misc_feature: Ceres ANNOT ID no. 8641243
  misc_feature: Encodes the peptide sequence at SEQ ID NO 15423
atggcgtcggagccgatcttccgcgggcacgaggagtccctccccacgggcgcccccgggtacacgcccaagcctcacaagccgctggcgcggccgctccggtacctcctggaggagcagcgcctcctgttcgcgctggtgggcatggctgtcacctcggcggtcctcctcacggccccatcgtcgtccaacgggggaggcgccgtcgccgccgccagtggcgcggccgcggcgggtggtagcggtagtctcgcgcggcggcagtactacggcgggtccgcgaacgcggcgctgggtgccgcggtgggcgagcaggagcggcgcgcgagcgcggcgcggctgccgctgggcgtccgtcggcgcgggctgcgcgtggtggtgacgggcggtgccgggttcgtgggcagccacctggtggaccgtctcctggagcgcggcgacagcgtggtggtggtggacaacttcttcacggggcggaaggagaacctggcgcaccaggccgggaacccggcgctggaggtgatccggcacgacgtggtggagcccatcctgctggaggtggaccggatctaccacctggcgtgcccggcgtcgcccgtgcactacaagcacaaccccgtgaagacgatcaagaccaacgtgatgggcacgctcaacatgctgggcctcgccaagcgcgtcggcgccaggttcctgctcaccagcaccagcgaggtgtacggcgacccgctgcagcacccgcaggtggagacctactggggaaacgtcaaccccatcggtgtccggagctgctacgacgagggcaagcgcacggcggagacgctgaccatggactaccaccgcgcagccaacctcgaggtgaggatcgcccggatcttcaacacgtacgggccgcgcatgtgcatcgacgacggccgggtcgtcagcaacttcgtcgcgcaggcgctgaggaaggatcccttgacggtgtacggcgacggcaagcagacgaggagcttccagtacgtgtccgacctggtggagggcctgatgatgctaatggagaaggagcacgtgggcccgttcaacctggggaacccgggcgagttcacgatgctggagctggccaaggtggtgcaggagaccatcgaccggggcgcgcgcatcgtgttccgccccaacaccgccgacgacccgcacaagcgcaagccggacatcacccgcgccaagcagctgctggggtgggagcccaaggtgccgctccgcgagggactcccgctcatggtccacgacttccgcgcccgcatcttcggagtcggggtcggagtcggacaccagcagcagcagcatcgcaacccggcaaatagctag

SEQ ID NO: 15423 - protein, 449 aa, Sorghum bicolor
  misc_feature: Useful for making plants with altered carbohydrate content
  misc_feature: Functional homolog of the protein sequence given in SEQ ID NO 13747
  misc_feature: Useful for making plants with altered cell wall content and/or composition
  misc_feature: Functional homolog of the protein sequence given in SEQ ID NO 13824
  misc_feature: Ceres ANNOT ID no. 8641243
  misc_feature (133)..(429): SWISSPROT Homolog: EC 4.1.1.35 UDP-glucuronate decarboxylase
  misc_feature (125)..(358): Pfam ID: Epimerase Pfam Description: NAD dependent epimerase/dehydratase family
MASEPIFRGHEESLPTGAPGYTPKPHKPLARPLRYLLEEQRLLFALVGMAVTSAVLLTAPSSSNGGGAVAAASGAAAAGGSGSLARRQYYGGSANAALGAAVGEQERRASAARLPLGVRRRGLRVVVTGGAGFVGSHLVDRLLERGDSVVVVDNFFTGRKENLAHQAGNPALEVIRHDVVEPILLEVDRIYHLACPASPVHYKHNPVKTIKTNVMGTLNMLGLAKRVGARFLLTSTSEVYGDPLQHPQVETYWGNVNPIGVRSCYDEGKRTAETLTMDYHRAANLEVRIARIFNTYGPRMCIDDGRVVSNFVAQALRKDPLTVYGDGKQTRSFQYVSDLVEGLMMLMEKEHVGPFNLGNPGEFTMLELAKVVQETIDRGARIVFRPNTADDPHKRKPDITRAKQLLGWEPKVPLREGLPLMVHDFRARIFGVGVGVGHQQQQHRNPANS

SEQ ID NO: 15424 - DNA, 1047 bp, Sorghum bicolor
  misc_feature: Ceres ANNOT ID no. 8641242
  misc_feature: Encodes the peptide sequence at SEQ ID NO 15425
atgcgccagccacggtccgggccggggaagaggcggggccgcgggccgcgcatccccgcggcgacgcttcggaagcagaaggcggcgttggcgaacgtcgaccagatcaccggcgccaagattccgaagagcttcgtcttcgcccgcggcaaactcccctccacgctccgccacctccagcaggacctccgcaaggttatgctcccctacactgctctcaatctcaaggagaagaagcgaaataacctcaaggactttgtcaatgttgccggtccgttgggcgtgtcacatttcctaatcctctcaaaccccaaaagcctgccacatttgcgctttgcgaaatcaccacagggcccaacattcacatttcagatagaggagtactcacttgcggcagacattgcaaactcccagaagcgcccaaggtgcccaccagggatattccaaaactcaccactggttgtacttggtgggttgacaggtctcggcaaccctttcaggagtttggttgaatacttccagcatatgttccctgctgttgacccaagcactgtcaagctggcaacatgccaaaggattctgttgttaaaacatgataaagagaaggatgttattgaattccggcattactccatcaagctccagcctgttggtgtcagtcgcaggattagaaagctcatgcaaaacaatcaagtgcctgatctaggagaatataaagatgttagtgatttcgtgacaaaagctgggtatggatcagaaagtgaagtagatgatgaagcagcaatggtaagcctgccaagtgatgttgacaaattaaaccgggcatcgagaaaaagcgctgtcagactccaggagattggaccaaggatgactatgcgcctaagtaaagttgaagctgggctatgttcaggagatgtcttatactcatggcctgtggaaaaggaagtgggaaagaaaggaacagaaactggggaagaagtagaagaacaagaagaagatgataatgctgaggccactgatgaatccgaggatgagatggaggtatag

SEQ ID NO: 15425 - protein, 348 aa, Sorghum bicolor
  misc_feature: Useful for making plants with modulated biomass
  misc_feature: Functional homolog of the protein sequence given in SEQ ID NO 14186
  misc_feature: Ceres ANNOT ID no. 8641242
  misc_feature (45)..(297): Pfam ID: Brix Pfam Description: Brix domain
MRQPRSGPGKRRGRGPRIPAATLRKQKAALANVDQITGAKIPKSFVFARGKLPSTLRHLQQDLRKVMLPYTALNLKEKKRNNLKDFVNVAGPLGVSHFLILSNPKSLPHLRFAKSPQGPTFTFQIEEYSLAADIANSQKRPRCPPGIFQNSPLVVLGGLTGLGNPFRSLVEYFQHMFPAVDPSTVKLATCQRILLLKHDKEKDVIEFRHYSIKLQPVGVSRRIRKLMQNNQVPDLGEYKDVSDFVTKAGYGSESEVDDEAAMVSLPSDVDKLNRASRKSAVRLQEIGPRMTMRLSKVEAGLCSGDVLYSWPVEKEVGKKGTETGEEVEEQEEDDNAEATDESEDEMEV

SEQ ID NO: 15426 - DNA, 1473 bp, Sorghum bicolor
  misc_feature: Ceres ANNOT ID no. 8641251
  misc_feature: Encodes the peptide sequence at SEQ ID NO 15427
atggagcagcagaccgtcatcctgtacccgagccccggcgtcggccacatcgtccccatggtgcagctcgccaaggtcatcctcacgcacggctacgacgtgaccatggtgatcgccgagccggccgtcagctcgcccgacttccgcatcgtcgacgtcggccgcgtcgctgcctccaaccccgccatcaccttccacgtcctccctccggtcccgtacgccgacctcgccgtccccggcaagcaccacttcctcctcacgctgcaggtgctgcggcggtacaacgacgagctggagaggttcctccgctccatcgtcccgcgccagcgcgtgcactccctggtggccggcatgttctccacctgcgcggtcgacgtcggcgccaagctgggcgtccccgtgtacacgctcttcgcctcagccgccgccaccctggccgtcgtggctcagctgccggcgttgctctccgggaggcgaggagcgggactcaaggagctcggggacacgccgctccggttcctcggcgtgccgccgttcccggcctcccatctcgtcagggagctgctggagcaccccgacgacgacgagctgtgcaggaccatggtggacgtctggacgcgcagcacgacggacgctagcggcgtcctcgtcaacacgttcgagtcgctggagagcccggccgtgcaggcgctgagggatccgcggtgcgtcccggggtgcgtgctgccgccggtctactgcgtgggcccgctgctcatcggcggcgacggcacggccgcagcagcagcggaccaagagcgcgcggcggagaggcgccggcacgagtgcctcgaatggctcgacgcgcagccggagaagagcgtcgtgttcctctgcttcggaagcagatgcgcgcactcggctgagcagctacgggacatcgccgttggccttgataggtctgggcagcggttcctgtgggcggtgcggacgccgccggccggcaccgacgacggcggcggtttggagagtctcgacgacacgctgtttccagaggggttcttggagcggaccaaggaccggggcctcgtcgtgcggtcatgggcgccgcaggttgaggtgctgcgccacccgtcgacgggcgcgttcgtgacgcactgcggatggaactcgacgctggaagccatcaccggaggggtgccgatgctgtgctggccgttctacgcggagcagcagatgaacaaggtgttcgtgaccgagggcatgggcgttggggtggagatggaagggtacagcacgggcttcgtcaaatccgaggaggtggaggccaaggtgaggctggtgatggaatctgaggagggcagccggatcagggtccgagcggcagcactcaagaatgaagcaatagcagcgatgcaggacgacggctcatcacaggcctcgttcgccacgttcttgtttgatgccaagaatcttcatgaacagcttggctag

SEQ ID NO: 15427 - protein, 490 aa, Sorghum bicolor
  misc_feature: Useful for making plants with altered carbohydrate content
  misc_feature: Functional homolog of the protein sequence given in SEQ ID NO 14187
  misc_feature: Ceres ANNOT ID no. 8641251
  misc_feature (212)..(476): SWISSPROT Homolog: EC 2.4.1.218 Hydroquinone glucosyltransferase
  misc_feature (5)..(486): Pfam ID: UDPGT Pfam Description: UDP-glucoronosyl and UDP-glucosyl transferase
MEQQTVILYPSPGVGHIVPMVQLAKVILTHGYDVTMVIAEPAVSSPDFRIVDVGRVAASNPAITFHVLPPVPYADLAVPGKHHFLLTLQVLRRYNDELERFLRSIVPRQRVHSLVAGMFSTCAVDVGAKLGVPVYTLFASAAATLAVVAQLPALLSGRRGAGLKELGDTPLRFLGVPPFPASHLVRELLEHPDDDELCRTMVDVWTRSTTDASGVLVNTFESLESPAVQALRDPRCVPGCVLPPVYCVGPLLIGGDGTAAAAADQERAAERRRHECLEWLDAQPEKSVVFLCFGSRCAHSAEQLRDIAVGLDRSGQRFLWAVRTPPAGTDDGGGLESLDDTLFPEGFLERTKDRGLVVRSWAPQVEVLRHPSTGAFVTHCGWNSTLEAITGGVPMLCWPFYAEQQMNKVFVTEGMGVGVEMEGYSTGFVKSEEVEAKVRLVMESEEGSRIRVRAAALKNEAIAAMQDDGSSQASFATFLFDAKNLHEQLG

SEQ ID NO: 15428 - DNA, 798 bp, Sorghum bicolor
  misc_feature: Ceres ANNOT ID no. 8641260
  misc_feature: Encodes the peptide sequence at SEQ ID NO 15429
atggtgcgtgtgcacaaacctgccctccgtagaggcgtagatcgactagatccgcgtgcagacgtgcacaaatgtggcggagccgaacccattcgtgtgatcgtgtcgacaccagcccctcctctatataaagccttactctttcgactcgacttcgaaaaccctagaacccgcgccgccgccgccgccgccgccgccgccgccggtcctcctcactgctcgccgcgcgttgcaatgggtatcgacctagtcgccggcggccggaacaagaagaccaagcgcaccgcgcccaagtccgacgatgtctacctcaagctcctcgtcaagctgtaccgcttccttgttcggaggaccaagagcaacttcaacgctgtgatcctgaagcggctcttcatgagcaagaccaaccgcccgcctctctcgctccgccgcctcgtcaacttcatggagggcaaggagaatcagattgctgtgatagtgggcaccgtgactgacgacaagagggtctatgaggtaccagcaatgaaggtggctgcgctcaggttcactgagacggccagggcccggattgtgaatgctggtggcgagtgcctcacctttgaccagcttgcgctgcgtgccccgctgggccagaacacggttctgctgaggggacctaagaatgctagggaagctgtgaagcactttggccctgcgcctggtgtgccccacagccacacgaagccatacgtgcgctccaagggcaggaagtttgagaaggcaagaggaaggaggaacagcagaggcttcaaggtctag

SEQ ID NO: 15429 - protein, 265 aa, Sorghum bicolor
  misc_feature: Useful for making plants with modulated nitrogen use efficiency
  misc_feature: Functional homolog of the protein sequence given in SEQ ID NO 14188
  misc_feature: Ceres ANNOT ID no. 8641260
  misc_feature (90)..(263): Pfam ID: Ribosomal_L18e Pfam Description: Eukaryotic ribosomal protein L18
MVRVHKPALRRGVDRLDPRADVHKCGGAEPIRVIVSTPAPPLYKALLFRLDFENPRTRAAAAAAAAAAGPPHCSPRVAMGIDLVAGGRNKKTKRTAPKSDDVYLKLLVKLYRFLVRRTKSNFNAVILKRLFMSKTNRPPLSLRRLVNFMEGKENQIAVIVGTVTDDKRVYEVPAMKVAALRFTETARARIVNAGGECLTFDQLALRAPLGQNTVLLRGPKNAREAVKHFGPAPGVPHSHTKPYVRSKGRKFEKARGRRNSRGFKV

SEQ ID NO: 15430 - DNA, 576 bp, Sorghum bicolor
  misc_feature: Ceres ANNOT ID no. 8641280
  misc_feature: Encodes the peptide sequence at SEQ ID NO 15431
atggccgcaacacaaggcgagagcaacttcgttgcatacgagaaagatgccaagcgcgtgcatacagcagagccgcggcgcagcgtaaacccctgctcctgctccgctataaaatggggtcgcatccccgatgcctccccacgcatctgcatctgcatctcccaggtcaggtggcatcctcaggtctctggccgtggcctgaccaattctaactacacggagcttacccagctatacgagatgtacaaggaccagggttttgagatccttgcgttcccatgcaaccagttcggtgggcaagagcctgccacgagtgaggagatcgtccagtttgtttgcactcgcttcacggccaagtttccaatttttgacaaggttgacgtcaacggcgaagatgctgcacccatctacaagtttctgaaatccagcaaaaccggtcccttcggtgagaacatcaagtggaacttcgccaagttcttggttgacaaaaaggggcatgtcattgagcggtatgctccaaccacttacccactcagcatccagaaggacatcaagaagctgcttgggagttattga

SEQ ID NO: 15431 - protein, 191 aa, Sorghum bicolor
  misc_feature: Useful for making plants with modulated flowering time
  misc_feature: Functional homolog of the protein sequence given in SEQ ID NO 12921
  misc_feature: Useful for making plants with modulated nitrogen use efficiency
  misc_feature: Functional homolog of the protein sequence given in SEQ ID NO 13071
  misc_feature: Ceres ANNOT ID no. 8641280
  misc_feature (62)..(190): SWISSPROT Homolog: EC 1.11.1.12 Phospholipid-hydroperoxide glutathione peroxidase
  misc_feature (42)..(141): Pfam ID: GSHPx Pfam Description: Glutathione peroxidase
MAATQGESNFVAYEKDAKRVHTAEPRRSVNPCSCSAIKWGRIPDASPRICICISQVRWHPQVSGRGLTNSNYTELTQLYEMYKDQGFEILAFPCNQFGGQEPATSEEIVQFVCTRFTAKFPIFDKVDVNGEDAAPIYKFLKSSKTGPFGENIKWNFAKFLVDKKGHVIERYAPTTYPLSIQKDIKKLLGSY

SEQ ID NO: 15432 - DNA, 942 bp, Sorghum bicolor
  misc_feature: Ceres ANNOT ID no. 8641289
  misc_feature: Encodes the peptide sequence at SEQ ID NO 15433
atgtctcgccgtttcgtggcggcggcgtgtgtcgtcgcgaccgtggcgttcgctctcttggcctcgaccagcagcgcgcagctggacccgcacttctacgacaaggcgtgccccgcggctctccccaccatcaagaggctcgtgcaggaggctgtggcggcggagccccgcatgggcgcgtcgctgctgcggctgcacttccacgactgcttcgtcaacgggtgcgacgggtccatcctgctcgacgacacgcccttcttcaccggcgagaagatggccgcgcccaacgccaactccgtccgcggcttcgacgtgatcgaccgcatcaagggcgccgtcaacgccgcctgcaggggcaatgtggtctcctgtgccgacatcgtcgccgtcgcggcacgtgactccgtcgtcgcgctgggaggcccgtcgtacaacgtgccgctgggccgccgggacgcgcggacggcgagccaggcggcggcgaacaacagcatcccggcgccgaccttcagcctggaccgcctcgcctccaacttcgcgtcgcacggcctctccctccaggacctcgtcgtgctgtccggaggccacacgctgggcttcgcccgctgcacaaacttccgggaccgcctctacaacgagaccgccaccctggacggctccctcgccgcctcgctgcgggccgtgtgcccgcgcgccaccggcagcggcgacgacagcctcgcgccgctcgaccccacgccggcgggagtcctccactccgaccagcagctgttcgccggcgggctcggcgtcacggacgctctcgtcaggttctacgccgcgaacgccgacgcgttcaggagggacttcgcggaggccatggtgaggatggccagcctgagctcgctcaccgggagcagcggcgagatccgctacgactgcaggaaagtgaactactcttga

SEQ ID NO: 15433 - protein, 313 aa, Sorghum bicolor
  misc_feature: Useful for making plants with altered carbohydrate content
  misc_feature: Functional homolog of the protein sequence given in SEQ ID NO 13606
  misc_feature: Useful for making plants with altered cell wall content and/or composition
  misc_feature: Functional homolog of the protein sequence given in SEQ ID NO 13605
  misc_feature: Ceres ANNOT ID no. 8641289
  misc_feature (27)..(311): SWISSPROT Homolog: EC 1.11.1.7 Peroxidase
  misc_feature (44)..(275): Pfam ID: peroxidase Pfam Description: Peroxidase
MSRRFVAAACVVATVAFALLASTSSAQLDPHFYDKACPAALPTIKRLVQEAVAAEPRMGASLLRLHFHDCFVNGCDGSILLDDTPFFTGEKMAAPNANSVRGFDVIDRIKGAVNAACRGNVVSCADIVAVAARDSVVALGGPSYNVPLGRRDARTASQAAANNSIPAPTFSLDRLASNFASHGLSLQDLVVLSGGHTLGFARCTNFRDRLYNETATLDGSLAASLRAVCPRATGSGDDSLAPLDPTPAGVLHSDQQLFAGGLGVTDALVRFYAANADAFRRDFAEAMVRMASLSSLTGSSGEIRYDCRKVNYS

SEQ ID NO: 15434 - DNA, 2406 bp, Sorghum bicolor
  misc_feature: Ceres ANNOT ID no. 8641295
  misc_feature: Encodes the peptide sequence at SEQ ID NO 15435
atggatcttgagttcgggagagccctgagatccccaaagagggactcatggaagaccaccttgctgctggcctaccagagcttgggggtggtctatggagacctcagcatatctccgctgtacgtgtactcgagcaccttcgccgaggacatccagcactcggacacgaacgaggagatctttggcgtgctctccttcgtcttctggacgctcaccttgatccctctcatcaagtacgtctccgttgtcctacgagctgacgacaatggcgagggaggaacgtttgccctgtactctctgatttgcaggcacgccaatgtgagccttctcccgaaccggcagattgctgatgaggagctttccacctataaactggaatgccctcctgaaataaccgacaagtcccggatcaaagtgtggcttgagaagcacaggaagctgcgcgttgctctactgatcatggttatgattggcacatgcatggttatcggggatggcgttctcacgccagcaatatctgtttcaggccttgagttttctctgtccaaggatcaccatgaatatgctgtcattccaataacctgtgtcatattagcattcctatttgccctccaacactatggtacacaccgggttggattcctctttgccccgatagttctagcctggctattctgcatgagtgctcttggcctttataatatcatccactggaatcctcacatctacaaagctctaaatccttctcatatgttcaagttcttaaaaaagactagaaagtatggttggatgtcacttggtggaatcttgctctgcatgacagggtcggaagcaatgtttgcagatcttggacacttctcatacagtgcaatccagcttgctttcacttgtctagtttaccccgcactgattctggcatatatgggccaagctgcttacttatcaagacatcatgacttttactctggttcaaaagttggattttacatcgcagttccagataagatcagatggccagtgctcatattggcaatcttggcttcggtagttggaagtcaagcgatcatcagcggaacattctcaatcatcaatcagagccagtccctgagctgctttcctcgagtaaaagttgtacacacatctgagaaaattcatggccaaatatacattcctgagatcaattggttgctcatgatcctctgcattgctgtgaccgttggatttagggacaccaaacacatgggaaatgcatctggtttggctgtgatcacagtgatgctggtgaccacgttcctgacgtccttggtcatcgttctgtgctggcacaggccaccgctgctggcattggctttcctcctgttctttggatccatcgaggcgctctacttctctgcgtccctgatcaagttcctggaaggcgcgtggctgcccatcctgctggcgctgatcctgatggcggtcatgctcatctggcactacaccaccatcaagaagtacgagttcgacctgcacaacaaggtgacactggagtggctcctcgccctcggggacaagctgggcatggtccgcgtccccggcatcggcctcgtgtacacggacctgacgtcgggcgtcccggccaacttctcccggttcgtgaccaacctcccggcgttccaccaggtgctggtgttcgtgtgcgtcaagtcggtgccggtgccgtacgtgttcccggcggagcggtacctcatcgggcgcgtcggcccgccgggccaccgctcgtaccggtgcatcgtgcgctacggctaccgcgacgtgcaccaggacgtggactcgttcgagacggagctcgtggagaccctggccacgttcataaagctggacgcctcgtaccggtgcagcgaggccagcgagcgggagcaggagcaggagctggagcccggcgagcgggagcggcggctgaccgtgatcgcgagccacccgctcaggcaccgcgccagctacgacctccaggacagcatgcagcactcggcagcatccacggtggagatgcgcgccacggccaccgccgcctccgctgacgacgacgacgacagacggagccccgggcgcgcggagatcagctcggcggcagcgggggcgaagcaggtgcggttcttcatcgacagccacgtggcgagcccggagttcgcggagaacaagcaggtggcggaggagctggaggcgctggcggcggcccgggagtgcggcacggcgttcatcctggggcactcgcacgtccagtgcaagcccgggtcgtcggtgctcaagcggctggcggtggacgtcgggtacaacttcctgcggcgcaactgccgcggcccggacgttgcgctgcgcgtgcccccggcgtcgctgctggaggtcggcatggtgtacgtgctttga

SEQ ID NO: 15435 - protein, 801 aa, Sorghum bicolor
  misc_feature: Useful for making plants with modulated biomass
  misc_feature: Functional homolog of the protein sequence given in SEQ ID NO 13565
  misc_feature: Ceres ANNOT ID no. 8641295
  misc_feature (22)..(801): Pfam ID: K_trans Pfam Description: K+ potassium transporter
MDLEFGRALRSPKRDSWKTTLLLAYQSLGVVYGDLSISPLYVYSSTFAEDIQHSDTNEEIFGVLSFVFWTLTLIPLIKYVSVVLRADDNGEGGTFALYSLICRHANVSLLPNRQIADEELSTYKLECPPEITDKSRIKVWLEKHRKLRVALLIMVMIGTCMVIGDGVLTPAISVSGLEFSLSKDHHEYAVIPITCVILAFLFALQHYGTHRVGFLFAPIVLAWLFCMSALGLYNIIHWNPHIYKALNPSHMFKFLKKTRKYGWMSLGGILLCMTGSEAMFADLGHFSYSAIQLAFTCLVYPALILAYMGQAAYLSRHHDFYSGSKVGFYIAVPDKIRWPVLILAILASVVGSQAIISGTFSIINQSQSLSCFPRVKVVHTSEKIHGQIYIPEINWLLMILCIAVTVGFRDTKHMGNASGLAVITVMLVTTFLTSLVIVLCWHRPPLLALAFLLFFGSIEALYFSASLIKFLEGAWLPILLALILMAVMLIWHYTTIKKYEFDLHNKVTLEWLLALGDKLGMVRVPGIGLVYTDLTSGVPANFSRFVTNLPAFHQVLVFVCVKSVPVPYVFPAERYLIGRVGPPGHRSYRCIVRYGYRDVHQDVDSFETELVETLATFIKLDASYRCSEASEREQEQELEPGERERRLTVIASHPLRHRASYDLQDSMQHSAASTVEMRATATAASADDDDDRRSPGRAEISSAAAGAKQVRFFIDSHVASPEFAENKQVAEELEALAAARECGTAFILGHSHVQCKPGSSVLKRLAVDVGYNFLRRNCRGPDVALRVPPASLLEVGMVYVL

SEQ ID NO: 15436 - DNA, 2688 bp, Sorghum bicolor
  misc_feature: Ceres ANNOT ID no. 8641327
  misc_feature: Encodes the peptide sequence at SEQ ID NO 15437
atgagggtcttgctgctgctggcgctgctgctggccgcttgcgccgcggcggcggcgcaggcggcgggaggggccaactccaactccacctccacgccgttcgtgccgcgggacgacatcctgctggactgcggcgccaaggggcagggcaacgacacggacggccgggtgtggaccggggacgcgggctccaagtacgccccgccggacaacctcgcctcggtggcctccgcctccggccaggatccctcggtcccgcaggtgccgtacctcaccgcgcgggtctcggcctcgcccttcacctactccttcccgctcggcccgggccgcaagttcctcaggctccacttctacccggccaactactccaaccgcgacgccgccgacggtctcttctccgtctccgtcgccatcccgggcggaaagctcacgctgctttccaacttcagcgcctaccagacggctgccgcgatcacctactcgtacctcgtccgggagttctccgtcaacgtctcgtcccagacgctcgacctcaccttcaccccggagaagggccaccccaacgcctacgcgttcgtcaacggcatcgaggtcgtatcctcccccgacctcttcgacctctccattcccaacatggttgctggcgacggcagcctccagcagttcgaaatcgatcctggcacggcgatgcagaccatgtaccggctcaacgtcggaggccaggcgatttcgccctccaaggacacgggcggttaccggtcctgggacgacgactcgacctacatctttggcgccagcttcggggtcagctacccgaaggataacaatgtcaccatcacatatccaagcaatgtgccggagtatgtggcgccagaggatgtctacggcacagcgcgttccatgggaccaactaaggaagtgaacatgaacttcaatctcacatggatgttgcaggtggatgctggattcctgtaccttatcaggctgcatttctgtgagatccagtacccgatcacgatgatcaatcagcgggtcttcaacatttacattaacaaccagactgcagtcaagggtgctgatgtgattgcatgggcggccgttagtggtgctaccacccgtattggctctccggtgtatcaggactatgtggtgagcacaccgggtgtaggggccatggatttatggatagctctccatccggatcctgactcaaaaccacaaatatatgatgctatcctcaatgggatggaggtgttcaagttacagcttatcaatggtagccttgcagggctcaatcctatcccaagtgttgccccggccaatgatgggacaactaagaagaagtcaactgttgggcctatcgtcggtggagtggttggaggtttggtggttcttgcacttgggtattgctgcttgtctatgatctgcaagcgtaggaggaatgctgggaaggatgcaggcatgagtgatggacattctggttggctacccctgtctctttatggcaattcacacacttccagttcggccaagtcacacactactggtagctatgcttcatctttgccatccaacctgtgccgtcatttctctttcgctgagatcaaggccgcaacaaaaaactttgatgagtcccttattcttggtgtgggtggatttggtaaagtttaccgtggtgagattgatgggggaacaactaaggtggctatcaagcgtggcaatcccttgtctgagcagggtgtgcatgagttccagactgagattgaaatgctgtccaagctccgccaccgtcatctggtgtcactgattgggtactgcgaggagaagaatgaaatgatcctggtctatgattacatggctcatggtactctccgcgaacacctgtacaagacccagaattcacctcttacctggaggcagcgtttggatatctgcattggtgcagctcgtgggcttcactaccttcacactggtgcaaagcacaccatcatccaccgtgatgtgaagacaacaaacatcctcctggacgagaaatgggttgccaaggtttcagattttggtctgtccaagactggcccatctatggaccatactcatgtgagcacagttgtcaaaggcagttttggttaccttgatcctgaatacttccgcaggcagcagctcacagagaaatctgatgtctactcttttggtgttgtgctgtttgaggtcctctgtgcacggcctgccctgaaccctactcttccaaaagaagaagttagcttggcggagtgggcgttgcactgccagaagaagggcattcttgatcagattgttgacccctacctgaagggaaagatagctccacaatgcttcaagaagtttgctgagacagctgagaagtgtgtttctgatcagggtattgaccgcccttcgatgggtgatgtgctctggaacttggagtttgcccttcagatgcaggaaagcgcagaagagagcggaagccttggttgtgggatgtcggacgagggcactccccttgtgatggtcggaaagaaggatccaaatgacccatcgatcgagtcaagcaccaccaccacaaccaccacttctataagcatgggcgatcaaagcgtcgcgagtatggactcagatgggctgacgcctagtgctgtcttctcacagatcatgaaccccaaggggcggtga

SEQ ID NO: 15437 - protein, 895 aa, Sorghum bicolor
  misc_feature: Useful for making plants with modulated biotic stress sensitivity
  misc_feature: Functional homolog of the protein sequence given in SEQ ID NO 14099
  misc_feature: Ceres ANNOT ID no. 8641327
  misc_feature (530)..(825): SWISSPROT Homolog: EC 2.7.11.1 Non-specific serine/threonine protein kinase
  misc_feature (542)..(813): Pfam ID: Pkinase_Tyr Pfam Description: Protein tyrosine kinase
MRVLLLLALLLAACAAAAAQAAGGANSNSTSTPFVPRDDILLDCGAKGQGNDTDGRVWTGDAGSKYAPPDNLASVASASGQDPSVPQVPYLTARVSASPFTYSFPLGPGRKFLRLHFYPANYSNRDAADGLFSVSVAIPGGKLTLLSNFSAYQTAAAITYSYLVREFSVNVSSQTLDLTFTPEKGHPNAYAFVNGIEVVSSPDLFDLSIPNMVAGDGSLQQFEIDPGTAMQTMYRLNVGGQAISPSKDTGGYRSWDDDSTYIFGASFGVSYPKDNNVTITYPSNVPEYVAPEDVYGTARSMGPTKEVNMNFNLTWMLQVDAGFLYLIRLHFCEIQYPITMINQRVFNIYINNQTAVKGADVIAWAAVSGATTRIGSPVYQDYVVSTPGVGAMDLWIALHPDPDSKPQIYDAILNGMEVFKLQLINGSLAGLNPIPSVAPANDGTTKKKSTVGPIVGGVVGGLVVLALGYCCLSMICKRRRNAGKDAGMSDGHSGWLPLSLYGNSHTSSSAKSHTTGSYASSLPSNLCRHFSFAEIKAATKNFDESLILGVGGFGKVYRGEIDGGTTKVAIKRGNPLSEQGVHEFQTEIEMLSKLRHRHLVSLIGYCEEKNEMILVYDYMAHGTLREHLYKTQNSPLTWRQRLDICIGAARGLHYLHTGAKHTIIHRDVKTTNILLDEKWVAKVSDFGLSKTGPSMDHTHVSTVVKGSFGYLDPEYFRRQQLTEKSDVYSFGVVLFEVLCARPALNPTLPKEEVSLAEWALHCQKKGILDQIVDPYLKGKIAPQCFKKFAETAEKCVSDQGIDRPSMGDVLWNLEFALQMQESAEESGSLGCGMSDEGTPLVMVGKKDPNDPSIESSTTTTTTTSISMGDQSVASMDSDGLTPSAVFSQIMNPKGR

SEQ ID NO: 15438 - DNA, 1209 bp, Sorghum bicolor
  misc_feature: Ceres ANNOT ID no. 8641350
  misc_feature: Encodes the peptide sequence at SEQ ID NO 15439
atgtcatcctctttgcctattctgccaaatcctttgaaagggagcttcccaaagccttgtaacccccagcatattcctatgtcgaggcagctgcctgatgactctatgcccttgcgtaatgacatacatcagtctgctagtttgcacccaagagctggtgttatcggggcaccatattcaggctactctgctagtccacttgattctgtgtctaaccatgatagccagtcaatggttgcaccctatatttctcagtcatccagttttgagtctttccagtctctatctgatactaccccaggaacacacactgaggcagcctggttcacatcttctatggatgtttcaccactctacacagataatattgctgctcctgatgataatcaaatccagagtatacgtcctgctatgacatctgatgagactgctaaacaaaatgattggtgggcagatataatgaatgatgattggaaagttattctagacgcaacagctactgattcacactcaaaagccatgattcaaacttccaactcagctacatcactacctgcagtaaaccagtcagcttcatctcatagtatggagatttgcccagttgctagtcctcccaatagcagcaatgcttcagttgctaaacaacggatgagatggaccccagaactccatgaatgttttgtagatgctgtaaatcagcttggcggtagcgaaaaagctactcccaagggcgtgctaaagcttatgaaagttgatggtttgactatatatcatgtcaaaagccacctgcagaagtaccgcacagctcgctataaaccagacctgtctgaagcgctgcgccttcagatggaagtccagaagcgtcttcatgaacagcttgagttgcggattgaagagcaaggaaagtatctgcagatgatgtttgaaaagcagagtcaatcaagcacggataaagtccaggatccatcctcaagggatacagtggcaaaaccatcatctaccctgagccaatcttcaaacaaggatagtggtgcaaccatggatccaaatggaacaggagacagcacgaagactgcaaaactgggagaacgatcgtctggatcaggtgtcaaccagaaacttgtagagatcgaatctgatactgaaggaggtacagacgatggatgtaagatctcccaagagaagcggcacaaactgcaagatagttaa

SEQ ID NO: 15439 - protein, 402 aa, Sorghum bicolor
  misc_feature: The sequence is a functional homolog of SEQ ID NO 1995 in the 11/479,226 US patent application
  misc_feature: The sequence is a functional homolog of SEQ ID NO 1996 in the 11/479,226 US patent application
  misc_feature: The sequence is a functional homolog of SEQ ID NO 1997 in the 11/479,226 US patent application
  misc_feature: The sequence is a functional homolog of SEQ ID NO 1998 in the 11/479,226 US patent application
  misc_feature: The sequence is a functional homolog of SEQ ID NO 2001 in the 11/479,226 US patent application
  misc_feature: The sequence is a functional homolog of SEQ ID NO 2000 in the 11/479,226 US patent application
  misc_feature: The sequence is a functional homolog of SEQ ID NO 1999 in the 11/479,226 US patent application
  misc_feature: Ceres ANNOT ID no. 8641350
  misc_feature (216)..(267): Pfam ID: Myb_DNA-binding Pfam Description: Myb-like DNA-binding domain
MSSSLPILPNPLKGSFPKPCNPQHIPMSRQLPDDSMPLRNDIHQSASLHPRAGVIGAPYSGYSASPLDSVSNHDSQSMVAPYISQSSSFESFQSLSDTTPGTHTEAAWFTSSMDVSPLYTDNIAAPDDNQIQSIRPAMTSDETAKQNDWWADIMNDDWKVILDATATDSHSKAMIQTSNSATSLPAVNQSASSHSMEICPVASPPNSSNASVAKQRMRWTPELHECFVDAVNQLGGSEKATPKGVLKLMKVDGLTIYHVKSHLQKYRTARYKPDLSEALRLQMEVQKRLHEQLELRIEEQGKYLQMMFEKQSQSSTDKVQDPSSRDTVAKPSSTLSQSSNKDSGATMDPNGTGDSTKTAKLGERSSGSGVNQKLVEIESDTEGGTDDGCKISQEKRHKLQDS

SEQ ID NO: 15440 - DNA, 1137 bp, Sorghum bicolor
  misc_feature: Ceres ANNOT ID no. 8641374
  misc_feature: Encodes the peptide sequence at SEQ ID NO 15441
atggcgaacccggacatgctgccgccggggttccggttccacccgacggacgaggagctcatcctccactacctccgcaaccgcgccgccaacgtgccgtgcccggtcgccatcatcgccgacgtcgacatctacaagttcgatccatgggaccttccatccagggcagcgtacggggacaaggagtggtacttcttcagcccgcgcgaccgcaagtacccaaacgggatccggccgaaccgcgccgcaggatccggctactggaaggccaccggcactgacaagcccatccagagcagcgccaccggcgagagcgtcggcgtcaagaaggcgctcgtcttctacaggggccgcccgcccaagggcaccaagaccaactggatcatgcacgagtaccgcctcgccgccgacgcgcacgccgcacacacctaccgccccatgcagttccgcaacgcctccatgaggctggatgactcggtgctgtgccggatctacaagaaggccagccacgcgccgtccatggcggtgccgccgctctccgaccacgagcaggacgagcccgcctgcggtggtggcggcttcgacgacaacccgtacgccgcgacgagcgccgccatgatcctgcagggcgcgtcgtttccggcgatgcatgccgcgccggccggcgctccgcagaggatgcccaggatcccgtccctctcggagctgctgttcagtgacccctacttcttcgaggagggcggcatgcagcaggacatggcacggctcagtaaccaccaccaccagcagcaggcccctctcctcggccgccccatcacgagccaactgctggtcaacaacggcaacagcatgatgtccggaggagggcagatcccgcagctggacccgccgccggcctcgacgtcggccgctggcgatggcgcagctggcaacaagcgcaagagatcgtcagcagagacgagcactgctagtgccagtttgctgtcgagccagcagcaggcgtcagcaggcaagaaaccgaacggctcctgtttcggtgcaacgacgacgttccaaataggcaacgggctgcagctgcaggggtcgtcgctaggccaccagatgctgcttcattcttctaacatggggatgaactga

SEQ ID NO: 15441 - protein, 378 aa, Sorghum bicolor
  misc_feature: The sequence is a functional homolog of SEQ ID NO 851 in the 10/374,780 US patent application
  misc_feature: Useful for making plants with modulated oxidative stress sensitivity
  misc_feature: Functional homolog of the protein sequence given in SEQ ID NO 13621
  misc_feature: The sequence is a functional homolog of SEQ ID NO 808 in the 10/225,066 US patent application
  misc_feature: The sequence is a functional homolog of SEQ ID NO 926 in the 11/435,388 US patent application
  misc_feature: The sequence is a functional homolog of SEQ ID NO 98 in the 10/374,780 US patent application
  misc_feature: Useful for making plants with altered cell wall content and/or composition
  misc_feature: Useful for making plants with altered lignin content
  misc_feature: Functional homolog of the protein sequence given in SEQ ID NO 13620
  misc_feature: Useful for making plants with altered alkaloid content
  misc_feature: Functional homolog of the protein sequence given in SEQ ID NO 14171
  misc_feature: The sequence is a functional homolog of SEQ ID NO 316 in the 10/412,699 US patent application
  misc_feature: The sequence is a functional homolog of SEQ ID NO 738 in the 11/479,226 US patent application
  misc_feature: The sequence is a functional homolog of SEQ ID NO 890 in the 10/374,780 US patent application
  misc_feature: The sequence is a functional homolog of SEQ ID NO 1036 in the 10/225,066 US patent application
  misc_feature: The sequence is a functional homolog of SEQ ID NO 216 in the 10/666,642 US patent application
  misc_feature: The sequence is a functional homolog of SEQ ID NO 2608 in the 10/374,780 US patent application
  misc_feature: The sequence is a functional homolog of SEQ ID NO 658 in the 11/435,388 US patent application
  misc_feature: The sequence is a functional homolog of SEQ ID NO 880 in the 10/412,699 US patent application
  misc_feature: Useful for making plants with modulated water use efficiency
  misc_feature: The sequence is a functional homolog of SEQ ID NO 891 in the 10/374,780 US patent application
  misc_feature: The sequence is a functional homolog of SEQ ID NO 2060 in the 10/374,780 US patent application
  misc_feature: The sequence is a functional homolog of SEQ ID NO 516 in the 10/412,699 US patent application
  misc_feature: The sequence is a functional homolog of SEQ ID NO 102 in the 10/374,780 US patent application
  misc_feature: The sequence is a functional homolog of SEQ ID NO 886 in the 10/225,066 US patent application
  misc_feature: The sequence is a functional homolog of SEQ ID NO 2012 in the 10/374,780 US patent application
  misc_feature: The sequence is a functional homolog of SEQ ID NO 312 in the 10/412,699 US patent application
  misc_feature: The sequence is a functional homolog of SEQ ID NO 731 in the 11/479,226 US patent application
  misc_feature: The sequence is a functional homolog of SEQ ID NO 2346 in the 10/374,780 US patent application
  misc_feature: The sequence is a functional homolog of SEQ ID NO 238 in the 10/225,068 US patent application
  misc_feature: The sequence is a functional homolog of SEQ ID NO 338 in the 10/412,699 US patent application
  misc_feature: The sequence is a functional homolog of SEQ ID NO 774 in the 11/479,226 US patent application
  misc_feature: Useful for making plants with altered terpenoid content
  misc_feature: Functional homolog of the protein sequence given in SEQ ID NO 13140
  misc_feature: Useful for making plants with modulated nitrogen use efficiency
  misc_feature: Functional homolog of the protein sequence given in SEQ ID NO 13624
  misc_feature: The sequence is a functional homolog of SEQ ID NO 26 in the 10/286,264 US patent application
  misc_feature: The sequence is a functional homolog of SEQ ID NO 336 in the 10/412,699 US patent application
  misc_feature: The sequence is a functional homolog of SEQ ID NO 770 in the 11/479,226 US patent application
  misc_feature: The sequence is a functional homolog of SEQ ID NO 2470 in the 10/374,780 US patent application
  misc_feature: The sequence is a functional homolog of SEQ ID NO 798 in the 10/225,066 US patent application
  misc_feature: Ceres ANNOT ID no. 8641374
  misc_feature (7)..(135): Pfam ID: NAM Pfam Description: No apical meristem (NAM) protein
MANPDMLPPGFRFHPTDEELILHYLRNRAANVPCPVAIIADVDIYKFDPWDLPSRAAYGDKEWYFFSPRDRKYPNGIRPNRAAGSGYWKATGTDKPIQSSATGESVGVKKALVFYRGRPPKGTKTNWIMHEYRLAADAHAAHTYRPMQFRNASMRLDDSVLCRIYKKASHAPSMAVPPLSDHEQDEPACGGGGFDDNPYAATSAAMILQGASFPAMHAAPAGAPQRMPRIPSLSELLFSDPYFFEEGGMQQDMARLSNHHHQQQAPLLGRPITSQLLVNNGNSMMSGGGQIPQLDPPPASTSAAGDGAAGNKRKRSSAETSTASASLLSSQQQASAGKKPNGSCFGATTTFQIGNGLQLQGSSLGHQMLLHSSNMGMN

SEQ ID NO: 15442 - DNA, 1071 bp, Sorghum bicolor
  misc_feature: Ceres ANNOT ID no. 8641378
  misc_feature: Encodes the peptide sequence at SEQ ID NO 15443
atgtctgaggtgtcggtgataaaccaggcggaggtggaggatgcgggtgccgccgggcagctggacctgccgccgggcttccgcttccaccccaccgacgaggagatcatctcgcactacctcacccacaaggccctcaaccaccgcttcatctccggcgtcatcggcgaggtcgacctcaacaagtgcgagccatgggacctcccaggcagggccaagatgggggagaaggagtggtacttcttctgccacaaggatcgcaagtacccgacgggcacgcggaccaaccgcgccaccgagaccggctactggaaggccaccggcaaggacaaggagatcttcaggggccgcggcatcctcgtgggcatgaagaagacgctcgtcttctaccgcggccgcgcgccgcggggagagaagaccggctgggtcatgcacgagtttcgccttgagggcaagctcccgcagccgctcccgcgctccgccaaggacgagtgggccgtgtgcaaggtgttcaacaaggagctggcggcgaggaccgagccaatggcggcggctgtggccggcgccgagctcgagcgcgtcggttcgctgggcttcctcaacgagctcctcgactccgcggagctgccggccctcatcggcgccgacgtggacgaggtgatcgacttcaagggccccgcgtccacctccggcctgcacgccggcgcgccgggcacgagctaccttccggtgaagatggaggagcacgcgctgctgcagcagatgcagtaccagcagcagccgcccccgatgttctactcgagccagtacttctcgctgccggcgatgaactccggcgacctccctccggcgatccggaggtactgcaaggcggagcagcaggtggtgtcgtcggggcagacggcgtcggtggtcagcccgtcccgcgagaccgggctcagcaccgaccgcaacgcggcaggcggcggctacgcggagatctcgtcggcggtgaccccgtcgtcgtcgcaccagttcctgcccgagctcgacgacccggtcctcaacctcgccgacctctggaagtactga

SEQ ID NO: 15443 - protein, 356 aa, Sorghum bicolor
  misc_feature: The sequence is a functional homolog of SEQ ID NO 106 in the 10/225,068 US patent application
  misc_feature: The sequence is a functional homolog of SEQ ID NO 2348 in the 10/374,780 US patent application
  misc_feature: The sequence is a functional homolog of SEQ ID NO 340 in the 10/412,699 US patent application
  misc_feature: The sequence is a functional homolog of SEQ ID NO 778 in the 11/479,226 US patent application
  misc_feature: Useful for making plants with altered lignin content
  misc_feature: Functional homolog of the protein sequence given in SEQ ID NO 13619
  misc_feature: Useful for making plants with altered terpenoid content
  misc_feature: Functional homolog of the protein sequence given in SEQ ID NO 13140
  misc_feature: The sequence is a functional homolog of SEQ ID NO 2346 in the 10/374,780 US patent application
  misc_feature: The sequence is a functional homolog of SEQ ID NO 238 in the 10/225,068 US patent application
  misc_feature: The sequence is a functional homolog of SEQ ID NO 338 in the 10/412,699 US patent application
  misc_feature: The sequence is a functional homolog of SEQ ID NO 774 in the 11/479,226 US patent application
  misc_feature: The sequence is a functional homolog of SEQ ID NO 326 in the 10/412,699 US patent application
  misc_feature: The sequence is a functional homolog of SEQ ID NO 760 in the 11/479,226 US patent application
  misc_feature: Useful for making plants with modulated light quality sensitivity
  misc_feature: Functional homolog of the protein sequence given in SEQ ID NO 13618
  misc_feature: The sequence is a functional homolog of SEQ ID NO 2776 in the 10/374,780 US patent application
  misc_feature: The sequence is a functional homolog of SEQ ID NO 416 in the 10/225,066 US patent application
  misc_feature: The sequence is a functional homolog of SEQ ID NO 476 in the 10/666,642 US patent application
  misc_feature: The sequence is a functional homolog of SEQ ID NO 2470 in the 10/374,780 US patent application
  misc_feature: The sequence is a functional homolog of SEQ ID NO 798 in the 10/225,066 US patent application
  misc_feature: The sequence is a functional homolog of SEQ ID NO 1196 in the 10/412,699 US patent application
  misc_feature: The sequence is a functional homolog of SEQ ID NO 865 in the 10/374,780 US patent application
  misc_feature: Useful for making plants with altered carbohydrate content
  misc_feature: Functional homolog of the protein sequence given in SEQ ID NO 13622
  misc_feature: The sequence is a functional homolog of SEQ ID NO 104 in the 10/225,068 US patent application
  misc_feature: The sequence is a functional homolog of SEQ ID NO 2014 in the 10/374,780 US patent application
  misc_feature: The sequence is a functional homolog of SEQ ID NO 22 in the 10/286,264 US patent application
  misc_feature: The sequence is a functional homolog of SEQ ID NO 314 in the 10/412,699 US patent application
  misc_feature: The sequence is a functional homolog of SEQ ID NO 734 in the 11/479,226 US patent application
  misc_feature: The sequence is a functional homolog of SEQ ID NO 1197 in the 10/412,699 US patent application
  misc_feature: The sequence is a functional homolog of SEQ ID NO 866 in the 10/374,780 US patent application
  misc_feature: Useful for biocontainment applications
  misc_feature: Functional homolog of the protein sequence given in SEQ ID NO 13623
  misc_feature: Useful for making plants with modulated oxidative stress sensitivity
  misc_feature: Functional homolog of the protein sequence given in SEQ ID NO 13621
  misc_feature: The sequence is a functional homolog of SEQ ID NO 2478 in the 10/374,780 US patent application
  misc_feature: The sequence is a functional homolog of SEQ ID NO 572 in the 10/225,066 US patent application
  misc_feature: The sequence is a functional homolog of SEQ ID NO 132 in the 10/225,066 US patent application
  misc_feature: The sequence is a functional homolog of SEQ ID NO 1508 in the 10/666,642 US patent application
  misc_feature: The sequence is a functional homolog of SEQ ID NO 1924 in the 10/412,699 US patent application
  misc_feature: The sequence is a functional homolog of SEQ ID NO 2186 in the 10/374,780 US patent application
  misc_feature: The sequence is a functional homolog of SEQ ID NO 564 in the 11/435,388 US patent application
  misc_feature: The sequence is a functional homolog of SEQ ID NO 808 in the 10/225,066 US patent application
  misc_feature: The sequence is a functional homolog of SEQ ID NO 926 in the 11/435,388 US patent application
  misc_feature: The sequence is a functional homolog of SEQ ID NO 98 in the 10/374,780 US patent application
  misc_feature: The sequence is a functional homolog of SEQ ID NO 102 in the 10/374,780 US patent application
  misc_feature: The sequence is a functional homolog of SEQ ID NO 886 in the 10/225,066 US patent application
  misc_feature: The sequence is a functional homolog of SEQ ID NO 2060 in the 10/374,780 US patent application
  misc_feature: The sequence is a functional homolog of SEQ ID NO 516 in the 10/412,699 US patent application
  misc_feature: The sequence is a functional homolog of SEQ ID NO 316 in the 10/412,699 US patent application
  misc_feature: The sequence is a functional homolog of SEQ ID NO 738 in the 11/479,226 US patent application
  misc_feature: The sequence is a functional homolog of SEQ ID NO 100 in the 10/374,780 US patent application
  misc_feature: The sequence is a functional homolog of SEQ ID NO 318 in the 10/412,699 US patent application
  misc_feature: The sequence is a functional homolog of SEQ ID NO 749 in the 11/479,226 US patent application
  misc_feature: The sequence is a functional homolog of SEQ ID NO 884 in the 10/225,066 US patent application
  misc_feature: The sequence is a functional homolog of SEQ ID NO 2012 in the 10/374,780 US patent application
  misc_feature: The sequence is a functional homolog of SEQ ID NO 312 in the 10/412,699 US patent application
  misc_feature: The sequence is a functional homolog of SEQ ID NO 731 in the 11/479,226 US patent application
  misc_feature: The sequence is a functional homolog of SEQ ID NO 26 in the 10/286,264 US patent application
  misc_feature: The sequence is a functional homolog of SEQ ID NO 336 in the 10/412,699 US patent application
  misc_feature: The sequence is a functional homolog of SEQ ID NO 770 in the 11/479,226 US patent application
  misc_feature: Ceres ANNOT ID no. 8641378
  misc_feature: Up-regulated in root tissues in response to methyl jasmonate treatment
  misc_feature: Up-regulated in shoot tissues in response to methyl jasmonate treatment
  misc_feature (23)..(150): Pfam ID: NAM Pfam Description: No apical meristem (NAM) protein
MSEVSVINQAEVEDAGAAGQLDLPPGFRFHPTDEEIISHYLTHKALNHRFISGVIGEVDLNKCEPWDLPGRAKMGEKEWYFFCHKDRKYPTGTRTNRATETGYWKATGKDKEIFRGRGILVGMKKTLVFYRGRAPRGEKTGWVMHEFRLEGKLPQPLPRSAKDEWAVCKVFNKELAARTEPMAAAVAGAELERVGSLGFLNELLDSAELPALIGADVDEVIDFKGPASTSGLHAGAPGTSYLPVKMEEHALLQQMQYQQQPPPMFYSSQYFSLPAMNSGDLPPAIRRYCKAEQQVVSSGQTASVVSPSRETGLSTDRNAAGGGYAEISSAVTPSSSHQFLPELDDPVLNLADLWKY

SEQ ID NO: 15444 - DNA, 489 bp, Sorghum bicolor
  misc_feature: Ceres ANNOT ID no. 8641371
  misc_feature: Up-regulated in root tissues in response to methyl jasmonate treatment
  misc_feature: Up-regulated in shoot tissues in response to methyl jasmonate treatment
  misc_feature: Encodes the peptide sequence at SEQ ID NO 15445
atggcgaacccggacatgctgccgccggggttccggttccacccgacggacgaggagctcatcctccactacctccgcaaccgcgccgccaacgtgccgtgcccggtcgccatcatcgccgacgtcgacatctacaagttcgatccatgggaccttccatccagggcagcgtacggggacaaggagtggtacttcttcagcccgcgcgaccgcaagtacccaaacgggatccggccgaaccgcgccgcaggatccggctactggaaggccaccggcactgacaagcccatccagagcagcgccaccggcgagagcgtcggcgtcaagaaggcgctcgtcttctacaggggccgcccgcccaagggcaccaagaccaactggatcatgcacgagtaccgcctcgccgccgacgcgcacgccgcacacacctaccgccccatgcagttccgcaacgcctccatgagggtacgagatgatatacgttgttga

SEQ ID NO: 15445 - protein, 162 aa, Sorghum bicolor
  misc_feature: The sequence is a functional homolog of SEQ ID NO 851 in the 10/374,780 US patent application
  misc_feature: The sequence is a functional homolog of SEQ ID NO 854 in the 10/374,780 US patent application
  misc_feature: The sequence is a functional homolog of SEQ ID NO 1012 in the 11/435,388 US patent application
  misc_feature: Useful for making plants with modulated oxidative stress sensitivity
  misc_feature: Functional homolog of the protein sequence given in SEQ ID NO 13621
  misc_feature: Useful for making plants with altered cell wall content and/or composition
  misc_feature: Useful for making plants with altered lignin content
  misc_feature: Functional homolog of the protein sequence given in SEQ ID NO 13620
  misc_feature: The sequence is a functional homolog of SEQ ID NO 808 in the 10/225,066 US patent application
  misc_feature: The sequence is a functional homolog of SEQ ID NO 926 in the 11/435,388 US patent application
  misc_feature: The sequence is a functional homolog of SEQ ID NO 98 in the 10/374,780 US patent application
  misc_feature: The sequence is a functional homolog of SEQ ID NO 2110 in the 10/374,780 US patent application
  misc_feature: The sequence is a functional homolog of SEQ ID NO 304 in the 10/225,066 US patent application
  misc_feature: The sequence is a functional homolog of SEQ ID NO 954 in the 11/435,388 US patent application
  misc_feature: Useful for making plants with altered alkaloid content
  misc_feature: Functional homolog of the protein sequence given in SEQ ID NO 14171
  misc_feature: The sequence is a functional homolog of SEQ ID NO 316 in the 10/412,699 US patent application
  misc_feature: The sequence is a functional homolog of SEQ ID NO 738 in the 11/479,226 US patent application
  misc_feature: The sequence is a functional homolog of SEQ ID NO 853 in the 10/374,780 US patent application
  misc_feature: The sequence is a functional homolog of SEQ ID NO 890 in the 10/374,780 US patent application
  misc_feature: The sequence is a functional homolog of SEQ ID NO 891 in the 10/374,780 US patent application
  misc_feature: The sequence is a functional homolog of SEQ ID NO 104 in the 10/225,068 US patent application
  misc_feature: The sequence is a functional homolog of SEQ ID NO 2014 in the 10/374,780 US patent application
  misc_feature: The sequence is a functional homolog of SEQ ID NO 22 in the 10/286,264 US patent application
  misc_feature: The sequence is a functional homolog of SEQ ID NO 314 in the 10/412,699 US patent application
  misc_feature: The sequence is a functional homolog of SEQ ID NO 734 in the 11/479,226 US patent application
  misc_feature: The sequence is a functional homolog of SEQ ID NO 2060 in the 10/374,780 US patent application
  misc_feature: The sequence is a functional homolog of SEQ ID NO 516 in the 10/412,699 US patent application
  misc_feature: The sequence is a functional homolog of SEQ ID NO 1036 in the 10/225,066 US patent application
  misc_feature: The sequence is a functional homolog of SEQ ID NO 216 in the 10/666,642 US patent application
  misc_feature: The sequence is a functional homolog of SEQ ID NO 2608 in the 10/374,780 US patent application
  misc_feature: The sequence is a functional homolog of SEQ ID NO 658 in the 11/435,388 US patent application
  misc_feature: The sequence is a functional homolog of SEQ ID NO 880 in the 10/412,699 US patent application
  misc_feature: Useful for making plants with modulated water use efficiency
  misc_feature: The sequence is a functional homolog of SEQ ID NO 1157 in the 11/479,226 US patent application
  misc_feature: The sequence is a functional homolog of SEQ ID NO 1416 in the 10/666,642 US patent application
  misc_feature: The sequence is a functional homolog of SEQ ID NO 30 in the 10/286,264 US patent application
  misc_feature: The sequence is a functional homolog of SEQ ID NO 430 in the 11/435,388 US patent application
  misc_feature: The sequence is a functional homolog of SEQ ID NO 518 in the 10/412,699 US patent application
  misc_feature: Useful for making plants with modulated light quality response
  misc_feature: Functional homolog of the protein sequence given in SEQ ID NO 13870
  misc_feature: Useful for making plants with altered terpenoid content
  misc_feature: Functional homolog of the protein sequence given in SEQ ID NO 13966
  misc_feature: The sequence is a functional homolog of SEQ ID NO 102 in the 10/374,780 US patent application
  misc_feature: The sequence is a functional homolog of SEQ ID NO 886 in the 10/225,066 US patent application
  misc_feature: The sequence is a functional homolog of SEQ ID NO 2012 in the 10/374,780 US patent application
  misc_feature: The sequence is a functional homolog of SEQ ID NO 312 in the 10/412,699 US patent application
  misc_feature: The sequence is a functional homolog of SEQ ID NO 731 in the 11/479,226 US patent application
  misc_feature: The sequence is a functional homolog of SEQ ID NO 852 in the 10/374,780 US patent application
  misc_feature: The sequence is a functional homolog of SEQ ID NO 320 in the 10/374,780 US patent application
  misc_feature: The sequence is a functional homolog of SEQ ID NO 850 in the 10/225,066 US patent application
  misc_feature: The sequence is a functional homolog of SEQ ID NO 2592 in the 10/374,780 US patent application
  misc_feature: The sequence is a functional homolog of SEQ ID NO 288 in the 10/225,066 US patent application
  misc_feature: The sequence is a functional homolog of SEQ ID NO 2418 in the 10/374,780 US patent application
  misc_feature: The sequence is a functional homolog of SEQ ID NO 554 in the 10/225,066 US patent application
  misc_feature: The sequence is a functional homolog of SEQ ID NO 68 in the 10/286,264 US patent application
  misc_feature: The sequence is a functional homolog of SEQ ID NO 2776 in the 10/374,780 US patent application
  misc_feature: The sequence is a functional homolog of SEQ ID NO 416 in the 10/225,066 US patent application
  misc_feature: The sequence is a functional homolog of SEQ ID NO 492 in the 11/435,388 US patent application
  misc_feature: The sequence is a functional homolog of SEQ ID NO 741 in the 11/479,226 US patent application
  misc_feature: The sequence is a functional homolog of SEQ ID NO 2346 in the 10/374,780 US patent application
  misc_feature: The sequence is a functional homolog of SEQ ID NO 238 in the 10/225,068 US patent application
  misc_feature: The sequence is a functional homolog of SEQ ID NO 338 in the 10/412,699 US patent application
  misc_feature: The sequence is a functional homolog of SEQ ID NO 774 in the 11/479,226 US patent application
  misc_feature: The sequence is a functional homolog of SEQ ID NO 326 in the 10/412,699 US patent application
  misc_feature: The sequence is a functional homolog of SEQ ID NO 760 in the 11/479,226 US patent application
  misc_feature: The sequence is a functional homolog of SEQ ID NO 2 in US patent 7230164
  misc_feature: The sequence is a functional homolog of SEQ ID NO 6 in US patent 7230160
  misc_feature: The sequence is a functional homolog of SEQ ID NO 116 in the 10/225,066 US patent application
  misc_feature: The sequence is a functional homolog of SEQ ID NO 2476 in the 10/374,780 US patent application
  misc_feature: The sequence is a functional homolog of SEQ ID NO 88 in the 11/375,241 US patent application
  misc_feature: Useful for making plants with modulated light quality sensitivity
  misc_feature: Functional homolog of the protein sequence given in SEQ ID NO 13618
  misc_feature: The sequence is a functional homolog of SEQ ID NO 476 in the 10/666,642 US patent application
  misc_feature: Useful for making plants with modulated nitrogen use efficiency
  misc_feature: Functional homolog of the protein sequence given in SEQ ID NO 13624
  misc_feature: The sequence is a functional homolog of SEQ ID NO 1064 in the 10/225,066 US patent application
  misc_feature: The sequence is a functional homolog of SEQ ID NO 2838 in the 10/374,780 US patent application
  misc_feature: The sequence is a functional homolog of SEQ ID NO 682 in the 11/435,388 US patent application
  misc_feature: The sequence is a functional homolog of SEQ ID NO 2840 in the 10/374,780 US patent application
  misc_feature: The sequence is a functional homolog of SEQ ID NO 450 in the 10/225,066 US patent application
  misc_feature: The sequence is a functional homolog of SEQ ID NO 106 in the 10/225,068 US patent application
  misc_feature: The sequence is a functional homolog of SEQ ID NO 2348 in the 10/374,780 US patent application
  misc_feature: The sequence is a functional homolog of SEQ ID NO 340 in the 10/412,699 US patent application
  misc_feature: The sequence is a functional homolog of SEQ ID NO 778 in the 11/479,226 US patent application
  misc_feature: The sequence is a functional homolog of SEQ ID NO 328 in the 10/374,780 US patent application
  misc_feature: The sequence is a functional homolog of SEQ ID NO 852 in the 10/225,066 US patent application
  misc_feature: The sequence is a functional homolog of SEQ ID NO 26 in the 10/286,264 US patent application
  misc_feature: The sequence is a functional homolog of SEQ ID NO 336 in the 10/412,699 US patent application
  misc_feature: The sequence is a functional homolog of SEQ ID NO 770 in the 11/479,226 US patent application
  misc_feature: The sequence is a functional homolog of SEQ ID NO 2472 in the 10/374,780 US patent application
  misc_feature: The sequence is a functional homolog of SEQ ID NO 520 in the 11/435,388 US patent application
  misc_feature: The sequence is a functional homolog of SEQ ID NO 974 in the 10/225,066 US patent application
  misc_feature: The sequence is a functional homolog of SEQ ID NO 2590 in the 10/374,780 US patent application
  misc_feature: The sequence is a functional homolog of SEQ ID NO 286 in the 10/225,066 US patent application
  misc_feature: Useful for making plants with modulated biomass
  misc_feature: The sequence is a functional homolog of SEQ ID NO 612 in the 11/435,388 US patent application
  misc_feature: The sequence is a functional homolog of SEQ ID NO 1365 in the 11/479,226 US patent application
  misc_feature: The sequence is a functional homolog of SEQ ID NO 2474 in the 10/374,780 US patent application
  misc_feature: The sequence is a functional homolog of SEQ ID NO 744 in the 10/225,066 US patent application
  misc_feature: The sequence is a functional homolog of SEQ ID NO 2478 in the 10/374,780 US patent application
  misc_feature: The sequence is a functional homolog of SEQ ID NO 572 in the 10/225,066 US patent application
  misc_feature: The sequence is a functional homolog of SEQ ID NO 2470 in the 10/374,780 US patent application
  misc_feature: The sequence is a functional homolog of SEQ ID NO 798 in the 10/225,066 US patent application
  misc_feature: The sequence is a functional homolog of SEQ ID NO 1729 in the 11/479,226 US patent application
  misc_feature: The sequence is a functional homolog of SEQ ID NO 1270 in the 10/374,780 US patent application
  misc_feature: The sequence is a functional homolog of SEQ ID NO 1423 in the 10/412,699 US patent application
  misc_feature: The sequence is a functional homolog of SEQ ID NO 898 in the 10/666,642 US patent application
  misc_feature: Useful for making plants with altered carbohydrate content
  misc_feature: Functional homolog of the protein sequence given in SEQ ID NO 13685
  misc_feature: The sequence is a functional homolog of SEQ ID NO 2416 in the 10/374,780 US patent application
  misc_feature: The sequence is a functional homolog of SEQ ID NO 914 in the 10/225,066 US patent application
  misc_feature: The sequence is a functional homolog of SEQ ID NO 1196 in the 10/412,699 US patent application
  misc_feature: The sequence is a functional homolog of SEQ ID NO 865 in the 10/374,780 US patent application
  misc_feature: The sequence is a functional homolog of SEQ ID NO 160 in the 10/666,642 US patent application
  misc_feature: The sequence is a functional homolog of SEQ ID NO 634 in the 10/412,699 US patent application
  misc_feature: The sequence is a functional homolog of SEQ ID NO 638 in the 11/435,388 US patent application
  misc_feature: The sequence is a functional homolog of SEQ ID NO 2168 in the 10/374,780 US patent application
  misc_feature: The sequence is a functional homolog of SEQ ID NO 370 in the 10/666,642 US patent application
  misc_feature: The sequence is a functional homolog of SEQ ID NO 194 in the 10/374,780 US patent application
  misc_feature: The sequence is a functional homolog of SEQ ID NO 898 in the 10/225,066 US patent application
  misc_feature: The sequence is a functional homolog of SEQ ID NO 132 in the 10/225,066 US patent application
  misc_feature: The sequence is a functional homolog of SEQ ID NO 1508 in the 10/666,642 US patent application
  misc_feature: The sequence is a functional homolog of SEQ ID NO 1924 in the 10/412,699 US patent application
  misc_feature: The sequence is a functional homolog of SEQ ID NO 2186 in the 10/374,780 US patent application
  misc_feature: The sequence is a functional homolog of SEQ ID NO 564 in the 11/435,388 US patent application
  misc_feature: Useful for biocontainment applications
  misc_feature: Functional homolog of the protein sequence given in SEQ ID NO 12949
  misc_feature: The sequence is a functional homolog of SEQ ID NO 1198 in the 10/412,699 US patent application
  misc_feature: The sequence is a functional homolog of SEQ ID NO 867 in the 10/374,780 US patent application
  misc_feature: The sequence is a functional homolog of SEQ ID NO 162 in the 10/225,068 US patent application
  misc_feature: The sequence is a functional homolog of SEQ ID NO 2414 in the 10/374,780 US patent application
  misc_feature: The sequence is a functional homolog of SEQ ID NO 428 in the 11/435,388 US patent application
  misc_feature: The sequence is a functional homolog of SEQ ID NO 508 in the 10/412,699 US patent application
  misc_feature: The sequence is a functional homolog of SEQ ID NO 728 in the 10/225,066 US patent application
  misc_feature: The sequence is a functional homolog of SEQ ID NO 745 in the 11/479,226 US patent application
  misc_feature: The sequence is a functional homolog of SEQ ID NO 854 in the 11/435,388 US patent application
  misc_feature: The sequence is a functional homolog of SEQ ID NO 142 in the 10/286,264 US patent application
  misc_feature: The sequence is a functional homolog of SEQ ID NO 324 in the 10/412,699 US patent application
  misc_feature: The sequence is a functional homolog of SEQ ID NO 756 in the 11/479,226 US patent application
  misc_feature: The sequence is a functional homolog of SEQ ID NO 344 in the 10/666,642 US patent application
  misc_feature: The sequence is a functional homolog of SEQ ID NO 310 in the 10/666,642 US patent application
  misc_feature: The sequence is a functional homolog of SEQ ID NO 886 in the 10/412,699 US patent application
  misc_feature: The sequence is a functional homolog of SEQ ID NO 240 in the 10/225,068 US patent application
  misc_feature: The sequence is a functional homolog of SEQ ID NO 368 in the 10/374,780 US patent application
  misc_feature: The sequence is a functional homolog of SEQ ID NO 1197 in the 10/412,699 US patent application
  misc_feature: The sequence is a functional homolog of SEQ ID NO 866 in the 10/374,780 US patent application
  misc_feature: The sequence is a functional homolog of SEQ ID NO 1816 in the 11/479,226 US patent application
  misc_feature: The sequence is a functional homolog of SEQ ID NO 2112 in the 10/374,780 US patent application
  misc_feature: The sequence is a functional homolog of SEQ ID NO 100 in the 10/374,780 US patent application
  misc_feature: The sequence is a functional homolog of SEQ ID NO 318 in the 10/412,699 US patent application
  misc_feature: The sequence is a functional homolog of SEQ ID NO 749 in the 11/479,226 US patent application
  misc_feature: The sequence is a functional homolog of SEQ ID NO 884 in the 10/225,066 US patent application
  misc_feature: The sequence is a functional homolog of SEQ ID NO 582 in the 10/666,642 US patent application
  misc_feature: The sequence is a functional homolog of SEQ ID NO 1452 in the 10/666,642 US patent application
  misc_feature: The sequence is a functional homolog of SEQ ID NO 158 in the 10/225,066 US patent application
  misc_feature: The sequence is a functional homolog of SEQ ID NO 226 in the 10/666,642 US patent application
  misc_feature: The sequence is a functional homolog of SEQ ID NO 242 in the 10/714,887 US patent application
  misc_feature: The sequence is a functional homolog of SEQ ID NO 242 in the 11/435,388 US patent application
  misc_feature: The sequence is a functional homolog of SEQ ID NO 280 in the 10/374,780 US patent application
  misc_feature: The sequence is a functional homolog of SEQ ID NO 68 in the 10/225,068 US patent application
  misc_feature: Ceres ANNOT ID no. 8641371
  misc_feature (7)..(135): Pfam ID: NAM Pfam Description: No apical meristem (NAM) protein
MANPDMLPPGFRFHPTDEELILHYLRNRAANVPCPVAIIADVDIYKFDPWDLPSRAAYGDKEWYFFSPRDRKYPNGIRPNRAAGSGYWKATGTDKPIQSSATGESVGVKKALVFYRGRPPKGTKTNWIMHEYRLAADAHAAHTYRPMQFRNASMRVRDDIRC

SEQ ID NO: 15446 - DNA, 1311 bp, Sorghum bicolor
  misc_feature: Ceres ANNOT ID no. 8641364
  misc_feature: Encodes the peptide sequence at SEQ ID NO 15447
atgcttcgggcaggagcctcctcgctcgcagccgcggcgccatgtgtgccatggagcttcctggtctacggtggccctgacgctcctgtggcatgccggccgtctgctgcaccggctgtggtggcgttcccggcggctggagcgcgcggcgtggcacgccgcaccgcctcctggcgagcgacctcagggaggatgaacagggaggcgtggtcgacgcccctgccgctgcggtgccacgacatcgcgccccgcgcctctgcaggaacgtgcgggagcacgggaagcaggcgtgccttctctggtggccagggacgtgctgtccaacaagtccgggcacctggagaagcccaatttcccggcactgaccaagctgctctcgccgacggcgtcgcgggcctcgagggagagaagtgggtcaagcacaggaggatccccaaccccacattccatgtcgagctcaaaggtatgctgccggcgttctccacgtgctgcgacgagctggttagcagatgggtggagtctgtgaagagctccgacggttggtatttgccgaccaaaaacaacaggagcatgcacgaaatcaacaacgaagtcagctcgctcttacgaggattgatcgagaaacgaatgcaggccatgaaagaaggctcgaacatgagagagacggacgagcatggccggtccaccctggggatgacaatcgaagacgtcatcgaggagtgcaagctcttctacttcgcaggcatggagaccacgtctgtgctgctaacctgggcaatggtcctgctatgcatgcacccggagtggcaggaccgtgcgagagaggaggtctttggcctgttcgggaaaaacaagccggaatacgatggctcagccggctcaaaactaccagagctgacaatgattcttcacgaagttctccggctgtaccctccggccatcacgatcagccggaaaacgtacaaggagatggagaccggcggcgtcagataccctgccggggttgtggtcgaactgcccgtgctgcttatccaccatgacccggatctctggggcagcgacgcgcacgagttcaggccggacaggttcgccgagggggtctccaaggcgcccgccgcgttcttcccgttcggctgggggccacgcacctgcatcggtcagaacttcgcgctgctcgaggccaagatggctctgagcatgatccttcagtggttcgagttcgagctcgcgccatcctacactcatgagccacgcaccgtgatcacactgcacccgatgcatggggcacagattaagctcaaggcactctga

SEQ ID NO: 15447 - protein, 436 aa, Sorghum bicolor
  misc_feature: Useful for making plants with modulated cold sensitivity
  misc_feature: Functional homolog of the protein sequence given in SEQ ID NO 14189
  misc_feature: Useful for biocontainment applications
  misc_feature: Useful for making plants with modulated biomass
  misc_feature: Useful for making plants with modulated flowering time
  misc_feature: Functional homolog of the protein sequence given in SEQ ID NO 14190
  misc_feature: Useful for making plants with modulated nitrogen use efficiency
  misc_feature: Functional homolog of the protein sequence given in SEQ ID NO 14191
  misc_feature: Ceres ANNOT ID no. 8641364
  misc_feature (180)..(436): SWISSPROT Homolog: EC 1.3.3.9 Secologanin synthase
  misc_feature (44)..(433): Pfam ID: p450 Pfam Description: Cytochrome P450
MLRAGASSLAAAAPCVPWSFLVYGGPDAPVACRPSAAPAVVAFPAAGARGVARRTASWRATSGRMNREAWSTPLPLRCHDIAPRASAGTCGSTGSRRAFSGGQGRAVQQVRAPGEAQFPGTDQAALADGVAGLEGEKWVKHRRIPNPTFHVELKGMLPAFSTCCDELVSRWVESVKSSDGWYLPTKNNRSMHEINNEVSSLLRGLIEKRMQAMKEGSNMRETDEHGRSTLGMTIEDVIEECKLFYFAGMETTSVLLTWAMVLLCMHPEWQDRAREEVFGLFGKNKPEYDGSAGSKLPELTMILHEVLRLYPPAITISRKTYKEMETGGVRYPAGVVVELPVLLIHHDPDLWGSDAHEFRPDRFAEGVSKAPAAFFPFGWGPRTCIGQNFALLEAKMALSMILQWFEFELAPSYTHEPRTVITLHPMHGAQIKLKAL

SEQ ID NO: 15448 - DNA, 1389 bp, Sorghum bicolor
  misc_feature: Ceres ANNOT ID no. 8641401
  misc_feature: Encodes the peptide sequence at SEQ ID NO 15449
atggccgcctcctcctcctcctcctcctcctgccggagcccgctcgtctggctcttcgcgctcgccgccgcgctcttcttcttctcctggtacctcctcctcgactccgccgcgggcccagccgccgcccgccgccccaaccagtggctccgcctcggcggcgccgggcccggtaggaaatgcgaccccgccgaggcgctgctgcgagtgttcatgtacgacctgccccccgagttccacttcggcctgctcgactggaagccccccgggttcggcggcggcgtgtggcccgacgtcagggacggcgtgccggaatacccgggggggctcaacctacagcacagcatcgagtactggctcaccctcgacctcctggcctccgagcagggcgcgcccacgccctgcgcggcggtgcgggtgcgccgcgcggcggacgccgacgtcgtcttcgtgcccttcttcgcctcgctcagcttcaaccgccactcccgggtcgtgccgcccgcgcgggacagcgaggaccgcgccctgcagcggaggctcctcgagttcctcgccgcgcggcccgagtggcggaggaccggagggcgggaccacgtcgtgctcgcgcaccaccccaacgggatgctcgacgcgcgctacaggttctggccctgcgtcttcgtgctctgtgacttcgggaggtacccgcccagcgtcgccaaccttgacaaggacgtcatcgcgccctaccggcacctcgtcgccaatttcgctaatgacaccgccggatacgatgaccggccgacgctgctctacttccaaggtgccatctacaggaaagatggtggttccatccggcaggaactgtattaccttctgaaagacgagaaagatgtgcatttctcatttggaagtgtagctggtaatgggatcgagcaatcaacacatgggatgcggtcatccaagttctgcctcaacattgcaggtgacactccatcgtccaaccgcctcttcgactccatagtcagtcactgtgttcctgtcatcatcagcgatgagattgagctcccgtttgaggatgtccttgactactcaaagttcagtgtcatagtacgtggcgcagacgcggtcaagaaggggtttctaatgagcctgatcacagggatcagccaagaagagtgggcacacatgtggaacaagctaaaggaagtagaaaagcactttgtgtaccaatacccatctcagactgatgatgccgtgcagatgatatggaaggctattgctcggaaggtgccctctatccggctgaagattaacagactacaaagattttctcggtttgatactaacaggacagatgagactctaccccagtcttcttcttggctacagaatcaggctccttga

SEQ ID NO: 15449 - protein, 462 aa, Sorghum bicolor
  misc_feature: Useful for making plants with altered carbohydrate content
  misc_feature: Functional homolog of the protein sequence given in SEQ ID NO 14192
  misc_feature: Useful for making plants with altered cell wall content and/or composition
  misc_feature: Functional homolog of the protein sequence given in SEQ ID NO 14193
  misc_feature: Ceres ANNOT ID no. 8641401
  misc_feature (70)..(395): Pfam ID: Exostosin Pfam Description: Exostosin family
MAASSSSSSSCRSPLVWLFALAAALFFFSWYLLLDSAAGPAAARRPNQWLRLGGAGPGRKCDPAEALLRVFMYDLPPEFHFGLLDWKPPGFGGGVWPDVRDGVPEYPGGLNLQHSIEYWLTLDLLASEQGAPTPCAAVRVRRAADADVVFVPFFASLSFNRHSRVVPPARDSEDRALQRRLLEFLAARPEWRRTGGRDHVVLAHHPNGMLDARYRFWPCVFVLCDFGRYPPSVANLDKDVIAPYRHLVANFANDTAGYDDRPTLLYFQGAIYRKDGGSIRQELYYLLKDEKDVHFSFGSVAGNGIEQSTHGMRSSKFCLNIAGDTPSSNRLFDSIVSHCVPVIISDEIELPFEDVLDYSKFSVIVRGADAVKKGFLMSLITGISQEEWAHMWNKLKEVEKHFVYQYPSQTDDAVQMIWKAIARKVPSIRLKINRLQRFSRFDTNRTDETLPQSSSWLQNQAP

SEQ ID NO: 15450 - DNA, 1014 bp, Sorghum bicolor
  misc_feature: Ceres ANNOT ID no. 8641393
  misc_feature: Encodes the peptide sequence at SEQ ID NO 15451
atggaggggagcagcaatagcccggacaggcagtcgtcgggcggcagcccagaggagcgcggaagcggtggtagcggaggccggggcggcaccggggagccggtgcggtcgcggtggacgcccaagccggagcagatactgatcctcgagtccatcttcaacagcggcatggtcaacccgcccaaggatgaaaccgtccgcatccgcaagctgctcgagcgcttcggcgccgtcggggacgccaacgtcttctactggttccagaaccgccgctcccgctcgcgccgccgccagcgccagatgcaggccgccgccgccgcggccgccgctgcggcagcggccaacagcgctcccgcggctagcgccaccgccggcggccttccttctggcgctctacaatatcccttggccatgggcggcggcaccgcctgccagtatgagcagcaggcgagctcctcctcgtcgtcggggagcactactgggggctcgtctcttggccagttcgcgctcggagccggggtgcccggcaccggcggcggtgggtacttccaggcgtcgtgtggcgcttcgtcgccactggcgactgggctgatgggggacgtggacagcagcagtggcggcagcgacgatctcttcgccatctccaggcagatggggttcgcggcgacgagccccgtcgcctcggcctcggtggcgccgccgagcaccaccgcacaccagcaaccgtattactcatgccaatcgcctgcagcgacgatcacggtgttcatcaatggagtcccaatggaggttcccaggggtccaatagacttgcgagccatgttcggccaggacgtgatgctcgtccattccaccggggccctcctcccagtcaacgactatggaattctaacgcagagcttgcagatgggtgaaagctatttcttgtggagaattgggggtgacaaatgtgtgcttgtggttgagttttggaggagtgaaagggtgaggcggcgcaacccccacagctgctag

SEQ ID NO: 15451 - protein, 337 aa, Sorghum bicolor
  misc_feature: Useful for biocontainment applications
  misc_feature: Useful for making plants with modulated biomass
  misc_feature: Functional homolog of the protein sequence given in SEQ ID NO 12941
  misc_feature: Ceres ANNOT ID no. 8641393
  misc_feature (35)..(96): Pfam ID: Homeobox Pfam Description: Homeobox domain
MEGSSNSPDRQSSGGSPEERGSGGSGGRGGTGEPVRSRWTPKPEQILILESIFNSGMVNPPKDETVRIRKLLERFGAVGDANVFYWFQNRRSRSRRRQRQMQAAAAAAAAAAAANSAPAASATAGGLPSGALQYPLAMGGGTACQYEQQASSSSSSGSTTGGSSLGQFALGAGVPGTGGGGYFQASCGASSPLATGLMGDVDSSSGGSDDLFAISRQMGFAATSPVASASVAPPSTTAHQQPYYSCQSPAATITVFINGVPMEVPRGPIDLRAMFGQDVMLVHSTGALLPVNDYGILTQSLQMGESYFLWRIGGDKCVLVVEFWRSERVRRRNPHSC

SEQ ID NO: 15452 - DNA, 1077 bp, Sorghum bicolor
  misc_feature: Ceres ANNOT ID no. 8641394
  misc_feature: Encodes the peptide sequence at SEQ ID NO 15453
atgtcttcatgccagatgtatcatcatcaacaacagcttcagagccacagccatttcctgtcttctaggcagacattccctccagaaaggcacatgattctgcaaggagggagcattccagcagagtcagggcttgtgctttcgactgatgctaaacctaggttaaaatggacgcctgaactacatgagcgttttgtggaggcagtaaatcaacttggtgggcctgataaagctacaccaaagacaatcatgagactcatgggtgtccccggactaacactataccaccttaagagtcatcttcagaaatacaggctaagcaaaaacattcatgcccaagctaatggtggaaatgcaaaaaatgtggttggctgcgccatggcaatggagaaaccacctgaaggaaatggatcaccggctagccacttaaatcttggaacccagacaaacaaatctgtgcacataggtgaagcccttcagatgcaaattgaagtacagcgccgactgcatgagcaacttgaggtacaaagacatttgcaactccgcattgaagcacaagggaagtacctacaatctgtgctagaaaaggcacaggagacactttcaaagcagaatgcagggtcagtcggtgtagaaaccgcgaagatgcaactgtcagaattagtctcaaaggtatcaacagaatgcctccagcattcatttacaggctttgaagagattgaaggttcccaaattctacaagggcacaccatccaacttggcgacgggtcagttgacagctgcttaactgcttgtgatggctcacagaaagatcaagatatcctatcaatcagcctttctgctcacagaggaaaggagataggaggcatggcctttgatatgcaagcgaaagaaagaagagaggatttgtttcttgacaagctaagcatgatgcctccaagccacttagacaggcatgagagagacagttttagtatgacacgcaaggcagcaaaattggatctgaatatcaatgacaccactgacgggccacagaactgcaagaaaattgacttgaatgggttcaactggacctaa

SEQ ID NO: 15453 - protein, 358 aa, Sorghum bicolor
  misc_feature: Useful for making plants with modulated flowering time
  misc_feature: Functional homolog of the protein sequence given in SEQ ID NO 13579
  misc_feature: The sequence is a functional homolog of SEQ ID NO 1589 in the 11/479,226 US patent application
  misc_feature: The sequence is a functional homolog of SEQ ID NO 762 in the 10/412,699 US patent application
  misc_feature: The sequence is a functional homolog of SEQ ID NO 1062 in the 10/225,066 US patent application
  misc_feature: The sequence is a functional homolog of SEQ ID NO 2788 in the 10/374,780 US patent application
  misc_feature: The sequence is a functional homolog of SEQ ID NO 190 in the 10/225,066 US patent application
  misc_feature: The sequence is a functional homolog of SEQ ID NO 2866 in the 10/374,780 US patent application
  misc_feature: Useful for making plants with altered lignin content
  misc_feature: Useful for making plants with altered terpenoid content
  misc_feature: Functional homolog of the protein sequence given in SEQ ID NO 12902
  misc_feature: The sequence is a functional homolog of SEQ ID NO 2000 in the 11/479,226 US patent application
  misc_feature: The sequence is a functional homolog of SEQ ID NO 1995 in the 11/479,226 US patent application
  misc_feature: The sequence is a functional homolog of SEQ ID NO 1996 in the 11/479,226 US patent application
  misc_feature: The sequence is a functional homolog of SEQ ID NO 1997 in the 11/479,226 US patent application
  misc_feature: The sequence is a functional homolog of SEQ ID NO 1998 in the 11/479,226 US patent application
  misc_feature: The sequence is a functional homolog of SEQ ID NO 2001 in the 11/479,226 US patent application
  misc_feature: The sequence is a functional homolog of SEQ ID NO 1999 in the 11/479,226 US patent application
  misc_feature: Ceres ANNOT ID no. 8641394
  misc_feature (54)..(105): Pfam ID: Myb_DNA-binding Pfam Description: Myb-like DNA-binding domain
MSSCQMYHHQQQLQSHSHFLSSRQTFPPERHMILQGGSIPAESGLVLSTDAKPRLKWTPELHERFVEAVNQLGGPDKATPKTIMRLMGVPGLTLYHLKSHLQKYRLSKNIHAQANGGNAKNVVGCAMAMEKPPEGNGSPASHLNLGTQTNKSVHIGEALQMQIEVQRRLHEQLEVQRHLQLRIEAQGKYLQSVLEKAQETLSKQNAGSVGVETAKMQLSELVSKVSTECLQHSFTGFEEIEGSQILQGHTIQLGDGSVDSCLTACDGSQKDQDILSISLSAHRGKEIGGMAFDMQAKERREDLFLDKLSMMPPSHLDRHERDSFSMTRKAAKLDLNINDTTDGPQNCKKIDLNGFNWT

SEQ ID NO: 15454 - DNA, 1050 bp, Sorghum bicolor
  misc_feature: Ceres ANNOT ID no. 8641456
  misc_feature: Encodes the peptide sequence at SEQ ID NO 15455
atggctcccgagcttgccggcaagatgaccgccaaggccgctgccgccgccgccgccgcggcggtgacgaagcccgcgacgagggcgtacgtgacgttcctggccggcgacggggactactggaagggcgtggtgggcctggccaagggcctgcgcaaggcccgctcggcgtacccgctggtggtggccgtgctgcccgacgtgccggagtcccaccgccgcatcctcgtctcgcagggctgcatcgtccgcgagatcgagcccgtgtacccgcctgagaaccagacgcagttcgccatggcgtactacgtcatcaactactccaagctccgcatctgggagttcgtggagtacgagaggatggtgtacctggacgcggacatccaggtgttcgagaacgtcgacgagctgttcgagctcgagaagggctacttttacgcggtgatggactgcttctgcgagaagacgtggagccacaccccgcagtacaagatcggctactgccagcagtgcccggacaaggtggcgtggccagcaaccgccgagctgggccctccgccggcgctctacttcaacgccggcatgttcgtgcacgagcccagcatggccaccgccaaggcgctcctcgacaccctccgtgtgactccgcccacccccttcgcggagcaggacttcctgaacatgttcttcagggaccagtacaggccgatcccgaacgtgtacaacctcgtgctggccatgctctggaggcaccccgagaacgtgcagctggagaaggtgaaggccgtgcactactgcgcggccgggtcgaagccgtggaggttcacgggcaaggagcccaacatggacagggaggacatcaagatgctggtgaagaagtggtgggacatctacaacgacgagacgctggacttcaagggcctgctgcccctcccgcccgccgacgccgacgccgacgacgaggtggaggcggtggccaagaagccgctgcgcgcggcgctggcggaggccggcacggtcaagtacgtcaccgcgccctcggccgcgtga

SEQ ID NO: 15455 - protein, 349 aa, Sorghum bicolor
  misc_feature: Useful for making plants with altered carbohydrate content
  misc_feature: Functional homolog of the protein sequence given in SEQ ID NO 14194
  misc_feature: Useful for making plants with altered cell wall content and/or composition
  misc_feature: Functional homolog of the protein sequence given in SEQ ID NO 14195
  misc_feature: Useful for making plants with modulated water use efficiency
  misc_feature: Functional homolog of the protein sequence given in SEQ ID NO 14196
  misc_feature: Ceres ANNOT ID no. 8641456
  misc_feature (30)..(142): SWISSPROT Homolog: EC 2.4.1.186 Glycogenin glucosyltransferase
  misc_feature (31)..(277): Pfam ID: Glyco_transf_8 Pfam Description: Glycosyl transferase family 8
MAPELAGKMTAKAAAAAAAAAVTKPATRAYVTFLAGDGDYWKGVVGLAKGLRKARSAYPLVVAVLPDVPESHRRILVSQGCIVREIEPVYPPENQTQFAMAYYVINYSKLRIWEFVEYERMVYLDADIQVFENVDELFELEKGYFYAVMDCFCEKTWSHTPQYKIGYCQQCPDKVAWPATAELGPPPALYFNAGMFVHEPSMATAKALLDTLRVTPPTPFAEQDFLNMFFRDQYRPIPNVYNLVLAMLWRHPENVQLEKVKAVHYCAAGSKPWRFTGKEPNMDREDIKMLVKKWWDIYNDETLDFKGLLPLPPADADADDEVEAVAKKPLRAALAEAGTVKYVTAPSAA

SEQ ID NO: 15456 - DNA, 1143 bp, Sorghum bicolor
  misc_feature: Ceres ANNOT ID no. 8641450
  misc_feature: Encodes the peptide sequence at SEQ ID NO 15457
atggccaatctcctgattttagttactcatgtcagattattttacaaaatttcaatttctctctgtgggacatctaatgatacaggtcttcgagagatgcatgtaaagtggttatgtcattttgatgtcattttagaaaatggacagggtggagctatggtcctgccttctaattcatctgatcgatctgacagatctgacaaacctatggaccaaaaggttttgcgacggcttgctcaaaatcgtgaggcagcacgaaaaagtcggctgagaaaaaaggcatatgtgcaacagctagagagcagtaagctaaaacttgcaagcctggagcaagaactccagaaagctcgacaacagggaatcttcatatccagttccggagatcaaactcatgctatgagtggaaatggagctatgaccttcgatttagaatattctcgatggcaagaggatcaaaataagcagatgaatgagctgaggactgcagtaaatgctcatgcaagtgatagtgacctccgtcttatcgtcgatgggataatggcacattatgatgagatattcaggctgaagggcattgctgcaaaggctgatgtgttccatatactttcaggcatgtggaaaacacctgctgaaaggtgcttcttgtggcttgggggtttccgttcgtctgagcttctaaagctccttgtgaatcagcttgagcctctaactgagcagcaattgatggggttatccaatctccagcaatcctcccagcaggctgaggatgcattgtcacaaggaatggaagcattgcagcagtccttggcagaaacgctggctgggtcccttggtccatcaggatcttctggaaacgtggcaaactatatgggtcaaatggctatggccatgggaaaacttggcacactcgagaatttccttcgtcaggctgacaatctacgacagcagaccttgcatcagatgcaacgcatcctgacaatccgacaagccgctcgtgcgcttcttgcaatccatgactacttttcacgtttgcgtgccctgagttctctttggcttgctaggccacgagaagtcagccctctctgtacaagttgtattaacatcttctggtctcatattgtgcttcagtgttgtacaagttag

SEQ ID NO: 15457 - protein, 380 aa, Sorghum bicolor
  misc_feature: The sequence is a functional homolog of SEQ ID NO 1792 in the 10/412,699 US patent application
  misc_feature: The sequence is a functional homolog of SEQ ID NO 2030 in the 10/374,780 US patent application
  misc_feature: The sequence is a functional homolog of SEQ ID NO 206 in the 10/225,068 US patent application
  misc_feature: The sequence is a functional homolog of SEQ ID NO 356 in the 10/412,699 US patent application
  misc_feature: The sequence is a functional homolog of SEQ ID NO 831 in the 11/479,226 US patent application
  misc_feature: The sequence is a functional homolog of SEQ ID NO 934 in the 11/435,388 US patent application
  misc_feature: The sequence is a functional homolog of SEQ ID NO 1496 in the 10/374,780 US patent application
  misc_feature: The sequence is a functional homolog of SEQ ID NO 1566 in the 10/412,699 US patent application
  misc_feature: The sequence is a functional homolog of SEQ ID NO 1494 in the 10/374,780 US patent application
  misc_feature: The sequence is a functional homolog of SEQ ID NO 1564 in the 10/412,699 US patent application
  misc_feature: The sequence is a functional homolog of SEQ ID NO 1492 in the 10/374,780 US patent application
  misc_feature: The sequence is a functional homolog of SEQ ID NO 1562 in the 10/412,699 US patent application
  misc_feature: The sequence is a functional homolog of SEQ ID NO 1794 in the 10/412,699 US patent application
  misc_feature: The sequence is a functional homolog of SEQ ID NO 2032 in the 10/374,780 US patent application
  misc_feature: The sequence is a functional homolog of SEQ ID NO 380 in the 10/412,699 US patent application
  misc_feature: The sequence is a functional homolog of SEQ ID NO 534 in the 10/225,066 US patent application
  misc_feature: The sequence is a functional homolog of SEQ ID NO 936 in the 11/435,388 US patent application
  misc_feature: The sequence is a functional homolog of SEQ ID NO 1788 in the 10/412,699 US patent application
  misc_feature: The sequence is a functional homolog of SEQ ID NO 2026 in the 10/374,780 US patent application
  misc_feature: The sequence is a functional homolog of SEQ ID NO 354 in the 10/412,699 US patent application
  misc_feature: The sequence is a functional homolog of SEQ ID NO 823 in the 11/479,226 US patent application
  misc_feature: The sequence is a functional homolog of SEQ ID NO 930 in the 11/435,388 US patent application
  misc_feature: The sequence is a functional homolog of SEQ ID NO 1878 in the 10/412,699 US patent application
  misc_feature: The sequence is a functional homolog of SEQ ID NO 2138 in the 10/374,780 US patent application
  misc_feature: The sequence is a functional homolog of SEQ ID NO 372 in the 10/225,066 US patent application
  misc_feature: The sequence is a functional homolog of SEQ ID NO 878 in the 11/435,388 US patent application
  misc_feature: The sequence is a functional homolog of SEQ ID NO 242 in the 10/374,780 US patent application
  misc_feature: The sequence is a functional homolog of SEQ ID NO 764 in the 10/412,699 US patent application
  misc_feature: The sequence is a functional homolog of SEQ ID NO 826 in the 10/225,066 US patent application
  misc_feature: The sequence is a functional homolog of SEQ ID NO 950 in the 11/435,388 US patent application
  misc_feature: The sequence is a functional homolog of SEQ ID NO 96 in the 11/375,241 US patent application
  misc_feature: The sequence is a functional homolog of SEQ ID NO 1498 in the 10/374,780 US patent application
  misc_feature: The sequence is a functional homolog of SEQ ID NO 1568 in the 10/412,699 US patent application
  misc_feature: Useful for making plants with modulated biomass
  misc_feature: Functional homolog of the protein sequence given in SEQ ID NO 13416
  misc_feature: The sequence is a functional homolog of SEQ ID NO 114 in the 10/666,642 US patent application
  misc_feature: The sequence is a functional homolog of SEQ ID NO 2362 in the 10/374,780 US patent application
  misc_feature: The sequence is a functional homolog of SEQ ID NO 376 in the 10/412,699 US patent application
  misc_feature: The sequence is a functional homolog of SEQ ID NO 608 in the 10/225,066 US patent application
  misc_feature: The sequence is a functional homolog of SEQ ID NO 848 in the 11/435,388 US patent application
  misc_feature: The sequence is a functional homolog of SEQ ID NO 871 in the 11/479,226 US patent application
  misc_feature: The sequence is a functional homolog of SEQ ID NO 1495 in the 10/374,780 US patent application
  misc_feature: The sequence is a functional homolog of SEQ ID NO 1565 in the 10/412,699 US patent application
  misc_feature: Useful for making plants with altered lignin content
  misc_feature: Functional homolog of the protein sequence given in SEQ ID NO 13093
  misc_feature: Ceres ANNOT ID no. 8641450
  misc_feature (69)..(121): Pfam ID: bZIP_1 Pfam Description: bZIP transcription factor
MANLLILVTHVRLFYKISISLCGTSNDTGLREMHVKWLCHFDVILENGQGGAMVLPSNSSDRSDRSDKPMDQKVLRRLAQNREAARKSRLRKKAYVQQLESSKLKLASLEQELQKARQQGIFISSSGDQTHAMSGNGAMTFDLEYSRWQEDQNKQMNELRTAVNAHASDSDLRLIVDGIMAHYDEIFRLKGIAAKADVFHILSGMWKTPAERCFLWLGGFRSSELLKLLVNQLEPLTEQQLMGLSNLQQSSQQAEDALSQGMEALQQSLAETLAGSLGPSGSSGNVANYMGQMAMAMGKLGTLENFLRQADNLRQQTLHQMQRILTIRQAARALLAIHDYFSRLRALSSLWLARPREVSPLCTSCINIFWSHIVLQCCTS

SEQ ID NO: 15458 - DNA, 300 bp, Sorghum bicolor
  misc_feature: Ceres ANNOT ID no. 8641473
  misc_feature: Encodes the peptide sequence at SEQ ID NO 15459
atggggggaaggctggtgtccgtgctccggtggccgccggacctgggcctgcccagcctggccgcgctgctcccctcgccgcccgcgcacctccgggtccaggtccaggagtggtggcagtggcagtggtcgcgccccgatgagcagctcggcgcgtcggcgcggcggtggcccgagctcgtgcgggacgtgccgctcctggtggacgccgcgctctggggcgtcgtcacggccgtggagtccgtcgcgctcgtctccatgatgtgctgcttcttcctctgctgcggctgcacgctctga

SEQ ID NO: 15459 - protein, 99 aa, Sorghum bicolor
  misc_feature: Useful for making plants with modulated nitrogen use efficiency
  misc_feature: Functional homolog of the protein sequence given in SEQ ID NO 14197
  misc_feature: Ceres ANNOT ID no. 8641473
MGGRLVSVLRWPPDLGLPSLAALLPSPPAHLRVQVQEWWQWQWSRPDEQLGASARRWPELVRDVPLLVDAALWGVVTAVESVALVSMMCCFFLCCGCTL

SEQ ID NO: 15460 - DNA, 3537 bp, Sorghum bicolor
  misc_feature: Ceres ANNOT ID no. 8641503
  misc_feature: Encodes the peptide sequence at SEQ ID NO 15461
atggcgtcgggcagccgcgccacgcccacgcgctccccctcctccgcgcgacccgaggcgccgcgtcacgcgcaccaccaccaccaccaccactcgcagtcgtcgggcgggagcacgtcccgcgcgggcgggggaggtggaggaggaggaggtggcgggggcaccgcggccacggctacggccacggccacggagtcggtctccaaggccgtggcgcagtacaccctagacgcgcggctccacgcggtgttcgagcaatcgggcgcgtcgggccgcagcttcgactactcccagtcgctgcgcgcgccgcccacgccgtcctccgagcagcagatcgccgcctacctctcccgcatccagcgcggcggccacatccagcccttcggctgcacgctcgccgtcgccgacgactcctccttccgcctcctcgccttctccgagaacgccgccgacctgctcgacctgtcgccgcaccactccgttccctcgctcgattccgcggcgccgccccccgtttccctgggtgccgacgcgcgcctcctcttctccccctcgtccgcggtcctcctggagcgcgccttcgccgcgcgcgagatctcgctgctcaacccgctatggatccactccagggtctcttccaagccgttctacgccatcctccaccgcatcgacgtcggcgtcgtcatcgacctcgagcccgcccgcaccgaggaccccgctctctccatcgccggcgcagtccagtcccagaaactcgcggtccgtgccatctcccgcctccaggcgctacctggcggggacatcaagctcctctgcgacacagtcgtggagcatgttcgcgagctcacgggttacgaccgtgtcatggtgtacaggttccatgaagacgagcatggggaagttgtcgccgagagccggcgcgataaccttgagccttacctcggattgcattatcccgccacagatatcccccaggcatcgcgcttcctgttccggcagaaccgcgtgcggatgattgctgattgccatgccaccccggtgagagtcatacaagatcctgggatgtcgcagccactgtgtttggtaggctccacgcttcgtgctccacacgggtgccatgcgcagtacatggcgaacatggggtcaattgcatcacttgttatggcagtcatcattagcagtggtggtgatgacgagcaaacaggtcggggaggcatctcctcggcaatgaagttgtgggggttagtggtgtgtcaccatacgtcaccacggtgtatcccttttccattgaggtatgcttgcgagtttctcatgcaggcatttgggctgcagctcaacatggaattgcagcttgcgcatcagctgtcagagaagcacattttgcgaactcagacgctattgtgtgacatgctattgcgagattcaccaactggcatcgtcacgcagagccccagcatcatggaccttgtgaagtgtgatggggctgcactgtattatcatgggaagtactatccattgggtgtcactcccactgagtctcagattaaggatatcattgagtggttgacggtgtgtcatggggactcaacagggctcagcacagacagccttgctgatgcaggctaccttggtgctgctgcattaggggatgctgtgtgtggaatggcggtggcttatattacaccgagtgattacttgttttggtttcggtcacacacagctaaagagatcaaatggggtggcgcaaagcatcaccctgaggataaggatgatggtcagaggatgcacccacggtcatcattcaaggcatttcttgaagtggttaaaagcagaagcctaccatgggagaatgcagaaatggacgcgatacattccttgcaactcatattgcgtgactccttcagagatgctgcagagggcactagcaactcaaaagccattgtcaatggacaagttcagcttggggagctagaattgcgggggataaatgagcttagctctgtagcaagagagatggttcggttgatagagacagcaacagtacccatatttgcagtagatactgatggatgtataaatggttggaatgcgaaaattgctgagttgacaggcctttcagttgaggaggcaatgggcaaatctctggtaaacgatcttatcttcaaggaatctgaggagatagtcgaaaagctactctcacgagctttaagaggtgaggaagacaaaaatgtggagataaagttgaagacatttgggtcagagcaatctaacggagcaatatttgttattgtcaatgcttgttccagtagagattacacacaaaatattgttggtgtctgttttgttggacaagatgtcacaggacaaaaggtggtcatggataaatttatcaacatacaaggggactataaagctattgtacacaatcctaatcctctgatacccccaatttttgcatcagatgagaacacttcttgttcagaatggaacacagccatggaaaaacttacaggatggtcgagaggtgaagttgttggtaaatttcttattggagaggtgtttggaagtttttgtcgactcaagggcccagatgcattgacaaagttcatggttgtcattcacaatgctataggagggcaggattatgagaagttccctttttcatttttcgacaagaatggaaagtatgtgcaggccttattgaccgccaacacaaggagcaaaatggatggtaaatccattggcgccttttgttttttgcagattgcaagcgctgaaatacagcaagcctttgagattcagagacaacaagaaaagaagtgttatgcaaggatgaaagaattggcctatatttgccaggagataaagaatcctcttagtggcatccgatttaccaactctctgttgcaaatgactgatttaaatgatgatcagaggcagttccttgaaacttgctctgcttgtgagaaacagatgtccaagattgttaaggacgccactctccaaagtattgaggacggctctttggtacttgagaaaagtgagttttcttttggagacgttatgaatgctgttgtcagccaagcaatgttattgttgagggagagggatttacaacttattcgggatatccctgatgaaatcaaggatgcatcagcatatggtgatcaatttagaattcaacaagttttggctgacttcttgctaagcatggtgcgatctgctccgtccgagaatggctgggtagaaatacaagtcagaccaaatgtaaaacagaattctgacggaacagatacagagcttttcatcttcaggtttgcctgccctggtgagggccttcccgctgacattgtccaggatatgttcagcaattcccagtggtcaacccaagaaggcgtaggactaagcacatgcaggaagatcctcaaattgatgggcggtgaggtccaatacatcagggagtcagagcggagtttcttcctcatcgtcctcgagctgccccagcctcgtccagcagctgatagagaaatcagttga

SEQ ID NO: 15461 - protein, 1178 aa, Sorghum bicolor
  misc_feature: Useful for making plants with modulated light quality response
  misc_feature: Useful for making plants with modulated light quality sensitivity
  misc_feature: Functional homolog of the protein sequence given in SEQ ID NO 14198
  misc_feature: Useful for making plants with altered low light response
  misc_feature: Useful for making plants with modulated biomass
  misc_feature: Useful for making plants with modulated flowering time
  misc_feature: Functional homolog of the protein sequence given in SEQ ID NO 14106
  misc_feature: Useful for making plants with modulated nitrogen use efficiency
  misc_feature: Functional homolog of the protein sequence given in SEQ ID NO 14116
  misc_feature: Ceres ANNOT ID no. 8641503
  misc_feature (68)..(844): SWISSPROT Homolog: EC 2.7.11.1 Non-specific serine/threonine protein kinase
  misc_feature (460)..(639): Pfam ID: Phytochrome Pfam Description: Phytochrome region
  misc_feature (114)..(234): Pfam ID: PAS_2 Pfam Description: PAS fold
  misc_feature (670)..(786): Pfam ID: PAS Pfam Description: PAS fold
  misc_feature (801)..(923): Pfam ID: PAS Pfam Description: PAS fold
  misc_feature (267)..(449): Pfam ID: GAF Pfam Description: GAF domain
  misc_feature (1055)..(1167): Pfam ID: HATPase_c Pfam Description: Histidine kinase-, DNA gyrase B-, and HSP90-like ATPase
  misc_feature (943)..(1007): Pfam ID: HisKA Pfam Description: His Kinase A (phosphoacceptor) domain
MASGSRATPTRSPSSARPEAPRHAHHHHHHHSQSSGGSTSRAGGGGGGGGGGGGTAATATATATESVSKAVAQYTLDARLHAVFEQSGASGRSFDYSQSLRAPPTPSSEQQIAAYLSRIQRGGHIQPFGCTLAVADDSSFRLLAFSENAADLLDLSPHHSVPSLDSAAPPPVSLGADARLLFSPSSAVLLERAFAAREISLLNPLWIHSRVSSKPFYAILHRIDVGVVIDLEPARTEDPALSIAGAVQSQKLAVRAISRLQALPGGDIKLLCDTVVEHVRELTGYDRVMVYRFHEDEHGEVVAESRRDNLEPYLGLHYPATDIPQASRFLFRQNRVRMIADCHATPVRVIQDPGMSQPLCLVGSTLRAPHGCHAQYMANMGSIASLVMAVIISSGGDDEQTGRGGISSAMKLWGLVVCHHTSPRCIPFPLRYACEFLMQAFGLQLNMELQLAHQLSEKHILRTQTLLCDMLLRDSPTGIVTQSPSIMDLVKCDGAALYYHGKYYPLGVTPTESQIKDIIEWLTVCHGDSTGLSTDSLADAGYLGAAALGDAVCGMAVAYITPSDYLFWFRSHTAKEIKWGGAKHHPEDKDDGQRMHPRSSFKAFLEVVKSRSLPWENAEMDAIHSLQLILRDSFRDAAEGTSNSKAIVNGQVQLGELELRGINELSSVAREMVRLIETATVPIFAVDTDGCINGWNAKIAELTGLSVEEAMGKSLVNDLIFKESEEIVEKLLSRALRGEEDKNVEIKLKTFGSEQSNGAIFVIVNACSSRDYTQNIVGVCFVGQDVTGQKVVMDKFINIQGDYKAIVHNPNPLIPPIFASDENTSCSEWNTAMEKLTGWSRGEVVGKFLIGEVFGSFCRLKGPDALTKFMVVIHNAIGGQDYEKFPFSFFDKNGKYVQALLTANTRSKMDGKSIGAFCFLQIASAEIQQAFEIQRQQEKKCYARMKELAYICQEIKNPLSGIRFTNSLLQMTDLNDDQRQFLETCSACEKQMSKIVKDATLQSIEDGSLVLEKSEFSFGDVMNAVVSQAMLLLRERDLQLIRDIPDEIKDASAYGDQFRIQQVLADFLLSMVRSAPSENGWVEIQVRPNVKQNSDGTDTELFIFRFACPGEGLPADIVQDMFSNSQWSTQEGVGLSTCRKILKLMGGEVQYIRESERSFFLIVLELPQPRPAADREIS

SEQ ID NO: 15462 - DNA, 1269 bp, Sorghum bicolor
  misc_feature: Ceres ANNOT ID no. 8641478
  misc_feature: Encodes the peptide sequence at SEQ ID NO 15463
atgtcgccaccgacgaacggcgccatctcgctcgcctacgcgccgtcgtccatgatgctgggggcggggggcctgacgaacccgccgctcctccccttcgacggtttcacggatgaggacttcctcgccgccgacgccgctctccttggcggggctggcgccgaccagaccctcctgctgctgccctcctgtcctgggacgaacggcggcggtagctccgccgcccagggtctcggagcagccctggcgtgtggtgaggtcacgaccgccgtcgccgccggatccatctcgctcgcgggccagcctgcgcctgggcagcaggttttgtgggaggtgatgactgccgtcgccgaggactgcaacgccaacttctcgccctcaccaccgtccccggcgctgccgctcgtgcaaaccacctcccacaggacctccatctaccgcggggtgaccaggtggacggggcggtacgaggcgcacctgtgggacaacacgtgccgtaaggaaggccagaagcgcaaggggcgccaaggtggctatgacaaagaagataaggcagctagggcatatgatattgctgctctgaagtattggggtgataatgctactactaacttccctagagagaactacatcagagagattcaggatatgcagaacatgaacaggcgtgatgttgtagcctcactgaggaggaagagcagtggcttttctagaggagcatcaatctacagaggagtaacaaggcaccaccaacatggacgctggcaggcaagaatcggccgtgttgcagggaacaaggatctatatcttgggacttttgcaaccgaacaagaggctgcagaggcgtacgacatcgcggcactgaagttcaggggcgagaatgccgtgaccaacttcgagcccagccggtacaacctgctagcaatcgctcaacgagaaatccccatcttggggaagaagctggttcagaagccggctccggaggcagaagaccaggccgctcggagcgctccttcattctcccactcccagcagtcgagcaacagcctgccaccgtatttcctcaccaacctcctggagccgctgccgtctcagccctcactagctcagcctcttccgagttacgacaacttcgggttctgggagccgcccagcttctaccggccctgcccctgcccctggggtaacccagagcagaaggtgcagcttggcaggaagatggaaatcgtcaacggtctcatgcagctgggcaactctgctgcgaactga

SEQ ID NO: 15463 - protein, 422 aa, Sorghum bicolor
  misc_feature: Useful for making plants with altered lignin content
  misc_feature: Useful for making plants with modulated drought sensitivity
  misc_feature: Functional homolog of the protein sequence given in SEQ ID NO 14199
  misc_feature: The sequence is a functional homolog of SEQ ID NO 320 in US patent 7157621
  misc_feature: The sequence is a functional homolog of SEQ ID NO 1070 in the 10/225,066 US patent application
  misc_feature: The sequence is a functional homolog of SEQ ID NO 140 in the 11/375,241 US patent application
  misc_feature: The sequence is a functional homolog of SEQ ID NO 1904 in the 10/412,699 US patent application
  misc_feature: The sequence is a functional homolog of SEQ ID NO 2164 in the 10/374,780 US patent application
  misc_feature: The sequence is a functional homolog of SEQ ID NO 458 in the 11/435,388 US patent application
  misc_feature: The sequence is a functional homolog of SEQ ID NO 1900 in the 10/412,699 US patent application
  misc_feature: The sequence is a functional homolog of SEQ ID NO 358 in the 10/666,642 US patent application
  misc_feature: The sequence is a functional homolog of SEQ ID NO 676 in the 11/435,388 US patent application
  misc_feature: Useful for biocontainment applications
  misc_feature: Functional homolog of the protein sequence given in SEQ ID NO 13650
  misc_feature: Ceres ANNOT ID no. 8641478
  misc_feature (241)..(293): Pfam ID: AP2 Pfam Description: AP2 domain
  misc_feature (144)..(199): Pfam ID: AP2 Pfam Description: AP2 domain
MSPPTNGAISLAYAPSSMMLGAGGLTNPPLLPFDGFTDEDFLAADAALLGGAGADQTLLLLPSCPGTNGGGSSAAQGLGAALACGEVTTAVAAGSISLAGQPAPGQQVLWEVMTAVAEDCNANFSPSPPSPALPLVQTTSHRTSIYRGVTRWTGRYEAHLWDNTCRKEGQKRKGRQGGYDKEDKAARAYDIAALKYWGDNATTNFPRENYIREIQDMQNMNRRDVVASLRRKSSGFSRGASIYRGVTRHHQHGRWQARIGRVAGNKDLYLGTFATEQEAAEAYDIAALKFRGENAVTNFEPSRYNLLAIAQREIPILGKKLVQKPAPEAEDQAARSAPSFSHSQQSSNSLPPYFLTNLLEPLPSQPSLAQPLPSYDNFGFWEPPSFYRPCPCPWGNPEQKVQLGRKMEIVNGLMQLGNSAAN

SEQ ID NO: 15464 - DNA, 1824 bp, Sorghum bicolor
  misc_feature: Ceres ANNOT ID no. 8641520
  misc_feature: Encodes the peptide sequence at SEQ ID NO 15465
atggagaggcagaggagctcctcctcctcttcctcgtaccagctccttagtcccaagtgcctcctcctcctgtccttcgcctcttcctccctcctcttctccttcctcttcgcgctcttcgccgtccgccacggccgccccctccacctcccattcgccatgcccaacgcctcctccactgcgtcccttgcacggtcaccgcctcttgggggcggtgggggttccatggtcggcgcggtggcgctcgcgccggaggccggttatgcggtccgtgggcgcgggagtggagattcagtggcggatggagcccaccacgcggttgccggagacctgtcggctcgcgccgcgggctcgccaatggatgtggaagaagcggttgctggaggaggaaatggtggagcacccgcgcctggtaaggttttggaggtgcaagagattgcagaagctgggagaacttctgcttcagaggaagtagctgcatcaatggtgaaatcggaggaaggagagtcttggagaactgtcaatttgtccatggaagcttcaggtactgcaatggagatgagaggtgaatccgtgcaagacgatcttgtggttgtgggggataagcacaattcctctgtacaagcagcttatggttctcaacaaggggagcaactgcaaagctcatatcattcagcagggaataataattccgtgggagctccggtcaatcaaaataagcaagatcctaacctgattgaggaagcggtcatgaccaaaacggattctacaggaggcaataccatacattgtgatgtttatgatgggagttgggtcttcgatgagacctatccactctacactagtgattcatgcccttttatagatgaagcattcagctgtggagcaaatggaagaatggatcaaagatacatgaagtggaggtggcagcctaagcattgcaatataccaaggtttgatgctaggaaaatgcttgagaagctgcgaggaaagcgactagtgtttattggggactccattaacaggaaccagtgggaatccatgatgtgcttactgagaacggctgtctcagatcctggaaggattcatcaaacccatggccgcaaaattactaaagagaagggtgattacaacttcaagttcttggactacaactgtagtgtggaatatcatgtgacacatttcttggtgcatgaaagcaaggcgagaattggccagaagcgcatgaagacactacggatcgataccattcatcggagctcatcaagatggaaaggtgctgatgtgcttgtgttcaacactgcccattggtggtcgcatcacaaaacacaatctggagtgaactattatcaggagggagatcatgttcatccccatctcgatgcctctactgctttccaaagagcactaaccacctgggcatcctggatcgacagtaacaccaatccacagctaactcaagtgttcttccgaagctcatccccgtcgcatttcagcggtggggagtggaattcaggggggcactgcagagagagcatgctgccccttaatgacacccatgctaggccggtacctgaaagaaacgtgatcttggaacaagtcacgaagcaaatgaagactcctgtgacaattctgaacatcactaatttatctgggatcaggatagatggtcacccatctgtatatggccggaagacagtagatttaaccgcatcgagcgtacaggattgcagccattggtgccttcctggagtcccagatacatggaatgaactgttattctaccatctactgtcaccacaagaaaaagatgtaacaagctag

SEQ ID NO: 15465 - protein, 607 aa, Sorghum bicolor
  misc_feature: Useful for making plants with altered cell wall content and/or composition
  misc_feature: Functional homolog of the protein sequence given in SEQ ID NO 13772
  misc_feature: Ceres ANNOT ID no. 8641520
MERQRSSSSSSSYQLLSPKCLLLLSFASSSLLFSFLFALFAVRHGRPLHLPFAMPNASSTASLARSPPLGGGGGSMVGAVALAPEAGYAVRGRGSGDSVADGAHHAVAGDLSARAAGSPMDVEEAVAGGGNGGAPAPGKVLEVQEIAEAGRTSASEEVAASMVKSEEGESWRTVNLSMEASGTAMEMRGESVQDDLVVVGDKHNSSVQAAYGSQQGEQLQSSYHSAGNNNSVGAPVNQNKQDPNLIEEAVMTKTDSTGGNTIHCDVYDGSWVFDETYPLYTSDSCPFIDEAFSCGANGRMDQRYMKWRWQPKHCNIPRFDARKMLEKLRGKRLVFIGDSINRNQWESMMCLLRTAVSDPGRIHQTHGRKITKEKGDYNFKFLDYNCSVEYHVTHFLVHESKARIGQKRMKTLRIDTIHRSSSRWKGADVLVFNTAHWWSHHKTQSGVNYYQEGDHVHPHLDASTAFQRALTTWASWIDSNTNPQLTQVFFRSSSPSHFSGGEWNSGGHCRESMLPLNDTHARPVPERNVILEQVTKQMKTPVTILNITNLSGIRIDGHPSVYGRKTVDLTASSVQDCSHWCLPGVPDTWNELLFYHLLSPQEKDVTS

SEQ ID NO: 15466 - DNA, 1341 bp, Sorghum bicolor
  misc_feature: Ceres ANNOT ID no. 8641531
  misc_feature: Encodes the peptide sequence at SEQ ID NO 15467
atgtcgtctgaggacgacgaccggcgaccgcggcagcaacggctgctccccgtcccgatcatccccttcgtcctcttcctcgtcgcaccgttcgccctcttcatgctcacgtcgcccgacctgcagtggcagctcccacgcatccgcatcgagtacgacgacgacgagccctccagcgcgcccacgcacgagcgcacttcgtcgacgccaccaaggtctccggttcttgccggtgccaaaagcgacgaagagcaacggcggctcccgctgccgccgccgcgccagctgactgacccgccgtacacgctcggcgcagccgtgtcggactacgacgcgcgcagggccaggtggctccacgacaacccgcggttcccggccttcgtcgcgccggggaggccccgggtgctcgtggtcaccgggtcgtcgccgcgccggtgcgggaacgcggacggcgaccacgtcctcctccgcgcgttcaagaacaaggtggactactgccgcgtccacggcttcgacgtcttctacagcaacgccgtgctcgacgccgagctgtcggggttctggaccaagctgcccatcctgcgcgcgctgatgctcgcgcacccagagacggagctcctgtggtgggtggactccgacgtcgtgttcaccgacatgctgttcgagccgccgtgggggaaatacgcgggccacaacctcgtcgttccgggctgggacgacaaggtgtacgccgccaagagctggctcggcatcaacgccggcagcttcatcatccgcaactgccagtggtcgctcgacctgctcgacgcgtgggcgcggatggggccgcgcggccccgtgcggtacgagtacgggaaggtcctcggcaaggcgctgtcggaccggccgtcgtacgaggccgacgaccagtcggcgctcgtctacctgctcgtcacggagcgcggcaggtggggcgacaagacgttcctggagggctcgtacagtctgcacggcttctggctggcgatcgtggacagatacgaagacatgcggcgggacgcgacggcgacgccggggggcggcggtggcgagcggtggccgctggtgacgcacttcgtcgggtgcaagccgtgcggggggcagtacgcgagctacgaggcatcgcggtgccggcgcggcatggagcgcgcgctcaacttcgccgacgaccagattctgaggctgtacgggttcgagcacgagtcgctcaacaccaccgccgtgcggcgcgtgcggaacgataccggaggaccgctggacgcggacgacgtggagatcggccggctcttgcacccgacgttcagggcggctaggccctggtga

SEQ ID NO: 15467 - protein, 446 aa, Sorghum bicolor
  misc_feature: Useful for making plants with altered carbohydrate content
  misc_feature: Functional homolog of the protein sequence given in SEQ ID NO 13770
  misc_feature: Useful for making plants with altered cell wall content and/or composition
  misc_feature: Functional homolog of the protein sequence given in SEQ ID NO 13771
  misc_feature: Ceres ANNOT ID no. 8641531
  misc_feature (101)..(444): SWISSPROT Homolog: EC 2.4.2.39 Xyloglucan 6-xylosyltransferase
  misc_feature (131)..(378): Pfam ID: Glyco_transf_34 Pfam Description: galactosyl transferase GMA12/MNN10 family
MSSEDDDRRPRQQRLLPVPIIPFVLFLVAPFALFMLTSPDLQWQLPRIRIEYDDDEPSSAPTHERTSSTPPRSPVLAGAKSDEEQRRLPLPPPRQLTDPPYTLGAAVSDYDARRARWLHDNPRFPAFVAPGRPRVLVVTGSSPRRCGNADGDHVLLRAFKNKVDYCRVHGFDVFYSNAVLDAELSGFWTKLPILRALMLAHPETELLWWVDSDVVFTDMLFEPPWGKYAGHNLVVPGWDDKVYAAKSWLGINAGSFIIRNCQWSLDLLDAWARMGPRGPVRYEYGKVLGKALSDRPSYEADDQSALVYLLVTERGRWGDKTFLEGSYSLHGFWLAIVDRYEDMRRDATATPGGGGGERWPLVTHFVGCKPCGGQYASYEASRCRRGMERALNFADDQILRLYGFEHESLNTTAVRRVRNDTGGPLDADDVEIGRLLHPTFRAARPW

SEQ ID NO: 15468 - DNA, 2322 bp, Sorghum bicolor
  misc_feature: Ceres ANNOT ID no. 8641535
  misc_feature: Encodes the peptide sequence at SEQ ID NO 15469
atgtcgacgactcctcgcgctcgcggccggttgtcccaccgccgcggtcggtgcaggtgcttaggcggcgccaacaaaaaaggggaccgcgccacgccgtgctgctccttcaacccgctgaggtccctcttccgatgccccggccgaggccgtagccgtagccgcagccgcagccgcagccgcagccgcagcaagcatcggcagcggaccagcaaacccaggaggaggaggagccttctttcttcgtgtacaccatgccgaaccatagcggcttcggcgccgccaccgacgagcacaacaagaagaagaagaaaaagaagaagcaccggaaaccgcgcatgccgtccttcggctcgtgcttccgcaggaagaagaaggagcggcggcagaccaaaactgcggccaccctcagctgacatctccgcggagtcctcagtgaagtcatcgctggactacgtcaacgagccaccactgccgccgccagccaaacggacggtggtggagagggaagctgcggcggcggtgccggtgaagattaatgaggttccgccgaagctgtggctcaacggcaaatcggccgagtcccgagcacgggaacggttctccgagcctcttgtggctgtggcgggcgaggaactgtgggcgcacgacgtcgcgtgcagccgcgtgcacgccgtcatgctcgccgagacgcacaatcgccaaaacccacaaagccaccaccaactacaccgccgcgccgccgcgtcaaacaacggcgggacgacgcctatggcattcacctcccaatccctaatcttccgggcagccgcctcgcctccttgtccccgcatagccccgtcgcccggtcgcgtcaccctccgggaccaccgggccgccttcccgcccctcgcggcggcctccacctcgatggcgtcctcggagagcgaagataagagggaagccaagctgtggggcgggcggttcgaggagggcgtcaccgacgccgtggagcgcttcacggagtccatatcctacgactggcaactctacaagtacgacatcatgggcagcaaggcccacgcctccatgctcgccggccagggtttgataacagctactgatagggatatcatcttagaggggcttgatcagatagagaggctgatccaagaaggcaaatttgaatggaggaaggaccgggaggacgtgcatatgaacattgaagcggctctgattgagagggttggtgagccagccaagaagttgcatactgctaggagccgcaatgaccaaattgtgacagatctaaggctatggtgccgtgatgctattgacaagattttgattcgtatcaagcagcttcaggtgtctttggttattttggcttcaaaatatgttgacttaatagtcccgggttatactcatctgcaaagggcacagcctgttctgctgccacatcttctcttatcatatgttgaacagttggagcgtgatgctggtcggctggtcaactgcagggagcgagtgaatttctgccctcttggtgcttgtgctttggctggaactggacttcccattgataggttccaaactgctaaagatttgaaatttacggctccaatgaagaatagcattgatgcagtatcagaccgtgactttgtactagagtttcttgccgccaattcaattgctgctgttcatctttcgcgaattggtgaagaatgggttctttgggcatcagaggaatttgggttcctgacaccaagtgacaaagtttcaacaggaagcagcattatgccccagaagaaaaatccagatccaatggagcttgttcgtgggaaatctgctagagttgttggagacctcatgactgttctaaccctctgtaaaggccttccacaagcctacaaccgtgaccttcaggaagacaaggaacccttgtttgatagtgtgaaagccgtattaggaatgcttgaagtatgcacggagtttgctcaaaatatctcatttaattcgaaaagaatacaaagttcccttccagctggttatctggatgcaacgacgctggcggattatcttgtgaagaagggaattcctttcagaacttctcacgagatagttggaaggtctgttgctctatgcgtctacaagcagtgtcagctagccgagcttgaattggatgacctaaaatctgtccatcctgtatttgagggcgacgtctatgaatacctgggggttgaaaacgccgtaaacaagttcatatcctatggctctactggttcagaacaagtaaagaagcagcttgaggattggcgcatccagctcgggatcagctcataa

SEQ ID NO: 15469 - protein, 773 aa, Sorghum bicolor
  misc_feature: Useful for making plants with modulated salt sensitivity
  misc_feature: Functional homolog of the protein sequence given in SEQ ID NO 13289
  misc_feature: Ceres ANNOT ID no. 8641535
  misc_feature: Down-regulated in root tissues in response to methyl jasmonate treatment
  misc_feature: Up-regulated in shoot tissues in response to methyl jasmonate treatment
  misc_feature: Up-regulated in shoot tissues in response to salicylic acid treatment
  misc_feature (316)..(771): SWISSPROT Homolog: EC 4.3.2.1 Argininosuccinate lyase
  misc_feature (320)..(614): Pfam ID: Lyase_1 Pfam Description: Lyase
MSTTPRARGRLSHRRGRCRCLGGANKKGDRATPCCSFNPLRSLFRCPGRGRSRSRSRSRSRSRSKHRQRTSKPRRRRSLLSSCTPCRTIAASAPPPTSTTRRRRKRRSTGNRACRPSARASAGRRRSGGRPKLRPPSADISAESSVKSSLDYVNEPPLPPPAKRTVVEREAAAAVPVKINEVPPKLWLNGKSAESRARERFSEPLVAVAGEELWAHDVACSRVHAVMLAETHNRQNPQSHHQLHRRAAASNNGGTTPMAFTSQSLIFRAAASPPCPRIAPSPGRVTLRDHRAAFPPLAAASTSMASSESEDKREAKLWGGRFEEGVTDAVERFTESISYDWQLYKYDIMGSKAHASMLAGQGLITATDRDIILEGLDQIERLIQEGKFEWRKDREDVHMNIEAALIERVGEPAKKLHTARSRNDQIVTDLRLWCRDAIDKILIRIKQLQVSLVILASKYVDLIVPGYTHLQRAQPVLLPHLLLSYVEQLERDAGRLVNCRERVNFCPLGACALAGTGLPIDRFQTAKDLKFTAPMKNSIDAVSDRDFVLEFLAANSIAAVHLSRIGEEWVLWASEEFGFLTPSDKVSTGSSIMPQKKNPDPMELVRGKSARVVGDLMTVLTLCKGLPQAYNRDLQEDKEPLFDSVKAVLGMLEVCTEFAQNISFNSKRIQSSLPAGYLDATTLADYLVKKGIPFRTSHEIVGRSVALCVYKQCQLAELELDDLKSVHPVFEGDVYEYLGVENAVNKFISYGSTGSEQVKKQLEDWRIQLGISS

SEQ ID NO: 15470 - DNA, 468 bp, Sorghum bicolor
  misc_feature: Ceres ANNOT ID no. 8641542
  misc_feature: Down-regulated in root tissues in response to methyl jasmonate treatment
  misc_feature: Up-regulated in shoot tissues in response to methyl jasmonate treatment
  misc_feature: Up-regulated in shoot tissues in response to salicylic acid treatment
  misc_feature: Encodes the peptide sequence at SEQ ID NO 15471
atggatacatacagccatacaggcacacgtcgacccatcaccagttgcagagaagggagacgacgggaggaagaggaggaggagtcagaggaagagatggcagggtgtgatggaggagccaagtcatcggcgtccatggaaaaagagtccactagagaagcaagcgtctgtgtctgtgccggcatgatggccctgacccctgaacaaacggataagccctccttcctcgctcccttcccgtacccggaagaggcatgcgcagagaagaagtacggaggaattgcacccaagaagcctttgatatccaaggaccacgagcgcgcctacttcgattctgcggactgggtgctgggcaagcaagctgcaaacagcagcacaagggctgctgtcgagtctctgaagcccaagctgaagagaacgcctcaccaccagctgccccctcgtaagcccacctgcgcttccagttga

SEQ ID NO: 15471 - protein, 155 aa, Sorghum bicolor
  misc_feature: Useful for biocontainment applications
  misc_feature: Functional homolog of the protein sequence given in SEQ ID NO 14200
  misc_feature: Ceres ANNOT ID no. 8641542
  misc_feature (88)..(155): Pfam ID: Lg106 Pfam Description: Lg106-like protein
MDTYSHTGTRRPITSCREGRRREEEEEESEEEMAGCDGGAKSSASMEKESTREASVCVCAGMMALTPEQTDKPSFLAPFPYPEEACAEKKYGGIAPKKPLISKDHERAYFDSADWVLGKQAANSSTRAAVESLKPKLKRTPHHQLPPRKPTCASS

SEQ ID NO: 15472 - DNA, 2013 bp, Sorghum bicolor
  misc_feature: Ceres ANNOT ID no. 8641584
  misc_feature: Encodes the peptide sequence at SEQ ID NO 15473
atggctggctccgtagctccacacgctgtggtcctcgctctcctcctgctcgcggggctcgcggcggcgcagagagggacgacgccgacgccgacgccggcggcggcggcccccgcgcccgaccccggctgcaacggcatcgaggtgacgtacaacttcgggggccgcaccaagatccggccctacgtcagcgacaagaacaagcagccctacgccttccgcgccaacgtcaccgtgcgcaactccggcacccgcccgctcaagtcgtgggcggcgctcgtcacgttcggctacgacgagatcctcgtcggcgtcgacggcgccgtgctcacgggcggcggcgagctgccgtacaacaccacggaggacgccggcaacgccacctccttctccgggtacccgcagacggacctcctcacgcccatcgccaccgccggggacctgtcgcagatccaggcctccgtcggcatcgtcggcacgctcttcgccgggcccggcttcgatccgctccccaccgcgctgtcgctggacgacccggcctacgcgtgccccgcggcgaccaacctcacctctaaggtgctgtccacctgctgcgtcctcacgccggaggccgaggccaatgccaccgtcatcgacgccaacgccaccgacccgaccaagaatttcctgccgcgcggcaccggtgacctcgtcatcacctacgacgtgctccaggcctacccctccagctaccttgcgctcgtcacgctcgagaacaacgccaagcttggccgcctcgacaactggcggatgtcgtgggagtggcggcgcggcgagttcatctactccatgaagggcgctcacccatcagaggtggacacctcgggctgtatctatggggcgcctgggcagtactaccagagccttgatttctcgcaggtgctcaattgtgaccgcaagccggtgatccttgacctgcccctgtcccggtacaatgacacccagattgggaagatcgacaactgctgcaggaatgggacaatcttgcccaagtccatggatgaagcacagtcgaaatcggcattccagatgcaagttttcaagatgccaccagacctgaaccggactaagctgttcccccctgccaatttcaagattgccggtgcatcatcgctgaacccggactacacctgtggccagccggtgcctgtcagcccaactgcgttccctgacccaagcgggcttgactcgacgacacttgctgtggcaacatggcaggtggtgtgcaacattaccacaacgaagggggccaagcccaagtgctgtgtgaccttctcggcgtactacaacgactcggtgatcccctgcaacacctgcgcctgtgggtgccctgcaaacaggcgaggtccaacgtgcagcacgactgcacaatccatgctcttgccaccggaggcgctgcttatgccattcaacaaccgctcacacaaggcgttggcgtgggctgagctgaagcattacaatgtgccccggccaatgccttgtggtgacttctgtggtgtgagcatcaattggcatgtctcaacagactacaacaagggctggagtgctcgggtgacattgttcaactgggaggatgtcgacatggccaattggtttgctgccatcgtcatggacaaggcgtatgatggctttgagaaggcgtactcatttaacgccacctcagtgggcaagaacacaatctttatgcagggtttggaggggcttaattacctggtgaagcagaccaacatgagtgggattgactaccttgtgcccggtaagcaacagtcagtcctctcattcaccaagaagctgaccccggggataaatgttgttgctggagatggcttcccaacaaaggtcttcttcaatggcgacgaatgtgctatgccgcagagaattccgatgagcaatgggttcggcaaccgtctcagcagtggccttgctttggtcttgttccttgctgcttcggctttcctattgcttcagcaatga

SEQ ID NO: 15473 - protein, 670 aa, Sorghum bicolor
  misc_feature: Useful for making plants with altered carbohydrate content
  misc_feature: Functional homolog of the protein sequence given in SEQ ID NO 13790
  misc_feature: Useful for making plants with altered cell wall content and/or composition
  misc_feature: Functional homolog of the protein sequence given in SEQ ID NO 13791
  misc_feature: Ceres ANNOT ID no. 8641584
  misc_feature (244)..(426): Pfam ID: Phytochel_synth Pfam Description: Phytochelatin synthetase-like conserved region
MAGSVAPHAVVLALLLLAGLAAAQRGTTPTPTPAAAAPAPDPGCNGIEVTYNFGGRTKIRPYVSDKNKQPYAFRANVTVRNSGTRPLKSWAALVTFGYDEILVGVDGAVLTGGGELPYNTTEDAGNATSFSGYPQTDLLTPIATAGDLSQIQASVGIVGTLFAGPGFDPLPTALSLDDPAYACPAATNLTSKVLSTCCVLTPEAEANATVIDANATDPTKNFLPRGTGDLVITYDVLQAYPSSYLALVTLENNAKLGRLDNWRMSWEWRRGEFIYSMKGAHPSEVDTSGCIYGAPGQYYQSLDFSQVLNCDRKPVILDLPLSRYNDTQIGKIDNCCRNGTILPKSMDEAQSKSAFQMQVFKMPPDLNRTKLFPPANFKIAGASSLNPDYTCGQPVPVSPTAFPDPSGLDSTTLAVATWQVVCNITTTKGAKPKCCVTFSAYYNDSVIPCNTCACGCPANRRGPTCSTTAQSMLLPPEALLMPFNNRSHKALAWAELKHYNVPRPMPCGDFCGVSINWHVSTDYNKGWSARVTLFNWEDVDMANWFAAIVMDKAYDGFEKAYSFNATSVGKNTIFMQGLEGLNYLVKQTNMSGIDYLVPGKQQSVLSFTKKLTPGINVVAGDGFPTKVFFNGDECAMPQRIPMSNGFGNRLSSGLALVLFLAASAFLLLQQ

SEQ ID NO: 15474 - DNA, 1578 bp, Sorghum bicolor
  misc_feature: Ceres ANNOT ID no. 8641588
  misc_feature: Encodes the peptide sequence at SEQ ID NO 15475
atgggcgatgggagtctgatcatagctggaagttcaacttattgttcctgtataaacactgaaccttattgtctagcaaatttggcaggaagtaatcaagttcaaggtcccattcaacgctgtctctcactgagaccatcttctcatctagcacctcctgtccgcattgcttaccctctctgctcctgtgcacaggaccatgccattcttgtcgtagggagggagctccataactcctacatactacaagaccgcgagagcactatgaagaatattgtagaggtgaccccctctctgataataacctcctatattgattcatgtgtcctttttttagccacctatgacttggaattgcttcctatgcttggctctactagccaacggaccaagcagcagcggccgccgccgccgcgcgggagacccggcgcgaggaagcggtggccgagccgggggagcgcgatgctgtgggtggcgcgcctgtccggcttcttatccgccgccatggtgatggtggtgctgtcgccgtcgctccagtccttcccgcccgccgaggccatccggtcgtcgcagttcgacggcagcgtccgcttcccgggccagatcgcagggggcgcccgggggatcgccttccgccgcgccccgtcgttccgcaatgccgccgattgcggcgccggcgcgggcaacggcaccgccgccaatgtctgcgacccttcgctcgtccacatcgcgattacgctcgatgaggagtacctgaggggctccgtcgccgcggtccactcggtggtgcagcacgccaggtgccccgagagcgtcttcttccacttcctcgtctccgacccgggcctcggggacctcgtccgcgcggtcttcccgcagctccggttcaaggtctactacttcgaccccgagcgcgtccgcgggctcatctccacgtcggtgcggcaggcgctggagcagccgctcaactatgcgcgcaactacctggccgacctcctcgagccctgcgtgcgccgcgtcatctacctcgactccgacctcgtcctcgtcgacgacgtcgccaagctctggcgcaccgacctcggcggccgcaccgtcggcgcccccgagtactgccacgccaactttaccaagtacttcaccggccggttctggtcggaccagcggttcgccgggacgttcgtggggcggcggccgtgctacttcaacacgggcgtcatggtgcttgacctggagcggtggcggcaagcgggctacacgcagcgcatcgagcgctggatggagatacagaagtcgccgccggggcgcatctacgagctgggttcgctgccgcccttcctgctcgtgttcgcggggcacgtggcgccgatcgagcaccggtggaaccagcacggcctcggcggcgacaatgtcctgggcagctgccgcgacctacacccgggacccgtgagcctgctgcattggtccgggtccggcaagccatgggcgcggctgggcgccgggcggccgtgcccgctcgatgcgctctgggcacccttcgacctgtacggccccgccggcgccggcgagtcccggtaa

SEQ ID NO: 15475 - protein, 525 aa, Sorghum bicolor
  misc_feature: Useful for making plants with altered carbohydrate content
  misc_feature: Functional homolog of the protein sequence given in SEQ ID NO 14010
  misc_feature: Useful for making plants with altered cell wall content and/or composition
  misc_feature: Functional homolog of the protein sequence given in SEQ ID NO 14201
  misc_feature: Ceres ANNOT ID no. 8641588
  misc_feature (242)..(499): Pfam ID: Glyco_transf_8 Pfam Description: Glycosyl transferase family 8
MGDGSLIIAGSSTYCSCINTEPYCLANLAGSNQVQGPIQRCLSLRPSSHLAPPVRIAYPLCSCAQDHAILVVGRELHNSYILQDRESTMKNIVEVTPSLIITSYIDSCVLFLATYDLELLPMLGSTSQRTKQQRPPPPRGRPGARKRWPSRGSAMLWVARLSGFLSAAMVMVVLSPSLQSFPPAEAIRSSQFDGSVRFPGQIAGGARGIAFRRAPSFRNAADCGAGAGNGTAANVCDPSLVHIAITLDEEYLRGSVAAVHSVVQHARCPESVFFHFLVSDPGLGDLVRAVFPQLRFKVYYFDPERVRGLISTSVRQALEQPLNYARNYLADLLEPCVRRVIYLDSDLVLVDDVAKLWRTDLGGRTVGAPEYCHANFTKYFTGRFWSDQRFAGTFVGRRPCYFNTGVMVLDLERWRQAGYTQRIERWMEIQKSPPGRIYELGSLPPFLLVFAGHVAPIEHRWNQHGLGGDNVLGSCRDLHPGPVSLLHWSGSGKPWARLGAGRPCPLDALWAPFDLYGPAGAGESR

SEQ ID NO: 15476 - DNA, 6420 bp, Sorghum bicolor
  misc_feature: Ceres ANNOT ID no. 8641592
  misc_feature: Encodes the peptide sequence at SEQ ID NO 15477
atggaagaggagggacaccacggagttgttttggcatgcagcatctgtgggttcctcttcgctgtccttagccctctcagcttttgggttctatgggctgtgaattggaggccatggaggttatacagttggatatatgcaaggaaatggccaacatatgtgcaaggacctcaactaagcacactttgcagccttttgactctttttgcatggcttgttgtcatttcccccatagcagttctcctcgtgtggggaagcatccttattgctcttctggaaaggaacataattggtttagctgttataatggcgggtgttgctttgcttctgtcattctactctataatgctctggtggagaacacaatggcaaagctcaaaggctgttgcttaccttctcctcctggcagtattcctactatgtgcctacgacttttgtgctatttatgtgacagctagtgctagtgcttccgagcttaattctccatcagggttcttcttcggggtgtctgcaatatcattggccatcaatatgctttttatatgtaaaatactgtttaatgtaagtggatttgatgttgatgaatatgtgcggaggtcatacaagtttgcctattctgactgtgttgaagtggctcctgtttcatgctctcctgagccaccagatcctaggcttctctacattagctcgctgcttgtgcttgttgcctattccatcttgtatggtcttacgtcaaaagaagctcgttggctgggtgctttaacttcagttgcagtggtgatccttgactggaatttgggcttgtgttcatttagatttgagcttcttaaaagtcggatgatagtgttatttgtggctggaacatcaagggctttccttatatccttcggagttcattactgttatgcttttgtagcatctgtgcttttatctgctgctgtctcttcctggctttctatttcaaacccctcagttgcaaggatagacgctctaagaagtacagttataaagctacgagagggatttcgaagaaaaggacaaaatagttcttcaaattcatcagaaggctgcggctctagtgtgaagcgtagtagcggtagtgttgaagctgttcaaaatggtaatgcaacggattctatgtacagaagcaactcacaaagcgatggtgtcaattggaacagtattccttttgatcgatcaaacagttgtcaagaaggccggagctctgacaagaacatagatagtgcacgtgcaagcttagctcataggagtaattcatgcctatctgctgtccaagactctgaaactgctgttgtttcaatagataggcatggagatcccactacttcacttgtttgttctagcagtggtttggaaagtcatggctgtgagcctagtggatcagccaccacctcaggtaatcaacagttattggatttgaacctggcagcgatatttcaggacagactaaatgacccaaggatttcatctatgctaaaaaagaacggtggacttggagatgtagaactagctaatcttcttcaggataaaggactggatccaaatttttcctacatgctgaaagacaaagtcatggatccacggattttagctttgctacagaggagcagcttggatgcagatagagagcatcaagatgatgtagatgtcacagctactgattcagatagattggataccactattgcaaaccagatctctttgtcagaagaactaaggagaagcggtctagaaaaatggttgaacatttcaaggctaatattccatcatttagctggatctccaatacgtgcttttattgttttcacagtaatgttcataatagagactactactgtggctatatatcgaccagagaccatcaaagtgataaatgcaacacatgaacagtttgaatttggtttctcgatactgcttctgtcaccagttgtctgctccattatggcattcatttggtctctgcgtgctgaagaaatgatgatgacatccaagccccggaagtatggtttcatcgcatggctactgagcacatgtgttggtttgtttctctctttcttaagcaagtcatcagttatattgggcttgtctctcacagtaccacttatggtggcttgcctctcatttgctgttcccatatggatgcgtaatggttaccgtttctggattcctggaagggagtttgataatcgtgaaaatgttagtcaagctccaggaaagaaagagcgggctctctttgttatcagcatagctgttttcactgcatcagttattggccttggcgcgatagtgtcagcaaagcctttagacgctttaggctataaagggtgggatgctgataagaacagcttctattctccctatgcaacatcgatgtatcttggatgggcgttgtcttcaacaattgctgtgattaccacggggttgatacctattgttgcttggtttgcaacgtaccggttttcaccttcatcagctatatgtgttggcctctttgcaactgttcttgtgtccttctgcggtgcatcctactggggagtggttaattcacgagaggatggtgtgcctctaaaggctgatttcctggcagcattacttcccttgctttgcattcctgcatttttctcgctgttcaccgggctgtacaaatggaaggatgatgattggaagatttctcgtggcgtttacctttttgttggcatgggaatgttgctgttgtttggtgcagttgcagctgttattgtcacaatcaggccctggactgttggagttgcttgcctcgtagccattctgttccttgtatttgttattggggtcatccactactggacatctaacaacttctatctaacgaggactcagatgctgcttgtttgttccattgcttttctcctagccttggctgccttcctgatgggtttatttcacggaaagccttttgttggagcatctataggttatttctcatttatatttcttctcactggaagggctttgactgtccttctatcaccgccaatcgtagtgtattcgccaagagtattgcctgtatacgtttatgatgctcatgcagactctgctaaaaatgttagctatgcctttcttattctgtacgggattgcattagcaactgaagtttggggtgttattgctagtctaataatgaatccaccatttgttggggctggcgtttctgctactactcttgtaattgctttcagttttgctgtttctcgaccatgcctgactcttaagatgatggaggatgcagttcattttctaagcaaggatacagttgtgcaagcgatgtcacggtctgctaataaaactagaaatgctatatctgggacttactcagcgcctcagaggtctgcaagctctgctgctcttttggttggagatcctgctcttacattggacagggctgggaactttgtgcttcctagggctgatgttatgaagctgagagatcgtttgagaaatgaagaaattgctgcaggatctttcttatgtggagtaaaagattgtttagtattttgcccccagtccctgtcaaacgtagattatcggaggaatatgtgtgcccatgcacgtattttggctttggaagaagcaattgatacggaatgggtgtatatgtgggacaaatttggtggttatttacttctgttgcttggattgactgccaaagctgaacaaatacaggatgaagtacgtctaagactctttttggatagcataggcctttccgatttgagtgccaaagaaattaagaaatggatgcccgaagatcggaggcaatttgagcttattcaagaaagttacataagggaaaaagaaatggaagaggaggctttgatgcaaaggcgagaggaagaaggaaagggaagagaaaggaggagggcattactggagagagaggaacgaaaatggaaggagctcgaaatatcattgctttcttccattcctaatactggaagcagggatgctgcagctatggcagcagctgtccgagctgttggaggtgaatctgctctggaagattcttttgcaagagatagggtctcttcaatagccaatcacatacgaaaggcacaattggctcggcgagcagaacagactggtattccaggcactgtatgcatacttgatgatgaaccaaggagtactggtcgtcattgtggagaacttgacttgtgcctctgtcaaagtcaaaaggttactttgtctattgctgtcatggttcaacctgtatctggtccagtgtgtctttttggaagtgaattccaaaagaaggtttgctgggaaatcttagtggcaggatcagaacagggaatggaagctggacaggttggtcttcgattagtgactaagggtgaaaggatgactactgttgctaaagagtggaacattggtgcgtctagtattgcagatggcaggtggcatcttgtcactgtaactttagatgccgacctaggtgaagcaacttctttcattgatggagtttatgatggatatcagaatgggttgccgttgccaacagagaacggtatttgggaacctgggactgatatttgggttggtgctaggccacccaccgacttagatgcctttggtaggtcagatagtgaaggttctgactcaaagatgcagatcatggatgcttttctatggggaagatgtctcagtgaagatgaggttactgtgttacatactgccatgtctcctgctgagtatggattttttgaccttgcacccggcgatgcttggcatggaagttattctgcaagggtggatgactgggaaagtgaagatgcttatgaggtttatgatcaaggggatgtcgaatgggatggacagtactcaagtggtaggaaacgtccagtacatgattctgtagctattgacattgactccttcgctaggagaccaagaaaaccaaggtttgagacacgtgatgaagtcaaccagcgtatgctttctgttgaaagggctgtcagggatgctcttgttgcgaaaggagagagaaacttcactgatcaagagttccctccagaggatcgttctttatttgtagatccaatgaatccacccctgaaactgcaggttgtttctgagtggatgaggccttctgacatagcaaaggagatatccatcagttctcagccttgcttgttttcgggttctgtgaattcctcagatgtgtgtcagggtcggttgggagactgttggttcctaagtgcagtcgcagttttaactgagatgtctcgtatatcagaagttataatcactcctgagtacaacgatgaagggatttacactgtcagattctgcattcagggtgagtgggtagccgtggttgttgatgattggatcccgtgcgagtctccggggaaaccagcattcgctactagtagaaagcaaaatgagctttgggtatccattcttgagaaggcttatgcgaaacttcatggctcttatgaggcattggaaggtgggcttgttcaagatgctctagtggatctcacaggtggggctggtgaagagattgatatgcgaagtcctcaagcacaacttgatctggctagtggaagattgtggtcccagttgttgcatttcaaacaagaaggttttcttcttggtgctggaagtccttctggatctgatgctcacatctcatcaagtggcattgttcagggacatgcatactcaattttgcaggtaagagaagttgatggccacaaactcatccaaatcagaaatccatgggcaaatgaagttgaatggaatggaccatggtcagactcttcaccagagtggaccgaacgaatgaagcataagctcatgcatgttccacagtcgaagaatggggtattctggatgtcttggcaagattttcagattcactttcggtcaatatatgtttgtcgtgtttatccaccagagatgcgttattctgtccatgggcaatggcgtggctacaatgcaggtggttgccaagattacgactcatggcatcaaaatccacagtatcgacttagagtaacaggacgtgatgcactataccctgttcatgtttttattacccttactcagggtgttggtttctctagaaagacgaatggtttccgtaactaccaatctagtcatgattcttcaatgttttacattggaatgaggatactcaagacacagggctgccgtgctgcttacaatatctacatgcatgaatcagctggtggaacagattatgttaactcgagagagatatcatgtgaactggtcttggatccttaccccaaagggtacacgattgtgccaactaccatccatcctggggaggaagcaccttttgtcttgtcagttttttcaaaagcatcaatcaaactagaggctgtttaa

SEQ ID NO: 15477 - protein, 2139 aa, Sorghum bicolor
  misc_feature: The sequence is a functional homolog of SEQ ID NO 24 in US patent 7189889
  misc_feature: Ceres ANNOT ID no. 8641592
  misc_feature (1684)..(1924): SWISSPROT Homolog: EC 3.4.22.54 Calpain-3
  misc_feature (1684)..(1985): Pfam ID: Peptidase_C2 Pfam Description: Calpain family cysteine protease
  misc_feature (1990)..(2137): Pfam ID: Calpain_III Pfam Description: Calpain large subunit, domain III
MEEEGHHGVVLACSICGFLFAVLSPLSFWVLWAVNWRPWRLYSWIYARKWPTYVQGPQLSTLCSLLTLFAWLVVISPIAVLLVWGSILIALLERNIIGLAVIMAGVALLLSFYSIMLWWRTQWQSSKAVAYLLLLAVFLLCAYDFCAIYVTASASASELNSPSGFFFGVSAISLAINMLFICKILFNVSGFDVDEYVRRSYKFAYSDCVEVAPVSCSPEPPDPRLLYISSLLVLVAYSILYGLTSKEARWLGALTSVAVVILDWNLGLCSFRFELLKSRMIVLFVAGTSRAFLISFGVHYCYAFVASVLLSAAVSSWLSISNPSVARIDALRSTVIKLREGFRRKGQNSSSNSSEGCGSSVKRSSGSVEAVQNGNATDSMYRSNSQSDGVNWNSIPFDRSNSCQEGRSSDKNIDSARASLAHRSNSCLSAVQDSETAVVSIDRHGDPTTSLVCSSSGLESHGCEPSGSATTSGNQQLLDLNLAAIFQDRLNDPRISSMLKKNGGLGDVELANLLQDKGLDPNFSYMLKDKVMDPRILALLQRSSLDADREHQDDVDVTATDSDRLDTTIANQISLSEELRRSGLEKWLNISRLIFHHLAGSPIRAFIVFTVMFIIETTTVAIYRPETIKVINATHEQFEFGFSILLLSPVVCSIMAFIWSLRAEEMMMTSKPRKYGFIAWLLSTCVGLFLSFLSKSSVILGLSLTVPLMVACLSFAVPIWMRNGYRFWIPGREFDNRENVSQAPGKKERALFVISIAVFTASVIGLGAIVSAKPLDALGYKGWDADKNSFYSPYATSMYLGWALSSTIAVITTGLIPIVAWFATYRFSPSSAICVGLFATVLVSFCGASYWGVVNSREDGVPLKADFLAALLPLLCIPAFFSLFTGLYKWKDDDWKISRGVYLFVGMGMLLLFGAVAAVIVTIRPWTVGVACLVAILFLVFVIGVIHYWTSNNFYLTRTQMLLVCSIAFLLALAAFLMGLFHGKPFVGASIGYFSFIFLLTGRALTVLLSPPIVVYSPRVLPVYVYDAHADSAKNVSYAFLILYGIALATEVWGVIASLIMNPPFVGAGVSATTLVIAFSFAVSRPCLTLKMMEDAVHFLSKDTVVQAMSRSANKTRNAISGTYSAPQRSASSAALLVGDPALTLDRAGNFVLPRADVMKLRDRLRNEEIAAGSFLCGVKDCLVFCPQSLSNVDYRRNMCAHARILALEEAIDTEWVYMWDKFGGYLLLLLGLTAKAEQIQDEVRLRLFLDSIGLSDLSAKEIKKWMPEDRRQFELIQESYIREKEMEEEALMQRREEEGKGRERRRALLEREERKWKELEISLLSSIPNTGSRDAAAMAAAVRAVGGESALEDSFARDRVSSIANHIRKAQLARRAEQTGIPGTVCILDDEPRSTGRHCGELDLCLCQSQKVTLSIAVMVQPVSGPVCLFGSEFQKKVCWEILVAGSEQGMEAGQVGLRLVTKGERMTTVAKEWNIGASSIADGRWHLVTVTLDADLGEATSFIDGVYDGYQNGLPLPTENGIWEPGTDIWVGARPPTDLDAFGRSDSEGSDSKMQIMDAFLWGRCLSEDEVTVLHTAMSPAEYGFFDLAPGDAWHGSYSARVDDWESEDAYEVYDQGDVEWDGQYSSGRKRPVHDSVAIDIDSFARRPRKPRFETRDEVNQRMLSVERAVRDALVAKGERNFTDQEFPPEDRSLFVDPMNPPLKLQVVSEWMRPSDIAKEISISSQPCLFSGSVNSSDVCQGRLGDCWFLSAVAVLTEMSRISEVIITPEYNDEGIYTVRFCIQGEWVAVVVDDWIPCESPGKPAFATSRKQNELWVSILEKAYAKLHGSYEALEGGLVQDALVDLTGGAGEEIDMRSPQAQLDLASGRLWSQLLHFKQEGFLLGAGSPSGSDAHISSSGIVQGHAYSILQVREVDGHKLIQIRNPWANEVEWNGPWSDSSPEWTERMKHKLMHVPQSKNGVFWMSWQDFQIHFRSIYVCRVYPPEMRYSVHGQWRGYNAGGCQDYDSWHQNPQYRLRVTGRDALYPVHVFITLTQGVGFSRKTNGFRNYQSSHDSSMFYIGMRILKTQGCRAAYNIYMHESAGGTDYVNSREISCELVLDPYPKGYTIVPTTIHPGEEAPFVLSVFSKASIKLEAV

SEQ ID NO: 15478 - DNA, 1707 bp, Sorghum bicolor
  misc_feature: Ceres ANNOT ID no. 8641591
  misc_feature: Encodes the peptide sequence at SEQ ID NO 15479
atgaaaggcgccgtcatcggcgcgtcgaccgtcctggtggtggcggtggtcgccaccatctgcgtcgtgtccttgagaggcagcggcgatggcgacagcagggaggagggcgagatgtcgacgtcggtgaagtccatcaagtccttctgccagcccgtggactacagggagacgtgcgagaaggcgctcagggcggctgccgggaacgccaccagcccgacggacctggccaaggccatcttcaaggtgacgtccgaccggatcgagaaggcggtgcgcgagtccgccgtcctgaacgagctcaagaacgacccgcgcaccaagggcgcgctcgacaactgcagggagctgctggactacgccatcgacgacctcaagacgaccttcgacaggctgggcggcttcgagatgaccaacttcaagagcgccgtggacgacctccggacgtggctcagctccgcgctcacgtaccaggagacgtgcctggacgggttcgagaacacgacgacggcggcggcgggcaagatgcgcagggcgctcaacagctcgcaggagctgacggagaacatcctggcgctcgtggacgagttctccgagacgctcgccaacctgggcatcccgagcttccaccgccggctcctggcggaccacgccggcggcgtgccgtcgtggatgcccgacgccaagcgccggctgcggaaggtctcccccggcgacaagggtttcaagccggacgtgacggtggccaaggacggcagcggcgacttcaggaccatcaacgcggcgctggccaaggtgccggtgaagagcgccgccacgtacgtcatgtacgtgaaggccggcacgtacagggagtacgtgtccgtgccccggaacgtgacgaacctggtgatggtcggcgacggcgccaccaagacggtgatcacgggcgacaagagcttcatgatgaacatcaccaccaaggacacggcgacgatggaggcgctcgggaacgggttcctgatgcgcgggatcggcgtggagaacacggcgggcgccaagaaccaccaggcggtggcgctgcgggtgcagagcgacatgtcggcgttctacgagtgccggttcgacgggtaccaggacacgctgtacacgcacacgagccggcagtactaccgcgagtgcgtcatcacgggcaccatcgacttcatcttcggcaacgcgcaggtggtgttccagaactgcctcatccaggtgcgcaagtgcatggacaaccagcagaacatcgtgacggcgcagggccgcaaggagaggaggtcggcgggcggcaccgtcatccacaactgcaccatcgagccgcacccggagttcgagaagagcgccggcgacggcaagctcaggaccttcctggggcggccgtggaaggagcactcgcgcacgctctacatccagtcggagatcgggggcttcatcgaccccaaggggtggctgccgtggctcggcgacttcggcctcagcacctgctactacgccgaggtggagaaccgcggggccggcgccgacacgagcaagcgtgtcaagtggaggggcgtcaagaacatcacctaccagcacgcgctgcagaagtacaccgtggagagcttcatccagggccagcactggctcccacagctcggcgtgccattcatcccggggctgctgccgcagaaccagtctggcaggatacactga

SEQ ID NO: 15479 - protein, 568 aa, Sorghum bicolor
  misc_feature: Useful for making plants with altered cell wall content and/or composition
  misc_feature: Functional homolog of the protein sequence given in SEQ ID NO 14202
  misc_feature: Ceres ANNOT ID no. 8641591
  misc_feature (41)..(552): SWISSPROT Homolog: EC 3.1.1.11 Pectinesterase
  misc_feature (245)..(544): Pfam ID: Pectinesterase Pfam Description: Pectinesterase
  misc_feature (40)..(193): Pfam ID: PMEI Pfam Description: Plant invertase/pectin methylesterase inhibitor
MKGAVIGASTVLVVAVVATICVVSLRGSGDGDSREEGEMSTSVKSIKSFCQPVDYRETCEKALRAAAGNATSPTDLAKAIFKVTSDRIEKAVRESAVLNELKNDPRTKGALDNCRELLDYAIDDLKTTFDRLGGFEMTNFKSAVDDLRTWLSSALTYQETCLDGFENTTTAAAGKMRRALNSSQELTENILALVDEFSETLANLGIPSFHRRLLADHAGGVPSWMPDAKRRLRKVSPGDKGFKPDVTVAKDGSGDFRTINAALAKVPVKSAATYVMYVKAGTYREYVSVPRNVTNLVMVGDGATKTVITGDKSFMMNITTKDTATMEALGNGFLMRGIGVENTAGAKNHQAVALRVQSDMSAFYECRFDGYQDTLYTHTSRQYYRECVITGTIDFIFGNAQVVFQNCLIQVRKCMDNQQNIVTAQGRKERRSAGGTVIHNCTIEPHPEFEKSAGDGKLRTFLGRPWKEHSRTLYIQSEIGGFIDPKGWLPWLGDFGLSTCYYAEVENRGAGADTSKRVKWRGVKNITYQHALQKYTVESFIQGQHWLPQLGVPFIPGLLPQNQSGRIH

SEQ ID NO: 15480 - DNA, 1341 bp, Sorghum bicolor
  misc_feature: Ceres ANNOT ID no. 8641619
  misc_feature: Encodes the peptide sequence at SEQ ID NO 15481
atgtgggcggagcgggtggtcggggagcgccggatgcggcagatccagcgcttcgcgcggaacgccaagctcaccgtcgtttgcctcctcctcaccgtcgtcgtgctccgcggcaccgtcggcgccggccgcttcggcacgccgcagcaggacctcatcgagctccgccagcacttcgtctcccacccgcaccgggcgctcgccgagcaccacgacgccaggtccagggcctccaccaccaccacgtcgtcctcctcctccgtccgccgcgacgacgagcccgacccgccgccgaggacgctcagggacccgccctacacgctgggccccaagatctccgactgggacgagcagcgcgccgcctggcaccgccgccacccggagacgccgcccttcctcaacgacatcaagccgcgggtgctgctcgtcacgggttcctcgcccaagccctgcgagaaccccgtcggggaccactacctcctcaagtccatcaagaacaagatggattactgccgcgtccacggcatcgaggtcttctacaacatggcgctgctcgacgccgagatggccggcttctgggccaaactcccgctcctgcgggcgctgctcctcgcgcacccggagttcgagttcatctggtggatggactctgacgccatgttcaccgacatggcattcgagctcccttgggagcgctacgggccatacaatctgatcatgcacggctgggacgagatggtctacgacgacaagaattggattgggctaaacaccggcagcttcttgctgcgcaactgccagtggtcacttgacatgctggatacctgggcgccaatggggccaaagggccctgtccgcattgaggctggcaaagtgctgaccaagtccttgaaggatcggccagtattcgaggccgatgatcagtcggccatggtgtacatcctcgcaacgcagcgcgagaagtggggtgataaggtttaccttgagaatgggtactaccttcatggctactgggggatcttggtcgacaggtatgaggagatgcttgagaattacaagccagggctcggcgatcaccggtggccgctcgtcacacactttgtcgggtgcaagccatgtggcaaatttggagactaccctgtcgagcgatgcctcaagaatatggatcgtgcgttcaattttggtgataaccagatcttgcagatgtatggattcactcacaagtcacttgcaagcaggagagtgaagaggatcaggaatgagaccagcaacccgcttgagacaaaggatgagcttgggttgcttcatccggcattcaaggctgtgaagacttccacatga

SEQ ID NO: 15481 - protein, 446 aa, Sorghum bicolor
  misc_feature: Useful for making plants with altered carbohydrate content
  misc_feature: Functional homolog of the protein sequence given in SEQ ID NO 13770
  misc_feature: Useful for making plants with altered cell wall content and/or composition
  misc_feature: Functional homolog of the protein sequence given in SEQ ID NO 13771
  misc_feature: Ceres ANNOT ID no. 8641619
  misc_feature (4)..(446): SWISSPROT Homolog: EC 2.4.2.39 Xyloglucan 6-xylosyltransferase
  misc_feature (136)..(380): Pfam ID: Glyco_transf_34 Pfam Description: galactosyl transferase GMA12/MNN10 family
MWAERVVGERRMRQIQRFARNAKLTVVCLLLTVVVLRGTVGAGRFGTPQQDLIELRQHFVSHPHRALAEHHDARSRASTTTTSSSSSVRRDDEPDPPPRTLRDPPYTLGPKISDWDEQRAAWHRRHPETPPFLNDIKPRVLLVTGSSPKPCENPVGDHYLLKSIKNKMDYCRVHGIEVFYNMALLDAEMAGFWAKLPLLRALLLAHPEFEFIWWMDSDAMFTDMAFELPWERYGPYNLIMHGWDEMVYDDKNWIGLNTGSFLLRNCQWSLDMLDTWAPMGPKGPVRIEAGKVLTKSLKDRPVFEADDQSAMVYILATQREKWGDKVYLENGYYLHGYWGILVDRYEEMLENYKPGLGDHRWPLVTHFVGCKPCGKFGDYPVERCLKNMDRAFNFGDNQILQMYGFTHKSLASRRVKRIRNETSNPLETKDELGLLHPAFKAVKTST

SEQ ID NO: 15482 - DNA, 1341 bp, Sorghum bicolor; identical to SEQ ID NO: 15480
  misc_feature: Ceres ANNOT ID no. 8641616
  misc_feature: Encodes the peptide sequence at SEQ ID NO 15483

SEQ ID NO: 15483 - protein, 446 aa, Sorghum bicolor; identical to SEQ ID NO: 15481
  misc_feature: Useful for making plants with altered carbohydrate content
  misc_feature: Functional homolog of the protein sequence given in SEQ ID NO 13770
  misc_feature: Useful for making plants with altered cell wall content and/or composition
  misc_feature: Functional homolog of the protein sequence given in SEQ ID NO 13771
  misc_feature: Ceres ANNOT ID no. 8641616
  misc_feature (4)..(446): SWISSPROT Homolog: EC 2.4.2.39 Xyloglucan 6-xylosyltransferase
  misc_feature (136)..(380): Pfam ID: Glyco_transf_34 Pfam Description: galactosyl transferase GMA12/MNN10 family

SEQ ID NO: 15484 - DNA, 1791 bp, Sorghum bicolor
  misc_feature: Ceres ANNOT ID no. 8641640
  misc_feature: Encodes the peptide sequence at SEQ ID NO 15485
atggcgaggtcaggtctcgtgaagctctgctgcgcctctgctctccttttgctaggctgcttcctcctccccggcgcccttgccgaggagcgcttctacgagttcgtcgtcaaggagacgctagtgaagaggctgtgcaagagccagaagatcgtgacggtgaacgggcagttcccggggccgaccatcgaggtgtacagcggcgacacgctggcgatcaaggccgtgaacctggcgccgtacaacgtgaccctgcactggcacggcctccggcagctgcggaacgggtgggcggacgggccggagttcgtgacgcagtgcccgatccgccccggcggcagctacacgtaccggttcaccacccagggccaggagggcacgctgtggtggcacgcgcacagctcctggctccgcgccaccgtgcatggcgcgctcatcatccaccccaggaggggcctcccctaccctttccccaagccacaaatggaggcccccgtcatcctagccgagtggtggatgaggaaccccatcgccgtgctccgccagtccatgatcaccggagcgccgcccaacgtctccgacgccctcctcatcaacggccagccgggagacttgctcccgtgctccagccaagagacgagcatcatcccggtggtcgccggcgagacgagcctgctgcgcatcatcaacgcggccatgaacaccgagctcttcgtcagcctcgccggccacaggatgaccgtggtcgccgcggacgccatgtacaccaagcccttcgagaccgacgtcgtcctcctcggccccggccagaccaccgacgtcctcgtcacggcgcacgcagccccgggacgatactacctcgccgcgcgcgcctacgcttcggcccagggcgtccccttcgacaacaccaccgccaccgccatcttccagtacaagaacgcccccggctgccccaccgcctctgccggtgccggtgccttcagcggcccagttggccggtccactaggtcctccggccacctcggccgcgcagggccgcagccgatgctcccgttcctgccggcgttcaacgacacgaacacggcgaccgccttctccaacagcctccggagcccagcgccggtgaaggtgcccgggccggtgacccaggaggtgttcaccaccgtggggtttggcctcttcaactgccgccccgggccgttctgccagggccccaacaacacccggttcggcgcgagcatgaacaacgtgtcgttccagctccccaacaccgtgtccctgctgcaggcgcactaccaccacatccccggcgtgttcaccgaagacttcccggcgttcccgccggtgttcttcgacttcacctcgcagaacgtcccgcgcgcgctgtggcagcccgtgaagggcaccaagctgtaccgcgtcgagtacggcgcggtggtgcagatggtgttccaggacacgggcatcttcgccgccgaggagcaccccatgcacatccacggctaccacttcttcgtgctggccacggggttcggcaactacgacccgcgccgggacgaggccaagttcaacctggtggacccgcccagccgcaacaccatcggcgtgcccgtcggcggctgggccgtcgtgcgcttcgtggcagacaacccaggggtgtggctcgtgcactgccacatcgacgcccacctcacgggcgggctcgccatggcgctgctggtggaggacggcgaggccgagctcgaggccaccatcgcgccgccgctcgacttgcccatatgcgtgctgtag

SEQ ID NO: 15485 - protein, 596 aa, Sorghum bicolor
  misc_feature: Useful for making plants with altered cell wall content and/or composition
  misc_feature: Functional homolog of the protein sequence given in SEQ ID NO 14203
  misc_feature: Useful for biocontainment applications
  misc_feature: Useful for making plants with modulated biomass
  misc_feature: Useful for making plants with modulated flowering time
  misc_feature: Useful for making plants with modulated low light sensitivity
  misc_feature: Functional homolog of the protein sequence given in SEQ ID NO 14204
  misc_feature: Useful for making plants with altered carbohydrate content
  misc_feature: Functional homolog of the protein sequence given in SEQ ID NO 14205
  misc_feature: Ceres ANNOT ID no. 8641640
  misc_feature (29)..(319): SWISSPROT Homolog: EC 1.10.3.2 Laccase
  misc_feature (36)..(152): Pfam ID: Cu-oxidase_3 Pfam Description: Multicopper oxidase
  misc_feature (163)..(314): Pfam ID: Cu-oxidase Pfam Description: Multicopper oxidase
  misc_feature (442)..(578): Pfam ID: Cu-oxidase_2 Pfam Description: Multicopper oxidase
MARSGLVKLCCASALLLLGCFLLPGALAEERFYEFVVKETLVKRLCKSQKIVTVNGQFPGPTIEVYSGDTLAIKAVNLAPYNVTLHWHGLRQLRNGWADGPEFVTQCPIRPGGSYTYRFTTQGQEGTLWWHAHSSWLRATVHGALIIHPRRGLPYPFPKPQMEAPVILAEWWMRNPIAVLRQSMITGAPPNVSDALLINGQPGDLLPCSSQETSIIPVVAGETSLLRIINAAMNTELFVSLAGHRMTVVAADAMYTKPFETDVVLLGPGQTTDVLVTAHAAPGRYYLAARAYASAQGVPFDNTTATAIFQYKNAPGCPTASAGAGAFSGPVGRSTRSSGHLGRAGPQPMLPFLPAFNDTNTATAFSNSLRSPAPVKVPGPVTQEVFTTVGFGLFNCRPGPFCQGPNNTRFGASMNNVSFQLPNTVSLLQAHYHHIPGVFTEDFPAFPPVFFDFTSQNVPRALWQPVKGTKLYRVEYGAVVQMVFQDTGIFAAEEHPMHIHGYHFFVLATGFGNYDPRRDEAKFNLVDPPSRNTIGVPVGGWAVVRFVADNPGVWLVHCHIDAHLTGGLAMALLVEDGEAELEATIAPPLDLPICVL

SEQ ID NO: 15486 - DNA, 312 bp, Sorghum bicolor
  misc_feature: Ceres ANNOT ID no. 8641666
  misc_feature: Encodes the peptide sequence at SEQ ID NO 15487
atgtcggcgagcagcgcgcccgtagacgcctcgggggagccgatcccgacgtcgtcggtgctgatggcggcgtcgaagcacatcgcagtccggtgccgcccggagaacgtcgccttcctcaactgcaagaagaaggaccctaaccccgagaagtgcctcgagaagggacgtcaggtcacacgttgcgtccttagcctggttcgatacggtagtgaagcgatttgtgagttttctgatgttgcagttgaacatctacctggcattggttacgtgataactagagtgtactctttggccatcccttatcagtag

SEQ ID NO: 15487 - protein, 103 aa, Sorghum bicolor
  misc_feature: Useful for making plants with modulated nitrogen use efficiency
  misc_feature: Useful for making plants with modulated oxidative stress sensitivity
  misc_feature: Functional homolog of the protein sequence given in SEQ ID NO 14206
  misc_feature: Ceres ANNOT ID no. 8641666
MSASSAPVDASGEPIPTSSVLMAASKHIAVRCRPENVAFLNCKKKDPNPEKCLEKGRQVTRCVLSLVRYGSEAICEFSDVAVEHLPGIGYVITRVYSLAIPYQ

SEQ ID NO: 15488 - DNA, 618 bp, Sorghum bicolor
  misc_feature: Ceres ANNOT ID no. 8641680
  misc_feature: Encodes the peptide sequence at SEQ ID NO 15489
atggccgaccccgcggagcaccgtccagcggaggaggaggaggaggccgcggcggccggcgaggatgaggacaccggcgcccaggtcgcccccatcgtgaagcttgaggaggtcgccgttaccaccggagaggaggacgaggacgtgaaagcgaagctataccggttcgataaggatgggaaccagtggaaagagcgcggaacaggcactgttaagctgctcaagcacaaggagaccgccaaggtccgcctcgtgatgcgtcaggcgaagacgcttaagatctgtgctaaccatctcgtggtggcgacgactaagatgcaggagcacgcggggagcgacaagtcgtgcgtgtggcacgcgctggacttcgccgaaggcgagctcaaggaggagatgttcgccatccgttttggatctgtcgagaattgcaagaagtttaaggatattgttgaagagatagctgaacagcaaggaaacactgaggagaaagaaaatgaggaagcctccactgccgctgatttggtagagaagttgacggtgacagaggccagcaaggaggaaactgtggagaaagaggaggctcctgcatctgatgataagaaggatgctaaagagtga

SEQ ID NO: 15489 - protein, 205 aa, Sorghum bicolor
  misc_feature: Useful for biocontainment applications
  misc_feature: Useful for making plants with modulated flowering time
  misc_feature: Functional homolog of the protein sequence given in SEQ ID NO 14207
  misc_feature: Ceres ANNOT ID no. 8641680
  misc_feature (39)..(156): Pfam ID: Ran_BP1 Pfam Description: RanBP1 domain
MADPAEHRPAEEEEEAAAAGEDEDTGAQVAPIVKLEEVAVTTGEEDEDVKAKLYRFDKDGNQWKERGTGTVKLLKHKETAKVRLVMRQAKTLKICANHLVVATTKMQEHAGSDKSCVWHALDFAEGELKEEMFAIRFGSVENCKKFKDIVEEIAEQQGNTEEKENEEASTAADLVEKLTVTEASKEETVEKEEAPASDDKKDAKE

SEQ ID NO: 15490 - DNA, 1149 bp, Sorghum bicolor
  misc_feature: Ceres ANNOT ID no. 8641696
  misc_feature: Encodes the peptide sequence at SEQ ID NO 15491
atgctgccgtcgtcctgcaggaagagtgccgccctcgccgccgttgcgttgtcttcctccgtcgtcctcctgctccacgctgtcgctgccttctctctcccggcagcctcggcgctctccgtcgggctggcgcggcgccaccggcacgacgccacgcccgggcttcaggccgccggctgcgacgtcttcagtggcagctgggtcctcgacggcggctcggcggcgtcgtacaccgggtacaactgcccgctcatcgacgcggagttcaactgccagctctacggccgcccggactccgactacctccggttcgatggcgcagacttcttgacgcggatgaaggggaagacggtgatgttcgtgggtgactcgctgggccgcaaccagtgggagtcgctcgtctgcctgctgcacgccgccgtgccgcagtcgccggcgcagctcgtctccgcggaccctctgtacacctacaagttcctggagtaccaggtgacggtgtccttctaccgcgcgccgtacctggtggacatcgacgtggtccaggggaagcgggtgctgatgctggacgacatctccgagaacgccgaggcgtggcgcgacgccgacgtgctctccttcaactccggccactggtggacgcacaccggctcgatgcaggggtgggactacatgggcacgtctggccgatactacgaggacatggaccgcacggtggcattccagcgcggcctcaccacctgggccaactgggtggacctcaacctcgatcaagccaagacccgtgtcttcttccagtccatgtcgcccacgcactacagctcgaaggaatggcccaacccggtatcgaagaactgctacggcgagacggcaccggtgactgggctgaactcgaccggccaggcctcgggccaggaccaggtgatccaggccgtgctgcggggcatgaagagccccgtccgtctcctcgacatcacggcgctgtcggcgatgcgcaaggacgcgcacccatcggtgtacagcggcgacttctcgccggcgcagcgtgccaaccccggcgccggcggctccgttgactgcagccactggtgccttcccggcctcccggacacctggaaccagctcttctacacactcctcttctacaaataa

SEQ ID NO: 15491 - protein, 382 aa, Sorghum bicolor
  misc_feature: Useful for making plants with modulated nitrogen use efficiency
  misc_feature: Functional homolog of the protein sequence given in SEQ ID NO 14208
  misc_feature: Ceres ANNOT ID no. 8641696
MLPSSCRKSAALAAVALSSSVVLLLHAVAAFSLPAASALSVGLARRHRHDATPGLQAAGCDVFSGSWVLDGGSAASYTGYNCPLIDAEFNCQLYGRPDSDYLRFDGADFLTRMKGKTVMFVGDSLGRNQWESLVCLLHAAVPQSPAQLVSADPLYTYKFLEYQVTVSFYRAPYLVDIDVVQGKRVLMLDDISENAEAWRDADVLSFNSGHWWTHTGSMQGWDYMGTSGRYYEDMDRTVAFQRGLTTWANWVDLNLDQAKTRVFFQSMSPTHYSSKEWPNPVSKNCYGETAPVTGLNSTGQASGQDQVIQAVLRGMKSPVRLLDITALSAMRKDAHPSVYSGDFSPAQRANPGAGGSVDCSHWCLPGLPDTWNQLFYTLLFYK

SEQ ID NO: 15492 - DNA, 1356 bp, Sorghum bicolor
  misc_feature: Ceres ANNOT ID no. 8641702
  misc_feature: Encodes the peptide sequence at SEQ ID NO 15493
atggcgcggctcgtgctctccgagtgctgcggcctcgcgccgctgcgcctgcgcgccggccgccggggcgccgccattgcggcgccgtcgcccgccgcgctctccgtggcggcagcggcggtggtcccgggccgccccgcgtccgcggccatccaccgcgactgggcgctccgcgtctccgcgcccacccgcctcacctccgccgtcgaggaggacaagaggagctccccgctcggggaggagggcgtggcggacagcggcgccgcgggcggggacgggttcgacccgggggcgcccccgccgttcgggctggcggagatccgcgcggccatccccaagcactgctgggtcaaggacccctggcgctccatgagctacgtgctgcgtgacgtcgtcgtcgtcctgggactcgccgcggcggccgcgcgcctcgacagctggctcgtctggccgctctactgggccgcgcagggcaccatgttctgggcgctcttcgtccttggccacgactgtggacacgggagcttctcaaacaaccccaagctcaacagcgtggtcggccacatactccattcctccattcttgtcccataccacggatggaggattagccacaggacgcaccatcaaaaccacggccacgttgagaaggacgagtcctggcacccgctaccagagaggctgtacaaaagcctggactttatgactaagaaattgcggttcaccatgccattccccctgctcgcgttcccgttatacttgttcgcaaggagtccagggaagacaggatcacacttcaacccaagcagtgatttgttccaacctaatgaaaagaaggacatcataacatcaacggcctcctggctggccatggttggtgttctggctggtctcacctttatgatgggtcctattccgatgctaaagctctacggagtcccatacttggtatttgttgcttggctggatatggtcacatacttgcaccatcatggccacgaagacaagcttccctggtaccgtggaaaggaatggagttatctgcgtggaggactgacgacactcgaccgggactatggattgatcaacaatatccatcatgacattggaacccatgtcatccatcaccttttccctcaaatcccacattaccatctcattgaggcgactgaggcagcaaaaccggttcttggcaagtactacaaagaaccaaagaagtcgggtgctcttccgtggcacctatttggggtgctagcacaaagcttaaagcaagaccactatgttagcgacaccggagatgtagtctactaccaaactgactcgaaaacgaacacctctgcacaaaaatctgattga

SEQ ID NO: 15493 - protein, 451 aa, Sorghum bicolor
  misc_feature: Useful for making plants with modulated heat sensitivity
  misc_feature: Functional homolog of the protein sequence given in SEQ ID NO 13709
  misc_feature: Ceres ANNOT ID no. 8641702
  misc_feature (104)..(402): SWISSPROT Homolog: EC 1.14.99.33 Delta(12)-fatty acid dehydrogenase
  misc_feature (153)..(397): Pfam ID: FA_desaturase Pfam Description: Fatty acid desaturase
MARLVLSECCGLAPLRLRAGRRGAAIAAPSPAALSVAAAAVVPGRPASAAIHRDWALRVSAPTRLTSAVEEDKRSSPLGEEGVADSGAAGGDGFDPGAPPPFGLAEIRAAIPKHCWVKDPWRSMSYVLRDVVVVLGLAAAAARLDSWLVWPLYWAAQGTMFWALFVLGHDCGHGSFSNNPKLNSVVGHILHSSILVPYHGWRISHRTHHQNHGHVEKDESWHPLPERLYKSLDFMTKKLRFTMPFPLLAFPLYLFARSPGKTGSHFNPSSDLFQPNEKKDIITSTASWLAMVGVLAGLTFMMGPIPMLKLYGVPYLVFVAWLDMVTYLHHHGHEDKLPWYRGKEWSYLRGGLTTLDRDYGLINNIHHDIGTHVIHHLFPQIPHYHLIEATEAAKPVLGKYYKEPKKSGALPWHLFGVLAQSLKQDHYVSDTGDVVYYQTDSKTNTSAQKSD

SEQ ID NO: 15494 - DNA, 387 bp, Sorghum bicolor
  misc_feature: Ceres ANNOT ID no. 8641732
  misc_feature: Encodes the peptide sequence at SEQ ID NO 15495
atgtggaagggcatcgtcgccgcatacctcgtcaccgccgcctgctactttcccgtcgcgctcctcgagtgctgggcctttgggcgcgacgtcagcgacaacgtcctcgtcgcgctgcagcgcctgccttggctcgtcgccgccgccaacatgatggtcgtcatccatgtcgtcggaagctatcagcatcaagatattctggtgacaagatacagattaccgcaaggattactactccgtctcgtggcccgatcggcttatgtcgcattcacgctgttcatcgcggtgaccttcctgttcttcggcgacctcctcggcttcttcggagggtttgggttcacgccgacctcctacttcctaagctgcagcagccttccgcttctttag

SEQ ID NO: 15495 - protein, 128 aa, Sorghum bicolor
  misc_feature: Useful for making plants with altered oil content
  misc_feature: Functional homolog of the protein sequence given in SEQ ID NO 13448
  misc_feature: Ceres ANNOT ID no. 8641732
MWKGIVAAYLVTAACYFPVALLECWAFGRDVSDNVLVALQRLPWLVAAANMMVVIHVVGSYQHQDILVTRYRLPQGLLLRLVARSAYVAFTLFIAVTFLFFGDLLGFFGGFGFTPTSYFLSCSSLPLL

SEQ ID NO: 15496 - DNA, 2577 bp, Sorghum bicolor
  misc_feature: Ceres ANNOT ID no. 8641780
  misc_feature: Encodes the peptide sequence at SEQ ID NO 15497
atggctggccccgttcttgacatgctcctgcgggtcgccgtcgtgctgtctgctctgttgcccgcggcgcgcgccgcgttcaccccggcggacaactacctcgtgctctgcggcacggcggccaacgccaccgtcgacggcaggacgttcctcggggacgccagcctacccgcctcggtgctgtcggcgtcccggggctccgaggccaacgcgtcggcggcgggatcggccaccggctccgacgacgcggcgctgtaccagtacgcgcgcgtgttcgccgcgccgtcctcgtacacgttcgcgatcacgaagccagggcgacacttcgtgcgcctccacttcttccccttccggtaccagtccggtgacctcgccgcggacgccaggttcagcgtgtccgtgcagggcctggtgctcatcgacgggtactcgcccgtcaacggcacggccgtggtccgggagttctccgtcaacgtcgctggcggcacgctggcgatcgcgttcacgccgacgccgacgccggcgggaaaggtggcgttcgtgaacgccatcgaggtcgtgtcgcaccccgacgacctcttcggcgacgcggcgcagacggtgaaccccatgggccgctacacggggctgtccacgctggcgctggagacggttcacagggtcaacatgggctctcccaagatcacgcccagaaacgacacgctggggaggacgtggctccccgacgagagcttcctggtcgacagttccgttacggtgcacaaagatgtggcgccctcgacgctccggtggacgcgaggcttcgcgacctccgagacggcgccaggcatggtctatgctacagcgacggagatcaacacgactctcatgtccgccagcaccataagcgtgcagtttaacatgacgtggaaattacaagccacgccggggtcggcgtacctgctccggctacacttctgcgacatagtcagcaaggcggcgaacgtattggtcttcaacgtctacgtcggcggatggactgtgctgccggactacgagatctccagagacactttcagcgttcaggccgtgccgttgttcaaggactttgtgctcagcgccaaggacgccaggggcaacatcaccgtgagcatcgggacgtccacgctgggcaacgcggacccggacggcatcctcaacggcctcgagatcatgagaatggtcgggagcaccggcggcgaaggcgccgcctcgtcggagggcggttcaaagaaaatcaccatcgcaatcgccgccggttcggccgtcgcgggggtcacagtggtgatggctctcgcgctcactgtcctcatggtgcgacgaaggaagaagccggagaagaagccgtcgagcacatgggccgcgttctcggcgagcgcgctgggctcccgggcgcactcgcggagcttcggcaacagcaacagcagtggcgccaggaacaacacgatcacgctcgggcagagcgccggtgctgggtaccggatccccttcgcggcgctgcaggaggcgacgtgcgggttcgacgaggccatggtgatcggcgtgggcgggttcggaaaggtgtacaagggcacgatgcgggacgagacgctggtggccgtgaagcgcggcaacaggcagtcaaagcaggggctgaacgagttccgcacggagatcgagctgctctcccggctgcggcaccgccacctggtgtcgctcatcggctactgcgacgagcgcggcgagatgatcctggtgtacgagtacatggccaggggcacgctccggagccacctctacgactccgagctgcctccgctgtcgtggaagcagaggctcgacgtctgcatcggcgccgccaggggcctgcactacctccacaccggctcggccaaggcgatcatccaccgggacgtcaagtccgccaacatcctcctcgacgacagcttcatggccaaggtcgccgactttgggctgtccaagaccgggccggagctggacaagacgcacgtcagcaccgccgtcaagggcagcttcgggtacctcgacccggagtacttccggcggcagatgctgacggacaagtccgacgtctactccttcggcgtcgtcttgctcgaggtgctctgcgcgcgccccgtcatcgacccgactctgccccgggagatggtcaacctggcggagtgggccacgcagcggctcaagaacggcgagctcgacagcatcgtcgaccagcggatcgccgggtcgatacggccggagtcgctcaagaagttcgttgacaccgcggagaagtgcctcgcggagtacggcgtggagcggcccgccatgggggacgtgctctggtgcctcgagttcgcgctgcagctgcaggaggcgtcgctggacagctccggcacaaaggcgtcgccggacagctccggcacagacaacacgcagctagttctcaggaatgcgtccagattacatcgcaaccagtcgaacgccagcgacggggcagaggccaacttgggggacctcgatggtatgtccatgaggagagttttttcaaagatgatcaagagcgaggagggtaggtga

SEQ ID NO: 15497 - protein, 858 aa, Sorghum bicolor
  misc_feature: Useful for making plants with modulated biotic stress sensitivity
  misc_feature: Functional homolog of the protein sequence given in SEQ ID NO 14099
  misc_feature: Ceres ANNOT ID no. 8641780
  misc_feature (518)..(828): SWISSPROT Homolog: EC 2.7.11.1 Non-specific serine/threonine protein kinase
  misc_feature (513)..(781): Pfam ID: Pkinase Pfam Description: Protein kinase domain
MAGPVLDMLLRVAVVLSALLPAARAAFTPADNYLVLCGTAANATVDGRTFLGDASLPASVLSASRGSEANASAAGSATGSDDAALYQYARVFAAPSSYTFAITKPGRHFVRLHFFPFRYQSGDLAADARFSVSVQGLVLIDGYSPVNGTAVVREFSVNVAGGTLAIAFTPTPTPAGKVAFVNAIEVVSHPDDLFGDAAQTVNPMGRYTGLSTLALETVHRVNMGSPKITPRNDTLGRTWLPDESFLVDSSVTVHKDVAPSTLRWTRGFATSETAPGMVYATATEINTTLMSASTISVQFNMTWKLQATPGSAYLLRLHFCDIVSKAANVLVFNVYVGGWTVLPDYEISRDTFSVQAVPLFKDFVLSAKDARGNITVSIGTSTLGNADPDGILNGLEIMRMVGSTGGEGAASSEGGSKKITIAIAAGSAVAGVTVVMALALTVLMVRRRKKPEKKPSSTWAAFSASALGSRAHSRSFGNSNSSGARNNTITLGQSAGAGYRIPFAALQEATCGFDEAMVIGVGGFGKVYKGTMRDETLVAVKRGNRQSKQGLNEFRTEIELLSRLRHRHLVSLIGYCDERGEMILVYEYMARGTLRSHLYDSELPPLSWKQRLDVCIGAARGLHYLHTGSAKAIIHRDVKSANILLDDSFMAKVADFGLSKTGPELDKTHVSTAVKGSFGYLDPEYFRRQMLTDKSDVYSFGVVLLEVLCARPVIDPTLPREMVNLAEWATQRLKNGELDSIVDQRIAGSIRPESLKKFVDTAEKCLAEYGVERPAMGDVLWCLEFALQLQEASLDSSGTKASPDSSGTDNTQLVLRNASRLHRNQSNASDGAEANLGDLDGMSMRRVFSKMIKSEEGR

SEQ ID NO: 15498 - DNA, 600 bp, Sorghum bicolor
  misc_feature: Ceres ANNOT ID no. 8641799
  misc_feature: Encodes the peptide sequence at SEQ ID NO 15499
atggcaagcctgcagaatctgatttgctccgtatccaaacaagtcacgaaaaggcgattagctttgtttggtgctggagcgttagccactggcctactgaagacaggctctgcatttgctgaagaagtaccgaagaattataaatcttatgtggatgcgaaagatggatactcatatctttatccagctgaatggagggatttcgacttcttggggcatgattcggcattcaaagataaaaattttgcccttcagtgtgttcgggtgggatttattcctactgagaaaacagatgtccgcgacctaggaccaatggatgaggccatcttcaatctggtaaacaatgtttatgctgccccgaatcaaataccgtctgtctatgacatgcaagagcgtactgttgacggcaagaactactggacgtttgaatacgatctggaggctccgggctacggtgtttctgcgtttgcaacggtcgccattggaaacggtcgatactacacgttgatcgtgaccgcgaacgaacgccggtggagcagactgcgaaacaagctcaaagtcgtcgcggactctttcaagatctcggatctgacagcgtga

SEQ ID NO: 15499 - protein, 199 aa, Sorghum bicolor
  misc_feature: Useful for making plants with modulated salt sensitivity
  misc_feature: Functional homolog of the protein sequence given in SEQ ID NO 14209
  misc_feature: Ceres ANNOT ID no. 8641799
  misc_feature (11)..(195): Pfam ID: PsbP Pfam Description: PsbP
MASLQNLICSVSKQVTKRRLALFGAGALATGLLKTGSAFAEEVPKNYKSYVDAKDGYSYLYPAEWRDFDFLGHDSAFKDKNFALQCVRVGFIPTEKTDVRDLGPMDEAIFNLVNNVYAAPNQIPSVYDMQERTVDGKNYWTFEYDLEAPGYGVSAFATVAIGNGRYYTLIVTANERRWSRLRNKLKVVADSFKISDLTA

SEQ ID NO: 15500 - DNA, 207 bp, Sorghum bicolor
  misc_feature: Ceres ANNOT ID no. 8641802
  misc_feature: Encodes the peptide sequence at SEQ ID NO 15501
atgacagaggcaggccccgtgctctccatgtgcatggcgtttgccaaggagccgttgccggtgaagtccgatgcctgcggcacggtggtgaggaacgccgagctcaagatcatggacctggacaccgggctgtccctcccccgcaaccagcccaatgagatttgcatcaggggcaagcagttgatgaaaggggctacagtttggtaa

SEQ ID NO: 15501 - protein, 68 aa, Sorghum bicolor
  misc_feature: Useful for making plants with altered carbohydrate content
  misc_feature: Functional homolog of the protein sequence given in SEQ ID NO 14210
  misc_feature: Useful for making plants with altered cell wall content and/or composition
  misc_feature: Functional homolog of the protein sequence given in SEQ ID NO 13696
  misc_feature: Useful for making plants with altered lignin content
  misc_feature: Functional homolog of the protein sequence given in SEQ ID NO 14211
  misc_feature: Ceres ANNOT ID no. 8641802
  misc_feature (1)..(64): SWISSPROT Homolog: EC 6.2.1.12 4-coumarate--CoA ligase
MTEAGPVLSMCMAFAKEPLPVKSDACGTVVRNAELKIMDLDTGLSLPRNQPNEICIRGKQLMKGATVW

SEQ ID NO: 15502 - DNA, 105 bp, Sorghum bicolor
  misc_feature: Ceres ANNOT ID no. 8641819
  misc_feature: Encodes the peptide sequence at SEQ ID NO 15503
atggacgcatcgaaattgaaggccgagttccccgagaagctgtccatcaagggccctttgatcaagtatgtctttgagccaaacaggaagattcctattaattga

SEQ ID NO: 15503 - protein, 34 aa, Sorghum bicolor
  misc_feature: Useful for making plants with altered carbohydrate content
  misc_feature: Functional homolog of the protein sequence given in SEQ ID NO 14212
  misc_feature: Useful for making plants with altered cell wall content and/or composition
  misc_feature: Functional homolog of the protein sequence given in SEQ ID NO 14213
  misc_feature: Ceres ANNOT ID no. 8641819
MDASKLKAEFPEKLSIKGPLIKYVFEPNRKIPIN

SEQ ID NO: 15504 - DNA, 2019 bp, Sorghum bicolor
  misc_feature: Ceres ANNOT ID no. 8641817
  misc_feature: Encodes the peptide sequence at SEQ ID NO 15505
atggcgacttacgagcccaagaacattcttatcaccggtgctgctggttttattgcatcgcatgtcgccaaccgcctggttaggaactatccgcactacaagattgttgtcctcgacaagcttgactactgctccagcctaaagaacctcaacccctcgcgggcctcacaaaatttgaagtttgtcaagggtgacattgcaagtgctgatctggtgaaccaccttctggtcacagagtcgattgacaccatcatgcactttgctgctcagactcatgtagataattcatttggcaattcatttgagttcacgaaaaacaatatatatggtacacacgtccttcttgaggcttgcaaggttactggtcagatcaggaggtttattcatgtcagtactgacgaggtctatggagaaactgatgaagatgctgtggttggtaatcatgaggcctcacagttgcttccaacaaatccgtattcagctacaaaagctggagctgaaatgcttgtgatggcatacggaaggtcttatggtcttcctgtgattaccactcggggcaacaatgtgtatgggccaaatcagttccctgagaaactcatccccaaattcattcttttggccatgagaggtctgcctcttccaattcatggagatggttccaatgtcaggagctacctgtactgtgaggatgtggctgaagcttttgaggtggttcttcacaaaggggaggttggacatgtgtataatattggtactgtgaaggagaggagggtgattgatgtggccaaagacatttgcaggctctttgacttggatactgagaaagtaatcaggtttgttgagaacagacccttcaatgaccagaggtacttcctggatgatcagaagctgaagagactgggatgggcagagcgcacaccatgggaagagggcttgaagaagacaattgagtggtacaccaccaatcctgattactggggagacgttactggtgctttgctccctcacccaaggatgttgatgactcctggagttgaaaggcataactggactgaggagatcaaatctcttacttcttcaccagctgaagctagcacaacagctcctgcaaccagtaccaaaagagccactgatgctcctcaaaagcctttgttcaagttcttaatctatggcaggactggatggattggtggcctccttgggaagatttgtgaaaagcaagggattccatatgagtatgggaaaggacgcttggaggagcgctctcagctgttggaggacattagaaatgtgaagccaactcatgtcttcaatgctgccggagtcactgggagaccaaatgttgactggtgcgagacccataaacaggacactatccgcaccaatgtcgtaggaacattgaatcttgctgacatctgtcgtgagcagggtttgctcatggttaattatgctacaggctgtatatttgagtatgatgctaagcaccctgaagggtctggtattggctttaaagaggaagacacacccaactttacgggttccttttattctaaaacgaaagcaatggtggaagagctgttgaaggagtatgataatgtctgtactcttagggtcaggatgcctatatcatcagatctaagcaaccctcgtaacttcatcacaaagatagctcgttatgacaaggtggtgaacattcccaacagcatgacaattttggatgagcttctgcctatctccattgagatggcaaaacgggactgcaggggcatatggaacttcaccaatcctggcgttgtcagccacaatgagattctagagatgtacaagaaatacatcaatcctgatttcaagtggaccaacttcacactcgaagagcaggccaaggtcatagtcgcacgtagaagcaacaacgagatggacgcgtcaaaactgaaggctgagttccctcagctgctgtccatcaaggattctttgatcaagtatgtctttgagcctaacaggaaggttccggctatttga

SEQ ID NO: 15505 - protein, 672 aa, Sorghum bicolor
  misc_feature: Useful for making plants with altered cell wall content and/or composition
  misc_feature: Functional homolog of the protein sequence given in SEQ ID NO 14214
  misc_feature: Useful for making plants with altered carbohydrate content
  misc_feature: Functional homolog of the protein sequence given in SEQ ID NO 14212
  misc_feature: Ceres ANNOT ID no. 8641817
  misc_feature (7)..(337): SWISSPROT Homolog: EC 4.2.1.46 dTDP-glucose 4,6-dehydratase
  misc_feature (9)..(251): Pfam ID: Epimerase Pfam Description: NAD dependent epimerase/dehydratase family
MATYEPKNILITGAAGFIASHVANRLVRNYPHYKIVVLDKLDYCSSLKNLNPSRASQNLKFVKGDIASADLVNHLLVTESIDTIMHFAAQTHVDNSFGNSFEFTKNNIYGTHVLLEACKVTGQIRRFIHVSTDEVYGETDEDAVVGNHEASQLLPTNPYSATKAGAEMLVMAYGRSYGLPVITTRGNNVYGPNQFPEKLIPKFILLAMRGLPLPIHGDGSNVRSYLYCEDVAEAFEVVLHKGEVGHVYNIGTVKERRVIDVAKDICRLFDLDTEKVIRFVENRPFNDQRYFLDDQKLKRLGWAERTPWEEGLKKTIEWYTTNPDYWGDVTGALLPHPRMLMTPGVERHNWTEEIKSLTSSPAEASTTAPATSTKRATDAPQKPLFKFLIYGRTGWIGGLLGKICEKQGIPYEYGKGRLEERSQLLEDIRNVKPTHVFNAAGVTGRPNVDWCETHKQDTIRTNVVGTLNLADICREQGLLMVNYATGCIFEYDAKHPEGSGIGFKEEDTPNFTGSFYSKTKAMVEELLKEYDNVCTLRVRMPISSDLSNPRNFITKIARYDKVVNIPNSMTILDELLPISIEMAKRDCRGIWNFTNPGVVSHNEILEMYKKYINPDFKWTNFTLEEQAKVIVARRSNNEMDASKLKAEFPQLLSIKDSLIKYVFEPNRKVPAI

SEQ ID NO: 15506 - DNA, 447 bp, Sorghum bicolor
  misc_feature: Ceres ANNOT ID no. 8641825
  misc_feature: Encodes the peptide sequence at SEQ ID NO 15507
atggcgcccaaggccgagaagaagccagcggagaagaagccggccgccgaggagaaggcggagaaggcgcccgcaggaaagaagcccaaggccgagaagcgcctgcccgcctccaagtcctccggtaaggagggcggcgagaagaaggggaagaagaaggccaagaagagcgtggagacctacaaaatctacatcttcaaggtgctgaagcaggtgcaccccgacatcggcatctcctccaaggccatgtccatcatgaactccttcatcaatgacatcttcgagaagctcgccggcgaggccgccaagctcgcgcggtacaacaagaagcccaccatcacctcccgcgagatccaaacctccgtgcgcctcgtcctccccggagagctcgccaagcacgccgtctccgagggaaccaaggccgtcaccaagttcaccagcaactga

SEQ ID NO: 15507 - protein, 148 aa, Sorghum bicolor
  misc_feature: Useful for biocontainment applications
  misc_feature: Useful for making plants with modulated flowering time
  misc_feature: Functional homolog of the protein sequence given in SEQ ID NO 13102
  misc_feature: Ceres ANNOT ID no. 8641825
  misc_feature (55)..(125): Pfam ID: Histone Pfam Description: Core histone H2A/H2B/H3/H4
MAPKAEKKPAEKKPAAEEKAEKAPAGKKPKAEKRLPASKSSGKEGGEKKGKKKAKKSVETYKIYIFKVLKQVHPDIGISSKAMSIMNSFINDIFEKLAGEAAKLARYNKKPTITSREIQTSVRLVLPGELAKHAVSEGTKAVTKFTSN

SEQ ID NO: 15508 - DNA, 120 bp, Sorghum bicolor
  misc_feature: Ceres ANNOT ID no. 8641824
  misc_feature: Encodes the peptide sequence at SEQ ID NO 15509
atgaagggatttggttttgttagatattcatcgcaagcagaggcagagaaggtgttaaggcaatggaatggcagggtatttgctatctgctcttctcactcgcttccaatacaaacttga

SEQ ID NO: 15509 - protein, 39 aa, Sorghum bicolor
  misc_feature: Useful for making plants with modulated cold sensitivity
  misc_feature: Functional homolog of the protein sequence given in SEQ ID NO 13130
  misc_feature: Ceres ANNOT ID no. 8641824
MKGFGFVRYSSQAEAEKVLRQWNGRVFAICSSHSLPIQT

SEQ ID NO: 15510 - DNA, 396 bp, Sorghum bicolor
  misc_feature: Ceres ANNOT ID no. 8641831
  misc_feature: Encodes the peptide sequence at SEQ ID NO 15511
atgcccttgttccatttagattgtcgtttgccactatgctcatgctcagtaataaacacggagtacttctctcagcaagcagtagctcccagcctttcaaggttaacaactgatgagaagctccagggtgcatttgctcctttcgggaggattctcgaagcaaaagtggtgacggatagagtttctgggaggtcaaagggtttcggtttcgtgagatatgccaccatagaagaggctgagaaagcgcggcaggagatgaacgccaagtttctggatggatgggtcatcttcgttgaccctgccaagccaaggcagccaaagcccgctcctgagcaggacaccagttcctcgcatgttggcttcacgacgaacaagactgtaggatggtgcggctag

SEQ ID NO: 15511 - protein, 131 aa, Sorghum bicolor
  misc_feature: The sequence is a functional homolog of SEQ ID NO 1039 in the 10/374,780 US patent application
  misc_feature: The sequence is a functional homolog of SEQ ID NO 849 in the 10/666,642 US patent application
  misc_feature: Ceres ANNOT ID no. 8641831
  misc_feature (37)..(107): SWISSPROT Homolog: EC 5.2.1.8 Peptidylprolyl isomerase
  misc_feature (31)..(98): Pfam ID: RRM_1 Pfam Description: RNA recognition motif. (a.k.a. RRM, RBD, or RNP domain)
MPLFHLDCRLPLCSCSVINTEYFSQQAVAPSLSRLTTDEKLQGAFAPFGRILEAKVVTDRVSGRSKGFGFVRYATIEEAEKARQEMNAKFLDGWVIFVDPAKPRQPKPAPEQDTSSSHVGFTTNKTVGWCG

SEQ ID NO: 15512 - DNA, 1053 bp, Sorghum bicolor
  misc_feature: Ceres ANNOT ID no. 8641840
  misc_feature: Encodes the peptide sequence at SEQ ID NO 15513
atggcgcagaaggagaccaatggcagcaacggcgagcacatctccacccgcccgccgcccaccccctcgcccctccgcttctccaagttcttccaggctaacctgcggatcctcgtcaccggtggggcgggcttcatcggctcgcacctcgtagacaagctcatggagaacgagaagcacgaggtcattgttgctgataaccttttcactggttcaaaagacaacctgaagaagtggatcggccacccaagatttgagttcatccgtcatgatgtcacccagccgcttcttgtggaggttgaccaaatctaccaccttgcttgccctgcttcaccaatcttctacaagcacaatcctgttaagaccatcaagaccaatgtcattggtaccctcaacatgctgggacttgcaaagagagttggagctaggattttgttgacatccacctctgaagtttatggtgatccgcttgagcatcctcaaaccgaggcatactggggcaatgttaacccaattggtgtcaggagctgttatgatgagggtaagcgtgtagcagagacgctgatgttcgactatcacaggcagcatggcattgaaatccgaattgccaggattttcaacacctatgggcctaggatgaacattgatgatggccgtgttgttagcaacttcattgctcaggctgtgcgtggtgaacccctgactgtccagaggcccggaacacagactaggagcttctgctatgttgccgatatggttgatggtcttattaagctgatgaatggaaacaacactgggccgattaacttggggaacccaggtgaattcaccatgctggaacttgctgagaatgtgaaggagttgatcaacccagatgtaacagtgacgatgaccgagaacactcctgatgatccccgccagaggaagcctgacatcacaaaggcaaaggaagttctggggtgggagcccaagatcgtcctgaaggacggcttggtgctcatggaggatgatttccgggagcgcctggccgtgcccaagaaaaccaaggcctaa

SEQ ID NO: 15513 - protein, 350 aa, Sorghum bicolor
  misc_feature: Useful for making plants with altered carbohydrate content
  misc_feature: Functional homolog of the protein sequence given in SEQ ID NO 14215
  misc_feature: Useful for making plants with altered cell wall content and/or composition
  misc_feature: Functional homolog of the protein sequence given in SEQ ID NO 14216
  misc_feature: Ceres ANNOT ID no. 8641840
  misc_feature (36)..(342): SWISSPROT Homolog: EC 4.1.1.35 UDP-glucuronate decarboxylase
  misc_feature (37)..(271): Pfam ID: Epimerase Pfam Description: NAD dependent epimerase/dehydratase family
MAQKETNGSNGEHISTRPPPTPSPLRFSKFFQANLRILVTGGAGFIGSHLVDKLMENEKHEVIVADNLFTGSKDNLKKWIGHPRFEFIRHDVTQPLLVEVDQIYHLACPASPIFYKHNPVKTIKTNVIGTLNMLGLAKRVGARILLTSTSEVYGDPLEHPQTEAYWGNVNPIGVRSCYDEGKRVAETLMFDYHRQHGIEIRIARIFNTYGPRMNIDDGRVVSNFIAQAVRGEPLTVQRPGTQTRSFCYVADMVDGLIKLMNGNNTGPINLGNPGEFTMLELAENVKELINPDVTVTMTENTPDDPRQRKPDITKAKEVLGWEPKIVLKDGLVLMEDDFRERLAVPKKTKA

SEQ ID NO: 15514 - DNA, 2019 bp, Sorghum bicolor
  misc_feature: Ceres ANNOT ID no. 8641839
  misc_feature: Encodes the peptide sequence at SEQ ID NO 15515
atggcgacttacgagcccaagaacattctcatcaccggtgctgctggttttattgcatcgcatgtcgccaaccgcctggttaggaactacccgcactacaagattgttgtcctcgacaagcttgactactgctccagcctaaagaacctcaacccctcgcgggcttcaccaaatttgaagtttgtcaagggtgacattgcaagtgctgatctggtgaactaccttctggtcacagaatcgattgacaccatcatgcactttgctgctcagactcatgtggataattcatttggcaattcatttgagttcacaaaaaacaatatatatggtacacacgtccttcttgaggcttgcaaggttactggacagatcaggaggtttattcatgtcagtactgatgaggtctatggagaaactgatgaagatgctgtggttggtaaccatgaggcctcacagttgcttccaacaaatccatattcagctacaaaagctggggctgaaatgcttgtgatggcatatggcaggtcgtacggtcttcctgtgattaccactcgtggcaacaatgtgtatggaccaaatcagttccctgagaaactcatccccaaattcattcttttggccatgagaggtctgcctcttccaattcatggagacggttccaatgtcaggagctacctgtactgtgaggatgtggctgaagcttttgaggttgttcttcacaaaggggaggttggacatgtgtataatattggtacagtgaaggagaggagggtgattgatgtggccaaagacatttgcaggctctttggcttggatactgagaaagtaataaggtttgttgagaacagacccttcaatgaccagaggtacttcctggatgatcagaagctgaagagactgggatgggcagagcgcacaccatgggaagagggcttgaagaagacaattgagtggtacaccaccaatcctgattactggggagatgttactggtgctttgctccctcacccaaggatgttgatgactcctggagttgaaaggcataactggactgaggaaatcaaatctcttacttcttcaccagctgaagctagcacaacagctcctgcaaccagtaccaaaagaaccactgatgcccctcaaaagcctttgtacaagttcttaatttatggcaggactggatggattggtggcctccttgggaagatttgtgaaaagcaagggattctatatgagtatgggaaaggacgcttggaggagcgctctcagctgttggaggacattagaaatgtgaagccaactcatgtcttcaatgctgccggagtcactgggagaccaaatgttgactggtgcgagacccataaacaggacactgtccgcaccaatgttgtaggcacattgaatcttgctgacgtctgtcgtgagcagggtttgctcatggttaattatgctacaggctgtatatttgagtatgatgctaagcaccctgaagggtctggtattggctttaaagaggaagacacacccaactttacgggttccttttattctaaaacgaaagcaatggtggaagagctgttgaaggagtatgataatgtctgtactcttagggtcaggatgcctatatcatcagatctaagcaaccctcgtaacttcatcacaaagatagctcgctatgacaaggtggtgaacattcccaacagcatgacaattttggatgagcttctgcctatctccattgagatggcgaaacaggactgcagggggatatggaacttcaccaaccctggcgttgtcagccacaatgagattctagagatgtacaagaaatacatcaatcctgatttcaagtggaccaacttcacactcgaagagcaggccaaggtcatagtcgcacctagaagcaacaacgagatggacgcgtccaaactaaaggctgagttccctcagctgctgtccatcaaggattctttgatcaagtatgtctttgagcctaacaggaaggttccgtctatttga

SEQ ID NO: 15515 - protein, 672 aa, Sorghum bicolor
  misc_feature: Useful for making plants with altered cell wall content and/or composition
  misc_feature: Functional homolog of the protein sequence given in SEQ ID NO 14214
  misc_feature: Useful for making plants with altered carbohydrate content
  misc_feature: Functional homolog of the protein sequence given in SEQ ID NO 14212
  misc_feature: Ceres ANNOT ID no. 8641839
  misc_feature: Up-regulated in shoot tissues in response to methyl jasmonate treatment
  misc_feature (7)..(337): SWISSPROT Homolog: EC 4.2.1.46 dTDP-glucose 4,6-dehydratase
  misc_feature (9)..(251): Pfam ID: Epimerase Pfam Description: NAD dependent epimerase/dehydratase family
MATYEPKNILITGAAGFIASHVANRLVRNYPHYKIVVLDKLDYCSSLKNLNPSRASPNLKFVKGDIASADLVNYLLVTESIDTIMHFAAQTHVDNSFGNSFEFTKNNIYGTHVLLEACKVTGQIRRFIHVSTDEVYGETDEDAVVGNHEASQLLPTNPYSATKAGAEMLVMAYGRSYGLPVITTRGNNVYGPNQFPEKLIPKFILLAMRGLPLPIHGDGSNVRSYLYCEDVAEAFEVVLHKGEVGHVYNIGTVKERRVIDVAKDICRLFGLDTEKVIRFVENRPFNDQRYFLDDQKLKRLGWAERTPWEEGLKKTIEWYTTNPDYWGDVTGALLPHPRMLMTPGVERHNWTEEIKSLTSSPAEASTTAPATSTKRTTDAPQKPLYKFLIYGRTGWIGGLLGKICEKQGILYEYGKGRLEERSQLLEDIRNVKPTHVFNAAGVTGRPNVDWCETHKQDTVRTNVVGTLNLADVCREQGLLMVNYATGCIFEYDAKHPEGSGIGFKEEDTPNFTGSFYSKTKAMVEELLKEYDNVCTLRVRMPISSDLSNPRNFITKIARYDKVVNIPNSMTILDELLPISIEMAKQDCRGIWNFTNPGVVSHNEILEMYKKYINPDFKWTNFTLEEQAKVIVAPRSNNEMDASKLKAEFPQLLSIKDSLIKYVFEPNRKVPSI

SEQ ID NO: 15516 - DNA, 1665 bp, Sorghum bicolor
  misc_feature: Ceres ANNOT ID no. 8641865
  misc_feature: Up-regulated in shoot tissues in response to methyl jasmonate treatment
  misc_feature: Encodes the peptide sequence at SEQ ID NO 15517
atggcggcgtcgaaggtggtcgacggtccggtgatcggcatcgacctggggacgacctactcctgcgtggccgtctggcggcacgaccgcagcgaggtcatcgccaacgaccagggcaaccgcctcacgccgtcctgcgtcgtgttcacggacgacgagagcctcgtcggcgacgcggccgtgaatcaggctgctttcaaccccaccaacaccattttcgaagtcaaacgactgatcggtcgacggttcagagacaactctgtacaagaagatatcaagttgtggcctttcaaagtcgtcgcaggacgtcaggacaggccgacgatcgtggtgcagcatgaaggcaaggagaggcagttgatgcctgaggagatctcctccatggtgctcgccaagatgagagagacagccgaggtctatctcggcaaaactgtcaagaacgccgtcgtcaccgtccccgtatacttcagcaactcccagcgtcaggctacgatcgacgccggcgccattgctggcctgaatatcttgcacatcatcaacgagccgaccgccgccgctctcgcctacggtctcgagaagatgcctgtcagcaaccaaaggaggaccgtgcttgtctttgatcttggtggtggtaccttcgatgtctcaatccttgagatcgatccgggtgtcggcatgggtaagggcgtctttgaggtaaaggccatcgccggcgacactcaccttggaggagcagatttcgacaacgagatggtggagtactctctgcgagagttcatacggaaacacggcaagatggacataaaaagcaaccacaaggcgctccggaggctgcggactgcctgcgaaagagccaaaaggatactgtccttcacgtcgcagaccaggattgaggtggactcgctgcacgaaggcattgacttctccacaagcatcacccgctcccggtttgaggagctcaacaagcacctcttcagcaagtgcatggaggctcttgacaagtgcctccaggacgccaagattgacaggaggagcatccatgatgtcgtactcgtcggtggctccacccgcatccccaaggtgcagagcatgcttcgagacttcttcgacgggaaggagctctgccggagcatcaaccccgatgaagccgttgcctacggcgccgcaatccaggccttcattcttagtggtgaagccagcgatgggaggttgttggatatgcttctgcgcgatgtcacgcccctctcgctagggttcagagttgcgacgccgacgatagggatggggccaacaatatatgatgtgatggagacggtgatcccacggaatactgccattccggtgaagaagacgaaaggctgttccaccttggtcgataaccaggacgtcatccccatcaaagtgtacgagggcgagagcaagagcaccagggacaacaacctgctcggtgagttcctgctatccggcattccaccggcgccttggggcgtacctaagatcgatgtgacctttgatatcgacgcaaatggcgtcctgaacgtgtcggccaaggacatgaccaccgggtcgactaacaacatcaccatcactaaccacagcggccggttgcgcaaggaggaaatcgagcgcatggctttgcaggtggagcggcatagaggaaactag

SEQ ID NO: 15517 - protein, 554 aa, Sorghum bicolor
  misc_feature: Useful for making plants with modulated heat sensitivity
  misc_feature: Functional homolog of the protein sequence given in SEQ ID NO 13726
  misc_feature: Useful for making plants with modulated drought sensitivity
  misc_feature: Functional homolog of the protein sequence given in SEQ ID NO 14080
  misc_feature: Ceres ANNOT ID no. 8641865
  misc_feature (11)..(554): Pfam ID: HSP70 Pfam Description: Hsp70 protein
MAASKVVDGPVIGIDLGTTYSCVAVWRHDRSEVIANDQGNRLTPSCVVFTDDESLVGDAAVNQAAFNPTNTIFEVKRLIGRRFRDNSVQEDIKLWPFKVVAGRQDRPTIVVQHEGKERQLMPEEISSMVLAKMRETAEVYLGKTVKNAVVTVPVYFSNSQRQATIDAGAIAGLNILHIINEPTAAALAYGLEKMPVSNQRRTVLVFDLGGGTFDVSILEIDPGVGMGKGVFEVKAIAGDTHLGGADFDNEMVEYSLREFIRKHGKMDIKSNHKALRRLRTACERAKRILSFTSQTRIEVDSLHEGIDFSTSITRSRFEELNKHLFSKCMEALDKCLQDAKIDRRSIHDVVLVGGSTRIPKVQSMLRDFFDGKELCRSINPDEAVAYGAAIQAFILSGEASDGRLLDMLLRDVTPLSLGFRVATPTIGMGPTIYDVMETVIPRNTAIPVKKTKGCSTLVDNQDVIPIKVYEGESKSTRDNNLLGEFLLSGIPPAPWGVPKIDVTFDIDANGVLNVSAKDMTTGSTNNITITNHSGRLRKEEIERMALQVERHRGN

SEQ ID NO: 15518 - DNA, 1959 bp, Sorghum bicolor
  misc_feature: Ceres ANNOT ID no. 8641853
  misc_feature: Encodes the peptide sequence at SEQ ID NO 15519
atggcgagcagcaagggagagggtccggcgatcggcatcgacctcggcaccacctactcctgcgtcggggtgtggcagcatgaccgggtggagatcatcgccaacgaccagggcaaccgcaccacgccgtcgtacgtggccttcaccgacaccgagaggctcatcggcgacgccgccaagaaccaggtcgccatgaaccccaccaacaccgtctttgatgcgaagcgactcatcggccggcgcttctcggacccgtccgtgcaggcggacatgaagatgtggccgttcaaggtcgtcccgggccccgccgacaaacccatgatcgtggtgacatacaagggcgaggagaagaaattttcggccgaggagatctcctccatggtgctcaccaagatgaaggagatcgccgaggcctacctgagcaccaccatcaagaacgccgtcatcaccgtccctgcctacttcaacgactcgcagcggcaggccaccaaggacgccggtgtcatcgccggcctcaacgtcatgcgcatcatcaacgagcccacggccgccgccatcgcctacgggctcgacaagaaggccgccagcagcggcgagaagaacgtgctcatcttcgacctcggcggcggcaccttcgatgtgtccatcctcaccatcgaggagggcatcttcgaggtcaaggccacggccggcgacacccacctgggaggcgaggacttcgacaaccgcctggtgaaccacttcgtgcaggagttcaagaggaagcacaagaaggacatcagcggcaacccgagggcgctccggcggctgcggaccgcgtgcgagagggccaagaggacgctctcctccaccgcccagaccaccatcgagatcgactcgctctacgagggcatcgacttctacgcgaccatcacgcgggcaaggttcgaggagctcaacatggacctcttcaggaagtgcatggagcccgtggagaagtgcctccgcgacgccaagatggacaaggcgcagatccacgacgtcgtgctcgtcggaggctccacccgtatccccaaggtgcagcagctgctccaggacttcttcaacggcaaggagctctgcaagagcatcaaccccgacgaggccgtcgcgtacggcgccgccgtccaggccgccatcctcagcggcgagggcaaccagaaggtgcaggacctgctcctgctcgacgtcacgccgctctcgctcgggctggagacggccggcggtgtgatgaccgtgctgatcccgaggaacaccaccattcctaccaagaaggagcaggtcttctccacctactccgacaaccagcccggcgtgctcatccaggtgtacgagggcgagaggacgaggaccaaggacaacaacctgctcggcaagttcgagctgacgggcatcccgccggcgccgaggggcgtgccccagatcaacgtgaccttcgacatcgacgcgaacggcatcctgaacgtgtcggcggaggacaagacgacggggaagaagaacaagatcaccatcaccaacgacaagggccgtctgagcaaggaagagatcgagcgcatggtgcaggaggcggagaagtacaaggccgaggacgaggaggtgaagcgcaaggtggaggcccgcaacgcgctggagaactacgcgtacaacatgcgcaacacggtgcgggacgagaagatcgcgtccaagctgcccgccgaggacaagaagaagatcgaggacacggtggaggacgccatcaagtggctcgacggcaaccagctcgccgaggccgaggagtttgaggacgagatgaaggagctggagaacgtctgcaaccccatcatctcgaagatgtaccagggcggcgcgggcgcggcgggcatggacgaggacgtgcccagcggtggcgccggcagcggaggtggcagcggcgccgggcccaagattgaggaggtcgactag

SEQ ID NO: 15519 - protein, 652 aa, Sorghum bicolor
  misc_feature: Useful for making plants with modulated drought sensitivity
  misc_feature: Useful for making plants with modulated heat sensitivity
  misc_feature: Functional homolog of the protein sequence given in SEQ ID NO 14080
  misc_feature: Ceres ANNOT ID no. 8641853
  misc_feature: Down-regulated in shoot tissues in response to aminocyclopropane carboxylic treatment
  misc_feature: Up-regulated in root tissues in response to salicylic acid treatment
  misc_feature (10)..(619): Pfam ID: HSP70 Pfam Description: Hsp70 protein
MASSKGEGPAIGIDLGTTYSCVGVWQHDRVEIIANDQGNRTTPSYVAFTDTERLIGDAAKNQVAMNPTNTVFDAKRLIGRRFSDPSVQADMKMWPFKVVPGPADKPMIVVTYKGEEKKFSAEEISSMVLTKMKEIAEAYLSTTIKNAVITVPAYFNDSQRQATKDAGVIAGLNVMRIINEPTAAAIAYGLDKKAASSGEKNVLIFDLGGGTFDVSILTIEEGIFEVKATAGDTHLGGEDFDNRLVNHFVQEFKRKHKKDISGNPRALRRLRTACERAKRTLSSTAQTTIEIDSLYEGIDFYATITRARFEELNMDLFRKCMEPVEKCLRDAKMDKAQIHDVVLVGGSTRIPKVQQLLQDFFNGKELCKSINPDEAVAYGAAVQAAILSGEGNQKVQDLLLLDVTPLSLGLETAGGVMTVLIPRNTTIPTKKEQVFSTYSDNQPGVLIQVYEGERTRTKDNNLLGKFELTGIPPAPRGVPQINVTFDIDANGILNVSAEDKTTGKKNKITITNDKGRLSKEEIERMVQEAEKYKAEDEEVKRKVEARNALENYAYNMRNTVRDEKIASKLPAEDKKKIEDTVEDAIKWLDGNQLAEAEEFEDEMKELENVCNPIISKMYQGGAGAAGMDEDVPSGGAGSGGGSGAGPKIEEVD

SEQ ID NO: 15520 - DNA, 1677 bp, Sorghum bicolor
  misc_feature: Ceres ANNOT ID no. 8641877
  misc_feature: Down-regulated in shoot tissues in response to aminocyclopropane carboxylic treatment
  misc_feature: Up-regulated in root tissues in response to salicylic acid treatment
  misc_feature: Encodes the peptide sequence at SEQ ID NO 15521
atggagacggcggcgtcgaccggcgacgggccggcggtcggcatcgacctggggacgacctactcctgcgtggccgtgtggcggcacgaccacggcgaggtcatcgccaacgaccagggcaacctcctcacgccatcctgcgtcgcgttcgccgacgttgggaggctcgtcggcgacgcggccgtgaaccaggccgctctgaaccccgacaacaccatccacgatgtgaagcgactgattggccgccgatttagcgacgagaccgtacagggagatgtcaagttgtggccttttaaagtcgtccctggtcgtgaggaccggccgatgattgtggttcattacaaaggcgaggagaaacagtttgctgctgaggagatctctgccatggtgctggcaaagatgaaggagactgcagaggtctacctcgagacgacggtcaggcacgccgtcatcactgtcccagtttacttcaacaactctcaacgccaggccaccattgacgccggcaccattgccggccttaacgtcatgcgcatcatcaacgagcccacagctgccgctattgcatatggtcttgacaagatgccaaccagagatgggaggaggacggtgctcatctttgatctcggtggcggtaccttggacgtttccctccttgacattgatccgggcctcgacatagacatgggtatgttcgaggtgaaggccattgctggtgacactcaccttggtggggaagacttcgacaatgaaatggtgaaacacttcctgcgcgagttcataaggaaacacaagaagatggacgtccgaagcaacccaaaggcgatgcagcggctgaagacggcctgtgacagggccaagaggctgctgtcttccacgagccagaccagcatcgacattgactccttccacgacggcattgacttctacgcaaccattacgcgcggccgtttcgaggagctcaacagagacctcttcaacaagtgcatagaggccgtggagaagtgcctccgcgacgccgcgacggacacgagcagcatcgacgacgtcgtcctcgttggtggctccacccgcatccccaaggtgcagagcatgctccaggacttcttcgacgggaaggggctctgccggagcatcaaccccgacgaggccgttgcgcacggagccgccatgatggctgctatcctcaacggcgaggctggccgtaacaagatcagagatttgatgctggtcgatgtcacgccgctgtcgctcggggtggagacgaaaggaggcgccatgacagttctgatcccgagaaacaccactatccctgccagaaaggagcggctcttctccacctgcatcgagaaccaggacagcgtgctcatcagggtgtacgagggtgagcaggtgactaccagggacaactacctgctcggcaggttcgagctctccggcatcgctccggcgcccagggccgcaccccggatcattgtgacctttgacatcgacgagaacggtgtcctgaacgtgtcggcggaggacacgacgacagggcagaagaacgagatcaccatctccagcgaccaggggcagctaagccaggaggagatcgagcgcatggttcaggacggcgagaagtacaaggcagaggaggaggagctgaaggaagttggggcccaagaacaggcttga

SEQ ID NO: 15521 - protein, 558 aa, Sorghum bicolor
  misc_feature: Useful for making plants with modulated heat sensitivity
  misc_feature: Functional homolog of the protein sequence given in SEQ ID NO 13726
  misc_feature: Useful for making plants with modulated drought sensitivity
  misc_feature: Functional homolog of the protein sequence given in SEQ ID NO 14080
  misc_feature: Ceres ANNOT ID no. 8641877
  misc_feature (12)..(558): Pfam ID: HSP70 Pfam Description: Hsp70 protein
METAASTGDGPAVGIDLGTTYSCVAVWRHDHGEVIANDQGNLLTPSCVAFADVGRLVGDAAVNQAALNPDNTIHDVKRLIGRRFSDETVQGDVKLWPFKVVPGREDRPMIVVHYKGEEKQFAAEEISAMVLAKMKETAEVYLETTVRHAVITVPVYFNNSQRQATIDAGTIAGLNVMRIINEPTAAAIAYGLDKMPTRDGRRTVLIFDLGGGTLDVSLLDIDPGLDIDMGMFEVKAIAGDTHLGGEDFDNEMVKHFLREFIRKHKKMDVRSNPKAMQRLKTACDRAKRLLSSTSQTSIDIDSFHDGIDFYATITRGRFEELNRDLFNKCIEAVEKCLRDAATDTSSIDDVVLVGGSTRIPKVQSMLQDFFDGKGLCRSINPDEAVAHGAAMMAAILNGEAGRNKIRDLMLVDVTPLSLGVETKGGAMTVLIPRNTTIPARKERLFSTCIENQDSVLIRVYEGEQVTTRDNYLLGRFELSGIAPAPRAAPRIIVTFDIDENGVLNVSAEDTTTGQKNEITISSDQGQLSQEEIERMVQDGEKYKAEEEELKEVGAQEQA

SEQ ID NO: 15522 - DNA, 1752 bp, Sorghum bicolor
  misc_feature: Ceres ANNOT ID no. 8641875
  misc_feature: Encodes the peptide sequence at SEQ ID NO 15523
atggcggccgcttcggagagcgacggtccggcggtcggcatcgacctcggtacgacttactcctgcgtggccgtgtggcggcatgaccgcggcgaggtcatcgccaatgaccagggcagtcgtctcacgccgtcctgcgtcgccttcaacagcaccgagaggctcgtcggcgaggcggccgtgaaccaggccgccctaaaccccaccaacaccatcttcgaggtgaaacaactgattggccgccgtttcagtgatgagcatgtacaagaagatatcaagctgtggcctttcaaagttgccgctgatcttgaggaccgcccaatgattgtggtgcagttcaaaggtgaggagaagcagttctttcctgaggagatctcctccatggtgctggccaaaatgaaggagacagctgaagtctaccttggtaccaggataaaaaatgcagtcatcactgttcctgtctacttcaacaactctcagcgccaggccacaatagatgcaggcaccattgctggcctgaatgtcatgcgcatcatcaacgagcccactgctgccgccattgcctatggtcttgagaagatgcctgtcagcaacaccgggagaacagtgctcgtctttgatcttggtggtggtaccttcgatgtctccctccttaacattgatccaggtgtctccatgggtaagggtgtctttgaggtgaaggccatcgccggtaacactcaccttggtggagcggattttgataatgagatggtggagtatgctcttcgggagttcataccgaaacacaacaagaccgaaaattcaaaagaaaaccagaaggcactcccggcgactggaggactgcctgcgagagagcgaagagaatgctgtcttctgcgaaacagaccaccattgagtaaatgcatggaggcattggaaaagtgcctccatgatgccaaggtggacaacagcagcatccatgatgttgtcctcgtgggtggctccacccgcatccccaaggtgcagaacatgctccaggaattctttgatgggaaagagcttcgccggagcatcaaccctgatgaagctgttgtttacggtgctgccatccatgcctttattctcagtggcaaaaccgatcatgggaggttgctggatatgcttcttcaggacgtcacacctctctcgctagggttatgtgtcagggatactgttaaggggaagatgcaagatgacataatgaggacaatgatcccacggaatacagccattcctttcaagaagagggtagagggctttaccaccagttatgacaatcaagagtctgtggacatcatggtgtacgagggtgagagtgcgagcaccaaggacaacaacctactcgggcagttcaagctatctgggatcctccccaggcccaggggcattccttgtcttgatgtcacgttcgacattgacttgaacggcgtcctgaatgtgttggcagaggacaagaccagtgggcagaaaaacagcattaccatcactaaccacagtggccggctgcacaaggaggaaatcgagcacatggtgcaggaggcggagagaattctatgtgtttattattattattattttcattttaatatttttacatttcttttatttcttttctcttttattttatttttttatttgttattatgttttatgttattttttgtgatgtttatgtgtatatatgtgatagtttttatgttcatgtgtcatacaacatgtgatgttctgtga

SEQ ID NO: 15523 - protein, 583 aa, Sorghum bicolor
  misc_feature: Useful for making plants with modulated heat sensitivity
  misc_feature: Functional homolog of the protein sequence given in SEQ ID NO 13726
  misc_feature: Useful for making plants with modulated drought sensitivity
  misc_feature: Functional homolog of the protein sequence given in SEQ ID NO 14080
  misc_feature: Ceres ANNOT ID no. 8641875
  misc_feature (11)..(566): Pfam ID: HSP70 Pfam Description: Hsp70 protein
MAAASESDGPAVGIDLGTTYSCVAVWRHDRGEVIANDQGSRLTPSCVAFNSTERLVGEAAVNQAALNPTNTIFEVKQLIGRRFSDEHVQEDIKLWPFKVAADLEDRPMIVVQFKGEEKQFFPEEISSMVLAKMKETAEVYLGTRIKNAVITVPVYFNNSQRQATIDAGTIAGLNVMRIINEPTAAAIAYGLEKMPVSNTGRTVLVFDLGGGTFDVSLLNIDPGVSMGKGVFEVKAIAGNTHLGGADFDNEMVEYALREFIPKHNKTENSKENQKALPATGGLPARERRECCLLRNRPPLSKCMEALEKCLHDAKVDNSSIHDVVLVGGSTRIPKVQNMLQEFFDGKELRRSINPDEAVVYGAAIHAFILSGKTDHGRLLDMLLQDVTPLSLGLCVRDTVKGKMQDDIMRTMIPRNTAIPFKKRVEGFTTSYDNQESVDIMVYEGESASTKDNNLLGQFKLSGILPRPRGIPCLDVTFDIDLNGVLNVLAEDKTSGQKNSITITNHSGRLHKEEIEHMVQEAERILCVYYYYYFHFNIFTFLLFLFSFILFFYLLLCFMLFFVMFMCIYVIVFMFMCHTTCDVL

SEQ ID NO: 15524 - DNA, 1716 bp, Sorghum bicolor
  misc_feature: Ceres ANNOT ID no. 8641868
  misc_feature: Encodes the peptide sequence at SEQ ID NO 15525
atggcggcctcgcaaggcgacggatcagcggcgatcggcatcgacttgggcacgacgtattcgtgtgctgccgtgtggcggggcaaccacgccgacatcatcgccaacgacctgggcaaacgcctcacgccgtcctacgtggcgttcactggcgccgggaggctcgtcggcgaggcggccgtgaatcaggccgccctgaaccccaccaacaccatctacgatgtgaagcgactgatcggccaccggttcagcgacgagtctgtgcaagaaagcatcaaggtgtggccttttaaggtcgttgccggccatctcgagaagccgatgatcgtggtgcaacacgaaggcaaagagaggcagtttatgcctgaagagatctcctccatggtgctagccaaggtgaaggagaccgcagaggtctacctaggcaccactgtcaagaaggcagtcgtcactgtccccgtctacttcaacaactctcagcgccaggccacaatcgacgctggtgctattgctggactggatgtcatgcatatcatcaacgagcccaccgcagcagcccttgcctacggtcttgacaagatgcccaccaccgatggagggaggacggtgctcatctttgatctcggtggtggcaccatggatgtgtctctccttaacattgatcccggtgtcgacataggtatgggtctcttcgaggtgaaggccgtcgccggtgacacccaccttggtggggctgattttgacaatgagatggtgaaatactgtatgcggaatttcataaagaaacacatgaaggtgggcatcagaaaagacctgaaggcgcgccggcggctgaagacagcctgcgaaaaggcaaagaggatgctatcttccatggaagaaactaaagttgaggttgactcgctgcatgacggcatcgacttttctgaaacgatcacccgtgcctgctttgaggagcttaacaaggacctcttcagcaagtgcttggaggccgtgaagaagtgcctccacgatgccaagatggagaagagcagcgttgaggacataatcctcgtgggaggctccacccgcatccccaaggtgcggagcatgctccaggacttcttcgatgggaaggacctctgccggagtatcaacccagacgaagctgtcgcctatggtgctgccattcatgcttcggttctcagtggtggaacaggcgacgggaaggtgggtgatatgcttctgctcgacgtcacgccactatcccttggggtggatatcaaaggagacctcatgtccgtcgtgatcccgaggaacagcaccatcccaaccaagcaggtgaaggtcttcgaaacctcctgccacaaccagaaaatgctggaattcaaggtgtatgagggcgagagcatgagcaccaaggacaataacctgctcggtgagttcctgatatctggcattccaccggcgcctaggggcctacataagttccgtgtgacctttgacatcgatgcgaatggtgtcctgagcgtatcggccaaggacaggaccaccgggctgaagaacagcatcaccctcactaatcacagcggtcggctgcacaaggcagaaattgagtgtatggcacaagaggaccagaggtacgaagcgaatgagacgacggaatcaagtaatgccaagaaggccaagagaattaagcatgaaaagaacatgggctacatcacactagatgcttaa

SEQ ID NO: 15525 - protein, 571 aa, Sorghum bicolor
  misc_feature: Useful for making plants with modulated heat sensitivity
  misc_feature: Functional homolog of the protein sequence given in SEQ ID NO 13726
  misc_feature: Useful for making plants with modulated drought sensitivity
  misc_feature: Functional homolog of the protein sequence given in SEQ ID NO 14080
  misc_feature: Ceres ANNOT ID no. 8641868
  misc_feature (11)..(571): Pfam ID: HSP70 Pfam Description: Hsp70 protein
MAASQGDGSAAIGIDLGTTYSCAAVWRGNHADIIANDLGKRLTPSYVAFTGAGRLVGEAAVNQAALNPTNTIYDVKRLIGHRFSDESVQESIKVWPFKVVAGHLEKPMIVVQHEGKERQFMPEEISSMVLAKVKETAEVYLGTTVKKAVVTVPVYFNNSQRQATIDAGAIAGLDVMHIINEPTAAALAYGLDKMPTTDGGRTVLIFDLGGGTMDVSLLNIDPGVDIGMGLFEVKAVAGDTHLGGADFDNEMVKYCMRNFIKKHMKVGIRKDLKARRRLKTACEKAKRMLSSMEETKVEVDSLHDGIDFSETITRACFEELNKDLFSKCLEAVKKCLHDAKMEKSSVEDIILVGGSTRIPKVRSMLQDFFDGKDLCRSINPDEAVAYGAAIHASVLSGGTGDGKVGDMLLLDVTPLSLGVDIKGDLMSVVIPRNSTIPTKQVKVFETSCHNQKMLEFKVYEGESMSTKDNNLLGEFLISGIPPAPRGLHKFRVTFDIDANGVLSVSAKDRTTGLKNSITLTNHSGRLHKAEIECMAQEDQRYEANETTESSNAKKAKRIKHEKNMGYITLDA

SEQ ID NO: 15526 - DNA, 1872 bp, Sorghum bicolor
  misc_feature: Ceres ANNOT ID no. 8641862
  misc_feature: Encodes the peptide sequence at SEQ ID NO 15527
atggcggccacgaaggtcgacgggccggcgatcggcatcgacctggggacgacctactcgtgcgtggcggtgtggcggcacgaccgcggcgaggtcatcgccaacgaccagggcaaccgcctcacgccgtcctgcgtggccttcaccagcaccgagaggctcgtcggcgaggcggcggtgaaccaggccgctttgaaccccaccaacaccatcttcgaggtgaagcggctgattggccgccgattcagcgacgaatctgtaaaagaagatgccaacttgtggcctttcaaagtcgtcgcgggtaatgacgaacggccaatgatcgtggtgcagcatgaaggcaaggagaagcagttcatgcctgaggagatctcctccatggtgctggtcaagatgagagagacagccgaggtatatctgggtaaaaagatcaagaacgctgtcatcaccgtgcctgtctacttcaacaactcccagcgccaggctaccattgacgccgtgctcgtctttgatcttggtggcggtacctttgatgtttccctcctcaacattgatcctggtaccaacatggataagggtctcttcgaggtggtggccattgccggtgacactcaccttggcggggctgatttcgacaacgagatggtgaaatattctcttcgtgagttcatacggaaacatgggaagatagacatccatagcaaccagaaggcactccggcggctgaggactgcctgcgagagagcaaaggggatgctgtcttccactgcacagaccaccattgaggtcgactcgctccatgacggcattgatttctgcaccaccatcacccgatctcgatttgaggagctcaacaaggatcttttcagcaagtgcatgaaagctctggacaagtgcttaagcgatgccaagatggacaagagaagcgtccatgatgtcgtcctggtgggtggctccacccgtatccccaaggtgcagaacatgcttcgggaattcttttgtgggaaggagctttgccagagcatcaaccctgatgaagctgttgcgtacggggctgccatccaggcctctatcctttgtggtggaaccgatgatgggagattagtggatatgcttctgcgcgacgttacaccactctcgcttgggattgaaactgaagataattttacaatgagcgtgatcattccgaggaacacttccatccctaccaagaagtcgcggcgcttcaccaccatcgacgacaaccagaccactgtgagcattccagtgtacgagggcgagagcgcaaagacctggaacaacaacctgctcggcaagttcgagctcactggcatacccccggcgccgcggggcaaacctcgtttggagaccaccttcgaaatcgatgcaaacggtatcttgaaagtgtccgaggaggacctggacactgggaggaagaacggcatcaccatccttaaccatggcggtaggctgcgcaaggaggaaatcgcgctacctgctggaggacttcttcgacgggatggagtcaaccccgacgaagcagtctcatacggcgccgccatccaagcggcgatcctcagcgacgaggaggatgtgcaggatgtgctcctggtcgatgtcacgccgctctcgcttggggtgaggacgatccgtggtgtgatgagcatgctgatcccgctggaagacatcgagcgagcgccaagaggcgtgcccaagattaacgtcacctttgaaatcgacgtcaatggcatcctagaagtttcggcggaggacaagacgttgaagaagaacaagatcaccgtcacttacgacgtgggcaggctgtgcgcggaggagatcgaacgcatgattcaggccttgtttaggccttag

SEQ ID NO: 15527 - protein, 623 aa, Sorghum bicolor
  misc_feature: Useful for making plants with modulated heat sensitivity
  misc_feature: Functional homolog of the protein sequence given in SEQ ID NO 13726
  misc_feature: Useful for making plants with modulated drought sensitivity
  misc_feature: Functional homolog of the protein sequence given in SEQ ID NO 14080
  misc_feature: Ceres ANNOT ID no. 8641862
  misc_feature (10)..(618): Pfam ID: HSP70 Pfam Description: Hsp70 protein
MAATKVDGPAIGIDLGTTYSCVAVWRHDRGEVIANDQGNRLTPSCVAFTSTERLVGEAAVNQAALNPTNTIFEVKRLIGRRFSDESVKEDANLWPFKVVAGNDERPMIVVQHEGKEKQFMPEEISSMVLVKMRETAEVYLGKKIKNAVITVPVYFNNSQRQATIDAVLVFDLGGGTFDVSLLNIDPGTNMDKGLFEVVAIAGDTHLGGADFDNEMVKYSLREFIRKHGKIDIHSNQKALRRLRTACERAKGMLSSTAQTTIEVDSLHDGIDFCTTITRSRFEELNKDLFSKCMKALDKCLSDAKMDKRSVHDVVLVGGSTRIPKVQNMLREFFCGKELCQSINPDEAVAYGAAIQASILCGGTDDGRLVDMLLRDVTPLSLGIETEDNFTMSVIIPRNTSIPTKKSRRFTTIDDNQTTVSIPVYEGESAKTWNNNLLGKFELTGIPPAPRGKPRLETTFEIDANGILKVSEEDLDTGRKNGITILNHGGRLRKEEIALPAGGLLRRDGVNPDEAVSYGAAIQAAILSDEEDVQDVLLVDVTPLSLGVRTIRGVMSMLIPLEDIERAPRGVPKINVTFEIDVNGILEVSAEDKTLKKNKITVTYDVGRLCAEEIERMIQALFRP

SEQ ID NO: 15528 - DNA, 1950 bp, Sorghum bicolor
  misc_feature: Ceres ANNOT ID no. 8641879
  misc_feature: Encodes the peptide sequence at SEQ ID NO 15529
atggccggaaagggagacgggccggcgatcggcatcgacctcggcacgacctactcgtgcgtcggggtgtggcagcatgaccgagtcgagatcatcgccaacgaccagggcaaccgcacgacgccgtcgtatgtcgccttcaccgactccgagaggctcgtcggcgacgccgccaagaatcaggtcgccatgaaccccatcaacaccgtcttcgacgcgaagcggctcatcggccggcgcttctctgacgcgtcggtgcagagtgacgtcaagctgtggcctttcaaggtgatcccgggctccggcgacaagcccatgatcggggtgcagttcaggggcgaggagaagcagttctcggcagaggagatcagctccatgatcctgaacaagatgaaggacacggcggaggcctacctcggcaccaccatcaagaacgccgtcgtcaccgtcccggcctacttcaacgactcccagcgccaggccaccaaggacgccggcgtcatctccggcctcaacgtcatgcgcatcatcaacgagcccaccgccgcggccatcgcctacgggctcgacaagaagtcgagcagtgacggcgagaagaacgtcctcatcttcgacctcggcggcggtaccttcgacgtctcgctcctcaccatcgaggagggcatcttcgaggtcaaggccaccgccggcgacacccacctaggaggcgaggacttcgacaaccggctcgtgaaccacttcgtccaggagttcaagaggaagaacaagaaggacatcaccggcaaccccagggcgctccggcggctgcggaccgcctgcgagagggccaagaggacgctctcctccaccgcccagaccaccatcgagatcgactcgctctacgagggcatcgacttctacaccaccatcacccgcgcccggtttgaggagctcaacatggacctcttccgcaagtgcatggagcccgtggagaagtgcctccgcgacgccaagatggacaagagcagcgtgcacgacgtcgtgctcgtgggcggctccacccgcatcccccgcgtgcagcagctgctccaggacttcttcaacggcaaggagctgtgcaagagcatcaacccagacgaggctgtcgcgtacggcgccgccgtccaggccgccatcctcaccggcgagggcaacgagaaggtgcaggacctgctcctgctcgacgtctcgccgctctcgctcggcctggagacggccggaggcgtcatgacggtgctcatccccaggaacaccaccatccccacgaagaaggagcaggtcttctccacttactccgacaaccagcccggcgtgctcatccaggtgtacgagggtgagagggccaggaccaaagacaacaacctgctcggcaagttcgagctctctggcatccctccggcgcccaggggcgtcccccagatcaccgtgtgcttcgacatggatgccaacggcatcctcaacgtgtcggctgaggacaagaccaccggccagaagaacaagatcacgatcaccaacgacaagggccggctgagcaaagaggagatcgagaagatggtgcaggaggcagagaagtacaaggccgaggacgaggagcacaagaagaaggtggacgccaagaactcgctcgagaactacgcctacaacatgcgcaacaccatcagggacgacaagatcgcctccaagctcccggaggccgacaagaagaagattgatgacgccatcgagggggccattaattggctcgacaacaaccagctcgccgaggtcgacgagtttgaggacaagatgaaggagctggagggcatctgcaaccccatcatcgccaagatgtaccagggcgctgctggtcctgacatggccggtggcatggatcaggatgctccgccggctggtggcagtggtgctggccccaagatcgaagaagtcgactaa

SEQ ID NO: 15529 - protein, 649 aa, Sorghum bicolor
  misc_feature: Useful for making plants with modulated drought sensitivity
  misc_feature: Useful for making plants with modulated heat sensitivity
  misc_feature: Functional homolog of the protein sequence given in SEQ ID NO 14080
  misc_feature: Ceres ANNOT ID no. 8641879
  misc_feature (9)..(618): Pfam ID: HSP70 Pfam Description: Hsp70 protein
MAGKGDGPAIGIDLGTTYSCVGVWQHDRVEIIANDQGNRTTPSYVAFTDSERLVGDAAKNQVAMNPINTVFDAKRLIGRRFSDASVQSDVKLWPFKVIPGSGDKPMIGVQFRGEEKQFSAEEISSMILNKMKDTAEAYLGTTIKNAVVTVPAYFNDSQRQATKDAGVISGLNVMRIINEPTAAAIAYGLDKKSSSDGEKNVLIFDLGGGTFDVSLLTIEEGIFEVKATAGDTHLGGEDFDNRLVNHFVQEFKRKNKKDITGNPRALRRLRTACERAKRTLSSTAQTTIEIDSLYEGIDFYTTITRARFEELNMDLFRKCMEPVEKCLRDAKMDKSSVHDVVLVGGSTRIPRVQQLLQDFFNGKELCKSINPDEAVAYGAAVQAAILTGEGNEKVQDLLLLDVSPLSLGLETAGGVMTVLIPRNTTIPTKKEQVFSTYSDNQPGVLIQVYEGERARTKDNNLLGKFELSGIPPAPRGVPQITVCFDMDANGILNVSAEDKTTGQKNKITITNDKGRLSKEEIEKMVQEAEKYKAEDEEHKKKVDAKNSLENYAYNMRNTIRDDKIASKLPEADKKKIDDAIEGAINWLDNNQLAEVDEFEDKMKELEGICNPIIAKMYQGAAGPDMAGGMDQDAPPAGGSGAGPKIEEVD

SEQ ID NO: 15530 - DNA, 1143 bp, Sorghum bicolor
  misc_feature: Ceres ANNOT ID no. 8641906
  misc_feature: Encodes the peptide sequence at SEQ ID NO 15531
atggggaactgcgccggcgtggaggggaacgctgagatcaacccttccttcagtgcccccaattcgtcagggaccggttctaaaaacagcagcaagaatgcaaccgacaccagcacctttggtaccaagacgtccggctcgtcgtcgtcggtgccaccaactccccgtacggagacagagatcctggagtcgtcgaatgttcgcaagttcaccttcagtgagctgaaaggctccacaaggaacttcaggccggacagcctgcttggggagggaggctttggctctgtgttcaagggatggatggatgagcgcacgcttgcgcctgtgaaaccgggcactgggatgattgtcgccgtgaagaagctcaagctcgacagcttccaggggcacagagaatggctggctgaggtcaattacctagggcagttatcccaccctaatcttgtgaaacttatcggctactgcttggaggacgaacaacggcttcttgtgtatgagtacatgccaagagggagcttggagcatcatcttttcaggaggagctcgaacttccaaccgctcccatggaacttacgcatcaaggttgcgcttgaagctgccagaggtcttgctttcctgcatggcgaccaggctaaagtcatttaccgtgatttcaagacctccaatattcttctcgactcggaatacaatgcaaaattggctgatttcggtttggcaaaagacggtccaactggtgataaaagtcatgtttctactagggtcatggggacacaaggatatgctgcccctgaatatcttgcgacaggccatttgaccgcaaagagcgatgtgtacagctatggtgttgttcttttggagttgctgtctgggcagcgtgctctggacaagaaccgtccgcctggtcagcacaatctggtggagtgggctagaccttacatcaccaacaagaggagggtcatacatgtcctggactcacggctgggttcccagtgttcccttcctgcggctcagaagatggcaaccctcgcactgcaatgcttgtcgatggacgcacgaggcaggcctggcatggatcaggttgtgactgtattagaagatcttcaagaagccaagggctcagtgaaaaagctggcaagtaagtag

SEQ ID NO: 15531 - protein, 380 aa, Sorghum bicolor
  misc_feature: Useful for making plants with modulated drought sensitivity
  misc_feature: Functional homolog of the protein sequence given in SEQ ID NO 14078
  misc_feature: Useful for making plants with modulated heat sensitivity
  misc_feature: Functional homolog of the protein sequence given in SEQ ID NO 14079
  misc_feature: Ceres ANNOT ID no. 8641906
  misc_feature (60)..(368): SWISSPROT Homolog: EC 2.7.11.1 Non-specific serine/threonine protein kinase
  misc_feature (82)..(364): Pfam ID: Pkinase Pfam Description: Protein kinase domain
MGNCAGVEGNAEINPSFSAPNSSGTGSKNSSKNATDTSTFGTKTSGSSSSVPPTPRTETEILESSNVRKFTFSELKGSTRNFRPDSLLGEGGFGSVFKGWMDERTLAPVKPGTGMIVAVKKLKLDSFQGHREWLAEVNYLGQLSHPNLVKLIGYCLEDEQRLLVYEYMPRGSLEHHLFRRSSNFQPLPWNLRIKVALEAARGLAFLHGDQAKVIYRDFKTSNILLDSEYNAKLADFGLAKDGPTGDKSHVSTRVMGTQGYAAPEYLATGHLTAKSDVYSYGVVLLELLSGQRALDKNRPPGQHNLVEWARPYITNKRRVIHVLDSRLGSQCSLPAAQKMATLALQCLSMDARGRPGMDQVVTVLEDLQEAKGSVKKLASK

SEQ ID NO: 15532 - DNA, 2205 bp, Sorghum bicolor
  misc_feature: Ceres ANNOT ID no. 8641912
  misc_feature: Encodes the peptide sequence at SEQ ID NO 15533
atgggtctggataatacttatggggagctatctggcatgttctgtggaggcctgtcttatgatggctacatagatcacagcagcggaagtgattatttcaggttcaccgatccacttcctgtggttgtgccccagatgacagcagaagcttgttcaaatccttcctccactgtgtcaagggccaacactgaaactgacaacccagaggattgggaattcatctcagatgagtccctcaactatattagccggatgctcatggaggaggatatagatgagaaagtcagcatgtaccaggcggagtcagcggcactgcgtgctgctgcaaagccgttctatgacattcttgggcacaagtttccaccgtctcctgatcaccagccgatcccttggtccatggacagccccagtgagagtagcagtagcatttgtacacaatctattgcaagtagtgtcactagcagcagcattggtggcacagtggatagcaactggcgctacgacgttggacgcagtgagcagttggaagcttatcaaggcttgtgtggtcagtcttctcaaccgcttgttggtacatctagtgatgcttccaatgcagtggatgggctagatgaccctttgatcacgaatggccagatccctgagtatttgtttgagagccttccaacttgggatttcaggagaggtattgaggaagcccagaagtttcttcctgttagcaatacactagtgattgatttagaagctggtggtatcacaagacctcaagaagcaaggaaagatgtttctttgaatgccaaaaaggcagatgtattgaaggccaagaaaaacagacagagtgaagaccttgacctgattgaaggccggaactttaaacagtccgcatttagttccgatgaacctgattggattgagatgtttgatgatctgcttcggcaaactgagaagaaggctacagatctgcgagagcttatgcgcaatgaagcttccaagaattctcaggtcactcagacgaaaggaccaagtgggccacggccgcggggaaggaaaccaacaaagaaggatgtggtggaccttaggaccatcctcatccactgtgcacaggctgtggcagcagatgaccgcagaactgctaatgaattgttaaagcaaataaggcaccattccaagccaaatggcgatggatcccagaggttagcacattgttttgcagatggtcttgaggctcgtttggcaggcacagggagtcagctttaccggaagcttatagcgaaacgtacaactgcctcagacatgcttaaagcctaccacctttaccttgcagcatgcccattcaagaggctttcacattttctttccgatcaaacaatcttgagtatgattaaaaatgcatcaaaggtgcatatcattgacttcggcatttattttggcttccaatggccatgcctaatcaggcgtctctccaagagggaaggcggtccacctgttctgcgcgtcactggaattgatgtacctcagccaggtttccgcccttctgagagaattgaagagactggacaaaggcttgcagaatatgctgcgaagttcaaggtgccttttgagtatcagggaatagcatcaaagtgggaaaccatccgagttgaggatctcaaagttggtaaggacgaagttgtgattgttaattgcctgtacagattcagaaacctgattgatgaaacagttgctgtagacagtcctaggaatagagtgctcaacacaataaggcaagtaaacccagctattttcatccatggaattgtgaatgggtcatacagtgttcccttcttcatcacacgtttccgtgaggcactgttccatttctctgcattgtttgacatgctagagacaactgtcccacgggatgatccccagcgtgcactcatagagagggaaatgtttggccgagaggcactcaatgttattgcttgtgagggctcagacagagttgagagacccgagacatacaaacagtggcaggtgaggaacctcagggctggatttgttcagtctccgttaaacaaagaaattgtgatgaaagccaaggacaaagtaaaagacatttatcacaaggactttgtcatagatgaagacagtggatggctcctgcaaggctggaaaggaaggataatctatgcgatatctacatggaagcctaagaataactag

SEQ ID NO: 15533 - protein, 734 aa, Sorghum bicolor
  misc_feature: The sequence is a functional homolog of SEQ ID NO 1324 in the 10/374,780 US patent application
  misc_feature: The sequence is a functional homolog of SEQ ID NO 1471 in the 10/412,699 US patent application
  misc_feature: The sequence is a functional homolog of SEQ ID NO 1392 in the 11/479,226 US patent application
  misc_feature: The sequence is a functional homolog of SEQ ID NO 204 in the 10/374,780 US patent application
  misc_feature: The sequence is a functional homolog of SEQ ID NO 576 in the 10/225,066 US patent application
  misc_feature: The sequence is a functional homolog of SEQ ID NO 654 in the 10/412,699 US patent application
  misc_feature: The sequence is a functional homolog of SEQ ID NO 92 in the 11/375,241 US patent application
  misc_feature: Ceres ANNOT ID no. 8641912
  misc_feature (333)..(639): Pfam ID: GRAS Pfam Description: GRAS family transcription factor
MGLDNTYGELSGMFCGGLSYDGYIDHSSGSDYFRFTDPLPVVVPQMTAEACSNPSSTVSRANTETDNPEDWEFISDESLNYISRMLMEEDIDEKVSMYQAESAALRAAAKPFYDILGHKFPPSPDHQPIPWSMDSPSESSSSICTQSIASSVTSSSIGGTVDSNWRYDVGRSEQLEAYQGLCGQSSQPLVGTSSDASNAVDGLDDPLITNGQIPEYLFESLPTWDFRRGIEEAQKFLPVSNTLVIDLEAGGITRPQEARKDVSLNAKKADVLKAKKNRQSEDLDLIEGRNFKQSAFSSDEPDWIEMFDDLLRQTEKKATDLRELMRNEASKNSQVTQTKGPSGPRPRGRKPTKKDVVDLRTILIHCAQAVAADDRRTANELLKQIRHHSKPNGDGSQRLAHCFADGLEARLAGTGSQLYRKLIAKRTTASDMLKAYHLYLAACPFKRLSHFLSDQTILSMIKNASKVHIIDFGIYFGFQWPCLIRRLSKREGGPPVLRVTGIDVPQPGFRPSERIEETGQRLAEYAAKFKVPFEYQGIASKWETIRVEDLKVGKDEVVIVNCLYRFRNLIDETVAVDSPRNRVLNTIRQVNPAIFIHGIVNGSYSVPFFITRFREALFHFSALFDMLETTVPRDDPQRALIEREMFGREALNVIACEGSDRVERPETYKQWQVRNLRAGFVQSPLNKEIVMKAKDKVKDIYHKDFVIDEDSGWLLQGWKGRIIYAISTWKPKNN

SEQ ID NO: 15534 - DNA, 1731 bp, Sorghum bicolor
  misc_feature: Ceres ANNOT ID no. 8641917
  misc_feature: Encodes the peptide sequence at SEQ ID NO 15535
atggcggcgccatcatctcttgcattcctcctgttctttggtacgttgctagcattgccgcagtcgtcgcacggcgcaaccagatactacaccttcaatgtgacgatgcagaaggtgacgcggctgtgcaccacccgcgccatcccgacggtaaacggcaagttcccggggcccaagatagtcaccagggagggcgatcgcgtcgtcgtcaaggtggtgaacaatgtcaaggacaacgttaccatccactggcacggcgttcggcagctgcggacggggtggtcggacgggccggcgtacgtgacgcagtgccccatccagacggggcagagcttcgtgtacaacttcaccatcacggggcagcgcggcaccctgttctggcacgcgcacgtctcctggttgcgcgccacgctctacgggcccatcgtcatcctccccaagcgcggcgtcccctacccgttcctcccggttaaaccctacaaggaggtccccatcatcttcggagagtggttcaacgcggatcccgaggcaattatcgcccaggcgcttcagactggagcaggcccaaatgtgtctgacgccttcaccatcaacgggcttccaggccccttgtacaactgctccagcaaagacacgttcaagctgaaggtgctccccggcaagtggtacctgctccggctcatcaacgccgcgctcaacgacgagctcttcttctccatcgccaaccacacgctcaccgtcgtcgacgtggacgcctcctacgtgaagccgttccacacggacatcgtcctcatcacgccgggccagaccaccaacgtgctcctgcgcgccgagcccgacgccgggtgcgccgcggccacgcacctcatgctggcgcgcccctacggcacgggccagccgggcaccttcgacaacaccaccgtcgccgccgtgctcgagtacgcgccggcggcggcggcggggcacatcaagagcctcccgctcttccggccctcgctccccgcgctcaacgacacggccttcgcggccaactacagcgccaggctccggagcctggccacaccggagttccccgccaccgtgccccgcgccgtggaccgctccttcttcttcgccgtggggctcggcaccaacccttgccctgccaaccagacgtgccagggccccaccaaccggaccaagttcacggcgtccatgaacaacgtgtccttcaccatgcccaccaccgcgctcctgcaggcgcactacgacaacatcgccggcgtgtacacggccgacttccccgtcgcgccgctggagccgttcaactacacgggcacgacgcccaacaacaccaacgtctccagcgggaccaaggtggtggtgctggagtacaataccagcgtggaggtggtgctgcagggcaccagcgtcctgggcgccgagagccacccgctgcacctccacggcttcgacttcttcgtcgtcggccaaggcttcggcaactacgactcgtcaaaggacccagccaagttcaatctagacgacccggtgcagaggaacaccgtcggcgtgccgtccggtggttgggtcgccatcaggttcttcgcggataatcccggtgtttggttcatgcattgccacttggaggttcacacaagctgggggttgaagatggcatgggttgtcaacgacggcccgttgcctgagcagaagctgatgccgccaccgcccgatcttcccaagtgttga

SEQ ID NO: 15535 - protein, 576 aa, Sorghum bicolor
  misc_feature: Useful for making plants with altered carbohydrate content
  misc_feature: Functional homolog of the protein sequence given in SEQ ID NO 14205
  misc_feature: Useful for making plants with altered cell wall content and/or composition
  misc_feature: Functional homolog of the protein sequence given in SEQ ID NO 14217
  misc_feature: Useful for biocontainment applications
  misc_feature: Useful for making plants with modulated biomass
  misc_feature: Useful for making plants with modulated flowering time
  misc_feature: Useful for making plants with modulated low light sensitivity
  misc_feature: Functional homolog of the protein sequence given in SEQ ID NO 14204
  misc_feature: Ceres ANNOT ID no. 8641917
  misc_feature (26)..(559): SWISSPROT Homolog: EC 1.10.3.2 Laccase
  misc_feature (33)..(149): Pfam ID: Cu-oxidase_3 Pfam Description: Multicopper oxidase
  misc_feature (161)..(317): Pfam ID: Cu-oxidase Pfam Description: Multicopper oxidase
  misc_feature (426)..(560): Pfam ID: Cu-oxidase_2 Pfam Description: Multicopper oxidase
MAAPSSLAFLLFFGTLLALPQSSHGATRYYTFNVTMQKVTRLCTTRAIPTVNGKFPGPKIVTREGDRVVVKVVNNVKDNVTIHWHGVRQLRTGWSDGPAYVTQCPIQTGQSFVYNFTITGQRGTLFWHAHVSWLRATLYGPIVILPKRGVPYPFLPVKPYKEVPIIFGEWFNADPEAIIAQALQTGAGPNVSDAFTINGLPGPLYNCSSKDTFKLKVLPGKWYLLRLINAALNDELFFSIANHTLTVVDVDASYVKPFHTDIVLITPGQTTNVLLRAEPDAGCAAATHLMLARPYGTGQPGTFDNTTVAAVLEYAPAAAAGHIKSLPLFRPSLPALNDTAFAANYSARLRSLATPEFPATVPRAVDRSFFFAVGLGTNPCPANQTCQGPTNRTKFTASMNNVSFTMPTTALLQAHYDNIAGVYTADFPVAPLEPFNYTGTTPNNTNVSSGTKVVVLEYNTSVEVVLQGTSVLGAESHPLHLHGFDFFVVGQGFGNYDSSKDPAKFNLDDPVQRNTVGVPSGGWVAIRFFADNPGVWFMHCHLEVHTSWGLKMAWVVNDGPLPEQKLMPPPPDLPKC

SEQ ID NO: 15536 - DNA, 1704 bp, Sorghum bicolor
  misc_feature: Ceres ANNOT ID no. 8641944
  misc_feature: Encodes the peptide sequence at SEQ ID NO 15537
atgtgggcgcgtttctggtttgccgtgccggccaagaggccgccacggccaccgtttacacctcctcctcctcctccgccgccgcctaagtacggccctcttcctgagccatcatccgtcgcgtcgctgtacgacctcgctggtaatttcctcgaccgcgccaagacagtgctggacaccaccggcggtccggcgggtctcgatgccatctcctccacgccgggcgcacgccgcgccgcggcagagttgacggccccagcctcagacgcggccccagcgggcacagagagtgactcgtggaccttgagttcgcgcgccgtgcactggatcatcgcgggggccgtggtggccgcggtgcttctggttttgtgcatggtggcctgcttcgtccggcggagaaggagacggcgccggcgccggccggtggtactggtaccacctcagctgccactgccagcaccgatggtttaccacaaagatggcccgacatggccagtacttcagcaagcgccgtccgagcactacttcgcgcagcagcagcgccccacaccaccccagacgagcggcgctttctcggacgcgggatccgagaaccgcccgcactccgtggacatcgtcaccgagctgccgaccggaggctcgcactcgtacgagcagctcgccgccgcgacggacgggttcgcccccggcaacatcatcgggcagggcggcttcgggtgcgtgtacagggggaggctcgacggcgccgaggtggcgatcaagaagctcaagacggagagccggcagggagaccgcgagttccgggcagaggtcgagatcatcagccgcgtgcaccaccggaaccttgtcacgctgatcgggtactgtatctactccgatgaaaggttgctggtctacgagtttgtccccaataggacactagacactcatttgcacgggcacaatggtccaccgcttgactggcatcaaaggtggaaaatagctgtgggatcagcaaggggcctggcctatcttcatgacgactgttatcctaaaatcatacatcgtgatgtcaaggcgtccaacattcttcttgatcataattttgagcccaaggttgcagattttgggttagcaaagtatcaaccaggagaccacactcatgtttccacaagaataatgggaactttcgggtacatagctccagagttcttatctagtggaaaactaactgacaaagctgatgttttctcttttggcgtcgttctcctggagctgattactggaaggctaccggttcagtcatctcagtcctacatggatgacacattagttggttgggctagacccttgattcagcaggttgcagatgatggcaaccttcaaacccttgtcgatccacgacttggaactgatttcgatccatccataatgatgcggatggtcgagtgcgctgcggccgctgtgcgccaatcagcgctgcatcgtccatccatggttcagatccttaaatacttgcaaggggaaacacgggcagatgatctgagtggagttttcaagattacagcagtagaggagtcttacagctccagcatggaatccggtgaatccgttggaccgaggccaagaagagcgcagcggagccaggagaacactggcaacgactacaacagcgaacaggctccgggcaacaaaccaaactggagcacgggcagcgcgtggtga

SEQ ID NO: 15537 - protein, 567 aa, Sorghum bicolor
  misc_feature: Useful for making plants with altered carbohydrate content
  misc_feature: Functional homolog of the protein sequence given in SEQ ID NO 14218
  misc_feature: Ceres ANNOT ID no. 8641944
  misc_feature (216)..(502): SWISSPROT Homolog: EC 2.7.11.1 Non-specific serine/threonine protein kinase
  misc_feature (227)..(499): Pfam ID: Pkinase Pfam Description: Protein kinase domain
MWARFWFAVPAKRPPRPPFTPPPPPPPPPKYGPLPEPSSVASLYDLAGNFLDRAKTVLDTTGGPAGLDAISSTPGARRAAAELTAPASDAAPAGTESDSWTLSSRAVHWIIAGAVVAAVLLVLCMVACFVRRRRRRRRRRPVVLVPPQLPLPAPMVYHKDGPTWPVLQQAPSEHYFAQQQRPTPPQTSGAFSDAGSENRPHSVDIVTELPTGGSHSYEQLAAATDGFAPGNIIGQGGFGCVYRGRLDGAEVAIKKLKTESRQGDREFRAEVEIISRVHHRNLVTLIGYCIYSDERLLVYEFVPNRTLDTHLHGHNGPPLDWHQRWKIAVGSARGLAYLHDDCYPKIIHRDVKASNILLDHNFEPKVADFGLAKYQPGDHTHVSTRIMGTFGYIAPEFLSSGKLTDKADVFSFGVVLLELITGRLPVQSSQSYMDDTLVGWARPLIQQVADDGNLQTLVDPRLGTDFDPSIMMRMVECAAAAVRQSALHRPSMVQILKYLQGETRADDLSGVFKITAVEESYSSSMESGESVGPRPRRAQRSQENTGNDYNSEQAPGNKPNWSTGSAW

SEQ ID NO: 15538 - DNA, 819 bp, Sorghum bicolor
  misc_feature: Ceres ANNOT ID no. 8641939
  misc_feature: Encodes the peptide sequence at SEQ ID NO 15539
atggggagcctcgacggccactcgctgcagcagggccatcaccacggctacgcccactcccacgtcggcgcgggccccgacagcagcggcaacaacaacaacgacgaggacgacgcgtcgcccccgcctgccggcgccgcggcggggggaggcggaggtcctcgccggccgcgggggaggcccccggggtccaagaacaagccgaagccgccggtggtggtgacgcgggagagccccaacgcgatgcgctcccacgtgctggagatcgccagcggcgccgacatcgtggacgccatcgcgggcttctcccgccgccgccagcgcggcgtctccgtgctcagcgggaccggcgcggtcaccaacgtcacgctgcggcagcccgcgggggccggcgcggcggccatcgcgctgcgtggccggttcgagatactgtccatgtccggggcgttcctcccggcgccggcgccgccgggggccacggggctcgccgtgtacctggcgggagggcaggggcaggtggtgggcgggagcgtcatgggggagctcatcgcgtcgggccccgtcatggtgatcgccgccacgttcggcaacgccacctacgagaggctgccgctggagcaggacgccgaggagggcgccgtgctctccgggtcgtccgagggcggcgccaccgcgcagcagctggagcagcagcagagcagcgggggccccgtcgtgccgccgtcgtccatgtacgccgtcccgcagacgccgccgcacgacatgttcggccagtgggggcacgcggctgtgacgcggccaccgccgacgtcgttctag

SEQ ID NO: 15539 - protein, 272 aa, Sorghum bicolor
  misc_feature: The sequence is a functional homolog of SEQ ID NO 1409 in the 10/374,780 US patent application
  misc_feature: The sequence is a functional homolog of SEQ ID NO 40 in the 10/669,824 US patent application
  misc_feature: The sequence is a functional homolog of SEQ ID NO 40 in the 10/870,198 US patent application
  misc_feature: The sequence is a functional homolog of SEQ ID NO 412 in the 11/435,388 US patent application
  misc_feature: The sequence is a functional homolog of SEQ ID NO 414 in the 10/714,887 US patent application
  misc_feature: The sequence is a functional homolog of SEQ ID NO 1418 in the 10/374,780 US patent application
  misc_feature: The sequence is a functional homolog of SEQ ID NO 1395 in the 10/374,780 US patent application
  misc_feature: The sequence is a functional homolog of SEQ ID NO 1507 in the 10/412,699 US patent application
  misc_feature: The sequence is a functional homolog of SEQ ID NO 22 in the 10/669,824 US patent application
  misc_feature: The sequence is a functional homolog of SEQ ID NO 22 in the 10/870,198 US patent application
  misc_feature: The sequence is a functional homolog of SEQ ID NO 346 in the 11/435,388 US patent application
  misc_feature: The sequence is a functional homolog of SEQ ID NO 348 in the 10/714,887 US patent application
  misc_feature: The sequence is a functional homolog of SEQ ID NO 1402 in the 10/374,780 US patent application
  misc_feature: The sequence is a functional homolog of SEQ ID NO 1410 in the 10/374,780 US patent application
  misc_feature: The sequence is a functional homolog of SEQ ID NO 344 in the 11/435,388 US patent application
  misc_feature: The sequence is a functional homolog of SEQ ID NO 346 in the 10/714,887 US patent application
  misc_feature: The sequence is a functional homolog of SEQ ID NO 38 in the 10/669,824 US patent application
  misc_feature: The sequence is a functional homolog of SEQ ID NO 38 in the 10/870,198 US patent application
  misc_feature: The sequence is a functional homolog of SEQ ID NO 1413 in the 10/374,780 US patent application
  misc_feature: Useful for making plants with modulated biomass
  misc_feature: Useful for making plants with modulated flowering time
  misc_feature: Functional homolog of the protein sequence given in SEQ ID NO 14219
  misc_feature: The sequence is a functional homolog of SEQ ID NO 322 in the 11/435,388 US patent application
  misc_feature: The sequence is a functional homolog of SEQ ID NO 324 in the 10/714,887 US patent application
  misc_feature: The sequence is a functional homolog of SEQ ID NO 50 in the 10/669,824 US patent application
  misc_feature: The sequence is a functional homolog of SEQ ID NO 50 in the 10/870,198 US patent application
  misc_feature: The sequence is a functional homolog of SEQ ID NO 1412 in the 10/374,780 US patent application
  misc_feature: Useful for making plants with modulated light quality response
  misc_feature: Functional homolog of the protein sequence given in SEQ ID NO 14220
  misc_feature: The sequence is a functional homolog of SEQ ID NO 2528 in the 10/374,780 US patent application
  misc_feature: The sequence is a functional homolog of SEQ ID NO 256 in the 10/225,066 US patent application
  misc_feature: The sequence is a functional homolog of SEQ ID NO 298 in the 11/435,388 US patent application
  misc_feature: The sequence is a functional homolog of SEQ ID NO 300 in the 10/714,887 US patent application
  misc_feature: The sequence is a functional homolog of SEQ ID NO 48 in the 10/669,824 US patent application
  misc_feature: The sequence is a functional homolog of SEQ ID NO 48 in the 10/870,198 US patent application
  misc_feature: The sequence is a functional homolog of SEQ ID NO 1400 in the 10/374,780 US patent application
  misc_feature: The sequence is a functional homolog of SEQ ID NO 1510 in the 10/412,699 US patent application
  misc_feature: The sequence is a functional homolog of SEQ ID NO 10 in the 10/669,824 US patent application
  misc_feature: The sequence is a functional homolog of SEQ ID NO 10 in the 10/870,198 US patent application
  misc_feature: The sequence is a functional homolog of SEQ ID NO 1399 in the 10/374,780 US patent application
  misc_feature: The sequence is a functional homolog of SEQ ID NO 1509 in the 10/412,699 US patent application
  misc_feature: The sequence is a functional homolog of SEQ ID NO 340 in the 11/435,388 US patent application
  misc_feature: The sequence is a functional homolog of SEQ ID NO 342 in the 10/714,887 US patent application
  misc_feature: The sequence is a functional homolog of SEQ ID NO 66 in the 10/669,824 US patent application
  misc_feature: The sequence is a functional homolog of SEQ ID NO 66 in the 10/870,198 US patent application
  misc_feature: The sequence is a functional homolog of SEQ ID NO 1416 in the 10/374,780 US patent application
  misc_feature: The sequence is a functional homolog of SEQ ID NO 16 in the 10/669,824 US patent application
  misc_feature: The sequence is a functional homolog of SEQ ID NO 16 in the 10/870,198 US patent application
  misc_feature: The sequence is a functional homolog of SEQ ID NO 388 in the 11/435,388 US patent application
  misc_feature: The sequence is a functional homolog of SEQ ID NO 390 in the 10/714,887 US patent application
  misc_feature: The sequence is a functional homolog of SEQ ID NO 1403 in the 10/374,780 US patent application
  misc_feature: The sequence is a functional homolog of SEQ ID NO 1404 in the 10/374,780 US patent application
  misc_feature: The sequence is a functional homolog of SEQ ID NO 32 in the 10/669,824 US patent application
  misc_feature: The sequence is a functional homolog of SEQ ID NO 32 in the 10/870,198 US patent application
  misc_feature: The sequence is a functional homolog of SEQ ID NO 348 in the 11/435,388 US patent application
  misc_feature: The sequence is a functional homolog of SEQ ID NO 350 in the 10/714,887 US patent application
  misc_feature: The sequence is a functional homolog of SEQ ID NO 1406 in the 10/374,780 US patent application
  misc_feature: The sequence is a functional homolog of SEQ ID NO 26 in the 10/669,824 US patent application
  misc_feature: The sequence is a functional homolog of SEQ ID NO 26 in the 10/870,198 US patent application
  misc_feature: The sequence is a functional homolog of SEQ ID NO 352 in the 11/435,388 US patent application
  misc_feature: The sequence is a functional homolog of SEQ ID NO 354 in the 10/714,887 US patent application
  misc_feature: The sequence is a functional homolog of SEQ ID NO 64 in the 10/669,824 US patent application
  misc_feature: The sequence is a functional homolog of SEQ ID NO 64 in the 10/870,198 US patent application
  misc_feature: Ceres ANNOT ID no. 8641939
MGSLDGHSLQQGHHHGYAHSHVGAGPDSSGNNNNDEDDASPPPAGAAAGGGGGPRRPRGRPPGSKNKPKPPVVVTRESPNAMRSHVLEIASGADIVDAIAGFSRRRQRGVSVLSGTGAVTNVTLRQPAGAGAAAIALRGRFEILSMSGAFLPAPAPPGATGLAVYLAGGQGQVVGGSVMGELIASGPVMVIAATFGNATYERLPLEQDAEEGAVLSGSSEGGATAQQLEQQQSSGGPVVPPSSMYAVPQTPPHDMFGQWGHAAVTRPPPTSF

SEQ ID NO: 15540 - DNA, 477 bp, Sorghum bicolor
  misc_feature: Ceres ANNOT ID no. 8641964
  misc_feature: Encodes the peptide sequence at SEQ ID NO 15541
atgtcgctgatccgccgcagcaacgtgttcgatcccttctccctcgacctctgggacccctttgagggcttccccttcggctccggcggcagcagcagtctcttcccctcgttcccgcgcaccagctcggagaccgcggcctttgccggcacgcggatcgactggaaggagacccccgaagcgcacgtgttcaaggcggacgtcccggggctgaagaaggaggaagtcaaggtggaggttgaggacggcaacgtcctccagatcagcggcgagcgcagcaaggagcaggaggagaagaacgacaggtggcaccgggtggagcgcagcagcggcaagttccttcgcaggttcaggctgccggagaacgccaagacggagcagatcaaggcgtccatggagaatggcgtgctcaccgtcaccgtgcccaaggaggaggccaagaaggccgacatcaagaacgtccagatcaccggctag

SEQ ID NO: 15541 - protein, 158 aa, Sorghum bicolor
  misc_feature: Useful for making plants with modulated heat sensitivity
  misc_feature: Functional homolog of the protein sequence given in SEQ ID NO 13940
  misc_feature: Ceres ANNOT ID no. 8641964
  misc_feature (54)..(157): Pfam ID: HSP20 Pfam Description: Hsp20/alpha crystallin family
MSLIRRSNVFDPFSLDLWDPFEGFPFGSGGSSSLFPSFPRTSSETAAFAGTRIDWKETPEAHVFKADVPGLKKEEVKVEVEDGNVLQISGERSKEQEEKNDRWHRVERSSGKFLRRFRLPENAKTEQIKASMENGVLTVTVPKEEAKKADIKNVQITG

SEQ ID NO: 15542 - DNA, 474 bp, Sorghum bicolor
  misc_feature: Ceres ANNOT ID no. 8641965
  misc_feature: Encodes the peptide sequence at SEQ ID NO 15543
atgtcgctgattcgccgtggaagcgcattcgaccccttctccctcgacctctgggaccccttccagggctttcccttcggctctggaagcagcagcctcttcccctcgttcggaggcaccaactcggagacggccgccttcgccggtgcccgcatcgactggaaggagacgccggaggcgcacgtgttcaaggccgacgtgccggggctgaagaaggaggaggtgaaggtggaggtcgaggacggcaacgtgctccagatcagcggtgagcgcaacaaggagcaggaggagaagacggacacctggcaccgcgtggagcgcagcagcggcaagttcctgcgcaggttccggctgccggagaacgccaagacggagcagatcagtgcgtccatggagaacggcgtgctcaccgtcaccgtgcccaaggaggaggccaagaaggccgacgtcaagtctatccagatttccggctag

SEQ ID NO: 15543 - protein, 157 aa, Sorghum bicolor
  misc_feature: Useful for making plants with modulated heat sensitivity
  misc_feature: Functional homolog of the protein sequence given in SEQ ID NO 13940
  misc_feature: Ceres ANNOT ID no. 8641965
  misc_feature (53)..(156): Pfam ID: HSP20 Pfam Description: Hsp20/alpha crystallin family
MSLIRRGSAFDPFSLDLWDPFQGFPFGSGSSSLFPSFGGTNSETAAFAGARIDWKETPEAHVFKADVPGLKKEEVKVEVEDGNVLQISGERNKEQEEKTDTWHRVERSSGKFLRRFRLPENAKTEQISASMENGVLTVTVPKEEAKKADVKSIQISG

SEQ ID NO: 15544 - DNA, 2838 bp, Sorghum bicolor
  misc_feature: Ceres ANNOT ID no. 8642002
  misc_feature: Encodes the peptide sequence at SEQ ID NO 15545
atggtattggttttcccacaaaatagtggtagacggcgatgccttgtacagctgtactcccgccgcgcccagcttgtccagttgcgttttgacgcctcagaaatccaaatcaacggtcccaacaaaggtaccggggcccggaccacgccagctttgccggcaccacccccagctctgccgcctcgcgcaacaagatccccctgccgctgtcgccgcagctgtaccactcctccaccagtccaacagcagcacagcgacgccccccggccgccatcggcgagcagctacgagcgggccgtacccgtaatggcgctgtccgcgtcggcggcgtcagccgggcgggggtcgcgggcggagaaggtgaggaggatcttcgagcgcttcgacaccaacggggacggcgggctggaccgcaacgagatggccgcgctcgtcgtcgccgtcaacccgcgggtcaagttcagcgaggaccagatctctgccatcctcgacgaggtgttccgcacctacgccgagttcatcctccccgacggcaggggcctctccctgccggggctgctccgcacctacgacgacggcgccggggacgtcgaccgcgacttcctcgcgctctccctgcccgtcgtcgactctgacgcctcatccccggagatcgccgcgggggacgccgccgccctctcctccccgccctccggagctgccgccgcagcgtcgctgctcgacgaccacgccaagccgctcggcgccggcggcgctctgccgtcggtcagctcccgcgccgcggccgccgcgccggcgtgggcgacctcccctaaccacggcatcgccttcgactcctcatgggggctcctcgacgacctggagatactcgtcaagcgcctccgctcaaagcagctgcggaagggctccgtcgacggaagcggcggcgccggcaacaacaacttcgactccttctccgaggccgggtggtccagggagatctcaggcgctgcggattcggcatccaccgccgctccgtgggacgagacgagccgcgactacctcaccttcgtcaaggaactcgccgtgctccgcacgcgcgccgacgcctcccgctcgcgcgaggaggccttcgacaaccacatggtcatcggccgggcgctttctgagcaccgcctcttccgagacgccctagccagcttccgccgcgcctgtgagctgcagcccactgacgtccgtccccacttccgcgcggggaactgcctgtacgccctcggtcgctatgcagaggccaaggaggagtacctccttgcccttgaggctgcggaggctggcggctcacagtccgcggacatcctcccgcagatccatgtcaaccttggtattgccatggaggccgaagggatggtgcttggtgcctgtgagcattaccgagaagcagccatattgtgtccatctcatgccagggcactcaagctcctggggagcgctctctttggcgttggggagtaccgagctgctgagaaggcactggaggaggccatcttcttgaaggaagactatgctgatgcgcactgtgaccttgggtcggccctgcatgcggtaggggaggatgaccgtgcaatccaggagtttcagacagcaattgatctcaaacctggccatgttgatgccttgtacaatcttggtggattgaacatggatgcaggccgcttcgtacgggctgcggagatgtatactcgtgtgctgagcatccgaccaaaccattggcgcgcacagctaaacaaggctgtggctttgcttggacagggtgaatctgaggaggccaagaaggcactcaaggaggcgtttaagatgacacagagggtggaagtgtatgatgctatctcacatttgaagacattgcaaaagaagaagccaaagccttccaaaggaaaagatgatggtcaaggggagcaggcttatgttgttgtggaggcatccaagttcaagagggttggcaggaagactaccttgcggcaggatttggccaatgctctagatataagggccttcgagaggatgacgaaactaggccactgtgatgttgagcttcttagaaaagagatgaatgagactgatgtccctgtatcttactcaggcactggcatccctgagaagtcaatacgcaaagcagctcttgaggttattctccgcaggctcctgtcttttctcaagccagatacctttcagggtgctatcaaggcaatcaatgaaagaattctctctgtccttgatgctcctggctctggtcgtgttgatttgggaatgttcttcgccatcattgctccagtctgttctggccctgtggataggcgcaagcgtatcgtctttgatgcacttctttggcgtcctgctagcgaaggtagcaatggtcagataaggaggagtgatgcgttaacctacattaagcttcttcgggctgtttatatacccacacatggggctagtgacatgcttgaaatgcatggggagtctgaccctactatggtatcatacacggaattcttagagatgttcaatgacccagattggggatttgggatcctgagcactctggtgaagcttgaagagagtgatcacatacggcatggtcgctacacatgctccatctgccggtaccctatcattgggtcacggtttaaggaaacaaaacactcattcagcctgtgcaaccgatgctacagtgaagggaaggttccgtcagcctacaagttggaggagtacaggttcaaagaatacggtaacgagtctgaggccctcatcgataagtgcatgtgcttcaatttacattctaagaagctggaaagtgatgcttga

SEQ ID NO: 15545 - protein, 945 aa, Sorghum bicolor
  misc_feature: Useful for making plants with altered alkaloid content
  misc_feature: Functional homolog of the protein sequence given in SEQ ID NO 13322
  misc_feature: Useful for making plants with modulated flowering time
  misc_feature: Functional homolog of the protein sequence given in SEQ ID NO 13556
  misc_feature: Ceres ANNOT ID no. 8642002
  misc_feature (515)..(548): Pfam ID: TPR_2 Pfam Description: Tetratricopeptide repeat
  misc_feature (549)..(582): Pfam ID: TPR_2 Pfam Description: Tetratricopeptide repeat
  misc_feature (481)..(514): Pfam ID: TPR_1 Pfam Description: Tetratricopeptide repeat
  misc_feature (120)..(148): Pfam ID: efhand Pfam Description: EF hand
  misc_feature (869)..(912): Pfam ID: ZZ Pfam Description: Zinc finger, ZZ type
MVLVFPQNSGRRRCLVQLYSRRAQLVQLRFDASEIQINGPNKGTGARTTPALPAPPPALPPRATRSPCRCRRSCTTPPPVQQQHSDAPRPPSASSYERAVPVMALSASAASAGRGSRAEKVRRIFERFDTNGDGGLDRNEMAALVVAVNPRVKFSEDQISAILDEVFRTYAEFILPDGRGLSLPGLLRTYDDGAGDVDRDFLALSLPVVDSDASSPEIAAGDAAALSSPPSGAAAAASLLDDHAKPLGAGGALPSVSSRAAAAAPAWATSPNHGIAFDSSWGLLDDLEILVKRLRSKQLRKGSVDGSGGAGNNNFDSFSEAGWSREISGAADSASTAAPWDETSRDYLTFVKELAVLRTRADASRSREEAFDNHMVIGRALSEHRLFRDALASFRRACELQPTDVRPHFRAGNCLYALGRYAEAKEEYLLALEAAEAGGSQSADILPQIHVNLGIAMEAEGMVLGACEHYREAAILCPSHARALKLLGSALFGVGEYRAAEKALEEAIFLKEDYADAHCDLGSALHAVGEDDRAIQEFQTAIDLKPGHVDALYNLGGLNMDAGRFVRAAEMYTRVLSIRPNHWRAQLNKAVALLGQGESEEAKKALKEAFKMTQRVEVYDAISHLKTLQKKKPKPSKGKDDGQGEQAYVVVEASKFKRVGRKTTLRQDLANALDIRAFERMTKLGHCDVELLRKEMNETDVPVSYSGTGIPEKSIRKAALEVILRRLLSFLKPDTFQGAIKAINERILSVLDAPGSGRVDLGMFFAIIAPVCSGPVDRRKRIVFDALLWRPASEGSNGQIRRSDALTYIKLLRAVYIPTHGASDMLEMHGESDPTMVSYTEFLEMFNDPDWGFGILSTLVKLEESDHIRHGRYTCSICRYPIIGSRFKETKHSFSLCNRCYSEGKVPSAYKLEEYRFKEYGNESEALIDKCMCFNLHSKKLESDA

SEQ ID NO: 15546 - DNA, 1368 bp, Sorghum bicolor
  misc_feature: Ceres ANNOT ID no. 8641991
  misc_feature: Encodes the peptide sequence at SEQ ID NO 15547
atggcgggcagtggtggtggctcgctgctgcgcggattcctgtccctcttcttcctcctgttcctccacattggccacgccagctgctgcttctcccccggcggccctgccgcgcgggcgcgggaggaggacgaagcagcggacggcgatggcgatgggaaggtaggcggcggcggaggtgggagcagcaagaggaggaagatatcgccgttgatcttctctccggcagcgtcgtcctctgccgttaccagcgatagcgtccgaggaggagccccgcgcaggcacgtgtcgtctctcgccaccagcctccggttctacctccaccgcatcttctcctcctcctcctccgggtccggggccaagaacggcggcaccgtcgcgggcagcagggaggaagaggaggcggtgaccaccaccgtgtcttcgccgctcgcggcccagtctctgccgcaccagccttcgacgtcggtggtgctgtccacgccgtcgtcaccgtgcgcgtcgtcgcccttcatgtcgccgctctcggtgcgctccctcagcgccacccccgtcccgtcctcgccgcagaaactgctgcaggcgagcaggcagtcgtcgcggtcgttcgccgcccgcggcgacgtgttcccctgcaaggtgtgcggcgaggtgctgggcaggccgcacctgctggagctccaccaggcgatgaagcactccctgtcggagctcacccacctggactccagcctcaacatcatccgcatgatcttcctcgccgggtggaagcccgccgcggcgtccggcgccggcgcgggcgaggcccccgcggtgcgccgcatcctcaggatccaccacaacccgcgcgcgctggcccgcttcgaggagtaccgcgacctcgtccgcgcccgtgccgcccggcgctgcggcgacgagggcgccgtcgtggaggagcgctgcatcgcggacggcaacgagcgcctgcggttccactgctccaccatgctctgctccctgggcggcggcggcgtgtgcgggagcccctactgctgcgtgtgcagcaccctgcggcacggcttcgcgggcaagcaggccgacgtggacggcatcgccacctacgcctccgcgtgggccgcgcacgcgtccctgccgggcgacgtggagcgcgagttcgccttcctccaggtgcgccgagccatgctggtgtgccgcgtcgtggcgggccgcgtcgcccgaggccccgcggacgacaaggtggcctacgactccatggtccccgtgcgcggcggcgtcagcagcgctgtcggggccgacgacgtcgagctgctggtgtacaaccccagagcagtgctcccgtgcttcgtcatcctctacagcagcagctag

SEQ ID NO: 15547 - protein, 455 aa, Sorghum bicolor
  misc_feature: The sequence is a functional homolog of SEQ ID NO 1317 in the 10/666,642 US patent application
  misc_feature: Ceres ANNOT ID no. 8641991
MAGSGGGSLLRGFLSLFFLLFLHIGHASCCFSPGGPAARAREEDEAADGDGDGKVGGGGGGSSKRRKISPLIFSPAASSSAVTSDSVRGGAPRRHVSSLATSLRFYLHRIFSSSSSGSGAKNGGTVAGSREEEEAVTTTVSSPLAAQSLPHQPSTSVVLSTPSSPCASSPFMSPLSVRSLSATPVPSSPQKLLQASRQSSRSFAARGDVFPCKVCGEVLGRPHLLELHQAMKHSLSELTHLDSSLNIIRMIFLAGWKPAAASGAGAGEAPAVRRILRIHHNPRALARFEEYRDLVRARAARRCGDEGAVVEERCIADGNERLRFHCSTMLCSLGGGGVCGSPYCCVCSTLRHGFAGKQADVDGIATYASAWAAHASLPGDVEREFAFLQVRRAMLVCRVVAGRVARGPADDKVAYDSMVPVRGGVSSAVGADDVELLVYNPRAVLPCFVILYSSS

SEQ ID NO: 15548 - DNA, 1014 bp, Sorghum bicolor
  misc_feature: Ceres ANNOT ID no. 8642003
  misc_feature: Encodes the peptide sequence at SEQ ID NO 15549
atggcgttcttctctcaccaccatctccagcagccacacccgcagcaggcgccaccgccgcatcagcagcagccggtccttccttccttcaggaacgcgctaccggtgcctgtggatggccagatcccagcgcccctcaccttcttcaacccgccgcctgccttcccggagcagcccgcgcaggcaccgctggtggatgcgatggggctgacggcagctgcggggcttggatggaggcagccgagggagcaggaactgcttggggaaaactcccagatgtcatccatcgattttctgcagacgggctcggcggtgtcgacggggctggcgctgtctctggaggaccggcgccacggcggcggcggggctgggaactcctccggcgattcaccgctgctcctgctgcccatgctggacgatgacatctcacgcgaggtccagcggcttgacgctgatatggaccgcttcattaaagctcagagtgaacggctgaggcaatctatactggagaaagttcaggcaaagcagtttgaggcactggcctcagttgaggacaagatactcagaaaaatacgggataaagaggcggaagtggagaccatcaacaaaaggaactctgaactagaggaccagattaagcatttgggagtggaagttggtgcttggcagcaaagggccaagtacaatgagagcatgatcaatgcactcaagtacaacttggaacaggtatgtgctcatcagagcaaggatttcaaggaaggttgcggcgatagcgaggtagatgacacggcgtcctgtcgcaatggtggtgctgtcaatttgcagctgacaccgaaggagaacagacaacagaaggatttgacggcttgcagggtctgtaaatcaagtgaggcatgcatgctcttgctgccttgtcggcatctttgtctatgcaaggaatgtgagagcaagctgagcttctgccccctgtgccagtcatccaagatacttggcatggagatatattacgcgtag

SEQ ID NO: 15549 - protein, 337 aa, Sorghum bicolor
  misc_feature: Useful for making plants with altered lignin content
  misc_feature: Functional homolog of the protein sequence given in SEQ ID NO 14221
  misc_feature: Ceres ANNOT ID no. 8642003
MAFFSHHHLQQPHPQQAPPPHQQQPVLPSFRNALPVPVDGQIPAPLTFFNPPPAFPEQPAQAPLVDAMGLTAAAGLGWRQPREQELLGENSQMSSIDFLQTGSAVSTGLALSLEDRRHGGGGAGNSSGDSPLLLLPMLDDDISREVQRLDADMDRFIKAQSERLRQSILEKVQAKQFEALASVEDKILRKIRDKEAEVETINKRNSELEDQIKHLGVEVGAWQQRAKYNESMINALKYNLEQVCAHQSKDFKEGCGDSEVDDTASCRNGGAVNLQLTPKENRQQKDLTACRVCKSSEACMLLLPCRHLCLCKECESKLSFCPLCQSSKILGMEIYYA

SEQ ID NO: 15550 - DNA, 2523 bp, Sorghum bicolor
  misc_feature: Ceres ANNOT ID no. 8642055
  misc_feature: Encodes the peptide sequence at SEQ ID NO 15551
atggctcgcgtcctccaccgccgtctcctcctcctcgccgccgtcaccttcgccgtggccgcttctctccttcgcccagctgccgcagtgcgcccctttgttttggttctctccggtgaggatttcctcaaggattcggcaaccgcgcacccgtccctcccctctgccgactccgccgacgacgacgggtgggacgacttcgccgacgattcgccggccgccgacccgctcctctccccgtcatcctgggtccccctcctcgacccaaccagccctcccccctctggcgatgagacggactcgcctgccgacgggctcttcgtggcgggcgcccgcgcgatgctctccgcagcgtccgacggggacgacgcggcgttcgccacggccgccgcgcagatcgaggccgcggcagaggcggggcacccgggcgcgcagtccgcgctggcgttcctcaccggcgccgggatgacgcgcccggcatcccgatcgctcgcgttcctgctgcacaagttcgccgccgacgcgggagatctccagtcaaagatggccctcgcgtactcctatttccgccaggagatgtatgaagaagctgttatactatacgctgaacttgcagaagctgccctaacaagctccttgatatcaaaggagccaccagtgattgaaccaatccgtcttcacagtgggactgaagaaaataaagaggccttgaggaagtcacggggtgaggacgatgaagatttccaaatcacagagtaccaggcacagcgaggcaatgctgctgccatgtacaaattagggcttctgtattactatggactacgtgggctccgtcgtgattatggaaaagcatttcattggttttctaaggctgttgagaaaggcgagacacgagcatcggagcttctgggtgagatctatgctagaggtgctggagtggaaaggaactataccgaagcatacaagtggttggcatttgctgcaaagcagcaacattactcagcttacaatggattgggttatctttatgttaaaggctatggggtggagaagaaaaacttgacaaaagcaagggagctttttgaacttgcagctgagaataaggaagccgggggacattataaccttggtgtgttgtatcttaagggtattggcgtaaagagggatgtaattagagcatgcaatctcttgcttcatgcagttaatgctgggcaaccaaaagctatttatcaggtggcaaagctgttccagaaaggcattggtcttaagaggaatctccatatggcaacaatgctgtacaagtctgttgctgagaggggaccctggagttcactgtccagatgggctctggagtcttacttgaaaggtgatgttggaaaagcattgctcttgtattccagaatggcagatcttggatatgaggttgcacagagcaatgctgcctggattctggataggtatggtgatcaaagtatttgcatgggagaatctagttattgcacagatatggaaagacatcttcgtgcacatgctttgtggtggcaagcatccgagcagggtaatgagcatgctgctttgttgattggcgatgcctactactatggtcggggcgtagcaagggactacgaacgtgcagcagaggcatatatgcatgctcggtcacagtctaatgctcaggctatgtttaaccttgggtacatgcatgagcatggtcatggacttccccttgatttgcacttggcaaaaagatattatgatcaagctgttgaggtggattcagctgctaaactccctgtcatgcttgcactaacaagtttgtggctaaggaagaactatgcagacagttttttggttaattttatcgattcacttccagaaatataccctgttgttaaggaatgggtggaagatgttctcatggatgaagggaacgcaacaattttgactctctttgcttgccttgtaactgtcctctacttgcgggagcgtcaaaggcgtcaagttgcagcagccaacccccaacaacctgatgatgtggccatagggcaagagctcgagagggaagggggagaagaaggaagaaggaagaagcagggacgaaagcccgggtgcgtgagatcacggtggagggagatgatgcaggtcttcctgaagacggtgacggggaagaccgtcatcctcgaggtcgagagcagcgacaccatcgccgccgtcaaggcgaagatccaagacaaggaagggacgcaactggaggacggccgcaccctggtcgactacgacatccgtaaggagtccacgcttcacctggagcttggcctcctcggcggcgcgtacgtcgcctggtggatctcaccaaatctccgagccctcgcgtacaagtacaacgtcaacaagatgatatgccgcaagtgctatgctcgccttcctcttggggccaagaactgccgcaaaaagaagtgtggccacagcaaccaggtgagccttatttctcccatcaggatcttagacattgctgaaatatga

SEQ ID NO: 15551 - protein, 840 aa, Sorghum bicolor
  misc_feature: Useful for making plants with modulated nitrogen use efficiency
  misc_feature: Functional homolog of the protein sequence given in SEQ ID NO 13585
  misc_feature: Useful for making plants with modulated cold sensitivity
  misc_feature: Functional homolog of the protein sequence given in SEQ ID NO 13521
  misc_feature: Ceres ANNOT ID no. 8642055
  misc_feature (508)..(593): SWISSPROT Homolog: EC 3.5.2.6 Beta-lactamase
  misc_feature (260)..(296): Pfam ID: Sel1 Pfam Description: Sel1 repeat
  misc_feature (558)..(593): Pfam ID: Sel1 Pfam Description: Sel1 repeat
  misc_feature (297)..(332): Pfam ID: Sel1 Pfam Description: Sel1 repeat
  misc_feature (333)..(369): Pfam ID: Sel1 Pfam Description: Sel1 repeat
  misc_feature (370)..(405): Pfam ID: Sel1 Pfam Description: Sel1 repeat
  misc_feature (782)..(833): Pfam ID: Ribosomal_L40e Pfam Description: Ribosomal L40e family
  misc_feature (718)..(774): Pfam ID: ubiquitin Pfam Description: Ubiquitin family
MARVLHRRLLLLAAVTFAVAASLLRPAAAVRPFVLVLSGEDFLKDSATAHPSLPSADSADDDGWDDFADDSPAADPLLSPSSWVPLLDPTSPPPSGDETDSPADGLFVAGARAMLSAASDGDDAAFATAAAQIEAAAEAGHPGAQSALAFLTGAGMTRPASRSLAFLLHKFAADAGDLQSKMALAYSYFRQEMYEEAVILYAELAEAALTSSLISKEPPVIEPIRLHSGTEENKEALRKSRGEDDEDFQITEYQAQRGNAAAMYKLGLLYYYGLRGLRRDYGKAFHWFSKAVEKGETRASELLGEIYARGAGVERNYTEAYKWLAFAAKQQHYSAYNGLGYLYVKGYGVEKKNLTKARELFELAAENKEAGGHYNLGVLYLKGIGVKRDVIRACNLLLHAVNAGQPKAIYQVAKLFQKGIGLKRNLHMATMLYKSVAERGPWSSLSRWALESYLKGDVGKALLLYSRMADLGYEVAQSNAAWILDRYGDQSICMGESSYCTDMERHLRAHALWWQASEQGNEHAALLIGDAYYYGRGVARDYERAAEAYMHARSQSNAQAMFNLGYMHEHGHGLPLDLHLAKRYYDQAVEVDSAAKLPVMLALTSLWLRKNYADSFLVNFIDSLPEIYPVVKEWVEDVLMDEGNATILTLFACLVTVLYLRERQRRQVAAANPQQPDDVAIGQELEREGGEEGRRKKQGRKPGCVRSRWREMMQVFLKTVTGKTVILEVESSDTIAAVKAKIQDKEGTQLEDGRTLVDYDIRKESTLHLELGLLGGAYVAWWISPNLRALAYKYNVNKMICRKCYARLPLGAKNCRKKKCGHSNQVSLISPIRILDIAEI

SEQ ID NO: 15552 - DNA, 660 bp, Sorghum bicolor
  misc_feature: Ceres ANNOT ID no. 8642069
  misc_feature: Encodes the peptide sequence at SEQ ID NO 15553
atgggttcggtctcggactgccaggagaatggcaaccaccagtcgccgccgccggcggcggcagaggcggagctggtcgtcgaggagggcgatgccggcgacacgatcaagggcaactaccagccgccggagccggtggctgaggcggggcaggtcgtcgaggagggcgatgccggcgtgactatggaaggcgtcgcttccatcgccttgctgcctaccggtgccatctccggccattttattcggctcccgggctccatctgctatgggctacaaggcaccccaatatcttgcgagagggaatgtagccgaggagaggactaccgccttataaagctcaccatcattgattttaagagcaagagagagaaggtgcttgtggtggaatgcaggggtcatgatgctgctcgattacaaaacattgaccatttgcatgggtgggaagatgacattgttggcttggttgagaaggagcatggaaatgagaaagtcttgctctcttttgaatgtgagacgctgaaggctgataaagacgcggaagatcatattaccaagtatatgccaaatctatgtggactggatgcagttgtaaatgtagggaaaatgagcatctcaggcatcaatctcgatgaggacgacgaaccaagaggggacaactga

SEQ ID NO: 15553 - protein, 219 aa, Sorghum bicolor
  misc_feature: Useful for making plants with modulated low light sensitivity
  misc_feature: Functional homolog of the protein sequence given in SEQ ID NO 14222
  misc_feature: Ceres ANNOT ID no. 8642069
MGSVSDCQENGNHQSPPPAAAEAELVVEEGDAGDTIKGNYQPPEPVAEAGQVVEEGDAGVTMEGVASIALLPTGAISGHFIRLPGSICYGLQGTPISCERECSRGEDYRLIKLTIIDFKSKREKVLVVECRGHDAARLQNIDHLHGWEDDIVGLVEKEHGNEKVLLSFECETLKADKDAEDHITKYMPNLCGLDAVVNVGKMSISGINLDEDDEPRGDN

SEQ ID NO: 15554 - DNA, 345 bp, Sorghum bicolor
  misc_feature: Ceres ANNOT ID no. 8642115
  misc_feature: Encodes the peptide sequence at SEQ ID NO 15555
atgtcttggagcgacagtgagaacgcggtgttcgagcgcgcgctggccacgtacgaccgggacacgcccaggcggtgggagctcgtggccgccgcggtgggcggcgggaagaccgccgaggacgcgaggcgccactacgcccacctcgtcaatgacgtcggcgacatcgagtccggcggctacggcaacgaccccaaccccaaccccaacgccgccgcccgcaacggcaacaacgggaacaacaacaggttgagccaagtccaattaaatccaacaatagctagctcatcattgctgacacaaacatcacacaataaattctacataatgatgcgcgcttgttga

SEQ ID NO: 15555 - protein, 114 aa, Sorghum bicolor
  misc_feature: Useful for making plants with altered lignin content
  misc_feature: Useful for making plants with modulated low light sensitivity
  misc_feature: Functional homolog of the protein sequence given in SEQ ID NO 12938
  misc_feature: The sequence is a functional homolog of SEQ ID NO 1973 in the 11/479,226 US patent application
  misc_feature: The sequence is a functional homolog of SEQ ID NO 880 in the 11/435,388 US patent application
  misc_feature: The sequence is a functional homolog of SEQ ID NO 976 in the 11/435,388 US patent application
  misc_feature: The sequence is a functional homolog of SEQ ID NO 1404 in the 11/479,226 US patent application
  misc_feature: The sequence is a functional homolog of SEQ ID NO 662 in the 10/412,699 US patent application
  misc_feature: The sequence is a functional homolog of SEQ ID NO 944 in the 11/435,388 US patent application
  misc_feature: The sequence is a functional homolog of SEQ ID NO 2720 in the 10/374,780 US patent application
  misc_feature: The sequence is a functional homolog of SEQ ID NO 360 in the 10/225,066 US patent application
  misc_feature: The sequence is a functional homolog of SEQ ID NO 876 in the 11/435,388 US patent application
  misc_feature: Useful for making plants with modulated nitrogen use efficiency
  misc_feature: The sequence is a functional homolog of SEQ ID NO 510 in the 10/666,642 US patent application
  misc_feature: The sequence is a functional homolog of SEQ ID NO 1000 in the 10/225,066 US patent application
  misc_feature: The sequence is a functional homolog of SEQ ID NO 1885 in the 11/479,226 US patent application
  misc_feature: The sequence is a functional homolog of SEQ ID NO 274 in the 10/714,887 US patent application
  misc_feature: The sequence is a functional homolog of SEQ ID NO 274 in the 11/435,388 US patent application
  misc_feature: The sequence is a functional homolog of SEQ ID NO 306 in the 10/374,780 US patent application
  misc_feature: The sequence is a functional homolog of SEQ ID NO 50 in the 10/286,264 US patent application
  misc_feature: The sequence is a functional homolog of SEQ ID NO 928 in the 10/412,699 US patent application
  misc_feature: The sequence is a functional homolog of SEQ ID NO 1930 in the 10/412,699 US patent application
  misc_feature: The sequence is a functional homolog of SEQ ID NO 246 in the 10/714,887 US patent application
  misc_feature: The sequence is a functional homolog of SEQ ID NO 246 in the 11/435,388 US patent application
  misc_feature: The sequence is a functional homolog of SEQ ID NO 452 in the 10/374,780 US patent application
  misc_feature: The sequence is a functional homolog of SEQ ID NO 88 in the 10/225,068 US patent application
  misc_feature: The sequence is a functional homolog of SEQ ID NO 984 in the 10/225,066 US patent application
  misc_feature: Ceres ANNOT ID no. 8642115
MSWSDSENAVFERALATYDRDTPRRWELVAAAVGGGKTAEDARRHYAHLVNDVGDIESGGYGNDPNPNPNAAARNGNNGNNNRLSQVQLNPTIASSSLLTQTSHNKFYIMMRAC

SEQ ID NO: 15556 - DNA, 744 bp, Sorghum bicolor
  misc_feature: Ceres ANNOT ID no. 8642122
  misc_feature: Encodes the peptide sequence at SEQ ID NO 15557
atggacaaccagccgctgccctactccaccggccagccccctgcccccggaggaaccccagtagtgccgggcgtgcccggcgcagccggccctccgccggtgccgcaccaccacctgctccagcagcagcaggcccagctgcaggcgttctgggcgtaccagcgccaggaggcggagcgcgcgtcggcgtcggacttcaagaaccaccagctgccgctggcccggatcaagaagatcatgaaggccgacgaggacgtgcgcatgatctccgccgaggcgcccgtgctgttcgccaaggcctgcgagctcttcatcctcgagctcaccatccggtcctggctgcacgccgaggagaacaagcgccgcaccctgcagcggaacgacgtcgccgcggccatcgcgcgcaccgacgtcttcgacttcctcgtcgacatcgtgccccgcgaggaggccaaggaggagcccggcagcgccctcggcttcgcggcgtccgggaccggcgtcgtcgggggtggcgccccgggcggggcgccggccgccgggatgccgtactactatccgccgatggggcagccggcgccgatgatgccggcctggcatgttccggcctgggacccggcctggcagcaaggggcagccgatgtcgatcacagcggcagcttcagcgaggaaggacaagcagggtttgctgcaggccatggcggccccgctagcttccctcctgcgcctccgagctccgagtga

SEQ ID NO: 15557 - protein, 247 aa, Sorghum bicolor
  misc_feature: Useful for making plants with altered alkaloid content
  misc_feature: Useful for making plants with altered lignin content
  misc_feature: Functional homolog of the protein sequence given in SEQ ID NO 13648
  misc_feature: Useful for making plants with altered terpenoid content
  misc_feature: Functional homolog of the protein sequence given in SEQ ID NO 13125
  misc_feature: The sequence is a functional homolog of SEQ ID NO 1109 in the 10/374,780 US patent application
  misc_feature: The sequence is a functional homolog of SEQ ID NO 102 in the 10/225,068 US patent application
  misc_feature: The sequence is a functional homolog of SEQ ID NO 230 in the 10/714,887 US patent application
  misc_feature: The sequence is a functional homolog of SEQ ID NO 230 in the 11/435,388 US patent application
  misc_feature: The sequence is a functional homolog of SEQ ID NO 310 in the 10/412,699 US patent application
  misc_feature: The sequence is a functional homolog of SEQ ID NO 727 in the 11/479,226 US patent application
  misc_feature: The sequence is a functional homolog of SEQ ID NO 94 in the 10/374,780 US patent application
  misc_feature: The sequence is a functional homolog of SEQ ID NO 1108 in the 10/374,780 US patent application
  misc_feature: The sequence is a functional homolog of SEQ ID NO 712 in the 11/479,226 US patent application
  misc_feature: Useful for making plants with modulated cold sensitivity
  misc_feature: Functional homolog of the protein sequence given in SEQ ID NO 13649
  misc_feature: Ceres ANNOT ID no. 8642122
  misc_feature (52)..(142): SWISSPROT Homolog: EC 2.7.7.7 DNA-directed DNA polymerase
  misc_feature (69)..(133): Pfam ID: CBFD_NFYB_HMF Pfam Description: Histone-like transcription factor (CBF/NF-Y) and archaeal histone
MDNQPLPYSTGQPPAPGGTPVVPGVPGAAGPPPVPHHHLLQQQQAQLQAFWAYQRQEAERASASDFKNHQLPLARIKKIMKADEDVRMISAEAPVLFAKACELFILELTIRSWLHAEENKRRTLQRNDVAAAIARTDVFDFLVDIVPREEAKEEPGSALGFAASGTGVVGGGAPGGAPAAGMPYYYPPMGQPAPMMPAWHVPAWDPAWQQGAADVDHSGSFSEEGQAGFAAGHGGPASFPPAPPSSE

SEQ ID NO: 15558 - DNA, 1443 bp, Sorghum bicolor
  misc_feature: Ceres ANNOT ID no. 8642128
  misc_feature: Encodes the peptide sequence at SEQ ID NO 15559
atggcgccgcagctgaccggcgcgcccggctcggcggccgcgtctggcggcgcggcggccgtcaagccgcagttccaccactaccaccaccaccgcctgcccccgcgccaccaccacccctcgccgacctcgctcctctccaagctcgccttctggtccgtctgctccctctccctcctcctcgccttcctcctcctctcccccgcggcgcccgccccgcgggccgcgcccgagtcgccgcgccgctccctccacgcctccccctcctccaccgcctcctggggcggcgccgcctgggagaagaaggtgcgggcgtcggcgcgcgtcaggcgctccatgggccactccgtcctcgtcacgggcgccgcgggcttcgtaggctgccacgccgccgccgcgcttcgccgccgaggggacggcgtgctcggcctcgacaacttcaacgactactacgacacgggcctcaagcgcggccgcgccgcgctcctcgcccgctccggggtctacgtcgtcgacggtgacatcgctgatgccgagctcctcgccaagctgttcgacgttgtgcccttcacacacgtcctccacctcgccgcgcaagcgggcgtgcggcacgcgctcgtggaccccatgtcttatgtgcgcgccaacgttgccggtctcgtggcgctgctcgaggcggcgcgcgcggccaaccctcagcccgccatcgtctgggcctcgtcgtcttcggtgtacgggctcaactcccatgtgcctttctccgagcatgacaggacggatcgaccagcctctctctatgcagccaccaaaaaggccggtgaggagatcgctcatgtctacaaccacatctatggtctgtcactcaccgccctcagattcttcactgtgtatgggccatgggggcgtccggacatggcctacttcttcttcaccagggacatccttgctggtcggccaatcacggtctatgagagtgccggtggaggttcacaccagacaaccatctcccgggatttcacctacattgatgacattgtgaaggggtgtgtagcggcattggatacagctggtcggagcacaggcagtggaggcaagaagcgaggtacagcaccgttcaggacatacaatttgggcaacacttcacctgtgcctgttacacagctagtcgatttgctggagaaactgctgaaagtgaaggctgtgaggaaggttgttaagatgccaaggaatggagatgtgccatacacgcatgctaatgtaagccttgcgcagagggagctcggttaccggccatccacagatctgcaaacagggctcaagaagtttgtgcggtggtatcttgagtactaccatcctgagctggctgagaagcagaagctgcgtaccagtagcaatggcaagggttcacgtggtcggaatggcagctcaagtagtgcaagatga

SEQ ID NO: 15559 - protein, 480 aa, Sorghum bicolor
  misc_feature: Useful for making plants with altered carbohydrate content
  misc_feature: Functional homolog of the protein sequence given in SEQ ID NO 14223
  misc_feature: Useful for making plants with altered cell wall content and/or composition
  misc_feature: Functional homolog of the protein sequence given in SEQ ID NO 14224
  misc_feature: Ceres ANNOT ID no. 8642128
  misc_feature (91)..(450): SWISSPROT Homolog: EC 5.1.3.6 UDP-glucuronate 4-epimerase
  misc_feature (117)..(378): Pfam ID: Epimerase Pfam Description: NAD dependent epimerase/dehydratase family
MAPQLTGAPGSAAASGGAAAVKPQFHHYHHHRLPPRHHHPSPTSLLSKLAFWSVCSLSLLLAFLLLSPAAPAPRAAPESPRRSLHASPSSTASWGGAAWEKKVRASARVRRSMGHSVLVTGAAGFVGCHAAAALRRRGDGVLGLDNFNDYYDTGLKRGRAALLARSGVYVVDGDIADAELLAKLFDVVPFTHVLHLAAQAGVRHALVDPMSYVRANVAGLVALLEAARAANPQPAIVWASSSSVYGLNSHVPFSEHDRTDRPASLYAATKKAGEEIAHVYNHIYGLSLTALRFFTVYGPWGRPDMAYFFFTRDILAGRPITVYESAGGGSHQTTISRDFTYIDDIVKGCVAALDTAGRSTGSGGKKRGTAPFRTYNLGNTSPVPVTQLVDLLEKLLKVKAVRKVVKMPRNGDVPYTHANVSLAQRELGYRPSTDLQTGLKKFVRWYLEYYHPELAEKQKLRTSSNGKGSRGRNGSSSSAR

SEQ ID NO: 15560 - DNA, 399 bp, Sorghum bicolor
  misc_feature: Ceres ANNOT ID no. 8642127
  misc_feature: Encodes the peptide sequence at SEQ ID NO 15561
atgtcgtactacggcgaccggcgcccggagtcgtcgatcgtggaggcgttcacgctgtcgccgctgccgtacccggtgatcctgatcctgctcatggtgacgctcctgctgggcgtctcctggttcttcacctacgaggacttcatcgaggaggcgtcgcagcagctgagctgggcgctgctggcggtgcccatcgcgctcgtcctcctcatccgctggatttcttccgtcgaatccttcgagggctacttcggcttctaccccagggagagccgctggaagggctacgagcggccacccgccgagggcagctcgccctggggcgtcgccatggtcgtcctgctcctcctcgtgctcgccagcttccactccaccatccaggacatgtggaggccatga

SEQ ID NO: 15561 - protein, 132 aa, Sorghum bicolor
  misc_feature: Useful for making plants with modulated nitrogen use efficiency
  misc_feature: Functional homolog of the protein sequence given in SEQ ID NO 13017
  misc_feature: Ceres ANNOT ID no. 8642127
MSYYGDRRPESSIVEAFTLSPLPYPVILILLMVTLLLGVSWFFTYEDFIEEASQQLSWALLAVPIALVLLIRWISSVESFEGYFGFYPRESRWKGYERPPAEGSSPWGVAMVVLLLLVLASFHSTIQDMWRP

SEQ ID NO: 15562 - DNA, 831 bp, Sorghum bicolor
  misc_feature: Ceres ANNOT ID no. 8642144
  misc_feature: Encodes the peptide sequence at SEQ ID NO 15563
atgagcgctggaggcggcaccagcacgcttggcggcgggggcccgagcggcagcggcgccagcggaggcccaggacctggaggaagcggcggcggcggcggcggtggcggcgggccctgcggcgcctgcaagttcctccggcgcaagtgcgtcagcggctgcatcttcgcgccctacttcgactcggagcagggcgcggcgcacttcgcggcggtgcacaaggtgttcggcgccagcaacgtgtccaagctgctgctccagatcccggcgcacaagcgcctcgacgccgtcgtcaccatctgctacgaggcccaggctcggctccgcgaccctgtctacggctgcgtcgcccacatcttcgcgctccagcagcaggtggtgaatctccaggccgagctgacctacctgcaagcacacctcgccacgctggagctgccgtccccgcctccgctgccggccccgccgcagatgccgctgccaggcgcgttctccatctcggacctgccgtcgtcgaccagcgtccccaccaccgtcgacctgtccgcgctcttcgacccgccgccgcagcaaccgcagtgggcggtccaggcggcgcagccgcaccaccaccaccatcaccaccaacagccgcaacagcagcagcaccaccagctccggcaaccggcgccgtatggcgcgcccgtcaggccgggtggcggcggccccggcatggcagagagctcaggcggcggcggggacgacctgcagtcgctggcgagggagctcctggaccgccaccggtcaggcggcgtgaagctcgagcagccgccgccaccgccacactcaagatga

SEQ ID NO: 15563 - protein, 276 aa, Sorghum bicolor
  misc_feature: Useful for making plants with modulated biomass
  misc_feature: Functional homolog of the protein sequence given in SEQ ID NO 12922
  misc_feature: Ceres ANNOT ID no. 8642144
MSAGGGTSTLGGGGPSGSGASGGPGPGGSGGGGGGGGGPCGACKFLRRKCVSGCIFAPYFDSEQGAAHFAAVHKVFGASNVSKLLLQIPAHKRLDAVVTICYEAQARLRDPVYGCVAHIFALQQQVVNLQAELTYLQAHLATLELPSPPPLPAPPQMPLPGAFSISDLPSSTSVPTTVDLSALFDPPPQQPQWAVQAAQPHHHHHHHQQPQQQQHHQLRQPAPYGAPVRPGGGGPGMAESSGGGGDDLQSLARELLDRHRSGGVKLEQPPPPPHSR

SEQ ID NO: 15564 - DNA, 1323 bp, Sorghum bicolor
  misc_feature: Ceres ANNOT ID no. 8642149
  misc_feature: Encodes the peptide sequence at SEQ ID NO 15565
atggcgccgtgctgcctgctccagatcggccgggggctcgaacgcgcccgtgcccttcgcctcgccgcggcgctgtgcgcggctgtggtcgcgctggcgctggcgcccgcctcggatgccacgtcggcgtcgcttctgggcatcaactacgggcgcgtcgggaacaacctcccgccgccgcagtccgtcgtgccgctgctcgcgggcctcggtattggccgcgtgcggatgtacgacgccgaccccacggtgctgcgcgcgttcgcgaagaccggggtcgagctcatcgtcggcgtgcccgacgagtgcctggccgccgtggccgatccgggcggcgcggcgcagtggcttaaggagaacgtcgtccccttcctgcaggacacgaagatcgccgtgctcgccgtcggcaacgaggtgctcacgggctccaacagctccacgctgtcgcgcaccctcctcccggcgatgcagtccctgcacggcgcggtggccgcgctcggcctcgacaagcagatcaccgtcaccacggcgcacaacctcggcgtgctcgggacgtcgtacccgccctcggcgggggcgttccgcaaggacctgctcccgtacctctgccccatcctggactaccatgccaggaccggctcgccgttcctcgtgaacgcgtatccctacttcgcctactccagcgaccccaggggcgtgcagctggagtacgcgctgctcgacccggggttcgccggcgtgcaggaccccaactccaggctgcactaccccaacctcctcgtggcgcaggtggacgcggtgtaccacgccatcgcggcggccaacgccgcggcgtcgcgggtggtggaggtgcggatctcggagaccggctggccctccgcgggggccgccaacgagacggccgcgacgccgcagaacgcggcgcggtacaacagcaacgcgatgcggctggtggccgacggcaagggcacgccgctaaggcccggcgcgccgctgcgcgcctacgtgttcgcgctcttcaacgagaacctcaagcccgggctggcgtctgagcgctactacggcctcttcaaccccgacggcacgccggcgtaccagctctcgttcaagctaccgcgcgacaactcgacctttgatcacggcggcaccggcaacggtgacggcgggttcggcggtaacggcaatggcaaagccaatggcagcagcgtgaacattagcggcggcggaaacagcggctactacgacatctcggcttcgggttactggtggacgtgggcgcaggcggcaatggcaggagcactagccgccgtcctgacagtgtag

SEQ ID NO: 15565 - protein, 440 aa, Sorghum bicolor
  misc_feature: Useful for making plants with altered carbohydrate content
  misc_feature: Functional homolog of the protein sequence given in SEQ ID NO 14225
  misc_feature: Useful for making plants with altered cell wall content and/or composition
  misc_feature: Useful for making plants with altered lignin content
  misc_feature: Functional homolog of the protein sequence given in SEQ ID NO 14156
  misc_feature: Ceres ANNOT ID no. 8642149
  misc_feature (47)..(369): SWISSPROT Homolog: EC 3.2.1.73 Licheninase
  misc_feature (46)..(369): Pfam ID: Glyco_hydro_17 Pfam Description: Glycosyl hydrolases family 17
MAPCCLLQIGRGLERARALRLAAALCAAVVALALAPASDATSASLLGINYGRVGNNLPPPQSVVPLLAGLGIGRVRMYDADPTVLRAFAKTGVELIVGVPDECLAAVADPGGAAQWLKENVVPFLQDTKIAVLAVGNEVLTGSNSSTLSRTLLPAMQSLHGAVAALGLDKQITVTTAHNLGVLGTSYPPSAGAFRKDLLPYLCPILDYHARTGSPFLVNAYPYFAYSSDPRGVQLEYALLDPGFAGVQDPNSRLHYPNLLVAQVDAVYHAIAAANAAASRVVEVRISETGWPSAGAANETAATPQNAARYNSNAMRLVADGKGTPLRPGAPLRAYVFALFNENLKPGLASERYYGLFNPDGTPAYQLSFKLPRDNSTFDHGGTGNGDGGFGGNGNGKANGSSVNISGGGNSGYYDISASGYWWTWAQAAMAGALAAVLTV

SEQ ID NO: 15566 - DNA, 735 bp, Sorghum bicolor
  misc_feature: Ceres ANNOT ID no. 8642152
  misc_feature: Encodes the peptide sequence at SEQ ID NO 15567
atggcagctgctccgttcacgattgccagccgcctctctcccgccgcgcgcctcccggtccgcgcctggagggcggcgaggccggcgcacgggttcgcgtcggccgggagggcccgctcgctcgccgtggcatccgcggcgcaggagaacggggacaacagcgtcgacgtacaggttagccagaacggcggcaacggcaacaggcagcagcagggcaacgccgtgcagcgccgaccgcgccgcgcggcaccgctcgacatctccccgttcgggttagttgatccgatgtcgccgatgcggacgatgcggcagatgctggacacgatggaccggctgttcgacgacgccgtggggttcccgatggcgacgcggaggtccccgacggcggcgaccggcgaggtgcgcctgccgtgggacatcgtggaggacgacaaggaggtgaagatgcggttcgacatgccggggctcgcgcgggacgaggtgaaggtgatggtggaggacgacacgctggtcatccgaggggagcacaagaaggaggagggcgccgacgagaccgcggagggcggcgacgggtggtggaagcagcggagcgtgagctcctacgacatgcggctggcgctgccggatgagtgcgacaagagcaaggtgcgggccgagctcaagaacggcgtgctcctcgtcaccgtgcccaagaccgaggtggagcgcaaggtcatcgacgtgcaggtccagtag

SEQ ID NO: 15567 - protein, 244 aa, Sorghum bicolor
  misc_feature: Useful for making plants with modulated heat sensitivity
  misc_feature: Functional homolog of the protein sequence given in SEQ ID NO 14226
  misc_feature: Ceres ANNOT ID no. 8642152
  misc_feature (139)..(244): Pfam ID: HSP20 Pfam Description: Hsp20/alpha crystallin family
MAAAPFTIASRLSPAARLPVRAWRAARPAHGFASAGRARSLAVASAAQENGDNSVDVQVSQNGGNGNRQQQGNAVQRRPRRAAPLDISPFGLVDPMSPMRTMRQMLDTMDRLFDDAVGFPMATRRSPTAATGEVRLPWDIVEDDKEVKMRFDMPGLARDEVKVMVEDDTLVIRGEHKKEEGADETAEGGDGWWKQRSVSSYDMRLALPDECDKSKVRAELKNGVLLVTVPKTEVERKVIDVQVQ

SEQ ID NO: 15568 - DNA, 1026 bp, Sorghum bicolor
  misc_feature: Ceres ANNOT ID no. 8642214
  misc_feature: Encodes the peptide sequence at SEQ ID NO 15569
atggcttgttccttcctattcctggccttcctgacggcggcggtggcggcgccggcgtgtctgtcagctgcggccgcgacggccaagcttgtttccccgtcggagaagccgtccctctccttcggagaaggatacacgcagctgttcggcgactccaacctcgcgctccacggcggcggcaagagggtgcacatctccctcgacgagcgcacaggcgctgggttcgcgtcgcaggcagcgtacctccacggcagcttcagcgcccgcatcaagctgcccgccgaccacaccgccggcgtcgtcgtcgccttctacatgtcgaacggggacgtgtacgagcggacgcacgacgagctggacttcgagttcctcgggaacgtgcggggcagggagtggcgggtgcagaccaacgtgtacggcaacggcagcacggcggtcggacgggaggagcgctacggcctcccgttcgaccccacggaggacttccaccgctacgccatccactggagccgccacaggatcatattctacgtcgacgacacaccgatcagggaggtggtgcggacggaggccatgggcgcacagttcccgtccaagcccatgtcgctgtacgccaccatctgggacggctccagctgggccacctcgggaggccgctacaaggtggactacaagtacgcgccctacgtcgccgagttcgccgacctcgcgctccgcggctgcgcggtcggccccgctagcgcctcggcgtgcgcgacgcctggcagtgccagcgacgacgacgatgcctacggccgcgccgccgacgcgatctcgcccgcgcggcgttcggccatggaggcgttccgggcgcggtacatgacgtacggctactgctacgaccgcctccggtaccccgcgccgctgccggagtgcagcgtcggcgcggaggccgcggcgttcctcccgtcgggggacgcgagggcggcattgcacaggcacggtaggcgcaaccggatgcgccgcggggcggactctgccgtatga

SEQ ID NO: 15569 - protein, 341 aa, Sorghum bicolor
  misc_feature: Useful for making plants with altered carbohydrate content
  misc_feature: Functional homolog of the protein sequence given in SEQ ID NO 14227
  misc_feature: Useful for making plants with altered cell wall content and/or composition
  misc_feature: Functional homolog of the protein sequence given in SEQ ID NO 14228
  misc_feature: Ceres ANNOT ID no. 8642214
  misc_feature (38)..(305): SWISSPROT Homolog: EC 2.4.1.207 Xyloglucan:xyloglucosyl transferase
  misc_feature (41)..(226): Pfam ID: Glyco_hydro_16 Pfam Description: Glycosyl hydrolases family 16
  misc_feature (251)..(305): Pfam ID: XET_C Pfam Description: Xyloglucan endo-transglycosylase (XET) C-terminus
MACSFLFLAFLTAAVAAPACLSAAAATAKLVSPSEKPSLSFGEGYTQLFGDSNLALHGGGKRVHISLDERTGAGFASQAAYLHGSFSARIKLPADHTAGVVVAFYMSNGDVYERTHDELDFEFLGNVRGREWRVQTNVYGNGSTAVGREERYGLPFDPTEDFHRYAIHWSRHRIIFYVDDTPIREVVRTEAMGAQFPSKPMSLYATIWDGSSWATSGGRYKVDYKYAPYVAEFADLALRGCAVGPASASACATPGSASDDDDAYGRAADAISPARRSAMEAFRARYMTYGYCYDRLRYPAPLPECSVGAEAAAFLPSGDARAALHRHGRRNRMRRGADSAV

SEQ ID NO: 15570 - DNA, 1770 bp, Sorghum bicolor
  misc_feature: Ceres ANNOT ID no. 8642241
  misc_feature: Encodes the peptide sequence at SEQ ID NO 15571
atggagtcatcgctggaggaggagcggcggcagaacctgctgctgcgcgcgacggagccgccagaggatcttgccgttgccgggtacacaggtgatggatcagttgactttagaggttttcctattttaaagcataacacagggaactggagagcatgttcattgattcttggaactgaaatatgtgaacgtttggcctactatggaatctcaaaaagtttggtcacttacctttcaacaaggctacatgaaggaaatgtctctgctgcgaggaacttcacaacctggcaaggaacttgttatcttacaccacttattggagcaaccttagcagattcgtactggggaaagtacaggactattgctgttttctccactatttactttcttgggatggcggcattgacactttcagcatcagttccttctttccagccccctcaatgtgttgggtctatttgtccacaaccgaccttacctcagtaccttatatactttgttggattatacatgattgctttgggagctggtggtataaagccatgtgtttcgtcctttggggctgaccaattcgatgatactgatccagttgagaaaacaaagaaaggcgctttcttcaattggttttatttctgcataaatattggttctttgatctctggcacagttcttatttgggtacaagagaattatggatatggcattggatttgggatccctacttttttcattgccttggctattggaagcttttttataggttcagaaaggtatagatttcagataccgggaggaagcccacttacaagagcatgtcaggtagttgtggcagccactcacaagcgaaaagcggatttgccagttgacagttctcttctctatgagctagatggtaagacttcagctattgaggggagtcgtaagctggagcacagtagtgaattcagtttccttgacaaagctgcagtcgttttgtggaatgaacatgatggttctcgcaatccatggagactttgcacagtcacacaagttgaagagcttaaaatattactgaggatgtttccaatctgggcaacaggaattgtgttcttcaccgtatgtgctcaaaactcatcgatgttcatagaacaagggatggccctcgataaccaaattggttctttcaagattccagcagcaactctgtcatccctagatgttatcagtattgttgtttgggttccaatttatgagagattagttgtgcccatagccaggagattcagtggaaaagagagaggtttctcagaacttcaacggatgggaattggtctatttgtatctacagttgcagtggcagttgcagcattagtcgagatcaagcgtctgcaggtcgcaagagcagaggatctggttcatcagaaggtacctgttcctatgagcatcctttggcaagcaccacagtacttgctggttggcgtgggcgaggtgttcacatcaatcggtcaagctgagtttttctacaatcagtcaccagacgccatgagaagcctatgctcagctttcgctcttgttaccgtgtcacttggaagttatctcagctcattcatcttgaccctggtgtcatatttcacaactcgaaatgggcaattggggtggatccctgataacttaaacgaaggccatcttgaccgttttttctggctgatagctggtctcagctctttaaatttccttgtttttatatattacgctcaacaatacaagtgcaagagagcctctgttgcttaa

SEQ ID NO: 15571 - protein, 589 aa, Sorghum bicolor
  misc_feature: Useful for making plants with altered carbon content
  misc_feature: Useful for making plants with altered nitrogen content
  misc_feature: Functional homolog of the protein sequence given in SEQ ID NO 14117
  misc_feature: Ceres ANNOT ID no. 8642241
  misc_feature (118)..(520): Pfam ID: PTR2 Pfam Description: POT family
MESSLEEERRQNLLLRATEPPEDLAVAGYTGDGSVDFRGFPILKHNTGNWRACSLILGTEICERLAYYGISKSLVTYLSTRLHEGNVSAARNFTTWQGTCYLTPLIGATLADSYWGKYRTIAVFSTIYFLGMAALTLSASVPSFQPPQCVGSICPQPTLPQYLIYFVGLYMIALGAGGIKPCVSSFGADQFDDTDPVEKTKKGAFFNWFYFCINIGSLISGTVLIWVQENYGYGIGFGIPTFFIALAIGSFFIGSERYRFQIPGGSPLTRACQVVVAATHKRKADLPVDSSLLYELDGKTSAIEGSRKLEHSSEFSFLDKAAVVLWNEHDGSRNPWRLCTVTQVEELKILLRMFPIWATGIVFFTVCAQNSSMFIEQGMALDNQIGSFKIPAATLSSLDVISIVVWVPIYERLVVPIARRFSGKERGFSELQRMGIGLFVSTVAVAVAALVEIKRLQVARAEDLVHQKVPVPMSILWQAPQYLLVGVGEVFTSIGQAEFFYNQSPDAMRSLCSAFALVTVSLGSYLSSFILTLVSYFTTRNGQLGWIPDNLNEGHLDRFFWLIAGLSSLNFLVFIYYAQQYKCKRASVA

SEQ ID NO: 15572 - DNA, 996 bp, Sorghum bicolor
  misc_feature: Ceres ANNOT ID no. 8642253
  misc_feature: Encodes the peptide sequence at SEQ ID NO 15573
atggcggtcccggcgatggccgtagcagccctgttcgccctcgcggcgctgggcggcgtcgcggaggcgcagcagctgagcaccgcgtactacgacggctcgtgcccgcacgtctacgacacggtgcggcgcgtggtccaggaggcgcgcgcctccgacccgcgcatcctcgccagcctcctccgcctccacttccacgactgcttcgtcaatggttgtgacgcgtcgctgctgctcgacgagaccccgacgatgcgcagcgagaaggcagccgaccccaacaacggctccgcgcgggggttccccgtggtgaacgacatcaaggccgccctggagaacgcctgcccaggcgtcgtctcctgcgctgacatcctcgccctggccgccgaggtctccgtcgagctggcaggaggtccgtactggagggtgatgctgggccggagggacggcatgacggctaacttcgacggcgcccaggacctcccaaacccgaaggaagcattgaacgatctgaagcagaagttcgccgacctcggcctcgacgacaccgattttgttgccctccaaggggcacacacgatcggccgcgcccagtgcacgtccttccaggacaggctctacaacttcagcggcacggagcgggcggacccgacgctggaccggtcctacctcgccgcgctccgggagagctgcccggcggcggtgagcggcggcaacacgcgcctgaacaacctcgacccggccacgccggacacgttcgacaaccactactacgccaacatccagagcaaccgcggcctgctcaggtccgaccaggcgatgctctccgcgacggaggagggcgcggcgtccaccacgccgatcgtcgcgcggttcgccgacagccagaccgagttcttcaaaagcttcgcgacggccatgatcaagatggggaacatcgcgcccctcaccgggggaatggggcaggtcaggagggactgcagggtggtgaactga

SEQ ID NO: 15573 - protein, 331 aa, Sorghum bicolor
  misc_feature: Useful for making plants with modulated nitrogen use efficiency
  misc_feature: Functional homolog of the protein sequence given in SEQ ID NO 13820
  misc_feature: Useful for making plants with altered cell wall content and/or composition
  misc_feature: Functional homolog of the protein sequence given in SEQ ID NO 14158
  misc_feature: Useful for making plants with altered carbohydrate content
  misc_feature: Functional homolog of the protein sequence given in SEQ ID NO 14159
  misc_feature: Useful for making plants with modulated oxidative stress sensitivity
  misc_feature: Functional homolog of the protein sequence given in SEQ ID NO 13607
  misc_feature: Ceres ANNOT ID no. 8642253
  misc_feature (25)..(331): SWISSPROT Homolog: EC 1.11.1.7 Peroxidase
  misc_feature (42)..(295): Pfam ID: peroxidase Pfam Description: Peroxidase
MAVPAMAVAALFALAALGGVAEAQQLSTAYYDGSCPHVYDTVRRVVQEARASDPRILASLLRLHFHDCFVNGCDASLLLDETPTMRSEKAADPNNGSARGFPVVNDIKAALENACPGVVSCADILALAAEVSVELAGGPYWRVMLGRRDGMTANFDGAQDLPNPKEALNDLKQKFADLGLDDTDFVALQGAHTIGRAQCTSFQDRLYNFSGTERADPTLDRSYLAALRESCPAAVSGGNTRLNNLDPATPDTFDNHYYANIQSNRGLLRSDQAMLSATEEGAASTTPIVARFADSQTEFFKSFATAMIKMGNIAPLTGGMGQVRRDCRVVN

SEQ ID NO: 15574 - DNA, 966 bp, Sorghum bicolor
  misc_feature: Ceres ANNOT ID no. 8642249
  misc_feature: Encodes the peptide sequence at SEQ ID NO 15575
atgagctgcctcctcgccgtgctcgccgccgccgcggtgctcgcggtggcgcggggccagctgacggacgacttctacgacgggtgctgcccccatgcggaggacatcgtgaaggcgcgcgtgtccgccgcgatgaaggccgagccccgcatgggcgcctccctgctcaggctccacttccacgactgcttcgtcaacgggtgcgacggctcgatcctgctggacgggaataacaccgagaagctggcggcgccgaacctgaactcggtgcgtgggttcgaggtcgtcgacgccatcaaggccgacctcgagaaggcgtgccccggggttgtctcctgcgccgatatcctcgcgatcgccgctaaatacggagtgctgctgagtggagggccagactacgacgttctgctgggaaggagggatggcctggtggcaaatcagtccggtgccaacagtaacctgcctagcccgttcgatcccatcaacaccatcacaaataagttcaatgatgtgggtctgaatacaaccgacgtggtcgttttatcaggaggccacacgatcgggcgagcgcggtgcgcgctgttcagcaaccggctatccaacttctcgacgacgagctccgtggacccgacgctgaactcgtcgctggcgtccagcctgcagacgctgtgccagggcggggacggcaaccagacggcggcgctggacgccggctccgccgacacgttcgacaaccactactaccagaacctgctgacccagaggggcctgctgtcctccgaccaaggcctcttctccagcaccgacgacggcgcggcggccacgaaggcgctcgtgcaggcatacagcgccaacagccagcgcttcttctgcgacttcggccggtccatggtcaagatgggcaacatcagcccgctcaccggctccgccggccagatccgtaagaactgccgtgccgtcaactga

SEQ ID NO: 15575 - protein, 321 aa, Sorghum bicolor
  misc_feature: Useful for making plants with altered cell wall content and/or composition
  misc_feature: Functional homolog of the protein sequence given in SEQ ID NO 14149
  misc_feature: Useful for making plants with altered carbohydrate content
  misc_feature: Functional homolog of the protein sequence given in SEQ ID NO 13815
  misc_feature: Useful for making plants with modulated nitrogen use efficiency
  misc_feature: Functional homolog of the protein sequence given in SEQ ID NO 13820
  misc_feature: Useful for making plants with modulated oxidative stress sensitivity
  misc_feature: Functional homolog of the protein sequence given in SEQ ID NO 13607
  misc_feature: Useful for making plants with modulated light quality response
  misc_feature: Functional homolog of the protein sequence given in SEQ ID NO 13816
  misc_feature: Ceres ANNOT ID no. 8642249
  misc_feature (18)..(321): SWISSPROT Homolog: EC 1.11.1.7 Peroxidase
  misc_feature (37)..(285): Pfam ID: peroxidase Pfam Description: Peroxidase
MSCLLAVLAAAAVLAVARGQLTDDFYDGCCPHAEDIVKARVSAAMKAEPRMGASLLRLHFHDCFVNGCDGSILLDGNNTEKLAAPNLNSVRGFEVVDAIKADLEKACPGVVSCADILAIAAKYGVLLSGGPDYDVLLGRRDGLVANQSGANSNLPSPFDPINTITNKFNDVGLNTTDVVVLSGGHTIGRARCALFSNRLSNFSTTSSVDPTLNSSLASSLQTLCQGGDGNQTAALDAGSADTFDNHYYQNLLTQRGLLSSDQGLFSSTDDGAAATKALVQAYSANSQRFFCDFGRSMVKMGNISPLTGSAGQIRKNCRAVN

SEQ ID NO: 15576 - DNA, 1473 bp, Sorghum bicolor
  misc_feature: Ceres ANNOT ID no. 8642240
  misc_feature: Encodes the peptide sequence at SEQ ID NO 15577
atggtgctctccaaggccgtctccgagagtgacatgtccgtgcactccacgttcgcgtcgcgctacgtccggtcgtctctcccaaggtatcgcatgccggagaactcgatccccaaggaggcggcgtaccagatcatcaacgacgagctgatgctggacgggaacccgcgcctgaacctggcgtccttcgtcaccacctggatggagcccgagtgcgacaagctcatcatggccgccatcaacaagaactacgtcgacatggacgagtaccccgtcaccaccgagctccagaaccggtgcgtgaacatgatcgctcatctcttcaacgcgccgctgggcgagtccgagacggcggtgggcgtcggcacggtgggctcgtcggaggccatcatgctggccgggctggccttcaagcgcaggtggcagaacaagcgcagggccgagggcaagccgtttgacaagcccaacatcgtcaccggcgccaacgtccaggtttgctgggaaaagttcgcgaggtacttcgaggtggagctgagggaggtgaagctgcgcgacggctactacgtgatggacccggagaaggcggtggagatggtggacgagaacaccatctgcgtcgcggcgatcctgggctccacgctcaacggcgagttcgaggacgtgaagctgctcaacgacctgctggaggtgaagaacggggagaccgggtgggggacgcccatccacgtggacgcggcgagcggcggcttcatcgcgcccttcctgtacccggagctggagtgggacttccgcctgccctgggtcaagagcatcaacgtcagcggccacaagtacgggctcgtctacgccggcatcggctggtgcatctggcgcagcaaggaggacctgccggaggagctcatcttccacatcaactacctcggcgccgaccagccgacgttcacgctcaacttctccaagggctcgagccaagtcatcgcgcagtactaccagctcatccgccatggcttcgagggatacaggaacatcatggagaactgccacgagaacgccatggtgctcaaggaaggcctggagaagacgggccgcttcaacatcgtgtccaaggacgagggcgtcccgctggtggccttctcgctcaaggaccgcagccggcacgacgagttcgagatctccgacatgctgcgccgcttcggctggatcgtgccggcctacaccatgcccgccgacgcgcagcacgtcacggtgctccgcgtcgtcatccgggaggagttcagccgcaccctcgccgagcgcctcgtcctcgacatcgagaaggtgatgtaccagctggacgcgctgccgtccaggatcccgccccctccaccgccggcacagctggtcaggaaaaagtcggagctcgagacgcagaggtcggtgacggaggcgtggaagaagtttgtgctcgccaagaagaccaacggcgtctgctag

SEQ ID NO: 15577 - protein, 490 aa, Sorghum bicolor
  misc_feature: Useful for making plants with modulated nitrogen use efficiency
  misc_feature: Functional homolog of the protein sequence given in SEQ ID NO 14115
  misc_feature: Ceres ANNOT ID no. 8642240
  misc_feature (1)..(490): SWISSPROT Homolog: EC 4.1.1.15 Glutamate decarboxylase
  misc_feature (33)..(381): Pfam ID: Pyridoxal_deC Pfam Description: Pyridoxal-dependent decarboxylase conserved domain
MVLSKAVSESDMSVHSTFASRYVRSSLPRYRMPENSIPKEAAYQIINDELMLDGNPRLNLASFVTTWMEPECDKLIMAAINKNYVDMDEYPVTTELQNRCVNMIAHLFNAPLGESETAVGVGTVGSSEAIMLAGLAFKRRWQNKRRAEGKPFDKPNIVTGANVQVCWEKFARYFEVELREVKLRDGYYVMDPEKAVEMVDENTICVAAILGSTLNGEFEDVKLLNDLLEVKNGETGWGTPIHVDAASGGFIAPFLYPELEWDFRLPWVKSINVSGHKYGLVYAGIGWCIWRSKEDLPEELIFHINYLGADQPTFTLNFSKGSSQVIAQYYQLIRHGFEGYRNIMENCHENAMVLKEGLEKTGRFNIVSKDEGVPLVAFSLKDRSRHDEFEISDMLRRFGWIVPAYTMPADAQHVTVLRVVIREEFSRTLAERLVLDIEKVMYQLDALPSRIPPPPPPAQLVRKKSELETQRSVTEAWKKFVLAKKTNGVC

SEQ ID NO: 15578 - DNA, 1719 bp, Sorghum bicolor
  misc_feature: Ceres ANNOT ID no. 8642262
  misc_feature: Encodes the peptide sequence at SEQ ID NO 15579
atggccactccagctgatggcgacgatgtgtcgccatctcctttcaactcgtcgccggagccctccgactcggacccaggcttgggctcgccaccgccatcactcacaccgtcggtgtcaccgccaccggcgccgatggagaatagcagcgcgttgtcacccccggcacctgcggccagaggctcgccgccggtagcgccgtcaagggactccccgccgtcacaaccggcttcgaagcacagcggtggtgactccaacaagagtggcggccgcagcaagagcggaagtagtagcaacgaggcaacacaggtaggtgtcatcgtggtcggcgtggtgatcggtgccctagccttcggcctgctgatgtgcatcgccgcatgcgtgtgctgcctcaagaaaaaaaagaggaagaagcccccgcacatgaacatgccatactacaccgacgagcacgggaacgtcttctacgcgaacagcatgcccaagtggcagaacagcgcgatggaccacggctggcacgcgccctactcgccggcgagcggggacatgagcggctctcacgggcctgccgggcaggtgccggcgccgtcgccgggcatgccgtcgctggggttctccaagagctccttctcgtacgaggagctggcggcggcgacgggcggcttctcgtcggcgaacgtgctggggcagggcgggttcgggtacgtgtacaggggcgtgctcgcgggcagcggcaaggaagtggccgtgaagcagctcaaggccgggagcgggcagggcgagcgcgagttccaggccgaggtggagatcatcagccgagtccaccaccgccacctcgtcacccttgtcgggtactgcatcgccggctcctcccagcgcctgcttgtctacgagttcgtgcccaacaataccctcgagtaccacctccacgggaagggcgtgccggtgatggagtggccgaggaggctcgccatcgccctcggctccgccaagggcctggcttacctgcacgaagattgccaccccaggatcatccaccgtgatatcaaggcggccaacatccttttggacgaaaatttcgaggctaaggtcgcggatttcggacttgccaagctgaccacagacaccaacacgcacgtctccacgcgcgtcatgggaactttcgggtatttggccccggagtacgcgtcgagcggcaagctcaccgacaagtccgacgtgttctccttcggcgtcatgctcctggagctcatcaccggcaagagaccgattgatcccacgaactacatggaggacagcctggttgactgggcgaggcccctcttggcgcacgccttgtccggagaaggcaacttcgacgagctgctggacccgcggctggagaacaggatcaaccggcaggagctggagcggatgtgtgcctccgccgccgccgccgtccgccactcagccaagcggcggcccaagatgaaacagattgttcgtgctctggaaggggacgcgtcgctggacgacctgaacgagggggtgaagccagggcagagcatgatgttcagctctggctcggagaacgactccggcggcaactacgcgtccaacatcaacaggttcaggaaggtggccttcgagagcagcgagtacagcaacgagtacagcgggacaagcgaatacggcgctgattccgaggatggggcgtcccggcggcagcaacatcgctga

SEQ ID NO: 15579 - protein, 572 aa, Sorghum bicolor
  misc_feature: Useful for making plants with altered carbohydrate content
  misc_feature: Functional homolog of the protein sequence given in SEQ ID NO 14218
  misc_feature: Ceres ANNOT ID no. 8642262
  misc_feature (193)..(511): SWISSPROT Homolog: EC 2.7.11.1 Non-specific serine/threonine protein kinase
  misc_feature (222)..(497): Pfam ID: Pkinase_Tyr Pfam Description: Protein tyrosine kinase
MATPADGDDVSPSPFNSSPEPSDSDPGLGSPPPSLTPSVSPPPAPMENSSALSPPAPAARGSPPVAPSRDSPPSQPASKHSGGDSNKSGGRSKSGSSSNEATQVGVIVVGVVIGALAFGLLMCIAACVCCLKKKKRKKPPHMNMPYYTDEHGNVFYANSMPKWQNSAMDHGWHAPYSPASGDMSGSHGPAGQVPAPSPGMPSLGFSKSSFSYEELAAATGGFSSANVLGQGGFGYVYRGVLAGSGKEVAVKQLKAGSGQGEREFQAEVEIISRVHHRHLVTLVGYCIAGSSQRLLVYEFVPNNTLEYHLHGKGVPVMEWPRRLAIALGSAKGLAYLHEDCHPRIIHRDIKAANILLDENFEAKVADFGLAKLTTDTNTHVSTRVMGTFGYLAPEYASSGKLTDKSDVFSFGVMLLELITGKRPIDPTNYMEDSLVDWARPLLAHALSGEGNFDELLDPRLENRINRQELERMCASAAAAVRHSAKRRPKMKQIVRALEGDASLDDLNEGVKPGQSMMFSSGSENDSGGNYASNINRFRKVAFESSEYSNEYSGTSEYGADSEDGASRRQQHR

SEQ ID NO: 15580 - DNA, 1299 bp, Sorghum bicolor
  misc_feature: Ceres ANNOT ID no. 8642265
  misc_feature: Encodes the peptide sequence at SEQ ID NO 15581
atggggatcaggaggcagcacggtgctgctacgatcgtcttggggatcatcctggagctcgtcctcttccgcttggcgacgtcgcagtcgttcatcggggtcaactacgggacgatcgcggacaacctgccgccgccggcgtcgacggccagcctgctcatgtccacgtccatcggcaagctccgcctgtacgagccacagccggacctggtcgccgcgctcgcgggctccaacatctccatcctgctgggcatccccaacggcgccgtcccgaacctcgcgtcctccccggccgccgccgcgtcctgggccgccgccaacatccccaccaccgttcccgtctccgccatctccgtcggcaacgagctgctcaactccggcgaccccacgctcgcgccccagctcctccccgccatgcagaacctgctcgccgcgctcccggcgggctcgaccaccaagatctccaccgtgcactccatggccgtgctgtcggcgtcggacccgccgtcctccggcgcgttccacccggacctcgccggcagcctggacccggtgctggacttcctgcaccagaacggggcgcccttcatgatcaacccgtacccctacttcgcgtacgcctccgacacgcggccggagacgctggcgttctgcctgttccagcccaacgcggggcgcgtcgacgccgtgtcggggctcacctacaccaacatgttcgacgcgcagctggacgccatccgcgccgcgctggacgccaaggggtacagcgacgtggagatcgtcatcgccgagaccgggtggccgtacaagggcgacgccgacgaggccggcgccacggtggacaacgccaaggcctacaacaccaacctcgtggcgcacctcaagtcccaggtcggcacgccgcggacgccgggcaagtcggtggacacgtacatcttcgcgctctacgacgaggacctcaaggggggcccggagtcggagcggtccttcgggctgtacaagacagacctgacggcgaactacgacgtcgggctcgcgaagagcagcagcacggcggcaccgaccagtttgactccggttccggcacagggcacgccgcagccgagcaaagggacgatgccgacggggttctgcgagaccacggccgccgtgccaggcagcaagcagggccagcagttgccacagagcagctcgtgctacatcccgggcggagccgtgtcgcagcgagctgacgccggcacatggcagcttgttttgtttggtgttttgctgtgcttggtcacggtagccgtcaactag

SEQ ID NO: 15581 - protein, 432 aa, Sorghum bicolor
  misc_feature: Useful for making plants with altered carbohydrate content
  misc_feature: Functional homolog of the protein sequence given in SEQ ID NO 14112
  misc_feature: Useful for making plants with altered cell wall content and/or composition
  misc_feature: Functional homolog of the protein sequence given in SEQ ID NO 14129
  misc_feature: Ceres ANNOT ID no. 8642265
  misc_feature (26)..(403): SWISSPROT Homolog: EC 3.2.1.39 Glucan endo-1,3-beta-D-glucosidase
  misc_feature (32)..(345): Pfam ID: Glyco_hydro_17 Pfam Description: Glycosyl hydrolases family 17
MGIRRQHGAATIVLGIILELVLFRLATSQSFIGVNYGTIADNLPPPASTASLLMSTSIGKLRLYEPQPDLVAALAGSNISILLGIPNGAVPNLASSPAAAASWAAANIPTTVPVSAISVGNELLNSGDPTLAPQLLPAMQNLLAALPAGSTTKISTVHSMAVLSASDPPSSGAFHPDLAGSLDPVLDFLHQNGAPFMINPYPYFAYASDTRPETLAFCLFQPNAGRVDAVSGLTYTNMFDAQLDAIRAALDAKGYSDVEIVIAETGWPYKGDADEAGATVDNAKAYNTNLVAHLKSQVGTPRTPGKSVDTYIFALYDEDLKGGPESERSFGLYKTDLTANYDVGLAKSSSTAAPTSLTPVPAQGTPQPSKGTMPTGFCETTAAVPGSKQGQQLPQSSSCYIPGGAVSQRADAGTWQLVLFGVLLCLVTVAVN

SEQ ID NO: 15582 - DNA, 936 bp, Sorghum bicolor
  misc_feature: Ceres ANNOT ID no. 8642281
  misc_feature: Encodes the peptide sequence at SEQ ID NO 15583
atggatgaactcaacaaatggcattcacatccggactactctgaggaggagctagcatacatgtacaggcagcagcaagaagaagagcacgccgggatgcaacagcaacaccattttgctgagcagcagcagtactacacaccaccagcagcaatggcgccgcctaggtcccctagccccttccttgagttccttcctcatcatcatcaccacagctccagcttcccggggtttggggtcccggcattaccaccccggctgccgttcgggccggtcaagaatgagccagggcagccgtcatcgtcgtcgagcaatcgcatcctctccttcggcggacagcctccaagcacgctcaacttctcctcaggaggagattggctggaagccggtgttgaagcggtgcagcagatgccgccggagaggcggagccggacgcactggaacacccaggaacatgtcattgccgagcgcaagcggcgcgagaagatgcagcagcagttcgtggcgctggccaccatcgtcccggacctcaccaagacagataaaatctctctactagggagtaccatcgagtacgtgaaacagctcgaggagaaggtgaagaccctagaggggcgaagggaaaggagaacatccgatcccaccatcctcgagaccaagtgccgcatatcaactgatagtgacgcctcatgctccaacgacagtgcctttgctgcgggtgggttcagcccgacggttgaggcgagcatacatggcgacaccgtcttgctgaaaatatgctgcttggagagaagaggagtgctggtgatgatcatctccgagcttgaaaatcagggcctctccatcataaacactagtgttttaccattcacagactcgtgcctcaacattaccatcactgcaaaggcaaggcacttttgtccctctcatgtttaa

SEQ ID NO: 15583 - protein, 311 aa, Sorghum bicolor
  misc_feature: The sequence is a functional homolog of SEQ ID NO 1274 in the 10/666,642 US patent application
  misc_feature: The sequence is a functional homolog of SEQ ID NO 1703 in the 10/374,780 US patent application
  misc_feature: Ceres ANNOT ID no. 8642281
  misc_feature (148)..(197): Pfam ID: HLH Pfam Description: Helix-loop-helix DNA-binding domain
MDELNKWHSHPDYSEEELAYMYRQQQEEEHAGMQQQHHFAEQQQYYTPPAAMAPPRSPSPFLEFLPHHHHHSSSFPGFGVPALPPRLPFGPVKNEPGQPSSSSSNRILSFGGQPPSTLNFSSGGDWLEAGVEAVQQMPPERRSRTHWNTQEHVIAERKRREKMQQQFVALATIVPDLTKTDKISLLGSTIEYVKQLEEKVKTLEGRRERRTSDPTILETKCRISTDSDASCSNDSAFAAGGFSPTVEASIHGDTVLLKICCLERRGVLVMIISELENQGLSIINTSVLPFTDSCLNITITAKARHFCPSHV

SEQ ID NO: 15584 - DNA, 1233 bp, Sorghum bicolor
  misc_feature: Ceres ANNOT ID no. 8642299
  misc_feature: Encodes the peptide sequence at SEQ ID NO 15585
atggctgcgtggacctctgccaagggcgctcttcttccctgggctcgcagcagcagcggcggccatggcggcctctcgagtgtcctgggcagggccttggcgttggctacggccggaggaggaggaggaggaggcggcggcggctcgcttctcccacgccggtggcagtcgtcgctgccgcagctggaccatgtcgacaggtccgacgaggagagcggcgagatcgactgggacaagctcggcttcggcctcaccccgaccgactacatgtacgtgacgcggtgctcgccggaggaccgcggcgacttcccccgcggcgagctctgccgatacggcaacatcgagctcagcccctcctccggcgttctcaactacgcccaggggctgttcgaggggatgaaggcgtaccggcggccggaccggtctgggtacacgctgttccgtccggaggagaacgcgcggcggatgcagcacggcgccgagcgcatgtgcatgccggcaccgtcggtggagcagttcgtccacgccgtcaagcagaccgtcctcgccaaccggcgctgggtgccgccgcaggggaagggagccctgtacctccgacctctgctcatgggcagcggcccgatccttgggctggctccggcccccgagtacactttcctcgtctacgctgcacccgtcggaaactacttcaaggagggcctggcgcccatcaacctggtggtgcatgacgagttccaccgcgcgatgcccggcgggaccggcggcgtcaagaccatcgccaactacgcgccggtgctgagggcacagacggacgccaagagcaaggggttcacggacgtgctgtacctggactcggtccacaagcgctacctggaggaggtgtcgtcgtgcaacgtgttcgtcgtcaagggcggcgtcgtcgccacgccggccacccagggcaccatcctgccgggcatcacgcgcaagagcgtcatcgagctcgccagggaccgcggatacaaggttgaagaacgcctcgtttccattgacgatctgatgagtgcagacgaggtgttctgcacggggaccgcggtggtggttgctccggtgtccacagttacgtaccgaggcaacaagtacgaattcagaacgggcccggacacggtgtcacaggagctgtacacgactctgacatccattcagatgggcctggccgaggacaacaagggatggacagtagcagtagagtag

SEQ ID NO: 15585 - protein, 410 aa, Sorghum bicolor
  misc_feature: Useful for making plants with modulated nitrogen use efficiency
  misc_feature: Functional homolog of the protein sequence given in SEQ ID NO 13131
  misc_feature: Ceres ANNOT ID no. 8642299
  misc_feature (71)..(407): SWISSPROT Homolog: EC 2.6.1.42 Branched-chain-amino-acid transaminase
  misc_feature (105)..(392): Pfam ID: Aminotran_4 Pfam Description: Aminotransferase class IV
MAAWTSAKGALLPWARSSSGGHGGLSSVLGRALALATAGGGGGGGGGGSLLPRRWQSSLPQLDHVDRSDEESGEIDWDKLGFGLTPTDYMYVTRCSPEDRGDFPRGELCRYGNIELSPSSGVLNYAQGLFEGMKAYRRPDRSGYTLFRPEENARRMQHGAERMCMPAPSVEQFVHAVKQTVLANRRWVPPQGKGALYLRPLLMGSGPILGLAPAPEYTFLVYAAPVGNYFKEGLAPINLVVHDEFHRAMPGGTGGVKTIANYAPVLRAQTDAKSKGFTDVLYLDSVHKRYLEEVSSCNVFVVKGGVVATPATQGTILPGITRKSVIELARDRGYKVEERLVSIDDLMSADEVFCTGTAVVVAPVSTVTYRGNKYEFRTGPDTVSQELYTTLTSIQMGLAEDNKGWTVAVE

SEQ ID NO: 15586 - DNA, 1848 bp, Sorghum bicolor
  misc_feature: Ceres ANNOT ID no. 8642305
  misc_feature: Encodes the peptide sequence at SEQ ID NO 15587
atggctagtggcagcaactggctaggcttctccctctccccgcaaacggccgtggaggtgccctccgcttctgaacccgctcctgcccatcacgctccacctgatccttccagtactatgatctcctcttccagtaccaacaacgccaccacttccaacttcctcttctcaccgatggccgctccctatcctggttactactgtgtgggcggcgcgtatggcgatggcaccagtgctgccggcgtctactactcccacttgcctgctatgcccatcaagtccgacggcaccctctgcaacatcgaagtaggcatgatgccgtcgtccccgccgaagctagaggacttcttgggcggtggcaatggcggtggtcaagaaacggccacctactacagccacggccaggaagagggggcgagcagggattaccgccagtaccagcaccaccagctcgtcccctacaacttccagcatctgacggaagcagagatgctccaagaagacgcggcgccaatggaggaggcgatggcggcggccaagaacttcctcctgacgagctacggcgcttgctacagcaacggggagatgcaccctctgagcctgtcgatgatgagccccgggtcccagtcgagcagctgcgtcggtgcggctccgcagcagcagctggccgctgtagccactgcttccgcggcggccgcagcccaggggcgcagtaatggcgatggtgagcagtgcgtcgggaggaagagaggcaccgggaagggaggccacaagcagcagccggtgcaccgcaagtccatcgacacgtttgggcagagaacctcccgttacaggggcgtcaccaggcacaggtggactgggagatatgaagcccacctctgggacaacagctgcagaaaggatgggcagactaggaaaggcagacaaggtggttatgacaccgaagacaaggccgcgagggcttatgatctggctgctctgaaatattggggtccagctactcacatcaatttccccgtagagaactatcgagatgaacttgaggtgatgaaaggcatgacaaggcaagaatatgttgcgcatttgagaaggagaagcagtggattttctcgaggcgcttccatctaccgaggagtgacaaggcatcaccagcaaggaagatggcagtctcggattggaagggttgctggaaacaaggatctatacctcggcactttcaccactcaagaagaagcagctgaggcttacgacatagctgccatcaagttccgtggcttgaacgcggtgacgaacttcgacataacaagatacgacgtcgacaagatcatggagagcaacacgctgctgcccgcggaggaagcacgcaaggtcaaggcgatcgaggcggctaacaatgctcctatgatgcagcacaacggtggcagggagctcaacccagccgaggaaacaagcgcagcctggaggatggtgctccatggttctccccaggaagctgtgcattgcccagaagcagttgatctccagagggcaatcatgagcaacgactctcagcatccctccctgcatggcatcgttggacttgatcatcacctcggcgttcctggcaagacgtctgggagcatcaatttctccaactcgtcctcgcaggtgacaagcctgggaaactccagggaggggagccccgagaggctgggcctggccatgctctacggcaagcagccgagcgccgtaagcctggccaccatgagcccctggatgccgatggcggcacagacagtggcccaagtgctgaagcagccgaacgtcgtctctcatctgcctgtctttgccgcttgggcagatgcctag

SEQ ID NO: 15587 - protein, 615 aa, Sorghum bicolor
  misc_feature: Useful for biocontainment applications
  misc_feature: Functional homolog of the protein sequence given in SEQ ID NO 13575
  misc_feature: The sequence is a functional homolog of SEQ ID NO 1070 in the 10/225,066 US patent application
  misc_feature: The sequence is a functional homolog of SEQ ID NO 140 in the 11/375,241 US patent application
  misc_feature: The sequence is a functional homolog of SEQ ID NO 1904 in the 10/412,699 US patent application
  misc_feature: The sequence is a functional homolog of SEQ ID NO 2164 in the 10/374,780 US patent application
  misc_feature: The sequence is a functional homolog of SEQ ID NO 458 in the 11/435,388 US patent application
  misc_feature: Useful for making plants with altered lignin content
  misc_feature: Useful for making plants with modulated drought sensitivity
  misc_feature: Functional homolog of the protein sequence given in SEQ ID NO 14199
  misc_feature: The sequence is a functional homolog of SEQ ID NO 320 in US patent 7157621
  misc_feature: Ceres ANNOT ID no. 8642305
  misc_feature (374)..(426): Pfam ID: AP2 Pfam Description: AP2 domain
  misc_feature (275)..(332): Pfam ID: AP2 Pfam Description: AP2 domain
MASGSNWLGFSLSPQTAVEVPSASEPAPAHHAPPDPSSTMISSSSTNNATTSNFLFSPMAAPYPGYYCVGGAYGDGTSAAGVYYSHLPAMPIKSDGTLCNIEVGMMPSSPPKLEDFLGGGNGGGQETATYYSHGQEEGASRDYRQYQHHQLVPYNFQHLTEAEMLQEDAAPMEEAMAAAKNFLLTSYGACYSNGEMHPLSLSMMSPGSQSSSCVGAAPQQQLAAVATASAAAAAQGRSNGDGEQCVGRKRGTGKGGHKQQPVHRKSIDTFGQRTSRYRGVTRHRWTGRYEAHLWDNSCRKDGQTRKGRQGGYDTEDKAARAYDLAALKYWGPATHINFPVENYRDELEVMKGMTRQEYVAHLRRRSSGFSRGASIYRGVTRHHQQGRWQSRIGRVAGNKDLYLGTFTTQEEAAEAYDIAAIKFRGLNAVTNFDITRYDVDKIMESNTLLPAEEARKVKAIEAANNAPMMQHNGGRELNPAEETSAAWRMVLHGSPQEAVHCPEAVDLQRAIMSNDSQHPSLHGIVGLDHHLGVPGKTSGSINFSNSSSQVTSLGNSREGSPERLGLAMLYGKQPSAVSLATMSPWMPMAAQTVAQVLKQPNVVSHLPVFAAWADA

SEQ ID NO: 15588 - DNA, 900 bp, Sorghum bicolor
  misc_feature: Ceres ANNOT ID no. 8642298
  misc_feature: Encodes the peptide sequence at SEQ ID NO 15589
atggctcaggaggacgtccaccacctggacgatgccggcctggcgctgggcctgtccctcggcggaggcggcgcctccgatgcggtgcgccacggtaccagcagcagccggctgagcatggaggcggtggcgcggctgccgtcgccgcggccgcagctggagccgtcgctgacgctgagcatgccggacgaagcgaccgccaccgcgaccgggtccggcggcggcggcggcggggccgcgcacagcgtgtcgtcgctgtcagtggcgggcgtgaagagggagcgcgtggacgacgccgagggcgaacgggcgtcgtcgacgacggcggccgcggctgcgcgggccgtcagcgccggcgccgaggacgacgacgacgggagcacgcggaagaagctgaggctgaccaaggagcagtccgcgctcctggaggaccgcttcaaggagcacagcaccctcaacccgaagcagaaagtcgcgttggcgaagcaactcaacctgaggccacgccaggtggaggtgtggttccaaaacagacgagcaaggacgaagctgaagcagacggaggtggactgcgagctcctgaagcgctgctgcgagtcgctgaccgaggagaaccgccgcctgcagcgggagctgcaggagctccgcgcgctcaagttcgccccactacacccacaggcggcacaggcgccgccgtcgtccgcggcgcaggcggcgggcgtgccggcgccgccgcagccgttctacatgcagatgcagctgccggcggccacgctgagcctctgcccgtcctgcgagcgcctggccgggcccgccgcggcggccaaggccgagcccgacaggcccaaggcagccacccaccacttcttcaaccccttcacccactccgccgcctgctga

SEQ ID NO: 15589 - protein, 299 aa, Sorghum bicolor
  misc_feature: The sequence is a functional homolog of SEQ ID NO 2326 in the 10/374,780 US patent application
  misc_feature: The sequence is a functional homolog of SEQ ID NO 252 in the 10/412,699 US patent application
  misc_feature: The sequence is a functional homolog of SEQ ID NO 546 in the 11/479,226 US patent application
  misc_feature: The sequence is a functional homolog of SEQ ID NO 8 in the 10/225,068 US patent application
  misc_feature: Ceres ANNOT ID no. 8642298
  misc_feature (185)..(229): Pfam ID: HALZ Pfam Description: Homeobox associated leucine zipper
  misc_feature (130)..(184): Pfam ID: Homeobox Pfam Description: Homeobox domain
MAQEDVHHLDDAGLALGLSLGGGGASDAVRHGTSSSRLSMEAVARLPSPRPQLEPSLTLSMPDEATATATGSGGGGGGAAHSVSSLSVAGVKRERVDDAEGERASSTTAAAAARAVSAGAEDDDDGSTRKKLRLTKEQSALLEDRFKEHSTLNPKQKVALAKQLNLRPRQVEVWFQNRRARTKLKQTEVDCELLKRCCESLTEENRRLQRELQELRALKFAPLHPQAAQAPPSSAAQAAGVPAPPQPFYMQMQLPAATLSLCPSCERLAGPAAAAKAEPDRPKAATHHFFNPFTHSAAC

SEQ ID NO: 15590 - DNA, 1146 bp, Sorghum bicolor
  misc_feature: Ceres ANNOT ID no. 8642318
  misc_feature: Encodes the peptide sequence at SEQ ID NO 15591
atggccacgaccaccggtgtcatcctcatctgcgcagagtttgcgtcgcctctccggaagacgcatatttgcgtttcctctcggctgctacgtataatgggtagttcatttgggtcttccgttggagcatggatttgctgcagccacccgcgagtcctcatccgccactccgtcgaacaacgcccctgcgcacgctccagcctccagcttgctatgctcctccgcccgcgcccctccctcttccgagccgtcgcgccgccgccgctcaccagcgcccgtgtcccctcccgtcgcacgttctcagcttctgcagaggcgggaacagcctcccccaaggatgcagcgccagcgccagcgccggttccggcggtcacgcgcaagaacgccaggaaggccgtgccgccgcctatggggatcgtgaagacggcgctgtttcttccgcccggggtggagcgggacgcgacggtggccgcggacatggtcataccggggtcgaacattgtggtcgggccctacgctggggacgcgagggtgaaggaggctgagttcgtcaagagcagtgcgcgtgcgcgggactgccccaaggacgaccgacccgagttcgccgtcctcggccgttccaacgttggcaaatcctcgctcatcaacgccctcacccgccgcaaggaagccgcgctcacctccaaaaagcctgggaagacacagacaatcaatcactttttggttaataagagttggtaccttgtggatttgcctggttatgggtttgcagctgcatcccaatcagctcgaatggactggtcttcatttaccaagggttacttcttgaacagagataccttggttggcgtacttctccttattgatgccagtatcccacctcagaaaattgatctagactgtgctaactggctcggccgtaacaatattggattgacatttgtgttcaccaagtgcgacaaagtaaagaagggtaaaggagggcggcctgatgagaacatcaagcagttccaggaaactatcagtgggctttatccagatccaccaccatggatcatgacaagcagtgttaccggattaggccgcgacgggctactcctccatatgtcacagctgaggaactactgggataatgaagcagtctag

SEQ ID NO: 15591 - protein, 381 aa, Sorghum bicolor
  misc_feature: Useful for making plants with modulated heat sensitivity
  misc_feature: Functional homolog of the protein sequence given in SEQ ID NO 13099
  misc_feature: Ceres ANNOT ID no. 8642318
  misc_feature (199)..(320): Pfam ID: MMR_HSR1 Pfam Description: GTPase of unknown function
MATTTGVILICAEFASPLRKTHICVSSRLLRIMGSSFGSSVGAWICCSHPRVLIRHSVEQRPCARSSLQLAMLLRPRPSLFRAVAPPPLTSARVPSRRTFSASAEAGTASPKDAAPAPAPVPAVTRKNARKAVPPPMGIVKTALFLPPGVERDATVAADMVIPGSNIVVGPYAGDARVKEAEFVKSSARARDCPKDDRPEFAVLGRSNVGKSSLINALTRRKEAALTSKKPGKTQTINHFLVNKSWYLVDLPGYGFAAASQSARMDWSSFTKGYFLNRDTLVGVLLLIDASIPPQKIDLDCANWLGRNNIGLTFVFTKCDKVKKGKGGRPDENIKQFQETISGLYPDPPPWIMTSSVTGLGRDGLLLHMSQLRNYWDNEAV

SEQ ID NO: 15592 - DNA, 1800 bp, Sorghum bicolor
  misc_feature: Ceres ANNOT ID no. 8642328
  misc_feature: Encodes the peptide sequence at SEQ ID NO 15593
atgggtcgcgacgccgaggagacctcgccgccggtgtcctcgtcggaattggagcaggaagaagacgacgacgactgctacctgagcgatcaggaggacgatgccctagaagagtccgtcctccaggtcctcgaggacgagcaccacgaggactgccattggtccgcctcatgcgtcatcaccaaggaatccctcctggcggcgcagagggaggatcttaggaaggtgatggagctgctagggttgagggagcaccatgcccggacgctcctcatccactaccgctgggatgtggagaggattttcgagcttctcgatcagaagggcagggataggctcttctcggaggctggtattcctctccagtacaccaataatgccgggacaacctcctcggcggaggtgacctgcaatgtttgttatgatgatgtgccaccctcgactgcctccgagatggactgcggccacagttactgcaatgattgttggactgaatatttcattgtgaaaataaatgagggtcagagccggcgtgtcagatgcatggctccaaagtgcaatgctatttgtgatgaagcaataattcgaaaactagtcattgcgagacacccagatatcgcagaacgctttgaaagatttttactggaatcatatattgaggataatgatacagtcaagtggtgcccaagcacaccacattgtggaaatgctatacgcgtcaaaggcgatatttattgtgaggtggaatgcacatgtggatgccagttttgttttaattgctccttacaagcacactcaccatgttcctgcatgatgtgggagctctggatcaagaaatgccgtgatgaatcagaaacagtgaattggataacagtaaatactaagccctgtcccaagtgtcacaaacctgtggagaagaatggtggctgcaacctggttgcatgtatatgtggacaagcattctgttggttatgtgggggggctacaggtagagatcacacatggtcaagtattagtggccacagttgtggccggttcactgatgatcagactaagaagacggaacaagcaaggcgagacctgtacagatatatgcactaccacaacagatacaaggctcacactgactctcttaagcaggaagcaaagctaaagaatgagatccaggggaagatatccatttcagaaaataaggagtcaaagataaaagattattcttgggtcatgaatgggttaaacaggctattcagatcaaggcgtgttctttcctattcatatccgtttgcattttatatgtttggtgatgagattttcaaggatgagatgactcctcacgaaagagaagtgaagcagaatttatttgaggatcagcaacaacaactagaatttaatgttgaaagactttctggtttccttgagaaagattttcaactttttactgatgacgaggtcatggatacgatgaagcatgtcatcaatctttccaatgtggttgataagtatcagtgcatcgagaatgatttgttatatcctctacgcacacctcacaacattgctccatacaaatctaagggccttgacagggcctcggagcttaatattagttgggattctgctgaacaaagttcacagtcaacaaaacgaagtcagaatgaagcatcgactgttctggggaaacgaggctcgagttctgataatagggggcaccaatctaacaagcgagagagggtagatgctaatggtggtggtagtgcactttttgatctcaatgtgccagctgaagtggtggataagatctga

SEQ ID NO: 15593 - protein, 599 aa, Sorghum bicolor
  misc_feature: The sequence is a functional homolog of SEQ ID NO 1727 in the 10/374,780 US patent application
  misc_feature: The sequence is a functional homolog of SEQ ID NO 330 in the 10/374,780 US patent application
  misc_feature: The sequence is a functional homolog of SEQ ID NO 56 in the 11/375,241 US patent application
  misc_feature: The sequence is a functional homolog of SEQ ID NO 854 in the 10/225,066 US patent application
  misc_feature: The sequence is a functional homolog of SEQ ID NO 274 in the 10/666,642 US patent application
  misc_feature: Ceres ANNOT ID no. 8642328
  misc_feature (208)..(270): Pfam ID: IBR Pfam Description: IBR domain
MGRDAEETSPPVSSSELEQEEDDDDCYLSDQEDDALEESVLQVLEDEHHEDCHWSASCVITKESLLAAQREDLRKVMELLGLREHHARTLLIHYRWDVERIFELLDQKGRDRLFSEAGIPLQYTNNAGTTSSAEVTCNVCYDDVPPSTASEMDCGHSYCNDCWTEYFIVKINEGQSRRVRCMAPKCNAICDEAIIRKLVIARHPDIAERFERFLLESYIEDNDTVKWCPSTPHCGNAIRVKGDIYCEVECTCGCQFCFNCSLQAHSPCSCMMWELWIKKCRDESETVNWITVNTKPCPKCHKPVEKNGGCNLVACICGQAFCWLCGGATGRDHTWSSISGHSCGRFTDDQTKKTEQARRDLYRYMHYHNRYKAHTDSLKQEAKLKNEIQGKISISENKESKIKDYSWVMNGLNRLFRSRRVLSYSYPFAFYMFGDEIFKDEMTPHEREVKQNLFEDQQQQLEFNVERLSGFLEKDFQLFTDDEVMDTMKHVINLSNVVDKYQCIENDLLYPLRTPHNIAPYKSKGLDRASELNISWDSAEQSSQSTKRSQNEASTVLGKRGSSSDNRGHQSNKRERVDANGGGSALFDLNVPAEVVDKI

SEQ ID NO: 15594 - DNA, 1074 bp, Sorghum bicolor
  misc_feature: Ceres ANNOT ID no. 8642360
  misc_feature: Encodes the peptide sequence at SEQ ID NO 15595
atggccagcctcaccgatctcgttaacctcgacctgagtgattgcaccgacaagatcattgccgagtacatctggattggaggatccggcatagacctcaggagcaaagcaaggacggtgaaaggccccatcaccgatccgagccagctgccaaaatggaactacgacggctccagcaccgggcaggctcccggagaggacagcgaagtcatcctctaccctcaagccattttcaaggacccgttcaggaagggcgacaacatccttgtgatgtgtgactgctacacgccacaaggcgagccaatccctactaacaagaggtacaatgctgccaaggttttcagccaccccgacgttgcagctgaggtgccatggtacggtattgagcaggagtacactctccttcagaaggatgtgaactggccccttggctggcctgttggtggataccctggtccccagggaccatactactgcgctgccggtgccgataaggcctttgggcgcgatgtggtcgacgcccactacaaagcctgcctctacgccggcatcaacatcagcggcatcaacggcgaagtcatgcctggccagtgggagttccaagttggcccgtccgttgggatatctgccggtgacgaaatatgggttgcccgctacattctcgagaggatcactgagattgccggaattgttctctccttggacccgaagccaatccagggtgactggaacggcgccggtgcccacaccaactacagcaccaagtcgatgagggaggccggtggctacgaggtgatcaagaaggcgatcgagaagctggggaagaggcacacggagcacatcgccgcgtacggcgagggcaacgagcgccgcctcacgggccgacacgagaccgccgacatcaacaccttcaaatggggcgtggcgaaccgcggcgcgtccatccgcgtgggccgcgacacggagagggagggcaagggatacttcgaggaccgcaggccggcatccaacatggacccctacgtcgtcaccggcatgatcgccgagaccaccatcctgtggaacggaaactga

SEQ ID NO: 15595 - protein, 357 aa, Sorghum bicolor
  misc_feature: Useful for making plants with modulated water use efficiency
  misc_feature: Functional homolog of the protein sequence given in SEQ ID NO 13877
  misc_feature: Ceres ANNOT ID no. 8642360
  misc_feature (1)..(357): SWISSPROT Homolog: EC 6.3.1.2 Glutamate--ammonia ligase
  misc_feature (103)..(355): Pfam ID: Gln-synt_C Pfam Description: Glutamine synthetase, catalytic domain
  misc_feature (17)..(97): Pfam ID: Gln-synt_N Pfam Description: Glutamine synthetase, beta-Grasp domain
MASLTDLVNLDLSDCTDKIIAEYIWIGGSGIDLRSKARTVKGPITDPSQLPKWNYDGSSTGQAPGEDSEVILYPQAIFKDPFRKGDNILVMCDCYTPQGEPIPTNKRYNAAKVFSHPDVAAEVPWYGIEQEYTLLQKDVNWPLGWPVGGYPGPQGPYYCAAGADKAFGRDVVDAHYKACLYAGINISGINGEVMPGQWEFQVGPSVGISAGDEIWVARYILERITEIAGIVLSLDPKPIQGDWNGAGAHTNYSTKSMREAGGYEVIKKAIEKLGKRHTEHIAAYGEGNERRLTGRHETADINTFKWGVANRGASIRVGRDTEREGKGYFEDRRPASNMDPYVVTGMIAETTILWNGN

SEQ ID NO: 15596 - DNA, 1941 bp, Sorghum bicolor
  misc_feature: Ceres ANNOT ID no. 8642350
  misc_feature: Encodes the peptide sequence at SEQ ID NO 15597
atggctgtggcccttctgctccctaccatgcaccttcctgcacgaccggtaggcccacggcttctcaacttgcctcgtgggacccatatcgactttgccccaagtgtcatcatcatggacaatcagccaagcaaaggatcgtgccgcagccgcgatacagcaacttccctgactcttctgtcccacacgaagcccccaaatacgcaaaaacacgcgcataattacctcagggcaatcatcgtcaaatcaaaggaaattgaacgaagcagcccaaccaaaatcccctcgccgcctcgtcccgttcccgttcgcgtaccgtcccttctcgacttctcccgtaccgtcgccgcctcaatctcgaagcctctccggcgcagccgcctcaatctcgactcgaagcgcctctccaaccagaaatcctctcgggttttcgcatcgtccgtcgcgatgggctccaagaagcggtcgccgcagcatcccgcctccccagccggcggcgaggtcggcgcccagacggcggggaaggccgtgccggtgacggcggcgccggagtcggcgcccgtgtcggtggtgccgaagcctccggacgtggcgcccttcctgaccaaggtctacgacatggtctccgacccggccaccgacgcggtcatctcctggagcgccgccggcggcagcttcgtgatctgggactctcacgttttcgagcgagacctgctgccgcggcacttcaagcacaatcacttcaccagcttcatacgccagctcaatacctacggatttcataaagttgatccagatagatgggaatgggccaatgaaggttttgttaagggccaaaaacatcttctgaagaccatcaagagaaagaagaaatcctctcaggatgtacctagtgatctgcagtcggtgcctgtcaaaactgcacctggcactgagaatattgagataggaaaatatggaggccttgcaaaggaggttgagacacttaagagggataaggcccttctaatgcagcagcttgtagatctgaggcagtaccagcaatcatccagccttgaagtgcagaatttaattcaacgcctccgtgtgatggaacagaaccagcagcagatgatggcacttttggcaatagttgtccagaatccagatttcctcaaccagctcgtgcagcagcagcgcaggagtaactggtggaatgatgatggtaacaggaaaagaaggttccaagctctggaacatggtcctgtagatgatcaggagacttctggtggaggcgcgcaaattattcaatatcgtcctcctgttcctgaaacttccaatcaaccaataccaggaaatgaagctatctattcaacccctgcacagccagtttcaagccatgcacaaccagtttcaagtcctgcagaagagatgcccatggatgtagaaatgacttcaaacaatgttgatacccttgattcaactgggaatgattttactgacacctctgctctatgtgaatgggatgacatggatatatttggtgatgaactagagtacattcttcaacagccagagcagaactttcaagtggaccctcctctaacagttgaagattatggttatgatcgtccacggctagagcaggactgtcagatggaagcacaacaggattgcaaaaatcctcaatatggtgaagggaaaactatgcatctgatgtccattagtactgatcaggttgagctgatgtcacaactgaagcatgagcggtggtcccagagaatgttgtcagtaacattagtggatagaggtgctttacaattaaaaagctttttgcgttgtgttctattcatgaactttactattagtctattacttttgcatgatcaaacacaaaccagggtcatacatttatttgacactattacaatagctgcctttcagaatataagtcagtactga

SEQ ID NO: 15597 - protein, 646 aa, Sorghum bicolor
  misc_feature: The sequence is a functional homolog of SEQ ID NO 1805 in the 10/374,780 US patent application
  misc_feature: Ceres ANNOT ID no. 8642350
  misc_feature (198)..(375): Pfam ID: HSF_DNA-bind Pfam Description: HSF-type DNA-binding
MAVALLLPTMHLPARPVGPRLLNLPRGTHIDFAPSVIIMDNQPSKGSCRSRDTATSLTLLSHTKPPNTQKHAHNYLRAIIVKSKEIERSSPTKIPSPPRPVPVRVPSLLDFSRTVAASISKPLRRSRLNLDSKRLSNQKSSRVFASSVAMGSKKRSPQHPASPAGGEVGAQTAGKAVPVTAAPESAPVSVVPKPPDVAPFLTKVYDMVSDPATDAVISWSAAGGSFVIWDSHVFERDLLPRHFKHNHFTSFIRQLNTYGFHKVDPDRWEWANEGFVKGQKHLLKTIKRKKKSSQDVPSDLQSVPVKTAPGTENIEIGKYGGLAKEVETLKRDKALLMQQLVDLRQYQQSSSLEVQNLIQRLRVMEQNQQQMMALLAIVVQNPDFLNQLVQQQRRSNWWNDDGNRKRRFQALEHGPVDDQETSGGGAQIIQYRPPVPETSNQPIPGNEAIYSTPAQPVSSHAQPVSSPAEEMPMDVEMTSNNVDTLDSTGNDFTDTSALCEWDDMDIFGDELEYILQQPEQNFQVDPPLTVEDYGYDRPRLEQDCQMEAQQDCKNPQYGEGKTMHLMSISTDQVELMSQLKHERWSQRMLSVTLVDRGALQLKSFLRCVLFMNFTISLLLLHDQTQTRVIHLFDTITIAAFQNISQY

SEQ ID NO: 15598 - DNA, 2175 bp, Sorghum bicolor
  misc_feature: Ceres ANNOT ID no. 8642366
  misc_feature: Encodes the peptide sequence at SEQ ID NO 15599
atgtcggccaccgcgctcttcctgcccgcaaacccaaactccacgcctagtcccgctggcactctccgtctccggcaacctgcgccggcttccacctccggaaagctccacttcccgctccgcctcccccgccatgcccgcgctaggacctatcgccccgccgcgttcgggaggggatcgcctgtggccgggcgtagagagaaggatcactacgccacgctgaacatccgccgcgacgccacgctccaggagatcaaggctgcctaccggattctcgcccgcaagtaccatcctgatatgaataagagtcctgaagccgaagaaaagttcaaggagatcagtgctgcatatgaggttctatctgatcaagataaaagatctttatatgaccgctttggagaagaggggctcagtggtgattacagagatggagatattggcacacatgggattgatccatatgaactcttcaatgcattctttggtggttctgacaacctttttggggatagtatgggccctgggggatttcgttatagtgcagaagcaaagggcagtagggcacttaatatcagctataatctgctcctttcttttgaagaatccatcctaggaggcaaacgtgaaatcaatgtttttcgccatgaaacatgtggcacctgccatggaactggagctaaatgtagcaatgacattacagaatgcacccgatgcagaggtcaaggcaggttgatgaaaactcaaaggacaccttttggtatagtttctcagatttcttcatgcttaaattgtgaaggcagcgggaaggtaatcactgaacattgcacagaatgttacggttcgggcagagtccaagttgaacgcattatcaaagtagatatacctgggggtattgatgagggctccaccattcgaatcagtggtggaggtaatgttgataagcaaaggggtgcaagtggtgacctgtatatatttgttcgcattaatgaaaaacaaggcatccacagagatggtctcaatttgtactcagatgtttcagttgattatactgatgtgattttaggaaccacagtgaaggttgaaacaatagaaggactcaaggatcttcacattcctcctggcactcaacctggagagaacttaaaattttctcaactgggagttccggacattaagaagcctaatgtcagaggagatcactacttcatgataaaggtgaagatcccgaagagtatcagtggccatgaacgtttgctagttgaagagcttgccgcactaaagaaagctcagaatatctcagttcaagaaactacaaaaatagaaaattttcgggagagaaaccatcatccatctgcaaagagaagatcattcttgggatctatctggaatttgttcagggatgataatggccatcagagatttgcttcaatcagtgtgcaacctattatcccaggattgaattctggccgaggaactgatactgcttttcccttgctgttaaaaggactcctcatgaccgcagcattcttatttttagtcagcagaaccagtaaactcagaagacacttgcaacaactgatgagttttgacgaacgccagagtaaagacatgaagaaacatgaccgtgttctaatgtacactttccagaccgatacaggcgcagcagcagaaggtttgcggcatccgtccgcccccaagccggcaagcccccaaaacgttcactctagccagctgacgggattcacactgcgccatgtctttccggccgccgccgcatccgtaccaccggaatccacggcgagtccgcttcgcctgctatctcctcgtactcaccttcgctctcctcgtcgtctccaccgccgccaagtcctcccgccgccccatctccgtacgtctccccgcctgacccgaccctgccttctctcctccgacaacgagatccggcagaagaaggaggcctgctacaccgacgtcgagaagtcctcgccgacggagaaggagaactgcgtgctgcgctgcctctcgccggagtgctacgacctcatatacggcggcgatccacttgaggaaggggagttggactatgttcgaggccaggagtacaagtactgtatgcacaaatcatcccttggagaaagcttggatggtgtgaagggatccttcagctactcatga

SEQ ID NO: 15599 - protein, 724 aa, Sorghum bicolor
  misc_feature: Useful for biocontainment applications
  misc_feature: Functional homolog of the protein sequence given in SEQ ID NO 14229
  misc_feature: Ceres ANNOT ID no. 8642366
  misc_feature (69)..(130): Pfam ID: DnaJ Pfam Description: DnaJ domain
  misc_feature (302)..(424): Pfam ID: DnaJ_C Pfam Description: DnaJ C terminal region
  misc_feature (205)..(289): Pfam ID: DnaJ_CXXCXGXG Pfam Description: DnaJ central domain (4 repeats)
MSATALFLPANPNSTPSPAGTLRLRQPAPASTSGKLHFPLRLPRHARARTYRPAAFGRGSPVAGRREKDHYATLNIRRDATLQEIKAAYRILARKYHPDMNKSPEAEEKFKEISAAYEVLSDQDKRSLYDRFGEEGLSGDYRDGDIGTHGIDPYELFNAFFGGSDNLFGDSMGPGGFRYSAEAKGSRALNISYNLLLSFEESILGGKREINVFRHETCGTCHGTGAKCSNDITECTRCRGQGRLMKTQRTPFGIVSQISSCLNCEGSGKVITEHCTECYGSGRVQVERIIKVDIPGGIDEGSTIRISGGGNVDKQRGASGDLYIFVRINEKQGIHRDGLNLYSDVSVDYTDVILGTTVKVETIEGLKDLHIPPGTQPGENLKFSQLGVPDIKKPNVRGDHYFMIKVKIPKSISGHERLLVEELAALKKAQNISVQETTKIENFRERNHHPSAKRRSFLGSIWNLFRDDNGHQRFASISVQPIIPGLNSGRGTDTAFPLLLKGLLMTAAFLFLVSRTSKLRRHLQQLMSFDERQSKDMKKHDRVLMYTFQTDTGAAAEGLRHPSAPKPASPQNVHSSQLTGFTLRHVFPAAAASVPPESTASPLRLLSPRTHLRSPRRLHRRQVLPPPHLRTSPRLTRPCLLSSDNEIRQKKEACYTDVEKSSPTEKENCVLRCLSPECYDLIYGGDPLEEGELDYVRGQEYKYCMHKSSLGESLDGVKGSFSYS

SEQ ID NO: 15600 - DNA, 468 bp, Sorghum bicolor
  misc_feature: Ceres ANNOT ID no. 8642370
  misc_feature: Encodes the peptide sequence at SEQ ID NO 15601
atgtcggccaccgcgctcttcctgcccgcaaacccaaactccacgcctagtcccgctggcactctccgtctccggcaacctgcgccggcttccacctccggaaagctccacttcccgctccgcctcccccgccatgcccgcgctaggacctatcgccccgccgcgttcgggaggggatcgcctgtggccgggcgtagagagaaggatcactacgccacgctgaacatccgccgcgacgccacgctccaggagatcaaggctgcctaccggattctcgcccgcaagtaccatcctgatatgaataagagtcctgaagccgaagaaaagttcaaggagatcagtgctgcatatgaggttctatctgatcaagataaaagatctttatatgaccgctttggagaagaggggctcagtggtgattacagagatggagatattggcacacatgggatgctcttttttctctag

SEQ ID NO: 15601 - protein, 155 aa, Sorghum bicolor
  misc_feature: Useful for making plants with modulated heat sensitivity
  misc_feature: Functional homolog of the protein sequence given in SEQ ID NO 14230
  misc_feature: Ceres ANNOT ID no. 8642370
  misc_feature (69)..(130): Pfam ID: DnaJ Pfam Description: DnaJ domain
MSATALFLPANPNSTPSPAGTLRLRQPAPASTSGKLHFPLRLPRHARARTYRPAAFGRGSPVAGRREKDHYATLNIRRDATLQEIKAAYRILARKYHPDMNKSPEAEEKFKEISAAYEVLSDQDKRSLYDRFGEEGLSGDYRDGDIGTHGMLFFL

SEQ ID NO: 15602 - DNA, 2589 bp, Sorghum bicolor
  misc_feature: Ceres ANNOT ID no. 8642352
  misc_feature: Encodes the peptide sequence at SEQ ID NO 15603
atggcgtcacgctcctactccaacctcctcgacctggccaccggagcagccgaccaggcgccggcggccgccgcgattagcgcgctccggcggaggctcccgcgcgtggtcaccaaccccgggttcatcgacgactccccggcgtcgccgtccacgccggcgcggccgcgcaccatcatcgtggccaaccagctccccattcggtcccgccgcccggcgtcgccggaggagccctggaccttcgagtgggacgaggactccctcctccgccacctccaccactcgtcctcccccctgatggagttcatctacatcggctgcctgcgcgacgacatcccgcaggccgaccaggacgccgtcgcgcaggcgctcctcgagacccacaactgtgtgccggccttcctgcccacggacatcgccgagcgctactaccacggcttctgcaagcagcacctgtggccgctcttccactacatgctgccgctgtcccccgacctcggcggccgcttcgaccgcgcgctctggcaggcctacgtctccgcgaacaagatcttcgccgacaaggtgctggaggtgatcaacccggacgacgacttcgtgtgggtgcacgactaccacctcatggtgctccccaccttcctgcgcaagcgcttcaaccgcatcaagctcggcttcttcctgcactcaccgttcccctcgtcggagatctacaagacgctccccgtgcgcgaggagctcctgcgcgccctgctcaactccgacctcatcggcttccacaccttcgactacgcgcgccacttcctctcctgctgcggccgcatgctcgggctctcgtacgaatccaagagggggcacatttgcctcgagtactacggccgtacggtgagcatcaaaatcctgcccgtgggggtgcatatggagcagctcaagacggtgctcgggttgccggaaaccgaggccaaggtggctgagctgatggagatgtactcgggaaaggggagagtggtcatgctgggcgtcgacgacatggacatcttcaaggggatcagccttaagctgcttgccatggaggagctgctgcggcagcaccctgagtggcgggggaagctggtgctggtgcaggtcgccaacccggcgcgaggaagggggaaggacgtcgccgaggtgcagaccgagacgtacgccatggtggggcgcatcaacgaggtgtatggtgagccggggtacgagccggtggtcctgattgatgagcctttgcagttctacgagcgcgtggcctactatgtcatcgccgaggtgtgcctggtgaccgcggtcagggacggcatgaacctgattccctatgaatacatcgtctcacggcaaggcaacgagaagctggacgggatgctgcggcaggggaagccagaggagaaaaagagtatgcttgtggtgtccgagttcatcggatgctcgccgtctctgagcggcgccatccgggtgaacccgtggaacatcgaggccgtggctgacgccatggagactgcccttgtgttgcctgagaatgagaagaggttgcgtcacgataagcacttccgctacgtgagcacccacgatgtcgggtattgggctaacagcttcctcgaggaccttaagaggacctgcagtgatcattctcagagaaggtgctggggcattggctttgggctgcggttcagagtggtctcgctcgaccttcacttcaggaagctttccttggagagcattcttatggcataccggagagccaagacacgggcaattctgcttgactacgatggcacgctgatgccacaggcgattaacaagagcccctccactgaatctgttcggatcctcaatagcttgtgcggagacaagaaaaatgtggtgtacctatgcagcgggtatgaccggcgcactcttcatgagtggttcccttgtgagaaccttggcatagctgcggagcatggctacttcctgaggtgtaagagggacgcagaatggaagacctgtgtcactgctaccgactgcagctggaagcagatcgccgagccggtgatgtgcctgtacagggagacgacggatggctcaaccatcgaggacagggagacggtgctcgtctggaactacgaagatgcggaccctgacttcggctcatgccaggccaaggagctcgtcgaccaccttgagagcgtgcttgcaaatgagcctgtatcagtgaagaccacgcctcactctgttgaagtgaaaccgcagggcgtgagcaagggcttggtggctcggcgcatgctggtgtcgatgaaggaccgcggccagtgcccggacttcgtcctgtgcatcggtgacgacaagtccgacgaggacatgttccagctgattgccagtgctgcctgcggggactcgctagggtccaaggcggaggtgttcgcgtgtaccgtcggccgcaagcccagcaaggccaagtactacctcgacgacgcggcagaggtggtgaggctgatgcaggggctttcctacgtctccgaggagctggccctggcgaaccaccgggatgaagacgacgactcttctctggacgtgtgggagtag

SEQ ID NO: 15603 - protein, 862 aa, Sorghum bicolor
  misc_feature: Useful for making plants with altered carbohydrate content
  misc_feature: Functional homolog of the protein sequence given in SEQ ID NO 13884
  misc_feature: Ceres ANNOT ID no. 8642352
  misc_feature: Up-regulated in shoot tissues in response to methyl jasmonate treatment
  misc_feature (124)..(549): SWISSPROT Homolog: EC 2.4.1.15 Alpha,alpha-trehalose-phosphate synthase (UDP-forming)
  misc_feature (56)..(546): Pfam ID: Glyco_transf_20 Pfam Description: Glycosyltransferase family 20
  misc_feature (595)..(828): Pfam ID: Trehalose_PPase Pfam Description: Trehalose-phosphatase
MASRSYSNLLDLATGAADQAPAAAAISALRRRLPRVVTNPGFIDDSPASPSTPARPRTIIVANQLPIRSRRPASPEEPWTFEWDEDSLLRHLHHSSSPLMEFIYIGCLRDDIPQADQDAVAQALLETHNCVPAFLPTDIAERYYHGFCKQHLWPLFHYMLPLSPDLGGRFDRALWQAYVSANKIFADKVLEVINPDDDFVWVHDYHLMVLPTFLRKRFNRIKLGFFLHSPFPSSEIYKTLPVREELLRALLNSDLIGFHTFDYARHFLSCCGRMLGLSYESKRGHICLEYYGRTVSIKILPVGVHMEQLKTVLGLPETEAKVAELMEMYSGKGRVVMLGVDDMDIFKGISLKLLAMEELLRQHPEWRGKLVLVQVANPARGRGKDVAEVQTETYAMVGRINEVYGEPGYEPVVLIDEPLQFYERVAYYVIAEVCLVTAVRDGMNLIPYEYIVSRQGNEKLDGMLRQGKPEEKKSMLVVSEFIGCSPSLSGAIRVNPWNIEAVADAMETALVLPENEKRLRHDKHFRYVSTHDVGYWANSFLEDLKRTCSDHSQRRCWGIGFGLRFRVVSLDLHFRKLSLESILMAYRRAKTRAILLDYDGTLMPQAINKSPSTESVRILNSLCGDKKNVVYLCSGYDRRTLHEWFPCENLGIAAEHGYFLRCKRDAEWKTCVTATDCSWKQIAEPVMCLYRETTDGSTIEDRETVLVWNYEDADPDFGSCQAKELVDHLESVLANEPVSVKTTPHSVEVKPQGVSKGLVARRMLVSMKDRGQCPDFVLCIGDDKSDEDMFQLIASAACGDSLGSKAEVFACTVGRKPSKAKYYLDDAAEVVRLMQGLSYVSEELALANHRDEDDDSSLDVWE

SEQ ID NO: 15604 - DNA, 1347 bp, Sorghum bicolor
  misc_feature: Ceres ANNOT ID no. 8642390
  misc_feature: Up-regulated in shoot tissues in response to methyl jasmonate treatment
  misc_feature: Encodes the peptide sequence at SEQ ID NO 15605
atgagggagatcatcagcatccatatcgggcaggcaggcatccaggtggggaattcttgctgggagctctactgcctcgagcacggtatccagcctgatggcctcatgcccagtgacaactctgttggggttgcgagggatgcattcaacacattcttcagtgaaacgagcgcagggaagcacgttccaagggccttgtttgtcgacttggagcccactgtgattgacgaggtgaagaccggggcataccgtcagcttttccatcctgagcagctcatctcacacaaggaagatgctgcaaacaactttgcccgtggacattacacagttggaagagaagtagtagatctttgccttgatcggataagaaaattggcagacaactgcactggtcttcaaggttttctggttttcaatgctgttggtggtggaaccggctctggccttggttcgctacttttagagcgtctatccgtagattatggtaggaagtcaaagctcggtttcaccatctatccttccccacagatctcaactgctgtggtcgagccttataacagcgtgctctccacacattccctgattgaacacaccgatgttgttgtgcttcttgacaatgaagctatatatgacatatgcaagaggtcccttgacattgagcgtccaacatacaccaatctgaacaggcttatatctcaagttatatcatctctaaccacgtcactgaggtttgacggagccattaatgttgacataactgagttccagaccaaccttgttccttatccccggatacacttcatgctctcttcatatgctccaattatctcagtggagaaggcctaccatgaacaacactctgttcctgagatcacaaattctgtgtttgagccatcaagtgtgatggcaaaatgtgatcccaggcatggtaagtacatggcatgctgtttgatgtaccgtggtgatgttgtgccaaaagatgtgaatgctgctgtccattcaatcaagaccaagagagcagtgcagtttgttgactggtgccctactggcttcaagtgcgggataaactaccaaccaccaactgtagtccctggaggggacctggccaaggtgcaacgagcagtctgcatgatcagcaacaacacagctgtggctgaggtcttttcccgtattgaccgcaaatttgatctcatgtatgcgaagcgtgcattcgttcattggtatgtcggtgaagggatggaagaaggggagttctcagaggcaagggaggatcttgcggcactggagaaggattatgaggaagtcggagctgaagttgaagatgatgatgaggaagctgagtattga

SEQ ID NO: 15605 - protein, 448 aa, Sorghum bicolor
  misc_feature: Useful for making plants with altered cell wall content and/or composition
  misc_feature: Functional homolog of the protein sequence given in SEQ ID NO 14092
  misc_feature: Ceres ANNOT ID no. 8642390
  misc_feature (49)..(246): Pfam ID: Tubulin Pfam Description: Tubulin/FtsZ family, GTPase domain
  misc_feature (248)..(393): Pfam ID: Tubulin_C Pfam Description: Tubulin/FtsZ family, C-terminal domain
MREIISIHIGQAGIQVGNSCWELYCLEHGIQPDGLMPSDNSVGVARDAFNTFFSETSAGKHVPRALFVDLEPTVIDEVKTGAYRQLFHPEQLISHKEDAANNFARGHYTVGREVVDLCLDRIRKLADNCTGLQGFLVFNAVGGGTGSGLGSLLLERLSVDYGRKSKLGFTIYPSPQISTAVVEPYNSVLSTHSLIEHTDVVVLLDNEAIYDICKRSLDIERPTYTNLNRLISQVISSLTTSLRFDGAINVDITEFQTNLVPYPRIHFMLSSYAPIISVEKAYHEQHSVPEITNSVFEPSSVMAKCDPRHGKYMACCLMYRGDVVPKDVNAAVHSIKTKRAVQFVDWCPTGFKCGINYQPPTVVPGGDLAKVQRAVCMISNNTAVAEVFSRIDRKFDLMYAKRAFVHWYVGEGMEEGEFSEAREDLAALEKDYEEVGAEVEDDDEEAEY

SEQ ID NO: 15606 - DNA, 1485 bp, Sorghum bicolor
  misc_feature: Ceres ANNOT ID no. 8642384
  misc_feature: Encodes the peptide sequence at SEQ ID NO 15607
atgccgacgggcggcgtgttctccgggtcggtgaacctcaagtacgtgaagctcgggtaccagtacctggtgaaccacttcctgacgctgctgctggtgccggtgatggccgccacggcgctggagctggcgcgcctgggccccggcgagctgctctcgctgtggcggtcgctggagctggacctggtccacatcctctgctccgtgttcctcgtcgtcttcatcggcaccgtgtacgtgatgtcgcgccccaggcccgtgtacctggtggactacgcctgctacaagccccccgccagctgccgcgtgcccttcgccaccttcatggagcacacgcgcctcatcagcgacgacgacaagagcgtgcgcttccagacgaggatcctcgagcgctcggggctcggcgaggacacgtgcctcccgccagccaaccactacatcccgcccaacccgagcatggaggcgtcgcgcgccgaggcgcagctcgtcatcttctccgccatcgacgacctcgtccgacgcacggggctcaagcccaaggacatcgacatactcgtcgtcaactgcagcctcttctcgcccacgccgtcgctgtccgccatgatcatcaacaagtacaagctccgtagcaacatccggagcttcaacctgtcggggatgggatgcagtgccgggctcatctccatcgacctcgcgcgggacatgctccaggtgcacccgaactcgaacgcgctggtggtgtcgaccgagatcatcacccccaacttctaccaggggagccggcgcgacatgctgctccccaactgcctgttccggatgggcgcggcggcgatcctgctgtccaaccggcggcgcgaggcccggcgcgccaagtaccggctggtgcacgtggtgaggacgcacaagggcgcggacgaccgcgcgtaccggtgcgtgtaccaggaggaggacgaccagggcttctcgggcatctcgctgtccaaggagctgatggccatcgccggcgacgcgctcaagtccaacatcaccaccatcggcccgctggtgctccccatgtcggagcagctgctcttcttcttccgcctggtggggcgcaagctcttcaacaaggcctggaagccctacatcccggacttcaagctggcgttcgagcacttctgcatccacgcgggcggccgcgccgtcatcgacgagctgcagaagaacctgcagctgtcgccgcgccacgtggaggcgtcccgcatgacgctgcaccgcttcggcaacacctccagcagctccctctggtacgagctcgcctacatcgaggccaagggccggatgcgccgcggcgaccgcgtctggcagatcggattcggcagcgggttcaagtgcaacagcgccgtgtggaagtgcctccgcagcatcaagacgcccaccaacgggccctgggacgactgcatccaccgctaccccgtcgacgtcccggaggtcgtcaagctgtga

SEQ ID NO: 15607 - protein, 494 aa, Sorghum bicolor
  misc_feature: The sequence is a functional homolog of SEQ ID NO 2 in US patent 7038112
  misc_feature: Ceres ANNOT ID no. 8642384
  misc_feature: Up-regulated in shoot tissues in response to methyl jasmonate treatment
  misc_feature (7)..(491): SWISSPROT Homolog: EC 2.3.1.119 Icosanoyl-CoA synthase
  misc_feature (79)..(367): Pfam ID: FAE1_CUT1_RppA Pfam Description: FAE1/Type III polyketide synthase-like protein
  misc_feature (381)..(465): Pfam ID: ACP_syn_III_C Pfam Description: 3-Oxoacyl-[acyl-carrier-protein (ACP)] synthase III C terminal
MPTGGVFSGSVNLKYVKLGYQYLVNHFLTLLLVPVMAATALELARLGPGELLSLWRSLELDLVHILCSVFLVVFIGTVYVMSRPRPVYLVDYACYKPPASCRVPFATFMEHTRLISDDDKSVRFQTRILERSGLGEDTCLPPANHYIPPNPSMEASRAEAQLVIFSAIDDLVRRTGLKPKDIDILVVNCSLFSPTPSLSAMIINKYKLRSNIRSFNLSGMGCSAGLISIDLARDMLQVHPNSNALVVSTEIITPNFYQGSRRDMLLPNCLFRMGAAAILLSNRRREARRAKYRLVHVVRTHKGADDRAYRCVYQEEDDQGFSGISLSKELMAIAGDALKSNITTIGPLVLPMSEQLLFFFRLVGRKLFNKAWKPYIPDFKLAFEHFCIHAGGRAVIDELQKNLQLSPRHVEASRMTLHRFGNTSSSSLWYELAYIEAKGRMRRGDRVWQIGFGSGFKCNSAVWKCLRSIKTPTNGPWDDCIHRYPVDVPEVVKL

SEQ ID NO: 15608 - DNA, 1509 bp, Sorghum bicolor
  misc_feature: Ceres ANNOT ID no. 8642380
  misc_feature: Up-regulated in shoot tissues in response to methyl jasmonate treatment
  misc_feature: Encodes the peptide sequence at SEQ ID NO 15609
atgaagaagctgttcttcgtctccttcgtcctcctgctggccgctccagcagttcacggtgaagatggtgcgtacattggcgtgaacattggcacggccatgtcgtcggtgccagcgccgacgcagatcaccacgctactccgctcgcagaacatccgccacgtccgcctctacgacgccgacccagcgatgctggcggcgctgtccaacaccggcatccgcgtcatcgtgtcggtgccgaacgagcagctgctggccatcggcaactccaacgcgacggcggccaactgggtggcgcgcaacgtggccgcgcacttccccgccgtgaacatcacggccatcgcggtgggctccgaggtgctgtcggcgcagcccaacgcggcgccgctgctgatgcccgccatgcgctacctccagaacgcgctggtggccgcggcgctggaccggtacatcaagatctcgacgccgcactcgtcgtccatcatcctcgactcgttcccgccgtcgcaggccttcttcaaccggtcgctggacaacgtgctggtgccgatgctcaagttcctgcagtccacggggtcgcctctcatgctcaacgtgtacccgtactacgactacatgcgctccaacggcgtgatcccgctggactacgcgctgttccggccgctgccgcccaacaaggaggccgtggacgccaacaccttgctgcactacaccaacgtgttcgacgcggtggtggacgccgcctacttcgccatggcgtacctcaacgttaccaacgttccggtgatggtgacggagaccgggtggccgcacaagggcgacccgtcctcggagcccgacgccacctccgacaacgccgacacctacaacagcaacctcatccggcacgtgatgaacagcaccggcacgcccaagcaccccggggtggccgtgccgacctacatctacgagctgtacgacgaggacacccggcctggctccacgtcggagaagtactggggcctcttcgacatgaacggcgtcccggcctacaccctgcacctgacgggctccggcgtcctgctggccaacgacacgacgaaccagacctactgcgtggcgcgcgacggcgcggaccccaagatgctgcaggcggcgctggactgggcgtgcggccccgggaaggtggactgctccgtgctgatgcagggccagccttgctacgacccggacaccgtggaggcgcacgccacgtacgccttcaacgcctactaccacggcatgggtatgggctcggggacctgctacttcagcggcgtcgcggtggtgaccacgaccgacccaagtcacgggtcttgtgtttactctgggaagaacgcgacggcgttgatgaacggcacgtcgctggcgccgtcgtcgaactccacggagggaggctccggcgcgcaccgggcgttcggcgacgtctcgtcactcgcccgcatcgtctccaccgcgctgctcttcagcgtcggcctcctcctgttgtag

SEQ ID NO: 15609 - protein, 502 aa, Sorghum bicolor
  misc_feature: Useful for making plants with altered carbohydrate content
  misc_feature: Functional homolog of the protein sequence given in SEQ ID NO 14231
  misc_feature: Useful for making plants with altered cell wall content and/or composition
  misc_feature: Functional homolog of the protein sequence given in SEQ ID NO 14232
  misc_feature: Ceres ANNOT ID no. 8642380
  misc_feature (25)..(448): SWISSPROT Homolog: EC 3.2.1.39 Glucan endo-1,3-beta-D-glucosidase
  misc_feature (26)..(348): Pfam ID: Glyco_hydro_17 Pfam Description: Glycosyl hydrolases family 17
  misc_feature (363)..(448): Pfam ID: X8 Pfam Description: X8 domain
MKKLFFVSFVLLLAAPAVHGEDGAYIGVNIGTAMSSVPAPTQITTLLRSQNIRHVRLYDADPAMLAALSNTGIRVIVSVPNEQLLAIGNSNATAANWVARNVAAHFPAVNITAIAVGSEVLSAQPNAAPLLMPAMRYLQNALVAAALDRYIKISTPHSSSIILDSFPPSQAFFNRSLDNVLVPMLKFLQSTGSPLMLNVYPYYDYMRSNGVIPLDYALFRPLPPNKEAVDANTLLHYTNVFDAVVDAAYFAMAYLNVTNVPVMVTETGWPHKGDPSSEPDATSDNADTYNSNLIRHVMNSTGTPKHPGVAVPTYIYELYDEDTRPGSTSEKYWGLFDMNGVPAYTLHLTGSGVLLANDTTNQTYCVARDGADPKMLQAALDWACGPGKVDCSVLMQGQPCYDPDTVEAHATYAFNAYYHGMGMGSGTCYFSGVAVVTTTDPSHGSCVYSGKNATALMNGTSLAPSSNSTEGGSGAHRAFGDVSSLARIVSTALLFSVGLLLL

SEQ ID NO: 15610 - DNA, 1308 bp, Sorghum bicolor
  misc_feature: Ceres ANNOT ID no. 8642405
  misc_feature: Encodes the peptide sequence at SEQ ID NO 15611
atgggtcccgcgaggcttcccctagcctgcatcgtcaccacgttgatctttgtctacatgctagtacaccacggcgccagttcgcaggaagttttcccggaggctgacggcccggcagcagagaattcagacgagctgtggctcaggtccggaccgccgccgagggtcgtcgacgtcgatgactacggagccggagatgccggcggcgaccacgtcaccgaggcgtttctcgaggcgtggagcgaggcctgcaactcctccgatgaccggtccgtgttcctcgtgcccgagggcaaggcctacctcctgatgcccgtcatcttccgtggcccctgcagagctgtctcgatcactgcgatgataaagggaacgctggaggcgccgtccaaccgatcggtctggctggatcaggatctgcaggagtggatcacgttcgagggcatcgatcgcctccgtgtcctcggcggcggcaccctcgatggcaacgggcttcagtggtggatcaactcgtgcaagctcaacaaatcaatgcgatgcgtcatcggtgtttcagctgccgagtttcaggcactgtacttcaggaggtgcacccacctggtggtggaggagctggaggtgagagacagcatgcagatgcacgtcgcgatcgcctactcgtggaacgtggtcgtgtcgaagctgctcatcactgcaccggggtggagccccaacaccgacggcatccatgtgtccaacagcagggaagtgtccataagcaagtgcaccatcagcacaggggatgactgtatatccattgtgactggatcaatgtttgtacgggtaaccagcatattttgcggaccgggccatggaataagcattggtagtctaggagcaaacaactcttgggcccatgtctctgatgtcctcgttgagaaagccacgctgctgggcactaccaacggtgtgaggatcaaaacttggcagggaggacatggctatgctgaaagaattagcttccaagatatatcaatgcacaacgttactaacccaataattatcgatcagaactactgtgactccaagagaccttgtcatgaacagggatcagcggttgccgtacgcaatatacgctacagaaacatacatggaactagtgcttcaaaagtcgccgtcaattttatttgcagtggcgctctgcactgtgatggtatactaatgcaagatatttatttggttggagaaggaagatatgctacatgttcttatacgaacgctacagttgtacaatttgggtataacttccctttttgcagtgcagagatgtag

SEQ ID NO: 15611 - protein, 435 aa, Sorghum bicolor
  misc_feature: Useful for making plants with altered carbohydrate content
  misc_feature: Functional homolog of the protein sequence given in SEQ ID NO 13985
  misc_feature: Ceres ANNOT ID no. 8642405
  misc_feature (73)..(434): SWISSPROT Homolog: EC 3.2.1.15 Polygalacturonase
  misc_feature (84)..(432): Pfam ID: Glyco_hydro_28 Pfam Description: Glycosyl hydrolases family 28
MGPARLPLACIVTTLIFVYMLVHHGASSQEVFPEADGPAAENSDELWLRSGPPPRVVDVDDYGAGDAGGDHVTEAFLEAWSEACNSSDDRSVFLVPEGKAYLLMPVIFRGPCRAVSITAMIKGTLEAPSNRSVWLDQDLQEWITFEGIDRLRVLGGGTLDGNGLQWWINSCKLNKSMRCVIGVSAAEFQALYFRRCTHLVVEELEVRDSMQMHVAIAYSWNVVVSKLLITAPGWSPNTDGIHVSNSREVSISKCTISTGDDCISIVTGSMFVRVTSIFCGPGHGISIGSLGANNSWAHVSDVLVEKATLLGTTNGVRIKTWQGGHGYAERISFQDISMHNVTNPIIIDQNYCDSKRPCHEQGSAVAVRNIRYRNIHGTSASKVAVNFICSGALHCDGILMQDIYLVGEGRYATCSYTNATVVQFGYNFPFCSAEM

SEQ ID NO: 15612 - DNA, 1698 bp, Sorghum bicolor
  misc_feature: Ceres ANNOT ID no. 8642407
  misc_feature: Encodes the peptide sequence at SEQ ID NO 15613
atggaggacaacggtgccgctgccgccaacgctgctccagcgacgagcatgctgccagctgccgagaagcacgtggcgatccctgatgacgccgcggcggcggcggcagctacgaacgctaccgccggcgaggagaacaaggtggaggaggaggacgcgccggagcccgcattattggcctgcgggccgaggaagacggggctccatcttttcgtcatgaacatcaggagcgtcttcaagctcgacgacctcggatcggaggtgctccgcattgcagtgcccgcctcgctcgctttggcggccgatccgctcgcctccttggtggacacggcgttcatcggccgtttaggttcggtggagattgccgctgttggtgtttcaatcgccatatttaaccaggtctcgaaagtctgtatctaccctcttgttagcgttacaacatcatttgtcgcggaggaagacgctatcatcagtaaagctatcgaagaaaagagcagtcaagacctggagaaagcttcccatgtggattcagaaaccaacaatttgcctgcatctggtcctgatttggcagaatgcgtgaactcatgcatccccacagagtgtacagatctccccaaccaagggtgcaagaagaggtacataccatcggtcacgtcagcactaatagttggttcaattctcggactgcttcaggctgtcttcctggttttttcagcgaaatttgtactaaacatcatgggtgttaaatctggatccccaatgcaaaaacctgcagttcgctacctaacaataagatctcttggtgcccctgctgtgctattgtctctggccatgcaaggggttttccggggattcaaggacacgaagacaccattatatgctactgtggtcggggacgcggcgaacatcatactagacccaattttgatgtttgtttgccatatgggcgtcactggtgcagctattgctcatgttgtttctcagtacctgataacattgatattgttgtgccggctcgtccagcaagttgatgttatcccacctagcattaaatctctgaaatttgggcgatttcttggatgtggattcctactgcttgcaagggttgttgcggtgacgttctgcgtcacgttggcggcgtccctggctgctcgccatggaccaaccatcatggcaggcttccaaatctgctgtcagctctggctggccacatctctccttgccgatggattggccgtggcaggacaggcagtgcttgcaagtgcgtttgccaagaatgacaagaagaaggttgttgccgcgacgtcccgtgtgttgcagctgagcattgtcctgggcatgggtctcactgtcgtgctgggacttgctatgaggttcggggctggcattttcacaagcgacctgcccgtgatcgaagtcattcacaaaggcatcccgtttgttgccggcacacagaccatcaattccctggccttcgtgtttgatggcatcaactttggagcatcagactacacatactctgcttactccatggttgctgttgcgtccgtgtcgataccatgcttggtgtacctttctgtgcataacggattcatcggtatatggatcgcattgacgatctacatgagcctgaggaccatagctagcacctggaggatgggggcagccaggggaccatggaagtttctccggaagtga

SEQ ID NO: 15613 - protein, 565 aa, Sorghum bicolor
  misc_feature: The sequence is a functional homolog of SEQ ID NO 3 in US patent 7189891
  misc_feature: Ceres ANNOT ID no. 8642407
  misc_feature (94)..(308): Pfam ID: MatE Pfam Description: MatE
  misc_feature (365)..(524): Pfam ID: MatE Pfam Description: MatE
MEDNGAAAANAAPATSMLPAAEKHVAIPDDAAAAAAATNATAGEENKVEEEDAPEPALLACGPRKTGLHLFVMNIRSVFKLDDLGSEVLRIAVPASLALAADPLASLVDTAFIGRLGSVEIAAVGVSIAIFNQVSKVCIYPLVSVTTSFVAEEDAIISKAIEEKSSQDLEKASHVDSETNNLPASGPDLAECVNSCIPTECTDLPNQGCKKRYIPSVTSALIVGSILGLLQAVFLVFSAKFVLNIMGVKSGSPMQKPAVRYLTIRSLGAPAVLLSLAMQGVFRGFKDTKTPLYATVVGDAANIILDPILMFVCHMGVTGAAIAHVVSQYLITLILLCRLVQQVDVIPPSIKSLKFGRFLGCGFLLLARVVAVTFCVTLAASLAARHGPTIMAGFQICCQLWLATSLLADGLAVAGQAVLASAFAKNDKKKVVAATSRVLQLSIVLGMGLTVVLGLAMRFGAGIFTSDLPVIEVIHKGIPFVAGTQTINSLAFVFDGINFGASDYTYSAYSMVAVASVSIPCLVYLSVHNGFIGIWIALTIYMSLRTIASTWRMGAARGPWKFLRK

SEQ ID NO: 15614 - DNA, 588 bp, Sorghum bicolor
  misc_feature: Ceres ANNOT ID no. 8642423
  misc_feature: Encodes the peptide sequence at SEQ ID NO 15615
atggacatggtttcgcagtccgagcacctgtgctacgtccgctgcacctactgcaacaccgtgctcgcggttggggttccatgcaagaggctgatggacacggtgactgtcaagtgcggccactgcaacaacctctcctacctcagtccacggccccccatggtgcagccgctctcgccgactgatcaccccttggggccattccagtgtcagggaccctgcaatgactgcaggaggaaccaaccgctgccgctggcctcgccgacatcaactgagctcagcccgagaatgcctttcgttgtcaagcccccggagaagaaacaccgcctcccatctgcttacaatcgcttcatgagggaggagattcagcgcatcaaagctgcgaagccagatatccctcacagggaggccttcagcatggctgccaagaattgggcgaagtgcgacccgcgctgctcgacgactgcctctactgccacttccaacagcgctccagaacctagagttgtgcccactcctcaggatagggccaaggagcaagtcattgagagcttcgacatcttcaagcagattgagcgcagcatctag

SEQ ID NO: 15615 - protein, 195 aa, Sorghum bicolor
  misc_feature: Useful for biocontainment applications
  misc_feature: Functional homolog of the protein sequence given in SEQ ID NO 14233
  misc_feature: The sequence is a functional homolog of SEQ ID NO 1152 in the 10/666,642 US patent application
  misc_feature: Useful for making plants with modulated flowering time
  misc_feature: Functional homolog of the protein sequence given in SEQ ID NO 14234
  misc_feature: The sequence is a functional homolog of SEQ ID NO 1151 in the 10/666,642 US patent application
  misc_feature: Ceres ANNOT ID no. 8642423
  misc_feature (1)..(148): Pfam ID: YABBY Pfam Description: YABBY protein
MDMVSQSEHLCYVRCTYCNTVLAVGVPCKRLMDTVTVKCGHCNNLSYLSPRPPMVQPLSPTDHPLGPFQCQGPCNDCRRNQPLPLASPTSTELSPRMPFVVKPPEKKHRLPSAYNRFMREEIQRIKAAKPDIPHREAFSMAAKNWAKCDPRCSTTASTATSNSAPEPRVVPTPQDRAKEQVIESFDIFKQIERSI

SEQ ID NO: 15616 - DNA, 1095 bp, Sorghum bicolor
  misc_feature: Ceres ANNOT ID no. 8642436
  misc_feature: Encodes the peptide sequence at SEQ ID NO 15617
atggcctgcactacggcagcatccctgcagcatgacaaggccaacgacgacgaggcgtgcatgtacgcccaggagctcctgttcagcttcatcgtgcccatgacactcaaggcggtcatcgagctcggcctcatcgactacctcctcgccgccgacggccgctctgtgaccccggaggagctggcggcggagtggccgcagtcagccgaggcggccgccgcggtggaccgcatgatgcggctcctcgcgtcgcacagcgtcgtcaggtgcacgacggaggtggggccggatgggaaggcccgccggagctatgccgcggcgccggtgtgcaagtggctcgccactcggaacgccggcggacagggctccttggctcctatggggctgatgaacctaaacaaggcgttcatggaaacctggtactttatgaaggaggccgtgacggagggagcgacaccgaccgagaaggcctacggcatgccgctgttcgagcacctggggtcggacgaggcgtccaacacgctcttcaaccaggcaatggccggccactcggagatgataatcaagaagctgctcgaggtttaccgcggcttcgaaggcgtcgacgtgctcgtcgacgtcggcggcggcaccggctccacgctgcgcatggtcaccgcccagtataagcatctgagaggcgtcaactacgacctcccccacgtcatcgcgcaggcgccgccggtgcaaggtgtggaacatgtaggtggcagcatgtttgagtacattccgagcggaaatgcaattctgttgaagtggattctccacctgtggcgcgacgatgagtgcgtgaagatcctcaagaactgccaccgggcgctcccggcgaacgggaaggtgatcgtggtggagtacgtgctgccggcgagtccggagccgacgcaggttgcgcaggtctcgttgctcctggacgtggcgatgctgaaccgcctcaggggcgccaaggagcggacggagcaggagttcgcccagctggccgcggaggccggcttctccggcgggtgcagggccacctacgtcttcgcctccgcctgggcgctcgagttcaccaagtag

SEQ ID NO: 15617 - protein, 364 aa, Sorghum bicolor
  misc_feature: Useful for making plants with altered carbohydrate content
  misc_feature: Functional homolog of the protein sequence given in SEQ ID NO 14235
  misc_feature: Ceres ANNOT ID no. 8642436
  misc_feature (4)..(364): SWISSPROT Homolog: EC 2.1.1.76 Quercetin 3-O-methyltransferase
  misc_feature (93)..(340): Pfam ID: Methyltransf_2 Pfam Description: O-methyltransferase
  misc_feature (34)..(83): Pfam ID: Dimerisation Pfam Description: Dimerisation domain
MACTTAASLQHDKANDDEACMYAQELLFSFIVPMTLKAVIELGLIDYLLAADGRSVTPEELAAEWPQSAEAAAAVDRMMRLLASHSVVRCTTEVGPDGKARRSYAAAPVCKWLATRNAGGQGSLAPMGLMNLNKAFMETWYFMKEAVTEGATPTEKAYGMPLFEHLGSDEASNTLFNQAMAGHSEMIIKKLLEVYRGFEGVDVLVDVGGGTGSTLRMVTAQYKHLRGVNYDLPHVIAQAPPVQGVEHVGGSMFEYIPSGNAILLKWILHLWRDDECVKILKNCHRALPANGKVIVVEYVLPASPEPTQVAQVSLLLDVAMLNRLRGAKERTEQEFAQLAAEAGFSGGCRATYVFASAWALEFTK

SEQ ID NO: 15618 - DNA, 297 bp, Sorghum bicolor
  misc_feature: Ceres ANNOT ID no. 8642421
  misc_feature: Encodes the peptide sequence at SEQ ID NO 15619
atgggtcgcggcaaggtggagctgaagcggatcgagaacaagatcagccggcaggtgacgttcgccaagcgccggaacgggctgctcaagaaggcgtacgagctgtcgctgctgtgcgacgccgaggtcgcgctcatcatcttctccggccgcggccgcctcttcgagttctccagctcgtcatgttcatcatcaaaacttaggttttttcttcaccacaactacgtaaaattatatacatatgcatactacagttcttccacttcccaaggtagatctcgtgagcttgatggatag

SEQ ID NO: 15619 - protein, 98 aa, Sorghum bicolor
  misc_feature: Useful for making plants with modulated biomass
  misc_feature: Functional homolog of the protein sequence given in SEQ ID NO 13659
  misc_feature: The sequence is a functional homolog of SEQ ID NO 36 in the 10/666,642 US patent application
  misc_feature: The sequence is a functional homolog of SEQ ID NO 60 in the 10/412,699 US patent application
  misc_feature: Useful for making plants with altered alkaloid content
  misc_feature: Useful for making plants with altered terpenoid content
  misc_feature: Useful for making plants with modulated flowering time
  misc_feature: Functional homolog of the protein sequence given in SEQ ID NO 13021
  misc_feature: The sequence is a functional homolog of SEQ ID NO 4 in US patent 7057087
  misc_feature: The sequence is a functional homolog of SEQ ID NO 28 in the 10/666,642 US patent application
  misc_feature: The sequence is a functional homolog of SEQ ID NO 707 in the 10/666,642 US patent application
  misc_feature: The sequence is a functional homolog of SEQ ID NO 30 in the 10/666,642 US patent application
  misc_feature: The sequence is a functional homolog of SEQ ID NO 1362 in the 10/666,642 US patent application
  misc_feature: The sequence is a functional homolog of SEQ ID NO 199 in the 11/479,226 US patent application
  misc_feature: The sequence is a functional homolog of SEQ ID NO 34 in the 10/666,642 US patent application
  misc_feature: The sequence is a functional homolog of SEQ ID NO 58 in the 10/412,699 US patent application
  misc_feature: Useful for biocontainment applications
  misc_feature: Functional homolog of the protein sequence given in SEQ ID NO 14236
  misc_feature: Useful for making plants with altered lignin content
  misc_feature: Functional homolog of the protein sequence given in SEQ ID NO 13528
  misc_feature: The sequence is a functional homolog of SEQ ID NO 6 in US patent 7279615
  misc_feature: The sequence is a functional homolog of SEQ ID NO 14 in the 10/666,642 US patent application
  misc_feature: The sequence is a functional homolog of SEQ ID NO 46 in the 10/666,642 US patent application
  misc_feature: The sequence is a functional homolog of SEQ ID NO 32 in the 10/666,642 US patent application
  misc_feature: The sequence is a functional homolog of SEQ ID NO 203 in the 11/479,226 US patent application
  misc_feature: The sequence is a functional homolog of SEQ ID NO 40 in the 10/666,642 US patent application
  misc_feature: The sequence is a functional homolog of SEQ ID NO 1360 in the 10/666,642 US patent application
  misc_feature: The sequence is a functional homolog of SEQ ID NO 22 in the 10/666,642 US patent application
  misc_feature: The sequence is a functional homolog of SEQ ID NO 731 in the 10/666,642 US patent application
  misc_feature: Useful for making plants with modulated phosphate use efficiency
  misc_feature: Functional homolog of the protein sequence given in SEQ ID NO 13166
  misc_feature: The sequence is a functional homolog of SEQ ID NO 2 in US patent 7273968
  misc_feature: The sequence is a functional homolog of SEQ ID NO 730 in the 10/666,642 US patent application
  misc_feature: The sequence is a functional homolog of SEQ ID NO 1364 in the 10/666,642 US patent application
  misc_feature: The sequence is a functional homolog of SEQ ID NO 1728 in the 10/412,699 US patent application
  misc_feature: The sequence is a functional homolog of SEQ ID NO 164 in the 10/666,642 US patent application
  misc_feature: The sequence is a functional homolog of SEQ ID NO 642 in the 11/435,388 US patent application
  misc_feature: The sequence is a functional homolog of SEQ ID NO 122 in the 10/666,642 US patent application
  misc_feature: The sequence is a functional homolog of SEQ ID NO 406 in the 10/412,699 US patent application
  misc_feature: The sequence is a functional homolog of SEQ ID NO 1368 in the 10/666,642 US patent application
  misc_feature: The sequence is a functional homolog of SEQ ID NO 422 in the 11/435,388 US patent application
  misc_feature: The sequence is a functional homolog of SEQ ID NO 42 in the 10/666,642 US patent application
  misc_feature: The sequence is a functional homolog of SEQ ID NO 428 in the 10/666,642 US patent application
  misc_feature: The sequence is a functional homolog of SEQ ID NO 892 in the 11/435,388 US patent application
  misc_feature: The sequence is a functional homolog of SEQ ID NO 1243 in the 11/479,226 US patent application
  misc_feature: The sequence is a functional homolog of SEQ ID NO 1420 in the 10/666,642 US patent application
  misc_feature: The sequence is a functional homolog of SEQ ID NO 1814 in the 10/412,699 US patent application
  misc_feature: The sequence is a functional homolog of SEQ ID NO 570 in the 10/412,699 US patent application
  misc_feature: The sequence is a functional homolog of SEQ ID NO 1971 in the 10/412,699 US patent application
  misc_feature: The sequence is a functional homolog of SEQ ID NO 2191 in the 10/666,642 US patent application
  misc_feature: The sequence is a functional homolog of SEQ ID NO 1701 in the 10/412,699 US patent application
  misc_feature: The sequence is a functional homolog of SEQ ID NO 1468 in the 10/666,642 US patent application
  misc_feature: The sequence is a functional homolog of SEQ ID NO 282 in the 10/666,642 US patent application
  misc_feature: The sequence is a functional homolog of SEQ ID NO 2197 in the 10/666,642 US patent application
  misc_feature: The sequence is a functional homolog of SEQ ID NO 2189 in the 10/666,642 US patent application
  misc_feature: The sequence is a functional homolog of SEQ ID NO 2199 in the 10/666,642 US patent application
  misc_feature: The sequence is a functional homolog of SEQ ID NO 14 in the 10/374,780 US patent application
  misc_feature: The sequence is a functional homolog of SEQ ID NO 328 in the 10/225,066 US patent application
  misc_feature: The sequence is a functional homolog of SEQ ID NO 34 in the 10/286,264 US patent application
  misc_feature: The sequence is a functional homolog of SEQ ID NO 468 in the 11/435,388 US patent application
  misc_feature: The sequence is a functional homolog of SEQ ID NO 68 in the 10/412,699 US patent application
  misc_feature: The sequence is a functional homolog of SEQ ID NO 2232 in the 10/374,780 US patent application
  misc_feature: The sequence is a functional homolog of SEQ ID NO 232 in the 10/225,068 US patent application
  misc_feature: The sequence is a functional homolog of SEQ ID NO 310 in the 10/225,066 US patent application
  misc_feature: The sequence is a functional homolog of SEQ ID NO 729 in the 10/666,642 US patent application
  misc_feature: The sequence is a functional homolog of SEQ ID NO 2193 in the 10/666,642 US patent application
  misc_feature: The sequence is a functional homolog of SEQ ID NO 1732 in the 10/412,699 US patent application
  misc_feature: The sequence is a functional homolog of SEQ ID NO 44 in the 10/666,642 US patent application
  misc_feature: The sequence is a functional homolog of SEQ ID NO 66 in the 10/412,699 US patent application
  misc_feature: The sequence is a functional homolog of SEQ ID NO 2195 in the 10/666,642 US patent application
  misc_feature: The sequence is a functional homolog of SEQ ID NO 919 in the 10/666,642 US patent application
  misc_feature: The sequence is a functional homolog of SEQ ID NO 1702 in the 10/412,699 US patent application
  misc_feature: The sequence is a functional homolog of SEQ ID NO 715 in the 10/666,642 US patent application
  misc_feature: The sequence is a functional homolog of SEQ ID NO 1967 in the 10/412,699 US patent application
  misc_feature: The sequence is a functional homolog of SEQ ID NO 1961 in the 10/412,699 US patent application
  misc_feature: The sequence is a functional homolog of SEQ ID NO 1884 in the 10/412,699 US patent application
  misc_feature: The sequence is a functional homolog of SEQ ID NO 352 in the 10/374,780 US patent application
  misc_feature: The sequence is a functional homolog of SEQ ID NO 384 in the 10/225,066 US patent application
  misc_feature: The sequence is a functional homolog of SEQ ID NO 946 in the 10/412,699 US patent application
  misc_feature: The sequence is a functional homolog of SEQ ID NO 1965 in the 10/412,699 US patent application
  misc_feature: The sequence is a functional homolog of SEQ ID NO 1963 in the 10/412,699 US patent application
  misc_feature: The sequence is a functional homolog of SEQ ID NO 1470 in the 10/666,642 US patent application
  misc_feature: The sequence is a functional homolog of SEQ ID NO 284 in the 10/666,642 US patent application
  misc_feature: The sequence is a functional homolog of SEQ ID NO 1973 in the 10/412,699 US patent application
  misc_feature: The sequence is a functional homolog of SEQ ID NO 1110 in the 10/225,066 US patent application
  misc_feature: The sequence is a functional homolog of SEQ ID NO 166 in the 10/374,780 US patent application
  misc_feature: The sequence is a functional homolog of SEQ ID NO 1812 in the 10/412,699 US patent application
  misc_feature: The sequence is a functional homolog of SEQ ID NO 568 in the 10/412,699 US patent application
  misc_feature: The sequence is a functional homolog of SEQ ID NO 1945 in the 10/412,699 US patent application
  misc_feature: The sequence is a functional homolog of SEQ ID NO 1947 in the 10/412,699 US patent application
  misc_feature: The sequence is a functional homolog of SEQ ID NO 122 in the 10/225,066 US patent application
  misc_feature: The sequence is a functional homolog of SEQ ID NO 234 in the 10/374,780 US patent application
  misc_feature: The sequence is a functional homolog of SEQ ID NO 1951 in the 10/412,699 US patent application
  misc_feature: The sequence is a functional homolog of SEQ ID NO 1460 in the 10/666,642 US patent application
  misc_feature: The sequence is a functional homolog of SEQ ID NO 938 in the 10/412,699 US patent application
  misc_feature: The sequence is a functional homolog of SEQ ID NO 2064 in the 10/374,780 US patent application
  misc_feature: The sequence is a functional homolog of SEQ ID NO 572 in the 10/412,699 US patent application
  misc_feature: The sequence is a functional homolog of SEQ ID NO 816 in the 10/225,066 US patent application
  misc_feature: The sequence is a functional homolog of SEQ ID NO 1949 in the 10/412,699 US patent application
  misc_feature: The sequence is a functional homolog of SEQ ID NO 1454 in the 10/374,780 US patent application
  misc_feature: The sequence is a functional homolog of SEQ ID NO 1056 in the 10/225,066 US patent application
  misc_feature: The sequence is a functional homolog of SEQ ID NO 1882 in the 10/412,699 US patent application
  misc_feature: The sequence is a functional homolog of SEQ ID NO 350 in the 10/374,780 US patent application
  misc_feature: The sequence is a functional homolog of SEQ ID NO 944 in the 10/412,699 US patent application
  misc_feature: The sequence is a functional homolog of SEQ ID NO 1955 in the 10/412,699 US patent application
  misc_feature: The sequence is a functional homolog of SEQ ID NO 1366 in the 10/666,642 US patent application
  misc_feature: The sequence is a functional homolog of SEQ ID NO 1730 in the 10/412,699 US patent application
  misc_feature: The sequence is a functional homolog of SEQ ID NO 207 in the 11/479,226 US patent application
  misc_feature: The sequence is a functional homolog of SEQ ID NO 64 in the 10/412,699 US patent application
  misc_feature: The sequence is a functional homolog of SEQ ID NO 1953 in the 10/412,699 US patent application
  misc_feature: The sequence is a functional homolog of SEQ ID NO 2 in US patent 7049489
  misc_feature: Useful for making plants with modulated nitrogen use efficiency
  misc_feature: Functional homolog of the protein sequence given in SEQ ID NO 12982
  misc_feature: The sequence is a functional homolog of SEQ ID NO 4 in US patent 7303918
  misc_feature: The sequence is a functional homolog of SEQ ID NO 1957 in the 10/412,699 US patent application
  misc_feature: The sequence is a functional homolog of SEQ ID NO 1959 in the 10/412,699 US patent application
  misc_feature: The sequence is a functional homolog of SEQ ID NO 1886 in the 10/412,699 US patent application
  misc_feature: The sequence is a functional homolog of SEQ ID NO 2146 in the 10/374,780 US patent application
  misc_feature: The sequence is a functional homolog of SEQ ID NO 948 in the 10/412,699 US patent application
  misc_feature: The sequence is a functional homolog of SEQ ID NO 1969 in the 10/412,699 US patent application
  misc_feature: The sequence is a functional homolog of SEQ ID NO 1453 in the 10/374,780 US patent application
  misc_feature: The sequence is a functional homolog of SEQ ID NO 216 in the 10/225,066 US patent application
  misc_feature: The sequence is a functional homolog of SEQ ID NO 2454 in the 10/374,780 US patent application
  misc_feature: The sequence is a functional homolog of SEQ ID NO 118 in the 11/375,241 US patent application
  misc_feature: The sequence is a functional homolog of SEQ ID NO 2234 in the 10/374,780 US patent application
  misc_feature: The sequence is a functional homolog of SEQ ID NO 2822 in the 10/374,780 US patent application
  misc_feature: The sequence is a functional homolog of SEQ ID NO 82 in the 11/375,241 US patent application
  misc_feature: Ceres ANNOT ID no. 8642421
  misc_feature (9)..(59): Pfam ID: SRF-TF Pfam Description: SRF-type transcription factor (DNA-binding and dimerisation domain)
MGRGKVELKRIENKISRQVTFAKRRNGLLKKAYELSLLCDAEVALIIFSGRGRLFEFSSSSCSSSKLRFFLHHNYVKLYTYAYYSSSTSQGRSRELDG

SEQ ID NO: 15620 - DNA, 1518 bp, Sorghum bicolor
  misc_feature: Ceres ANNOT ID no. 8642463
  misc_feature: Encodes the peptide sequence at SEQ ID NO 15621
atggggagtgggcgacgcaccatgccgcccgtggtggtgcttcttcttcttctcgtcgtcctcggcgtgtcgctgcaaggacgatgcactgcgcagggcgggggagggctcacgcgggggagcttccccaagggcttcgtcttcggcaccgccgccgccgcttaccagtacgagggagccgtcacgacggatggcagaggacggacaatctgggacacgtttgcacacacttttggcaagatctcggacttcagcaatgcggatgttgcagttgatcagtaccaccgtttcgaggaggacgtgcagctcatggcggacatgggaatggatgcgtatcgcttctccattgcctggtcaagaattttgccaaatggtacgggccaagtcaatcaggctggcattgaccactacaacaaagtgatcaatgcactactatccaaaggaattcagccatatgtaacactgtaccactgggacctccctcaggcactggaagacagtaatgactttgcggcgtatgctgagacatgcttcaaggcgtttggagaccgtgtgaaacactggatcacgctcaatgagccgcacacggttgccattcaaggctacgatgctgggcttcacgcgccagggcgttgttcggtgctgctccatctatactgcaagtcagggaactctggcactgagccctacatcgttgctcacaacttcatcttagctcatgccaccgtttcagacatctacaggagaaaatataaggcagctcagaatggtgaacttgggatcgcatttgacgtcatctggtacgaacctatgacaaacagcacgattgacattgaagctaccaaaagggcacaagagtttcagctaggatggttcgcggaaccgttcttcttcggagattacccggcgacgatgagaactcgggttggagaaagactgcccaagttcacggcagatgaagctactcttgtcaagggggctctggacttcatgggcataaaccactacaccactttctacacgaggcataacgaaaccaacatcatcggacgactgctgaatgacactttggcagacaccggaaccatcagccttcccttcgacaagaatgggaaacccattggagacagggctaattcgatatggttgtacatcgtacccagcgggataagaaagctgatgaactatgtcaaggagaggtacaatagcccgacggtttacatcaccgaaaacgggatggacgacggcaacagccctttcacttccatccaggacgcgctcaaggacaaaaagagaatcaagtaccacaacgactacctcagcaacgttgctgcctccataaaggaggacgggtgcgatgtgcgtgggtatttcgcgtggtcgctgctggacaactgggaatgggcggccgggtacagttcgagatttgggctctacttcgtggactacaaggataatctcaagaggtaccccaagaactcggtgcagtggttcaaaaccctgctgagctccagctga

SEQ ID NO: 15621 - protein, 505 aa, Sorghum bicolor
  misc_feature: Useful for making plants with altered carbohydrate content
  misc_feature: Functional homolog of the protein sequence given in SEQ ID NO 14124
  misc_feature: Useful for making plants with altered cell wall content and/or composition
  misc_feature: Functional homolog of the protein sequence given in SEQ ID NO 14237
  misc_feature: Ceres ANNOT ID no. 8642463
  misc_feature (35)..(482): SWISSPROT Homolog: EC 3.2.1.21 Beta-glucosidase
  misc_feature (38)..(504): Pfam ID: Glyco_hydro_1 Pfam Description: Glycosyl hydrolase family 1
MGSGRRTMPPVVVLLLLLVVLGVSLQGRCTAQGGGGLTRGSFPKGFVFGTAAAAYQYEGAVTTDGRGRTIWDTFAHTFGKISDFSNADVAVDQYHRFEEDVQLMADMGMDAYRFSIAWSRILPNGTGQVNQAGIDHYNKVINALLSKGIQPYVTLYHWDLPQALEDSNDFAAYAETCFKAFGDRVKHWITLNEPHTVAIQGYDAGLHAPGRCSVLLHLYCKSGNSGTEPYIVAHNFILAHATVSDIYRRKYKAAQNGELGIAFDVIWYEPMTNSTIDIEATKRAQEFQLGWFAEPFFFGDYPATMRTRVGERLPKFTADEATLVKGALDFMGINHYTTFYTRHNETNIIGRLLNDTLADTGTISLPFDKNGKPIGDRANSIWLYIVPSGIRKLMNYVKERYNSPTVYITENGMDDGNSPFTSIQDALKDKKRIKYHNDYLSNVAASIKEDGCDVRGYFAWSLLDNWEWAAGYSSRFGLYFVDYKDNLKRYPKNSVQWFKTLLSSS

SEQ ID NO: 15622 - DNA, 1497 bp, Sorghum bicolor
  misc_feature: Ceres ANNOT ID no. 8642464
  misc_feature: Encodes the peptide sequence at SEQ ID NO 15623
atggaactgacgaggcagcagctgctgcttctcgtcatcctcggcgtgtcgctgcaaggatgcattgcgcagggcggggacggaggagggctcacgcgggggagcttcccaaagggattcgtcttcggcaccgcctcctccgcttaccagtacgagggagccgtgaaggaggacgggagagggaaaaccatctgggacaagttcgcccacacgtttgggaaggttgccgacttcagtaatgctgatgtcgcagtcgatcagtaccaccttttcgaggaggatatacagctcatggcagacatggggatggatgcgtatcgcttctcgattgcctggtcgaggattttgccaaatggtactggccaagtcaatcaggccggcatcgaccactacaacagatttatcgatgcactgctatcgaaaggtattgagccatatgtaaccctgtaccactgggacctcccccaggccttggaagacagcaatgatttcgccgaatacgccgagacatgcttcaaggctttcggagaccgtgtgaagcactggatcacactcaacgagccgcacacggttgccattcagggctacgacgccgggcttcaggcgccggggcgctgttctttgctgctccatctctactgcaagtcagggaattcaggcaccgagccctacattgtcgcccacaacttcatcttggctcacgccacggtttcagacatctacagacggaattacaaggcaactcaaaatggggaacttggaatagcatttgatgtcatgtggttcgaaccgatgacgaatacgactgccgacatcgaagctgccaagagagggcaagagtttcagctaggatggttcgcggatcctttcttcttcggcgattaccctgcattgatgagatcacgggtcggggacaggctacccaagttcacagcagatgaggctgcccttgtcaagggggcactcgacttcgttggcataaaccactacaccacttactacaccaaacacaacagcaccaacctcgtggggcgtctgctgcataacaccttggcagacaccggcaccatcagccttccattcaggaacgggaaagccattggtgacagggccaattcgatatggctgtacattgtgcccaatgggatgaggagcctgatgaactacgtcaaggaaaggtacaacagcccaccagtttacatcacggaaaacgggatggatgacggcaacagccctttcacttccatcaaggacgcgctcaaggacagcaagaggatcaagtaccacaacgactacctcaccaacctggctgcctccataaaggaggatgggtgcgacgtgcgtggctacttcgcgtggtcgctgctggacaactgggagtggacggccggctactcatccagattcgggctctacttcgtggactacaaggacagcctcaagagataccccaagagctcggtgcagtggttcaagaacctgttaagctctagctga

SEQ ID NO: 15623 - protein, 498 aa, Sorghum bicolor
  misc_feature: Useful for making plants with altered carbohydrate content
  misc_feature: Functional homolog of the protein sequence given in SEQ ID NO 14124
  misc_feature: Useful for making plants with altered cell wall content and/or composition
  misc_feature: Functional homolog of the protein sequence given in SEQ ID NO 14237
  misc_feature: Ceres ANNOT ID no. 8642464
  misc_feature (34)..(496): SWISSPROT Homolog: EC 3.2.1.147 Thioglucosidase
  misc_feature (32)..(497): Pfam ID: Glyco_hydro_1 Pfam Description: Glycosyl hydrolase family 1
MELTRQQLLLLVILGVSLQGCIAQGGDGGGLTRGSFPKGFVFGTASSAYQYEGAVKEDGRGKTIWDKFAHTFGKVADFSNADVAVDQYHLFEEDIQLMADMGMDAYRFSIAWSRILPNGTGQVNQAGIDHYNRFIDALLSKGIEPYVTLYHWDLPQALEDSNDFAEYAETCFKAFGDRVKHWITLNEPHTVAIQGYDAGLQAPGRCSLLLHLYCKSGNSGTEPYIVAHNFILAHATVSDIYRRNYKATQNGELGIAFDVMWFEPMTNTTADIEAAKRGQEFQLGWFADPFFFGDYPALMRSRVGDRLPKFTADEAALVKGALDFVGINHYTTYYTKHNSTNLVGRLLHNTLADTGTISLPFRNGKAIGDRANSIWLYIVPNGMRSLMNYVKERYNSPPVYITENGMDDGNSPFTSIKDALKDSKRIKYHNDYLTNLAASIKEDGCDVRGYFAWSLLDNWEWTAGYSSRFGLYFVDYKDSLKRYPKSSVQWFKNLLSSS

SEQ ID NO: 15624 - DNA, 681 bp, Sorghum bicolor
  misc_feature: Ceres ANNOT ID no. 8642560
  misc_feature: Encodes the peptide sequence at SEQ ID NO 15625
atggcctcactccccgttcctcgcacgctcccgcgggcctcgccaacggtggtgggcgccgcgagggggaggagggggagggccgcggtgcgcgtgcgcactgccaccgcggcattgggcggtgggtgctgcggcggcggcggaatggagcagcgccacggggaggcaccgcacagcccagggaaaagtactcttgcttgtgcactgagtcatgagttgcattatagaggccacatcacgtatgtacttgatggtgacaaccttagacatggcctcaatcgagatttaagctttaaggcagaagaccgtgcagaaaatatacgaagagttggtgaagtggcaaagctttttgccgatgctggtatcatatgcattgctagcttgatatctccatacaggagagatcgtgatgcatgccgtgctctacttccagattctaactttattgaagtatttatggatttgcccctaaaaatttgtgaagctcgtgatcctaaaggtctgtacaagcttgcacgcacaggaaagattaaaggtttcactggaattgatgatccatacgaaccgccagttaatggtgagatagtaattacgatgaaagatggggaatgcccttcacccaaagcaatggcgaagcaagttctatcataccttgaagagaacggatatttgcaagcttag

SEQ ID NO: 15625 - protein, 226 aa, Sorghum bicolor
  misc_feature: Useful for making plants with modulated biomass
  misc_feature: Useful for making plants with modulated heat sensitivity
  misc_feature: Functional homolog of the protein sequence given in SEQ ID NO 13501
  misc_feature: Ceres ANNOT ID no. 8642560
  misc_feature (61)..(226): SWISSPROT Homolog: EC 2.7.1.25 Adenylyl-sulfate kinase
  misc_feature (61)..(203): Pfam ID: APS_kinase Pfam Description: Adenylylsulphate kinase
MASLPVPRTLPRASPTVVGAARGRRGRAAVRVRTATAALGGGCCGGGGMEQRHGEAPHSPGKSTLACALSHELHYRGHITYVLDGDNLRHGLNRDLSFKAEDRAENIRRVGEVAKLFADAGIICIASLISPYRRDRDACRALLPDSNFIEVFMDLPLKICEARDPKGLYKLARTGKIKGFTGIDDPYEPPVNGEIVITMKDGECPSPKAMAKQVLSYLEENGYLQA

SEQ ID NO: 15626 - DNA, 1152 bp, Sorghum bicolor
  misc_feature: Ceres ANNOT ID no. 8642580
  misc_feature: Encodes the peptide sequence at SEQ ID NO 15627
atggcttccacggtgacgctggagaagacgaccaccatcctgagtgatgacgcaggtgctgtcggatcgcccaagaccaccatgaggtctcgtctcctgatgaagaagggggcagcaggtggcgccaaggccaaggggaggtgctgcgggcacaggtgcgagctcgtcagctacgacaagctgccggagttcctcaagcacaacgagttcatcgtccaccactaccgcagcgagtggcccatcaaggaggcgctgctcagcgccttctccatccacaacgagaccatcaacgtctggacgcatttgatcggcttcttcgtcttcctcgcgttcgccgtgtgcgccgccacggtggtcccggcggagtacgagtcgcctcacatggcgacgacaggcctgggcaacatcaccggcaacgcagtggtgctgaggagctactacagcgccgacggagcgatcttggcaagtacaatgaaggcgttccgcaacgtgtccgtcgtcgaaaccgagaccgccaccgccgccgccgttctgtcagcggcgggcggccgggtggcgcggtggccgttctacgcgtacctgtgcggcgccatgttctgcctgctgatgagcagcgcgtgccacctgctggcgtgccactcggagcacgccagctacgtgttcctccgcctcgactacgcgggcatcacggggctcatcgtcacctccttctacccgctcgtctactacactttcctctgcaacccattctaccaggcggtctacctcggcttcatcaccgtctccggcgccgccgccgtggcagtctccctgctgcccgtcttcgagaggcccgagctgcggtgggcgcgggcggcactgttcgcgtgcatgggcatgtcgggcctggtgcccatcctgcacaagttgctcgtcttcggggaccgcccggaggccctgctcaccacggggtacgagatggccatgggcgccttctacctggccggcgtcgtggtgtacgccaccagggtccccgagcgctggatgccggggcggttcgacctcgcgggacacagccaccagctcttccacgtgctcgtcatcgccggcgcctacgcgcactacctcgccggactcgtctacctcggctggagggacatggaagggtgctga

SEQ ID NO: 15627 - protein, 383 aa, Sorghum bicolor
  misc_feature: Useful for making plants with altered carbohydrate content
  misc_feature: Functional homolog of the protein sequence given in SEQ ID NO 13987
  misc_feature: Ceres ANNOT ID no. 8642580
  misc_feature (89)..(368): Pfam ID: HlyIII Pfam Description: Haemolysin-III related
MASTVTLEKTTTILSDDAGAVGSPKTTMRSRLLMKKGAAGGAKAKGRCCGHRCELVSYDKLPEFLKHNEFIVHHYRSEWPIKEALLSAFSIHNETINVWTHLIGFFVFLAFAVCAATVVPAEYESPHMATTGLGNITGNAVVLRSYYSADGAILASTMKAFRNVSVVETETATAAAVLSAAGGRVARWPFYAYLCGAMFCLLMSSACHLLACHSEHASYVFLRLDYAGITGLIVTSFYPLVYYTFLCNPFYQAVYLGFITVSGAAAVAVSLLPVFERPELRWARAALFACMGMSGLVPILHKLLVFGDRPEALLTTGYEMAMGAFYLAGVVVYATRVPERWMPGRFDLAGHSHQLFHVLVIAGAYAHYLAGLVYLGWRDMEGC

SEQ ID NO: 15628 - DNA, 729 bp, Sorghum bicolor
  misc_feature: Ceres ANNOT ID no. 8642593
  misc_feature: Encodes the peptide sequence at SEQ ID NO 15629
atgggctgcgaggaggaagagaggctgctgttcccgtccttcgtcttccccgagagcttcgcggaggccgccacccccggctccggtggtgagcagaagaaggctcggcagcggcggaggcggaagccgcggccggcggcggatggcggcgagggcggggacgagcaggccaagaagcggcggctgagcgacgagcaagcgcggttcctggagctcagcttcaggaaggagcgcaagctggagacgccccgcaaggtgcagctggccgccgagctgggcctcgacgccaagcaggtggccgtctggttccagaaccgccgcgcccgccacaagagcaagctcatggaggaggagttctccaagctccgcgccgcgcacgacgccgtcgtcctccagaactgccacctcgagaccgagctgctgaagatgaaggacagactggaggaggcggaggaggagaagaggaaggtcatcgcggctgccgcggcagccggtggtggcggcggcggagcgggcgcaggaagcagcagcccgagctcgtcgtcgttctcgacggtgacgcacaacccggcggcgctggtggggcagttcggggtggacccggaggaggccgccgccgacctcacctacatgagcgagtacgcctacaacagctacatgaacatgatggacatggacctcgcgcccggcggctacttcggaggagtagtctacgatcacttcaactga

SEQ ID NO: 15629 - protein, 242 aa, Sorghum bicolor
  misc_feature: The sequence is a functional homolog of SEQ ID NO 1857 in the 11/479,226 US patent application
  misc_feature: The sequence is a functional homolog of SEQ ID NO 246 in the 10/666,642 US patent application
  misc_feature: Ceres ANNOT ID no. 8642593
  misc_feature (58)..(112): Pfam ID: Homeobox Pfam Description: Homeobox domain
MGCEEEERLLFPSFVFPESFAEAATPGSGGEQKKARQRRRRKPRPAADGGEGGDEQAKKRRLSDEQARFLELSFRKERKLETPRKVQLAAELGLDAKQVAVWFQNRRARHKSKLMEEEFSKLRAAHDAVVLQNCHLETELLKMKDRLEEAEEEKRKVIAAAAAAGGGGGGAGAGSSSPSSSSFSTVTHNPAALVGQFGVDPEEAAADLTYMSEYAYNSYMNMMDMDLAPGGYFGGVVYDHFN

SEQ ID NO: 15630 - DNA, 1365 bp, Sorghum bicolor
  misc_feature: Ceres ANNOT ID no. 8642632
  misc_feature: Encodes the peptide sequence at SEQ ID NO 15631
atggagttcacaacttgtttaatggctatgggaatgccggtcggtgatgaggaacaaaggttccttgagaagtctgtcgtccttccgctggatgctgcacctatccatgtgaagactaccggaggaggtcctcggaccagtgtgctgcgcaatccgaacatggagaagcttcagaagggctacctgttcccggagattagcattaagcatgaagctcacctgaagaagtaccctgatgccaaggtcatcagcttgggcatcggcgacacaactgaacccatcccaagcgtcataacatcagctatggccgagtatgtgcttgcgttatccactccagaaggataccagggttatggaccggagcagggtcaaatgaatctgcgcaaggtcatagctgagaaagtgtaccaagacatggggattaaagagtccgaggtgttcatctcggacggagcgcagtgtgacattgctcgcctccagacgctgttcgggcccaacgtgaccatagccgtccaagatcccaccttcccgggttacgtggacaacggcgtgatcgtggggcagaccggcagcgcggacgaggccggcaagtacgccggcatcgcctacatgcgttgcgcgccggagaaccacttcttcccggacctctcccgcgtgccgcgcaccgacgtcatcttcttctgctcgcccaacaacccgacgggccacgcggcgtcggcggcgcagctgcgcgacctggtggacttcgcgcgccgcaacggctccatcatcgtcttcgacacggcgtacgcgtggtacgtgtcggaggggcaggggcagggcaagccgcggtccatctacgaggtgcccggcgccagggaggtggccatcgagatctcctccttctccaagttcgccggcttcacgggcgtccgcctcggctgggcggtggtgcccgacgagctccgctacgccgacggctcccgcgtcgcgcgcgacttcgaccgcatcgtctgcacctgcttcaacggcgcgtccagcgtcgcgcaggccggcggactcgcctgcctctccacggaggaaggccgggacgccgtgcgccgcgtcgtgggcgtctacaaggacaacgcgcgggtgctggtggacaccttcgcgtcgctcggcaaggaggtgtacggcggcaccgactcgccctacgtctgggtgcgcttcccgggccgccgctcctgggacgtgttcgccgagatcctcgaaaagacgcacgtcatcaccgtgccgggcagcggcttcggccccggcggcgagggcttcatccgtgtcagcgcgttcaacagcagggacagggtgctggaggccgcagctaggctcaagaagttcctggcctga

SEQ ID NO: 15631 - protein, 454 aa, Sorghum bicolor
  misc_feature: Useful for making plants with modulated nitrogen use efficiency
  misc_feature: Functional homolog of the protein sequence given in SEQ ID NO 13353
  misc_feature: Ceres ANNOT ID no. 8642632
  misc_feature (45)..(451): SWISSPROT Homolog: EC 2.6.1.83 LL-diaminopimelate aminotransferase
  misc_feature (80)..(449): Pfam ID: Aminotran_1_2 Pfam Description: Aminotransferase class I and II
MEFTTCLMAMGMPVGDEEQRFLEKSVVLPLDAAPIHVKTTGGGPRTSVLRNPNMEKLQKGYLFPEISIKHEAHLKKYPDAKVISLGIGDTTEPIPSVITSAMAEYVLALSTPEGYQGYGPEQGQMNLRKVIAEKVYQDMGIKESEVFISDGAQCDIARLQTLFGPNVTIAVQDPTFPGYVDNGVIVGQTGSADEAGKYAGIAYMRCAPENHFFPDLSRVPRTDVIFFCSPNNPTGHAASAAQLRDLVDFARRNGSIIVFDTAYAWYVSEGQGQGKPRSIYEVPGAREVAIEISSFSKFAGFTGVRLGWAVVPDELRYADGSRVARDFDRIVCTCFNGASSVAQAGGLACLSTEEGRDAVRRVVGVYKDNARVLVDTFASLGKEVYGGTDSPYVWVRFPGRRSWDVFAEILEKTHVITVPGSGFGPGGEGFIRVSAFNSRDRVLEAAARLKKFLA

SEQ ID NO: 15632 - DNA, 1743 bp, Sorghum bicolor
  misc_feature: Ceres ANNOT ID no. 8642656
  misc_feature: Encodes the peptide sequence at SEQ ID NO 15633
atggggcccctgcctaagtgccttcctgagatcggactcaagggaagggaagatatccctccaggagacgacaagatcttctctttgggttccagcatacaactcctgcccacaaaatttgcactagaaaatatgtcgacacaggcctctaaccggtcatacagatatccagacaatacccaactactgtaccacaatggcaatccaatgcatgttgggggcaatggtaattactatgtgcaacaaaatcatgatgatgttaactacatttcctctgatgatggatcacagagcagtaattctagagctcaaggttttcaagcacagttttgcaccctagactcgtcttcggccaattgtgtttatcctgcacatagctctacctcttctcagagcataagtggaagccctctgtctcagcaagagagccactctgatcatgcatatggttcctctccaagtgcatcgtgcattactcaggttcccacctggacacttaaggatctagaaaatgtgatgcttggacccgattctgacatatgtagccctgacagttcctttctgcctggcactgccttgcatgaaaataactggagagaacttttgggaattcaaactggggatttgaggcagttaattatagcatgtggtaaggctgttgacgagaatgctttctatatggatgcactgatgtctgagttaaggccgatggtttctgtctctggtgaaccgatgcaacgtctgggagcttacatgttggaaggtctcattgcgaggctttctttcactggacatgccctgtataaatctctgaagtgcaaagagcctgtggctacaagttctgagctcatgtcctatatgcatcttctttatgagatctgtccattcttcaagttcggttacatgtctgccaatggtgccatagctgatgctgttaagggtgaagacattattcacatcatcgatttccaaatcgctcagggtagtcagtggatgactatgatacatgcccttgcttcaaggcctgggaggcgaccatacctaagaataactggcatagatgactcgaattctgctcatgcccgaggtggtggactggatatggttggacagaggttgcacacagtggcccagtcgtgtggtctgcccttcgagttcaatgctgtgccagcagctagtcatgaggttgtgtttgaagatctttgtgtaagacctggtgaggccatcgttgtcaattttgcttatcagctgcatcatactcctgatgagagtgtgggcacagaaaaccatcgtgatagaatcttgagaatggtcaagagcctctctcctagggtggtaactcttgtagagcaggaggcaaacacaaacacggcacctttctttcttagatacatggagactcttgattattacacagcaatgtttgaggcaatagatgttgcttgccccagggatgataagaagcgcattagcacagagcagcactgtgttgcaagggatatcgtcaatttaattgcttgtgaaggtacagaaagaatagagaggcatgagccttttggaaaatggagggcaaggcttgcaatggctgggtttagaccatacccgttaagtccagtggtgaacagaaccatcaaaacactgctcgacagttaccacagctattacaggcttgaggagagagatggcatcctttatcttggctggaagaacagaaagctggtcgtatcttctgcctggtgctga

SEQ ID NO: 15633 - protein, 580 aa, Sorghum bicolor
  misc_feature: Useful for making plants with modulated low light sensitivity
  misc_feature: Functional homolog of the protein sequence given in SEQ ID NO 13378
  misc_feature: The sequence is a functional homolog of SEQ ID NO 474 in the 10/666,642 US patent application
  misc_feature: Useful for making plants with modulated light quality sensitivity
  misc_feature: The sequence is a functional homolog of SEQ ID NO 1018 in the 10/225,066 US patent application
  misc_feature: The sequence is a functional homolog of SEQ ID NO 2712 in the 10/374,780 US patent application
  misc_feature: The sequence is a functional homolog of SEQ ID NO 220 in the 10/412,699 US patent application
  misc_feature: The sequence is a functional homolog of SEQ ID NO 443 in the 11/479,226 US patent application
  misc_feature: Ceres ANNOT ID no. 8642656
  misc_feature (184)..(490): Pfam ID: GRAS Pfam Description: GRAS family transcription factor
MGPLPKCLPEIGLKGREDIPPGDDKIFSLGSSIQLLPTKFALENMSTQASNRSYRYPDNTQLLYHNGNPMHVGGNGNYYVQQNHDDVNYISSDDGSQSSNSRAQGFQAQFCTLDSSSANCVYPAHSSTSSQSISGSPLSQQESHSDHAYGSSPSASCITQVPTWTLKDLENVMLGPDSDICSPDSSFLPGTALHENNWRELLGIQTGDLRQLIIACGKAVDENAFYMDALMSELRPMVSVSGEPMQRLGAYMLEGLIARLSFTGHALYKSLKCKEPVATSSELMSYMHLLYEICPFFKFGYMSANGAIADAVKGEDIIHIIDFQIAQGSQWMTMIHALASRPGRRPYLRITGIDDSNSAHARGGGLDMVGQRLHTVAQSCGLPFEFNAVPAASHEVVFEDLCVRPGEAIVVNFAYQLHHTPDESVGTENHRDRILRMVKSLSPRVVTLVEQEANTNTAPFFLRYMETLDYYTAMFEAIDVACPRDDKKRISTEQHCVARDIVNLIACEGTERIERHEPFGKWRARLAMAGFRPYPLSPVVNRTIKTLLDSYHSYYRLEERDGILYLGWKNRKLVVSSAWC

SEQ ID NO: 15634 - DNA, 3300 bp, Sorghum bicolor
  misc_feature: Ceres ANNOT ID no. 8642682
  misc_feature: Encodes the peptide sequence at SEQ ID NO 15635
atggcggaggcgcggcgccacgcgatcgcgccgcagctaggtctggtgagtgctgactgtatggagcccattatgcggaagtggagattggagctattagcacgtaaccagggattgggttgccatcctggaactttgaagagcttaacaagaggatttctctatgttgagcagatattgaaggaagcacaacaccgatggctacgacccgctgagatatgtgaaatacttaagaactacagaaattttcgtatttccccagaaccaccaaataggcctccaagtggttcactcttcttgtttgatcggaaagtattgagatatttccggaaggacggccataattggaggaagaaaagggatggaaaaactgtcaaagaagctcatgaaagattaaaatctggaagtgttgatgtgcttcactgctactatgctcatggggaaggaaacgaaaactttcagaggaggagttattggatgttggaggaggattttatgcacattgtacttgtacattatctcgaagtcaagggtggcaaatccacttctcgtattagaggacatgatgatatgcttcaagctgctcgtacggatagccctttaagtcagttgccttcacaaactacagagggtgaaagctctcttagcggacaagcctcagaatacgaagaaacagaatcaggtaactttcaaggcttcccagctacagtgactaatacagacatttattcttattgtcaagatgccttaccaggtgctcttaatgagcctggccttggagttggattcaatggggcagataatcaggtggatccatcatcattgaatggccttgttaaacctgaccaggggatccttcaaatgtccccaccccaaagtactgttccctcagaactatttcctttcgctgaaggacatggaattgaatccttcacatttgacgaagtatatggtaatggattgagtatcaaggatgcagatgttataggcactgatgaagaatcagtatggcagcttcctggtgctatcagctcatttcctccagaggacagtttccagcaaaatgatagatcgttggaggaaaatattaattaccctctcttgaaaactcaatcatctagtctttctgaaatgctgaaggatagctttaagaaaagtgatagttttacgagatggatgagcaaagcacttggtgaagtagatgattcccaaattaagtccagttctggagtgtattggaacagtgaagagactgataatatcattgaagcatcaagtcgtgatcagttggatcaattcactcttgacccagtgcttgcacaagaccagctgtttagtatagatgatttttctccaagctggacatatgcgggctccaagactagggttctcattactggtaggttcctaaattctaatgagattcaaagatgcaagtggtcatgtatgtttggtgaagtcgaagttccagcagaggtttcagctgatgggactctcagatgttattccccatcacacaaacctggcagggttcctttttatgtcacatgtaccaacaggttggcctgcagtgaaatccgagagtttgagtttcgaccaagtgttactcaatacatggatgccccaagtccacatggtgctacaaacaaaacatatctccagatgcgtcttgatgacctgttgtctttgggacacaatgagtaccaggcaacagtatctaaccccactaaagagatggttgatttgagcaagaagataagctcactgatgacaagcaacgattcctggtccaagttgctaaaattggctagtgacaatgagcctgccactgatcataatcaggatcagttctttgaaaaacgcttaaaggaaaaattgcatatctggcttgtccacaaagcacgcgatggtggcaaaggccccaatgtgttggatgatgaagggcagggtgttcttcatctggcagctgccctaggatacgattgggtgataaggccaacagtttctgctggtgtgaatataaatttcagagatgctcatggatggactgcactccattgggcggcattttgtggcagagagcgaacagttgtcgcacttattgcacttggtgcagctcctggagctttgacagacccaacgccagatttccctacaggaagcacaccagctgatcttgcatcagctaatggatacaagggaatctctggtttcttggcggagtcttctttaacaagtcatcttcagaccctcgatcttaaggaaggcaaggggagcaatgcaccagaaatatcaggtctgcctggtattggagatgttactgaaagaagagcatcaccattagcaggtgaaggtcttcaagctggatccgtgggagattcactaggtgctgttcgaaatgctgcccaagctgctgctcgtatatatcaagttttcagggtgcagtccttccagagaaagcaagcagttcagtatgaagatggcaatggtgcagtatcagatgatcgtgccatatcactcttatctgttaaaccatctaaacctgtacagcttgatcccctgcatactgctgcaactcgaatacagaacaagtaccgtggatggaaagggagaaaggaatttctacttatcagacagcgcattgtcaagatccaggctcatgtgcgaggtcaccaagtgaggaagcattatcgtaaaatcatttggtctgttggaatagtggagaaagtcatattgcgttggaggcgaaaaggggctgggttgcgcggatttcggtctacagaaggtgcaatggagggcaacagcagcagtagtagtaatttgatccaaaataaacctgctgaggatgattatgatttcttacaacaaggacggaaacaaaccgaggaaaggctgcagaaagctcttgccagagtgaagtcgatggctcagtacccagacgctcgggatcagtatcaaaggattctgactgttgtgacaaaaattcaagaatcgcaggccatgcaagaaaagatgctcgatgagtcgaccgagatggatgaaggcttctttatgagcgagttcaaagagctttgggatgatgacgtgccaatgccttcttgtagcacggattctacgacatgctataaactggagcagcattctcgtggcagtggcagtgttgtttttcatgaccagctcctttcaattaagagggaaaagcgagttgaaaaggttccaaaagatgtatataaccatgctgttaggttaaaacgtctccgctctgttaggggcacatcgttgacggccttgtcccactag

SEQ ID NO: 15635 - protein, 1099 aa, Sorghum bicolor
  misc_feature: The sequence is a functional homolog of SEQ ID NO 1308 in the 10/666,642 US patent application
  misc_feature: The sequence is a functional homolog of SEQ ID NO 1309 in the 10/666,642 US patent application
  misc_feature: Useful for making plants with altered alkaloid content
  misc_feature: Functional homolog of the protein sequence given in SEQ ID NO 13200
  misc_feature: Ceres ANNOT ID no. 8642682
  misc_feature (59)..(177): Pfam ID: CG-1 Pfam Description: CG-1 domain
  misc_feature (878)..(898): Pfam ID: IQ Pfam Description: IQ calmodulin-binding motif
  misc_feature (680)..(712): Pfam ID: Ank Pfam Description: Ankyrin repeat
  misc_feature (446)..(531): Pfam ID: TIG Pfam Description: IPT/TIG domain
MAEARRHAIAPQLGLVSADCMEPIMRKWRLELLARNQGLGCHPGTLKSLTRGFLYVEQILKEAQHRWLRPAEICEILKNYRNFRISPEPPNRPPSGSLFLFDRKVLRYFRKDGHNWRKKRDGKTVKEAHERLKSGSVDVLHCYYAHGEGNENFQRRSYWMLEEDFMHIVLVHYLEVKGGKSTSRIRGHDDMLQAARTDSPLSQLPSQTTEGESSLSGQASEYEETESGNFQGFPATVTNTDIYSYCQDALPGALNEPGLGVGFNGADNQVDPSSLNGLVKPDQGILQMSPPQSTVPSELFPFAEGHGIESFTFDEVYGNGLSIKDADVIGTDEESVWQLPGAISSFPPEDSFQQNDRSLEENINYPLLKTQSSSLSEMLKDSFKKSDSFTRWMSKALGEVDDSQIKSSSGVYWNSEETDNIIEASSRDQLDQFTLDPVLAQDQLFSIDDFSPSWTYAGSKTRVLITGRFLNSNEIQRCKWSCMFGEVEVPAEVSADGTLRCYSPSHKPGRVPFYVTCTNRLACSEIREFEFRPSVTQYMDAPSPHGATNKTYLQMRLDDLLSLGHNEYQATVSNPTKEMVDLSKKISSLMTSNDSWSKLLKLASDNEPATDHNQDQFFEKRLKEKLHIWLVHKARDGGKGPNVLDDEGQGVLHLAAALGYDWVIRPTVSAGVNINFRDAHGWTALHWAAFCGRERTVVALIALGAAPGALTDPTPDFPTGSTPADLASANGYKGISGFLAESSLTSHLQTLDLKEGKGSNAPEISGLPGIGDVTERRASPLAGEGLQAGSVGDSLGAVRNAAQAAARIYQVFRVQSFQRKQAVQYEDGNGAVSDDRAISLLSVKPSKPVQLDPLHTAATRIQNKYRGWKGRKEFLLIRQRIVKIQAHVRGHQVRKHYRKIIWSVGIVEKVILRWRRKGAGLRGFRSTEGAMEGNSSSSSNLIQNKPAEDDYDFLQQGRKQTEERLQKALARVKSMAQYPDARDQYQRILTVVTKIQESQAMQEKMLDESTEMDEGFFMSEFKELWDDDVPMPSCSTDSTTCYKLEQHSRGSGSVVFHDQLLSIKREKRVEKVPKDVYNHAVRLKRLRSVRGTSLTALSH

SEQ ID NO: 15636 - DNA, 954 bp, Sorghum bicolor
  misc_feature: Ceres ANNOT ID no. 8642674
  misc_feature: Encodes the peptide sequence at SEQ ID NO 15637
atggcggctacgacgatagattggcacggccgcaacgccgccttgtatggcgtggcggacagggacagcaaggagctggtgcgcgcgcttgctccgcccatgcaacaggcggccccgaccatctcgttcgcgtacccctgctccggcgtggagcagcagagcgcggcggcggcggcgggctcgtttctgggcgccggcggtagtagtggcctgctgactccggcacagattctccagctgcagtcgcgactccagttcctgcgccggccggcggcgggcggcgccacgctggccgcggtgaccacgcagcagatgaagcggcagggcgtgccgcaggctccggcgccgcttacctcaaggccggcggtgtccaagctgtaccgcggcgtccggcagcggcattgggggaagtgggtggcggagatccgcctgccgcgcaaccgcacccgcctctggctcggcaccttcgacaccgccgaggaggccgcgctcgcctacgacagcgccgcgttccgcctccgcggggactccgccaggctcaacttccccgagctcaggcgcggcggccagcacctcggcccgccgctccacgccgcggtcgacgccaagctccacgccatctgcaacggcacgacggacgtcgttgtgccgctgccccagagccagagccagagccagagccagagccagagccacgccacgacggcgacggcgacaaccaccccgagctctctctcctcggcgagcccacacgtcaagagcgagccgggctgctccggctccgagagctcgttttccgcagacggcgacgtgtcctcgactgggtcctccgacgtggtgccagagatgcaactactcgacttctcagaagcgccatgggacgagtccgagagcttccacctgcgcaagtacccgtccctggagatcgactgggactccatcctgatttcataa

SEQ ID NO: 15637 - protein, 317 aa, Sorghum bicolor
  misc_feature: The sequence is a functional homolog of SEQ ID NO 1289 in the 10/374,780 US patent application
  misc_feature: The sequence is a functional homolog of SEQ ID NO 1435 in the 10/412,699 US patent application
  misc_feature: Ceres ANNOT ID no. 8642674
  misc_feature (125)..(176): Pfam ID: AP2 Pfam Description: AP2 domain
MAATTIDWHGRNAALYGVADRDSKELVRALAPPMQQAAPTISFAYPCSGVEQQSAAAAAGSFLGAGGSSGLLTPAQILQLQSRLQFLRRPAAGGATLAAVTTQQMKRQGVPQAPAPLTSRPAVSKLYRGVRQRHWGKWVAEIRLPRNRTRLWLGTFDTAEEAALAYDSAAFRLRGDSARLNFPELRRGGQHLGPPLHAAVDAKLHAICNGTTDVVVPLPQSQSQSQSQSQSHATTATATTTPSSLSSASPHVKSEPGCSGSESSFSADGDVSSTGSSDVVPEMQLLDFSEAPWDESESFHLRKYPSLEIDWDSILIS

SEQ ID NO: 15638 - DNA, 696 bp, Sorghum bicolor
  misc_feature: Ceres ANNOT ID no. 8642774
  misc_feature: Encodes the peptide sequence at SEQ ID NO 15639
atggggatgtcgccgtacgaggcggcgagggagcggaatgtgcaggagaacaagcgcaagatggaggcgctcaacctgcgccacctctccgccgtcatcaaggaggcacccaagaccccttcccctctgaagcccaagaggcgcaggatcatcgagaacgcggtcgtggttccctcgcctcctaggaggtcccgccggcttgcgcaactccctgaggtcaagtacgcagagatagcaccacacactgcagaaagaatgacaagatctcctagaaaaccagctgacctcatctacttggcaagaagcggaacagtttccatgaaagctaggttggaggcaacaagaaaggccgaggagctagaatcacaacttgaccctgacatcccatcctttgtgaaggcaatgttgcattcacatgtggttcgaggtttttggctgcaacttccgtgccatttctgtcacacttacatgccaaagcaagactccattatcaccttggtggatgagaagggtgaagaattcgccaccaactaccttgcctacaagaaagggctaagtggcggatgggctggttttgctctatgccatgggatgcatgacggagatgcagctgtttttcagttgattaagcccacgaccttcaaggtgtatatcgtccgagcagcttctgatgatggcagtgaggttgatgagtga

SEQ ID NO: 15639 - protein, 231 aa, Sorghum bicolor
  misc_feature: Useful for making plants with altered terpenoid content
  misc_feature: Functional homolog of the protein sequence given in SEQ ID NO 13124
  misc_feature: Ceres ANNOT ID no. 8642774
  misc_feature (130)..(224): Pfam ID: B3 Pfam Description: B3 DNA binding domain
MGMSPYEAARERNVQENKRKMEALNLRHLSAVIKEAPKTPSPLKPKRRRIIENAVVVPSPPRRSRRLAQLPEVKYAEIAPHTAERMTRSPRKPADLIYLARSGTVSMKARLEATRKAEELESQLDPDIPSFVKAMLHSHVVRGFWLQLPCHFCHTYMPKQDSIITLVDEKGEEFATNYLAYKKGLSGGWAGFALCHGMHDGDAAVFQLIKPTTFKVYIVRAASDDGSEVDE

SEQ ID NO: 15640 - DNA, 1818 bp, Sorghum bicolor
  misc_feature: Ceres ANNOT ID no. 8642776
  misc_feature: Encodes the peptide sequence at SEQ ID NO 15641
atgggggtgaccaccgccggtgaagcggcctgcaagtccccggcggtgcgggcctcggtcatcgtcaggctcaacgccgcgttcctcgccttcttcctcttcgcctacctggcgctcctcctccaccccaagtactcggacatcctcgaccgcggcgccacctccctcgtccgctgcaccttccgcgactcctgcccaccgccggcgccgtcgtcgtcgtcgtcgacccagctctcacggaagctgggaggcgtggcggcgaacaaggtggcggcggcggcggagcgcatcgtgatcgtgaacgcggggcgcgcgccggccatgttcgacgacctccgtggccgtcttcggatgggcctggtgaacatcgggcgcgacgaggtggtggcgctgggcgtggagggcgacgcggtgcgcgtggacttcgaccgcgtctccgagacgttccggtggtcggacctgttcccggagtggatcgacgaggaggaggacgacgagggcccgtcctgcccggagctccccatgccggactggtcccggtacggcgacgtggacgtggtggtggcgtcgctgccgtgcaaccgcagcgcgaccgggtggaaccgcgacgtgttcaggctgcaggtgcacctggtggcggcgcaggtggcggcacggaagggccggcgcaacggggccggcgccggggccgtgcgcgtggtgctgcggagccagtgcgagcccatgatggacctgttccgctgcgacgaggcggtgggacgggagggggactggtacatgtacagagtcgacgtgcagcgcctggaggagaagctccgcctgcccgtgggctcctgcaacctcgccatgccgctctggggagcaggagggatccaggaggtgttcaacgcgtcgtcggagctggcgacgtcgccgtcgtggtcgggcgggcgtccccggcgtgaggcgtacgcgacggtgctgcactcgtcggacacgtacctgtgcggcgcgatcgtgctggcgcagagcatccggcgctcggggtccacccgggacctgatcctcctccacgaccacacggtgtcgaagccggcgctccgggcgctgacggcggccgggtggacgcctcgccggatcaagcggatccgcaacccgcgcgcggcgcggggcacctacaacgagtacaactacagcaagttccggctgtggcagctgaccgactacgaccgcgtggtgttcgtggacgccgacatcctggtgctccgcagcctggacgcgctgttcgcgttcccgcagctcacggcggtgggcaacgacgggtccctcttcaactccggtgtgatggtgatcgagccgtcggcgtgcacgttcgacgcgctgatccgggaccgccggaccatccggtcgtacaacggcggcgaccaggggttcctgaacgaggtgttcgtgtggtggcaccggctgccgcggcgggtgaactacctcaagaacttctgggcaaacaccaccggggagcgcgcgctcaaggagcggatgttccgggcggacccggccgaggtgtggtccatccactacctggggatgaagccatggacgtgctacagggactacgactgcaactggaacgtggcggaccagcgggtgtacgccagcgacgaggcgcacaggcgctggtggcaggtgtacgaccagatgggggagaccatgcgcgggccatgccgcctctccgagcggaggaaggtggagatcgcatgggacaggcacgtcgccgaggaggtcgggtacgccgaccagcactggaagatcaacatcacggacccaaggaaatgggactga

SEQ ID NO: 15641 - protein, 605 aa, Sorghum bicolor
  misc_feature: Useful for making plants with altered carbohydrate content
  misc_feature: Functional homolog of the protein sequence given in SEQ ID NO 14238
  misc_feature: Useful for making plants with altered cell wall content and/or composition
  misc_feature: Functional homolog of the protein sequence given in SEQ ID NO 13752
  misc_feature: Ceres ANNOT ID no. 8642776
  misc_feature (298)..(556): SWISSPROT Homolog: EC 2.4.1.186 Glycogenin glucosyltransferase
  misc_feature (318)..(529): Pfam ID: Glyco_transf_8 Pfam Description: Glycosyl transferase family 8
MGVTTAGEAACKSPAVRASVIVRLNAAFLAFFLFAYLALLLHPKYSDILDRGATSLVRCTFRDSCPPPAPSSSSSTQLSRKLGGVAANKVAAAAERIVIVNAGRAPAMFDDLRGRLRMGLVNIGRDEVVALGVEGDAVRVDFDRVSETFRWSDLFPEWIDEEEDDEGPSCPELPMPDWSRYGDVDVVVASLPCNRSATGWNRDVFRLQVHLVAAQVAARKGRRNGAGAGAVRVVLRSQCEPMMDLFRCDEAVGREGDWYMYRVDVQRLEEKLRLPVGSCNLAMPLWGAGGIQEVFNASSELATSPSWSGGRPRREAYATVLHSSDTYLCGAIVLAQSIRRSGSTRDLILLHDHTVSKPALRALTAAGWTPRRIKRIRNPRAARGTYNEYNYSKFRLWQLTDYDRVVFVDADILVLRSLDALFAFPQLTAVGNDGSLFNSGVMVIEPSACTFDALIRDRRTIRSYNGGDQGFLNEVFVWWHRLPRRVNYLKNFWANTTGERALKERMFRADPAEVWSIHYLGMKPWTCYRDYDCNWNVADQRVYASDEAHRRWWQVYDQMGETMRGPCRLSERRKVEIAWDRHVAEEVGYADQHWKINITDPRKWD

SEQ ID NO: 15642 - DNA, 804 bp, Sorghum bicolor
  misc_feature: Ceres ANNOT ID no. 8642802
  misc_feature: Encodes the peptide sequence at SEQ ID NO 15643
atgtgcggcggcgcgatcctcgcagagctcatacccagcgcgccggcgcggcgcgtagtcacgccgggccacgcgagcggcggcggcggcggcgatgacgacttcgaggccgcgttccgggacttcgacgaggactccgacgaaggcgcggtcatgaaggaggagcgtcagaagcgcaaggcgttcgggttcgcggtccccgcgaccgcgcccggaacccggcgcaggcggcggccgcccagcagcagccagtaccacggcgtccggcgccggccgtggggcaagtgggcggccgaggtgcgcgaccccgtcaggggcgtccgcgtctggctcggcaccttcgccaccgccgaggccgcggcgcgcgcctacgaccacgccgcgcgcgacctccgcggcgccaacgccaagctcaacttcccgtccaagcgccgctccgctgccgccaatgggaggcccggggtcgaaaggcaggggcgggggcggcgccccgtcccggacttctcgtggcagggcttgtccgcgaccgacgacagcgcggtggtcgagctcggcggcgccaagaagcgcgcccggacggagccagagccccaagaagtggcgcaggcgccgccgtctgatgattcagccgacatgctgttcgacgctttcatgttcggcgaccagttcagcttgttcaacggcggcggcgtgtacgacgagcctgccgcgactgcgatggacggcttgttgggcggcgacgccgtgctgtgcaacgacagcgtggggctctggagcttcgacgacagcgtgtgttattactag

SEQ ID NO: 15643 - protein, 267 aa, Sorghum bicolor
  misc_feature: The sequence is a functional homolog of SEQ ID NO 14 in the 10/903,236 US patent application
  misc_feature: The sequence is a functional homolog of SEQ ID NO 1737 in the 10/374,780 US patent application
  misc_feature: The sequence is a functional homolog of SEQ ID NO 2129 in the 10/666,642 US patent application
  misc_feature: The sequence is a functional homolog of SEQ ID NO 74 in the 10/714,887 US patent application
  misc_feature: The sequence is a functional homolog of SEQ ID NO 74 in the 11/435,388 US patent application
  misc_feature: Ceres ANNOT ID no. 8642802
  misc_feature (83)..(134): Pfam ID: AP2 Pfam Description: AP2 domain
MCGGAILAELIPSAPARRVVTPGHASGGGGGDDDFEAAFRDFDEDSDEGAVMKEERQKRKAFGFAVPATAPGTRRRRRPPSSSQYHGVRRRPWGKWAAEVRDPVRGVRVWLGTFATAEAAARAYDHAARDLRGANAKLNFPSKRRSAAANGRPGVERQGRGRRPVPDFSWQGLSATDDSAVVELGGAKKRARTEPEPQEVAQAPPSDDSADMLFDAFMFGDQFSLFNGGGVYDEPAATAMDGLLGGDAVLCNDSVGLWSFDDSVCYY

SEQ ID NO: 15644 - DNA, 1008 bp, Sorghum bicolor
  misc_feature: Ceres ANNOT ID no. 8642803
  misc_feature: Encodes the peptide sequence at SEQ ID NO 15645
atgtgcggaggcgccatcctcgcggaactgatcccgccgacgcggcgcgtggcgccgaagccggtgaccgagggccacctctggccggcgagctccaagaaagccggcagcggcagcaacaagaggcaccaccacgaatacgccgacgacgacgattttgaggccgccttcgaggagttcgacgacgactttgacgtgcacgaagacgacgaggaccaccctgaccacttcgtgttctcgtccaaatccgctttctccccagcgcacgacggcaggcgcgatgcgcgagccgcggcgagccagaggacgaagcgcggccgccgccacttccacggcatccggcagcgtccctggggcaagtgggcggcggagatccgcgacccgcacaagggcacccgcgtctggctcggcaccttcaacaccgccgaggacgccgcccgggcctacgacgtcgaggcgcgccgcctccgcggcagcaaggccaaggtcaacttccccgcagccagcgcgcgcccacgcgcacgccgcggcaagggcaacccaagaaccgcgccgaaacctgcagcacaggcacagcccgctctgctccttcgaggggagaagggtctggaaggagttgccgtgaagcctgaaactactatggacatgttcgacgtgggcagcttcttcgacatgaccttccccaccttcccagccgcgccggcggcggccatggagagctccttcgctggcagcagcgccacgtcggagacccggagccccgggaagaagctgagatacgacgacggcgactcgtccgaggggagcggctgtggctccgcgctggagctcgctgacgagctggcgttcgatccgtttatgctactgcagatgccctactctggcgggtacgattccctggacggccttttcgccgcagaggccgtgcagcaggacgtgaacaacgacatgaacggcgtcagcctgtggagcttcgacgagttccccgtcgacggctatgttttctga

SEQ ID NO: 15645 - protein, 335 aa, Sorghum bicolor
  misc_feature: Useful for making plants with altered lignin content
  misc_feature: Functional homolog of the protein sequence given in SEQ ID NO 13219
  misc_feature: The sequence is a functional homolog of SEQ ID NO 20 in the 10/903,236 US patent application
  misc_feature: The sequence is a functional homolog of SEQ ID NO 2213 in the 10/666,642 US patent application
  misc_feature: The sequence is a functional homolog of SEQ ID NO 80 in the 10/714,887 US patent application
  misc_feature: The sequence is a functional homolog of SEQ ID NO 80 in the 11/435,388 US patent application
  misc_feature: Ceres ANNOT ID no. 8642803
  misc_feature (108)..(159): Pfam ID: AP2 Pfam Description: AP2 domain
MCGGAILAELIPPTRRVAPKPVTEGHLWPASSKKAGSGSNKRHHHEYADDDDFEAAFEEFDDDFDVHEDDEDHPDHFVFSSKSAFSPAHDGRRDARAAASQRTKRGRRHFHGIRQRPWGKWAAEIRDPHKGTRVWLGTFNTAEDAARAYDVEARRLRGSKAKVNFPAASARPRARRGKGNPRTAPKPAAQAQPALLLRGEKGLEGVAVKPETTMDMFDVGSFFDMTFPTFPAAPAAAMESSFAGSSATSETRSPGKKLRYDDGDSSEGSGCGSALELADELAFDPFMLLQMPYSGGYDSLDGLFAAEAVQQDVNNDMNGVSLWSFDEFPVDGYVF

SEQ ID NO: 15646 - DNA, 1329 bp, Sorghum bicolor
  misc_feature: Ceres ANNOT ID no. 8642832
  misc_feature: Encodes the peptide sequence at SEQ ID NO 15647
atggcggcgaggccggcggggtgtggctcgctgttcggctgcttcggcagcagcagcagcagctcccacgagaacggaggcagcacgaagaagaagggcgggaagaagaagaagaagaagagcaagcagcagcagaaggtggcggcggggagcggcagcggcaggccgcggtcgctgcagagccggatgtcgttcaatgagctgagcctgagcgggatggtgtcgcccgaggacctgtcgctatcgctcgtcggctccaacctccacgtcttcaccatcgccgacctgcgcgccgtcacccgggacttctccatgaccaacttcatcggcgaaggaggcttcggccccgtctacaaggggtacgtcgacgacaagacaaagccggggctcgccgcgcagaccgtcgccgtcaagctgctcgacctcgagggcggacaaggacacaccgaatggctgacggaagtgttcttcctgggacagctgaggcaccctcacctggtgaagctgatcggctactgctacgaggacgagcacaggctgctcgtctacgagttcatgaccaggggcagcctggagaagcatctcttcaaaaaatacgctgcgtcgttgccatggtcaacacggctgaagatcgccattggcgctgctaaagggttggccttcctccatgaagccgagaagccggtcatctaccgggacttcaagacctccaacatcctgctggactcggattacaaggcgaagctgtcggatttcggtctggccaaggacggtccggaggacgacgagacgcacgtgtcgacgcgagtcatgggcacgcagggctacgcggcgccggagtacatcatgacgggccacctgacggcgaagagcgacgtgtacggcttcggcgtggtgctgctggagctgctgtcgggccgcaaggcggtggacaagacccggccggcgagggagcagagccttgtggagtgggcgcgcccgtacctgacggacgcgcgccgcctggaccgcgtcgtcatggaccccaacctcgccggccagtactccgcccgcgccgcgcacagggccgccgccgtcgcgcaccagtgcgtcgcgctcaacccaaagtcacggccacacatgtccgccgtcgtcgacgcgctcgagccgctcctcgcgctcgacgactgcggcatcgtcgggccattcgtctacgtcgcgccgccggagacggtcaccaaaggggacgaagcggcggtgggtaataagagagggtccggcagacgaggaggccggaggaggtcgtcaggagaaggcggtgcggcggccgtcgtgcggccggaggagtga

SEQ ID NO: 15647 - protein, 442 aa, Sorghum bicolor
  misc_feature: Useful for making plants with modulated drought sensitivity
  misc_feature: Functional homolog of the protein sequence given in SEQ ID NO 14078
  misc_feature: Useful for making plants with modulated heat sensitivity
  misc_feature: Functional homolog of the protein sequence given in SEQ ID NO 14079
  misc_feature: Ceres ANNOT ID no. 8642832
  misc_feature (47)..(416): SWISSPROT Homolog: EC 2.7.11.1 Non-specific serine/threonine protein kinase
  misc_feature (103)..(381): Pfam ID: Pkinase_Tyr Pfam Description: Protein tyrosine kinase
MAARPAGCGSLFGCFGSSSSSSHENGGSTKKKGGKKKKKKSKQQQKVAAGSGSGRPRSLQSRMSFNELSLSGMVSPEDLSLSLVGSNLHVFTIADLRAVTRDFSMTNFIGEGGFGPVYKGYVDDKTKPGLAAQTVAVKLLDLEGGQGHTEWLTEVFFLGQLRHPHLVKLIGYCYEDEHRLLVYEFMTRGSLEKHLFKKYAASLPWSTRLKIAIGAAKGLAFLHEAEKPVIYRDFKTSNILLDSDYKAKLSDFGLAKDGPEDDETHVSTRVMGTQGYAAPEYIMTGHLTAKSDVYGFGVVLLELLSGRKAVDKTRPAREQSLVEWARPYLTDARRLDRVVMDPNLAGQYSARAAHRAAAVAHQCVALNPKSRPHMSAVVDALEPLLALDDCGIVGPFVYVAPPETVTKGDEAAVGNKRGSGRRGGRRRSSGEGGAAAVVRPEE

SEQ ID NO: 15648 - DNA, 2286 bp, Sorghum bicolor
  misc_feature: Ceres ANNOT ID no. 8642881
  misc_feature: Encodes the peptide sequence at SEQ ID NO 15649
atgctcgcaatccgttcgacgaaatgccctgtggcatttgtgggcgtagccggcgccctggtggtgcttgtcaccgctgttcatgtgttcatggtgccaatccttcctgcctccttggattacttcggtgctcgcagcagtataagccgcccaaataatgttcttccggccgtcggggtggtggactctcgtctcagggggcgcttcccttctgattcatatggcgccgtggcatttcgtggcgcgccatggaaggctgagattggtagatggcttgctgggtgtcatgccaactcttcgtctgttgatgttactgaggctataggtgcaaagcgctgtgagaaagactgcagtggtcgtggtgtttgcaactataatctgggagagtgcagatgctttcatggatattccggtctatggatagtttccacctgtgcagctcactgtgataaaacaagggcaatgtgcttttgtgggcctggaacaaagtacccagatcgtcctgtggcagaagcttgtggttttaaaacaattttacctgcaaaacctgatgatccaaagcttaccgattggaaaacacctgacctggaaaacatattcacaacaaacagcagtgagttaggatggtgtaatgtggtacctgaggatgcgtattcatccaaagtgaagtttaaagaagaatgtgattgcaaatatgatggtctctgggggcagttctgtgagacacgtgttgaatgcagctgcatcaaccagtgctctggacatggacattgccatggtggtttctgtcagtgtgacagtggatattttgggattgattgcagtatcccatcagcatattcgcttacacatgattggccctcgtggctccagacaccagtgaattcaccagatctgaaaattttaaacagtaccaccattgatgttaaggccgttgttcagaaaaaaagaccactcatatatgtttatgatttgccagctgagtttgacagtcatcttcttgaaggacgacattacagattccagtgtgtaaacagaatatatgatgacaagaacagaactgtatggacccagcaattgtatggtgctcagatagcactctacgagagcattcttgctagccctcaccgcactcttaatggggatgaagctgattatttctatgtgccagtgcttgactcatgtctaataactagatctgatgatgctccacatctgctattgccgagggacctgcgccgaaggagctaccatgcacttgagtactatagaatggcgtatgatcacatagctcagcagtatccttactggaatcgcacttcgggaagagaccatatctggttcttttcatgggatgaaggtgcctgctatgctccaaaagagatctggaacagcatgatgcttgtccactggggaaacactaatacaaaacataagaattcaacgactgcttattgggcagacaactgggatgatattcctttggataagagaggcaaccatccatgttttgatccaagaaaggatctagtgcttccggcgtggaaggaaccaaaccctggggcaatatggttaaaactgtgggcaaggcctaggaagaaccgtacaacactcttttatttcaacggtaatctaggttcagcatacgaaggaggccgcccagaagacacgtatagcatggggattcggcaaaagctagcagctgaatttggttctacaccaaacaagcagggaagccttggacgacagcatgcagccgatgtgacagttacctatttacgaactgagaaatattatgaagaactagcaagctctgttttttgtggtgtcctgccaggggatggctggagtgggcgtatggaagacagcatgcttcaaggatgcattcctgtaataattcaggatggaatttttctaccatatgagaatgcactcaactataatagttttgcagtgcgcatacaagaagatgacatcccaggcctcataagtacacttcgaggaataaacaatacacaagtggagtttatgctgggaaatgtccgccagatatggcagaggtttttctatcgagactctatattgttagaggcgcagagacagaaaggactgttctctgaagaggcaccctggtctgttgaggtctcaaaactacctcacgatgacgatgcctttgcgacatttatacaggtattgcattataagctgtacaatgacccttggcgtcaaggtctcctgcaaacaaaggaaactcggctgccgaacatctgctcaagaacatcctga

SEQ ID NO: 15649 - protein, 761 aa, Sorghum bicolor
  misc_feature: Useful for making plants with altered cell wall content and/or composition
  misc_feature: Functional homolog of the protein sequence given in SEQ ID NO 14239
  misc_feature: Ceres ANNOT ID no. 8642881
  misc_feature (320)..(681): Pfam ID: Exostosin Pfam Description: Exostosin family
MLAIRSTKCPVAFVGVAGALVVLVTAVHVFMVPILPASLDYFGARSSISRPNNVLPAVGVVDSRLRGRFPSDSYGAVAFRGAPWKAEIGRWLAGCHANSSSVDVTEAIGAKRCEKDCSGRGVCNYNLGECRCFHGYSGLWIVSTCAAHCDKTRAMCFCGPGTKYPDRPVAEACGFKTILPAKPDDPKLTDWKTPDLENIFTTNSSELGWCNVVPEDAYSSKVKFKEECDCKYDGLWGQFCETRVECSCINQCSGHGHCHGGFCQCDSGYFGIDCSIPSAYSLTHDWPSWLQTPVNSPDLKILNSTTIDVKAVVQKKRPLIYVYDLPAEFDSHLLEGRHYRFQCVNRIYDDKNRTVWTQQLYGAQIALYESILASPHRTLNGDEADYFYVPVLDSCLITRSDDAPHLLLPRDLRRRSYHALEYYRMAYDHIAQQYPYWNRTSGRDHIWFFSWDEGACYAPKEIWNSMMLVHWGNTNTKHKNSTTAYWADNWDDIPLDKRGNHPCFDPRKDLVLPAWKEPNPGAIWLKLWARPRKNRTTLFYFNGNLGSAYEGGRPEDTYSMGIRQKLAAEFGSTPNKQGSLGRQHAADVTVTYLRTEKYYEELASSVFCGVLPGDGWSGRMEDSMLQGCIPVIIQDGIFLPYENALNYNSFAVRIQEDDIPGLISTLRGINNTQVEFMLGNVRQIWQRFFYRDSILLEAQRQKGLFSEEAPWSVEVSKLPHDDDAFATFIQVLHYKLYNDPWRQGLLQTKETRLPNICSRTS

SEQ ID NO: 15650 - DNA, 951 bp, Sorghum bicolor
  misc_feature: Ceres ANNOT ID no. 8642880
  misc_feature: Encodes the peptide sequence at SEQ ID NO 15651
atggagagccacggcggccggaagcgcgcgtggaagaagggcccgacgcgggggaagggcggcccgcagaacgcggcgtgcgagtaccgcggcgtgcgccagcggacgtggggcaagtgggtggccgagatccgcgagcccaacaagcgcacccgcctctggctcggctccttcgccaccgccgaggaggccgcgctcgcctacgacgaggccgcgcgcaggctctacgggcccgacgccttcctcaacctgccgcacctacgcgcctccgtctccgccgccgccgcgcaccagaggctcaggtggctcccggcctccgccgccaggggcgccgcggcagccgccgtcccggcctacggcctgctcaacctcaacgcgcagcacaacgtgcacgtcatccaccagaggctgcaggagctcaagaacggcggctcgaccgccaagccgccgcctgcccgccaggtcgtcgccccggtcgatcatctccctgcggcggcctccacgtctccctgctccaccgtcaccacccacgcggctctgccgccgcccatgtcctgcttccacgccctggagcaggcggtggccacggccgccatgacgacggtcgacgacgacgccgagccgtgcgaggccggcggcgcctgcccgcccggcgccgacaagccccagctcgacctcagggagttcttgcagcagatcggagtgctcaagaccgacgacgacgacggcacggccactgctaaagccagctttcacggtgatgccgccgacgctgctggctgcttcggcggcaacggcgagttcgactgggacgcgctggcagcggacctcaacgacatcgcgggagcccacggcggcgccgtcggcgtcaacggaggttttcagatggacgatctgcatgaggtcgaccagttcggcacctgcctgcccatccctgtctgggacgtctag

SEQ ID NO: 15651 - protein, 316 aa, Sorghum bicolor
  misc_feature: Useful for biocontainment applications
  misc_feature: Useful for making plants with modulated biomass
  misc_feature: Functional homolog of the protein sequence given in SEQ ID NO 14240
  misc_feature: Ceres ANNOT ID no. 8642880
  misc_feature (27)..(78): Pfam ID: AP2 Pfam Description: AP2 domain
MESHGGRKRAWKKGPTRGKGGPQNAACEYRGVRQRTWGKWVAEIREPNKRTRLWLGSFATAEEAALAYDEAARRLYGPDAFLNLPHLRASVSAAAAHQRLRWLPASAARGAAAAAVPAYGLLNLNAQHNVHVIHQRLQELKNGGSTAKPPPARQVVAPVDHLPAAASTSPCSTVTTHAALPPPMSCFHALEQAVATAAMTTVDDDAEPCEAGGACPPGADKPQLDLREFLQQIGVLKTDDDDGTATAKASFHGDAADAAGCFGGNGEFDWDALAADLNDIAGAHGGAVGVNGGFQMDDLHEVDQFGTCLPIPVWDV

SEQ ID NO: 15652 - DNA, 609 bp, Sorghum bicolor
  misc_feature: Ceres ANNOT ID no. 8642892
  misc_feature: Encodes the peptide sequence at SEQ ID NO 15653
atggaggaagggctcgggcttcccggccgtggaggaagggaaccgcgtcgggcttcccggccgtggaggacaaaacctccgtatcgcacaaaacctccaccacgcgaccgcaagtaccgcggcgtccggcagcggccctggggcaagtacgcggcggagatccgcgacccgaagcggtgtggctcgcgcgtgtggctcggcacgtacgacgcgcccgtcgaggccgcgcgcgcctacgaccgcgccgcgttccggatgtgcgccgccaaggccatcctcaacttccccaacgaggtcggcacccgcggcgctgacctttgggccgcgccagcgacgatggagggtggtcaggacgaccccgaggtcgaggtggtcgcggtggtgaacaaggtggtgaagatcgaggcgccgccgccgccgtcgacccaggtgtcctcaacctcgccgtcgtccgtgtctacacccgagaccaccgcctcatcggacgccccggactcgcgacgaccttccctgtcgtctggcgacgtcctggttcgccagcagaagcaatctcgtcgccgcaacactcccaagtatgaattaaaaaaaatactaggatgtatcttgtag

SEQ ID NO: 15653 - protein, 202 aa, Sorghum bicolor
  misc_feature: The sequence is a functional homolog of SEQ ID NO 18 in the 10/903,236 US patent application
  misc_feature: The sequence is a functional homolog of SEQ ID NO 2211 in the 10/666,642 US patent application
  misc_feature: The sequence is a functional homolog of SEQ ID NO 78 in the 10/714,887 US patent application
  misc_feature: The sequence is a functional homolog of SEQ ID NO 78 in the 11/435,388 US patent application
  misc_feature: The sequence is a functional homolog of SEQ ID NO 1354 in the 10/666,642 US patent application
  misc_feature: The sequence is a functional homolog of SEQ ID NO 171 in the 11/479,226 US patent application
  misc_feature: The sequence is a functional homolog of SEQ ID NO 18 in the 10/714,887 US patent application
  misc_feature: The sequence is a functional homolog of SEQ ID NO 18 in the 11/435,388 US patent application
  misc_feature: The sequence is a functional homolog of SEQ ID NO 1954 in the 10/374,780 US patent application
  misc_feature: The sequence is a functional homolog of SEQ ID NO 8 in the 10/666,642 US patent application
  misc_feature: The sequence is a functional homolog of SEQ ID NO 8 in the 10/903,236 US patent application
  misc_feature: The sequence is a functional homolog of SEQ ID NO 20 in the 10/903,236 US patent application
  misc_feature: The sequence is a functional homolog of SEQ ID NO 2213 in the 10/666,642 US patent application
  misc_feature: The sequence is a functional homolog of SEQ ID NO 80 in the 10/714,887 US patent application
  misc_feature: The sequence is a functional homolog of SEQ ID NO 80 in the 11/435,388 US patent application
  misc_feature: The sequence is a functional homolog of SEQ ID NO 162 in the 10/714,887 US patent application
  misc_feature: The sequence is a functional homolog of SEQ ID NO 162 in the 11/435,388 US patent application
  misc_feature: The sequence is a functional homolog of SEQ ID NO 30 in the 10/903,236 US patent application
  misc_feature: Useful for making plants with altered lignin content
  misc_feature: Functional homolog of the protein sequence given in SEQ ID NO 13219
  misc_feature: Ceres ANNOT ID no. 8642892
  misc_feature (37)..(89): Pfam ID: AP2 Pfam Description: AP2 domain
MEEGLGLPGRGGREPRRASRPWRTKPPYRTKPPPRDRKYRGVRQRPWGKYAAEIRDPKRCGSRVWLGTYDAPVEAARAYDRAAFRMCAAKAILNFPNEVGTRGADLWAAPATMEGGQDDPEVEVVAVVNKVVKIEAPPPPSTQVSSTSPSSVSTPETTASSDAPDSRRPSLSSGDVLVRQQKQSRRRNTPKYELKKILGCIL

SEQ ID NO: 15654 - DNA, 279 bp, Sorghum bicolor
  misc_feature: Ceres ANNOT ID no. 8642907
  misc_feature: Encodes the peptide sequence at SEQ ID NO 15655
atgtcgagccggaggtcacggtctaggcagtctggttcgtcgaggatcactgaggagcaaatcagcgaccttgtatcaaagctgcaggacctcctccccgaagctcgccttcagagcaatgctagagtgccatctgcgagggtgttgcaggagacatgcaactacatcaggagcttgcaccaggaggtggacgacctgagcgagaggctgtcggagctgctggctacgtccgacatgagcagcgcgcaggcggctgtcatccgaagcctgctcatgtag

SEQ ID NO: 15655 - protein, 92 aa, Sorghum bicolor
  misc_feature: Useful for making plants with modulated nitrogen use efficiency
  misc_feature: Useful for making plants with modulated seedling growth
  misc_feature: Functional homolog of the protein sequence given in SEQ ID NO 14152
  misc_feature: Useful for making plants with altered terpenoid content
  misc_feature: Functional homolog of the protein sequence given in SEQ ID NO 14241
  misc_feature: Useful for making plants with altered lignin content
  misc_feature: Useful for making plants with modulated biomass
  misc_feature: Functional homolog of the protein sequence given in SEQ ID NO 14242
  misc_feature: Useful for making plants with altered alkaloid content
  misc_feature: Useful for making plants with modulated flowering time
  misc_feature: Functional homolog of the protein sequence given in SEQ ID NO 14243
  misc_feature: Ceres ANNOT ID no. 8642907
MSSRRSRSRQSGSSRITEEQISDLVSKLQDLLPEARLQSNARVPSARVLQETCNYIRSLHQEVDDLSERLSELLATSDMSSAQAAVIRSLLM

SEQ ID NO: 15656 - DNA, 261 bp, Sorghum bicolor
  misc_feature: Ceres ANNOT ID no. 8642902
  misc_feature: Encodes the peptide sequence at SEQ ID NO 15657
atgtcgtcgggccggcgtggcaggatcagcgacgacgagatcaacgagctcatctccaagctgcaggcgctgctcccggagtcctcacgccgccggaacgccagccggtcgtcggcgtcgaagcttctgaaggagacgtgtgcctacatcaagagcctgcaccgggaggtggacgacctctcggaacggctgtcggggctcatgtcgaccatggacaacgacagcccacaggccgagatcatccggagcctcctccggtga

SEQ ID NO: 15657 - protein, 86 aa, Sorghum bicolor; identical to SEQ ID NO: 14244
  misc_feature: Useful for making plants with modulated nitrogen use efficiency
  misc_feature: Functional homolog of the protein sequence given in SEQ ID NO 14244
  misc_feature: Useful for making plants with altered terpenoid content
  misc_feature: Functional homolog of the protein sequence given in SEQ ID NO 14245
  misc_feature: Useful for making plants with modulated seedling growth
  misc_feature: Functional homolog of the protein sequence given in SEQ ID NO 14152
  misc_feature: Useful for making plants with altered lignin content
  misc_feature: Functional homolog of the protein sequence given in SEQ ID NO 14246
  misc_feature: Useful for making plants with modulated biomass
  misc_feature: Functional homolog of the protein sequence given in SEQ ID NO 14242
  misc_feature: Ceres ANNOT ID no. 8642902

SEQ ID NO: 15658 - DNA, 1059 bp, Sorghum bicolor
  misc_feature: Ceres ANNOT ID no. 8642913
  misc_feature: Encodes the peptide sequence at SEQ ID NO 15659
atggccagcaatggcatggcgtcctcaccctcgcccttcttccctccaaacttcctcctccaaatgcagcagacaccctccgatcatgacccccaagaacagcaacaccatcaccaccaccaccaccaccatgagcaccacctccctgctcctccccttcatcctcaccacaaccccttcctcccgtcctctcaatgcccctccctgcaagacttccgaggtatggcgccaatgctggggaagcgtccgatgtacggcgcggacgtcgtcgccggaggaggcgacgaggtgaacggctgcggcggcggcggcggcgcgaacgaggacgagctgtcggacgacggctcccaggccggggagaagaagcggcggctgaacgtggagcaggtgcggacgctggagaagaacttcgagctcgggaacaagctggagccggagcggaagctgcagctggcgcgtgcccttggcctgcagccgcggcaggtggccatctggttccagaaccggcgcgcgcggtggaagacgaagcagctggagaaggactacgacgcgctcaagcgccagctcgacgccgtcaaggccgacaacgacgccctcctctcccacaacaagaagctccaggccgagatactggcgctgaagggaggcagggaggcagggtcgtcggagctgatcaacctcaacaaggagacggaggcgtcctgcagcaaccgcagcgagaacagctccgagatcaacctcgacatctcgcgcacgccgccgtccgagggccccatggaccctccgccgccgcaccagcacccgcaccagcaccaccacgccgccggtggcggcttgatccctttctacccttccgtcggcggcggccgccctgctgctgctgctggcgtggacatcgaccagctcgtcctgcacacctccatcaccccaaagctggagccgctcggcaacggcgccgctgtccaggccgcggaaaccgccagcttcggcaacctcctgtgcggcgtcgacgagccgccgccgttctggccgtgggccgaccaccagcacttccattga

SEQ ID NO: 15659 - protein, 352 aa, Sorghum bicolor
  misc_feature: Useful for making plants with altered lignin content
  misc_feature: Functional homolog of the protein sequence given in SEQ ID NO 14247
  misc_feature: The sequence is a functional homolog of SEQ ID NO 1869 in the 11/479,226 US patent application
  misc_feature: Ceres ANNOT ID no. 8642913
  misc_feature (121)..(175): Pfam ID: Homeobox Pfam Description: Homeobox domain
  misc_feature (176)..(220): Pfam ID: HALZ Pfam Description: Homeobox associated leucine zipper
MASNGMASSPSPFFPPNFLLQMQQTPSDHDPQEQQHHHHHHHHHEHHLPAPPLHPHHNPFLPSSQCPSLQDFRGMAPMLGKRPMYGADVVAGGGDEVNGCGGGGGANEDELSDDGSQAGEKKRRLNVEQVRTLEKNFELGNKLEPERKLQLARALGLQPRQVAIWFQNRRARWKTKQLEKDYDALKRQLDAVKADNDALLSHNKKLQAEILALKGGREAGSSELINLNKETEASCSNRSENSSEINLDISRTPPSEGPMDPPPPHQHPHQHHHAAGGGLIPFYPSVGGGRPAAAAGVDIDQLVLHTSITPKLEPLGNGAAVQAAETASFGNLLCGVDEPPPFWPWADHQHFH

SEQ ID NO: 15660 - DNA, 1320 bp, Sorghum bicolor
  misc_feature: Ceres ANNOT ID no. 8642918
  misc_feature: Encodes the peptide sequence at SEQ ID NO 15661
atggggaattgcatcgacacgacggcgcgggtggatcacagcatgaacaatgctgcctacccatcaaaagtgaccagcaagacaagtttgtcatctgtcccttccacaatcaagagcaactcaactcgttcaactttgactcttccatcaatgagagatcgaagtgagcttcctactcctcggacagaaggcgaaatcttgtcatcttctaatttgaaggcattcacattcaatgatctaaaaaatgcaaccaagaacttccgaccggacagtcttcttggggaaggaggatttgggcatgtctacaaaggttggattgatgaacacacgcttgctccttcaagaccagggagtggtatggttgttgctgtgaagaagcttaaaccagaaggttttcaaggacacaaggagtggctgacagaggttgattaccttggccaacttcaccacaagaatcttgttaagctcattggctattgctcagatggtgataaccggcttctggtgtatgaatttatgcccaagggaagtttggagaaccatctgtttagaagaggcgcggatcctttgtcatgggcaataaggctcaaagttgctattggagctgctaggggcttgtcatttttacatgatgctgaaaaccaagtcatatatcgtgatttcaaggcatcaaacattctgctagattcagaattcaacgcaaaactttcagattttggcttagcaaaagccggtccaactggggataaaacccatgtatccacacaagtcatgggtactcatggatatgcagctccagagtacattgcaacaggccgcctctctgcaaaggcagatgtctatagcttcggggtggtgttgcttgaattgctcactggaagaagggccctggataaatcaaaaccaggctttgagcagaacctagttgactgggccagacctcacttgggcgacaagcgcagactataccgtatcatggacacgaagctgggaggacagtatccaaaaaaaggcgcaaatgccattgcaagcattgccttgcaatgcatttgcggtgacgccaagctgcgtcctcctatgtcgcaggtgttggaagagctggaacagctacaagatgccaaatatggttcaccatcaccattagtcgacataaggacagcttcacacgccgccccaaaatcaccaatgagcaccaccccaaaatcaccaatgagcaccaccccaaagtcgccaatgagagttcaaccttcaccacggcgctcacttggagcagcggcagcatccccattggcaggatatcgcactgcacaagtgcactag

SEQ ID NO: 15661 - protein, 439 aa, Sorghum bicolor
  misc_feature: Useful for making plants with modulated drought sensitivity
  misc_feature: Functional homolog of the protein sequence given in SEQ ID NO 14078
  misc_feature: Useful for making plants with modulated heat sensitivity
  misc_feature: Functional homolog of the protein sequence given in SEQ ID NO 14079
  misc_feature: Ceres ANNOT ID no. 8642918
  misc_feature: Up-regulated in root tissues in response to salicylic acid treatment
  misc_feature (58)..(371): SWISSPROT Homolog: EC 2.7.11.1 Non-specific serine/threonine protein kinase
  misc_feature (87)..(367): Pfam ID: Pkinase Pfam Description: Protein kinase domain
MGNCIDTTARVDHSMNNAAYPSKVTSKTSLSSVPSTIKSNSTRSTLTLPSMRDRSELPTPRTEGEILSSSNLKAFTFNDLKNATKNFRPDSLLGEGGFGHVYKGWIDEHTLAPSRPGSGMVVAVKKLKPEGFQGHKEWLTEVDYLGQLHHKNLVKLIGYCSDGDNRLLVYEFMPKGSLENHLFRRGADPLSWAIRLKVAIGAARGLSFLHDAENQVIYRDFKASNILLDSEFNAKLSDFGLAKAGPTGDKTHVSTQVMGTHGYAAPEYIATGRLSAKADVYSFGVVLLELLTGRRALDKSKPGFEQNLVDWARPHLGDKRRLYRIMDTKLGGQYPKKGANAIASIALQCICGDAKLRPPMSQVLEELEQLQDAKYGSPSPLVDIRTASHAAPKSPMSTTPKSPMSTTPKSPMRVQPSPRRSLGAAAASPLAGYRTAQVH

SEQ ID NO: 15662 - DNA, 1632 bp, Sorghum bicolor
  misc_feature: Ceres ANNOT ID no. 8642927
  misc_feature: Up-regulated in root tissues in response to salicylic acid treatment
  misc_feature: Encodes the peptide sequence at SEQ ID NO 15663
atggagttggaggggctgtgggcacgggtgctgctcgacgcggcctccgccgcagcgccgggggaccgggcggcgtgggcagcggtgcgggcgcgcgcggtggcgccggtgctggaggccgcggtgtgggcgtgcctcgccatgtcggtcatgctcgtgctcgaggtgtgctacatgagcgtcgccagcttcgtcgccgtcaacctgctgcgccggaccccggagcggcggtaccgctgggagcccatgccctccgggaccgccggcggccagcaggacgatgaggaggccgcggtgggcagcggcggcggcgaggcgtacccgatggtgctcgtgcagatccccatgtacaacgagagggaggtctacaagctctctattggagcagcatgtgccctcacatggccgctcgaccgtattataatccaagtcttggatgattccaccgatccattcattaaggaacttgtggagcttgaatgcgaggattgggccagaaagaaaataaatataaaatatgaaactcgagaaagtaggaagggatacaaagcaggagccctcaagaagggcatggaacagggttatgcccaagaatgtgattttgtcgccatctttgatgcagattttcagcctgatcctgacttccttttaagaactataccatttcttgtgcataacccgaagattgctttggtacagacacgttgggagtttgtgaactacaatatttgcctactgacaaggatacagaagatgtcactagattatcatttcaaggtagagcaggaatcaggctcatctatgcatgccttctttggtttcaacggtactgctggtgtgtggcgggtatcagctattagggaagcaggaggatggaaggatcgcaccactgtagaagacatggacttggctgtgcgagcaagtctcaagggatggcaattcctgtatgttggtgatataagggttaagagtgaactcccaagtaccttcaaggcctaccgccatcaacagcacaggtggacttgtggtgctgccaacctcttcagaaaaatggccggggacattggggtaactgtatggaagaagcttcatcttctgtacagcttcttctttgtccgaagggtcatcgctcccatcctgacattcctgttctactgcgtcgtgatcccactgtctgttatggtccctgaagtcagtatcccagtctggggaatgttctacattcccactgctatcacggtcatgaacgccatcaggaatccatggtctatccatctggtgccaatatggatcctgttcgagaacgtcatgtcaatgcaccgaatgcgcgcggcactgacggggttgctggagaccatgtacgtggatgagtgggtggtcaccgagaaggtgggcgaccatgtgaagggcaagctcgagatccctctccttacaccggtgaagccaaccgagtgcgtcgagaggatctacgtgcctgagctcctggtggcgttctacctgttgctatgcgcgtcatacgatgtcgtgctcggaaccgggcactgctacctgtacatcttcctccaggccttcgctttcctcgtgctgggatttggcttcgtcggcaccgcgacgccctgttcttgtccatag

SEQ ID NO: 15663 - protein, 543 aa, Sorghum bicolor
  misc_feature: Useful for making plants with altered cell wall content and/or composition
  misc_feature: Functional homolog of the protein sequence given in SEQ ID NO 13963
  misc_feature: Useful for making plants with altered carbohydrate content
  misc_feature: Functional homolog of the protein sequence given in SEQ ID NO 13964
  misc_feature: Ceres ANNOT ID no. 8642927
  misc_feature (107)..(509): SWISSPROT Homolog: EC 2.4.1.12 Cellulose synthase (UDP-forming)
  misc_feature (111)..(289): Pfam ID: Glycos_transf_2 Pfam Description: Glycosyl transferase family 2
MELEGLWARVLLDAASAAAPGDRAAWAAVRARAVAPVLEAAVWACLAMSVMLVLEVCYMSVASFVAVNLLRRTPERRYRWEPMPSGTAGGQQDDEEAAVGSGGGEAYPMVLVQIPMYNEREVYKLSIGAACALTWPLDRIIIQVLDDSTDPFIKELVELECEDWARKKINIKYETRESRKGYKAGALKKGMEQGYAQECDFVAIFDADFQPDPDFLLRTIPFLVHNPKIALVQTRWEFVNYNICLLTRIQKMSLDYHFKVEQESGSSMHAFFGFNGTAGVWRVSAIREAGGWKDRTTVEDMDLAVRASLKGWQFLYVGDIRVKSELPSTFKAYRHQQHRWTCGAANLFRKMAGDIGVTVWKKLHLLYSFFFVRRVIAPILTFLFYCVVIPLSVMVPEVSIPVWGMFYIPTAITVMNAIRNPWSIHLVPIWILFENVMSMHRMRAALTGLLETMYVDEWVVTEKVGDHVKGKLEIPLLTPVKPTECVERIYVPELLVAFYLLLCASYDVVLGTGHCYLYIFLQAFAFLVLGFGFVGTATPCSCP

SEQ ID NO: 15664 - DNA, 1275 bp, Sorghum bicolor
  misc_feature: Ceres ANNOT ID no. 8642924
  misc_feature: Encodes the peptide sequence at SEQ ID NO 15665
atgggggagggcagagcaggagacggcctcatcaagctgttcggcaagaccatccccgtgccggagacgcccgccgcgggcgacgctgccaaggacatccaacaaagcggcagcagcggcacgactgatctgaaggggcaagagaacacccttcaggattccacaggctcgcctccgcagcaggaggttgcggacactgaagactcgtcggctgccaagaactcctcggcagacaaacagcagggcgaggcggccaaccagaaggagaagctcaagaagcctgacaagatcctgccttgcccccggtgcaacagcatggacaccaagttctgctactataacaactacaacatcaaccagccacgccacttctgcaagaactgccagaggtactggactgctggcggtgccatgcgcaacgtccctgtgggtgcaggccggcgcaagagcaagagcgcgtcagctgcttcccacttccttcagagggtcagggccgctttgcccatggatcccctctgcactgcagccaagacgaatggcacggtgctcagcttcggctcagacatgtccagcttagacctcacagagcagatgaagcacctgaaggagaagctcatcccaatagcggggatcaagaacggcgatgaacgttcagttggctcttgcactgaaggacctgcgaaggcagaagactcaaaccaaaaggagaatgttacagcagagaaatctgcaaaacttgttcagcatccatgcatgaacggggtggccatgtggccatttagctgtgcaccaccacctgcctgttacaccccaggcagcatagcaattccgttctacccagcacctgctgcctactggggctgcatggttccaggagcttggaatgccccatggccgcctcagtccccgtccgagacaggttcgacccttagcactgcttcaccagcatccacgaagtccaattgcttcacaccaggaaagcgccctagagactgcaacgaggaaggagataccaaaggaaatggcaaggtgtgggtgccaaagacgatccgaatcgatgacgtggatgaggtggctaggagttctatcttgtcgctaatcgggatcaatggcgacaaggcaggcaaagatggcaaagggtgcaagcttgcaagggtttttgagcagaaagaagaggcaaggacggcaactcactcagtcatcaatggcttgccattcttgcaggggaacccagctgcgctctcacggtcattgaccttccaggagggatcttga

SEQ ID NO: 15665 - protein, 424 aa, Sorghum bicolor
  misc_feature: The sequence is a functional homolog of SEQ ID NO 1132 in the 10/374,780 US patent application
  misc_feature: The sequence is a functional homolog of SEQ ID NO 1331 in the 10/412,699 US patent application
  misc_feature: Ceres ANNOT ID no. 8642924
  misc_feature (93)..(155): Pfam ID: zf-Dof Pfam Description: Dof domain, zinc finger
MGEGRAGDGLIKLFGKTIPVPETPAAGDAAKDIQQSGSSGTTDLKGQENTLQDSTGSPPQQEVADTEDSSAAKNSSADKQQGEAANQKEKLKKPDKILPCPRCNSMDTKFCYYNNYNINQPRHFCKNCQRYWTAGGAMRNVPVGAGRRKSKSASAASHFLQRVRAALPMDPLCTAAKTNGTVLSFGSDMSSLDLTEQMKHLKEKLIPIAGIKNGDERSVGSCTEGPAKAEDSNQKENVTAEKSAKLVQHPCMNGVAMWPFSCAPPPACYTPGSIAIPFYPAPAAYWGCMVPGAWNAPWPPQSPSETGSTLSTASPASTKSNCFTPGKRPRDCNEEGDTKGNGKVWVPKTIRIDDVDEVARSSILSLIGINGDKAGKDGKGCKLARVFEQKEEARTATHSVINGLPFLQGNPAALSRSLTFQEGS

SEQ ID NO: 15666 - DNA, 504 bp, Sorghum bicolor
  misc_feature: Ceres ANNOT ID no. 8642934
  misc_feature: Encodes the peptide sequence at SEQ ID NO 15667
atggggcggccgccgtgctgcgacaaggagggcgtgaagaagggccccttgcccccccaggggggcctgtttttttttttttttttttttaggagaggggccacccccccccccccccccccccagtccccgccaacacacaggtgggtgtacacttcaagagctgccgcctccggtggaccgggcatccgccggggcggcttctccgaccaggaggaccggctcatcgtcgtccacctccaggcgctcctcggcaaccgctgggccgccatcgcctcctacctccccgatcgcaccgacaacggcgtcaagaattactggaacacgcacgtcgcctcgttgccgcccaagggccagcgggagctcaagctgccgaccgacatcgaccttttagtttttctgttttcaagtcgttgctttttttcccaactggctgcaagttttactgaaagtgattgcctttgcacaaataatcaaccagtcaccaagggaggcaatgtataa

SEQ ID NO: 15667 - protein, 167 aa, Sorghum bicolor
  misc_feature: Useful for making plants with altered cell wall content and/or composition
  misc_feature: Functional homolog of the protein sequence given in SEQ ID NO 13602
  misc_feature: Ceres ANNOT ID no. 8642934
  misc_feature (65)..(111): Pfam ID: Myb_DNA-binding Pfam Description: Myb-like DNA-binding domain
MGRPPCCDKEGVKKGPLPPQGGLFFFFFFFRRGATPPPPPPQSPPTHRWVYTSRAAASGGPGIRRGGFSDQEDRLIVVHLQALLGNRWAAIASYLPDRTDNGVKNYWNTHVASLPPKGQRELKLPTDIDLLVFLFSSRCFFSQLAASFTESDCLCTNNQPVTKGGNV

SEQ ID NO: 15668 - DNA, 2049 bp, Sorghum bicolor
  misc_feature: Ceres ANNOT ID no. 8642937
  misc_feature: Encodes the peptide sequence at SEQ ID NO 15669
atggcatcagtgccagactccacggcatacactgatgacgcgcagccagcttccgcgatgccgtcgatctcaccggcagatttacttgcctgctcaggccgcgctggcatcgagctcttcaccgcgatgcgccgcgcgggcgccgctcccgacgccttcaccttcaccttcgtcctcaaatcttgctcccgctgccattcgcctggtcggttgccttctgacctccacgctcaggcgttcaagcacggttgcctcagcgcgcggagcgagcacgttcatgtacacaatgctttgctgcacgcgtacgcgtctcggtccgccgtcgacgacgcccacagggtgttcgacgaaatgcccgtcagggatgtagtctccttctcagggctacttacggcgcacctcaaaaacaaccagctggactccgcgcgcatggtgtttgaccagatgccacaccgtgatgttgtttcctggactgccatgatctctgcctatgccagggcttcacgtccacaggacgccctggcattgtttgatgcaatgccagtgcaaccagacgaggtgaccatggtaagtgttgtgtcagcatgcactgcacttggggaccttgcgactggggagcgtctgcgtctttatgttgattccaatggttttgggtggatggtttcactccgcaatgcactcatggacatgtatgctaagtgtgggtgcctacctgaagcacgcgagttgtttgatgggatggcaataaggagcttggcatcttggaatacacttatcttagcatatgcatcacatggtgatgaggaaagcacaattgctttgtttcatcaaatgctggctcatgacaattctgtgaagccagatggggtgacgctgcttgcagtgctcaccatgtatgcacacaagggctgtgttgaggaggggcgcactgtgtttgatgcgatgcaaagaggagattatggcaaagtggagctgaccgtcgagcactatgggtgcatggtggacttgcttagtcgggcaggacaccttgaggaagcttacaagatgatagagcaaatgtcgattccaagcaatgatgtggtctggggtgtgttacttggtgcatgtcgtatgcatggcaatattgacatggcagagaaggcagtccaaaaactacggatcctaaacccacatgagggtggttactacattttgctcatagatatgtacacagccgctggccgaacagcagaagccatggaggatgccgtggatgctgttccactgaacaaccaagtgcgcaccatcatcaggattggtcctggtgtgcatcggcagccagtgcacattcccaagaccaagaaattcatcaccttgtgtggatccccaataaaggacatggtgatctgttgggacaacacgactactcacatcaagcatactcaggggggtgatttcgttgcagagaatgttatttttaagaactcagcttcccaggtgtctgggctagcagcagcagtccatgtgatggccaacaggtgtgccttctatggttgcacatttctcggatggcaggaaactttacatttgcatggtggaaagcagttcttgaaaaactgttacattgaaggtaattacgacttcatctttggagattctactgcccttctggagcattgccatatccactgcaaagcagcaggatatattactgctcatggccgcaaatcctcttcagaatcaactggatttgtattcttcaagtgtgttattacttgtaatggagaagctgcatatatatacctagaaacttttatggatcactgcatagagcctgttgggtggcataattgggacaaacctgagaatgagcaaactgcctgcttctacgagtacaggtgctccggtccaggatccagcacattggaacaggtaccttggtgcaaagaattgttcggtgatgaagctataccgttccttatacaaactttcattgatccagatatcgagaatccatggttggttcacaggttgggaactcaagtcccagttccagcgtcttcaccgtag

SEQ ID NO: 15669 - protein, 682 aa, Sorghum bicolor
  misc_feature: Useful for making plants with altered cell wall content and/or composition
  misc_feature: Functional homolog of the protein sequence given in SEQ ID NO 14151
  misc_feature: Ceres ANNOT ID no. 8642937
  misc_feature (411)..(581): SWISSPROT Homolog: EC 3.1.1.11 Pectinesterase
  misc_feature (414)..(661): Pfam ID: Pectinesterase Pfam Description: Pectinesterase
  misc_feature (155)..(189): Pfam ID: PPR Pfam Description: PPR repeat
MASVPDSTAYTDDAQPASAMPSISPADLLACSGRAGIELFTAMRRAGAAPDAFTFTFVLKSCSRCHSPGRLPSDLHAQAFKHGCLSARSEHVHVHNALLHAYASRSAVDDAHRVFDEMPVRDVVSFSGLLTAHLKNNQLDSARMVFDQMPHRDVVSWTAMISAYARASRPQDALALFDAMPVQPDEVTMVSVVSACTALGDLATGERLRLYVDSNGFGWMVSLRNALMDMYAKCGCLPEARELFDGMAIRSLASWNTLILAYASHGDEESTIALFHQMLAHDNSVKPDGVTLLAVLTMYAHKGCVEEGRTVFDAMQRGDYGKVELTVEHYGCMVDLLSRAGHLEEAYKMIEQMSIPSNDVVWGVLLGACRMHGNIDMAEKAVQKLRILNPHEGGYYILLIDMYTAAGRTAEAMEDAVDAVPLNNQVRTIIRIGPGVHRQPVHIPKTKKFITLCGSPIKDMVICWDNTTTHIKHTQGGDFVAENVIFKNSASQVSGLAAAVHVMANRCAFYGCTFLGWQETLHLHGGKQFLKNCYIEGNYDFIFGDSTALLEHCHIHCKAAGYITAHGRKSSSESTGFVFFKCVITCNGEAAYIYLETFMDHCIEPVGWHNWDKPENEQTACFYEYRCSGPGSSTLEQVPWCKELFGDEAIPFLIQTFIDPDIENPWLVHRLGTQVPVPASSP

SEQ ID NO: 15670 - DNA, 1773 bp, Sorghum bicolor
  misc_feature: Ceres ANNOT ID no. 8642989
  misc_feature: Encodes the peptide sequence at SEQ ID NO 15671
atggccacattcttctccacttccacgaatcagagggacctcaccggaggcggcggcgacatgtcgttccaccactacacctactcagactcaccagccggcggcctcatgcctttccccgccaccatcgtgtcggaaggccacgtcgcgcatggcggtgacgacggcagggacgagccggccgcgttcgtgaacgtgaacgtaaacgcaagggacgggacgacgagcggcgccgagatgggcctgcagacgcagctgctcatggcgaacgcgtcggcggcggtgcagcaccaggggctgtcgcttagccttggcacgcagggagtgccggtgtctctttaccagtaccgccaggcgcagcaggcaggcatggccgccgccgcctccttgctaagcccgaaccaggcgtcggcggcggcgagcaggaacgcgcagagcatctacatccagaactccaagtacctcaaggccgcgagggagctgctggacgaggtggtcaatgtccgggacgcgatcaagcggaagggggcggacaagaaccagcagggtaaggattccggcggcgagggcaaggacgccgagacgagcgacgacaaggccgacgagcacgaagggaactcctccgcggcggagctgacaccgtccgagaggcaagatctccagaacaaagtgtcggcactgatggcgctgctggatcaggtggaccgcaagtacaggcactaccaccaccagatgcagatcgtgatgtcgtccttcgacgcggtggccggcgccggcgcggcgaggccgtacacggcgctggcgctgcagaccatctcccgtcacttccggtcgctgcgtgacgccgtgggcgcgcaggtgcagtcgctgcggcggagcctgggcgagaaggacacctcggcgcacggcggcgggctgtcccggctccgctacatcgaccagcagctgcggcagcagcgcgccatgcagcagttcggcatgatgcagcagccgcagcacgcgtggcgcccccagcgcggcctcccggagtccgccgtctccgtgctccgcgcctggctcttcgagcatttcctccacccgtacccgaaagattcggagaagctgatgctcgctaggcagacaggcttgtctaggggtcaggtgtccaactggttcatcaacgcgcgagttcgtctgtggaagccgatgatcgaggagatgtacaaggaggaattcggggcggagatggactcgcactcgtcgtcggagaacgcggcgggcaacaagggcaaggcggacgaggcgatatcctcggaggaccacgacgagttccagagcccgtcgagcgccgctgcaaagcacggcgctgcagcaggtcaccacctcagcgcgttcaagtcggaggcgatcggtggcatggacgccgccggcgtcggcgtcggcgtcggcctgtccagcctcgacggcgccattggcccgtacgcgaccagcctcaacctcggcgctgctgtcgtcggcaacggcctgcaggaggccttcgcgcaccaccacggcggtggagacgcgaggttcgtgcaggcgtacggcgacatggccggcctcggcggctacgacggcggcagcgtgtcgctgacgctgggcctgcagcactgcaacgacgccggcgccgtgcccgccgagcagcagggcggtctcctgtacggcaacgccggcgacttcgagttcatcaacggctccgccgaggacaggcagcggttcggctcgtcgcagctgctgcacgattttgtcgcgtga

SEQ ID NO: 15671 - protein, 590 aa, Sorghum bicolor
  misc_feature: The sequence is a functional homolog of SEQ ID NO 1877 in the 11/479,226 US patent application
  misc_feature: The sequence is a functional homolog of SEQ ID NO 436 in the 10/666,642 US patent application
  misc_feature: The sequence is a functional homolog of SEQ ID NO 820 in the 11/435,388 US patent application
  misc_feature: Ceres ANNOT ID no. 8642989
  misc_feature (147)..(285): Pfam ID: POX Pfam Description: Associated with HOX
MATFFSTSTNQRDLTGGGGDMSFHHYTYSDSPAGGLMPFPATIVSEGHVAHGGDDGRDEPAAFVNVNVNARDGTTSGAEMGLQTQLLMANASAAVQHQGLSLSLGTQGVPVSLYQYRQAQQAGMAAAASLLSPNQASAAASRNAQSIYIQNSKYLKAARELLDEVVNVRDAIKRKGADKNQQGKDSGGEGKDAETSDDKADEHEGNSSAAELTPSERQDLQNKVSALMALLDQVDRKYRHYHHQMQIVMSSFDAVAGAGAARPYTALALQTISRHFRSLRDAVGAQVQSLRRSLGEKDTSAHGGGLSRLRYIDQQLRQQRAMQQFGMMQQPQHAWRPQRGLPESAVSVLRAWLFEHFLHPYPKDSEKLMLARQTGLSRGQVSNWFINARVRLWKPMIEEMYKEEFGAEMDSHSSSENAAGNKGKADEAISSEDHDEFQSPSSAAAKHGAAAGHHLSAFKSEAIGGMDAAGVGVGVGLSSLDGAIGPYATSLNLGAAVVGNGLQEAFAHHHGGGDARFVQAYGDMAGLGGYDGGSVSLTLGLQHCNDAGAVPAEQQGGLLYGNAGDFEFINGSAEDRQRFGSSQLLHDFVA

SEQ ID NO: 15672 - DNA, 939 bp, Sorghum bicolor
  misc_feature: Ceres ANNOT ID no. 8642981
  misc_feature: Encodes the peptide sequence at SEQ ID NO 15673
atggatcagctggtcaccatggcgatggccgctcagccggcgagccccacctcgccgcacgtcgcgcacaagatccccgccggcgacgggccttacgctagggccaagcacttccagctggtggagaaggacctggacgcgtcgatcgcgtggttctggaaggcgatcagcacgggcgacaaggtggacagcgcgctcaaggacatggcggtggtgatgaagcagcgcgggtacctgacggaggccatcgacgccatccggtcgctccggcacctctgccccaagcagtcccaggagtcgctggacaacatcctcctggacctctacaaggccagtggccggaccaaggaggagatcgagctgctcaagcagaagctccgcaagatctacctcggcgaggcgttccatggcaagaccaccaagcgcgcccgctcgcacggccgcaagatccacgtctccgtcaggcaagagacctcgcgcatcctgggcaacctcgcgtgggcgtacatgcagcagcgcaacttcatggcggcggaggtggtgtaccggaaggcgcagatgatcgacccggacgccaacaaagcctgcaacctcgcgctctgcctcatcgagcagacccggttcgccgacgccgagctcgtcctcgccgacgtgctcgccgggaggtacctggcgcgcgaccagcagcaggacggcaagatcgtccggaaagtggaggagctgctggcccggatcgtggcgcagacgtggccgggcggcggcgccaacagcggacgccgccgggacgagagcgggagcgagagcgacgacgacgatgactgggtcgagaaccagatgttggctctcctggacgtggcggtgccgtaccggaagagcagcaagaggctgcccgtgttcgaggagatctcgcctgtctacagggagcaggtggcttgctag

SEQ ID NO: 15673 - protein, 312 aa, Sorghum bicolor
  misc_feature: Useful for making plants with altered terpenoid content
  misc_feature: Functional homolog of the protein sequence given in SEQ ID NO 13067
  misc_feature: Ceres ANNOT ID no. 8642981
  misc_feature (159)..(192): Pfam ID: TPR_1 Pfam Description: Tetratricopeptide repeat
MDQLVTMAMAAQPASPTSPHVAHKIPAGDGPYARAKHFQLVEKDLDASIAWFWKAISTGDKVDSALKDMAVVMKQRGYLTEAIDAIRSLRHLCPKQSQESLDNILLDLYKASGRTKEEIELLKQKLRKIYLGEAFHGKTTKRARSHGRKIHVSVRQETSRILGNLAWAYMQQRNFMAAEVVYRKAQMIDPDANKACNLALCLIEQTRFADAELVLADVLAGRYLARDQQQDGKIVRKVEELLARIVAQTWPGGGANSGRRRDESGSESDDDDDWVENQMLALLDVAVPYRKSSKRLPVFEEISPVYREQVAC

SEQ ID NO: 15674 - DNA, 4191 bp, Sorghum bicolor
  misc_feature: Ceres ANNOT ID no. 8643017
  misc_feature: Encodes the peptide sequence at SEQ ID NO 15675
atggcgaaccagcagcatcggtcctccatcgccggcatggaccgggagctgttccggacggtacgtcaggcggcgctgaaccacgcgaggctgctgtaccaccgcctcgtcagccgccttccgcacctcctggccgtcacgctcgtcgtggccgcggcccagctcgtgccgccaccgtcgtccgcgcacgccgcccggacgctcctgcgcgaggcggcggcgcgcgccgacgcggggctcgtggccgcggcgctggcggcgtgcgcgtgcgcgtgcgcgtacgccgcgctgcgcccgcggcccgtgtacctggtggacctggcggcgtaccgtcccggccccgcgcaccgggccacccgcgccgagtccgtccgccacttcgcgctggcggggcggttcacggacgagagcgtcgcgttccagacgcggatgctggagcgcgcgggcgtcggggacgccacccacttcccggcatccatcctcgccaaccccgtcgacatgagcctccgcgccgccagggaggagtccgaggccgtcgtcttcggcgtcgtcgacgacctgctgcgcaccacggccgtgcgcgcggcggacgtcggcgtcgtcatcgtcaactccagcctcttcagccccacgccgtccttcacgtcgctgctcgtcaaccgctacggcctccggcacgacgtcgtcacacacaacctcagtggcatggggtgcagcgcaggcatcatcgccattgacctcgccaaacacctgcttcaggtgcacccgaacacgtacgcgctggtggtgagcacggagaacatcacgctgaacgcctacctgggcaaccaccgcccgatgctggtgaccaacacgctgttccggatgggcggcgccgccgtgctgctctccaaccgccggtccgaccgcggccgcgccaagtaccgtctggtgcacacggtgcggacgcaccggggcggcgccgccagcgacgacagctacgcgtgcgtgacgcaggaggaggacggcgagggcaacgtcggcgtctcgctctccaagaacctcatgtccgtggccggggacgcgctgcggtgcaacatcacgacgctgggcccgctcgtgctcccgctgtcggagcagctccggttcctgcgcgccgcgctgctccgccgcgccgccgtcaaggtgaagccctacgtgccggacttcaagctggcgctggagcacttctgcatccacgccggcggccgcggcgtgctggacgagctggagcgcagcctcgggctcagcgcctggcacatggagccgtcccggatgacgctctaccgcttcggcaacacctccagcagctcgctctggtacgagctcgcctactgcgaggccaagggacggatcaagaagggcgaccgcgtctggcagatcgcgttcgggtcagggttcaagtgcaacagcgccgtctggaaggcgctccggacggtggacgacgccgcccgggagaccaataacccatgggccgacgaaatcgacgacctgccggtgcacgtgcccaagccgacgcgtggtgtttgctccgcgcctgctcctgctccagctccagccgggcctgcccaccttccctcattcaacccggctcctaccattgcccttgcccgcacgccccttggcccaccgcctggactcgtctcgtccgcggccgatctcctgcatccgctcgccgcgccgcaacccggaggccggaggagactgcgctcagtcgagcactacctggagcccagcatcctcgagaccatctccggcacggcgtccgccctctgcagccccggtgtccctgcgaccgtcgctgctgtcctacttcgccactggccactttgccaggcgacgagcaccaccacaacactagatcttacagctccggcgccctggagagagaatgttctcaacttccagattaaagcagtctctgcaccagctaggactgctgaaatttgcccggagttggtagttccatgcatggttcccaaacatactgtcagagggaagaagaaaggcagctgggtccattacggtgggtcacttccggcaatgctggaggcacttgagcatgtccgggatgttggggaagcgctctgggcatggaaggacaccctgagcaacagggagaggacgatcatcctcaaggagcagaaagactggcgacgggcagtcgagatctttgactggtttcgctgggagcagggccatgagctcaatgtgattcactacaatgtcatgctctatacagttgggaaggcaaggaggtgggacctcgttctgaggttgtggcatgagatgcattcctttggtgtggcgccggacaactcaacatatggtacgctgattaatgtctgttgtcaagggggaagagaatcggtggctttgctttggcttggggacatgtgcaagcgtggtttgatgcctgatgaggtcactatgaatattgtgatgcaggcgcacaagaaggctggagagtatgaaacggctgggcttttcttcgaaaggtggtcctcggattcaatcagaaggatggagggaagttctcactacagcttgtatacttacaacaccttgattgatacttatggaaaggctggtcatcttgagaaagtatcagatacattcaaccaaatgctgagagaaggtgttgcaccaagcgttgttacatttaactcaatgattcacgtttggggcaagcaccacagaatggagcaagttgcttctttggttcgaatgatggaggaattccagtgctttcctgacaccaggacttacaatatactgatcgcattgtatagagaaagcaatgatattgatattgcagagtactactactgtaagatgaaaggagaaaacttggtaccagatgttgtgagctgccgcacactcttatacggatactctatcaggggtatggtcactaaagcggaagcccttctaaaggaaatggatgagaggggctttgtggtagatgaatacacacaatcagctttgacaaggatgtatgtaaatgttgggatgcttgagcaagcttggcgttggtttgacaggttccatcaccatatgaattctgaatgcttttctgcaaatattgatgcatttggagagaaaggatacatagttcttgcagagaaggcttttatatattgcataaagaagaagatgctcagtgtttctgcgtgcaatgttatgatcaaagcatatgggttggtagagaagcttgatgaggcatgtgagatagctgatggcatggagaggtatggcattttgcctgattatgttacatatgcttctctcattcaacttctgtcaactgctaaactgccaaagaaggctatttactacttggaaaaaatgaaagttgtgaaattgctgtcagactgtatcccgtactctgtggtaattagtagctttgctaagattggtgatctacgaatggctgaatacctatttagagaaatggtcatgtcaggggtccgccctgatgtttttgtctactctatcttaattgatgcatacgctgaagttggaaatgtccaacaagcttcagcatattttggtttaatgaaaaaggatggtttatgtgagaacgttacgatctacaattctttgataaagctctacacaaaagtagggtatgtggcagaggcccgagaaacatataagttactcaaatcattggatgccaatgccatcctttatgcatctaattgcatgattgatctctatagtgatcattgtatggtgaaggaagcatgtgaggtttttgaaggtttgaaggttaggggaattgccaatgaattctcacatgcaatgatggtgtgtatgtacaagaaagttggtcgctatgatgtggctcacaggatttgcaaggaaatgcaagctttaggacttctaactcagttactaagctacaattctgtaatccaaatgtatgcatctggtggaagaatggaggaggctcttaaaatattcaagaagatgttggcatcgaacacagcaccaaatgatgcaacattccaggcactaaaggttattctagtaagaagtggagtcacgaaaaatgagacaagaaagttagaattgttaagaagaaataacactcatgattgcttgcgtcagtggtacagggcgctatcttcagctgtaagatcaagtgcaaattcttttcaaacatag

SEQ ID NO: 15675 - protein, 1396 aa, Sorghum bicolor
  misc_feature: The sequence is a functional homolog of SEQ ID NO 2 in US patent 7038112
  misc_feature: Ceres ANNOT ID no. 8643017
  misc_feature: Down-regulated in shoot tissues in response to methyl jasmonate treatment
  misc_feature: Down-regulated in root tissues in response to methyl jasmonate treatment
  misc_feature: Down-regulated in shoot tissues in response to salicylic acid treatment
  misc_feature (101)..(510): SWISSPROT Homolog: EC 2.3.1.119 Icosanoyl-CoA synthase
  misc_feature (94)..(385): Pfam ID: FAE1_CUT1_RppA Pfam Description: FAE1/Type III polyketide synthase-like protein
  misc_feature (857)..(891): Pfam ID: PPR Pfam Description: PPR repeat
  misc_feature (1307)..(1341): Pfam ID: PPR Pfam Description: PPR repeat
  misc_feature (1133)..(1167): Pfam ID: PPR Pfam Description: PPR repeat
  misc_feature (962)..(996): Pfam ID: PPR Pfam Description: PPR repeat
  misc_feature (780)..(814): Pfam ID: PPR Pfam Description: PPR repeat
  misc_feature (892)..(926): Pfam ID: PPR Pfam Description: PPR repeat
  misc_feature (1168)..(1202): Pfam ID: PPR Pfam Description: PPR repeat
  misc_feature (927)..(961): Pfam ID: PPR Pfam Description: PPR repeat
  misc_feature (745)..(779): Pfam ID: PPR Pfam Description: PPR repeat
  misc_feature (1063)..(1097): Pfam ID: PPR Pfam Description: PPR repeat
  misc_feature (382)..(482): Pfam ID: ACP_syn_III_C Pfam Description: 3-Oxoacyl-[acyl-carrier-protein (ACP)] synthase III C terminal
MANQQHRSSIAGMDRELFRTVRQAALNHARLLYHRLVSRLPHLLAVTLVVAAAQLVPPPSSAHAARTLLREAAARADAGLVAAALAACACACAYAALRPRPVYLVDLAAYRPGPAHRATRAESVRHFALAGRFTDESVAFQTRMLERAGVGDATHFPASILANPVDMSLRAAREESEAVVFGVVDDLLRTTAVRAADVGVVIVNSSLFSPTPSFTSLLVNRYGLRHDVVTHNLSGMGCSAGIIAIDLAKHLLQVHPNTYALVVSTENITLNAYLGNHRPMLVTNTLFRMGGAAVLLSNRRSDRGRAKYRLVHTVRTHRGGAASDDSYACVTQEEDGEGNVGVSLSKNLMSVAGDALRCNITTLGPLVLPLSEQLRFLRAALLRRAAVKVKPYVPDFKLALEHFCIHAGGRGVLDELERSLGLSAWHMEPSRMTLYRFGNTSSSSLWYELAYCEAKGRIKKGDRVWQIAFGSGFKCNSAVWKALRTVDDAARETNNPWADEIDDLPVHVPKPTRGVCSAPAPAPAPAGPAHLPSFNPAPTIALARTPLGPPPGLVSSAADLLHPLAAPQPGGRRRLRSVEHYLEPSILETISGTASALCSPGVPATVAAVLLRHWPLCQATSTTTTLDLTAPAPWRENVLNFQIKAVSAPARTAEICPELVVPCMVPKHTVRGKKKGSWVHYGGSLPAMLEALEHVRDVGEALWAWKDTLSNRERTIILKEQKDWRRAVEIFDWFRWEQGHELNVIHYNVMLYTVGKARRWDLVLRLWHEMHSFGVAPDNSTYGTLINVCCQGGRESVALLWLGDMCKRGLMPDEVTMNIVMQAHKKAGEYETAGLFFERWSSDSIRRMEGSSHYSLYTYNTLIDTYGKAGHLEKVSDTFNQMLREGVAPSVVTFNSMIHVWGKHHRMEQVASLVRMMEEFQCFPDTRTYNILIALYRESNDIDIAEYYYCKMKGENLVPDVVSCRTLLYGYSIRGMVTKAEALLKEMDERGFVVDEYTQSALTRMYVNVGMLEQAWRWFDRFHHHMNSECFSANIDAFGEKGYIVLAEKAFIYCIKKKMLSVSACNVMIKAYGLVEKLDEACEIADGMERYGILPDYVTYASLIQLLSTAKLPKKAIYYLEKMKVVKLLSDCIPYSVVISSFAKIGDLRMAEYLFREMVMSGVRPDVFVYSILIDAYAEVGNVQQASAYFGLMKKDGLCENVTIYNSLIKLYTKVGYVAEARETYKLLKSLDANAILYASNCMIDLYSDHCMVKEACEVFEGLKVRGIANEFSHAMMVCMYKKVGRYDVAHRICKEMQALGLLTQLLSYNSVIQMYASGGRMEEALKIFKKMLASNTAPNDATFQALKVILVRSGVTKNETRKLELLRRNNTHDCLRQWYRALSSAVRSSANSFQT

SEQ ID NO: 15676 - DNA, 1404 bp, Sorghum bicolor
  misc_feature: Ceres ANNOT ID no. 8643038
  misc_feature: Down-regulated in shoot tissues in response to methyl jasmonate treatment
  misc_feature: Down-regulated in root tissues in response to methyl jasmonate treatment
  misc_feature: Down-regulated in shoot tissues in response to salicylic acid treatment
  misc_feature: Encodes the peptide sequence at SEQ ID NO 15677
atggcacgacccgtcgccgtcgtcgcccccctgtcggctgccgatggattcggggagcctcgcccgcccaccacgcgcaaccccagccacaccccgcggcgtccagaaccttctaatccccgcgcggccacgaccgcgccgcgcggcctagaacgttccattcccctcttggcaggcctcggaatgaatagcgtcaagccggcggtagccccgtcggtaggtggcgagatggaccggatgctgccggggacggtgacggtgaaggaggagtggccgccggaggaggaagaggaggaggaggtggtggtggaggacgtggacgctccgcggccgatggaggggctgcacgaggtcgggccgccgccgttcctgaccaagacgttcgacctggtggccgacccggccaccgacgaggtcatctcctggggccgcgccggcaacagcttcgtggtctgggatccccatgtgttcgccgccgtgctgctccccaggttcttcaagcacaacaacttctccagcttcgtccgccagctcaacacctatggtttcagaaagatcgatccggacagatgggagttcgcgaacgaaggcttcctgaggggccagaggcatcttctgcggctgatcaagcggcggaggccggcgccgccgccgccgtacctccaggcgtcgcagtcgcagtcacaggggtcgtgcctggaggtgggtcagttcgggggactggacggagagatggaccggctgaggcgcgacaagagcatcctgctggcggaggtggtgaagctgcggcaggaacagcagagcacgcgggcgggcatgcgcgccatggaggagcggctgcagcacgcggagcacaagcaggtgcagatgatggggttccttgcgcgggcgatgcagagcccggacttcttccagcagctggcccagcagcaggacaggcggagggagctggagggcgcgctgatgctctccgccgccgcctccaggaagcggaggcggcccatcggcaccgcgccggccctgctggacggcggcgtgcaggaggaggaggaggaggagcaggcggccgacgacgatcccaccgccacgcaggcgctgttcgcggagctggacgagcgggggaccacgtcggagctggagaacctggcgctcaacatccagggtctcggcagcagcaagcgcaggcagggcgggggcggcgcgcggagccagcagcgggccgccgcggtcggtggtggcgagacggcggagctgaccgacgacttctgggaggagctgctgaacgaagggatgagaggcggtgcggcggctgagctgttgccgccggagaggagacggccgggctggtacgtcgacgcgctggcgcagaagctgagctccatgagcaacaccacggcgaagtag

SEQ ID NO: 15677 - protein, 467 aa, Sorghum bicolor
  misc_feature: The sequence is a functional homolog of SEQ ID NO 2660 in the 10/374,780 US patent application
  misc_feature: The sequence is a functional homolog of SEQ ID NO 74 in the 10/225,066 US patent application
  misc_feature: The sequence is a functional homolog of SEQ ID NO 926 in the 10/412,699 US patent application
  misc_feature: The sequence is a functional homolog of SEQ ID NO 1687 in the 10/412,699 US patent application
  misc_feature: The sequence is a functional homolog of SEQ ID NO 1686 in the 10/412,699 US patent application
  misc_feature: The sequence is a functional homolog of SEQ ID NO 1685 in the 10/412,699 US patent application
  misc_feature: Useful for making plants with modulated heat sensitivity
  misc_feature: Functional homolog of the protein sequence given in SEQ ID NO 13699
  misc_feature: The sequence is a functional homolog of SEQ ID NO 1688 in the 10/412,699 US patent application
  misc_feature: The sequence is a functional homolog of SEQ ID NO 422 in the 10/666,642 US patent application
  misc_feature: The sequence is a functional homolog of SEQ ID NO 816 in the 11/435,388 US patent application
  misc_feature: The sequence is a functional homolog of SEQ ID NO 2794 in the 10/374,780 US patent application
  misc_feature: The sequence is a functional homolog of SEQ ID NO 82 in the 10/225,066 US patent application
  misc_feature: The sequence is a functional homolog of SEQ ID NO 882 in the 11/435,388 US patent application
  misc_feature: The sequence is a functional homolog of SEQ ID NO 378 in the 10/374,780 US patent application
  misc_feature: The sequence is a functional homolog of SEQ ID NO 80 in the 10/225,066 US patent application
  misc_feature: The sequence is a functional homolog of SEQ ID NO 950 in the 10/412,699 US patent application
  misc_feature: Ceres ANNOT ID no. 8643038
  misc_feature (121)..(294): Pfam ID: HSF_DNA-bind Pfam Description: HSF-type DNA-binding
MARPVAVVAPLSAADGFGEPRPPTTRNPSHTPRRPEPSNPRAATTAPRGLERSIPLLAGLGMNSVKPAVAPSVGGEMDRMLPGTVTVKEEWPPEEEEEEEVVVEDVDAPRPMEGLHEVGPPPFLTKTFDLVADPATDEVISWGRAGNSFVVWDPHVFAAVLLPRFFKHNNFSSFVRQLNTYGFRKIDPDRWEFANEGFLRGQRHLLRLIKRRRPAPPPPYLQASQSQSQGSCLEVGQFGGLDGEMDRLRRDKSILLAEVVKLRQEQQSTRAGMRAMEERLQHAEHKQVQMMGFLARAMQSPDFFQQLAQQQDRRRELEGALMLSAAASRKRRRPIGTAPALLDGGVQEEEEEEQAADDDPTATQALFAELDERGTTSELENLALNIQGLGSSKRRQGGGGARSQQRAAAVGGGETAELTDDFWEELLNEGMRGGAAAELLPPERRRPGWYVDALAQKLSSMSNTTAK

SEQ ID NO: 15678 - DNA, 1134 bp, Sorghum bicolor
  misc_feature: Ceres ANNOT ID no. 8643068
  misc_feature: Encodes the peptide sequence at SEQ ID NO 15679
atgggtaattgctggtttaaggggaatccatactttaacagggtttcttccaatgcaaccaaatcagaatctcccaaaattcagagcccatcggagagaactgaaaaggaggactgccagctaccatccaacccaaaagaagtggaggcgctgagaaaggatacagcctgcaatcctttgatagcattcacatttgaggagctcaagagaattaccaaaaatttcaggcaagattcattactagggggtggtggatttggcagagtctacaaaggtttcatcaccaaggatctccgtgaaggattagagatagaagagcccctgagagttgccgtaaaggtccatgatggtgacaatagcttccaaggccatagggagtggctggcagaggttatatttcttggacagctctctcacccaaatttagtgaagttgattggctactgttgtgaagatgaccacagggttcttgtttatgagttcatgcctctaggaagtgtggagtctcatttattttcaagggttatggtgccacttccgtggtcgatcagaatgaaaattgcgctcggtgctgcaaaaggacttgcttttctgcatgaagctgagaagccagtcatctatagggactttaagacatcaaacatattgctagatgaggaatacaatgcaaaactatctgactttgggcttgcaaaagatggaccagttggcgataaatcccatgtttcaactcgtattatgggtacctacggttatgctgcaccagagtacattatgacagggcatctaacagcgatgagcgatgtctacagctatggtgttgtactactggagctcctcacgggccggaagtcactcgacaagtcccgacctgtcagggagcagatgttggcagactgggcattcccgctgttgacacagaagaagaaggtacttggcatagtagacccaaggcttgccgaggactacccagtaaaggcggtgcagaagacatcgatgttggcataccattgccttagccacaacccaaaggctaggccgctgatgcgtgacatcgtggcgactttggagcctcttcagcagctggaggagacccctagtgacagtgtggcgatgacacttcaagggacttga

SEQ ID NO: 15679 - protein, 377 aa, Sorghum bicolor
  misc_feature: Useful for making plants with modulated drought sensitivity
  misc_feature: Functional homolog of the protein sequence given in SEQ ID NO 14078
  misc_feature: Useful for making plants with modulated heat sensitivity
  misc_feature: Functional homolog of the protein sequence given in SEQ ID NO 14079
  misc_feature: Ceres ANNOT ID no. 8643068
  misc_feature (24)..(372): SWISSPROT Homolog: EC 2.7.11.1 Non-specific serine/threonine protein kinase
  misc_feature (75)..(356): Pfam ID: Pkinase Pfam Description: Protein kinase domain
MGNCWFKGNPYFNRVSSNATKSESPKIQSPSERTEKEDCQLPSNPKEVEALRKDTACNPLIAFTFEELKRITKNFRQDSLLGGGGFGRVYKGFITKDLREGLEIEEPLRVAVKVHDGDNSFQGHREWLAEVIFLGQLSHPNLVKLIGYCCEDDHRVLVYEFMPLGSVESHLFSRVMVPLPWSIRMKIALGAAKGLAFLHEAEKPVIYRDFKTSNILLDEEYNAKLSDFGLAKDGPVGDKSHVSTRIMGTYGYAAPEYIMTGHLTAMSDVYSYGVVLLELLTGRKSLDKSRPVREQMLADWAFPLLTQKKKVLGIVDPRLAEDYPVKAVQKTSMLAYHCLSHNPKARPLMRDIVATLEPLQQLEETPSDSVAMTLQGT

SEQ ID NO: 15680 - DNA, 357 bp, Sorghum bicolor
  misc_feature: Ceres ANNOT ID no. 8643095
  misc_feature: Encodes the peptide sequence at SEQ ID NO 15681
atggagatgcagagaccactacgcttccatttcctcatcatcatcgccgccgcggcgtggccgttggtgccaccggcggcggcggacgacagcgggtggtccaaaggcacggcgacgttctacggcgggggcgacgtctccggcacgatgggcggcgcgtgcgggtacgggaacctgtactggtccgggtacgggacggacacggcggcgctgagctcggcgctgttcaacgacggcgcggcgtgcggggagtgctaccgggtcacgtgcgacgacagcgcgtcccagtggtgcctgccggggaggaagtcggtgactgtcacggccaccaacctgtgcccgcaaacttctcgttaa

SEQ ID NO: 15681 - protein, 118 aa, Sorghum bicolor
  misc_feature: Useful for making plants with altered carbohydrate content
  misc_feature: Functional homolog of the protein sequence given in SEQ ID NO 13784
  misc_feature: Useful for making plants with altered cell wall content and/or composition
  misc_feature: Functional homolog of the protein sequence given in SEQ ID NO 13785
  misc_feature: Ceres ANNOT ID no. 8643095
  misc_feature (35)..(114): SWISSPROT Homolog: EC 3.2.1.4 Cellulase
  misc_feature (68)..(118): Pfam ID: DPBB_1 Pfam Description: Rare lipoprotein A (RlpA)-like double-psi beta-barrel
MEMQRPLRFHFLIIIAAAAWPLVPPAAADDSGWSKGTATFYGGGDVSGTMGGACGYGNLYWSGYGTDTAALSSALFNDGAACGECYRVTCDDSASQWCLPGRKSVTVTATNLCPQTSR

SEQ ID NO: 15682 - DNA, 765 bp, Sorghum bicolor
  misc_feature: Ceres ANNOT ID no. 8643096
  misc_feature: Encodes the peptide sequence at SEQ ID NO 15683
atggcgcgcaaggtcgacctgtgccgcctgctcgtggctgccgtagcagcctgcctcgccgcgacgacggtccgggccgggtggcagagaggctcggcgacgttctacggcggggccaacgccgccggcacaatgggtggcgcgtgcgggtatggcaacctgtactcggcggggtacggcacggacacggcggcgctgagcttggcgatgttcaacggcggcgcggcgtgcggggagtgctaccaggtgaagtgcgaccagcagaacagccggtggtgcaagccgggcgtgacggtgaccgtcaccgccaccaacctgtgcccggccgactactcccagcccagcaacgacggcgggtggtgcaacccgccgcggcagcacttcgacatgtcccagccgtcgtgggagaagatcggcgtctacagcggcggcatcgtcccggtcttctaccagagggtgtcctgctccaggaccggcggcgtgcgcttcaccatcaacggcaacaggtacttcaagctcgtgctcatcttcaacgtcgccgggccggggtccatcagcgcggtgcagatcaagggctcgtccacggggtggatcaccatgtcccggaactggggcgccaactggcaggccaacagcgacctcaccaggcagagcatctccttccgtgtcaccgccaccaacggcaggttcctcgagttctacaacgtcgccggatccaactggcagctgggccagaccttcaccaacggccaaaatttctactag

SEQ ID NO: 15683 - protein, 254 aa, Sorghum bicolor
  misc_feature: Useful for making plants with altered carbohydrate content
  misc_feature: Functional homolog of the protein sequence given in SEQ ID NO 13784
  misc_feature: Useful for making plants with altered cell wall content and/or composition
  misc_feature: Functional homolog of the protein sequence given in SEQ ID NO 14248
  misc_feature: Useful for making plants with altered lignin content
  misc_feature: Functional homolog of the protein sequence given in SEQ ID NO 12888
  misc_feature: Ceres ANNOT ID no. 8643096
  misc_feature (63)..(150): Pfam ID: DPBB_1 Pfam Description: Rare lipoprotein A (RlpA)-like double-psi beta-barrel
  misc_feature (161)..(238): Pfam ID: Pollen_allerg_1 Pfam Description: Pollen allergen
MARKVDLCRLLVAAVAACLAATTVRAGWQRGSATFYGGANAAGTMGGACGYGNLYSAGYGTDTAALSLAMFNGGAACGECYQVKCDQQNSRWCKPGVTVTVTATNLCPADYSQPSNDGGWCNPPRQHFDMSQPSWEKIGVYSGGIVPVFYQRVSCSRTGGVRFTINGNRYFKLVLIFNVAGPGSISAVQIKGSSTGWITMSRNWGANWQANSDLTRQSISFRVTATNGRFLEFYNVAGSNWQLGQTFTNGQNFY

SEQ ID NO: 15684 - DNA, 1662 bp, Sorghum bicolor
  misc_feature: Ceres ANNOT ID no. 8643112
  misc_feature: Encodes the peptide sequence at SEQ ID NO 15685
atggcccgcacgacggcgccggccgcgggctacggggcggacggagtgtaccgctccccgcgcccggccgtgcgcatcgagtccgacccgggcctctccctcaacgacctcctcttccgccgcgccgacgcgtgcccctccgccctcgcgctggtcgactccgccaccggccaatccctcaccttcgccgcctttcgctccgccgtcctcaccacggccgtcgcgctctcctcgcgcgcgggcgtccgacgcggcgatgtcgtcctcttcttcgcccccaactgcttcctctaccccgtctgcttcttcgccgtcaccgccctcggcgccgtcgctaccactgccaaccccctctatacccctcgggaggtcgccaagcaggccaccgactcgcgcgccaagctcgcaatcacagtctctgaactccttcccaaaatcgtggacctccgcctccccaccatcctgctcgacgtcgacggcggcgcggccagtgtcaccgcctccaagcctcagggcgccagcgtcacgctctactcagacctcatttctggggtgcgggagacggagtaccgccgcccgccgacgaagcagagcgatacggccgcgctgctgtactcgtccggcacgacgggggcgagcaagggcgtaatcctgacgcaccgcaacttcatctcggcggcggccatgatgacagcggaccaggacgagctcggagaggggcccaacgtcttcctctgcttcctgcccatgttccacatcttcggcttgtccgtcctcacgttcgcgcagatgcagcgtggcaactccgtcgtcgtgatgtcacggtttgacatggactctgtgatggccgccgtgcagcggcaccgtgtcactcacctcttctgcgtgccgccggtcatgatagcgctcgccaagctcgggagtgtcgggaaatacgacctcagctcgctcaggttcatcggctcgggcgcagcgccgctcggcaaggacgtgatggagggcgtggccaagaactttccagaagccgtgattgcccagggttatggaatgactgaaacttgtggaatcatatctttagagtacccagaaaaaggacaagttcgtcaatttgggtcaactggagcacttgtctcgggagttgaagcaaaaattgttgatgtagaaacattgaaatgtctgccgccaaatcaactaggagaaatttgtgttcgaggactgaacataatgcaaggatatttcaacaatgtgcaagctactgaatttacaatcaagcaagggtggttgcatactggtgatattggatactttgatgaaggaggtcagctttttgtagttgatagacttaaagaactgattaagtacaaaggttttcagattgcacccgctgagcttgaagggctacttctgtctcatccagaaattctggatgctgttgttatcccgttccccgatgctgaagctggggaagttcctattgcctacgtcgtaaggtcccctgtgagttctttgactgaagttgatgtccagaaatttattgaaaagcaggtcgcatactacaaaaaattgaggagggttacctttgtggacagcgtaccaaaatctgcttcaggaaagattttgagaagagaactgatcgctaaagtcagatcgtccaagctatag

SEQ ID NO: 15685 - protein, 553 aa, Sorghum bicolor
  misc_feature: Useful for making plants with altered cell wall content and/or composition
  misc_feature: Functional homolog of the protein sequence given in SEQ ID NO 14036
  misc_feature: Ceres ANNOT ID no. 8643112
  misc_feature (14)..(550): SWISSPROT Homolog: EC 6.2.1.12 4-coumarate--CoA ligase
  misc_feature (61)..(479): Pfam ID: AMP-binding Pfam Description: AMP-binding enzyme
MARTTAPAAGYGADGVYRSPRPAVRIESDPGLSLNDLLFRRADACPSALALVDSATGQSLTFAAFRSAVLTTAVALSSRAGVRRGDVVLFFAPNCFLYPVCFFAVTALGAVATTANPLYTPREVAKQATDSRAKLAITVSELLPKIVDLRLPTILLDVDGGAASVTASKPQGASVTLYSDLISGVRETEYRRPPTKQSDTAALLYSSGTTGASKGVILTHRNFISAAAMMTADQDELGEGPNVFLCFLPMFHIFGLSVLTFAQMQRGNSVVVMSRFDMDSVMAAVQRHRVTHLFCVPPVMIALAKLGSVGKYDLSSLRFIGSGAAPLGKDVMEGVAKNFPEAVIAQGYGMTETCGIISLEYPEKGQVRQFGSTGALVSGVEAKIVDVETLKCLPPNQLGEICVRGLNIMQGYFNNVQATEFTIKQGWLHTGDIGYFDEGGQLFVVDRLKELIKYKGFQIAPAELEGLLLSHPEILDAVVIPFPDAEAGEVPIAYVVRSPVSSLTEVDVQKFIEKQVAYYKKLRRVTFVDSVPKSASGKILRRELIAKVRSSKL

SEQ ID NO: 15686 - DNA, 1608 bp, Sorghum bicolor
  misc_feature: Ceres ANNOT ID no. 8643126
  misc_feature: Encodes the peptide sequence at SEQ ID NO 15687
atggcgagggaggagcaggagcggcagcggcagctgcaggtgctgaccacgctcgacgccgccaagacgcagtggtaccacttcacggcgatcgtcgtggcgggcatgggcttcttcaccgacgcctacgacctcttctgcatctcgctcgtcaccaagctgctcggccgcgtctactacaccgaccccaccaagccggacccaggcacgctgccacccaacgtcgcggcggcggtgaacggcgtcgcgctctgcgggacgctcgccgggcagctcttcttcggctggctcggcgacaggctcggccggaagagcgtctacggcatgacgctgctgctcatggtggtctgctccatcgcctcggggctctcgttcgggagcacgccgaccggcgtcatggccacgctctgcttcttccgcttctggctcggtttcggcatcggcggcgactacccgctcagcgccaccatcatgtccgagtacgccaacaagaagacccgcggcgggttcatcgccgccgtcttcgccatgcagggattcggcatcctcggcggcggcatcgtcacgctcgccctctccgcggtgttccgcagggcgtacccggcgccagcgtacctagtcgacgccgtggcgtccaccgtgccgcaggccgactacgtgtggcgcgtcatcctcatgctcggcgcggcgcccgcggtgctgacgtactactggcggaccaagatgcccgagacggcgcggtacaccgcgctggtcgccgggaacgccaagcaggccgcctccgacatgtccagggtgctgcaggtggagatcaaggcggaggcggagaatctggacgagatcaccggaggcagcgcctacggcctcttctcgtcgcggttcgcgcggcgccacggctggcacctcctcggcacggccgtcacgtggttcctggtggacatcgcctactacagccagaacctgttccagaaggacatcttcgccagcatccactggatccccaaggcgcgcaccatgagcgcgctcgacgaggtgttccgcatctcccgcgcgcagacgctcatcgcgctctgcggcaccgtgccgggctactggttcaccgtcttcctcatcgacgtcctcggccgattcgccatccagctcctgggcttcgccatgatgaccgtcttcatgctcggcctcgccatcccgtaccaccactggaccacgccaggcaaccacatcggcttcgccgtcatgtacggcttcaccttcttcttcgcaaacttcgggccgaatgcgaccacgttcatcgtgccggccgagatcttcccggcgcggctccggtccacctgccacggcatctccgctgccgccggcaaggcaggcgcgatcataggagccttcggcttcctctacgcggcgcagtctcaggacaaggcgcacgtggacgccgggtataaacctgggatcggtgtcaggaacgcgctgttcgtgctcgccgcctgcaacttgctggggttcttgttcaccttcctggtgccggaatcgaaagggaaatcgctcgaggagatgtccggcgaagccgatggcgaccaagcctccggcaatggcgccaatgccgtgtag

SEQ ID NO: 15687 - protein, 535 aa, Sorghum bicolor
  misc_feature: Useful for making plants with modulated phosphate use efficiency
  misc_feature: Functional homolog of the protein sequence given in SEQ ID NO 13402
  misc_feature: Useful for making plants with modulated carbohydrate content
  misc_feature: Functional homolog of the protein sequence given in SEQ ID NO 13408
  misc_feature: Ceres ANNOT ID no. 8643126
  misc_feature (34)..(461): Pfam ID: MFS_1 Pfam Description: Major Facilitator Superfamily
MAREEQERQRQLQVLTTLDAAKTQWYHFTAIVVAGMGFFTDAYDLFCISLVTKLLGRVYYTDPTKPDPGTLPPNVAAAVNGVALCGTLAGQLFFGWLGDRLGRKSVYGMTLLLMVVCSIASGLSFGSTPTGVMATLCFFRFWLGFGIGGDYPLSATIMSEYANKKTRGGFIAAVFAMQGFGILGGGIVTLALSAVFRRAYPAPAYLVDAVASTVPQADYVWRVILMLGAAPAVLTYYWRTKMPETARYTALVAGNAKQAASDMSRVLQVEIKAEAENLDEITGGSAYGLFSSRFARRHGWHLLGTAVTWFLVDIAYYSQNLFQKDIFASIHWIPKARTMSALDEVFRISRAQTLIALCGTVPGYWFTVFLIDVLGRFAIQLLGFAMMTVFMLGLAIPYHHWTTPGNHIGFAVMYGFTFFFANFGPNATTFIVPAEIFPARLRSTCHGISAAAGKAGAIIGAFGFLYAAQSQDKAHVDAGYKPGIGVRNALFVLAACNLLGFLFTFLVPESKGKSLEEMSGEADGDQASGNGANAV

SEQ ID NO: 15688 - DNA, 1569 bp, Sorghum bicolor
  misc_feature: Ceres ANNOT ID no. 8643125
  misc_feature: Encodes the peptide sequence at SEQ ID NO 15689
atggcgggaggtcagctcaacgtgctggccacactcgaccaggccaagacgcaatggtaccatttcatggcgatcgtcatcgccggcatgggattcttcaccgacgcatacgacctcttctgcatcgcgctcgtgaccaagctcctcggccgcatctactaccccgaccccacctccaaggagcccggcagcctcccggccaacgtgtcggccgccgtgacgggcgtcgcgctctgcggcacgctcgccggacagctcttcttcggatggctcggcgacaagctcgggcgcaagagcgtctacggcttcaccctcatcctcatggtgctctgctccgtggcgtcgggcctctcgttcgggagcacgcccaagggcgtcatcggcacgctctgcttcttccgcttctggcttggcttcggcatcggcggcgactacccgctgagcgccaccatcatgtccgagtacgccaacaagaagacccgcggcgccttcatcgccgccgtgttcgccatgcagggcttcggcatcctcttcggcaccatcgtcgcgatcgtcgtctcggcggcgttccggaacgcgttcccggccccgccgtacttcgtcgacgcccaggcgtcgctcgtcccggaggccgactacgtctggcgcgtcatcctcatgttcggcaccctcccggccgcgctcacctactactggcgcatgaagatgcccgagacggcgcggtacacggcgctcatcgcccggaacacgaagcaggccacggccgacatggccaaggtgctcaagaaggagatcgaggaggaggaggagcaggtggagcggcaggtgatcggcgccgacacctggggcctcttctcggtgcagttcctccggcgccatggcctccacctgttggccaccagcagcacgtggttcctgctggacatcgccttctacagccagaacctgttccagaaggacatcttcaccaaggtcggctggatcccgccggcgaggaccatgaacgccatcgaggaggtgtaccgcatctcgcgcgcccaggcgctgatcgcgctctgcggcaccatcccgggctactggttcaccgtcgccctcatcgacgtcgtgggcaggttctggatccagatcatgggcttcttcatgatgaccgtgttcatgctcgcgctcggggtgccgtacgagcactggaccaaggcgtccaaccacacaggtttcgtcgtgctctacgggctcaccttcttcttcgcaaacttcgggcccaacagcaccaccttcatcgtgccggccgagatcttcccggcgaggctccggtccacgtgccacggcatatcggcggcggcaggcaaggccggcgccatcatcggcgcgttcgggttcctgtacgcggcgcaggaccccaagaagcccgacaaggggtactcgccgggcatcggcatccgcaacgcgctcttcgtgctcgccggaaccaacttcctgggcatgctcatgtcgctgttcgtgccggagtccaagggaaagtcgcttgaggagatctccaaggagaatgtggatggggaagctgaggcctga

SEQ ID NO: 15689 - protein, 522 aa, Sorghum bicolor
  misc_feature: Useful for making plants with modulated phosphate use efficiency
  misc_feature: Functional homolog of the protein sequence given in SEQ ID NO 13397
  misc_feature: Useful for making plants with modulated carbohydrate content
  misc_feature: Functional homolog of the protein sequence given in SEQ ID NO 13408
  misc_feature: Ceres ANNOT ID no. 8643125
  misc_feature (23)..(515): Pfam ID: Sugar_tr Pfam Description: Sugar (and other) transporter
MAGGQLNVLATLDQAKTQWYHFMAIVIAGMGFFTDAYDLFCIALVTKLLGRIYYPDPTSKEPGSLPANVSAAVTGVALCGTLAGQLFFGWLGDKLGRKSVYGFTLILMVLCSVASGLSFGSTPKGVIGTLCFFRFWLGFGIGGDYPLSATIMSEYANKKTRGAFIAAVFAMQGFGILFGTIVAIVVSAAFRNAFPAPPYFVDAQASLVPEADYVWRVILMFGTLPAALTYYWRMKMPETARYTALIARNTKQATADMAKVLKKEIEEEEEQVERQVIGADTWGLFSVQFLRRHGLHLLATSSTWFLLDIAFYSQNLFQKDIFTKVGWIPPARTMNAIEEVYRISRAQALIALCGTIPGYWFTVALIDVVGRFWIQIMGFFMMTVFMLALGVPYEHWTKASNHTGFVVLYGLTFFFANFGPNSTTFIVPAEIFPARLRSTCHGISAAAGKAGAIIGAFGFLYAAQDPKKPDKGYSPGIGIRNALFVLAGTNFLGMLMSLFVPESKGKSLEEISKENVDGEAEA

SEQ ID NO: 15690 - DNA, 1323 bp, Sorghum bicolor
  misc_feature: Ceres ANNOT ID no. 8643113
  misc_feature: Encodes the peptide sequence at SEQ ID NO 15691
atggacgcccgcctccgccgcctcgtcttcctcctcctcctcgcggccgcggcgccgctggccaccgcccagctctcacaagatttctacaagacgtcgtgccccgacgccgagaagatcatcttcggcgtcgtcgagaagcggttcaaggcggaccccggcaccgccgccggcctcctccgcctcgtcttccacgactgcttcgcaaacggctgcgacgcgtccatcttgatcgacccgatgtcgaaccaagcctccgagaaggaggccggtcccaacatctccgtcaagggctacgacgtgatcgaggagatcaagacggagctggagaagaagtgccccggcgtggtgtcgtgcgcggacatcgtgtcggtgagcgcccgcgactcggtgaagctgacgggagggcccgagtactcggtgcccctggggcggcgcgactcgctcgtgtccaaccgcgaggacgccgacaacctgcctggcccggacatcgcggtgcccaagctcatcgacgagttctccaagcagggcttcaacctcgaggagatggtcgccatgctgggcggcggccacagcatcggcatctgcaggtgcttcttcatcgagaccgacgcggcgcccatcgaccccgggtacaagaagaagatcagcgacgcctgcgacggcaaggactcgggctccgtcgacatggactccacctcgcccaacaccttcgacggcagctacttcggcctcgtcctggagaagaagatgccgctcaccatcgaccgcctcatggggatggactccaagacggagcccgtggtgcaggccatggccgacaagaagaccgacttcgtccccatcttcgccaaggccatggagaagctcagcaacttgaaggttatcacggggaaggacggcgagatcaggaaggtgtgctccgagttcaacaacccgcagaacagcagcagcagctcgtcggtgatacggaccagctccgtcaacgccgacgaggtggccggcctgtcgtcctcgtccagcaggaaggtgggccctcccgacgcggtggaaacacccgccatggtggcggatgaggcggccgccaaggttcccggcggtgtcgtcgtcagcgtcgggggagaccagcagcagccgccaaacccggaagccgataggcccggcctgaagctccgcggcagccgcgaacctgtgaacccggcggccccggtggagcccggccccggcggcgaggatgctgccaagcagcaggcggtggcggccctggaggagaagaagaagaggaacatggccaaactccgggccgcccaggccaagatgtag

SEQ ID NO: 15691 - protein, 440 aa, Sorghum bicolor
  misc_feature: Useful for making plants with altered cell wall content and/or composition
  misc_feature: Functional homolog of the protein sequence given in SEQ ID NO 13958
  misc_feature: Ceres ANNOT ID no. 8643113
  misc_feature (29)..(307): SWISSPROT Homolog: EC 1.11.1.7 Peroxidase
  misc_feature (41)..(275): Pfam ID: peroxidase Pfam Description: Peroxidase
MDARLRRLVFLLLLAAAAPLATAQLSQDFYKTSCPDAEKIIFGVVEKRFKADPGTAAGLLRLVFHDCFANGCDASILIDPMSNQASEKEAGPNISVKGYDVIEEIKTELEKKCPGVVSCADIVSVSARDSVKLTGGPEYSVPLGRRDSLVSNREDADNLPGPDIAVPKLIDEFSKQGFNLEEMVAMLGGGHSIGICRCFFIETDAAPIDPGYKKKISDACDGKDSGSVDMDSTSPNTFDGSYFGLVLEKKMPLTIDRLMGMDSKTEPVVQAMADKKTDFVPIFAKAMEKLSNLKVITGKDGEIRKVCSEFNNPQNSSSSSSVIRTSSVNADEVAGLSSSSSRKVGPPDAVETPAMVADEAAAKVPGGVVVSVGGDQQQPPNPEADRPGLKLRGSREPVNPAAPVEPGPGGEDAAKQQAVAALEEKKKRNMAKLRAAQAKM

SEQ ID NO: 15692 - DNA, 264 bp, Sorghum bicolor
  misc_feature: Ceres ANNOT ID no. 8643168
  misc_feature: Encodes the peptide sequence at SEQ ID NO 15693
atgggtcagatccagtactccgagaagtacttcgacgatacctacgagtacagacacgtcgtcctcccgcccgaggtcgccaagctcctccccaagaaccgcctcctctccgagaacgagtggcgcgcgatcggcgtgcagcagagccgcgggtggatgcactacgcgatccaccgtccggagccgcacatcatgctgttccgccgcccgatcaactaccagcagcagcaggaggcggctgccgcgcagttgctcgccaagtga

SEQ ID NO: 15693 - protein, 87 aa, Sorghum bicolor
  misc_feature: Useful for making plants with altered oil content
  misc_feature: Functional homolog of the protein sequence given in SEQ ID NO 14249
  misc_feature: Ceres ANNOT ID no. 8643168
  misc_feature (1)..(72): Pfam ID: CKS Pfam Description: Cyclin-dependent kinase regulatory subunit
MGQIQYSEKYFDDTYEYRHVVLPPEVAKLLPKNRLLSENEWRAIGVQQSRGWMHYAIHRPEPHIMLFRRPINYQQQQEAAAAQLLAK

SEQ ID NO: 15694 - DNA, 1851 bp, Sorghum bicolor
  misc_feature: Ceres ANNOT ID no. 8643192
  misc_feature: Encodes the peptide sequence at SEQ ID NO 15695
atgaggcggcggtcggtcctgccgtcccaccacgacgacatggagaagggcggcggcaagccggcgtcgtcgcgcctctgcttcctcgccacgctctgcgccatgttctgggtcctcatcttctacttccacttcgccgtcgtctccaacgagccggccgtttcggcggcgcaggccaccggtgtccgcattgaccgctctcgcatccacattcccgaactcgacggcgcgtcccgcgtcgacgttcccctcgccccgcccgcccgcgcgtcggagccaccgccgccacctcctgtcgcgcgccccaaggagacggagacggagacggagacggagacggagacggaggcggaggcggaggaggagcacgccgcccaagtccgccgggaggaggcgccgcccaaggttgcggcgccgtacccgttcgagcgggcgctcaagacggcggagaacaagagcgacccctgcggcggccggtacatctacgtgcacgacctgccgccgcggttcaacgaggacatgctgcgggactgcgagaagctcagcgtctggaccaacatgtgcaggttcatgagcaacgacgggcttggcccgccgttgggcaacgaggagggcgtcttctccaacaccggctggtatggcaccaaccaattctccgtggatgttatcttcggcaacaggatgaagcagtacgagtgcctgaccaaggactcgtctatcgccgcggcggtgttcgtgccgttctatgctgggtttgatgtggcaaggtatctctggggttataataccacgacgagggatgccgcgtcgcttgatttggtggagtggctgatgaagaagccggagtggagtgtgatgggtgggcgggaccatttcctggttgcagggaggatcacttgggatttcagaaggttgacggatgaagagtcagattggggcagcaagctgcttttcttgccggctgcaaagaacatgtcgatgctcgtggtggagtcgagcccgtggaattcaaatgattttgggataccatatcctacatacttccacccggccaaggacgctgatgttttcctttggcaggatagaatgaggagcttggaacgcccatggctgttctcgtttgcaggcgctccacgtcctggtgatccaatgtccatcagagggcagctcatcgatcaatgcaggagctcaagcgtttgtaaattgttggagtgtgaccttggggagagcaagtgccactccccgagcacaatcatgaagatgttccagagctctctgttctgcttgcagccccagggcgactcctacacaagaagatctgcctttgactcgatgttggctggctgcatacctgttttcttccatcctggttcagcgtacgtccaatatacatggcatcttccaaagaactatacaaggtactctgtattcatccctgaagatgacgtccgttctagaaatgccagcattgaggagagactaaagagtattcacccagatgtgatcaagcaaatgagagaggaggtcatcaatctaataccaaaggtgatatatgctgatccaagatcgaaactggagaccttgaaagatgcatttgatgtttctgtagaggcaatcattaacaaagtgacaaagttgagaagagatatcatcgcaggccaagaagataaagattttatcgaagagaatagctggaagtatagtctgttagaagatggacagcggacaattggacctcatgaatgggatccattcttctcaaagcccaaagataaaggtggagattctagtggttcatctgctgaatctgccaagaattcttggaaaagtgaacaaagaggacatagttga

SEQ ID NO: 15695 - protein, 616 aa, Sorghum bicolor
  misc_feature: Useful for making plants with altered cell wall content and/or composition
  misc_feature: Functional homolog of the protein sequence given in SEQ ID NO 13965
  misc_feature: Ceres ANNOT ID no. 8643192
  misc_feature (161)..(509): Pfam ID: Exostosin Pfam Description: Exostosin family
MRRRSVLPSHHDDMEKGGGKPASSRLCFLATLCAMFWVLIFYFHFAVVSNEPAVSAAQATGVRIDRSRIHIPELDGASRVDVPLAPPARASEPPPPPPVARPKETETETETETETEAEAEEEHAAQVRREEAPPKVAAPYPFERALKTAENKSDPCGGRYIYVHDLPPRFNEDMLRDCEKLSVWTNMCRFMSNDGLGPPLGNEEGVFSNTGWYGTNQFSVDVIFGNRMKQYECLTKDSSIAAAVFVPFYAGFDVARYLWGYNTTTRDAASLDLVEWLMKKPEWSVMGGRDHFLVAGRITWDFRRLTDEESDWGSKLLFLPAAKNMSMLVVESSPWNSNDFGIPYPTYFHPAKDADVFLWQDRMRSLERPWLFSFAGAPRPGDPMSIRGQLIDQCRSSSVCKLLECDLGESKCHSPSTIMKMFQSSLFCLQPQGDSYTRRSAFDSMLAGCIPVFFHPGSAYVQYTWHLPKNYTRYSVFIPEDDVRSRNASIEERLKSIHPDVIKQMREEVINLIPKVIYADPRSKLETLKDAFDVSVEAIINKVTKLRRDIIAGQEDKDFIEENSWKYSLLEDGQRTIGPHEWDPFFSKPKDKGGDSSGSSAESAKNSWKSEQRGHS

SEQ ID NO: 15696 - DNA, 2004 bp, Sorghum bicolor
  misc_feature: Ceres ANNOT ID no. 8643201
  misc_feature: Encodes the peptide sequence at SEQ ID NO 15697
atggccaagacaccgccacccacctccacctccacctccacctccgaccccgcgctcccaaccaccactacctcagcccccaagtcgttgccccgccccgccgccgcgggcctcctcgccccactcgcagcctctgcgcgcaccatcctcgcgtcggcgcggcgctccccggtgaccacgctcgccgccgccttcttcctgctcgcgctcgtcatgtacggcgaggacgcgcgcaccatcgccgagctctccatcaacgactacctctacccggacgccgacctctacaacgtctctggcctgccgccgctcgtgctgccgcccacctgcgacctctcccacggccgctggggttggaatgcatgccgacggttagtgctgggcccattatttgtggtttggatctggcaaagtgctatccgcctgcacgctccagtgtccattgtcaacctggtcaaatctggacggaaatccggcggcaatgctcgatcgcgccgggccgtcgaaatgaagggaatcgagatcaaggcggcggcgaacgtattgccgccgccgagaatcctcgccgccctcgccttggcagcatggaccttcttcctctacgtgcatttctccatgatcagcggcacggtggaggtgaacaacgtggaaggcctcgccgacccgtgccggggacggtacatctacatgcacgacctgccgccgcgtttcaacgccgacatcatccgcaacgactgtcgcaacactgagggccactggggcgacatctgcgcctccctgagcaacggcggcctcggccgtccgctcgccgacgacggcggtgtcatcacgggcggcgccgggtggtacagcacgcaccagttcgcgctggacatcatcttccacaaccggatgaagcagtacgagtgcctgaccaaccaccccgccgtggcgtccgccgtgttcgtcccgttctacgccggcttcgacttcgcccgctaccactggggctacgacaacgccaccagggacgccgcgtcggtggacctgacaaggtggctcatggcacggccacagtggcagcgcatgggcgggcgcgaccacttcctcgtcgccgggcgaactgggtgggacttccggaggatcagcaacctcggcgcggactggggcaacgacctcctcgtcattccgggagcccggaacatgtccgtcctcgtgctggagtccacgctgaaacgcggcaccgacttctccgtgccgtacccgacctacttccaccccaggtcggacgccgacgtgctccggtggcaggaccgggtgcgccgccggcgccggacgtggctcatggcgttcgtgggcgcgccgcggccggacgttcagatgagcatccgggtccgggatcacgtcatcgcgcagtgcaaggcgtccggcgcctgcgccatgctgagctgcgcgcgcacacccagcagcacgcagtgccacacccccgccaacatcatgcggctgttccagaaggccgtcttctgcctgcagccgccgggcgactcccccacgcgacggtcggtgttcgactcgatggtggccggctgcattccggtgttcttccacacggggtcggcgtacaagcagtacccgtggcatctccccaaggacgaccacctcaagtactccgtgtacatcccgaccgcggacgtgaggcggcgcaacgtgagcatcgaggccgtgctccgggcgatccctccggccacggtggtgcggatgcaacaggaggtgatcaggctcatcccgagtttgttgtacgctgaccccaggtccaagctggagactgtcaaggatgcggttgacgtcgccgtcgatgggatcctcgacacggtggcgcggatcaagaacggcgaggatgtcaactgtggcggtccagttgacaaggatccgccgaaccttttcgcctcgacggcatcaaggttcttttctggagggatatggcaagcagctcgctatgtttcattgtggcagtcaggcatctga

SEQ ID NO: 15697 - protein, 667 aa, Sorghum bicolor
  misc_feature: Useful for making plants with altered cell wall content and/or composition
  misc_feature: Functional homolog of the protein sequence given in SEQ ID NO 13965
  misc_feature: Ceres ANNOT ID no. 8643201
  misc_feature (228)..(584): Pfam ID: Exostosin Pfam Description: Exostosin family
MAKTPPPTSTSTSTSDPALPTTTTSAPKSLPRPAAAGLLAPLAASARTILASARRSPVTTLAAAFFLLALVMYGEDARTIAELSINDYLYPDADLYNVSGLPPLVLPPTCDLSHGRWGWNACRRLVLGPLFVVWIWQSAIRLHAPVSIVNLVKSGRKSGGNARSRRAVEMKGIEIKAAANVLPPPRILAALALAAWTFFLYVHFSMISGTVEVNNVEGLADPCRGRYIYMHDLPPRFNADIIRNDCRNTEGHWGDICASLSNGGLGRPLADDGGVITGGAGWYSTHQFALDIIFHNRMKQYECLTNHPAVASAVFVPFYAGFDFARYHWGYDNATRDAASVDLTRWLMARPQWQRMGGRDHFLVAGRTGWDFRRISNLGADWGNDLLVIPGARNMSVLVLESTLKRGTDFSVPYPTYFHPRSDADVLRWQDRVRRRRRTWLMAFVGAPRPDVQMSIRVRDHVIAQCKASGACAMLSCARTPSSTQCHTPANIMRLFQKAVFCLQPPGDSPTRRSVFDSMVAGCIPVFFHTGSAYKQYPWHLPKDDHLKYSVYIPTADVRRRNVSIEAVLRAIPPATVVRMQQEVIRLIPSLLYADPRSKLETVKDAVDVAVDGILDTVARIKNGEDVNCGGPVDKDPPNLFASTASRFFSGGIWQAARYVSLWQSGI

SEQ ID NO: 15698 - DNA, 1443 bp, Sorghum bicolor
  misc_feature: Ceres ANNOT ID no. 8643200
  misc_feature: Encodes the peptide sequence at SEQ ID NO 15699
atgaagggaattgggatcaaggcggcggcgaacgtgttgccgcggctgcggatcctcgccgtcctcggcgtggcggcgtggaccttcttcctctacgtacatttcaccgtgatcagcagcacggtggaggtgagcaacaatggggatggcctcgcggccgacccgtgccgggggcggtacatctacatgcacgatctgccgccgcgtttcaacgccgacatcatccgcgactgccgcaagaccgaggaccactggggggacatgtgcggcttcgtcagcaacgccggcctcggccgtcccctcgccgccgccgccgacgacggcggtgccatcacgggcgaagctgggtggtacgggacgcaccagttcgcgctggactccatcttccacaaccggatgaagcagtacgagtgcctgaccaaccactccgccgtggcgtccgccgtgttcgtcccgttctacgccggcttcgacttcgcccgctatcactggggctacgacaacgccaccagggacgccgcgtcggtggacctgatagagtggctcatggcacggccccagtggcggcgcatgtggggccgcgaccacttcctcgtcgccgggcgaacggggtgggacttccggaggagcagcaacgtgaacccggactggggcaccgacctcctcgccatgccgggtggccggaacatgaccgtgctcgtgctggagtccacgctgaaatacaccagcgacttctccgtgccgtacccgacctacttccacccaaggtctgacgccgacgtgctccggtggcaggacagggtgcgcggccagaaccggacgtggctcatggcgttcgtgggtgcgccgcggccggacgttccgatgagcatccggatccgggatcacgtcatcgcgcagtgcaaggcgtccagcgcctgcgccatgctggggtgcgctcgcaccctcggcagcacgcagtgccacacccccgccagcatcatgcggctgttccagaaggccgtgttctgcctgcagccgccgggcgactcgtgcacgcggcgatcggtgttcgactcgatggtggccggatgcatcccggtgttcttccacacggggacggcgtacgagcagtacccgtggcatctccccaaggacggccacctcaagtactcggtgttcatcccggacgccgacgtgaggcggcgcaacgtgagcatcgaggccgtgctccgggcgatccctccggccacggtggagcggatgcgggaggaggtgatcaggctcatcccgtctttgttgtacgccgaccccaggtcgaagctggagacgatcaaggacgcggtggacgtcgccgtcaatgggatcctcgacacggtggcggggatcaagaatccgccgagccttttcgccgccattgtgtcaaggttccggccgaggcgatcttggaaagcagctcgctag

SEQ ID NO: 15699 - protein, 480 aa, Sorghum bicolor
  misc_feature: Useful for making plants with altered cell wall content and/or composition
  misc_feature: Functional homolog of the protein sequence given in SEQ ID NO 13965
  misc_feature: Ceres ANNOT ID no. 8643200
  misc_feature (61)..(419): Pfam ID: Exostosin Pfam Description: Exostosin family
MKGIGIKAAANVLPRLRILAVLGVAAWTFFLYVHFTVISSTVEVSNNGDGLAADPCRGRYIYMHDLPPRFNADIIRDCRKTEDHWGDMCGFVSNAGLGRPLAAAADDGGAITGEAGWYGTHQFALDSIFHNRMKQYECLTNHSAVASAVFVPFYAGFDFARYHWGYDNATRDAASVDLIEWLMARPQWRRMWGRDHFLVAGRTGWDFRRSSNVNPDWGTDLLAMPGGRNMTVLVLESTLKYTSDFSVPYPTYFHPRSDADVLRWQDRVRGQNRTWLMAFVGAPRPDVPMSIRIRDHVIAQCKASSACAMLGCARTLGSTQCHTPASIMRLFQKAVFCLQPPGDSCTRRSVFDSMVAGCIPVFFHTGTAYEQYPWHLPKDGHLKYSVFIPDADVRRRNVSIEAVLRAIPPATVERMREEVIRLIPSLLYADPRSKLETIKDAVDVAVNGILDTVAGIKNPPSLFAAIVSRFRPRRSWKAAR

SEQ ID NO: 15700 - DNA, 1644 bp, Sorghum bicolor
  misc_feature: Ceres ANNOT ID no. 8643202
  misc_feature: Encodes the peptide sequence at SEQ ID NO 15701
atgtgcactgtacgaatgcagcgggcagcatcatctcctaagcttgctctaaaaaaacgtacatcatctcctaggctaaataggataactgtccgtcaacgatctcctaagccgacccattctgcacggaaaaccggcagcaatgctcggtcgcgccgggctgtgcaatcgaaggggccgtgctgcccgtgttcgctgcggaacctcgccatcctcgccgtggtagcatggaccttcttcctctacctagatttctcggtgatcagcgacacggcggaggtgagcaacggcggcgacccgtgccggggacggtacatctacgtctacgacctgccgccgcgcttcaacaccgacatcatccgcgactgccgcaaggccgggggccgctggggcgacatgtgcgacttcctgagcaacgccggccttggccgccccctcaccgacgacggcacggacggcggtggagcggggtggtacgacacgcacgagctcgcgctggacgccatcttccacaaccggatgaagcagtacgagtgcctgaccaaccgctccgctgcggccgccgccgtgttcgtcccgttctacgccggcttcgactttctgcgccaccatcgggaatacgacaaggccaccagggacgccgcgtcggcggacctgtcgttttggctcacggtacagccccagtggcggcgcatggcggggcgtgaccacttcctcgtcgccgggagaacagggtgggacttccggagaagcggcggcggcgacgtgaacccggaccgagccaacggcctcctcctcacgccggccggccggaacatgtccctgctcgtgctggagtccacgctggaacacggcaccgacttctccgtgccgtacccgacctacttccaccccaggtccgacgccgacgtgctccggtggcaggacagggtgcgcggccagcaccggacgtggctcatggtgttcgtgggtgcgccgcggccggacgttccgaggaggacccaagtccgggatcgcgtcatcgcgcagtgccaggcgtccagcgcttgcgccacgccggggtgcacgcgcagccccgccggcagtgcccagtgccccagcgccgccgacattatacggctattccagaaggccaccttctgcctgcaaccacctggcgacgacgacgacggctacttttactcccgcacgcgacggtcggtgttcgactcgatggtggccggctgcatcccggtgttcttccacgcggcgtcggcgtacaagcagtacccgtggcacctccccaaggacgaccacctcaagtactcggtgttcatcccggacgccgacgtgaggcggcgcaacgtgagcatcgaggccgtgctccgggcgatccctccggccacggtggaacgaatgcgagaggaggtgatcaggctcatcccgactttgttgtacgccgaccccaggtccaagctggagacactcaaggacgcggtcgacgtcgccattgacgggatcctagacacggtggcgcggatcaagaacggcgagcaagttaattgtggcggaccggtggacaaggatccaccgaaccttttcgccgcgacagcatcaaggatcacgccgaatggatcgatgcgagcagttgaccagcatcggtaa

SEQ ID NO: 15701 - protein, 547 aa, Sorghum bicolor
  misc_feature: Useful for making plants with altered cell wall content and/or composition
  misc_feature: Functional homolog of the protein sequence given in SEQ ID NO 13965
  misc_feature: Ceres ANNOT ID no. 8643202
  misc_feature (106)..(470): Pfam ID: Exostosin Pfam Description: Exostosin family
MCTVRMQRAASSPKLALKKRTSSPRLNRITVRQRSPKPTHSARKTGSNARSRRAVQSKGPCCPCSLRNLAILAVVAWTFFLYLDFSVISDTAEVSNGGDPCRGRYIYVYDLPPRFNTDIIRDCRKAGGRWGDMCDFLSNAGLGRPLTDDGTDGGGAGWYDTHELALDAIFHNRMKQYECLTNRSAAAAAVFVPFYAGFDFLRHHREYDKATRDAASADLSFWLTVQPQWRRMAGRDHFLVAGRTGWDFRRSGGGDVNPDRANGLLLTPAGRNMSLLVLESTLEHGTDFSVPYPTYFHPRSDADVLRWQDRVRGQHRTWLMVFVGAPRPDVPRRTQVRDRVIAQCQASSACATPGCTRSPAGSAQCPSAADIIRLFQKATFCLQPPGDDDDGYFYSRTRRSVFDSMVAGCIPVFFHAASAYKQYPWHLPKDDHLKYSVFIPDADVRRRNVSIEAVLRAIPPATVERMREEVIRLIPTLLYADPRSKLETLKDAVDVAIDGILDTVARIKNGEQVNCGGPVDKDPPNLFAATASRITPNGSMRAVDQHR

SEQ ID NO: 15702 - DNA, 1461 bp, Sorghum bicolor
  misc_feature: Ceres ANNOT ID no. 8643196
  misc_feature: Encodes the peptide sequence at SEQ ID NO 15703
atggagaaggcggcggcgaacgcgttgccgccactgcggttcctcgccgttctcgcagtgacagcgtggaccttcttcctctacttccacttctccgtgatcagcggcacggtggaggtgagccacggcgatgacgacggcgccgaccggtgccgggggcggtacatctacatgcacgacctgccgccgcgcttcaacgctgacatcatcagcaactgccgcaagaccgaggaccactggggggacatgtgcggcgccctcagcaacgctggcctcggcaggccgctggccgaccgcaccgacggcgtgctcaagagcgaggccgggtggtacgccacgcaccagttcgcgctggactccatcttccacaaccggatgaagcagtacgagtgcctgaccaaccactccgccgtggctgccgccgtgttcgtcccgttctacgccggcttcgacttcgtccgctaccactggggatacgacaacgccgccagggacgccgcgtcggtggatctgacgaaatggctcatggcgcggcccgagtggcggcgcatgggaggccgcgaccacttcctcgtcgccggccggacggggtgggacttccggaggagcaacaacgtgaacccggactggggcactgacctcctcgtcatgcctgccggccggaacatgtcggtgctcgtgctggagtcggcgatgctgcacggcaacgactaccccgttccttacccgacctacttccaccccaggtcggacgccgacgtgctccggtggcaggaccgtgtgcgcggccagcaccggacgtggctcatggcgttcgtgggcgcgccgcggccggacgtccccatcaacatccgcgtccgcgaccacgtgatcgcgcagtgcaaggcgtccagcgcctgcaccatgctgggttgcgcgcgcgccaccggcagcacccagtgccacaccccgggcaacatcatgcggctgttccagaagactactttctgcctgcagccgcccggcgacacctgcacgcggcggtcggcgttcgactccatggtggccggatgcatcccggtgttcttccaccccgggtcggcgtacaagcagtaccggtggcacctccccatggacgaccacctcaggtactcggtgtacatcccggacgccgacgtgcgggagcgcaacgtgagcatcgaggccgtgctccgggcgatccctccggccacggtggagcggatgcgggaggaggtgatcaggctcatcccgagggtcctgtacgccgaccccaggtcgaagctggagactgtcaaggacgcggtggacgtcgccgtcgaggggatcctcgacacggtggcgcggatcaataacggcgagtacgtcgacagcggcgggccggtcaccgaggaccctccgaaccttttcgcctccacggagtccagattccggccggtgcaatcggtgcaagccgatcagtag

SEQ ID NO: 15703 - protein, 486 aa, Sorghum bicolor
  misc_feature: Useful for making plants with altered cell wall content and/or composition
  misc_feature: Functional homolog of the protein sequence given in SEQ ID NO 13965
  misc_feature: Ceres ANNOT ID no. 8643196
  misc_feature (56)..(412): Pfam ID: Exostosin Pfam Description: Exostosin family
MEKAAANALPPLRFLAVLAVTAWTFFLYFHFSVISGTVEVSHGDDDGADRCRGRYIYMHDLPPRFNADIISNCRKTEDHWGDMCGALSNAGLGRPLADRTDGVLKSEAGWYATHQFALDSIFHNRMKQYECLTNHSAVAAAVFVPFYAGFDFVRYHWGYDNAARDAASVDLTKWLMARPEWRRMGGRDHFLVAGRTGWDFRRSNNVNPDWGTDLLVMPAGRNMSVLVLESAMLHGNDYPVPYPTYFHPRSDADVLRWQDRVRGQHRTWLMAFVGAPRPDVPINIRVRDHVIAQCKASSACTMLGCARATGSTQCHTPGNIMRLFQKTTFCLQPPGDTCTRRSAFDSMVAGCIPVFFHPGSAYKQYRWHLPMDDHLRYSVYIPDADVRERNVSIEAVLRAIPPATVERMREEVIRLIPRVLYADPRSKLETVKDAVDVAVEGILDTVARINNGEYVDSGGPVTEDPPNLFASTESRFRPVQSVQADQ

SEQ ID NO: 15704 - DNA, 642 bp, Sorghum bicolor
  misc_feature: Ceres ANNOT ID no. 8643278
  misc_feature: Encodes the peptide sequence at SEQ ID NO 15705
atggggaagtacatgcgcaagggcaaggtgtccggggaggtcgccgtcatggaggtccccggcggcgcgctgctcggcgtccgcacccgctcccgcacgctcgcgctgcagcgcgcgcagaggccgctcgacaagggcgacgccgaggacgccgctgcggagtacctcgagctcaggagccggaggctcgagaagccgcacaaggacccgttaccgccgccgtctgcgcctgcgaccaagaggggcgccgggaggaaggtcgccaccgccgccgccgccgccgcggcgccgcacgggctggcggaggacgacgtcgaggtctccttcggcgagaacgtgctcgacttcgacgccatggaaaggagtaccagagagacaacaccgtgcagtttgattaggaacccagagatgataagcaccccaggatccacaactaaaagtaaaaccagcaactcgatgacttcccgtcgcagaatggaaacctcaatctgccgtttcataccaagttcgcatgagatggaagagttcttctcagcagctgaaaaacaggagcagcaaagcttcagggagaagtataacttctgtcctgtgaacgactgtcctcttccgggtcggtatgaatgggcgaggctagactgctag

SEQ ID NO: 15705 - protein, 213 aa, Sorghum bicolor
  misc_feature: Useful for making plants with modulated light quality response
  misc_feature: Functional homolog of the protein sequence given in SEQ ID NO 14144
  misc_feature: Ceres ANNOT ID no. 8643278
  misc_feature (163)..(212): Pfam ID: CDI Pfam Description: Cyclin-dependent kinase inhibitor
MGKYMRKGKVSGEVAVMEVPGGALLGVRTRSRTLALQRAQRPLDKGDAEDAAAEYLELRSRRLEKPHKDPLPPPSAPATKRGAGRKVATAAAAAAAPHGLAEDDVEVSFGENVLDFDAMERSTRETTPCSLIRNPEMISTPGSTTKSKTSNSMTSRRRMETSICRFIPSSHEMEEFFSAAEKQEQQSFREKYNFCPVNDCPLPGRYEWARLDC

SEQ ID NO: 15706 - DNA, 1185 bp, Sorghum bicolor
  misc_feature: Ceres ANNOT ID no. 8643286
  misc_feature: Encodes the peptide sequence at SEQ ID NO 15707
atggactacttcagctcctgctggggcccgcgatcgcgtgccgggcaccggggcaagggctccgacgcggccggccggcaggacggtctcctctggtacaaggacgctggccagctcgtcactggggagttctccatggccgtggtgcaggccaaccagctgcttgaggaccagagccaggtggaatccggaccgctctccctggctgaccccggcccgcagggcaccttcgtcggcgtccatgatggccatggcggcccagagacggcccggttcatcaatgaccacctcttcaaccatctcaggaaatttgcaactgagcacaagtgtgtgtcagcggatgtgatccggaaagctttccaagcaactgaggagggctggctttctcttgtaagcaaggaatggtctatgaagcctcagattgcttcagtaggctcctgctgccttgttggtgtaatctgtgctgggactctctatgttgcaaacctgggcgactcacgtgcagttcttggaaggcttgttaaggcaactggagaggctgtggccatgcagttgtcatcggagcacaatgcgtgccatgaggaagttagacaagagctgcagtcatcacatcctgatgatccacatattgtggttcttaaacacaatgtttggcgagtgaagggtctcatccagatctcaagatctatcggagatgtatatctaaagaaaccagagtataacagagaacctcttcatagcaagtttcggcttcgagaaaccttccagaggccgattcttagtgctgaccctcaaattactgaacatcgaatacagccaaacgatcagtttgttatatttgcttctgatggtctatgggagcacctcagcactcaggaagcagttgaccttgtccacagtagtccccgtaatggaatcgctcggagactagttaaagccgcgatgcaagaagctgccaagaagagggagatgagatattcagacctcaagaagatcgaccgaggtgtgagaaggcatttccacgacgatacaaccgtggttgtgctgttcctggattcaaatgccatgagcaaagcaagctggagcaaaagcccctctgtttctatccgagggggcggtgtaacccttcccgcgaaatccctcgcacctttctcagctctggcacagttgaacagcacctactga

SEQ ID NO: 15707 - protein, 394 aa, Sorghum bicolor
  misc_feature: Useful for making plants with modulated biomass
  misc_feature: Useful for making plants with modulated low light sensitivity
  misc_feature: Functional homolog of the protein sequence given in SEQ ID NO 13347
  misc_feature: Ceres ANNOT ID no. 8643286
  misc_feature: Up-regulated in root tissues in response to methyl jasmonate treatment
  misc_feature (114)..(354): SWISSPROT Homolog: EC 3.1.3.16 Phosphoprotein phosphatase
  misc_feature (45)..(323): Pfam ID: PP2C Pfam Description: Protein phosphatase 2C
MDYFSSCWGPRSRAGHRGKGSDAAGRQDGLLWYKDAGQLVTGEFSMAVVQANQLLEDQSQVESGPLSLADPGPQGTFVGVHDGHGGPETARFINDHLFNHLRKFATEHKCVSADVIRKAFQATEEGWLSLVSKEWSMKPQIASVGSCCLVGVICAGTLYVANLGDSRAVLGRLVKATGEAVAMQLSSEHNACHEEVRQELQSSHPDDPHIVVLKHNVWRVKGLIQISRSIGDVYLKKPEYNREPLHSKFRLRETFQRPILSADPQITEHRIQPNDQFVIFASDGLWEHLSTQEAVDLVHSSPRNGIARRLVKAAMQEAAKKREMRYSDLKKIDRGVRRHFHDDTTVVVLFLDSNAMSKASWSKSPSVSIRGGGVTLPAKSLAPFSALAQLNSTY

SEQ ID NO: 15708 - DNA, 1650 bp, Sorghum bicolor
  misc_feature: Ceres ANNOT ID no. 8643320
  misc_feature: Up-regulated in root tissues in response to methyl jasmonate treatment
  misc_feature: Encodes the peptide sequence at SEQ ID NO 15709
atggagagctcagttgagagctggtgggtgcttcccatgaccttgatcccggccatctccggccagcagcacgagaacatggccaccatagccactagcttcgtctacctcgccatcttcgcatgccttgcatgggcaggcgcgtccctgctctactgggctcacccaggcggccctgcgtggggcaagtactggagggcgaaggggaagccgtcgtcgacgatcccggggcccaaggggctcccggtcgtcggcagcctcggcctcatgtccgggctggcgcactgctcgctggccgacgaggcgtcgcgccggccgggggccaagcggctcatggcgctgtcgctcggccccgtccgcgcggtggtcacgtcccacccggacgtggccaaggagatcctcgacaacccggcgttcgccgaccgccccctcaaccacgccgcgtacggcctcatgttccaccgctccatcggcttcgccgagcacggcccgtactggcgcgcgctccggcgcgtcgccgcgggacacctgttcggcccgaggcaggtcgaggccttcgcgccgtaccgtgccgccgtcggggaagggatcgtcgcggccctgcacggcgccggcggcggcgtcgtccaggtgcgcggcctcctgcgccgagcttcgctctactacatcatgcggttcgtgttcggcaaggagtacgacgtgtcgcgcgccgtgccggcgtccgggaaggaggaggtggaggagctgctcgagatggtgcacgaggggtacgagctcctgggcatggagaactggtgcgactacttcccggggctcgccgccctcgacccgcagggcgtcggagcacggtgcgccgagctcatgccacgggtgaaccggttcgtgcatggcatcatccaggagcgccgtgccaaggcgatcgccggaggagacgcgcgtgacttcgttgacatcttgctctccctgcaggagagcgagaggctcgccgacgccgacatagccgctgtgctctgggagatgatcttcagaggaacggacgccatggccgtgctcatggagtggaccctagctcgcctcgtcctccaccgtgacgtccaagccaaggcgcaccgtgagctcgacgaggtcgtcggcgggaacagccaggtcgtcaccgagtcggcagcggcgccgtcgctgccttacctgcaggcgttgctaaaggaggctctccggatgcacccgccggggcccctcctgtcgtggcgccacagggcgatatccgacacgtacgtcgacgggcacctcgtcccggcaggcaccaccgccatggtgaaccagtgggcaatcagccgcgaccccgaggtgtgggacgcgccgctcgagttccggcccgagcggttcctccctggcggcgagggccaggacgtgtccgtgctcggcgccgacggccgcctcgtgccgttcgggtccggtcggaggagctgccccggcaagtccctggctatgaccaccgtgaccacctggatggccaccctgctgaacgagttcgagtggctgccggcgtcagacgatacaggcggcgacgtcgacctctcggaggtgctccgtctgtcctgcgagatggctgtgccgctggaggtccgcgtgcgcccgaggagcggcatgtga

SEQ ID NO: 15709 - protein, 549 aa, Sorghum bicolor
  misc_feature: Useful for biocontainment applications
  misc_feature: Useful for making plants with modulated flowering time
  misc_feature: Useful for making plants with modulated nitrogen use efficiency
  misc_feature: Functional homolog of the protein sequence given in SEQ ID NO 14250
  misc_feature: Ceres ANNOT ID no. 8643320
  misc_feature (259)..(546): SWISSPROT Homolog: EC 1.14.13.21 Flavonoid 3'-monooxygenase
  misc_feature (75)..(539): Pfam ID: p450 Pfam Description: Cytochrome P450
MESSVESWWVLPMTLIPAISGQQHENMATIATSFVYLAIFACLAWAGASLLYWAHPGGPAWGKYWRAKGKPSSTIPGPKGLPVVGSLGLMSGLAHCSLADEASRRPGAKRLMALSLGPVRAVVTSHPDVAKEILDNPAFADRPLNHAAYGLMFHRSIGFAEHGPYWRALRRVAAGHLFGPRQVEAFAPYRAAVGEGIVAALHGAGGGVVQVRGLLRRASLYYIMRFVFGKEYDVSRAVPASGKEEVEELLEMVHEGYELLGMENWCDYFPGLAALDPQGVGARCAELMPRVNRFVHGIIQERRAKAIAGGDARDFVDILLSLQESERLADADIAAVLWEMIFRGTDAMAVLMEWTLARLVLHRDVQAKAHRELDEVVGGNSQVVTESAAAPSLPYLQALLKEALRMHPPGPLLSWRHRAISDTYVDGHLVPAGTTAMVNQWAISRDPEVWDAPLEFRPERFLPGGEGQDVSVLGADGRLVPFGSGRRSCPGKSLAMTTVTTWMATLLNEFEWLPASDDTGGDVDLSEVLRLSCEMAVPLEVRVRPRSGM

SEQ ID NO: 15710 - DNA, 1626 bp, Sorghum bicolor
  misc_feature: Ceres ANNOT ID no. 8643297
  misc_feature: Encodes the peptide sequence at SEQ ID NO 15711
atggcgggcgggcaggggcagaacatggaggtgctctcggcgctagacggcgccaggacgcagtggtaccacttcacggcgatcatcgtggcggggatgggcttcttcaccgacgcgtacgacctcttctgcatctccctcgtcaccaagctcatcggccgaatctactacaccgtcgacggctcgcccaagccgggcagcctgccgccgcacgtgtcctcgcccgtcaacggcgtggcgttcgtgggcacgctgtcggggcagctcttcttcggctggctcggcgaccgggtgggccggaagagcgtctacgggatgacgctcgtgacgatgatcgtctgctccgtcgcgtcgggcctctcgttcggctactcgccggcctgcgtcatggccacgctctgcttcttccgcttctggcttggcttcgggatcggcggcgactacccgctgtcggcgaccatcatgtcggagtacgccaacaagaagacgcgcggcgcgttcgtcgctgccgtcttcgccatgcaggggttcggcatcctggccgccggcgccgtcgccatcggcgtcagcgcgctgttccggagcccgttccccgcgccgccctacgacgtcgaccccgcggcgtccacgccggcggaggcggacctggtgtggcgcatcatcctcatgttcggcgccgtgcccgcggcgctcacattctactcgcgtatgaacatgcccgagacggcgcggtacacggcgttggtggcccggaacgcggagcgcgccgcggcggacatgtccagggtgctccaggtcgacatcggcaataaggaggaagggccggagacacagccccggtgccgcggcgagccgcaagaagaagcgacaacggtgccgccgccgccgccgccgttcgggctcttctcccgcgagttctttcaccggcacgggctccacctgctgggcacgacgtcgacgtggctcctcctggacatcgcctactactcgcagaacctgttccagaaggacctgttcagcgcggtggggtggatcccggcggcggagacgatgagcgcgctggacgagctgttccacatcgcgcgcgcgcagacgctgatcgcgctgtgcggcacggtgcccgggtactggttcacggtggcgttcatcgacgtggtggggcggttcgcgatccaggcggtgggattcctcatgatggcggccttcatgctggggctggccgtcccgtacgaccggtggacgcgccccggcaaccagacggggttcgtggtgatgtacgcgctcaccttcttcttcgccaacttcgggcccaacgccaccaccttcatcgtgcccgcggagatctacccggcgcggttccgcgcgacgtgccacggcatctcggcagcgtcgggcaaggtgggcgccatcatcggctccttcgggttcctgtacctggcgcagagccaggacccggccaagacggcgcacgggtacccgccgggcatcggcgtgcgcaactcgctgctgctgctcgccgggtgcagcttcctggggttcctgctcacgttcctggtgccggagcccaagggcaagtcgctcgaggagttgtcgcgcgagaccgagccgggggccgccgagccgtaa

SEQ ID NO: 15711 - protein, 541 aa, Sorghum bicolor
  misc_feature: Useful for making plants with modulated phosphate use efficiency
  misc_feature: Functional homolog of the protein sequence given in SEQ ID NO 14251
  misc_feature: Useful for making plants with modulated carbohydrate content
  misc_feature: Functional homolog of the protein sequence given in SEQ ID NO 13407
  misc_feature: Ceres ANNOT ID no. 8643297
  misc_feature (31)..(473): Pfam ID: MFS_1 Pfam Description: Major Facilitator Superfamily
MAGGQGQNMEVLSALDGARTQWYHFTAIIVAGMGFFTDAYDLFCISLVTKLIGRIYYTVDGSPKPGSLPPHVSSPVNGVAFVGTLSGQLFFGWLGDRVGRKSVYGMTLVTMIVCSVASGLSFGYSPACVMATLCFFRFWLGFGIGGDYPLSATIMSEYANKKTRGAFVAAVFAMQGFGILAAGAVAIGVSALFRSPFPAPPYDVDPAASTPAEADLVWRIILMFGAVPAALTFYSRMNMPETARYTALVARNAERAAADMSRVLQVDIGNKEEGPETQPRCRGEPQEEATTVPPPPPPFGLFSREFFHRHGLHLLGTTSTWLLLDIAYYSQNLFQKDLFSAVGWIPAAETMSALDELFHIARAQTLIALCGTVPGYWFTVAFIDVVGRFAIQAVGFLMMAAFMLGLAVPYDRWTRPGNQTGFVVMYALTFFFANFGPNATTFIVPAEIYPARFRATCHGISAASGKVGAIIGSFGFLYLAQSQDPAKTAHGYPPGIGVRNSLLLLAGCSFLGFLLTFLVPEPKGKSLEELSRETEPGAAEP

SEQ ID NO: 15712 - DNA, 813 bp, Sorghum bicolor
  misc_feature: Ceres ANNOT ID no. 8643349
  misc_feature: Encodes the peptide sequence at SEQ ID NO 15713
atggccgtcctcaccgccgcctccaccacgctcccgctgctgctcctcgtctggctatggctcccgctcctcgcgtccgcctgcgaccgctgcgtgcgccactccaaggccgcctactacacctcctcgctcaccctcgccggtggctcctgcgggtacggcaccgaggccgcctccttcagcgccggcttcctcgccgccgccagccccgcgctgtaccgcgccggcgtcggctgcggcgcctgcttccaggtgcggtgcaaggacaagaagctctgcgccgcggcgggcgccagggtggtggtcacggaccgcgccaggaccaaccgcaccgacctcgtgctcagcagcaccgcgttcgcggccatggcgcgccccggcgtggccaaacgtctcgccgccctccgcaccgtcgacgtcgagtacaaaagggtgccgtgcgagtacaagcacaggaacctgtcggtgagggtggaggacaagagccgcgctccgggcgacctcgccatcaggttcctctaccagggcggccagaccgacatcgtcgccgtcgacgtcgcgcaggtgggttcgtccaactggaagttcatgacgcgcgacaacgggccggcgtggagcacgagccaggcgccgccggggccgctccagctcagggtggtggtgacgggcggctacgacggcaagtgggtgtgggccgaccgcgaggtgctgccgcggcggtggcgcgccggcgaggtctacgacacgggcgtccagatcactgacatcgcccaggagggctgcttcccctgcgacacgcacgagtgggagtga

SEQ ID NO: 15713 - protein, 270 aa, Sorghum bicolor
  misc_feature: Useful for making plants with altered carbohydrate content
  misc_feature: Functional homolog of the protein sequence given in SEQ ID NO 14167
  misc_feature: Useful for making plants with altered cell wall content and/or composition
  misc_feature: Functional homolog of the protein sequence given in SEQ ID NO 14168
  misc_feature: Ceres ANNOT ID no. 8643349
  misc_feature (65)..(142): Pfam ID: DPBB_1 Pfam Description: Rare lipoprotein A (RlpA)-like double-psi beta-barrel
  misc_feature (154)..(238): Pfam ID: Pollen_allerg_1 Pfam Description: Pollen allergen
MAVLTAASTTLPLLLLVWLWLPLLASACDRCVRHSKAAYYTSSLTLAGGSCGYGTEAASFSAGFLAAASPALYRAGVGCGACFQVRCKDKKLCAAAGARVVVTDRARTNRTDLVLSSTAFAAMARPGVAKRLAALRTVDVEYKRVPCEYKHRNLSVRVEDKSRAPGDLAIRFLYQGGQTDIVAVDVAQVGSSNWKFMTRDNGPAWSTSQAPPGPLQLRVVVTGGYDGKWVWADREVLPRRWRAGEVYDTGVQITDIAQEGCFPCDTHEWE

SEQ ID NO: 15714 - DNA, 1662 bp, Sorghum bicolor
  misc_feature: Ceres ANNOT ID no. 8643351
  misc_feature: Encodes the peptide sequence at SEQ ID NO 15715
atggcggaccggccggaggtggcggtggactcgcgcagcggctactgcgccgcgacgcgcaccttccgcagcaagcgcgcggacgtcccgctccccgccgacgcggacctggacgtggtccggttcctcgcgtcccgccgccacgcgggcgtcgtcgcgctcatcgacgccgccacgggccgccgggtcacgttccgggacctctggcgcgccgtggagggggcggccaccgcgctcgccgcgccgccgctgtcgctccgcaagggccaggtcgcgctcatcctctccccgaactccatccacttccccgtcgccgcgctcgccgccatgtcccttggcgccgtcctcaccaccgccaacccgctcaacacgcccgccgagatcgctaagcaggtcgccgacgcgcgccccgtcgtcgccttcaccacccgcgacctactccccaagctccctctcggcgccggcctccgcgtcgtgctcctcgagcccgaccgcctcgcctccgaccctagctccgtcgtcgccactatcggggagatctccgccacgccgcccgaccctgcgcgccgcggggaccgccgcgtcacgcaggacgatccggccacgctgctctactcctcgggcaccacgggccccagcaagggcgtcgtcgccacgcaccggagcctcatctccatggtgcagatcatcatgacgcgcttccgcctcgagggctctgacaagaccgagaccttcctctgcacggtgcccatgttccacgtctacggccttgtcgccttcgccacggggctgctcggctgcggcgccaccatcgtcgtgctctccaagtacgagctccccgagatgctgcgctccatcaatgaatacggggtcacctacctcccgctcgtgccgcccatcctcgtcgccatgctggcgcaccccaagccgctgccgctcgggaacctgcgcaaggtgctctccggcggagcgccgctgagcaaggagctcatcgaggggttcaaggagaagtacccgcaggtggagatcctgcaggggtacgggcttacggagagcacggctatcggcgcgtccacggactctgccgaggagagccgtcggtacggcacggctgggctgctgtcacccaacaccgaggctaagatcgtcgacccggagaccggcgaggcactgccggtgaaccgcaccggcgagctctggatccgggggccatacgtcatgaaagggtatttcaagaacacggaggcaacacagtcaacattgacacctgatggatggctcaagactggggatctctgctacatagacgaagatgggtatctctttgtggtggatcgtctgaaggagttgatcaaatacaaagggtatcaggtgcctccggcagagttggaagctcttttgctaacacactcagaaatccaagatgtcgccgttataccgtttcctgatcgggaggtcggccagttcccaatggcctacgtagtgaggaagaaggggagcaatttgtcagagcgcgaggtgatggagtttgtggccaaacaggtagcgccttataagaaggttagaaaggtggcgtttgtgacagaaattcccaagaacgcgtccggcaagatactgaggaaggatctcatcaagctcgccacatccaaatccaaactatga

SEQ ID NO: 15715 - protein, 553 aa, Sorghum bicolor
  misc_feature: Useful for making plants with altered carbohydrate content
  misc_feature: Functional homolog of the protein sequence given in SEQ ID NO 14252
  misc_feature: Useful for making plants with altered cell wall content and/or composition
  misc_feature: Functional homolog of the protein sequence given in SEQ ID NO 14253
  misc_feature: Ceres ANNOT ID no. 8643351
  misc_feature (54)..(545): SWISSPROT Homolog: EC 6.2.1.12 4-coumarate--CoA ligase
  misc_feature (64)..(478): Pfam ID: AMP-binding Pfam Description: AMP-binding enzyme
MADRPEVAVDSRSGYCAATRTFRSKRADVPLPADADLDVVRFLASRRHAGVVALIDAATGRRVTFRDLWRAVEGAATALAAPPLSLRKGQVALILSPNSIHFPVAALAAMSLGAVLTTANPLNTPAEIAKQVADARPVVAFTTRDLLPKLPLGAGLRVVLLEPDRLASDPSSVVATIGEISATPPDPARRGDRRVTQDDPATLLYSSGTTGPSKGVVATHRSLISMVQIIMTRFRLEGSDKTETFLCTVPMFHVYGLVAFATGLLGCGATIVVLSKYELPEMLRSINEYGVTYLPLVPPILVAMLAHPKPLPLGNLRKVLSGGAPLSKELIEGFKEKYPQVEILQGYGLTESTAIGASTDSAEESRRYGTAGLLSPNTEAKIVDPETGEALPVNRTGELWIRGPYVMKGYFKNTEATQSTLTPDGWLKTGDLCYIDEDGYLFVVDRLKELIKYKGYQVPPAELEALLLTHSEIQDVAVIPFPDREVGQFPMAYVVRKKGSNLSEREVMEFVAKQVAPYKKVRKVAFVTEIPKNASGKILRKDLIKLATSKSKL

SEQ ID NO: 15716 - DNA, 1173 bp, Sorghum bicolor
  misc_feature: Ceres ANNOT ID no. 8643364
  misc_feature: Encodes the peptide sequence at SEQ ID NO 15717
atggggaactgctgcggctccgctgacgcagacgggaagccgccgagtcgtcctcccaccaaagggccgccgccgaagacgacgacatgggcgccgccgacgccgaagccgagcgacggcggcggcggggcgaagcaagagacgggaggaggagacgatcctccgtgcacgggtcccgggcgggttctggaggcgccgaggctgagggagttcacgctggccgagctgcggcaggccacgcgcgggttcaagccggagatggtgctcggggagggcggcttcggccgggtctacaagggctgggtcgacgagcgcacgctcaacccggccaagagcaacgccggcgtcatcgtcgcagtcaagaagctcaacccggagagcgtccagggcctgcaggagtggcagtcggaggtcaacttcctgggtaggctgtcgcatcccaacctggtgaggctgctgggctactgcggcgaggacagggagctgctcctggtgtacgagttcatgtccaagggcagcctggaaaaccatctcttcagaaggggtggaaacttggaggcgctgtcgtggagccggaggctcaagatcgccacgggcgcggcccgcggcctcgccttcctgcactcgtcggagaagcaggtcatctacagggacttcaaggcgtccaacatcctcctcgactcggattacactgcgaagctgtcggatttcgggctcgccaagaacgggccctccgccggcaagtcgcacgtcacgacccggatcatcggcacctacggctacgcggcgccggagtacgtcgccaccgggcacttgtacgtgaagagcgacgtgtacggcttcggcgtggtgctgctggagctgctgacggggctgcgcgcgcacgacctgaaccggccgagccaccagcacaacctggtggagtgggctaaaccctacctctccggcgccggcaagctcaagagcctcatggaccagcggatcgacggccagtacaacaccaaggccgcgctccgggccgccaggctcgccggcaagtgcctcaccggagaccccaagagccgcccttccatggacgacgtcgtcgccgcgctcgaggacatcgaggccccgcagcagggggccggaggacaccgggacctgccgccgcggcccggagcgcgccgctcgtag

SEQ ID NO: 15717 - protein, 390 aa, Sorghum bicolor
  misc_feature: Useful for making plants with modulated drought sensitivity
  misc_feature: Functional homolog of the protein sequence given in SEQ ID NO 14078
  misc_feature: Useful for making plants with modulated heat sensitivity
  misc_feature: Functional homolog of the protein sequence given in SEQ ID NO 14079
  misc_feature: Ceres ANNOT ID no. 8643364
  misc_feature (62)..(390): SWISSPROT Homolog: EC 2.7.11.1 Non-specific serine/threonine protein kinase
  misc_feature (83)..(365): Pfam ID: Pkinase Pfam Description: Protein kinase domain
MGNCCGSADADGKPPSRPPTKGPPPKTTTWAPPTPKPSDGGGGAKQETGGGDDPPCTGPGRVLEAPRLREFTLAELRQATRGFKPEMVLGEGGFGRVYKGWVDERTLNPAKSNAGVIVAVKKLNPESVQGLQEWQSEVNFLGRLSHPNLVRLLGYCGEDRELLLVYEFMSKGSLENHLFRRGGNLEALSWSRRLKIATGAARGLAFLHSSEKQVIYRDFKASNILLDSDYTAKLSDFGLAKNGPSAGKSHVTTRIIGTYGYAAPEYVATGHLYVKSDVYGFGVVLLELLTGLRAHDLNRPSHQHNLVEWAKPYLSGAGKLKSLMDQRIDGQYNTKAALRAARLAGKCLTGDPKSRPSMDDVVAALEDIEAPQQGAGGHRDLPPRPGARRS

SEQ ID NO: 15718 - DNA, 2919 bp, Sorghum bicolor
  misc_feature: Ceres ANNOT ID no. 8643363
  misc_feature: Encodes the peptide sequence at SEQ ID NO 15719
atggagaaagcgccgcagaccgacgacgacggcttgctggcctgcggcgtcatggagatggatgacatcgcggtcggcgacctggatctcatggaggagctgtttatggcggcgccggggttcgatttctccgacttctcgcagcccgggcccggcggcgcgtccccggggtcctgcttctcgccgctgttcgacatctgcagcaccaccaccacggcgactcccccgccggcgccggagccggcgggcgacgacgaccaggcggcggccgccccgccgccgcgccgcggctgggtgttccagccccgccacgaggtcgaggccacggtgaaggagcggctgcggcgcgcgctggagcgcatcgcgtcgctgtcgcagacgcagcccggggagctgctggcgcaggtctgggtccccaccgtcatcggcgaccgccaggtgctcaccacctgcggccagcccttctggctcgaccgccggaacgagcgcctcgccaactaccggacagtgtccatgaagtaccagttctccgccgacgagaccgcgcgcgccgacctggggatgcccggccgcgtcttcgtcggccgcgtccccgagtggacccccgacgttcgctacttctccaccgaggagtacccgcgcgtacgccacgcgcagtacttcgacatccgcggcagcgtcgcgctccccatcttcgagccccgcagccgggcatgccttggcgtcgtcgagctcgtcatgaccaccgagaaggtcaactacaatgctgagatccagaacatctgcagcgctctcaaggaggttgatctcagaagctctgatgtttcgagtgatccccgtgcaaaggtgactgatacttcttaccgagcaaccataccagagatcgttgacgttctcagaactgtttgtgagacacacaaactgccactggcccagacatggataccctgcatctgccaggcaaagaggggaagccgccacactgatgaaaaactcaagtattgtgtgtctactgtggacgaggcgtgttacgtccgtgacctaaatgtaaagggctttcacgaagcttgttctgagcatcatctgttcagaggtgagggtgttgttggcagggccttcggaacgaacgagccatgtttctccgaggacattaccacctccagcaaggtccaataccctctctctcatcatgccaaacttttcagcttaagggctgcagtggccatccggttacgaagtatcaccactggaagccttgactatgtcttggaattcttcctgccagtggactgtatagagatcgaacagcagcgagccatgctgaattctttgtccattacaatacagcaaacatgctatacgcttcgagttgtcagcttgaaagaactcgtggatgaaggatcaattgaaacaagtgcactaactccaccagaatatgccaaaactatgcatgaaaacctagatgaggtttgtagtggcattgatgctcctgcaaggacagcatcactggaaacttctgaggaggtgtcctcatggatagcaagccttgtgtgcgctcaaaataagggagtgaaagaaatggatggtgacctgccatttggattcagcaaacaagaggatgaagggtttagtgtgacagctggttggcataccacaccagtaatagggcctgaaggtagcatcttttcagggattaagcagcatgaagactacaaggtcaaggaggtaacatgtctcagagatccaagctcatccaaattgggaaaaactgtagagaagagacggactaagatggagaaaactgttagcctggaagaacttcggaagcattttgctggcagcctgaaagaagctgcaaagaatctaggagtgtgccccactacactgaagagaatatgcaggcagcatggaattaatcgttggccatcacggaagattaagaaagttgggcactccttgaagaaattgcaaatggtgattgattcagtacatggtaatgaaggaactgttcagctcagctcgctctatgaaaactttaccaagaccacatggtcagaaagagagttacagggggatgcctcttatccgttgtctgaggaaaaaggtctcttggaaccttctgttcctgatcagcactgcgagggcagattcacctcgcatacttctggttctaattccctctccccctcttgcagccaaagctcaaattccagccatggttgttccagtggttcgaaatcacaacaacatggcagtgcttctcaacttgcagtaaagaaagaagttttcatggaggagaatcagagctccacactactcaaagctgcgagccatgcggaactgcagatgtgtccagaagaaagacctgttaccctgcctaggtctcatagtcaaatgcttttaagtgaacaaaaaccagtggaaaacatgacaggtatgcaaatgtctaagcctgattctctcaagataaaagccatgtacggcgaagaaagatgtatattccggcttcagcctagttggggatttgaaaagctaaaagaagaaattctaaagcggttcggcgttgctcaggagatgcatgtggacctcaagtacttggatgatgaatctgagtgggttcttttaacatgcgatgcagacctgcttgagtgtattgatgtgtacaagtcatcaaatactcaaacagggaacaatacgagctcatatccggtcaaatgtgatttttgttggttcaaggtcaatgctagtttttcatgttgcttcaaccacacagaagggatggtggtttttggtatcctgaataattctacagttagaaggcaggagatatctcagtctcctagacgacattggaccatagagattttcctttgtttcgctcttatttttgttcagcggtggaattcccaagtactttga

SEQ ID NO: 15719 - protein, 972 aa, Sorghum bicolor
  misc_feature: The sequence is a functional homolog of SEQ ID NO 1498 in the 10/666,642 US patent application
  misc_feature: Ceres ANNOT ID no. 8643363
  misc_feature: Up-regulated in root tissues in response to salicylic acid treatment
  misc_feature: Up-regulated in shoot tissues in response to salicylic acid treatment
  misc_feature (598)..(649): Pfam ID: RWP-RK Pfam Description: RWP-RK domain
  misc_feature (820)..(894): Pfam ID: PB1 Pfam Description: PB1 domain
MEKAPQTDDDGLLACGVMEMDDIAVGDLDLMEELFMAAPGFDFSDFSQPGPGGASPGSCFSPLFDICSTTTTATPPPAPEPAGDDDQAAAAPPPRRGWVFQPRHEVEATVKERLRRALERIASLSQTQPGELLAQVWVPTVIGDRQVLTTCGQPFWLDRRNERLANYRTVSMKYQFSADETARADLGMPGRVFVGRVPEWTPDVRYFSTEEYPRVRHAQYFDIRGSVALPIFEPRSRACLGVVELVMTTEKVNYNAEIQNICSALKEVDLRSSDVSSDPRAKVTDTSYRATIPEIVDVLRTVCETHKLPLAQTWIPCICQAKRGSRHTDEKLKYCVSTVDEACYVRDLNVKGFHEACSEHHLFRGEGVVGRAFGTNEPCFSEDITTSSKVQYPLSHHAKLFSLRAAVAIRLRSITTGSLDYVLEFFLPVDCIEIEQQRAMLNSLSITIQQTCYTLRVVSLKELVDEGSIETSALTPPEYAKTMHENLDEVCSGIDAPARTASLETSEEVSSWIASLVCAQNKGVKEMDGDLPFGFSKQEDEGFSVTAGWHTTPVIGPEGSIFSGIKQHEDYKVKEVTCLRDPSSSKLGKTVEKRRTKMEKTVSLEELRKHFAGSLKEAAKNLGVCPTTLKRICRQHGINRWPSRKIKKVGHSLKKLQMVIDSVHGNEGTVQLSSLYENFTKTTWSERELQGDASYPLSEEKGLLEPSVPDQHCEGRFTSHTSGSNSLSPSCSQSSNSSHGCSSGSKSQQHGSASQLAVKKEVFMEENQSSTLLKAASHAELQMCPEERPVTLPRSHSQMLLSEQKPVENMTGMQMSKPDSLKIKAMYGEERCIFRLQPSWGFEKLKEEILKRFGVAQEMHVDLKYLDDESEWVLLTCDADLLECIDVYKSSNTQTGNNTSSYPVKCDFCWFKVNASFSCCFNHTEGMVVFGILNNSTVRRQEISQSPRRHWTIEIFLCFALIFVQRWNSQVL

SEQ ID NO: 15720 - DNA, 2001 bp, Sorghum bicolor
  misc_feature: Ceres ANNOT ID no. 8643414
  misc_feature: Up-regulated in root tissues in response to salicylic acid treatment
  misc_feature: Up-regulated in shoot tissues in response to salicylic acid treatment
  misc_feature: Encodes the peptide sequence at SEQ ID NO 15721
atgacgtccttgtcacggacgctgtctcggggcgggccgatgcagcctccagggtctcgccgcatccaaaggacgcagactgctgtgaactttggtgagcccatgtttgacagtgaggtggtgccatcgtcgcttgttgagatcgcgcccatcctccgtgttgccaatgaggttgagacggccaaccctcgcgtcgcctatctctgccggttctatgcattcgaaaaggctcacaggttagatccgacttcaagtggtcgtggtgtccgacagttcaagacagctcttctacagcggcttgaaagggagaatgagcccaccttgatgggaagggggcaaaagagtgatgcacgggaaatacagaccttctatcatcactactacaagaaatacattcaagcacttcagaatgcttctgaccaagtggatcgtgcccaactaaccaaagcctaccagactgctgctgttctgtttgaagttttaaaagcagttacacaacaacatgctgttgaagttgaccatgagatcttggaagctgctgataaggttaaagagaaaacaaagatctatctcccttttaacattctccctcttgatccagacagtggcaatcaggcaatcatgaaatttcctgagacggatagtgtttcaaatcagagagaacatttgattttacttcttgctaacatacatatacgaagaaatccgaagaccgatcaacaatccaagttggatgacaatgcactgaatgacgtgatgaaaagattgtttaagaattacaagaaatggtgcaaatatcttggtcgcaagagcagcctttggttgccaacaattcagcaggagatgcaacaacgaaaaatactgtatatgggtttgtaccttctcatttggggtgaagctgcaaacttgcgatttatgccagaatgcatttgctacatatatcaccatatggcatttgaaatgtatggtatgttagctggaaatgtcagtgccttgacgggtgaatatgttaagccggcctatggtggtgagaaagaagcctttctgaagaaagttgttacaccgatttaccataccatagcaaaggaagctgaaaggagcaaaagagagaaagggaatcattctgagtggagaaactatgatgatcttaatgagtacttctggtctgctgactgctttcggcttggttggcctatgcgagctgatgctgacttcttttgtcaaccagatgaaagaaatgaaagcacaaggatcagcaaacagaagggaaagatcaacttcgttgagctacgttcattttggcacatattcagaagttttgacagactgtggagcttctttattttagctcttcaggttatgataattctcgcttgggagggaggttcattagccagtatttttgattacgctgttttcaagaaggttttgagtatctttatcacttctgctatactaaatcttggacaagctacactagatattatatttaattggaaggccaggaggacaatggaatttgcagttaagctgagatatgttctaaaattcgtaatggcagccttgtgggtggtactactgccagttacatatgcttacacctgggaaaatccaactggaattatcagagtcataaaaagctggttcggaaatggtcgaaaccacccacccctatttgttgtttcagtagtcatatatttgtcacccagtatgctttctgctattctttttcttcttccatttctacgccggagccttgaaagttcagacttcaagcttgtgaggttcatcatgtggtggtctcagcaaattgaaaagcatcatcacaagggtttcaattctttagtggtgatggtggcatggtggatttggaaacataggaatgcctgtgtctttgaaggggccttacctaatgttaatgctctcatgcaagaaattaagggtgagacaatattgtggtgtatcgctggggctaaaggtcttagacatatttggccatag

SEQ ID NO: 15721 - protein, 666 aa, Sorghum bicolor
  misc_feature: Useful for making plants with altered cell wall content and/or composition
  misc_feature: Functional homolog of the protein sequence given in SEQ ID NO 14254
  misc_feature: Ceres ANNOT ID no. 8643414
  misc_feature (272)..(448): SWISSPROT Homolog: EC 2.4.1.34 1,3-beta-glucan synthase
MTSLSRTLSRGGPMQPPGSRRIQRTQTAVNFGEPMFDSEVVPSSLVEIAPILRVANEVETANPRVAYLCRFYAFEKAHRLDPTSSGRGVRQFKTALLQRLERENEPTLMGRGQKSDAREIQTFYHHYYKKYIQALQNASDQVDRAQLTKAYQTAAVLFEVLKAVTQQHAVEVDHEILEAADKVKEKTKIYLPFNILPLDPDSGNQAIMKFPETDSVSNQREHLILLLANIHIRRNPKTDQQSKLDDNALNDVMKRLFKNYKKWCKYLGRKSSLWLPTIQQEMQQRKILYMGLYLLIWGEAANLRFMPECICYIYHHMAFEMYGMLAGNVSALTGEYVKPAYGGEKEAFLKKVVTPIYHTIAKEAERSKREKGNHSEWRNYDDLNEYFWSADCFRLGWPMRADADFFCQPDERNESTRISKQKGKINFVELRSFWHIFRSFDRLWSFFILALQVMIILAWEGGSLASIFDYAVFKKVLSIFITSAILNLGQATLDIIFNWKARRTMEFAVKLRYVLKFVMAALWVVLLPVTYAYTWENPTGIIRVIKSWFGNGRNHPPLFVVSVVIYLSPSMLSAILFLLPFLRRSLESSDFKLVRFIMWWSQQIEKHHHKGFNSLVVMVAWWIWKHRNACVFEGALPNVNALMQEIKGETILWCIAGAKGLRHIWP

SEQ ID NO: 15722 - DNA, 1227 bp, Sorghum bicolor
  misc_feature: Ceres ANNOT ID no. 8643431
  misc_feature: Encodes the peptide sequence at SEQ ID NO 15723
atggcggagcccgcggcgacgccgacgacggcggcggggaggaagacgcgggtgggcccgtacgaggtcggcaagaccatcggggagggcagcttcgcaaaggtgaagcacgcccgcgactcccgcaccggcgccgtccgcgccatcaaggtgctcgaccgcaaccacgtcctccgacacaagatggtcgagcagatcaaacgggagatttcgactatgaagctaatcaaacatcccaatgtggtccagctgcatgaggttatggcgagtagaacaaagatatatatggttcttgaatttgtggatggaggcgagttattcgataagatcgtcaattctggaaggctaggagaggatgaagctaggatatactttcatcaacttataaatgcggttgattattgccatagccgaggagtgtaccatagagatctgaagccagagaatctgcttctggactcacatggaactcttaaagtttcagacttcggcctaagtgcatttgcaccacaaacaaaagaggatggacttctgcatactgcctgtggaactccaaactatgtagcacctgaggttcttgctgataaaggttatgatggtatggctgcagacgtatggtcctgtggcataatcttatttgttcttatggctggatacttaccctttgatgacgccaatctgatgagactgtacaagctgatctgccaagcgcatgtttcttgcccaccatggttttcttctggagcgaagaagtttattaagcgcattctcgatcctaatcctgatacgaggataacaattgcagaaattttgaaagatgaatggttcaaaaaagactataaaccaccacgttttgaacaaggcgaagatgttagccttgacgatgtcgatgctgcattcaatgattcagaggaccgccttgtgtcagagaacagagaaaaaccagaatccatgaatgcatttgctcttatttcgagatcacagggcttcaaccttggaaatttgtttgagaaggagatgatgatgaaattgaaaggtgacaaatctggaagaaaaggtcacttatctgttgcaactgaggtttttgaggttgctccatcacttcacatggttgagcttcgtaaaaccggtggagacacattggagttccacaatttctacaagaacttctcaacagagctgaaagatatcgtgtggaaagctgaatctgacgcaactaagaaatag

SEQ ID NO: 15723 - protein, 408 aa, Sorghum bicolor
  misc_feature: Useful for making plants with modulated salt sensitivity
  misc_feature: Functional homolog of the protein sequence given in SEQ ID NO 14255
  misc_feature: Useful for making plants with modulated biomass
  misc_feature: Functional homolog of the protein sequence given in SEQ ID NO 14256
  misc_feature: Ceres ANNOT ID no. 8643431
  misc_feature (15)..(368): SWISSPROT Homolog: EC 2.7.11.1 Non-specific serine/threonine protein kinase
  misc_feature (21)..(276): Pfam ID: Pkinase Pfam Description: Protein kinase domain
  misc_feature (314)..(375): Pfam ID: NAF Pfam Description: NAF domain
MAEPAATPTTAAGRKTRVGPYEVGKTIGEGSFAKVKHARDSRTGAVRAIKVLDRNHVLRHKMVEQIKREISTMKLIKHPNVVQLHEVMASRTKIYMVLEFVDGGELFDKIVNSGRLGEDEARIYFHQLINAVDYCHSRGVYHRDLKPENLLLDSHGTLKVSDFGLSAFAPQTKEDGLLHTACGTPNYVAPEVLADKGYDGMAADVWSCGIILFVLMAGYLPFDDANLMRLYKLICQAHVSCPPWFSSGAKKFIKRILDPNPDTRITIAEILKDEWFKKDYKPPRFEQGEDVSLDDVDAAFNDSEDRLVSENREKPESMNAFALISRSQGFNLGNLFEKEMMMKLKGDKSGRKGHLSVATEVFEVAPSLHMVELRKTGGDTLEFHNFYKNFSTELKDIVWKAESDATKK

SEQ ID NO: 15724 - DNA, 1239 bp, Sorghum bicolor
  misc_feature: Ceres ANNOT ID no. 8643392
  misc_feature: Encodes the peptide sequence at SEQ ID NO 15725
atggccgcgccgccgcagccgctgcccgtgacacgcgccgccgccaatgtcggcggcggcggcgccgctcatgaccaccagcagcagggtcacggcggcgcgggtgcggaggttcggagggcggccaaggcgctgctgttcctggtggccctcgcgctcccgtgcctcgtgctgtaccaccgcgccgtcgtgacgccgggggacctgctcggcgccgctgccatgccgtggcggcgcgccgcactacgtgacgccgacgccgcggaggacctggacagcgaggacgcgaggctggagcgagtcctgacggcggccgcgatgcccaacgacacggtgatcctgacgacgctgaactcggcgtggtcggagccgggctccgtgctggacgtgttcctggagagcttccggtccggcgagagcaccagggagctgctggaccacctcgtcatcgtgtcgctggacacgacggcgcacgcgcgctgcaggcaggtgcaccgccactgcttcgcgctcgtcacggacggcgtcgacttctccgggcagaagaacttcatgaccgacggctacctcaagatgatgtggaggaggatcgatttcctcaggaaagttcttgagaaaggcttcagcttcgtgttcacggacacggacatcgtgtggttcaggaacccgctgccgcacttctacccggacggggacttgcagatcgcgtgcgaccacttcaccggcgacccgagcgacctgagcaacgcgcccaacggcggcttcgtgtacgtgcggtccaacacggagacgaccgagttctacaggttctggtacgcggcgagggagcgccacccggggctgcacgaccaggacgtgctcaacgccatcaagcgcgacccctacgtggccgagctcggcgtccagatcaggttcctcagcaccgagctcttcggcggcctctgcgagccgagccggaacatgagcagggtctgcaccatgcacgccaactgctgcatcgggctgcgacgcaagatcagcgacctcaacgccatgctccaggactggaggaggttcagggagctgccgcgcgacgacaaccactcggtttcctggaccgtgccgcgcaactgcagcttgtcaaatgttcagacttcgttcttcagaacatggatggatggatggatggatgatgtagtaagcaaaagatgtatgggaagtttatatgagttcatatacgttgttttgtactgtaggtag

SEQ ID NO: 15725 - protein, 412 aa, Sorghum bicolor
  misc_feature: Useful for making plants with modulated biomass
  misc_feature: Functional homolog of the protein sequence given in SEQ ID NO 13568
  misc_feature: Ceres ANNOT ID no. 8643392
MAAPPQPLPVTRAAANVGGGGAAHDHQQQGHGGAGAEVRRAAKALLFLVALALPCLVLYHRAVVTPGDLLGAAAMPWRRAALRDADAAEDLDSEDARLERVLTAAAMPNDTVILTTLNSAWSEPGSVLDVFLESFRSGESTRELLDHLVIVSLDTTAHARCRQVHRHCFALVTDGVDFSGQKNFMTDGYLKMMWRRIDFLRKVLEKGFSFVFTDTDIVWFRNPLPHFYPDGDLQIACDHFTGDPSDLSNAPNGGFVYVRSNTETTEFYRFWYAARERHPGLHDQDVLNAIKRDPYVAELGVQIRFLSTELFGGLCEPSRNMSRVCTMHANCCIGLRRKISDLNAMLQDWRRFRELPRDDNHSVSWTVPRNCSLSNVQTSFFRTWMDGWMDDVVSKRCMGSLYEFIYVVLYCR

SEQ ID NO: 15726 - DNA, 1107 bp, Sorghum bicolor
  misc_feature: Ceres ANNOT ID no. 8643427
  misc_feature: Encodes the peptide sequence at SEQ ID NO 15727
atggaatcatgcgtgcccccgggcttcaggttccaccccaccgacgaggagctcgtcggctactacctcaggaagaaggtggcctctcagaagatcgacctcgacgtcatacgcgacatcgatctctaccgcatcgagccatgggatcttcaagaacattgcgggatcgggtacgaggagcagaacgagtggtacttcttcagctacaaggaccgcaagtacccgacagggacacggaccaacagggccaccatggccgggttctggaaggcgacgggcagggacaaggcggtgcacgacaaaagccgcctcatcggcatgaggaagacgctcgtcttctacaagggaagggcgcccaacgggcagaagaccgactggatcatgcacgagtaccggctggagactgacgagaacgcgccaccacaggaagaaggctgggtggtgtgccgggcgttcaagaagagaacagcgtacccagcaaggagcatggcgatggcatgggaccccagctacgcctatcgcgaggtcagcgccatgggcgcggcggtggcagcggaggcggcggcgttcgtggaccccaatgcggcgtacgctcagatcaggcgccagtccaacaagagcgcgcgcttcaagcaggaggccgagctggacggcgctgctgccgcgttgctgcagtactcctccagccacctagtcgagctgccgcagctcgagagcccgtcggcgccgctcgcgccggccaaccagagccaggcgtcagccgctgatgaggtggtggtggacggcgccgacagcggtaggcggccgggcaagaaggcgcgggctgataagatggccacggactggagggcgctcgacaagttcgtcgcgtcacagctcagccccgccgcggagtgcggcggcagcttggaggcggccgcagcagcagcgtcgacggccgccgccggcaacgtgggctcacagctggaccacgttgaggatgatgacgacatggcggcattgctgttcctcaacagcgacgggagggaggaagcggagaggtggacggggctgctcggccccgccggcggggacggcgactttggactgtgtgtgttcgagaaatga

SEQ ID NO: 15727 - protein, 368 aa, Sorghum bicolor
  misc_feature: Useful for biocontainment applications
  misc_feature: Functional homolog of the protein sequence given in SEQ ID NO 13623
  misc_feature: The sequence is a functional homolog of SEQ ID NO 2416 in the 10/374,780 US patent application
  misc_feature: The sequence is a functional homolog of SEQ ID NO 914 in the 10/225,066 US patent application
  misc_feature: Useful for making plants with altered cell wall content and/or composition
  misc_feature: Useful for making plants with altered lignin content
  misc_feature: Useful for making plants with modulated biomass
  misc_feature: Functional homolog of the protein sequence given in SEQ ID NO 12949
  misc_feature: Useful for making plants with altered carbohydrate content
  misc_feature: Functional homolog of the protein sequence given in SEQ ID NO 13685
  misc_feature: The sequence is a functional homolog of SEQ ID NO 132 in the 10/225,066 US patent application
  misc_feature: The sequence is a functional homolog of SEQ ID NO 1508 in the 10/666,642 US patent application
  misc_feature: The sequence is a functional homolog of SEQ ID NO 1924 in the 10/412,699 US patent application
  misc_feature: The sequence is a functional homolog of SEQ ID NO 2186 in the 10/374,780 US patent application
  misc_feature: The sequence is a functional homolog of SEQ ID NO 564 in the 11/435,388 US patent application
  misc_feature: The sequence is a functional homolog of SEQ ID NO 2478 in the 10/374,780 US patent application
  misc_feature: The sequence is a functional homolog of SEQ ID NO 572 in the 10/225,066 US patent application
  misc_feature: The sequence is a functional homolog of SEQ ID NO 2346 in the 10/374,780 US patent application
  misc_feature: The sequence is a functional homolog of SEQ ID NO 238 in the 10/225,068 US patent application
  misc_feature: The sequence is a functional homolog of SEQ ID NO 338 in the 10/412,699 US patent application
  misc_feature: The sequence is a functional homolog of SEQ ID NO 774 in the 11/479,226 US patent application
  misc_feature: The sequence is a functional homolog of SEQ ID NO 316 in the 10/412,699 US patent application
  misc_feature: The sequence is a functional homolog of SEQ ID NO 738 in the 11/479,226 US patent application
  misc_feature: The sequence is a functional homolog of SEQ ID NO 1196 in the 10/412,699 US patent application
  misc_feature: The sequence is a functional homolog of SEQ ID NO 865 in the 10/374,780 US patent application
  misc_feature: The sequence is a functional homolog of SEQ ID NO 2470 in the 10/374,780 US patent application
  misc_feature: The sequence is a functional homolog of SEQ ID NO 798 in the 10/225,066 US patent application
  misc_feature: The sequence is a functional homolog of SEQ ID NO 476 in the 10/666,642 US patent application
  misc_feature: The sequence is a functional homolog of SEQ ID NO 2060 in the 10/374,780 US patent application
  misc_feature: The sequence is a functional homolog of SEQ ID NO 516 in the 10/412,699 US patent application
  misc_feature: Useful for making plants with modulated oxidative stress sensitivity
  misc_feature: Functional homolog of the protein sequence given in SEQ ID NO 13621
  misc_feature: The sequence is a functional homolog of SEQ ID NO 328 in the 10/374,780 US patent application
  misc_feature: The sequence is a functional homolog of SEQ ID NO 852 in the 10/225,066 US patent application
  misc_feature: The sequence is a functional homolog of SEQ ID NO 102 in the 10/374,780 US patent application
  misc_feature: The sequence is a functional homolog of SEQ ID NO 886 in the 10/225,066 US patent application
  misc_feature: The sequence is a functional homolog of SEQ ID NO 2012 in the 10/374,780 US patent application
  misc_feature: The sequence is a functional homolog of SEQ ID NO 312 in the 10/412,699 US patent application
  misc_feature: The sequence is a functional homolog of SEQ ID NO 731 in the 11/479,226 US patent application
  misc_feature: The sequence is a functional homolog of SEQ ID NO 26 in the 10/286,264 US patent application
  misc_feature: The sequence is a functional homolog of SEQ ID NO 336 in the 10/412,699 US patent application
  misc_feature: The sequence is a functional homolog of SEQ ID NO 770 in the 11/479,226 US patent application
  misc_feature: The sequence is a functional homolog of SEQ ID NO 100 in the 10/374,780 US patent application
  misc_feature: The sequence is a functional homolog of SEQ ID NO 318 in the 10/412,699 US patent application
  misc_feature: The sequence is a functional homolog of SEQ ID NO 749 in the 11/479,226 US patent application
  misc_feature: The sequence is a functional homolog of SEQ ID NO 884 in the 10/225,066 US patent application
  misc_feature: Useful for making plants with modulated nitrogen use efficiency
  misc_feature: Functional homolog of the protein sequence given in SEQ ID NO 13624
  misc_feature: Ceres ANNOT ID no. 8643427
  misc_feature (5)..(134): Pfam ID: NAM Pfam Description: No apical meristem (NAM) protein
MESCVPPGFRFHPTDEELVGYYLRKKVASQKIDLDVIRDIDLYRIEPWDLQEHCGIGYEEQNEWYFFSYKDRKYPTGTRTNRATMAGFWKATGRDKAVHDKSRLIGMRKTLVFYKGRAPNGQKTDWIMHEYRLETDENAPPQEEGWVVCRAFKKRTAYPARSMAMAWDPSYAYREVSAMGAAVAAEAAAFVDPNAAYAQIRRQSNKSARFKQEAELDGAAAALLQYSSSHLVELPQLESPSAPLAPANQSQASAADEVVVDGADSGRRPGKKARADKMATDWRALDKFVASQLSPAAECGGSLEAAAAAASTAAAGNVGSQLDHVEDDDDMAALLFLNSDGREEAERWTGLLGPAGGDGDFGLCVFEK

SEQ ID NO: 15728 - DNA, 3894 bp, Sorghum bicolor
  misc_feature: Ceres ANNOT ID no. 8643415
  misc_feature: Encodes the peptide sequence at SEQ ID NO 15729
atgttgtgtgtcttcgtgcagcctcgtctgtacaccatgttctggattgctcttctcttgataaagtttgcatttagctactatgtggagatcaaaccccttgttgaacccaccaaggttatcatgaagacccccatacgtactttccggtggcatgaatttttcccaagagaaaagagcaacattggtgttgttattgcactttgggccccaatcattctggtatatttcatggatacacaaatttggtatacaatcttctccactctgcttggtggaatttacggtgctttccaacgactcggagagattcgtacactggggatgctgcgatctcgctttgattcaataccgttagcctttaactcatgcctaattcctgttgaaacatctgatgcaaaaaggaagaaaggcctgaggtcttacttacacaatcgtttcaaagagatggaacatgcagacaaggagaatatagcagcaaggtttgcacaaatgtggaatgaaattgtcaccagctttcgagatgaagatcttatagacaatagggagaaggagctgctacttgttccttatgtgtctgatcaggcccttggtgtcgtgcaatggcctccatttttacttgccagcaagatcccgatagcagttgacatggctaaagatagcaatggcaaagaccgagatctgaaaaagaggcttgagaatgattattattttaagtgtgcaattgaggaatgttatgcatcatttaagaatatcatcaatgaccttgtacagggtgaaccagagaaaagggtcataaagaagatatttgaagaagttgaaaaatgcatatctgaggacaaagttattgcagatttgaacatgcgtgccctgccagatctctactccaagtttgttgagttggtaacctacttgaaggagaatgatgagaaagacaggagtgctgtaataaagatttttcaagatatgctggaggttgtaacaagagatatatttgacgaccaacttagtattttagagtcaagtcatggaggttcatatcaaaagcatgatgacacaaccgcatgggataaagagtatcagttgtttcaaccatctggagctatcaagtttcccctacaagtcacgaccacagatgcttggctagaaaagataaaacggctggaactactacttaccgtgaaggaatctgctatggatgttccttcaaatctagaagccagaaggcgtcttaccttttttaccaactccttatttatggatatgcctgatgcacccaaagtccgaaacatgctctcattttccgcattgaccccttattacaatgaacccgttcttttctctataaaagagcttgaagaagaaaatgaagatggagtttccaccctattctacctgcaaaaaatttatccagatgaatggaaaaactttaaggaaagggttggcttggaggaagaacttaaagagagcgaagaaagcgaagaattaaaggaggagcttcgtctatgggcctcatacagaggccaaacactagctcgaacagttagaggcatgatgtactacaagaaagctttgaatcttgaagcatttttagacatggccaaacgtgaagatctcatggaaggatacaaagcagctgagtcagtaaatgatgaacaatggaagatacagcagaggtccttatttgctcaatgcgaagcagtggctgatatgaagttcacctatgtggtttcatgccagcaatatggaaatgataagcgtgctgcacttgctaatgcccaagacatattgcagctaatgaggaactactcttctctccgtgtagcatatattgatgaggtggaagatagagtaggagacaagaaaatggagacagcttattattctactttggtaaaggttgctctcactaaggattctgaatctgcagaccccattcaaaatcttgatcaggttatctatcggataaaacttccaggccctgcaattttgggagaaggaaagcccgaaaaccaaaatcatgcaataattttcacccgtggtgaaggcttgcagaccatagatatgaaccaggacaactatttggaagaagctcttaaaatgagaaatctgctccaagagttccttacggagcatggagtgcggcgtccatctatacttggagttagagagcacatttttactggcagtgtatcttcccttgcatggttcatgtcaaatcaggagcacagttttgtgactattgggcagcgtctccttgcaaaccctctgaaggtccggttccactatgggcatcctgatgtatttgataggcttttccatctgacaaggggtggtgtcagtaaggcatcaaagagtatcaatttaagtgaagacatttttgcaggctataactcaactcttcgtggaggcaatgtaacacaccatgaatatgtgcaagttggtaagggaagagacgtcggactaaatcagatctctaagtttgaggctaaagtagcaaatggaaatggtgaacagactcttagtcgtgatatctaccggcttgggcaccgctttgattttttcaggatgctttcatgctacttcacaaccgtggggttttatttcagtacgctgttgacggttgtcacagtttatgtatttctgtatgggcgcctttatcttgctctcagtggacttgaagaggggctatcacagggaagattgattcataaccatcccctacaagttgctctggcctcacaatctcttgttcagcttggttttctgatggctcttccaatgatgatggaaattggtcttgaaagaggatttggtcaggcactaagtgatctaatcatgatgaacttgcaattggctactgtgtttttcacattttcccttggcactaagactcactactatgggagaatgttgcttcatggaggtgctcagtacagaggtactggtaggggatttgtcgtctttcatgcaaagtttgcagagaattatagactctactctcgcagccactttgttaaagggattgagctgatgattctgctcattgtataccaactattcggtcaatcttatcgctcaaccattgcctatatttttattacaatctctatgtggttcctggtattgacatggctatttgcaccctttctattcaacccctccggatttgagtgggcaaaaattgttgatgattggtctgattggaataagtggatcagcaatcgtggtgggattggtgtgtcaccagacaagagctgggaatcttggtgggaagtggagcaggatcatctaaaatattcaggaacaataggacgctttgttgagataatcttggccgtgcgttttttcatataccagtatggccttgtttaccacttacatatcacacacgacaaaagcatcttggtatatttaatgtcttggctcgtaattgtggcagttctgttcgttatgaagacagtgtcggtgggaaggcgaacattcagtgcagatttccagctattcttccgtctgatcaagtttttgatatttgttgctttcactgctattttgattgtcttgatagtatttcttcatatgaccttccgtgatatatttgtgtgctttctagcattcttgcccacaggatgggggatactgctgattgcacaagcttgcaagcctcttgctcgacatgtaggattatggggatctgttcgtgcccttgcacgggcctatgagataattatgggggtgcttctctttactccaatcactatattggcatggttcccctttgtgtccgagttccagacgcggatgctgtttaatcaagcgttcagtagaggactgcaaatttctcgaattcttggtggtcaaaagaaggaacggtctgctcgcagcaaagattga

SEQ ID NO: 15729 - protein, 1297 aa, Sorghum bicolor
  misc_feature: Useful for making plants with altered cell wall content and/or composition
  misc_feature: Functional homolog of the protein sequence given in SEQ ID NO 14254
  misc_feature: Useful for making plants with altered carbohydrate content
  misc_feature: Functional homolog of the protein sequence given in SEQ ID NO 14257
  misc_feature: Ceres ANNOT ID no. 8643415
  misc_feature (404)..(1077): SWISSPROT Homolog: EC 2.4.1.34 1,3-beta-glucan synthase
  misc_feature (401)..(1167): Pfam ID: Glucan_synthase Pfam Description: 1,3-beta-glucan synthase component
MLCVFVQPRLYTMFWIALLLIKFAFSYYVEIKPLVEPTKVIMKTPIRTFRWHEFFPREKSNIGVVIALWAPIILVYFMDTQIWYTIFSTLLGGIYGAFQRLGEIRTLGMLRSRFDSIPLAFNSCLIPVETSDAKRKKGLRSYLHNRFKEMEHADKENIAARFAQMWNEIVTSFRDEDLIDNREKELLLVPYVSDQALGVVQWPPFLLASKIPIAVDMAKDSNGKDRDLKKRLENDYYFKCAIEECYASFKNIINDLVQGEPEKRVIKKIFEEVEKCISEDKVIADLNMRALPDLYSKFVELVTYLKENDEKDRSAVIKIFQDMLEVVTRDIFDDQLSILESSHGGSYQKHDDTTAWDKEYQLFQPSGAIKFPLQVTTTDAWLEKIKRLELLLTVKESAMDVPSNLEARRRLTFFTNSLFMDMPDAPKVRNMLSFSALTPYYNEPVLFSIKELEEENEDGVSTLFYLQKIYPDEWKNFKERVGLEEELKESEESEELKEELRLWASYRGQTLARTVRGMMYYKKALNLEAFLDMAKREDLMEGYKAAESVNDEQWKIQQRSLFAQCEAVADMKFTYVVSCQQYGNDKRAALANAQDILQLMRNYSSLRVAYIDEVEDRVGDKKMETAYYSTLVKVALTKDSESADPIQNLDQVIYRIKLPGPAILGEGKPENQNHAIIFTRGEGLQTIDMNQDNYLEEALKMRNLLQEFLTEHGVRRPSILGVREHIFTGSVSSLAWFMSNQEHSFVTIGQRLLANPLKVRFHYGHPDVFDRLFHLTRGGVSKASKSINLSEDIFAGYNSTLRGGNVTHHEYVQVGKGRDVGLNQISKFEAKVANGNGEQTLSRDIYRLGHRFDFFRMLSCYFTTVGFYFSTLLTVVTVYVFLYGRLYLALSGLEEGLSQGRLIHNHPLQVALASQSLVQLGFLMALPMMMEIGLERGFGQALSDLIMMNLQLATVFFTFSLGTKTHYYGRMLLHGGAQYRGTGRGFVVFHAKFAENYRLYSRSHFVKGIELMILLIVYQLFGQSYRSTIAYIFITISMWFLVLTWLFAPFLFNPSGFEWAKIVDDWSDWNKWISNRGGIGVSPDKSWESWWEVEQDHLKYSGTIGRFVEIILAVRFFIYQYGLVYHLHITHDKSILVYLMSWLVIVAVLFVMKTVSVGRRTFSADFQLFFRLIKFLIFVAFTAILIVLIVFLHMTFRDIFVCFLAFLPTGWGILLIAQACKPLARHVGLWGSVRALARAYEIIMGVLLFTPITILAWFPFVSEFQTRMLFNQAFSRGLQISRILGGQKKERSARSKD

SEQ ID NO: 15730 - DNA, 2574 bp, Sorghum bicolor
  misc_feature: Ceres ANNOT ID no. 8643461
  misc_feature: Encodes the peptide sequence at SEQ ID NO 15731
atggctgtcctcgtcctcgtcctcgtcctcctcgccaccttcctcccgtccaccgccctggccgccttctccccggccttctccttcttcctcgcctgcggcgccggctccacagtcaccttcccacgcgacagcccagcgcgcaacttcaccccggacgacggttacctgaccaccaaaagcgtcccggcggtgacgaacgccaaccccaacagcgtcgcctccccgctctacgacgccgcgcgcgcgtccagctccgccttctcctacaggttccctgtccccgactccgccgggcagcaggccgcgttcttcgtcctccgcctccacttcttccctttctccccagcctcgccgtccaccgtcagcctctcctccgcgcgcttcgcggtctctgttcaggacgcgtacaccttgctgtcctccttctcgccgccgaacgccggcgtcgtcaaggagttcttcgtcccggcaggcggctccggcgacttcagcgtcaccttcacgccggcctccggctcggccgcgttcatcaacgccgtcgagctgttcccggccccagcggagctgctgtggaacggcagcgtgacgccggtgggcgtaggcgcggcggccctcaacatagccgcgtggcccaaggacgcgctggagacggtgtaccgcctcaacgtgggcggccccgaggtgaccaaggagaacgacaccctctggcggacgtggctccccgacgaccccttcctcttcggtcctgcggggagctccatgttgcagaacacgaccacccagatcgtctacgccacctacaccaaggagttggcgcccgacgtcgtctacaagacgcagcgcgccgcgaacgtgtcggcggccggagcaggggcggtacctccgcgtttcaacgtcacgtggaccttctcggcggaaccggggtccaactacctcgtccgtctccacttctgcgactacgagctgctgagctccgtcgtcgcagtcgtcagcgtgttcaacgtcttcgtcgcgcaatccatgggcacccaggacttcacgcccacacagttcgagacgcaggcgaacacggccttatacatggactacgcggccacggcgcccatctccgggaacctcaccgtcagcatcggcatgtccgccaagagcggcactggcgaagggggcttcctgaacgggctggagatcatgaaggtgcgaccttcggattcgagcttggcggcgggctcacatggtagcaggaataagagagttttgatcaccgctctgtcggccgtgctcggcgcctcggttctcgcgtccgccgcgctctgcttgttcttcgtcgtgcggagaaaaaggcggatggcgcgggcggcgccgttggagaaggagagcagcaagccgctgccgtggtcgcaggaaagctccgggtgggtgctggagccgtcgagccggtcgggcgagggcacgaccggggcgatgcagagggtgagcacgcagctccacatcccgctggaggagctgaggtcggccaccgacaacttccacgagcgcaacctcatcggcgtgggcggcttcggcaacgtgtaccgcggcgcgctccgcgacggcacccgcgtggcagtgaagcgcgcgacgcgcgcgtccaagcagggcctgccggagttccagacggagatcgtggtgctgtcccgcatccggcaccggcacctggtgtccctcatcggctactgcaacgagcaggcggagatgatcctggtgtacgagtacatggagaaaggcacgctgcggagccacctgtacggcccggactccgacggggcggcggcgccgctgtcgtggaagcagcggctggaggtgtgcatcggcgccgcgagggggctgcactacctgcacacgggctactccgagaacatcatccaccgcgacgtcaagtccaccaacatcctcctcggcgacgggttcatcgccaaggtggccgacttcgggctgtcgcggatcggcccgtcgttcggggagacgcacgtgagcacggcggtgaagggcagcttcgggtacctggacccggagtacttcaagacgcagcagctgacggaccgctccgacgtctactccttcggggtggtgctgttcgaggtgctgtgcgcgcggccggtgatcgaccaggcgctggagcgcgaccagatcaacctcgccgagtgggccgtcgggtggcagaggcgcgggcagctggaccggatcgccgacccgcggatcctcggtgaggtgaacgagaactcgctgcgcaagttcgcggagacggcggagcggtgcctggcggactacgggcaggagcggccgtccatggccgacgtgctgtggaacctcgagtactgcctgcagctgcaggagacgcacgtccgccgggacgcgttcgaggacagcggcgcagtgggcgcgcagttccccgaggacgtcgtcgtcccgcgctgggtgccctcgtcgacgagcttcatgacgacgggagatccggacgacacggccgtcacggacgtgggcgtcgtcaacagcaaggtgttctctcagctcagcagcggcgagggccgctga

SEQ ID NO: 15731 - protein, 857 aa, Sorghum bicolor
  misc_feature: Useful for making plants with altered carbohydrate content
  misc_feature: Functional homolog of the protein sequence given in SEQ ID NO 14258
  misc_feature: Useful for making plants with modulated biotic stress sensitivity
  misc_feature: Functional homolog of the protein sequence given in SEQ ID NO 14099
  misc_feature: Ceres ANNOT ID no. 8643461
  misc_feature (500)..(825): SWISSPROT Homolog: EC 2.7.11.1 Non-specific serine/threonine protein kinase
  misc_feature (510)..(784): Pfam ID: Pkinase_Tyr Pfam Description: Protein tyrosine kinase
MAVLVLVLVLLATFLPSTALAAFSPAFSFFLACGAGSTVTFPRDSPARNFTPDDGYLTTKSVPAVTNANPNSVASPLYDAARASSSAFSYRFPVPDSAGQQAAFFVLRLHFFPFSPASPSTVSLSSARFAVSVQDAYTLLSSFSPPNAGVVKEFFVPAGGSGDFSVTFTPASGSAAFINAVELFPAPAELLWNGSVTPVGVGAAALNIAAWPKDALETVYRLNVGGPEVTKENDTLWRTWLPDDPFLFGPAGSSMLQNTTTQIVYATYTKELAPDVVYKTQRAANVSAAGAGAVPPRFNVTWTFSAEPGSNYLVRLHFCDYELLSSVVAVVSVFNVFVAQSMGTQDFTPTQFETQANTALYMDYAATAPISGNLTVSIGMSAKSGTGEGGFLNGLEIMKVRPSDSSLAAGSHGSRNKRVLITALSAVLGASVLASAALCLFFVVRRKRRMARAAPLEKESSKPLPWSQESSGWVLEPSSRSGEGTTGAMQRVSTQLHIPLEELRSATDNFHERNLIGVGGFGNVYRGALRDGTRVAVKRATRASKQGLPEFQTEIVVLSRIRHRHLVSLIGYCNEQAEMILVYEYMEKGTLRSHLYGPDSDGAAAPLSWKQRLEVCIGAARGLHYLHTGYSENIIHRDVKSTNILLGDGFIAKVADFGLSRIGPSFGETHVSTAVKGSFGYLDPEYFKTQQLTDRSDVYSFGVVLFEVLCARPVIDQALERDQINLAEWAVGWQRRGQLDRIADPRILGEVNENSLRKFAETAERCLADYGQERPSMADVLWNLEYCLQLQETHVRRDAFEDSGAVGAQFPEDVVVPRWVPSSTSFMTTGDPDDTAVTDVGVVNSKVFSQLSSGEGR

SEQ ID NO: 15732 - DNA, 1575 bp, Sorghum bicolor
  misc_feature: Ceres ANNOT ID no. 8643462
  misc_feature: Encodes the peptide sequence at SEQ ID NO 15733
atgaaaggaggaggcgccattgtcatgcacgccgccgccggcaagcaggtgcccaagtccaagacctccttcttcctctacatcctcctcctctacgtactcctgcccgtgctggtgctctacgtcgtcgcgctcgccgtgtccccgttctactcccacccgtgcccgcaggacggcggtgccggtgccgatggcaagtggcataatggtagctcgtcgcggcttccgccgcccaaggcgcggtcgaaactgaagccgaagccttccgcggacgacgacgatgccgcacccaccgggctgcgtcacattgtgttcggcatcggcgcatcgtcgtcgctctggaaaagccggaaggagtacatccgggtgtggtggcagccggggaagatgcgcggcttcgtgtggctggacaagccggtgccggatctgtacaccaggaacccctcctcggatctccccggcatcaagatcagcggcaacacgtccaggttcccctacacgcacggcgccggcagccggtcggcgctgcggatcacgcgcatcgtctcggagagcttccggctgggcctcccgggcgcgcggtggttcgtgatgggcgacgacgacacggtgttcttcccggacaacctggcggacgtgctgtcccggtacgaccacacgcagccgtactacatcgggaacccgtcggagagccacatccagaacctcatcttctcgtacggcatggcgttcggcggcggcgggttcgccatcagccgcgcgctggcggcgcagctggcgcgcatgcaggacggctgcatcgagcggtaccccgcgctgtacggcagcgacgaccgtatccacgcgtgcatgtcggagctgggggtgccgctgacgcgccacctgggcttccaccagtgcgacctgtggggcgacgtgctgggactcctgggcgcgcacccggtgacgccgcttgtgtcgctgcaccacttcgacttcctgcagccggtgttcccgacggtgcggtcgcggacgcaagcgctgcggcggctgttcgcggggcccgtggcgctggacccggcggccgtggcgcagcagtcggtgtgctacgacgccggcaaggagtggacggtgtccgtgtcgtgggggttcgcggtgatggtgctccgcggggtgctgtcgccgcgggagatggagacgccgatgcggacgttcctcaactggtaccgccgcgccgactacacggcgtacgcgttcaacacgcggcccgtggcgcggcacccgtgccagaggccgcaggtgtactacatgcggcaggcgcggctggaacgccgccggcgcaaacgcaacgccaccaccacggtgaccgagtacgagcggcaccgggtgccgcccacgccgtgccggtggcgcatcccggaccccgccgcgctgctggaccgcgtcgtcgtgcgcaagaagcccgaccccgatctctggaaacggtccccgaggaggaattgctgccgggtggtgtcgtcgccgacggtggggaaagaccggaggatgaccatcgacgtcggcgtctgcagagacggcgagttcgccagggtttag

SEQ ID NO: 15733 - protein, 524 aa, Sorghum bicolor
  misc_feature: Useful for making plants with altered carbohydrate content
  misc_feature: Functional homolog of the protein sequence given in SEQ ID NO 14169
  misc_feature: Ceres ANNOT ID no. 8643462
  misc_feature (70)..(298): SWISSPROT Homolog: EC 2.4.1.222 O-fucosylpeptide 3-beta-N-acetylglucosaminyltransferase
MKGGGAIVMHAAAGKQVPKSKTSFFLYILLLYVLLPVLVLYVVALAVSPFYSHPCPQDGGAGADGKWHNGSSSRLPPPKARSKLKPKPSADDDDAAPTGLRHIVFGIGASSSLWKSRKEYIRVWWQPGKMRGFVWLDKPVPDLYTRNPSSDLPGIKISGNTSRFPYTHGAGSRSALRITRIVSESFRLGLPGARWFVMGDDDTVFFPDNLADVLSRYDHTQPYYIGNPSESHIQNLIFSYGMAFGGGGFAISRALAAQLARMQDGCIERYPALYGSDDRIHACMSELGVPLTRHLGFHQCDLWGDVLGLLGAHPVTPLVSLHHFDFLQPVFPTVRSRTQALRRLFAGPVALDPAAVAQQSVCYDAGKEWTVSVSWGFAVMVLRGVLSPREMETPMRTFLNWYRRADYTAYAFNTRPVARHPCQRPQVYYMRQARLERRRRKRNATTTVTEYERHRVPPTPCRWRIPDPAALLDRVVVRKKPDPDLWKRSPRRNCCRVVSSPTVGKDRRMTIDVGVCRDGEFARV

SEQ ID NO: 15734 - DNA, 1392 bp, Sorghum bicolor
  misc_feature: Ceres ANNOT ID no. 8643454
  misc_feature: Encodes the peptide sequence at SEQ ID NO 15735
atgacaccgggaagatctcttcgccctgcggtggcggcggttctgtgggcggcgtcgctggtgctgctgctggcggcggcgtgcgcgggcggcggcggcgcgtccgggggcccagggtgccggaagcacgtggcgaaggtcacggagtacggcgcggtgggggacgggaggacgctcaacacgggggcgttcgccaaggcggtggcggacctgtcgcatcgcgcgcgcgacggcggcgcggcgctggtggtgccgccggggaagtggctcacggggcccttcaatctcaccagctgcttcacgctctacctcgacgagggcgccgagatcctagcgtcccaggacatgaaccattggcccctcatagctcccttgccatcttacgggagaggaagggacgagcctggcccaaggtacatcaatttcattggaggatccaatctcactgacgtcatcatcacaggtaaaaatggaacaatcaacgggcaggggcaagtctggtgggacaagttccatgccaaggagctcaagtccacccgtggccacctcctagagctcctccactctgataacatcatcatctccaatgtcaccttcgttgacgcgccatactggaatctccaccctacctattgcaccaatgtgaccatcagcggcgtcaccattcttgcaccgttgaattcgcctaacaccgatggaattgacccagactcttccacgcatgtgaagatcgaggactgctacatcgtctccggcgacgactgcgtcgccgtgaagagcgggtgggacgaatacggcatcaagttcaacatgccgagccagcacatcgtcatccggaggctcacctgcatctcccccacgagcgccatgatcgcgctgggcagcgagatgtccggcggcatccgtgacgtgcgcgccgaggacaacatcgccatcaacacggagtcggccgtcaggatcaagtccggcgcggggaggggcggcttcgtcaaggacatcttcgtgcgcggcctcagcctccacaccatgaagtgggtgttctggatgaccggcaactacgggcagcaccccgacaacacgtccaaccccaacgccatgcccgaggtcaccggcatcaactacagcgatgtgttcgccgagaacgtgaccacggccggcaggatggagggcatccccaacgacccatacaccggcatctgcatatccaacgtgaccgccagcctcgcgccgaacgccacggagctgcagtggaactgtaccaacgtcaagggggtcacctccaacgtctcgcccaagccatgcccggagctcggcgcggagggcaagccgtgcgccttcccagtggaagagctcgtcatcggcccaccggcgctgccaaagtgtagctactga

SEQ ID NO: 15735 - protein, 463 aa, Sorghum bicolor
  misc_feature: Useful for making plants with altered carbohydrate content
  misc_feature: Functional homolog of the protein sequence given in SEQ ID NO 14259
  misc_feature: Useful for making plants with altered cell wall content and/or composition
  misc_feature: Functional homolog of the protein sequence given in SEQ ID NO 14260
  misc_feature: Ceres ANNOT ID no. 8643454
  misc_feature (177)..(412): SWISSPROT Homolog: EC 3.2.1.15 Polygalacturonase
  misc_feature (44)..(195): SWISSPROT Homolog: EC 3.2.1.82 Exo-poly-alpha-galacturonosidase
  misc_feature (77)..(434): Pfam ID: Glyco_hydro_28 Pfam Description: Glycosyl hydrolases family 28
MTPGRSLRPAVAAVLWAASLVLLLAAACAGGGGASGGPGCRKHVAKVTEYGAVGDGRTLNTGAFAKAVADLSHRARDGGAALVVPPGKWLTGPFNLTSCFTLYLDEGAEILASQDMNHWPLIAPLPSYGRGRDEPGPRYINFIGGSNLTDVIITGKNGTINGQGQVWWDKFHAKELKSTRGHLLELLHSDNIIISNVTFVDAPYWNLHPTYCTNVTISGVTILAPLNSPNTDGIDPDSSTHVKIEDCYIVSGDDCVAVKSGWDEYGIKFNMPSQHIVIRRLTCISPTSAMIALGSEMSGGIRDVRAEDNIAINTESAVRIKSGAGRGGFVKDIFVRGLSLHTMKWVFWMTGNYGQHPDNTSNPNAMPEVTGINYSDVFAENVTTAGRMEGIPNDPYTGICISNVTASLAPNATELQWNCTNVKGVTSNVSPKPCPELGAEGKPCAFPVEELVIGPPALPKCSY

SEQ ID NO: 15736 - DNA, 246 bp, Sorghum bicolor
  misc_feature: Ceres ANNOT ID no. 8643481
  misc_feature: Encodes the peptide sequence at SEQ ID NO 15737
atggtgcggggcaagacgcagatgaagcggatagagaacgcgaccagccgccaggtcaccttctccaagcgccgcaacggcctgctcaagaaggcgttcgagctctccgtcctctgcgacgccgaggtcgcgctcgtcgtcttctctccgcgcggcaagctcttcgaattcgccagcggcagctatcctttttcggtttgggggcaatccattgtcttccgtgtctgcgggttcggtgattggtaa

SEQ ID NO: 15737 - protein, 81 aa, Sorghum bicolor
  misc_feature: The sequence is a functional homolog of SEQ ID NO 1364 in the 10/666,642 US patent application
  misc_feature: The sequence is a functional homolog of SEQ ID NO 1728 in the 10/412,699 US patent application
  misc_feature: Useful for making plants with modulated flowering time
  misc_feature: Functional homolog of the protein sequence given in SEQ ID NO 13660
  misc_feature: The sequence is a functional homolog of SEQ ID NO 1368 in the 10/666,642 US patent application
  misc_feature: The sequence is a functional homolog of SEQ ID NO 422 in the 11/435,388 US patent application
  misc_feature: The sequence is a functional homolog of SEQ ID NO 122 in the 10/666,642 US patent application
  misc_feature: The sequence is a functional homolog of SEQ ID NO 406 in the 10/412,699 US patent application
  misc_feature: The sequence is a functional homolog of SEQ ID NO 164 in the 10/666,642 US patent application
  misc_feature: The sequence is a functional homolog of SEQ ID NO 642 in the 11/435,388 US patent application
  misc_feature: The sequence is a functional homolog of SEQ ID NO 919 in the 10/666,642 US patent application
  misc_feature: Useful for biocontainment applications
  misc_feature: Functional homolog of the protein sequence given in SEQ ID NO 14236
  misc_feature: The sequence is a functional homolog of SEQ ID NO 1362 in the 10/666,642 US patent application
  misc_feature: The sequence is a functional homolog of SEQ ID NO 199 in the 11/479,226 US patent application
  misc_feature: The sequence is a functional homolog of SEQ ID NO 34 in the 10/666,642 US patent application
  misc_feature: The sequence is a functional homolog of SEQ ID NO 58 in the 10/412,699 US patent application
  misc_feature: The sequence is a functional homolog of SEQ ID NO 731 in the 10/666,642 US patent application
  misc_feature: Useful for making plants with altered alkaloid content
  misc_feature: Useful for making plants with altered lignin content
  misc_feature: Useful for making plants with modulated biomass
  misc_feature: Functional homolog of the protein sequence given in SEQ ID NO 13528
  misc_feature: Useful for making plants with altered terpenoid content
  misc_feature: Functional homolog of the protein sequence given in SEQ ID NO 13438
  misc_feature: The sequence is a functional homolog of SEQ ID NO 32 in the 10/666,642 US patent application
  misc_feature: The sequence is a functional homolog of SEQ ID NO 707 in the 10/666,642 US patent application
  misc_feature: The sequence is a functional homolog of SEQ ID NO 36 in the 10/666,642 US patent application
  misc_feature: The sequence is a functional homolog of SEQ ID NO 60 in the 10/412,699 US patent application
  misc_feature: The sequence is a functional homolog of SEQ ID NO 4 in US patent 7057087
  misc_feature: The sequence is a functional homolog of SEQ ID NO 14 in the 10/666,642 US patent application
  misc_feature: The sequence is a functional homolog of SEQ ID NO 30 in the 10/666,642 US patent application
  misc_feature: The sequence is a functional homolog of SEQ ID NO 28 in the 10/666,642 US patent application
  misc_feature: The sequence is a functional homolog of SEQ ID NO 428 in the 10/666,642 US patent application
  misc_feature: The sequence is a functional homolog of SEQ ID NO 892 in the 11/435,388 US patent application
  misc_feature: The sequence is a functional homolog of SEQ ID NO 42 in the 10/666,642 US patent application
  misc_feature: The sequence is a functional homolog of SEQ ID NO 46 in the 10/666,642 US patent application
  misc_feature: The sequence is a functional homolog of SEQ ID NO 6 in US patent 7279615
  misc_feature: The sequence is a functional homolog of SEQ ID NO 1468 in the 10/666,642 US patent application
  misc_feature: The sequence is a functional homolog of SEQ ID NO 282 in the 10/666,642 US patent application
  misc_feature: The sequence is a functional homolog of SEQ ID NO 730 in the 10/666,642 US patent application
  misc_feature: Useful for making plants with modulated phosphate use efficiency
  misc_feature: Functional homolog of the protein sequence given in SEQ ID NO 13166
  misc_feature: The sequence is a functional homolog of SEQ ID NO 2 in US patent 7273968
  misc_feature: The sequence is a functional homolog of SEQ ID NO 2232 in the 10/374,780 US patent application
  misc_feature: The sequence is a functional homolog of SEQ ID NO 232 in the 10/225,068 US patent application
  misc_feature: The sequence is a functional homolog of SEQ ID NO 310 in the 10/225,066 US patent application
  misc_feature: The sequence is a functional homolog of SEQ ID NO 2191 in the 10/666,642 US patent application
  misc_feature: The sequence is a functional homolog of SEQ ID NO 2064 in the 10/374,780 US patent application
  misc_feature: The sequence is a functional homolog of SEQ ID NO 572 in the 10/412,699 US patent application
  misc_feature: The sequence is a functional homolog of SEQ ID NO 816 in the 10/225,066 US patent application
  misc_feature: The sequence is a functional homolog of SEQ ID NO 1360 in the 10/666,642 US patent application
  misc_feature: The sequence is a functional homolog of SEQ ID NO 22 in the 10/666,642 US patent application
  misc_feature: The sequence is a functional homolog of SEQ ID NO 2193 in the 10/666,642 US patent application
  misc_feature: The sequence is a functional homolog of SEQ ID NO 203 in the 11/479,226 US patent application
  misc_feature: The sequence is a functional homolog of SEQ ID NO 40 in the 10/666,642 US patent application
  misc_feature: The sequence is a functional homolog of SEQ ID NO 1243 in the 11/479,226 US patent application
  misc_feature: The sequence is a functional homolog of SEQ ID NO 1420 in the 10/666,642 US patent application
  misc_feature: The sequence is a functional homolog of SEQ ID NO 1814 in the 10/412,699 US patent application
  misc_feature: The sequence is a functional homolog of SEQ ID NO 570 in the 10/412,699 US patent application
  misc_feature: The sequence is a functional homolog of SEQ ID NO 1470 in the 10/666,642 US patent application
  misc_feature: The sequence is a functional homolog of SEQ ID NO 284 in the 10/666,642 US patent application
  misc_feature: The sequence is a functional homolog of SEQ ID NO 1732 in the 10/412,699 US patent application
  misc_feature: The sequence is a functional homolog of SEQ ID NO 44 in the 10/666,642 US patent application
  misc_feature: The sequence is a functional homolog of SEQ ID NO 66 in the 10/412,699 US patent application
  misc_feature: The sequence is a functional homolog of SEQ ID NO 729 in the 10/666,642 US patent application
  misc_feature: The sequence is a functional homolog of SEQ ID NO 1701 in the 10/412,699 US patent application
  misc_feature: The sequence is a functional homolog of SEQ ID NO 2197 in the 10/666,642 US patent application
  misc_feature: The sequence is a functional homolog of SEQ ID NO 1454 in the 10/374,780 US patent application
  misc_feature: The sequence is a functional homolog of SEQ ID NO 2195 in the 10/666,642 US patent application
  misc_feature: The sequence is a functional homolog of SEQ ID NO 2189 in the 10/666,642 US patent application
  misc_feature: The sequence is a functional homolog of SEQ ID NO 2199 in the 10/666,642 US patent application
  misc_feature: The sequence is a functional homolog of SEQ ID NO 1460 in the 10/666,642 US patent application
  misc_feature: The sequence is a functional homolog of SEQ ID NO 938 in the 10/412,699 US patent application
  misc_feature: The sequence is a functional homolog of SEQ ID NO 122 in the 10/225,066 US patent application
  misc_feature: The sequence is a functional homolog of SEQ ID NO 234 in the 10/374,780 US patent application
  misc_feature: The sequence is a functional homolog of SEQ ID NO 1453 in the 10/374,780 US patent application
  misc_feature: The sequence is a functional homolog of SEQ ID NO 1971 in the 10/412,699 US patent application
  misc_feature: The sequence is a functional homolog of SEQ ID NO 14 in the 10/374,780 US patent application
  misc_feature: The sequence is a functional homolog of SEQ ID NO 328 in the 10/225,066 US patent application
  misc_feature: The sequence is a functional homolog of SEQ ID NO 34 in the 10/286,264 US patent application
  misc_feature: The sequence is a functional homolog of SEQ ID NO 468 in the 11/435,388 US patent application
  misc_feature: The sequence is a functional homolog of SEQ ID NO 68 in the 10/412,699 US patent application
  misc_feature: The sequence is a functional homolog of SEQ ID NO 1702 in the 10/412,699 US patent application
  misc_feature: The sequence is a functional homolog of SEQ ID NO 715 in the 10/666,642 US patent application
  misc_feature: The sequence is a functional homolog of SEQ ID NO 1366 in the 10/666,642 US patent application
  misc_feature: The sequence is a functional homolog of SEQ ID NO 1730 in the 10/412,699 US patent application
  misc_feature: The sequence is a functional homolog of SEQ ID NO 207 in the 11/479,226 US patent application
  misc_feature: The sequence is a functional homolog of SEQ ID NO 64 in the 10/412,699 US patent application
  misc_feature: Useful for making plants with modulated nitrogen use efficiency
  misc_feature: Functional homolog of the protein sequence given in SEQ ID NO 12982
  misc_feature: The sequence is a functional homolog of SEQ ID NO 2 in US patent 7049489
  misc_feature: The sequence is a functional homolog of SEQ ID NO 1973 in the 10/412,699 US patent application
  misc_feature: The sequence is a functional homolog of SEQ ID NO 1965 in the 10/412,699 US patent application
  misc_feature: The sequence is a functional homolog of SEQ ID NO 1961 in the 10/412,699 US patent application
  misc_feature: The sequence is a functional homolog of SEQ ID NO 1884 in the 10/412,699 US patent application
  misc_feature: The sequence is a functional homolog of SEQ ID NO 352 in the 10/374,780 US patent application
  misc_feature: The sequence is a functional homolog of SEQ ID NO 384 in the 10/225,066 US patent application
  misc_feature: The sequence is a functional homolog of SEQ ID NO 946 in the 10/412,699 US patent application
  misc_feature: The sequence is a functional homolog of SEQ ID NO 1963 in the 10/412,699 US patent application
  misc_feature: The sequence is a functional homolog of SEQ ID NO 4 in US patent 7303918
  misc_feature: The sequence is a functional homolog of SEQ ID NO 1949 in the 10/412,699 US patent application
  misc_feature: The sequence is a functional homolog of SEQ ID NO 1110 in the 10/225,066 US patent application
  misc_feature: The sequence is a functional homolog of SEQ ID NO 166 in the 10/374,780 US patent application
  misc_feature: The sequence is a functional homolog of SEQ ID NO 1812 in the 10/412,699 US patent application
  misc_feature: The sequence is a functional homolog of SEQ ID NO 568 in the 10/412,699 US patent application
  misc_feature: The sequence is a functional homolog of SEQ ID NO 1945 in the 10/412,699 US patent application
  misc_feature: The sequence is a functional homolog of SEQ ID NO 1947 in the 10/412,699 US patent application
  misc_feature: The sequence is a functional homolog of SEQ ID NO 1967 in the 10/412,699 US patent application
  misc_feature: The sequence is a functional homolog of SEQ ID NO 1951 in the 10/412,699 US patent application
  misc_feature: The sequence is a functional homolog of SEQ ID NO 1056 in the 10/225,066 US patent application
  misc_feature: The sequence is a functional homolog of SEQ ID NO 1882 in the 10/412,699 US patent application
  misc_feature: The sequence is a functional homolog of SEQ ID NO 350 in the 10/374,780 US patent application
  misc_feature: The sequence is a functional homolog of SEQ ID NO 944 in the 10/412,699 US patent application
  misc_feature: The sequence is a functional homolog of SEQ ID NO 1957 in the 10/412,699 US patent application
  misc_feature: The sequence is a functional homolog of SEQ ID NO 1959 in the 10/412,699 US patent application
  misc_feature: The sequence is a functional homolog of SEQ ID NO 1955 in the 10/412,699 US patent application
  misc_feature: The sequence is a functional homolog of SEQ ID NO 1953 in the 10/412,699 US patent application
  misc_feature: The sequence is a functional homolog of SEQ ID NO 1886 in the 10/412,699 US patent application
  misc_feature: The sequence is a functional homolog of SEQ ID NO 2146 in the 10/374,780 US patent application
  misc_feature: The sequence is a functional homolog of SEQ ID NO 948 in the 10/412,699 US patent application
  misc_feature: The sequence is a functional homolog of SEQ ID NO 1969 in the 10/412,699 US patent application
  misc_feature: The sequence is a functional homolog of SEQ ID NO 216 in the 10/225,066 US patent application
  misc_feature: The sequence is a functional homolog of SEQ ID NO 2454 in the 10/374,780 US patent application
  misc_feature: Useful for making plants with altered tocopherol content
  misc_feature: Functional homolog of the protein sequence given in SEQ ID NO 14261
  misc_feature: The sequence is a functional homolog of SEQ ID NO 215 in the 11/479,226 US patent application
  misc_feature: The sequence is a functional homolog of SEQ ID NO 470 in the 11/435,388 US patent application
  misc_feature: The sequence is a functional homolog of SEQ ID NO 2238 in the 10/374,780 US patent application
  misc_feature: The sequence is a functional homolog of SEQ ID NO 656 in the 10/225,066 US patent application
  misc_feature: The sequence is a functional homolog of SEQ ID NO 2822 in the 10/374,780 US patent application
  misc_feature: The sequence is a functional homolog of SEQ ID NO 82 in the 11/375,241 US patent application
  misc_feature: Ceres ANNOT ID no. 8643481
  misc_feature (9)..(59): Pfam ID: SRF-TF Pfam Description: SRF-type transcription factor (DNA-binding and dimerisation domain)
MVRGKTQMKRIENATSRQVTFSKRRNGLLKKAFELSVLCDAEVALVVFSPRGKLFEFASGSYPFSVWGQSIVFRVCGFGDW

SEQ ID NO: 15738 - DNA, 1002 bp, Sorghum bicolor
  misc_feature: Ceres ANNOT ID no. 8643499
  misc_feature: Encodes the peptide sequence at SEQ ID NO 15739
atggggggacgacgcagtagaggaggaggcgcgtcgggcctgctagtgtgggcggtggcgattgcggcggcggcggcggcggcggtgtcgcgggcgcagctgcaggtggggttctacgacacgctgtgcccggcggcggagatcatcgtgcaggaggaggtcagcaaggcggcgtccggcaaccccggcgtcgccgcgggcctcctccgcctccacttccacgactgcttcgtcagggggtgcgacgggtcggtcctgctggactcgacggcgggcaaccaggcggagaaggacgcggcgccgaacgcgagcctgcgcgggttcgaggtgatcgacagcgccaagacgcggctggagcaggcctgcttcggcgtcgtctcctgcgccgacatcctcgccttcgccgcccgcgacgccctcgcgctggtcgggggcaacgcgtaccaggtgccggctggtcggagggacggcaacgtctcgtcggcgcaggaggcgggcgcgaacctgccgccgccgacggcgagcgtgagccggctgaaccaggtgttcggcgccaaggggctgacccaggcggacatggtggcgctgtcgggcgcgcacacggtgggcgccgcgcgctgcagctccttcaacggccggctctactcgtacggtcccagcggcgccgggcaggacccgtccatggaccccgcgtacctggcggcgctcacgcagcagtgcccgcaggtgcaggggagcgacccggcggtgcccatggaccccgtcacgcccaccaccttcgacaccaactactacgccaacctggtcgccaagcgcggcctgctcgcctccgaccaggcgctgctcgccgacccgaccaccgccgcgcaggtggtcggatacaccaacagccccgccacgttccagaccgacttcgtcgccgccatgctcaagatgggcaacatcgaggtgctcaccggcaccgccggcaccatccggaccaactgcagggtggctagctag

SEQ ID NO: 15739 - protein, 333 aa, Sorghum bicolor
  misc_feature: Useful for making plants with altered carbohydrate content
  misc_feature: Functional homolog of the protein sequence given in SEQ ID NO 13714
  misc_feature: Useful for making plants with altered cell wall content and/or composition
  misc_feature: Functional homolog of the protein sequence given in SEQ ID NO 14262
  misc_feature: Useful for making plants with modulated oxidative stress sensitivity
  misc_feature: Functional homolog of the protein sequence given in SEQ ID NO 13607
  misc_feature: Ceres ANNOT ID no. 8643499
  misc_feature (31)..(333): SWISSPROT Homolog: EC 1.11.1.7 Peroxidase
  misc_feature (50)..(297): Pfam ID: peroxidase Pfam Description: Peroxidase
MGGRRSRGGGASGLLVWAVAIAAAAAAAVSRAQLQVGFYDTLCPAAEIIVQEEVSKAASGNPGVAAGLLRLHFHDCFVRGCDGSVLLDSTAGNQAEKDAAPNASLRGFEVIDSAKTRLEQACFGVVSCADILAFAARDALALVGGNAYQVPAGRRDGNVSSAQEAGANLPPPTASVSRLNQVFGAKGLTQADMVALSGAHTVGAARCSSFNGRLYSYGPSGAGQDPSMDPAYLAALTQQCPQVQGSDPAVPMDPVTPTTFDTNYYANLVAKRGLLASDQALLADPTTAAQVVGYTNSPATFQTDFVAAMLKMGNIEVLTGTAGTIRTNCRVAS

SEQ ID NO: 15740 - DNA, 978 bp, Sorghum bicolor
  misc_feature: Ceres ANNOT ID no. 8643492
  misc_feature: Encodes the peptide sequence at SEQ ID NO 15741
atgcagctgcagctgcaagggcccatcgcctcttcgctgtgggcggacaagcagcagcaggcggccagcaccagcgccgcggtggcggcggcgcagatgcccttcctggcgttgctccagggcgcgggcgtcgtcatggaggcggaggagcagcagcagcatgacgggcgcaagcggcaggccttcgcgcgcgccgtctccgacctcgacctgctcgagagctgcgtcacgcaggcggcggtggctcctgctgcggcgtctgcgcccgtggccagcaggaccgagaggcggaggaagcggccgagaccccgcgcgcgggccgcgccgccgccggagaagcgcaggaagcccgaggaggccgagagccagcggatgacgcacatcgccgtggagcgcaaccggcggcgcctcatgaacgaccacctcgcctcgctccgctccctcatcccctccagctacatcccccgcggcgaccaggcgacagtggtgggtggcgcgatcgactacgtgaagcaactggagcagcagctggtggcattgcaggcggccgcggccgcgcgtcgcgacggtaccggcgccggcgccgcggtggccacggccgcgtcggacggcgtgttcgtgtccccgcagtacgcgagctactcggactcgtcgcgcggcggcctcggcgccggcgtggacgtggaggccacggccgcggtgggcgggcacgtgcgcgtgcgcgtcgcggggaggcggtggcccggacggctcgtgcgcgccgtcgccgcgctcgaggacctccgcctcgcggtcttgcacctcgccgtcacctccgtcggacatgacgccgtcgtgtactgcttcaacctcaaggtcagcgacaagtgtcacgacgattttacttcctgtcatggtcatccatgtccacgcacttccattgcttgcgttacgttcccttactcgtccgtccctacgttcccccaatcatgcgtttga

SEQ ID NO: 15741 - protein, 325 aa, Sorghum bicolor
  misc_feature: The sequence is a functional homolog of SEQ ID NO 1501 in the 10/374,780 US patent application
  misc_feature: Ceres ANNOT ID no. 8643492
  misc_feature (123)..(174): Pfam ID: HLH Pfam Description: Helix-loop-helix DNA-binding domain
MQLQLQGPIASSLWADKQQQAASTSAAVAAAQMPFLALLQGAGVVMEAEEQQQHDGRKRQAFARAVSDLDLLESCVTQAAVAPAAASAPVASRTERRRKRPRPRARAAPPPEKRRKPEEAESQRMTHIAVERNRRRLMNDHLASLRSLIPSSYIPRGDQATVVGGAIDYVKQLEQQLVALQAAAAARRDGTGAGAAVATAASDGVFVSPQYASYSDSSRGGLGAGVDVEATAAVGGHVRVRVAGRRWPGRLVRAVAALEDLRLAVLHLAVTSVGHDAVVYCFNLKVSDKCHDDFTSCHGHPCPRTSIACVTFPYSSVPTFPQSCV

SEQ ID NO: 15742 - DNA, 1875 bp, Sorghum bicolor
  misc_feature: Ceres ANNOT ID no. 8643511
  misc_feature: Encodes the peptide sequence at SEQ ID NO 15743
atgggggcatgcaaggactgggggcggaatcagatgaacggctcgcgggttcggagcggcgaggtgggttgggtcatcggggggggggggcttaccggggagggccttcgattgtccggacggggaagcgggaggaggatgaggaggagaggttcggggggggaaatggtggaggagagcacagagagcgacggcgagagaccccgacgaaacgtcgtgaggacgaagagagggaggtggggcgcgtggcatccgatgcgatgcgtgggccaggcccggctctgcggattggccaaatgggctattcttttcgcggattgggctgcctgcaaatgctggcccactgaggaggaaagccgcaaacgagaagaggcccaatggattgcagactgcaatttgcagtggcagtgggacttggcattcagccagcctgtgcagcaaatgcagagaaggaaggtctcctcggattctgctcccaccaccatcaaaatctccaaattcccaagcaccagtagggtttggaagggttccccggccggggtcgtcgtgaagccatggccgacggtagcatcaagatcaatctcgccgtggacagggcgcggaaccgcgtcctgttcgccgacgcgggctccgactttgtcgacgtgctgctcgatcagcttcctgacgcttccactctccgctgtgcgtctcgtcgcgggcgcgtcgtcgcccggctgcctctcgaccctctgccagggcgtcagctacctcaaggaaagcgagctgctgagttgctaccctgcgaccgtcaggagcgagccgagcctacaggggaacggctcggactgcaggtgttggcaagtcatggccagagtggcgcatctgttcaaccgaaaagaaggcgcggagatgttcgttgttcggaaacgtcggtttgtgatcagtgatgacctggtgatcaaaccagcatccactgccaatacacatttgctgcttcatcagaggattgttggttctggtaggattgatcacgccattgactttgaggagatcgaagttttcgtaggctggacagaggttgtatctatgctgaaggcatctttttcgtcgaagactgtattcactgataccttcctacccaaggaaactgaagttcgtgccattgtgaacttgagcactgctcaaaacattcaacaccagatctatcaagaaaccgatgattcagcacagtttagcatcaaggtgttctacgatagtcacgaaaagaaagttattttggacaatctgtacgtcagtgcagttgatctagacgcgaatagagtgctagcaggcaatgcaataggttcctactataaacagacgttgcttgaccccagcatttccccgttggtggcggttcatagatccaaatgggcaatcaagaagtggttctgcctgtgcagtgttccgtattgttgctccttcgctaagagccactcctgttctttctgtagcccgcagtttgtcgacaacggcacgtacgttgtagacgataatttacttatctatcaggcttcagcattgctggttatgaagcactggtgcaatagagaaaaagatagggtgttggagatggacattgcaatcagcaaacaagagagcaagctggaggacaagaagtgccaactttcgccgaggctccaacaaaaccattttcagatctttgtgaagctgcacacgggtaagactataacactggatgttcagaatggtgacaccattgccactgtgaagcacaagatcaaccagaaagcaggactgcaacttccagcgggttatccatgtcacttggtgtacggaaacacccttccggactcgagcacgcttgcggattgcaacattggcaagggatga

SEQ ID NO: 15743 - protein, 624 aa, Sorghum bicolor
  misc_feature: Useful for making plants with modulated cold sensitivity
  misc_feature: Functional homolog of the protein sequence given in SEQ ID NO 13521
  misc_feature: Ceres ANNOT ID no. 8643511
MGACKDWGRNQMNGSRVRSGEVGWVIGGGGLTGEGLRLSGRGSGRRMRRRGSGGEMVEESTESDGERPRRNVVRTKRGRWGAWHPMRCVGQARLCGLAKWAILFADWAACKCWPTEEESRKREEAQWIADCNLQWQWDLAFSQPVQQMQRRKVSSDSAPTTIKISKFPSTSRVWKGSPAGVVVKPWPTVASRSISPWTGRGTASCSPTRAPTLSTCCSISFLTLPLSAVRLVAGASSPGCLSTLCQGVSYLKESELLSCYPATVRSEPSLQGNGSDCRCWQVMARVAHLFNRKEGAEMFVVRKRRFVISDDLVIKPASTANTHLLLHQRIVGSGRIDHAIDFEEIEVFVGWTEVVSMLKASFSSKTVFTDTFLPKETEVRAIVNLSTAQNIQHQIYQETDDSAQFSIKVFYDSHEKKVILDNLYVSAVDLDANRVLAGNAIGSYYKQTLLDPSISPLVAVHRSKWAIKKWFCLCSVPYCCSFAKSHSCSFCSPQFVDNGTYVVDDNLLIYQASALLVMKHWCNREKDRVLEMDIAISKQESKLEDKKCQLSPRLQQNHFQIFVKLHTGKTITLDVQNGDTIATVKHKINQKAGLQLPAGYPCHLVYGNTLPDSSTLADCNIGKG

SEQ ID NO: 15744 - DNA, 5628 bp, Sorghum bicolor
  misc_feature: Ceres ANNOT ID no. 8643520
  misc_feature: Encodes the peptide sequence at SEQ ID NO 15745
atggctagggcggaggccaactgggagcggctggtgcgcgccgcgctgcgcggggagcggctcgtcggcgcctacgggcagccggtcaccggcatcgccgggaacgtgccgtcgtcgcttggcaacaacgtgcacatcgaggaggtgctccgcgccgccgacgagatccaggatgaagaccccaccgtcgccaggatcctttgtgagcatgcttacacgctagcccagagtttggatcccaacagcgaagggagaggagtattgcagttcaaaaccggtttaatgtcagtgatcaggcaaaaactagcgaagagggaaggtggtcctattgaccgaagtcaggatattgctaaattgcaagaattttacaagctttatagagaaaagcataaagtggatgagttgattgaagatgaaatgaagctgagggaatcagctgtgttcagcggtaaccttggagagctggaacggaaaaccagaaagcgcaaaaaagtacttgcgactttgaaggtcttatggtcggtaattgaggatatcacaaaggaaatatcaccggaggatgcaaaaaatttgatatctgaagagatgaaaaaggtcatgcaaaaggacgcagcaaggacggaggatgttgttccatataatatcattcctctggattccttgacttctaccactaatgcaattgtgaattttccggaggtaatagttcagagtaaggtgagggcagcaatatcaactcttcagtaccatggggatctgcccaggcttcctagtaccttttcagtccctgatgctaggaattcggatatcctggatcttttacaatgtgtatttggttttcaggaggataatgtgaaaaaccaaagagagcatatcattcacctattggcaaatgaacaatctcgtgtgggaaaactatcagagaacgaaccgaaaattgatgagggtgccgtgcatgctgtgttttctaaagcccttgataactatatcaaatggtgcaactatctgccccttcgtcctgtctgggataacactgattcattgacaaaggaaaagaagttgctatatgtctgtttgtactacttgatgtggggagaagctgccaatgtgcgatttattccagagggcttatgctacatatttcatcatctagcaagagaattaggtgagattttgcgaaaacaaactgtagagccagctgaaagctgtagttctggtggtggcgtgtcgtttcttgacaaagtcatttatcctttgtatgaaatcatggcagcggaagcagccaataataaaaacgggcgtgcaccgcattctgaatggagaaattatgatgatttcaatgagtttttctggtctcataagtgctttcacctaggatggccttggaagctgagcgacccgtttttctctaagcccagtaggaaggataagggcttgctaggtaggaatcatcactacggaaagacatcttttgtggaacataggacttttcttcatctttaccacagctttcatcgcctttggatgttccttattatgatgtttcagggactaactatcattgctttcaatgatggtagttttgacaggaagaccatattgcaacttcttagtctgggtcctacttatgttgtaatgaaatttattgagagtctattggatattctaatgatgtatggtgcctattcaaagtctcgtggatctgcaatcactagggtggcatggcgattctgctggtttactgtagcttcagttgcgatttgctacctatatatcaaggcacttcaagatggcacagagtcagcaacattcaagatatatgtttttgtaatcagtgcatatgtgggcgctaagataattatcagcctacttacgagtgtcccttgttgccatggtttggctgaggcttgctatcgctggtctgctgtacgccttgttaagtggatgcatcagataaaacctcttgtaagtccaacaagaactataatcagtttcagaggcctgcagtatgcttggcatgactttgtctcaaagaataatcataatgctcttacaatcctttctttatgggctccagtgctgtcaatttaccttttggacattcatgtattctacaccgtattgtctgctatttatggatttctccttggtgcacgcgatcgcttgggagagattaataatgtcgaggcagttcatagattctttgagaagtttcctagagaattcatgcatagacttcatgttgctgttccaaaaaggaagcaattgctatcttctggtcaggaaacggaattagacaagtttgatgcatctagattctcccccttctggaatgaaattgtgaggaatttacgggaagaggattatattaacaattttgaattagaattgcttttgatgcccaaaaatgacgctggagtgcttccgattgtgcagtggccacttttcttgcttgctagcaaggttttcttggccaaagagattgcagaggactgcaaagactcacaagaagaactttggctaaggatatctaaggatgaatacatgcaatatgctgttgtagagtgcttccacagcatttatcatattctgacgtctatactagagaaagaaggacgcctctgggtggaaaagatttatggtggtatccgggacagcatttcaaacaggaccatccaaagtgatcttcatttcaaaaagttgcctaatgttattgccaagcttgttgctgtattgggaatactgcgaggtacgacagagtccagtgatctgaaaaaaggtttggttaatgctattcaagatctatatgatgttgttcatcatgaagcgttttctgttaatatgagtggccacattgaagactgggatcaaattaatttagcaagggctgaaggtcgcctcttcaacaaactcaagtggccaaatgatcccaaattgaaggacttgatcaagcgattgtattcacttctgacaattaaagaatcagctgcaactgtccctaaaaatttagaagccaggcggagacttcagttctttacgaactctctgttcatggaaatgccccttgcacggcctgtttcagaaatggtctcctttagcgtgtttactccatattactctgagattgttctctacagcatggctgaactgcagaagaaaaatgaagatggtataactacactgttttatctccagaagatttacccagatgaatggaagaacttcctcactcgtatcaacagggatgaaaatacgccagactctgagctttttggcaacccaaatgacatacttgaactacgtctatgggcttcttatcgtgggcagaccttagctcgaactgtccgtggcatgatgtactataggaaagcccttatgctgcagagttatttggagaggatacaatccgaagatttggaatctacattagggttgactagttcagctgatacacattttgagttgtcacctgaggcgcgtgcacaggctgatttgaagtttacatatgtggttacctgccaaatttatggaaaacagaagggggaagggaaacctgaagctgcagacatagccttactaatgcaaaggaatgaagctcttagagttgcctacattgatgaagttgagaatgctaagaatggaaaacccatcactgagtattactcaaagcttgtgaaagctgatattcatgggaaggacaaggaaatttattcgattaaattgcctggcaatccaaagcttggagagggaaaacctgaaaatcaaaatcatgccataatattcactcgtggaaatgcagtgcaaactattgatatgaatcaggataactacttcgaggaggcacttaaaatgaggaatctacttgaggagttctctctgaagcgtggcaagcattacccttcaattcttggtgttagagagcatgtcttcacgggaagtgtttcctccttggcctcatttatgtctaaccaagagacaagttttgtgacattaggacaacgtgttctggctaacccactgaaagtgagaatgcactatggtcatccagatgtttttgatagaatttttcatataacaaggggtggaattagtaaggcctcccgcagcatcaatatcagtgaggatatatatgcaggattcaactcaacgctgcgtcaaggatgcataactcatcatgagtatattcaggttggcaaaggtagggatgttggacttaatcagattgcactctttgaaggaaaagttgctggtggaaatggtgaacaagttcttagccgagacatatatagactcggacaactttttgactttttcaggatgttatccttctacgtgacaactgttggattctacttctgtactatgctaactgtgctgacagtgtacatatttctctatgggaaaacgtatctggccttatctggtgttggagaatcaattcaaagtagagcggatatactgcacaacacagccttggatgctgctctgaacactcaatttcttttccagattggtgtatttactgcagtgcccatgattcttggtttcatccttgaatcaggtgtcttaacggcttttgttcaatttattacaatgcagttccaactatgctctgtatttttcactttctcacttggaacaaggacccactactttggccgtgcaatattacatggaggtgcaaagtatagagcaactggtagaggttttgtggtacggcatatcaagtttgctgagaactatcgtatttatgctcgaagccattttgtgaaagggatggaggttgcacttttgttggttatcttcctagtgtatgggtttaacaatggtggagcagttggctatattttactctctataagcagttggtttatggcattgtcttggctttttgctccctacttatttaacccatctggatttgaatggcagaagatcgtcgaggatttcagagactggacaaattggctgttttatcgaggtggtattggtgttaaaggagaagaaagctgggaagcttggtgggaagaagaactgcaacatatttacagcattcgagggaggatactggaaaccatactaagcctgaggtttttcatcttccaatacggagttgtttaccacatgcatgccagcagagaaagtacagctttatcggtgtattggatttcgtgggctgtgcttggtggccttttcatcctcctcttggtatttggtttaaaccccaaggccatggtacatttccaattgttcctgcgtctagtcaaaagtatagcgttattgatggttttggctggtctggtcctggcaattttgtttacggaactcagtatcggagacgtttttgcttcgattctagcatttgtgccaactgggtggggaatcatttcgattgccatggcatggaaacctgtcgtgaagaaattgggtttgtggaaaactgtccgtgccctagctcgcctgtatgatgctggcacggggatgatcattttcatacccatagccatttgctcgtggtttccattcatatccacattccagacgcgacttctgttcaaccaggcgttcagcagaggtttggagatatctctcatccttgctggcaacaatccaaatgctgggatttga

SEQ ID NO: 15745 - protein, 1875 aa, Sorghum bicolor
  misc_feature: Useful for making plants with altered cell wall content and/or composition
  misc_feature: Functional homolog of the protein sequence given in SEQ ID NO 14263
  misc_feature: Useful for making plants with altered carbohydrate content
  misc_feature: Functional homolog of the protein sequence given in SEQ ID NO 14257
  misc_feature: Ceres ANNOT ID no. 8643520
  misc_feature (1094)..(1657): SWISSPROT Homolog: EC 2.4.1.34 1,3-beta-glucan synthase
  misc_feature (997)..(1749): Pfam ID: Glucan_synthase Pfam Description: 1,3-beta-glucan synthase component
MARAEANWERLVRAALRGERLVGAYGQPVTGIAGNVPSSLGNNVHIEEVLRAADEIQDEDPTVARILCEHAYTLAQSLDPNSEGRGVLQFKTGLMSVIRQKLAKREGGPIDRSQDIAKLQEFYKLYREKHKVDELIEDEMKLRESAVFSGNLGELERKTRKRKKVLATLKVLWSVIEDITKEISPEDAKNLISEEMKKVMQKDAARTEDVVPYNIIPLDSLTSTTNAIVNFPEVIVQSKVRAAISTLQYHGDLPRLPSTFSVPDARNSDILDLLQCVFGFQEDNVKNQREHIIHLLANEQSRVGKLSENEPKIDEGAVHAVFSKALDNYIKWCNYLPLRPVWDNTDSLTKEKKLLYVCLYYLMWGEAANVRFIPEGLCYIFHHLARELGEILRKQTVEPAESCSSGGGVSFLDKVIYPLYEIMAAEAANNKNGRAPHSEWRNYDDFNEFFWSHKCFHLGWPWKLSDPFFSKPSRKDKGLLGRNHHYGKTSFVEHRTFLHLYHSFHRLWMFLIMMFQGLTIIAFNDGSFDRKTILQLLSLGPTYVVMKFIESLLDILMMYGAYSKSRGSAITRVAWRFCWFTVASVAICYLYIKALQDGTESATFKIYVFVISAYVGAKIIISLLTSVPCCHGLAEACYRWSAVRLVKWMHQIKPLVSPTRTIISFRGLQYAWHDFVSKNNHNALTILSLWAPVLSIYLLDIHVFYTVLSAIYGFLLGARDRLGEINNVEAVHRFFEKFPREFMHRLHVAVPKRKQLLSSGQETELDKFDASRFSPFWNEIVRNLREEDYINNFELELLLMPKNDAGVLPIVQWPLFLLASKVFLAKEIAEDCKDSQEELWLRISKDEYMQYAVVECFHSIYHILTSILEKEGRLWVEKIYGGIRDSISNRTIQSDLHFKKLPNVIAKLVAVLGILRGTTESSDLKKGLVNAIQDLYDVVHHEAFSVNMSGHIEDWDQINLARAEGRLFNKLKWPNDPKLKDLIKRLYSLLTIKESAATVPKNLEARRRLQFFTNSLFMEMPLARPVSEMVSFSVFTPYYSEIVLYSMAELQKKNEDGITTLFYLQKIYPDEWKNFLTRINRDENTPDSELFGNPNDILELRLWASYRGQTLARTVRGMMYYRKALMLQSYLERIQSEDLESTLGLTSSADTHFELSPEARAQADLKFTYVVTCQIYGKQKGEGKPEAADIALLMQRNEALRVAYIDEVENAKNGKPITEYYSKLVKADIHGKDKEIYSIKLPGNPKLGEGKPENQNHAIIFTRGNAVQTIDMNQDNYFEEALKMRNLLEEFSLKRGKHYPSILGVREHVFTGSVSSLASFMSNQETSFVTLGQRVLANPLKVRMHYGHPDVFDRIFHITRGGISKASRSINISEDIYAGFNSTLRQGCITHHEYIQVGKGRDVGLNQIALFEGKVAGGNGEQVLSRDIYRLGQLFDFFRMLSFYVTTVGFYFCTMLTVLTVYIFLYGKTYLALSGVGESIQSRADILHNTALDAALNTQFLFQIGVFTAVPMILGFILESGVLTAFVQFITMQFQLCSVFFTFSLGTRTHYFGRAILHGGAKYRATGRGFVVRHIKFAENYRIYARSHFVKGMEVALLLVIFLVYGFNNGGAVGYILLSISSWFMALSWLFAPYLFNPSGFEWQKIVEDFRDWTNWLFYRGGIGVKGEESWEAWWEEELQHIYSIRGRILETILSLRFFIFQYGVVYHMHASRESTALSVYWISWAVLGGLFILLLVFGLNPKAMVHFQLFLRLVKSIALLMVLAGLVLAILFTELSIGDVFASILAFVPTGWGIISIAMAWKPVVKKLGLWKTVRALARLYDAGTGMIIFIPIAICSWFPFISTFQTRLLFNQAFSRGLEISLILAGNNPNAGI

SEQ ID NO: 15746 - DNA, 885 bp, Sorghum bicolor
  misc_feature: Ceres ANNOT ID no. 8643537
  misc_feature: Encodes the peptide sequence at SEQ ID NO 15747
atggagcagtacgagaagcaggagaagatcggggagggcacctacggggtggtgtacaaggcggtgaacaaggtcaccaacgagacgatcgcgctcaagaagatccgactcgagcaggaggacgagggcgtcccatccaccgccatccgcgagatctctctcctcaaggagatgaaccacgacaacatcgtcaggttacatgatgttatccacagcgagaagcgcatacatcttgtctttgagttcctggatctggacctgaagaagttcatggactcttgcccggagtttgctaagaatcccactttgattaagtcatacctctaccagatactccgtggtgttgcttactgccattctcatagatttcttcatcgagatttgaaacctcagaacttattgatagatcggcgtactaatacactgaagcttgctgactttggtttatccagggcatttggaattcctgtccgtacatttactcatgaggtagtgacattatggtacagagctccagaaattctgcttggagcgaaacagtattcaacaccagttgatgtatggtctgtgggctgtatctttgctgaaatggtgaaccaaaagccactattccctggtgattctgagatcgacgaactgtttaagatattcagggtactaggtacaccaaatgaacaaagttggccaggagtcagttgtttgcctgacttcaagactgctttccccaggtggcaagctcaggacctggcaacaattgtcccaaatcttgaacctgctggtttggaccttctctcaaaaatgcttcgatacgagccaagcaaaagaatcacagctaggcaagcacttgagcatgagtacttcaaggaccttgagatggtacagtga

SEQ ID NO: 15747 - protein, 294 aa, Sorghum bicolor
  misc_feature: Useful for making plants with modulated growth rate
  misc_feature: Functional homolog of the protein sequence given in SEQ ID NO 14264
  misc_feature: Useful for making plants with modulated nitrogen use efficiency
  misc_feature: Functional homolog of the protein sequence given in SEQ ID NO 14265
  misc_feature: Ceres ANNOT ID no. 8643537
  misc_feature (1)..(293): SWISSPROT Homolog: EC 2.7.11.22 Cyclin-dependent kinase
  misc_feature (4)..(287): Pfam ID: Pkinase Pfam Description: Protein kinase domain
MEQYEKQEKIGEGTYGVVYKAVNKVTNETIALKKIRLEQEDEGVPSTAIREISLLKEMNHDNIVRLHDVIHSEKRIHLVFEFLDLDLKKFMDSCPEFAKNPTLIKSYLYQILRGVAYCHSHRFLHRDLKPQNLLIDRRTNTLKLADFGLSRAFGIPVRTFTHEVVTLWYRAPEILLGAKQYSTPVDVWSVGCIFAEMVNQKPLFPGDSEIDELFKIFRVLGTPNEQSWPGVSCLPDFKTAFPRWQAQDLATIVPNLEPAGLDLLSKMLRYEPSKRITARQALEHEYFKDLEMVQ

SEQ ID NO: 15748 - DNA, 2187 bp, Sorghum bicolor
  misc_feature: Ceres ANNOT ID no. 8643516
  misc_feature: Encodes the peptide sequence at SEQ ID NO 15749
atggcgccagtcagtttgcctcctggtttcaggttccaccccactgacgaggaactcatcatctactaccttaagaggaagatcaacgggagacagatagagctcgaaatcattcctgaggttgatctctacaagtgtgagccctgggatttgccagaaaaatcctttcttccaagcaaagaccttgaatggtatttcttcagccctcgggaccgcaagtacccaaatggatcaaggacaaaccgtgcaacaaaatctgggtactggaaggcaactgggaaggacagaaaggtgaactcgcacaggcgtgcagttggtatgaagaagaccttggtgtactatcggggccgagctccacatggttctcgcactgattgggtcatgcatgagtaccgcctcgacgagagggaatgcgagactgacactggcttacaggacgcgtatgcattatgccgagtttttaagaagacagcgcctgggccaaaaatcatagagcattatggtgcagtgcaccaccccatcgagcaacctcagtggatggcaagcagtgttgaccgctccccaacgctggacttgtccagtgatgttagaggtgatgatttcgagagcagcagtttctcattcccgactgaggcgccgatggactccatgcatggtgggttcgggatgcagatgagtgcacctcacgaggatggcaaatggatgcagttcctgagcgaagacgcctttaacgccaccaatcctttcttcatgaatccagcttcttccagcttctcatgtctcccatccaaggtggatgttgcactggagtgtgcaaggcttcagcacaggctctcattacctcccctggaggtggaggacttcccacaggacgtcagcctcgacacaaagacgagcgtgctccgcagcaaccccaacgaggttgacatccttcaagagttcctctccgtggcttcggcctctcaggagctaatcaacggcaccagcagcagctacgctgcagaaatgtggccaggcgctggcccaagcagcaccagcacccactacatcaatgaactatcttccctcgttgagcttggggtgaaggcaaaagaggaggcagacaatttctaccatatggactgcattggcacatctgtaggattcgcatcaaagccggtccatgtcgatgaaccggttaggttggttgagattgctgacatggaggagttcaaggaagagaagaggcaagtagagaaccttagaggagtgaggcttcacaacaatgacctaggagagattgttgtagaaggagatgaaagcaatccaacggactgcatcacacaataccccatatcagacgctgctgacaattcaggagaagccggtcacctgaccgatcccactaacgccggcggcctagacactacacccatcttctcgcaatctcaacctgacgactttgctattgggttcagtgacgacgtcaaccctaatgcatctttcgacctgtatgagaaggttgacgtcaaacatgggctcttcgtctcaacagtcggtgcaccgaagacattcttccaccacgttgagccatcgaagaaggtcagcttccacctgaatcccgtagcaagcgacgtcagcaaggcgatcgagaagttccatttccccattagtgtgacaaccaaagttagtggcagcagcatttccatttttagcaagttgaaggcgctcatcagggacaaattcctggtgaagaagctgccttcattatcataccaaagatccttaagcagcaaagaaacagcggcagcgagtgagctgctgcagatagtgtcgtcgctcctcttaacaccaatggaagtcacaggccccacgacgatgactaccgagcaagagttggtcaagaaggcgaagaaggtgatgaagccggggcccggttgtgatggaagccatgcatggcttcttccattctccaagaggagcaaaggcatttccagcatgttttttagtgggaaatgggcgtttctgacatccgcattggccatccgcactccagggttcaaaagtaaagatggcagcggggcggttttgggtcggatatccgcgggtttcgggtttggccgtatccaaaggaaacctttagataccaatatgaggaaaggtagaggaagaccgaagctgacatgggaaaaaaagagatttaaatag

SEQ ID NO: 15749 - protein, 728 aa, Sorghum bicolor
  misc_feature: The sequence is a functional homolog of SEQ ID NO 612 in the 11/435,388 US patent application
  misc_feature: The sequence is a functional homolog of SEQ ID NO 2478 in the 10/374,780 US patent application
  misc_feature: The sequence is a functional homolog of SEQ ID NO 572 in the 10/225,066 US patent application
  misc_feature: The sequence is a functional homolog of SEQ ID NO 344 in the 10/666,642 US patent application
  misc_feature: Useful for making plants with altered carbohydrate content
  misc_feature: Functional homolog of the protein sequence given in SEQ ID NO 13622
  misc_feature: The sequence is a functional homolog of SEQ ID NO 1157 in the 11/479,226 US patent application
  misc_feature: The sequence is a functional homolog of SEQ ID NO 1416 in the 10/666,642 US patent application
  misc_feature: The sequence is a functional homolog of SEQ ID NO 30 in the 10/286,264 US patent application
  misc_feature: The sequence is a functional homolog of SEQ ID NO 430 in the 11/435,388 US patent application
  misc_feature: The sequence is a functional homolog of SEQ ID NO 518 in the 10/412,699 US patent application
  misc_feature: Useful for making plants with modulated water use efficiency
  misc_feature: The sequence is a functional homolog of SEQ ID NO 2418 in the 10/374,780 US patent application
  misc_feature: The sequence is a functional homolog of SEQ ID NO 554 in the 10/225,066 US patent application
  misc_feature: The sequence is a functional homolog of SEQ ID NO 68 in the 10/286,264 US patent application
  misc_feature: The sequence is a functional homolog of SEQ ID NO 316 in the 10/412,699 US patent application
  misc_feature: The sequence is a functional homolog of SEQ ID NO 738 in the 11/479,226 US patent application
  misc_feature: The sequence is a functional homolog of SEQ ID NO 2346 in the 10/374,780 US patent application
  misc_feature: The sequence is a functional homolog of SEQ ID NO 238 in the 10/225,068 US patent application
  misc_feature: The sequence is a functional homolog of SEQ ID NO 338 in the 10/412,699 US patent application
  misc_feature: The sequence is a functional homolog of SEQ ID NO 774 in the 11/479,226 US patent application
  misc_feature: Useful for making plants with altered terpenoid content
  misc_feature: Functional homolog of the protein sequence given in SEQ ID NO 13140
  misc_feature: Useful for biocontainment applications
  misc_feature: Functional homolog of the protein sequence given in SEQ ID NO 13623
  misc_feature: The sequence is a functional homolog of SEQ ID NO 2776 in the 10/374,780 US patent application
  misc_feature: The sequence is a functional homolog of SEQ ID NO 416 in the 10/225,066 US patent application
  misc_feature: The sequence is a functional homolog of SEQ ID NO 326 in the 10/412,699 US patent application
  misc_feature: The sequence is a functional homolog of SEQ ID NO 760 in the 11/479,226 US patent application
  misc_feature: The sequence is a functional homolog of SEQ ID NO 890 in the 10/374,780 US patent application
  misc_feature: Useful for making plants with altered cell wall content and/or composition
  misc_feature: Useful for making plants with altered lignin content
  misc_feature: Functional homolog of the protein sequence given in SEQ ID NO 13620
  misc_feature: Useful for making plants with modulated nitrogen use efficiency
  misc_feature: Functional homolog of the protein sequence given in SEQ ID NO 13624
  misc_feature: The sequence is a functional homolog of SEQ ID NO 2060 in the 10/374,780 US patent application
  misc_feature: The sequence is a functional homolog of SEQ ID NO 516 in the 10/412,699 US patent application
  misc_feature: The sequence is a functional homolog of SEQ ID NO 2470 in the 10/374,780 US patent application
  misc_feature: The sequence is a functional homolog of SEQ ID NO 798 in the 10/225,066 US patent application
  misc_feature: The sequence is a functional homolog of SEQ ID NO 26 in the 10/286,264 US patent application
  misc_feature: The sequence is a functional homolog of SEQ ID NO 336 in the 10/412,699 US patent application
  misc_feature: The sequence is a functional homolog of SEQ ID NO 770 in the 11/479,226 US patent application
  misc_feature: Useful for making plants with modulated oxidative stress sensitivity
  misc_feature: Functional homolog of the protein sequence given in SEQ ID NO 13621
  misc_feature: The sequence is a functional homolog of SEQ ID NO 1196 in the 10/412,699 US patent application
  misc_feature: The sequence is a functional homolog of SEQ ID NO 865 in the 10/374,780 US patent application
  misc_feature: The sequence is a functional homolog of SEQ ID NO 328 in the 10/374,780 US patent application
  misc_feature: The sequence is a functional homolog of SEQ ID NO 852 in the 10/225,066 US patent application
  misc_feature: The sequence is a functional homolog of SEQ ID NO 100 in the 10/374,780 US patent application
  misc_feature: The sequence is a functional homolog of SEQ ID NO 318 in the 10/412,699 US patent application
  misc_feature: The sequence is a functional homolog of SEQ ID NO 749 in the 11/479,226 US patent application
  misc_feature: The sequence is a functional homolog of SEQ ID NO 884 in the 10/225,066 US patent application
  misc_feature: The sequence is a functional homolog of SEQ ID NO 1197 in the 10/412,699 US patent application
  misc_feature: The sequence is a functional homolog of SEQ ID NO 866 in the 10/374,780 US patent application
  misc_feature: Ceres ANNOT ID no. 8643516
  misc_feature (6)..(134): Pfam ID: NAM Pfam Description: No apical meristem (NAM) protein
MAPVSLPPGFRFHPTDEELIIYYLKRKINGRQIELEIIPEVDLYKCEPWDLPEKSFLPSKDLEWYFFSPRDRKYPNGSRTNRATKSGYWKATGKDRKVNSHRRAVGMKKTLVYYRGRAPHGSRTDWVMHEYRLDERECETDTGLQDAYALCRVFKKTAPGPKIIEHYGAVHHPIEQPQWMASSVDRSPTLDLSSDVRGDDFESSSFSFPTEAPMDSMHGGFGMQMSAPHEDGKWMQFLSEDAFNATNPFFMNPASSSFSCLPSKVDVALECARLQHRLSLPPLEVEDFPQDVSLDTKTSVLRSNPNEVDILQEFLSVASASQELINGTSSSYAAEMWPGAGPSSTSTHYINELSSLVELGVKAKEEADNFYHMDCIGTSVGFASKPVHVDEPVRLVEIADMEEFKEEKRQVENLRGVRLHNNDLGEIVVEGDESNPTDCITQYPISDAADNSGEAGHLTDPTNAGGLDTTPIFSQSQPDDFAIGFSDDVNPNASFDLYEKVDVKHGLFVSTVGAPKTFFHHVEPSKKVSFHLNPVASDVSKAIEKFHFPISVTTKVSGSSISIFSKLKALIRDKFLVKKLPSLSYQRSLSSKETAAASELLQIVSSLLLTPMEVTGPTTMTTEQELVKKAKKVMKPGPGCDGSHAWLLPFSKRSKGISSMFFSGKWAFLTSALAIRTPGFKSKDGSGAVLGRISAGFGFGRIQRKPLDTNMRKGRGRPKLTWEKKRFK

SEQ ID NO: 15750 - DNA, 1185 bp, Sorghum bicolor
  misc_feature: Ceres ANNOT ID no. 8643540
  misc_feature: Encodes the peptide sequence at SEQ ID NO 15751
atgaggttccttatatcttgttgtctgtttcttggtcctcccaagtcatgctgttctatctcagcctttggtggtgtggcagcggtttctgatgattttgtagaaagctcgccatcaagcagtggatatctgaatagtgctatggatgcttcatctcatgaagataatcaatcagaaagggctgttaagatgaaccaaaactccagagacaataaaatgattaaaatatgtgataagttaattggtgtattcctggtggataaacctacaccaatggattggagaaaattactagcttttagcagggaatgggacaacataaggcctcatttctttaaacgctgccaggaaaaagcagatacagagctgaaccctgagatgaagcacaatcttctcagacttggtagaaaacttaaagagattgatgaggacgtacagaggcataatgaacttcttgaagtagtaaaatccacaccatcagacgaacttggttctattgttgctaagaggcgtaaagatttcacagtggaattcttcaatcacctttactatgttgcagagtcttatcatgatgaacctgaaaagcaaactgagttggcgaagcttggaaatgattgtgtagatgctctacaagctcatgatgatacaacagggagccttgaagctttgaatgctgcagaactgaagttaaaagatatacttaattcaccttcagtggatgctgcttgcagaaagattgatgacttggctgagaagaaagaactggattctgcattagtgttgatgctttcaaaagcttggtcagctgcaaagggcactgacatcacaaaatctgaggcaaaggatataatgtttcacctatatatgactgcggtggccaatctccagagacaaatgccgaaggatatcagaatactgaagcatcttataatgatagaggatccagaagaacggttaagtgcacttaatgatgcttttactcctggtcctgaacttcaaggggacaatgttgatacattatacacgagtccagatgcgatgcacacttgggcaagagctatagttgatgcatattataatagcagagaaggcactctccttgggcaagcaagagacatgatgaatcctaaagtcattaagagagtcgaagagatagtgaagataatcaaggacaaatacctttaa

SEQ ID NO: 15751 - protein, 394 aa, Sorghum bicolor
  misc_feature: Useful for making plants with modulated salt sensitivity
  misc_feature: Functional homolog of the protein sequence given in SEQ ID NO 14266
  misc_feature: Ceres ANNOT ID no. 8643540
MRFLISCCLFLGPPKSCCSISAFGGVAAVSDDFVESSPSSSGYLNSAMDASSHEDNQSERAVKMNQNSRDNKMIKICDKLIGVFLVDKPTPMDWRKLLAFSREWDNIRPHFFKRCQEKADTELNPEMKHNLLRLGRKLKEIDEDVQRHNELLEVVKSTPSDELGSIVAKRRKDFTVEFFNHLYYVAESYHDEPEKQTELAKLGNDCVDALQAHDDTTGSLEALNAAELKLKDILNSPSVDAACRKIDDLAEKKELDSALVLMLSKAWSAAKGTDITKSEAKDIMFHLYMTAVANLQRQMPKDIRILKHLIMIEDPEERLSALNDAFTPGPELQGDNVDTLYTSPDAMHTWARAIVDAYYNSREGTLLGQARDMMNPKVIKRVEEIVKIIKDKYL

SEQ ID NO: 15752 - DNA, 774 bp, Sorghum bicolor
  misc_feature: Ceres ANNOT ID no. 8643545
  misc_feature: Encodes the peptide sequence at SEQ ID NO 15753
atggccgtggccgtggccgtagtatccggaactggcattgctcacttgcatttcctgcacgttttgctgccggaaatccctggtttctccggcgaagaacagcgcggatcagtaccagtgtgtccggagtgtccgggccagatggagcgggagcaggagcaggaggcgggcacagcacagcaactgctcggtcggcgcgtgcgcgcggacacgcgacacccggtgtaccgcggcatccggtaccgcgggggcaagtgggtgtcggagatccgggagccgcgcaagtccaacaggatctggctgggcacgtacccggcgccggagatggccgccgcggcctacgacgccgccgcattggctctgcggggcgccgaggccgcgctcaacttccccggcgcggccatgtcccggcccgcgccggcgtcgtgctctcccgacgacatccgcgcggccgctgcggccgccgctgccgcggtgatcggccgttcccattcgccgcaggtgggtggtgaagcagctgctggtggtggttgcggtgcaagcacttggtcgtccggtgccggtgcccagggccaggtgccggagcaccgagcgggcgacaggcggatcgtggacgaggacgacgtgttccaggtgccgcgactgctggcgggcatggccgaggggttgatgatgagcccaccgaggctcgtcggccccgcgacggacggcgccgtgttgctggaggaggacggcagcgaggacggcgtggtgagcctgtgggatcactcgtga

SEQ ID NO: 15753 - protein, 257 aa, Sorghum bicolor
  misc_feature: The sequence is a functional homolog of SEQ ID NO 1233 in the 10/374,780 US patent application
  misc_feature: Ceres ANNOT ID no. 8643545
  misc_feature (74)..(124): Pfam ID: AP2 Pfam Description: AP2 domain
MAVAVAVVSGTGIAHLHFLHVLLPEIPGFSGEEQRGSVPVCPECPGQMEREQEQEAGTAQQLLGRRVRADTRHPVYRGIRYRGGKWVSEIREPRKSNRIWLGTYPAPEMAAAAYDAAALALRGAEAALNFPGAAMSRPAPASCSPDDIRAAAAAAAAAVIGRSHSPQVGGEAAAGGGCGASTWSSGAGAQGQVPEHRAGDRRIVDEDDVFQVPRLLAGMAEGLMMSPPRLVGPATDGAVLLEEDGSEDGVVSLWDHS

SEQ ID NO: 15754 - DNA, 801 bp, Sorghum bicolor
  misc_feature: Ceres ANNOT ID no. 8643568
  misc_feature: Encodes the peptide sequence at SEQ ID NO 15755
atgaggccggtgttctgcggcaacttcgaccacgacacccgccagtatgacctcgagcgcctcttctccaagtacggctccatcagccggatcgacatgaagacaggctatgctttcatttactttgaagatgagcgtgatgcagaggatgctataaggcgcctcgacaacgtgtcttttggttatgacaggcgcaaactctctgtagaatggtccaggcaagttgaaccagtgccaaagagccgtgatagacctactggggatgtaaagccaacgagaaccctctttgttatcaattttgaccccatgcgcactaaggttcaagatatcgagaggcatttcgaaccttacggcaagattgccaacattcgcattcgaaggaactttgcgttcgtacagtatgagacacaagaggaagctagtgctgctgtcaagaacactgacaagagcaccatattggacagggtagtgactgttgaatatgccttccgggatgatgacagcgagagagatgacagatacggcagccccaagcgaggtgcttatgacaggcgtcgtggtaacccctacttgcgctcacctagcccaaggtaccgaagggagtacagtccagattatgatcggcgtgggcgttatcctgggtatgatcgccgtgacggagcaatgtatgaaaggcgaagccctgtatatgatcgctacaataggggcagaagccctgtatatgatcgctacaacaggggcagaagccctgtttatgatggctatgataggagaggaagccctggctatgatcaatattag

SEQ ID NO: 15755 - protein, 266 aa, Sorghum bicolor
  misc_feature: Useful for making plants with modulated biomass
  misc_feature: Functional homolog of the protein sequence given in SEQ ID NO 12876
  misc_feature: Ceres ANNOT ID no. 8643568
  misc_feature (13)..(80): SWISSPROT Homolog: EC 5.2.1.8 Peptidylprolyl isomerase
  misc_feature (4)..(69): Pfam ID: RRM_1 Pfam Description: RNA recognition motif. (a.k.a. RRM, RBD, or RNP domain)
  misc_feature (95)..(159): Pfam ID: RRM_1 Pfam Description: RNA recognition motif. (a.k.a. RRM, RBD, or RNP domain)
MRPVFCGNFDHDTRQYDLERLFSKYGSISRIDMKTGYAFIYFEDERDAEDAIRRLDNVSFGYDRRKLSVEWSRQVEPVPKSRDRPTGDVKPTRTLFVINFDPMRTKVQDIERHFEPYGKIANIRIRRNFAFVQYETQEEASAAVKNTDKSTILDRVVTVEYAFRDDDSERDDRYGSPKRGAYDRRRGNPYLRSPSPRYRREYSPDYDRRGRYPGYDRRDGAMYERRSPVYDRYNRGRSPVYDRYNRGRSPVYDGYDRRGSPGYDQY

SEQ ID NO: 15756 - DNA, 279 bp, Sorghum bicolor
  misc_feature: Ceres ANNOT ID no. 8643609
  misc_feature: Encodes the peptide sequence at SEQ ID NO 15757
atggcgaagcagcagcagcaggcgatggcgctgctgatgatgctggtgctggctgcggagacggcgtcggcggcttcgtgcaacgcggggcagctgacggtgtgcgcgtcggcgatgttgtccggggcggcgccctcggcggcgtgctgctccaacctcaaggcgcagcaggggtgcttgtgccagttcgccaagaaccccgcctacgcgcgctacgtcaacagccccaacgcgcgcaagaccgtcgcctcctgcggcgtcgccctgccgcgctgctaa

SEQ ID NO: 15757 - protein, 92 aa, Sorghum bicolor
  misc_feature: Useful for making plants with modulated biomass
  misc_feature: Functional homolog of the protein sequence given in SEQ ID NO 13146
  misc_feature: Ceres ANNOT ID no. 8643609
  misc_feature (27)..(92): Pfam ID: Tryp_alpha_amyl Pfam Description: Protease inhibitor/seed storage/LTP family
MAKQQQQAMALLMMLVLAAETASAASCNAGQLTVCASAMLSGAAPSAACCSNLKAQQGCLCQFAKNPAYARYVNSPNARKTVASCGVALPRC

SEQ ID NO: 15758 - DNA, 504 bp, Sorghum bicolor
  misc_feature: Ceres ANNOT ID no. 8643637
  misc_feature: Encodes the peptide sequence at SEQ ID NO 15759
atgaatgtggacaagctcaagaagatggcgggcgctgtgcgcaccggaggaaagggcagcatgcgcaggaagaagaaggcagttcacaagaccacaaccaccgatgacaagcggcttcagagcacattgaaaagaatcggagtgaacactattcctggtattgaagaggtcaacattttcaaggatgatgttgttatccaatttcagaaccctaaagtgcaagcatctattcctgcaaatacatgggtagtcagtggagtaccccagacaaaaagtctgcaagatcttctgccatcaattatcaaccaactgggccctgataacctggacaaccttaagaggcttgctgagcatttccagaagcaggtaccaggtgctgaagctggtgcagctgcacaggatgatgacgatgtccctgagcttgtcccaggagagacatttgaggaggctgcagaagagaagaaggtgcctgaaccggaaccggaagagaagaaagaatcgtaa

SEQ ID NO: 15759 - protein, 167 aa, Sorghum bicolor
  misc_feature: Useful for making plants with modulated biomass
  misc_feature: Functional homolog of the protein sequence given in SEQ ID NO 13061
  misc_feature: The sequence is a functional homolog of SEQ ID NO 1617 in the 11/479,226 US patent application
  misc_feature: The sequence is a functional homolog of SEQ ID NO 786 in the 10/412,699 US patent application
  misc_feature: The sequence is a functional homolog of SEQ ID NO 1614 in the 11/479,226 US patent application
  misc_feature: The sequence is a functional homolog of SEQ ID NO 784 in the 10/412,699 US patent application
  misc_feature: Ceres ANNOT ID no. 8643637
  misc_feature (34)..(92): Pfam ID: NAC Pfam Description: NAC domain
MNVDKLKKMAGAVRTGGKGSMRRKKKAVHKTTTTDDKRLQSTLKRIGVNTIPGIEEVNIFKDDVVIQFQNPKVQASIPANTWVVSGVPQTKSLQDLLPSIINQLGPDNLDNLKRLAEHFQKQVPGAEAGAAAQDDDDVPELVPGETFEEAAEEKKVPEPEPEEKKES

SEQ ID NO: 15760 - DNA, 2523 bp, Sorghum bicolor
  misc_feature: Ceres ANNOT ID no. 8643638
  misc_feature: Encodes the peptide sequence at SEQ ID NO 15761
atggctgcagcggtggcgatgcgagggggaagcagcgacagtggaggatttgataaggttcccgggatggactcggggaaatacgtgcgctacaccccggagcaagtcgaggtgctcgagcggctctacatagattgccccaagccaagctcctcacggaggcagcaactgctgcgcgagtgtcctatactctccaacattgagccgaagcagatcaaggtctggttccagaaccgaaggtgccgtgataagcagcggaaggagtcctcgcggcttcaggctgtgaacagaaagctgacggcaatgaacaagcttcttatggaagagaatgagcgtcttcagaagcaagtctctcagttggttcatgaaaatgcgcacatgcggcagcagctgcagaatacttcattggccaatgatacaagctgtgaatcaaatgtcactacccctccaaaccctataagggatgcaagtaacccttctggactccttgcgattgcagaggagaccttcacagagttcctctcaaaggctactgggacagctattgattgggtccagatgcctgggatgaagcctggtccggattcggttggtatcgtggccatttcgcatggttgccgtggcgttgctgcccgcgcctgtggtttggtgaatctagaaccaacaaaagttatagagatcttgaaagatcgtccctcttggttccgtgattgtcgaagtcttgaagtgtttacaatgtttccagctggaaatggaggaacagttgaacttatctacatgcagatgtatgccccaacaactttagtccctgcacgtgatttttggacgttacgatacacgacaacaatggaagatggtagccttgtggtctgtgagagatccttgagtggttctggaggcggcccaaatgcagcctctgcacagcaatttgttagggctgagatgcttccaagtgggtatttagttcgcccatgcgaaggtggaggttcgattgtgcatatagtggaccatctagatctcgaggcatggagtgttcctgaagtgcttcgaccgctgtatgagtcttctagagtagttgctcagaaaatgactacggtggcactgcgccaccttaggcaaattgctcaagaaacaagtggagaagtagtgtacgccttgggaaggcaacctgcagtactacggacctttagtcaaagactaagcaggggttttaatgatgccattagtggtttcaatgatgatggctggtctgtaatggggggagatggcattgaagacgttgttgttgcttgcaactcaaccaagaaaattaggaataacagcaatgctgggattacatttggagcccctggaggcattatttgtgcgaaggcatccatgttactgcagagtgtcccaccggcagtactggtccgatttctgagggagcatagatctgaatgggccgattacaatatggatgcgtatttggcttcatcactgaagaccagtgcgtgctcacttcccgggttgcgacctatgagattttctggggggcagatgatcatgccacttgctcacacagtggagaacgaggagattcttgaagttgtccgccttgaaggacaacctcttactcatgatgaagctcttctttcaagagacatccaccttctccagctttgcactggaatagatgagaaatctgtgggttcctccttccagcttgtgtttgcaccaattgatgaacattttccagatgatgctccattgatttcttctggctttcgtgtcataccacttgatatgaaaacagatggtgtagcctctggcaggacgctagatttggcatctagtcttgatgtgggttctgctgcaccccaagcctcaggggatgcatctccagatgactgtaatttgagatctgtgctgacaatcgcctttcaattcccttatgagatgcaccttcaagacagtgttgcaactatggcccgtcaatatgttcgtggtgttgtttctgctgtgcaaagagtgtcgatggctatatctccctcccaatctggtctaaatgctgggcagaggatgctttctggcttccctgaagctgccacacttgctagatgggtttgccagagttatcattaccatctaggtttggaattacttaatcaatcagatgaagctggtgaagcattgttgaaaatgctctggcatcatccagacgctgttctgtgctgctcttttaaggagaaacctatgtttacatttgcaaacaaggcagggcttgacatgttagaaacatctcttgttgcgctgcaagacctgacactagacaagattttcgacgagtcaggaaggaaagcaatattctcagatatctcaaaactaatggaacagggctacgcatacctgccatcaggtgtgtgcatgtcaggaatgggtcgccatgtttctttcgaccaagctgtggcgtggaaggtgctcggtgaggacagcaacgtgcactgcctggcattctgcttcgtcaactggtccttcgtgtga

SEQ ID NO: 15761 - protein, 840 aa, Sorghum bicolor
  misc_feature: The sequence is a functional homolog of SEQ ID NO 1110 in the 10/412,699 US patent application
  misc_feature: The sequence is a functional homolog of SEQ ID NO 667 in the 10/374,780 US patent application
  misc_feature: The sequence is a functional homolog of SEQ ID NO 721 in the 10/374,780 US patent application
  misc_feature: The sequence is a functional homolog of SEQ ID NO 784 in the 10/666,642 US patent application
  misc_feature: The sequence is a functional homolog of SEQ ID NO 2 in US patent 7056739
  misc_feature: Useful for making plants with altered lignin content
  misc_feature: Useful for making plants with altered carbohydrate content
  misc_feature: Functional homolog of the protein sequence given in SEQ ID NO 13708
  misc_feature: The sequence is a functional homolog of SEQ ID NO 1392 in the 10/666,642 US patent application
  misc_feature: The sequence is a functional homolog of SEQ ID NO 1772 in the 10/412,699 US patent application
  misc_feature: The sequence is a functional homolog of SEQ ID NO 28 in the 10/225,066 US patent application
  misc_feature: The sequence is a functional homolog of SEQ ID NO 538 in the 11/479,226 US patent application
  misc_feature: The sequence is a functional homolog of SEQ ID NO 72 in the 10/374,780 US patent application
  misc_feature: The sequence is a functional homolog of SEQ ID NO 1454 in the 10/666,642 US patent application
  misc_feature: The sequence is a functional homolog of SEQ ID NO 162 in the 10/225,066 US patent application
  misc_feature: The sequence is a functional homolog of SEQ ID NO 1868 in the 10/412,699 US patent application
  misc_feature: The sequence is a functional homolog of SEQ ID NO 2124 in the 10/374,780 US patent application
  misc_feature: The sequence is a functional homolog of SEQ ID NO 1394 in the 10/666,642 US patent application
  misc_feature: The sequence is a functional homolog of SEQ ID NO 1774 in the 10/412,699 US patent application
  misc_feature: The sequence is a functional homolog of SEQ ID NO 1994 in the 10/374,780 US patent application
  misc_feature: The sequence is a functional homolog of SEQ ID NO 1390 in the 10/666,642 US patent application
  misc_feature: The sequence is a functional homolog of SEQ ID NO 1770 in the 10/412,699 US patent application
  misc_feature: The sequence is a functional homolog of SEQ ID NO 250 in the 10/412,699 US patent application
  misc_feature: The sequence is a functional homolog of SEQ ID NO 26 in the 10/225,066 US patent application
  misc_feature: The sequence is a functional homolog of SEQ ID NO 534 in the 11/479,226 US patent application
  misc_feature: The sequence is a functional homolog of SEQ ID NO 70 in the 10/374,780 US patent application
  misc_feature: The sequence is a functional homolog of SEQ ID NO 1109 in the 10/412,699 US patent application
  misc_feature: The sequence is a functional homolog of SEQ ID NO 666 in the 10/374,780 US patent application
  misc_feature: The sequence is a functional homolog of SEQ ID NO 783 in the 10/666,642 US patent application
  misc_feature: The sequence is a functional homolog of SEQ ID NO 669 in the 10/374,780 US patent application
  misc_feature: The sequence is a functional homolog of SEQ ID NO 720 in the 10/374,780 US patent application
  misc_feature: The sequence is a functional homolog of SEQ ID NO 1108 in the 10/412,699 US patent application
  misc_feature: The sequence is a functional homolog of SEQ ID NO 665 in the 10/374,780 US patent application
  misc_feature: The sequence is a functional homolog of SEQ ID NO 782 in the 10/666,642 US patent application
  misc_feature: Ceres ANNOT ID no. 8643638
  misc_feature (693)..(840): Pfam ID: MEKHLA Pfam Description: MEKHLA domain
  misc_feature (164)..(374): Pfam ID: START Pfam Description: START domain
  misc_feature (25)..(85): Pfam ID: Homeobox Pfam Description: Homeobox domain
MAAAVAMRGGSSDSGGFDKVPGMDSGKYVRYTPEQVEVLERLYIDCPKPSSSRRQQLLRECPILSNIEPKQIKVWFQNRRCRDKQRKESSRLQAVNRKLTAMNKLLMEENERLQKQVSQLVHENAHMRQQLQNTSLANDTSCESNVTTPPNPIRDASNPSGLLAIAEETFTEFLSKATGTAIDWVQMPGMKPGPDSVGIVAISHGCRGVAARACGLVNLEPTKVIEILKDRPSWFRDCRSLEVFTMFPAGNGGTVELIYMQMYAPTTLVPARDFWTLRYTTTMEDGSLVVCERSLSGSGGGPNAASAQQFVRAEMLPSGYLVRPCEGGGSIVHIVDHLDLEAWSVPEVLRPLYESSRVVAQKMTTVALRHLRQIAQETSGEVVYALGRQPAVLRTFSQRLSRGFNDAISGFNDDGWSVMGGDGIEDVVVACNSTKKIRNNSNAGITFGAPGGIICAKASMLLQSVPPAVLVRFLREHRSEWADYNMDAYLASSLKTSACSLPGLRPMRFSGGQMIMPLAHTVENEEILEVVRLEGQPLTHDEALLSRDIHLLQLCTGIDEKSVGSSFQLVFAPIDEHFPDDAPLISSGFRVIPLDMKTDGVASGRTLDLASSLDVGSAAPQASGDASPDDCNLRSVLTIAFQFPYEMHLQDSVATMARQYVRGVVSAVQRVSMAISPSQSGLNAGQRMLSGFPEAATLARWVCQSYHYHLGLELLNQSDEAGEALLKMLWHHPDAVLCCSFKEKPMFTFANKAGLDMLETSLVALQDLTLDKIFDESGRKAIFSDISKLMEQGYAYLPSGVCMSGMGRHVSFDQAVAWKVLGEDSNVHCLAFCFVNWSFV

SEQ ID NO: 15762 - DNA, 1332 bp, Sorghum bicolor
  misc_feature: Ceres ANNOT ID no. 8643622
  misc_feature: Encodes the peptide sequence at SEQ ID NO 15763
atgtacggcggagacgaggtttcggcaatcgtcatagatgtgggctcctacagctgcaaggcgggctacgccggcgacgacacccccaaggccgtgttcccctcggtcgttggttcagttgaacaaactgaaggcatggatgaccccaagccagagaaggaagctgactctgcatcagattctaagaatggggccaagcctatggatgtggacaaagccaaaacaaaacgcaaactttatgtaggccaagagttggagttcaggagggatcacatggaggtgatttcacctatgaaagatggaacggtaactgattgggatattgttgataatatatggaatcatgctttcagacggaggttgttgatcaatcctgaagagcatcccatgctcatagctgaaccatctacaaacactgctcaacaaagagagaaagcagcggaacttatgtttgagagctacaaagtgccagcactgttcctagccaaaaatgcagtgctcacatcttttgcgtctggacgagctacatctttggtggttgacagtggtggtgggtctactgtggtttctgctgtgcatgatggttttgttttgcaaaagtctgtggctacttctccagttggcggtgaatttttaactgactgtatgatgaaaagcttggagagcaagggcatcgttattaggcccagatattcatttaagaagaaggaaaccagtcccggagaatataagattgtagatcttgatcttccaaacacaactgagagttacaggttgtactgcatgagagctattgctagtgacgtcaaggagtctgtttgcagagttccagacactgcttttgatgaagtggcatatgcaaatgttcctacgacttcatatgagcttcctgatggacaaactattgaagttggcgctgatagattcaaggttcctgatattctatttaatccatctctatcccagactattcctggaattgatggatttgcagattcaacaccagtccgtggccttcaacgaatggtcattgacagcataaataagtgtgacgttgacatacgaaaggagctatttagcaatatcttgctttctggtggttcatcatcaattctgcagttaaaggagcgcctagagaaagaagtattagaggagtctccgcaagctgctcgtgttaaagtcatggcaagtggaaactcagtagagagacgattcagtgtttggattggagggagcattcttgcatcccttgggtcgttccagcaaatgtggttctccaaagcagagtatgaagagcatggggtttcctatattcaaaggaagtgtccttga

SEQ ID NO: 15763 - protein, 443 aa, Sorghum bicolor
  misc_feature: Useful for making plants with modulated biomass
  misc_feature: Useful for making plants with modulated flowering time
  misc_feature: Functional homolog of the protein sequence given in SEQ ID NO 14267
  misc_feature: Ceres ANNOT ID no. 8643622
  misc_feature (80)..(162): SWISSPROT Homolog: EC 2.7.10.2 Non-specific protein-tyrosine kinase
  misc_feature (4)..(443): Pfam ID: Actin Pfam Description: Actin
MYGGDEVSAIVIDVGSYSCKAGYAGDDTPKAVFPSVVGSVEQTEGMDDPKPEKEADSASDSKNGAKPMDVDKAKTKRKLYVGQELEFRRDHMEVISPMKDGTVTDWDIVDNIWNHAFRRRLLINPEEHPMLIAEPSTNTAQQREKAAELMFESYKVPALFLAKNAVLTSFASGRATSLVVDSGGGSTVVSAVHDGFVLQKSVATSPVGGEFLTDCMMKSLESKGIVIRPRYSFKKKETSPGEYKIVDLDLPNTTESYRLYCMRAIASDVKESVCRVPDTAFDEVAYANVPTTSYELPDGQTIEVGADRFKVPDILFNPSLSQTIPGIDGFADSTPVRGLQRMVIDSINKCDVDIRKELFSNILLSGGSSSILQLKERLEKEVLEESPQAARVKVMASGNSVERRFSVWIGGSILASLGSFQQMWFSKAEYEEHGVSYIQRKCP

SEQ ID NO: 15764 - DNA, 1290 bp, Sorghum bicolor
  misc_feature: Ceres ANNOT ID no. 8643657
  misc_feature: Encodes the peptide sequence at SEQ ID NO 15765
atgagagatcccaaaccgaggagaagccaagcagcccccaccctcgccgccaagctgcggaagcactccacttgcctcctcctcctgctctggttcgccctatccctctgcctcttcctctccgccgcgccgcccgccgccgcgccgctcagccgctcctccttcctccgctccaagccccgcgccctcgccgccaccaccaccggcgcagccgcatcccccgtccggatctacgtctacgacctccccgcccgcttcaaccgcgactgggccgccgccgacgcgcggtgcgcgcgccacctcttcgcggccgaggtggcggtgcacgaggcgttgctcgcctacgccggccgcgccgcgcgccccgaggacgccgacctctttttcgtccccgtctacgtctcctgcaacttctccactcccaacggcttcccctcgctgtcgcacgcccggggcctgctcgccgaggccgtcgacctcgtccgggtccggatgccgtactggaatcgctccgccggggccgaccacgtcttcgtcgcctcccacgacttcggtgcctgcttccatccaatggaggatgtagccatcgccgacggcataccagagttcctgaagaggtccatcctgctacagacatttggtgtccaaggccatcatgtatgtcaggaggtggagcatgttgtgatcccacctcatgtgccgccggaggtggctcatgaactaccggagccagagaaggctcagagggacatttttgccttctttcgaggcaagatggaggtgcaccccaagaacattagtggccgcttctacagcaagaaggtgaggactgagcttctacaacattatggtcgcaaccgcaagttctaccttaagagaaagcggtttgacaactaccgatctgagatggctcggtcgttgttctgtctctgtccgctgggatgggcgccttggagtcctcggcttgtggaatcagtcctcctaggctgcattcctgttataattgctgataacatacgtctgccgttcccttcagtcctccagtggccggagatctcattgcaggtggctgagaaggacatagccaaccttgagatggtgcttgaccatgtcgtagcaaccaatttgactatgatacagaagaatttgtgggatccagtgaagcgtaaggctctagttttcaatcgtccgatggaagtgggagatgctacatggcaagtgttgagggagcttgaggttttgctagaccagtctcaaaggaggagatatgttggatcctggaggaggtga

SEQ ID NO: 15765 - protein, 429 aa, Sorghum bicolor
  misc_feature: Useful for making plants with altered cell wall content and/or composition
  misc_feature: Functional homolog of the protein sequence given in SEQ ID NO 14268
  misc_feature: Useful for making plants with altered carbohydrate content
  misc_feature: Functional homolog of the protein sequence given in SEQ ID NO 14269
  misc_feature: Ceres ANNOT ID no. 8643657
  misc_feature (77)..(383): Pfam ID: Exostosin Pfam Description: Exostosin family
MRDPKPRRSQAAPTLAAKLRKHSTCLLLLLWFALSLCLFLSAAPPAAAPLSRSSFLRSKPRALAATTTGAAASPVRIYVYDLPARFNRDWAAADARCARHLFAAEVAVHEALLAYAGRAARPEDADLFFVPVYVSCNFSTPNGFPSLSHARGLLAEAVDLVRVRMPYWNRSAGADHVFVASHDFGACFHPMEDVAIADGIPEFLKRSILLQTFGVQGHHVCQEVEHVVIPPHVPPEVAHELPEPEKAQRDIFAFFRGKMEVHPKNISGRFYSKKVRTELLQHYGRNRKFYLKRKRFDNYRSEMARSLFCLCPLGWAPWSPRLVESVLLGCIPVIIADNIRLPFPSVLQWPEISLQVAEKDIANLEMVLDHVVATNLTMIQKNLWDPVKRKALVFNRPMEVGDATWQVLRELEVLLDQSQRRRYVGSWRR

SEQ ID NO: 15766 - DNA, 951 bp, Sorghum bicolor
  misc_feature: Ceres ANNOT ID no. 8643647
  misc_feature: Encodes the peptide sequence at SEQ ID NO 15767
atgtctgagaggaatctccttgcacgccgccagccgctgccgcccgccattgccgtggcggtggtggtggtggcggtgctcgtccatccacgagcggtggcggtggcgcaggctcagccttcgccgggctacttcccgagcgccacggtgaggtccatggccttctccgaggactacgacaacctgtgggggccgcagcaccagacgctgtcgcaggacaagatggcgctcacgctcttgatggaccgaacctcaggcagcggattcaagtcgaagcgctcgtaccggaacggctacttcggcgtctccatcaaggtgcagccgggctacaccgccggcgtcaacaccgccttctacctgtcgaacaacgagctgtaccctgggaagcacgacgagatcgacatagagctgctgggcacggtgccgggggagccctacactctgcagaccaacgtgtacgtgcggggcaccggcgacggcgcgcacctggtggggcgggagatgcggttccacctctggttcgacccgaccgccgacttccaccactacgccatcctgtggaaccccgacgagatcgtcttcctcgtcgacgacgtccccatcaggcgctacgccgccgccagcacgacgttattcccggacagggagatgtgggcgtacggctccatctgggacgcctccgactgggccaccgacggcggccgctacagggccgactaccgctaccagcccttcctggcgggcttccggacgttcaggaccgccggatgcgaggccgccgcgcccgccgccgggtgcccacccgtgccggcgtcccccgccggcgctgggctcagcgtgcagcagcgtgacgccatgcgctgggcgcagcagaggtccatggtctactactactgccaggattacacaaaggatcgctccttatacccagaatgctcgctcgctacctag

SEQ ID NO: 15767 - protein, 316 aa, Sorghum bicolor
  misc_feature: Useful for making plants with altered carbohydrate content
  misc_feature: Functional homolog of the protein sequence given in SEQ ID NO 13842
  misc_feature: Useful for making plants with altered cell wall content and/or composition
  misc_feature: Functional homolog of the protein sequence given in SEQ ID NO 13843
  misc_feature: Ceres ANNOT ID no. 8643647
  misc_feature (43)..(314): SWISSPROT Homolog: EC 2.4.1.207 Xyloglucan:xyloglucosyl transferase
  misc_feature (55)..(242): Pfam ID: Glyco_hydro_16 Pfam Description: Glycosyl hydrolases family 16
  misc_feature (266)..(312): Pfam ID: XET_C Pfam Description: Xyloglucan endo-transglycosylase (XET) C-terminus
MSERNLLARRQPLPPAIAVAVVVVAVLVHPRAVAVAQAQPSPGYFPSATVRSMAFSEDYDNLWGPQHQTLSQDKMALTLLMDRTSGSGFKSKRSYRNGYFGVSIKVQPGYTAGVNTAFYLSNNELYPGKHDEIDIELLGTVPGEPYTLQTNVYVRGTGDGAHLVGREMRFHLWFDPTADFHHYAILWNPDEIVFLVDDVPIRRYAAASTTLFPDREMWAYGSIWDASDWATDGGRYRADYRYQPFLAGFRTFRTAGCEAAAPAAGCPPVPASPAGAGLSVQQRDAMRWAQQRSMVYYYCQDYTKDRSLYPECSLAT

SEQ ID NO: 15768 - DNA, 657 bp, Sorghum bicolor
  misc_feature: Ceres ANNOT ID no. 8643670
  misc_feature: Encodes the peptide sequence at SEQ ID NO 15769
atgattgatctaacgagtcgattgcacaagccgacgggcgccggccccgacgacaacggtggtgcgtgcgggtacaaggatgtgaacaaggcccccttcaacagcaagggtgcgtgcggcaacctccccatcttcaaggatggcctcggctgcggctcctgctttgagatcaagtgtgacaagccagccgagtgctccggcgaggccgtggtggtgcacatcacggacatgaactacgagcaaatcgccgcctaccacttcgacctagccggcacggcgttcgccgccatggccaagaagggcgaggaggagaagctgcggaaggcgggcatcatcgacatgcagtttcgtcgggtcaagtgcaagtatggcgaaaaggtcaccttccatgtggagaaggggagcaaccccaactacctggcgctgctggtcaagtacgtcgacggcgacgttgtgggggtggacatcaaggagaagggtggcgacgcttaccagcccctcaagcactcctggggcgctatctggaggaaggacagcgacaagccaatcaagttccccgtcaccgtccaaatcaccacggagggaggcaccaagaccgcctacgaagacgtcatccccgaaggttggaaggccgacaccacctacaccgccaaataa

SEQ ID NO: 15769 - protein, 218 aa, Sorghum bicolor
  misc_feature: Useful for making plants with altered carbohydrate content
  misc_feature: Functional homolog of the protein sequence given in SEQ ID NO 13970
  misc_feature: Ceres ANNOT ID no. 8643670
  misc_feature (127)..(206): Pfam ID: Pollen_allerg_1 Pfam Description: Pollen allergen
  misc_feature (37)..(116): Pfam ID: DPBB_1 Pfam Description: Rare lipoprotein A (RlpA)-like double-psi beta-barrel
MIDLTSRLHKPTGAGPDDNGGACGYKDVNKAPFNSKGACGNLPIFKDGLGCGSCFEIKCDKPAECSGEAVVVHITDMNYEQIAAYHFDLAGTAFAAMAKKGEEEKLRKAGIIDMQFRRVKCKYGEKVTFHVEKGSNPNYLALLVKYVDGDVVGVDIKEKGGDAYQPLKHSWGAIWRKDSDKPIKFPVTVQITTEGGTKTAYEDVIPEGWKADTTYTAK

SEQ ID NO: 15770 - DNA, 786 bp, Sorghum bicolor
  misc_feature: Ceres ANNOT ID no. 8643669
  misc_feature: Encodes the peptide sequence at SEQ ID NO 15771
atgtcgtggtcgatgcaggtggcgttggtggtggcgctggcgtttctggtgggcggcgcatggtgcggtcctcccaaggttgccccgggcaagaacatcacggccacctacggcagcgactggctggaagcgaaggcaacatggtacggtaagccaacaggcgccggccccgacgacaacggcggcgcatgtggttacaaggatgtgaacaaggcccccttcaacagcatgggcgcgtgcggcaacctccccatcttcaaggacggcctcggctgcggctcctgctttgagatcaagtgtgacaagccggccgagtgctccggcgaggccgtggtggtgcacatcacggacatgaactacgagcaaatcgccgcctaccacttcgacctggccggcacggcgttcggcgccatggccaagaagggcgaggaggagaagctgcgcaaggcgggcatcatcgacatgaagttccgccgggtcaagtgcaagtacggcgaaaaggtcaccttccacgtggagaaggggagcaaccccaactacctggcgctgttggtcaagtacgtcgacggcgacggtgacgttgtgggggtggacatcaaggagaagggtggcgacgcgtaccagcccctcaagcactcctggggcgctatctggaggaaggacagcgacaagccaatcaagtttcccgtcaccgtccaaatcaccaccgaaggaggcaccaagaccgcctatgaagacgtcatccccgaaggctggaaggccgacaccacctacaccgccaaataa

SEQ ID NO: 15771 - protein, 261 aa, Sorghum bicolor
  misc_feature: Useful for making plants with altered carbohydrate content
  misc_feature: Functional homolog of the protein sequence given in SEQ ID NO 13970
  misc_feature: Ceres ANNOT ID no. 8643669
  misc_feature (168)..(249): Pfam ID: Pollen_allerg_1 Pfam Description: Pollen allergen
  misc_feature (78)..(157): Pfam ID: DPBB_1 Pfam Description: Rare lipoprotein A (RlpA)-like double-psi beta-barrel
MSWSMQVALVVALAFLVGGAWCGPPKVAPGKNITATYGSDWLEAKATWYGKPTGAGPDDNGGACGYKDVNKAPFNSMGACGNLPIFKDGLGCGSCFEIKCDKPAECSGEAVVVHITDMNYEQIAAYHFDLAGTAFGAMAKKGEEEKLRKAGIIDMKFRRVKCKYGEKVTFHVEKGSNPNYLALLVKYVDGDGDVVGVDIKEKGGDAYQPLKHSWGAIWRKDSDKPIKFPVTVQITTEGGTKTAYEDVIPEGWKADTTYTAK

SEQ ID NO: 15772 - DNA, 1341 bp, Sorghum bicolor
  misc_feature: Ceres ANNOT ID no. 8643689
  misc_feature: Encodes the peptide sequence at SEQ ID NO 15773
atgagggagatcctccacatccagggcggccagtgcggcaaccagatcggggccaagttctgggaggtggtgtgcgccgagcacggcatcgacgccaccggccgctatggcggcgactccgacctccagctcgagcgcgtcaacgtctactacaacgaggcctcctgcggccgcttcgtgccccgcgccgtcctcatggacctggagcccggcaccatggactccgtccgctcggggccctacggccacatcttccgccccgacaacttcgtcttcggccagtccggagcaggcaacaactgggccaagggccactacaccgagggagccgagctcatcgactccgtgctcgacgtcgtgcgaaaggaggccgagaactgcgactgcctgcaaggcttccaggtgtgccactccctcggcggcggcaccgggtccggcatgggcacgctcctcatctccaagatccgcgaggagtaccccgaccggatgatgctcaccttctccgtcttcccctcgcccaaggtctccgacaccgtggtggagccctacaacgccacgctgtccgtgcaccagctcgtggagaacgcggacgagtgcatggtgctcgacaacgaggcgctctacgacatctgcttccgcacgctcaagctcaccaccccgagcttcggcgacctcaaccacctcatctccgccaccatgagcggcgtcacctgctgcctccgcttcccgggccagctcaactccgacctccgcaagctggccgtcaacctcatcccgttcccgcgcctgcacttcttcatggtcggcttcgcgccgctcacctcccggggctcccagcagtaccgcgccctgacggtcccggagctcacccagcagatgtgggacgccaagaacatgatgtgcgccgccgacccgcgccacggtcgctacctcacggcgtccgccatgttccgcggcaagatgagcaccaaggaggtggacgagcagatgctcaacgtgcagaacaagaactcctcctacttcgtggagtggatccccaacaacgtcaagtccaccgtgtgtgacatcccgcccacgggcctcaagatggcctccaccttcatcggcaactccacctccatccaggagatgttccgccgcgtcagcgagcagttcaccgccatgttccgcaggaaggccttcttgcactggtacacgggggagggcatggatgagatggagttcaccgaggccgagagcaacatgaacgacctcgtctccgagtaccagcagtaccaggacgccaccgccgacgaggagggcgagtacgaggacgaagaggaaggagacctccaggactag

SEQ ID NO: 15773 - protein, 446 aa, Sorghum bicolor
  misc_feature: Useful for making plants with modulated flowering time
  misc_feature: Functional homolog of the protein sequence given in SEQ ID NO 14090
  misc_feature: Ceres ANNOT ID no. 8643689
  misc_feature: Down-regulated in root tissues in response to methyl jasmonate treatment
  misc_feature: Down-regulated in shoot tissues in response to methyl jasmonate treatment
  misc_feature: Down-regulated in root tissues in response to aminocyclopropane carboxylic treatment
  misc_feature: Down-regulated in shoot tissues in response to salicylic acid treatment
  misc_feature (45)..(244): Pfam ID: Tubulin Pfam Description: Tubulin/FtsZ family, GTPase domain
  misc_feature (246)..(383): Pfam ID: Tubulin_C Pfam Description: Tubulin/FtsZ family, C-terminal domain
MREILHIQGGQCGNQIGAKFWEVVCAEHGIDATGRYGGDSDLQLERVNVYYNEASCGRFVPRAVLMDLEPGTMDSVRSGPYGHIFRPDNFVFGQSGAGNNWAKGHYTEGAELIDSVLDVVRKEAENCDCLQGFQVCHSLGGGTGSGMGTLLISKIREEYPDRMMLTFSVFPSPKVSDTVVEPYNATLSVHQLVENADECMVLDNEALYDICFRTLKLTTPSFGDLNHLISATMSGVTCCLRFPGQLNSDLRKLAVNLIPFPRLHFFMVGFAPLTSRGSQQYRALTVPELTQQMWDAKNMMCAADPRHGRYLTASAMFRGKMSTKEVDEQMLNVQNKNSSYFVEWIPNNVKSTVCDIPPTGLKMASTFIGNSTSIQEMFRRVSEQFTAMFRRKAFLHWYTGEGMDEMEFTEAESNMNDLVSEYQQYQDATADEEGEYEDEEEGDLQD

SEQ ID NO: 15774 - DNA, 801 bp, Sorghum bicolor
  misc_feature: Ceres ANNOT ID no. 8643671
  misc_feature: Down-regulated in root tissues in response to methyl jasmonate treatment
  misc_feature: Down-regulated in shoot tissues in response to methyl jasmonate treatment
  misc_feature: Down-regulated in root tissues in response to aminocyclopropane carboxylic treatment
  misc_feature: Down-regulated in shoot tissues in response to salicylic acid treatment
  misc_feature: Encodes the peptide sequence at SEQ ID NO 15775
atgggagtgaacatgatgtcgtggtcgatgcaggtggcgttggtggtggcgctggcgtttctggtgggcggcgcatggtgcggtcctcccaaggttgccccgggcaagaacatcacggccacctacggcagcgactggctggaagcgaaggcaacatggtacggtaagccaacaggcgccggccccgacgacaacggcggcgcatgtggttacaaggatgtgaacaaggcccccttcaacagcatgggcgcgtgcggcaacctccccatcttcaaggacggcctcggctgcggctcctgctttgagatcaagtgtgacaagccggccgagtgctccggcgaggccgtggtggtgcacatcacggacatgaactacgagcaaatcgccgcctaccacttcgacctggccggcacggcgttcggcgccatggccaagaagggcgaggaggagaagctgcgcaaggcgggcatcatcgacatgaagttccgccgggtcaagtgcaagtacggcgaaaaggtcaccttccacgtggagaaggggagcaaccccaactacctggctctgttggtcaagtacgtcgacggcgacggtgacgttgtgggggtggacatcaaggagaagggtggcgacgcgtaccagcccctcaagcactcctggggcgctatctggaggaaggacagcgacaagccaatcaagtttcccgtcaccgtccaaatcaccaccgagggaggcaccaagaccgcctacgaagacgtcatccccgaaggctggaaggccgacaccacctacaccgccaaataa

SEQ ID NO: 15775 - protein, 266 aa, Sorghum bicolor
  misc_feature: Useful for making plants with altered carbohydrate content
  misc_feature: Functional homolog of the protein sequence given in SEQ ID NO 13970
  misc_feature: Ceres ANNOT ID no. 8643671
  misc_feature (173)..(254): Pfam ID: Pollen_allerg_1 Pfam Description: Pollen allergen
  misc_feature (83)..(162): Pfam ID: DPBB_1 Pfam Description: Rare lipoprotein A (RlpA)-like double-psi beta-barrel
MGVNMMSWSMQVALVVALAFLVGGAWCGPPKVAPGKNITATYGSDWLEAKATWYGKPTGAGPDDNGGACGYKDVNKAPFNSMGACGNLPIFKDGLGCGSCFEIKCDKPAECSGEAVVVHITDMNYEQIAAYHFDLAGTAFGAMAKKGEEEKLRKAGIIDMKFRRVKCKYGEKVTFHVEKGSNPNYLALLVKYVDGDGDVVGVDIKEKGGDAYQPLKHSWGAIWRKDSDKPIKFPVTVQITTEGGTKTAYEDVIPEGWKADTTYTAK

SEQ ID NO: 15776 - DNA, 786 bp, Sorghum bicolor
  misc_feature: Ceres ANNOT ID no. 8643673
  misc_feature: Encodes the peptide sequence at SEQ ID NO 15777
atgtcgtggtcgatgcaggtggcgttggtggtggcgctggcgtttctggtgggcggcgcatggtgcggtcctcccaaggttgccccgggcaagaacatcacggccacctacggcagcgactggctggaagcgaaggcaacatggtacggtaagccaacaggcgccggccccgacgacaacggcggcgcatgtggttacaaggatgtgaacaaggcccccttcaacagcatgggcgcgtgcggcaacctccccatcttcaaggacggcctcggctgcggctcctgctttgagatcaagtgtgacaagccggccgagtgctccggcgaggccgtggtggtgcacatcacggacatgaactacgagcaaatcgccgcctaccacttcgacctggccggcacggcgttcggcgccatggccaagaagggcgaggaggagaagctgcgcaaggcgggcatcatcgacatgaagttccgccgggtcaagtgcaagtacggtgaaaaggtcaccttccacgtggagaaggggagcaaccccaactacctggctctgttggtcaagtacgtcgacggcgacggtgacgttgtgggggtggacatcaaggagaagggtggcgacgcgtaccagcccctcaagcactcctggggcgctatctggaggaaggacagcgacaagccaatcaagtttcccgtcaccgtccaaatcaccaccgagggaggcaccaagaccgcctacgaagacgtcatccccgaaggctggaaggccgacaccacctacaccgccaaataa

SEQ ID NO: 15777 - protein, 261 aa, Sorghum bicolor; identical to SEQ ID NO: 15771
  misc_feature: Useful for making plants with altered carbohydrate content
  misc_feature: Functional homolog of the protein sequence given in SEQ ID NO 13970
  misc_feature: Ceres ANNOT ID no. 8643673
  misc_feature (168)..(249): Pfam ID: Pollen_allerg_1 Pfam Description: Pollen allergen
  misc_feature (78)..(157): Pfam ID: DPBB_1 Pfam Description: Rare lipoprotein A (RlpA)-like double-psi beta-barrel

SEQ ID NO: 15778 - DNA, 963 bp, Sorghum bicolor
  misc_feature: Ceres ANNOT ID no. 8643723
  misc_feature: Encodes the peptide sequence at SEQ ID NO 15779
atggcggtacgactgtggtggtcgtcgtccttgtcctcccgcgccgtcgctgcagcgctgctgtgcctgctggtggctcacggcagcaactgcgccaagcattccggcggcaagagccacaagggtggaggtggacatgcccatgccgcgccgaccccgtctccgccggcggctcctccaccagccgtcgtctacccgacgccgcccaccactcctccgcctccgccggcaagcagcagcaacggcagtggtggtggtggtgggtggctgaacgcccgtgcgacatggtacggcgcccccaacggggcggggcccgacgacaatggtggcgcgtgcggcttcaagggcgtcaacctcccacctttctcggcgatgacgtcctgcggcaacgagccactcttcaaggacggcaaaggatgcggctcatgctaccagatccgttgcaaggcccaccctgcttgctccggcgtgccggagacggtgatcatcacggacatgaactactaccccgtggccccctaccacttcgacctcagcggcaccgccttcggagccatggccaaagacgaccgcaacgacgagctgcgccacgcaggcatcatcgacatccagttcaagagggttccctgccagtaccctggcctcaccgtcaccttccacatcgagcgcggctccaacccaaactacctggccgtgctcgtcgagtacggcaacggcgacggcgacgtcgtgcaggtcgacctcatggagtcccgcaccgacgacggcgagcccaccggcgtgtgggagcccatgcgcgagtcctggggctccatctggaggatggacacgcgacgcccgctgcagggacccttctcgctgcgcgtcaccaacgagtccggcaagacgctcgtcgccgaccaggtcatcccagccgactggcagccagacaacgtctacagctctatcgtccagttcgactga

SEQ ID NO: 15779 - protein, 320 aa, Sorghum bicolor
  misc_feature: Useful for making plants with altered carbohydrate content
  misc_feature: Functional homolog of the protein sequence given in SEQ ID NO 14064
  misc_feature: Useful for making plants with altered cell wall content and/or composition
  misc_feature: Functional homolog of the protein sequence given in SEQ ID NO 13995
  misc_feature: Ceres ANNOT ID no. 8643723
  misc_feature (217)..(304): Pfam ID: Pollen_allerg_1 Pfam Description: Pollen allergen
  misc_feature (126)..(205): Pfam ID: DPBB_1 Pfam Description: Rare lipoprotein A (RlpA)-like double-psi beta-barrel
MAVRLWWSSSLSSRAVAAALLCLLVAHGSNCAKHSGGKSHKGGGGHAHAAPTPSPPAAPPPAVVYPTPPTTPPPPPASSSNGSGGGGGWLNARATWYGAPNGAGPDDNGGACGFKGVNLPPFSAMTSCGNEPLFKDGKGCGSCYQIRCKAHPACSGVPETVIITDMNYYPVAPYHFDLSGTAFGAMAKDDRNDELRHAGIIDIQFKRVPCQYPGLTVTFHIERGSNPNYLAVLVEYGNGDGDVVQVDLMESRTDDGEPTGVWEPMRESWGSIWRMDTRRPLQGPFSLRVTNESGKTLVADQVIPADWQPDNVYSSIVQFD

SEQ ID NO: 15780 - DNA, 1446 bp, Sorghum bicolor
  misc_feature: Ceres ANNOT ID no. 8643714
  misc_feature: Encodes the peptide sequence at SEQ ID NO 15781
atggcggcgcgcctcctcctcacgcttctcctctgctccgtcgtcattactggcgcctcttcccgcaagaagaagactagcctggcagtggcagtgccagtggcaccaccaccagacggcccgccagacccttgcgccggccgccgcatccacatccgtcgcctccccgcgagcttcaacacgcagctgctcctctactgcggcagcggcagcggcagcggcacggcgttcccgctggcggacccaggtgactccaagtggtcagtgccggcgtgcgcctccctggccaaccacgggctgggcccgcgcacccacaacggcacccgttcctggtaccgcacggacgcccggctgctggagcccttcttccaccgccgcctgctggagcaccagtgcctggtgtcccgccccgcacaggccgacgccgtcttcctcccctactacgcggcgctggacgcgctgccctacgtcctccacccggacctcctcaactcctccgcgctccacggggtgccgctcgcgcgcttcctggcgcaccaccagccgcgggtcctcgcgcgccgccacggccacgaccacttcttcctcctcgccggcaccgcctgggactactcgcagccgcacgacgccgacccccgcctctacggcaccacgtcgctgctccgcctccccgacctcgccaacttcaccgtcctcaccctcgagtcgcgcgcctggccctggcaggagcacgccatcccgcacccgacctccttccacccgtcctcgctgccgcgcctccggtcctggatcgcccgcgcgcgccgctcccgacgcaccgcgctcatgctctacgccggcggcgtctccaggccgtccaggcccaacatccggggcgccatcctcgccgagtgcgccaaccgcaccacgtcgtcgcctgatgtgtgcaccgtcgtcgactgctccgccgccgcgtgcggcctcaaccccgtggcttacatgcggcccatgctcaaggccaacttctgcctgcagccgcccggggactcgccgtcccgccgctccacgttcgacgccatcgtcgccgggtgcatcccggtcttcttcgagcacgccgccgccagggcgcactacggctggcacctgccccgcgggaggtacgaccagttctcggtcaccatacccaaggagtcggtggtgatgggggacgtcaggatcgccgacgtgctggcggcggtgcccgaggacaaggtcgccaggatgcgggagcgcgtgctggagatggcgcccagggtggtgtaccggcggcacgggagcgccgcggaactgagagactccactagctatagggacgccgtcgacctcgccgtggagggcgtcctgaggaggatacggaggcgggtgagcgcgctggaggacgcccaaccggacgccatctacgagctggaggaggacgacgacgattag

SEQ ID NO: 15781 - protein, 481 aa, Sorghum bicolor
  misc_feature: Useful for making plants with altered cell wall content and/or composition
  misc_feature: Functional homolog of the protein sequence given in SEQ ID NO 14163
  misc_feature: Ceres ANNOT ID no. 8643714
  misc_feature (50)..(418): Pfam ID: Exostosin Pfam Description: Exostosin family
MAARLLLTLLLCSVVITGASSRKKKTSLAVAVPVAPPPDGPPDPCAGRRIHIRRLPASFNTQLLLYCGSGSGSGTAFPLADPGDSKWSVPACASLANHGLGPRTHNGTRSWYRTDARLLEPFFHRRLLEHQCLVSRPAQADAVFLPYYAALDALPYVLHPDLLNSSALHGVPLARFLAHHQPRVLARRHGHDHFFLLAGTAWDYSQPHDADPRLYGTTSLLRLPDLANFTVLTLESRAWPWQEHAIPHPTSFHPSSLPRLRSWIARARRSRRTALMLYAGGVSRPSRPNIRGAILAECANRTTSSPDVCTVVDCSAAACGLNPVAYMRPMLKANFCLQPPGDSPSRRSTFDAIVAGCIPVFFEHAAARAHYGWHLPRGRYDQFSVTIPKESVVMGDVRIADVLAAVPEDKVARMRERVLEMAPRVVYRRHGSAAELRDSTSYRDAVDLAVEGVLRRIRRRVSALEDAQPDAIYELEEDDDD

SEQ ID NO: 15782 - DNA, 822 bp, Sorghum bicolor
  misc_feature: Ceres ANNOT ID no. 8643724
  misc_feature: Encodes the peptide sequence at SEQ ID NO 15783
atggggtccctgtcctcgctctcctgcctgctagtggcggcaagggccgccgccgtctccctcctgctggcctattgcgccgccgccgccgtgaactacaacacgagcgatgccgccgccttgcagtggggcaacgccagggccacctggtacggccagcccaacggtgccgggccctacgacaacggcggcgcttgcgggttcaagaaggtgaaccagtacccgttcatggccatgacctcgtgcggcaaccagccgctgtaccgcgacggcaaaggctgcggttcctgctacaagatcaggtgctccagctccaagcacgccgcctgctccggccgcaccgagacggtggtgatcacggacatgaactacaccccgggcgtggcgccctaccacttcgacctcagcggcaccgccttcggcaagctggccaagcccggccgcaacgacgagctccgccgcgcggggatcatcgacatccagttcaccagggtgccctgcgagttcccgggcctcaaggtcggcttccacgtcgaggagggctccagccaggtctacttcgccgtgctggtcgagtacgagaacggagacggcgacgtcgtgcaggtggacctcatggagaagggcagcagccgccggtggacgcccatgcgccactcctggggatccatctggcgcctcgactccaaccaccgcctgcagccgcccttctccatccgcacccgaagcgactccggcaagacgctcgtcgcacgcgacgtcatcccactcaactggaggccaaacacattctacagatcaatcgtccagtactcgtcgtga

SEQ ID NO: 15783 - protein, 273 aa, Sorghum bicolor
  misc_feature: Useful for making plants with altered carbohydrate content
  misc_feature: Functional homolog of the protein sequence given in SEQ ID NO 13970
  misc_feature: Ceres ANNOT ID no. 8643724
  misc_feature (174)..(256): Pfam ID: Pollen_allerg_1 Pfam Description: Pollen allergen
  misc_feature (80)..(162): Pfam ID: DPBB_1 Pfam Description: Rare lipoprotein A (RlpA)-like double-psi beta-barrel
MGSLSSLSCLLVAARAAAVSLLLAYCAAAAVNYNTSDAAALQWGNARATWYGQPNGAGPYDNGGACGFKKVNQYPFMAMTSCGNQPLYRDGKGCGSCYKIRCSSSKHAACSGRTETVVITDMNYTPGVAPYHFDLSGTAFGKLAKPGRNDELRRAGIIDIQFTRVPCEFPGLKVGFHVEEGSSQVYFAVLVEYENGDGDVVQVDLMEKGSSRRWTPMRHSWGSIWRLDSNHRLQPPFSIRTRSDSGKTLVARDVIPLNWRPNTFYRSIVQYSS

SEQ ID NO: 15784 - DNA, 1503 bp, Sorghum bicolor
  misc_feature: Ceres ANNOT ID no. 8643787
  misc_feature: Encodes the peptide sequence at SEQ ID NO 15785
atggcggcggccatcctagcgcccaagccgcctccttcgctgcctacaagcgcctttccttcctccttcccctccccctcgcggctctgcctctccccgcggcatcccctgacaagattgctcctccgccccattccgtgcgcctcatcgccgtcctcctccgtcttgatgccggacccggacccggacctcgagcctgagcctgcccacgatagagatagagcccaagacgaggcgccggagtccaggccccgccgcatcgccctcttcgtcgagccttcgcccttcgcctacgtctccggctacaagaaccgcttccagaacttcatcaagtacctccgggagatgggcgacgaggtgattgtggtcaccacgcacgagggcgtgcctcaggaattccacggggccaagctaattggctcatggagcttcccttgcccctggtatcaaaaggttccgctgtcgctggccctcagtcctcgaatcatcggagaagttgctagattcaagcctgacattattcatgcctcttcccctgggataatggtatttggcgcgcttatcatagcaaagttgctctgcgtccctctggtaatgtcataccacacccacgttccaatttatatacccagatatacattcagctggcttgtcaagcccatgtggctaattataaaattcttgcaccgagctgcggacctcacgctggtaccatccgttgctatcggcagggatcttcaagctgcccatgttacagcagccaataaaatacgcctttggaacaagggtgttgactcagaaagcttccatcctcgttttcgcgatatggaaatgcgttcaaggctaacaaatggcaaaccagaaaagccacttatattttatgttgggcgcttaggagttgagaaaagcttggattttcttaagagagtcatggaccgacttccaggagcaaggatcgcatttattggagatggcccattcagggctgagcttgagcagatgttctcaggtatgccggcggtgttcacgggcacgttgcaaggggaagagctatcacaggcctatgccagcggggatgtgtttgtgatgccttccgagtcagagacgctgggttttgtggtgctggaggccatgtcatcgggaattccggtagtgggggctcgcgctggaggaattcctgatatcatacctgaggatcaggaggggaagaccagctttctgtacacaccaggggatgtggatgactgtgttggcaagatcgggcagcttctgtcaagcgaggagctgagggaggccatggggagggctgccaggaaggagatggagaagtttgactggcgagcagcaacgaggaagatccggaacgagcagtacagtgctgcgatctggttctggcgcaagaagagggcacagctgctgcgacccctccagtgggcgctgcggctgctgaggccgacaacgtctggggctgccattgccgatgccatggcgaagcaatcatag

SEQ ID NO: 15785 - protein, 500 aa, Sorghum bicolor
  misc_feature: Useful for making plants with altered carbohydrate content
  misc_feature: Functional homolog of the protein sequence given in SEQ ID NO 13732
  misc_feature: Ceres ANNOT ID no. 8643787
  misc_feature (86)..(453): SWISSPROT Homolog: EC 2.4.1.57 Phosphatidylinositol alpha-mannosyltransferase
  misc_feature (277)..(440): Pfam ID: Glycos_transf_1 Pfam Description: Glycosyl transferases group 1
MAAAILAPKPPPSLPTSAFPSSFPSPSRLCLSPRHPLTRLLLRPIPCASSPSSSVLMPDPDPDLEPEPAHDRDRAQDEAPESRPRRIALFVEPSPFAYVSGYKNRFQNFIKYLREMGDEVIVVTTHEGVPQEFHGAKLIGSWSFPCPWYQKVPLSLALSPRIIGEVARFKPDIIHASSPGIMVFGALIIAKLLCVPLVMSYHTHVPIYIPRYTFSWLVKPMWLIIKFLHRAADLTLVPSVAIGRDLQAAHVTAANKIRLWNKGVDSESFHPRFRDMEMRSRLTNGKPEKPLIFYVGRLGVEKSLDFLKRVMDRLPGARIAFIGDGPFRAELEQMFSGMPAVFTGTLQGEELSQAYASGDVFVMPSESETLGFVVLEAMSSGIPVVGARAGGIPDIIPEDQEGKTSFLYTPGDVDDCVGKIGQLLSSEELREAMGRAARKEMEKFDWRAATRKIRNEQYSAAIWFWRKKRAQLLRPLQWALRLLRPTTSGAAIADAMAKQS

SEQ ID NO: 15786 - DNA, 1758 bp, Sorghum bicolor
  misc_feature: Ceres ANNOT ID no. 8643789
  misc_feature: Encodes the peptide sequence at SEQ ID NO 15787
atggcggccatggccagtggaggagatgagacgacgacgacgacgcttgacgggacgacggatcactccggcaagccggcggtgcggagcaagacggggacgtggcgcgcgtgccctttcatcctgggcaacgagtgctgcgagcgcctggcctactacggcatgagctccaacctcgtcaactacatgatcgaccgcctccaccaggggaacgccgccgccgccaacaacgtcagcaactggtccggcacctgctacgtcatgcccctcctcggcgccttcctggccgacgcctacctcggcaggtaccgcaccatcgccgccttcatggcgctctacatcctcggcctcacgctgctcaccatgagcgccgccgtcccgggcctcaggccgccgcccgacggagcaggcgccgtgaccgcgggccagagcgccgccttcttcgtggcgctctacctcatcgcggtgggcacgggaggcatcaagccctgcgtctcatccttcggcgccgaccagttcgacgacgccgacccgcgcgagcgccagagcaagagctccttcttcaactggttctacatgtccatcaacgtcggcgcactcctcgcctcctccgtgctcgtctgggtccagatgaacgtcggctggggatggggctttggcatccccgccgccgccatggccgtcgccgtcgccagcttcctgatggggagcaagctgtacaggcaccagaagccggggggcagcccgctcacgcggatgctgcaggtggtggtcgccgcctggaggaagggaaagcagcccgtgcccgcggacgcgtccctgctccacgaggcgtcctccgcctccgcgtccgccatccagggcagcaggaagctggagcacacggagcagttccggtggctggacagggcggcggtggtgacctccaccgatgaggacggcaagaacaaccccgacccctggcggctgtgcacggtgacgcaggtggaggagctcaagagtgtcatccgtcttctgccggtgtgggcgagcggcatcgtcatgtcggcggtgtacagccagatgagcaccatgttcgtgctgcagggcaacacgctggacccgcgcatgggctccggcgccggcgccttcaagatcccctccgcctcgctctccatcttcgacaccctcagcgtcatcgcctgggcgcccgcctacgaccgactcgtcgtccccgccgcgcgccgctggacggggcacccgcgcggcttcacgcagctccagcgcatgggcatcggcctcgccgtctccgtcctgtccatgctcgccgcgggggcgctggaggtggccaggctccgcgtcgccgcctcgcacggcatgctcgacgactccaccaactacctgcccatctccatcttctggcaggtgccgcagtacttcatcatcggagccgcagaggtgttcaccttcatcggccagatcgagttcttctacgaccaggcgccggacgccatgaggagcatgggcaccgcgctctcgctcacctcgtccgcgctcggcagctacctcagcgcgctgctggtgtccgtcgtcaccgccatcaccacgaggaacggcggcctcggctggatccccgacaacctcaaccggggccacctcgactacttcttctggctgctctccgtgctcagcgtcatcaacttcgtcgtctacctctggattgcaaagtggtacaggtacaagcaggcaaccacaagttatgaactcagcagtgtatag

SEQ ID NO: 15787 - protein, 585 aa, Sorghum bicolor
  misc_feature: Useful for making plants with altered carbon content
  misc_feature: Useful for making plants with altered nitrogen content
  misc_feature: Functional homolog of the protein sequence given in SEQ ID NO 14117
  misc_feature: Ceres ANNOT ID no. 8643789
  misc_feature (103)..(510): Pfam ID: PTR2 Pfam Description: POT family
MAAMASGGDETTTTTLDGTTDHSGKPAVRSKTGTWRACPFILGNECCERLAYYGMSSNLVNYMIDRLHQGNAAAANNVSNWSGTCYVMPLLGAFLADAYLGRYRTIAAFMALYILGLTLLTMSAAVPGLRPPPDGAGAVTAGQSAAFFVALYLIAVGTGGIKPCVSSFGADQFDDADPRERQSKSSFFNWFYMSINVGALLASSVLVWVQMNVGWGWGFGIPAAAMAVAVASFLMGSKLYRHQKPGGSPLTRMLQVVVAAWRKGKQPVPADASLLHEASSASASAIQGSRKLEHTEQFRWLDRAAVVTSTDEDGKNNPDPWRLCTVTQVEELKSVIRLLPVWASGIVMSAVYSQMSTMFVLQGNTLDPRMGSGAGAFKIPSASLSIFDTLSVIAWAPAYDRLVVPAARRWTGHPRGFTQLQRMGIGLAVSVLSMLAAGALEVARLRVAASHGMLDDSTNYLPISIFWQVPQYFIIGAAEVFTFIGQIEFFYDQAPDAMRSMGTALSLTSSALGSYLSALLVSVVTAITTRNGGLGWIPDNLNRGHLDYFFWLLSVLSVINFVVYLWIAKWYRYKQATTSYELSSV

SEQ ID NO: 15788 - DNA, 1167 bp, Sorghum bicolor
  misc_feature: Ceres ANNOT ID no. 8643782
  misc_feature: Encodes the peptide sequence at SEQ ID NO 15789
atggccgtggccggagccaacgcgtcctgctccatagccgccggagcctgcccgtcgtcatccggatcctcctcacttttccctcaccaccgtcctagtcgtcctcggcgccacggccgcataggcatagcaaccatcatgtgcaccagcagcagcatgcacgggtacggctatgatagcagctcccttccgtccttgtccctgccattcccaatcccagcgccgcgcggcgtcaccagcaccggcagtggcagccgtttgcgcatcttctccggcagcgccaacccggtgctggcgcaggagatcgcgtgctaccttgggatggagctgggcaagatcaagatcaagcggttcgcggacggcgagatctacgtgcagctgcaggagagcgtgcgcggctgcgacgtgttcctggtgcagcccacctgccctccagccaacgagaacctcatggagctcctcatcatgatcgacgcctgccggagggcctccgccaagaacatcaccgccgtcatcccctacttcggctacgccagggctgacaggaagatgcagggccgcgagtccatcgccgccaagctggtggccaacctcatcacggaggccggcgcccaccgcgtgctggcctgcgatctccactcgggccagtccatcggctacttcgacatccccgtggaccacgtctacggccagcccgtcatcctcgactacctggccagcaagaccatctgccccaacgacgtcgtggtggtgtcgccggacgtgggaggggtggccagggcgcgcgccttcgccaagaagctctccgacgcgccgctggccatagtcgacaagaggcgccagggacacaaccaggccgaggtggtgaacctcatcggtgatgtcaggggaaaggttgccgtcatggtggacgacatgatcgacacggccgggaccatctccaagggcgccgagctgttgcacaaggagggagcgcgagccgtgtacgcctgcagcacccacgcggtcttcagcccaccggcgctgcagaggctctccagcggcctcttccaggaggtgatcatcaccaacaccgtgccgctcaccgtcctctccgtcgccaacctcctcggcgagaccatctggcgtgttcacgacgattgctccctcagcagcatcttcaagtga

SEQ ID NO: 15789 - protein, 388 aa, Sorghum bicolor
  misc_feature: Useful for making plants with modulated biomass
  misc_feature: Functional homolog of the protein sequence given in SEQ ID NO 13893
  misc_feature: Ceres ANNOT ID no. 8643782
  misc_feature: Down-regulated in shoot tissues in response to salicylic acid treatment
  misc_feature (85)..(388): SWISSPROT Homolog: EC 2.7.6.1 Ribose-phosphate diphosphokinase
  misc_feature (222)..(355): Pfam ID: Pribosyltran Pfam Description: Phosphoribosyl transferase domain
MAVAGANASCSIAAGACPSSSGSSSLFPHHRPSRPRRHGRIGIATIMCTSSSMHGYGYDSSSLPSLSLPFPIPAPRGVTSTGSGSRLRIFSGSANPVLAQEIACYLGMELGKIKIKRFADGEIYVQLQESVRGCDVFLVQPTCPPANENLMELLIMIDACRRASAKNITAVIPYFGYARADRKMQGRESIAAKLVANLITEAGAHRVLACDLHSGQSIGYFDIPVDHVYGQPVILDYLASKTICPNDVVVVSPDVGGVARARAFAKKLSDAPLAIVDKRRQGHNQAEVVNLIGDVRGKVAVMVDDMIDTAGTISKGAELLHKEGARAVYACSTHAVFSPPALQRLSSGLFQEVIITNTVPLTVLSVANLLGETIWRVHDDCSLSSIFK

SEQ ID NO: 15790 - DNA, 1209 bp, Sorghum bicolor
  misc_feature: Ceres ANNOT ID no. 8643801
  misc_feature: Down-regulated in shoot tissues in response to salicylic acid treatment
  misc_feature: Encodes the peptide sequence at SEQ ID NO 15791
atggcgattccgccgcggactcctcccccgccgccatcgtggtcgcgctacgtcaccgagaccgtgaaggggtcccaccagttcaccgtccggggcttctccctcgccaagggcatgggccccggccgccacctcgccagcgacatcttcgctgtcggaggataccactgggccgtctacttctaccccgacggcaagaacgccgaggacaactccaactacgtctccgtcttcgtcgccctcgcctccgacggcatcgacgtccgagccctcttcgacctcaccctcctcgaccagtccggccgcggccgccacaagattcactcgcactttggccgcaagctagattccggcccatacaccctcaagtacaggggctccatgtggggttacaaacgcttctacaaaagatcactcttggaagcatctgatttcttaaagaatgattgcctagtgatgaactgcacagtaggtgttgtcaagaaccgtatggaaacaccaaaggacatccagattcatgttccacgatcagacatgggccactgcttcaaggagctcctcagccgcggcattggatgtgacataaccttcgaagtgcgcgacgagaaagtcagggcacacaagtggattcttgctgctcgctccccagtatttaaagcccagttctttggtcctattggaaagcctgacctgcacacggttgtcgtggaggatgtggaacctgtcgtcttcaaggcaatggtgaacttcatgtacactgatgaactccccagcatttctgagctagctggatctgcctcaacatggacatcaacagtagtagtacagcatttgttggcagcagctgatagatatggactggaccgtcttcgtatcctgtgtgaatcaaagctatgtgatgaactgactcctgaaactgtcgcaacaaccttagcccttgctgaacaacaccattgcgctgagctgaagtctgcctgtctaaggtttgctgctgtgcgagaaaatttgggagctgttatggggacggaaggctttgattacttggaagagacatgcccgtccctactatccgacttgttagctactgtggcagaagtggacgatgatcctgcatcccttgaccgaaaaaggggagtttgcggtaaccaagtcttggctccagtggaaagtgtcgaggctactgaaaggcgcacccggaggaggctttag

SEQ ID NO: 15791 - protein, 402 aa, Sorghum bicolor
  misc_feature: Useful for making plants with modulated biomass
  misc_feature: Functional homolog of the protein sequence given in SEQ ID NO 12898
  misc_feature: Ceres ANNOT ID no. 8643801
  misc_feature (47)..(161): SWISSPROT Homolog: EC 3.1.2.15 Ubiquitin thiolesterase
  misc_feature (183)..(302): Pfam ID: BTB Pfam Description: BTB/POZ domain
MAIPPRTPPPPPSWSRYVTETVKGSHQFTVRGFSLAKGMGPGRHLASDIFAVGGYHWAVYFYPDGKNAEDNSNYVSVFVALASDGIDVRALFDLTLLDQSGRGRHKIHSHFGRKLDSGPYTLKYRGSMWGYKRFYKRSLLEASDFLKNDCLVMNCTVGVVKNRMETPKDIQIHVPRSDMGHCFKELLSRGIGCDITFEVRDEKVRAHKWILAARSPVFKAQFFGPIGKPDLHTVVVEDVEPVVFKAMVNFMYTDELPSISELAGSASTWTSTVVVQHLLAAADRYGLDRLRILCESKLCDELTPETVATTLALAEQHHCAELKSACLRFAAVRENLGAVMGTEGFDYLEETCPSLLSDLLATVAEVDDDPASLDRKRGVCGNQVLAPVESVEATERRTRRRL

SEQ ID NO: 15792 - DNA, 987 bp, Sorghum bicolor
  misc_feature: Ceres ANNOT ID no. 8643830
  misc_feature: Encodes the peptide sequence at SEQ ID NO 15793
atggcgccctgcaccatgatcatggcgagcgttgcagctgtgctcgtcgtcctttcgtcggctgccgccgcagggctggacatggatttctacagcagcacgtgcccgcgcgtggaggccatcgtcaaggaggagatgacggagatcctcaaggtgtcgccgacgctcgccggcccgctgctccgcctccatttccacgactgcttcgtcaggggctgcgacggctccgtgctactggactcgacccctagcagcacgtcggagaaggacgcgaccccgaacctcaccctgcggggcttcggctccgtgcagcgcgtcaaggacaagctagagcaggcgtgcccgggcaccgtctcgtgcgccgatgtcctggcgctcatggcgcgcgacgccgtcgtgcttgccaacggcccgtcctggcccgtcgcgctgggccgccgcgacggccgcgtctccatctccaacgagaccaaccagcttcccccgcccaccgccaacttcacccgcctcgtccagatgttcgccgccaagggcctctccgtcaaggacctcgtcgtgctctccggcggccacaccctcggcaccgcgcactgcaacctcttcagcgaccgcctctacaacttcacgggcgccaacaacctcgccgacgtcgacccggcgctcgacgccacctacctcgcccgcctcaggtccaggtgccggagcctcgccgacaacaccacgctcaacgagatggaccccggcagcttcctcagcttcgacgccagctactaccgcctcgtcgcaaagcgccggggactcttccactccgacgccgcgctgctcaccgacccggccaccagggcctacgtccagcgccaggccacgggactcttcgccgccgagttcttccgcgacttcgccgactccatggtcaagatgtccaccatcgacgtgctcaccggcgcgcagggagagatcagaaacaaatgctacctcgtcaactga

SEQ ID NO: 15793 - protein, 328 aa, Sorghum bicolor
  misc_feature: Useful for making plants with altered carbohydrate content
  misc_feature: Functional homolog of the protein sequence given in SEQ ID NO 13757
  misc_feature: Useful for making plants with modulated nitrogen use efficiency
  misc_feature: Functional homolog of the protein sequence given in SEQ ID NO 13758
  misc_feature: Useful for making plants with altered cell wall content and/or composition
  misc_feature: Functional homolog of the protein sequence given in SEQ ID NO 14262
  misc_feature: Useful for making plants with modulated phosphate use efficiency
  misc_feature: Functional homolog of the protein sequence given in SEQ ID NO 13134
  misc_feature: Ceres ANNOT ID no. 8643830
  misc_feature (26)..(328): SWISSPROT Homolog: EC 1.11.1.7 Peroxidase
  misc_feature (42)..(290): Pfam ID: peroxidase Pfam Description: Peroxidase
MAPCTMIMASVAAVLVVLSSAAAAGLDMDFYSSTCPRVEAIVKEEMTEILKVSPTLAGPLLRLHFHDCFVRGCDGSVLLDSTPSSTSEKDATPNLTLRGFGSVQRVKDKLEQACPGTVSCADVLALMARDAVVLANGPSWPVALGRRDGRVSISNETNQLPPPTANFTRLVQMFAAKGLSVKDLVVLSGGHTLGTAHCNLFSDRLYNFTGANNLADVDPALDATYLARLRSRCRSLADNTTLNEMDPGSFLSFDASYYRLVAKRRGLFHSDAALLTDPATRAYVQRQATGLFAAEFFRDFADSMVKMSTIDVLTGAQGEIRNKCYLVN

SEQ ID NO: 15794 - DNA, 948 bp, Sorghum bicolor
  misc_feature: Ceres ANNOT ID no. 8643804
  misc_feature: Encodes the peptide sequence at SEQ ID NO 15795
atggccaagtactactggggtatgctgggcgccgcaaggacgacgaccggcggcgctggcgcagcgactagtagcctcatcaggtcaagctggcctccaccagcagcgcatggccgcagcggcggcgagccgtcgtgggaggagctggctttcgcccgggacgcggcggggcaactcggcggctgcgtgtggccgccgcgctcctacacgtgcaccttctgccgccgagagttccggtccgcgcaggcgctcggcggccatatgaacgtgcaccgccgcgaccgggctcgacttcggcagtgcgcctccccgtcgtccccgccggatcatgaccaggagccgatagccgcgcctcttccaacgccggaattggcggatcaccaccagcttctgcaactgcagggatctcccttgttcaggacaaccaaggcggcagtattaatctctggccgccctgcttgtgatcatcatcaccaaaattattacaatgataacagggaggaggaggaggaggaggaggaggaggaggaggaggctgtgattaccaccacttgtcctcggtacatatcaacgaccatcatcaaggagagcaagagcaaggtagtcatctccatacctgcatcaacagcggcggcggggagcatcaaagaaaccgctatagcaatcatcggtgaggaggaggaggaggaggaagaggagatcatgttggcggggaggagaaagcgaaggcgactagtttcacagccaccagagccggcgtttacatcgccgccgttctacgacctgcggcttgtggcggcatcatcacccaaaggaggagttgagcatgatgcgaaggtacccaacaataaagtaaccagtacaagccctagtagcctcagtccactgcatcatcttgcaggccggcaagaagaagtggatctggagctcaggcttggcactagctag

SEQ ID NO: 15795 - protein, 315 aa, Sorghum bicolor
  misc_feature: Useful for making plants with altered terpenoid content
  misc_feature: Functional homolog of the protein sequence given in SEQ ID NO 13159
  misc_feature: Ceres ANNOT ID no. 8643804
MAKYYWGMLGAARTTTGGAGAATSSLIRSSWPPPAAHGRSGGEPSWEELAFARDAAGQLGGCVWPPRSYTCTFCRREFRSAQALGGHMNVHRRDRARLRQCASPSSPPDHDQEPIAAPLPTPELADHHQLLQLQGSPLFRTTKAAVLISGRPACDHHHQNYYNDNREEEEEEEEEEEEAVITTTCPRYISTTIIKESKSKVVISIPASTAAAGSIKETAIAIIGEEEEEEEEEIMLAGRRKRRRLVSQPPEPAFTSPPFYDLRLVAASSPKGGVEHDAKVPNNKVTSTSPSSLSPLHHLAGRQEEVDLELRLGTS

SEQ ID NO: 15796 - DNA, 1035 bp, Sorghum bicolor
  misc_feature: Ceres ANNOT ID no. 8643832
  misc_feature: Encodes the peptide sequence at SEQ ID NO 15797
atggccgcggcagcagcggcgaccaccgccaccaccaggactgcacctcgtcccatggtggccgtagcagtgctaatagtcgtcctgtgtgctacatcagttgccgggcaggggcagctccagctccaggtcggctactacaacaagacgtgcccggcggcggagcagatcgtgcgcaacgagacgacggccgccatccaggcctcgccggacctcgccgccgcgctcctcaggctgcactaccacgactgcttcgtccaggggtgcgacgcgtccgtgctgctggactcgacgcccaacaacacggcggagaaggattcgctgcccaacggcagcctccgcggcttcgacgtcgtggcgcgggtcaaggaccagctggagacggcgtgcccgggcaccgtctcctgcgcggacatcctggcgctcatggcgcgcgacgccgtctcgctggccaagggccctacctggcccgtcgcgctgggccgccgcgacggccgcacctccagcgccgccagctgcggggagctcccgccgctgcacggcgacatcgggctcatggtgcaggcgttcgccgccaagggcctcgacgtcaaggacctcgccgtgctgtcgggggcgcacacgctggggaaggcgcactgctcgtcctacgccgaccgcctctacgcctccgccagctgcgccacgcccgacccggcactcgacgcgcgctacgccgccaggctgcggatgcgctgccccagcgctggcgacggcaacaacgctacggcggcgtcggagctcgaccccggcagctgcaccaccttcgacaccagctactaccgccacgtcgcgcggaggcgcggcctgctccgctccgacgcctcgctgctggaccaccgcttcaccagggcctacgtgctgcaggtcgcctccggcaggatcgacggccactacttccacgatttcaccgtctccatggccaagatggcggccatcggtgtgctcaccggcgaccagggcgagatcaggagaaagtgcaacgtcgtcaactga

SEQ ID NO: 15797 - protein, 344 aa, Sorghum bicolor
  misc_feature: Useful for making plants with altered carbohydrate content
  misc_feature: Functional homolog of the protein sequence given in SEQ ID NO 13757
  misc_feature: Useful for making plants with modulated nitrogen use efficiency
  misc_feature: Functional homolog of the protein sequence given in SEQ ID NO 13758
  misc_feature: Ceres ANNOT ID no. 8643832
  misc_feature (46)..(344): SWISSPROT Homolog: EC 1.11.1.7 Peroxidase
  misc_feature (58)..(306): Pfam ID: peroxidase Pfam Description: Peroxidase
MAAAAAATTATTRTAPRPMVAVAVLIVVLCATSVAGQGQLQLQVGYYNKTCPAAEQIVRNETTAAIQASPDLAAALLRLHYHDCFVQGCDASVLLDSTPNNTAEKDSLPNGSLRGFDVVARVKDQLETACPGTVSCADILALMARDAVSLAKGPTWPVALGRRDGRTSSAASCGELPPLHGDIGLMVQAFAAKGLDVKDLAVLSGAHTLGKAHCSSYADRLYASASCATPDPALDARYAARLRMRCPSAGDGNNATAASELDPGSCTTFDTSYYRHVARRRGLLRSDASLLDHRFTRAYVLQVASGRIDGHYFHDFTVSMAKMAAIGVLTGDQGEIRRKCNVVN

SEQ ID NO: 15798 - DNA, 1398 bp, Sorghum bicolor
  misc_feature: Ceres ANNOT ID no. 8643813
  misc_feature: Encodes the peptide sequence at SEQ ID NO 15799
atggcgcctgccgggcggctcctcgcggtagccgccctctccttcctctgtttgcaggggctgtggggcgattcaggcagcgcattggctcagagccagccgccgcttcaccggatcgttcgcgcagaggcaaatgacggcggcggcggcggcctcatgccggagctcccgcccagtggcttcatgcccatgccggacctctcaccctcacccagcggctccccgaggccatttgttcccttcctggctcccgcaccactcgcgcccttctttaacaacagcacgccaaagctctcagggaaatgcacactcaactttaccgctgtcgacaaactcatgaccaccacggctgtcgactgcttcacctcgtttgcacctttcttggccaatgtcatctgctgcccgcagcttcaggcaacactgaccatcctcatagggcagtctagcaagcagacagggtctctcgcattggatcccacggtggccaactactgcctgtcggatgtccaggagctgttgttgagccaaggcgccagtgataatctccatagcctttgctcggttcacctctcgaatgtaactgaggggtcctgccctgttagcactgtggattcgtttgagagcgtcgttgattcgtccaagctccttgaggcctgtcggaagatcgactctgttaatgagtgctgcagccagacatgccagaatgcgataaatgaagctgcccagaaaatctcgtctaaggatggaggtttgacgacctaccctgggagccccaaggttgacagttgcaggaacgtagttctgagatggttgtcaagcaggcttgacccacagtccgcgaaggaaatgttgaggcagatatctaactgtaatgtcaatggagtttgtccgctaagttttccagacacaagtaaggtggcaaaagagtgtggtggaacgatgaagaacagtactgcatgttgcaaggctatgttaacttatgtagcccatttgcaaaagcaaagcttcataacaaacttgcaagctttaaattgtgcttctttccttggggcaaagttgcaaaagatgaatgttagcacgaatgtctatagctcttgtcaaataacactaaaagatttttcacttcaagaatctggatgcctccttccaagtatgccctctgatgcatctttcgacagcacttctgggattagcttcacatgtgatctgaatgacaacattgctgctccatggccatcttccatgcaagcaccatcttcatcatgcaacaagtctgtcaatatcccagagcgacccgctgcgacatcggcacaaaatggtgtgaaccacaagaacctgaagctaaggctgcttgcttctttggtctcccttcttctggtgctcttggtacaagtttag

SEQ ID NO: 15799 - protein, 465 aa, Sorghum bicolor
  misc_feature: Useful for making plants with altered carbohydrate content
  misc_feature: Functional homolog of the protein sequence given in SEQ ID NO 14270
  misc_feature: Ceres ANNOT ID no. 8643813
  misc_feature: Down-regulated in shoot tissues in response to aminocyclopropane carboxylic treatment
  misc_feature: Down-regulated in shoot tissues in response to salicylic acid treatment
MAPAGRLLAVAALSFLCLQGLWGDSGSALAQSQPPLHRIVRAEANDGGGGGLMPELPPSGFMPMPDLSPSPSGSPRPFVPFLAPAPLAPFFNNSTPKLSGKCTLNFTAVDKLMTTTAVDCFTSFAPFLANVICCPQLQATLTILIGQSSKQTGSLALDPTVANYCLSDVQELLLSQGASDNLHSLCSVHLSNVTEGSCPVSTVDSFESVVDSSKLLEACRKIDSVNECCSQTCQNAINEAAQKISSKDGGLTTYPGSPKVDSCRNVVLRWLSSRLDPQSAKEMLRQISNCNVNGVCPLSFPDTSKVAKECGGTMKNSTACCKAMLTYVAHLQKQSFITNLQALNCASFLGAKLQKMNVSTNVYSSCQITLKDFSLQESGCLLPSMPSDASFDSTSGISFTCDLNDNIAAPWPSSMQAPSSSCNKSVNIPERPAATSAQNGVNHKNLKLRLLASLVSLLLVLLVQV

SEQ ID NO: 15800 - DNA, 1071 bp, Sorghum bicolor
  misc_feature: Ceres ANNOT ID no. 8643833
  misc_feature: Down-regulated in shoot tissues in response to aminocyclopropane carboxylic treatment
  misc_feature: Down-regulated in shoot tissues in response to salicylic acid treatment
  misc_feature: Encodes the peptide sequence at SEQ ID NO 15801
atggccagcgtcaccgcagcagcaagagcagcggcggcggtgctgctcctggttgtggcggcgccgtcggcggacgcccacttggcgatgggcgcgtacaacaagacgtgcccgcaggcggaggacgtggtgttgaaggagatgacgtccatggtggccaagtcgccggacgtggcgggcgccgtgctccggctcttctccgtggactgcttcgtgggcggctgcgagggctccatcctgctcgactccacacccggcaacaccgccgagaaggacgcgccgctgaaccagggagtccgcggctacgaggtggtggacgccatcaaggccaagctcgacgccgcttgccccgccgtcgtctcctgcgccgacacgctcgccctcgccgcgcgtgactccgtcaggctgacgaaaggcccgttcatcccgctcccgactggccggagggacggcaacaggtcggtggccgccgacgtggccctgaactcgccgccgccgggcgccaacatcaccgacatcatcgccctgtttgctacaaagttcaacctcaccgccaaggacgtcgctgtcctctccggcgcacacacaatcgggaaggcgaggtgctcgacgaacggcgcgtcggaccccacgctggacgccaactacacggccaccctccgcgggcagtgcaagcccggcgacaacgccaccctcgtctacctcgaccctcccacgccgacgaccttcgacaccgactactacgccctcgtcgccggcaacaagggcctcctttccaccgacgccgccctcctcctcgacgccaccaccagcgcctacgtcgcgcgccaggccaacgccaccgccaccgcggccgcggcgagcgagttcttcgccgacttcgcaacgtccttcgtcgccatgagcaagctcggcgtgctcacgcaccacaacggcgagatcaggcaggtctgctccaaggtcaacccgccgtcgccgtccagcagtaccagcaccgctgctgcccagctgaccgctaccggtgggttggcagtggcactactcgctctcgctgtggctctcgtgctctaa

SEQ ID NO: 15801 - protein, 356 aa, Sorghum bicolor
  misc_feature: Useful for making plants with altered carbohydrate content
  misc_feature: Functional homolog of the protein sequence given in SEQ ID NO 13714
  misc_feature: Useful for making plants with altered cell wall content and/or composition
  misc_feature: Functional homolog of the protein sequence given in SEQ ID NO 13958
  misc_feature: Ceres ANNOT ID no. 8643833
  misc_feature (33)..(256): SWISSPROT Homolog: EC 1.11.1.7 Peroxidase
  misc_feature (44)..(280): Pfam ID: peroxidase Pfam Description: Peroxidase
MASVTAAARAAAAVLLLVVAAPSADAHLAMGAYNKTCPQAEDVVLKEMTSMVAKSPDVAGAVLRLFSVDCFVGGCEGSILLDSTPGNTAEKDAPLNQGVRGYEVVDAIKAKLDAACPAVVSCADTLALAARDSVRLTKGPFIPLPTGRRDGNRSVAADVALNSPPPGANITDIIALFATKFNLTAKDVAVLSGAHTIGKARCSTNGASDPTLDANYTATLRGQCKPGDNATLVYLDPPTPTTFDTDYYALVAGNKGLLSTDAALLLDATTSAYVARQANATATAAAASEFFADFATSFVAMSKLGVLTHHNGEIRQVCSKVNPPSPSSSTSTAAAQLTATGGLAVALLALAVALVL

SEQ ID NO: 15802 - DNA, 1140 bp, Sorghum bicolor
  misc_feature: Ceres ANNOT ID no. 8643902
  misc_feature: Encodes the peptide sequence at SEQ ID NO 15803
atggccggtgccggcggcggtgaagcggcggacgtcgtggggggcggcgagtggcccttcacggccgacgacgcgtactacgctgactcctcggcgatattcgcggagctcgccgggtgctgggccgccggcggcggcgggacgacgacggaggagctgatgatgtcgatgatgctgccgccgctggatccgccggaggatcatcatgccacgccaccgccgccgccctgcttggcgtcgacgccgacgcgtgccgtgtcggtggacggcggcggcgcgtcgtcggccagctccaccgacgacggtgccgccgccgccgccgccgcgcaggaagaggaggaggaggacgacgacgacgacggggcgccggcggccgccgcagccaccgaggcagcgagcaagccgccggcgccggggaagacgacgaagtcgtcggcggcggggcagaagcgggcgcggcagccgcggttcgcgttcatgaccaagagcgacgtggaccacctggaggacggataccgatggaggaagtacggacagaaggccgtcaagaacagccccttccccaggagctactaccggtgcaccaacagcaagtgcacggtgaagaagcgggtggagcggtcctccgacgacccctccgtcgtcgtcaccacctacgagggccagcactgccaccacaccgtcgccttcccgcgcgcccaccacctccacgccgccctcgccgccgccggccaccaccacatgccattcaatttctctgccgccgcgcaccaccaccacctctacggcaccaccagcggcgtcgtcaccgaccacggccacctgccgccgctgcttctcccgacgacacccgcgcctcagcacaacgctctcaacgacagcgacaacaacggctcgccgctcgcctgcaggacgtcgacgacgacgtcgtcgctgctaaggccactcgactgcaaccaccaggagcttctgctggcggcggcagcgagctaccccttgtcgtcctcagctgcgatgtcgtcgatgccagtgccttccatgtcaacgacgacgacgacatcgttgccgccgccggctagcagtgccgtcgacaaggggcttcttgacgacatggtgccgccggcgatgaggcatggatag

SEQ ID NO: 15803 - protein, 379 aa, Sorghum bicolor
  misc_feature: The sequence is a functional homolog of SEQ ID NO 86 in the 10/412,699 US patent application
  misc_feature: The sequence is a functional homolog of SEQ ID NO 114 in the 11/375,241 US patent application
  misc_feature: The sequence is a functional homolog of SEQ ID NO 146 in the 10/286,264 US patent application
  misc_feature: The sequence is a functional homolog of SEQ ID NO 2500 in the 10/374,780 US patent application
  misc_feature: The sequence is a functional homolog of SEQ ID NO 672 in the 10/412,699 US patent application
  misc_feature: The sequence is a functional homolog of SEQ ID NO 202 in the 10/714,887 US patent application
  misc_feature: The sequence is a functional homolog of SEQ ID NO 202 in the 11/435,388 US patent application
  misc_feature: Ceres ANNOT ID no. 8643902
  misc_feature (168)..(227): Pfam ID: WRKY Pfam Description: WRKY DNA -binding domain
MAGAGGGEAADVVGGGEWPFTADDAYYADSSAIFAELAGCWAAGGGGTTTEELMMSMMLPPLDPPEDHHATPPPPPCLASTPTRAVSVDGGGASSASSTDDGAAAAAAAQEEEEEDDDDDGAPAAAAATEAASKPPAPGKTTKSSAAGQKRARQPRFAFMTKSDVDHLEDGYRWRKYGQKAVKNSPFPRSYYRCTNSKCTVKKRVERSSDDPSVVVTTYEGQHCHHTVAFPRAHHLHAALAAAGHHHMPFNFSAAAHHHHLYGTTSGVVTDHGHLPPLLLPTTPAPQHNALNDSDNNGSPLACRTSTTTSSLLRPLDCNHQELLLAAAASYPLSSSAAMSSMPVPSMSTTTTTSLPPPASSAVDKGLLDDMVPPAMRHG

SEQ ID NO: 15804 - DNA, 1404 bp, Sorghum bicolor
  misc_feature: Ceres ANNOT ID no. 8643903
  misc_feature: Encodes the peptide sequence at SEQ ID NO 15805
atggtgaagatctgctgcattggtgccggctacgtcggcggcccgtccatggccgtgatggcactcaagtgcccggccatcgaggtcaccgtcgtggacgtctcccggccgcgcatcgacgcctggaacagcgaccgcctcccggtgctggaaccgggcctggacaccatcgtcagggcctgccgcggccgcaacctctccttcagcgccgacgtggaccgccatgtcgccgacgccgacatcgtcttcgtgtccgtcaacacgcccaccaaggcgcgcggcctcggcaccggcagggcgcccgacctcgcctactgggagagcgcggcgcgcgtggtcgccgccgcgtcccgccccggcacgggcaagatcgtcgtcgagaagtccgccgtccccgtcaggaccgccgaggccatggagaggatcctgcatgcgcatgccggagacggcgcgttccaggtcctctccaacccggagttcttctccgagggcaccgccgtgcgggacctgctgtgccccgaccgcgtggtcatcggcggcggggacaccgacgtgggcgccgtgcgcgcgctggtggacgtgtacgcgcactgggtccccgaggatcggatcgtcaccacggggctccagtccgcggagctcgccaagctcgcggcgagcgcgctcctggcgcagcgagtgtcgtcggtgaacgcgctctccgcgctgtgcgaggccacgggcgccgacgtctcggacgtcgcgcgcgccgtcggcagcgacggccgcgtcgggggcggcggcagggggttcctggacgccggcgtcgggttcggcgggccgagcctccggcgagacgtgctgagcctggcgtacgactgcgagcgtcacggcctgcacgaggcggcggagtactggcggcaggtggtggccgtgaacgagtaccagaagggccggttcgtgcgccgcttggtggcgtccatgctcggcacggtggccggcaagaaggtggccgtgctcgggctcgcgttcaagaagggcgtgggggatacgagggagtcgccggcggtggacgtgtgccgggccctgctggccgagggggcccgagtcagcgtgtacgacccggtggtgagcgagacgcagataattcggcgggacacggcggcggcggcggcggaggtggaggtgacgagggacgcgtacgaggctgccgacggcgcgcatggcctctgcgtgctgacggagtgggacgagttcaggacgctcgactaccgccgggtgttcgacggcatgatgaggccggcgttcgtcttcgacggccgcaacgtcgtcgacgccggggagctcagggagatcggcttcgtcgtctactccgtcggcaagccgctggacgcctggctcaatggcatgccggcggtggcgtag

SEQ ID NO: 15805 - protein, 467 aa, Sorghum bicolor
  misc_feature: Useful for making plants with altered carbohydrate content
  misc_feature: Functional homolog of the protein sequence given in SEQ ID NO 14271
  misc_feature: Useful for making plants with altered cell wall content and/or composition
  misc_feature: Functional homolog of the protein sequence given in SEQ ID NO 14272
  misc_feature: Ceres ANNOT ID no. 8643903
  misc_feature (1)..(467): SWISSPROT Homolog: EC 1.1.1.22 UDP-glucose 6-dehydrogenase
  misc_feature (2)..(200): Pfam ID: UDPG_MGDP_dh_N Pfam Description: UDP-glucose/GDP-mannose dehydrogenase family, NAD binding domain
  misc_feature (331)..(439): Pfam ID: UDPG_MGDP_dh_C Pfam Description: UDP-glucose/GDP-mannose dehydrogenase family, UDP binding domain
  misc_feature (209)..(309): Pfam ID: UDPG_MGDP_dh Pfam Description: UDP-glucose/GDP-mannose dehydrogenase family, central domain
MVKICCIGAGYVGGPSMAVMALKCPAIEVTVVDVSRPRIDAWNSDRLPVLEPGLDTIVRACRGRNLSFSADVDRHVADADIVFVSVNTPTKARGLGTGRAPDLAYWESAARVVAAASRPGTGKIVVEKSAVPVRTAEAMERILHAHAGDGAFQVLSNPEFFSEGTAVRDLLCPDRVVIGGGDTDVGAVRALVDVYAHWVPEDRIVTTGLQSAELAKLAASALLAQRVSSVNALSALCEATGADVSDVARAVGSDGRVGGGGRGFLDAGVGFGGPSLRRDVLSLAYDCERHGLHEAAEYWRQVVAVNEYQKGRFVRRLVASMLGTVAGKKVAVLGLAFKKGVGDTRESPAVDVCRALLAEGARVSVYDPVVSETQIIRRDTAAAAAEVEVTRDAYEAADGAHGLCVLTEWDEFRTLDYRRVFDGMMRPAFVFDGRNVVDAGELREIGFVVYSVGKPLDAWLNGMPAVA

SEQ ID NO: 15806 - DNA, 999 bp, Sorghum bicolor
  misc_feature: Ceres ANNOT ID no. 8643945
  misc_feature: Encodes the peptide sequence at SEQ ID NO 15807
atgtacgccggcggcggcggcgtgaggcgtgcggcgacggcgctgatctgggtactggtgcttgcggcggcgggtggcggcagcgtcgtctgcgaggcgcagctccggcgcgggtactacgccggcgtgtgccccaacgtggagtccatcgtccgcggcgtggtggccaagaagatccagcagacacccgccaccgtcggcgccaccgtgcgcctcttcttccacgactgcttcgtcgagggctgcgacgcgtcggtgatggtggcgtcgacggcgaacaacacggcggagaaggaccaccccatcaacctgtccctggccggcgacggcttcgacacggtgatcagggccagggcggccgtggacgccgcgccgggatgccgcggcaaggtgtcgtgcgccgacatcctcgccatggccaccagggacgccatcgcgctgtcgggcggtccgtcgtacgcggtggagctgggtcggctggacgggctgaggtcgacggcgagcagcgtcaacgggaggctgccggcgcccttcttcaacctggaccagctcaaccagatgttcgccgccaacgggctctcgcagaccgacatggtcgccctctcagctgggcacacggtgggtctggcgcactgcagcacgttcgcggggcggctgcggggggcggacgcgacgctggacgccgggtacgcggcgcagctggcggggtggtgcccggcgggggtggatccgcgggtggcggtggccatggaccccgtgacgccggtgagcttcgacaaccagttcttccggaacctgcaggccgggaagggactgctggcgtcggaccaggtgctgcacacggacaccaggtccagacccaccgtcgacgcgctggcacggagtcgcgtcgcgttcgaccgagccttcgtcgacgccatcaccaggctgggccgcgtcggggtcaagacggcgacggcacggggcaacgtccgccgcgactgcgccgtgctcggctga

SEQ ID NO: 15807 - protein, 332 aa, Sorghum bicolor
  misc_feature: Useful for making plants with altered carbohydrate content
  misc_feature: Functional homolog of the protein sequence given in SEQ ID NO 13853
  misc_feature: Useful for making plants with altered cell wall content and/or composition
  misc_feature: Functional homolog of the protein sequence given in SEQ ID NO 13854
  misc_feature: Ceres ANNOT ID no. 8643945
  misc_feature (33)..(328): SWISSPROT Homolog: EC 1.11.1.7 Peroxidase
  misc_feature (51)..(295): Pfam ID: peroxidase Pfam Description: Peroxidase
MYAGGGGVRRAATALIWVLVLAAAGGGSVVCEAQLRRGYYAGVCPNVESIVRGVVAKKIQQTPATVGATVRLFFHDCFVEGCDASVMVASTANNTAEKDHPINLSLAGDGFDTVIRARAAVDAAPGCRGKVSCADILAMATRDAIALSGGPSYAVELGRLDGLRSTASSVNGRLPAPFFNLDQLNQMFAANGLSQTDMVALSAGHTVGLAHCSTFAGRLRGADATLDAGYAAQLAGWCPAGVDPRVAVAMDPVTPVSFDNQFFRNLQAGKGLLASDQVLHTDTRSRPTVDALARSRVAFDRAFVDAITRLGRVGVKTATARGNVRRDCAVLG

SEQ ID NO: 15808 - DNA, 663 bp, Sorghum bicolor
  misc_feature: Ceres ANNOT ID no. 8643944
  misc_feature: Encodes the peptide sequence at SEQ ID NO 15809
atggtcgcctgcagcaacctgaggcttttggcggcggcggcggcgctggcgttcctggcgctggcggcggcggctgccaccgtgtgctcggcgcagcagcagcagcagctccgtcgcaactactacgcgagcgtgtgcccaaacgtggagtccatcgtccgcgacgcggtggcgagcaagtacagggagacgttcatcacggtgggcgcgacggtgcacctcttcttccacgactgcttcgtcgagggctgcgacgcctccgtggtggtggcctccacgcccaactccaccgccgcggagaaagaccaccccgtgaacctctccctcgccggcgacggcttcgacaccgtgatccgcgccaaggccgccgtcgacgccgtgccgcggtgccgcaaccgggtctcctgcgccgacatcctcgccatggccacccgcgacgccatcgcgctggccggcggcccgtcctacgccgggatgggcctcctggcgtcggaccagctgctgtacacggacaccaggtccaggcccattgtcgacgcgttggcacggagtagcgtcgcgtttgaacgggccttcgtggaggccatcaccaagatgggccggattggggtcaagacgggggcccaagggaacatccgacggaactgcgcggtgctcaattga

SEQ ID NO: 15809 - protein, 220 aa, Sorghum bicolor
  misc_feature: Useful for making plants with altered carbohydrate content
  misc_feature: Functional homolog of the protein sequence given in SEQ ID NO 13853
  misc_feature: Useful for making plants with altered cell wall content and/or composition
  misc_feature: Functional homolog of the protein sequence given in SEQ ID NO 13852
  misc_feature: Ceres ANNOT ID no. 8643944
  misc_feature (36)..(156): SWISSPROT Homolog: EC 1.11.1.7 Peroxidase
  misc_feature (53)..(184): Pfam ID: peroxidase Pfam Description: Peroxidase
MVACSNLRLLAAAAALAFLALAAAAATVCSAQQQQQLRRNYYASVCPNVESIVRDAVASKYRETFITVGATVHLFFHDCFVEGCDASVVVASTPNSTAAEKDHPVNLSLAGDGFDTVIRAKAAVDAVPRCRNRVSCADILAMATRDAIALAGGPSYAGMGLLASDQLLYTDTRSRPIVDALARSSVAFERAFVEAITKMGRIGVKTGAQGNIRRNCAVLN

SEQ ID NO: 15810 - DNA, 999 bp, Sorghum bicolor
  misc_feature: Ceres ANNOT ID no. 8643938
  misc_feature: Encodes the peptide sequence at SEQ ID NO 15811
atgtcgaaggccagggtctacgccgacgtcaacgtgctgcgccccaaggagtactgggactacgaggcgctcaccgttcaatggggtgagcaggatgactatgaagttgttaggaaagttgggagaggaaaatacagtgaagtctttgagggtattaatgttaacaataatgagaaatgcatcattaagatcctcaagcctgtgaagaaaaagaagatcaaaagagaaattaaaattcttcagaatctttgtggaggccctaacattgtgaagctgcttgatattgttagagatcagcattcaaaaacacccagcttgatctttgagtatgtcaacaacacagatttcaaagtgttgtacccaacactaacagattatgacattcgatattacatctacgagttactcaaggcattagattactgccattcacaaggtattatgcaccgagatgtgaagccccacaatgttatgatagatcacgagcttcggaaactccggctgatagactggggccttgctgaattctatcatcctggcaaggaatataatgtccgtgttgcctccaggtacttcaaggggcctgagcttcttgttgacttgcaagattatgattactctttggacatgtggagtctgggctgcatgtttgctggaatgatttttcgtaaggaaccatttttctacggccatgacaaccatgatcaacttgttaagatagccaaggtacttggaacagatgggctgaatgcttatttgaacaagtacagaattgagcttgaccctcagctggaagcccttgttgggaggcatagcaggaaaccctggtcaaagtttatcaatgcagataaccaacacctagtgtctcctgaggccatagatttccttgacaagcttttgcgttatgatcatcaggacaggcttactgcacgtgaagctatggcacacccatacttccaacaagtgagagctgcagagaacagcaggacgcgagcatga

SEQ ID NO: 15811 - protein, 332 aa, Sorghum bicolor
  misc_feature: The sequence is a functional homolog of SEQ ID NO 1 in US patent 7038110
  misc_feature: Useful for making plants with modulated flowering time
  misc_feature: Functional homolog of the protein sequence given in SEQ ID NO 14095
  misc_feature: Ceres ANNOT ID no. 8643938
  misc_feature (1)..(332): SWISSPROT Homolog: EC 2.7.11.1 Non-specific serine/threonine protein kinase
  misc_feature (34)..(319): Pfam ID: Pkinase Pfam Description: Protein kinase domain
MSKARVYADVNVLRPKEYWDYEALTVQWGEQDDYEVVRKVGRGKYSEVFEGINVNNNEKCIIKILKPVKKKKIKREIKILQNLCGGPNIVKLLDIVRDQHSKTPSLIFEYVNNTDFKVLYPTLTDYDIRYYIYELLKALDYCHSQGIMHRDVKPHNVMIDHELRKLRLIDWGLAEFYHPGKEYNVRVASRYFKGPELLVDLQDYDYSLDMWSLGCMFAGMIFRKEPFFYGHDNHDQLVKIAKVLGTDGLNAYLNKYRIELDPQLEALVGRHSRKPWSKFINADNQHLVSPEAIDFLDKLLRYDHQDRLTAREAMAHPYFQQVRAAENSRTRA

SEQ ID NO: 15812 - DNA, 288 bp, Sorghum bicolor
  misc_feature: Ceres ANNOT ID no. 8644078
  misc_feature: Encodes the peptide sequence at SEQ ID NO 15813
atggcgtccaggttgacagatctagcaagcgtgggcctctccgacggtaagtccattgacagagatggagaaagattattgatattgaaatacaagaagcccctcatgaagattctagttcttcttccctcaaaaaagactctatgggcggtgctagccccatgcaacgagatagacaagctgaagaagtggtgcctgcactgcagcaccacatcgaccctgcagtggaggatggggccactgggcaaaagcacgctgtgcaatgcgtgcggtgtgcgctacaggtag

SEQ ID NO: 15813 - protein, 95 aa, Sorghum bicolor
  misc_feature: Useful for making plants with altered alkaloid content
  misc_feature: Useful for making plants with modulated biomass
  misc_feature: Functional homolog of the protein sequence given in SEQ ID NO 12975
  misc_feature: Useful for making plants with modulated flowering time
  misc_feature: Functional homolog of the protein sequence given in SEQ ID NO 13019
  misc_feature: Ceres ANNOT ID no. 8644078
  misc_feature (65)..(95): Pfam ID: GATA Pfam Description: GATA zinc finger
MASRLTDLASVGLSDGKSIDRDGERLLILKYKKPLMKILVLLPSKKTLWAVLAPCNEIDKLKKWCLHCSTTSTLQWRMGPLGKSTLCNACGVRYR

SEQ ID NO: 15814 - DNA, 414 bp, Sorghum bicolor
  misc_feature: Ceres ANNOT ID no. 8644104
  misc_feature: Encodes the peptide sequence at SEQ ID NO 15815
atgtacaattcatggctagttgtggaatggttaagtattatattactcttagttcttgaatgcattttttttgccaaaattttattgttgcagataagcagctatgaaaaagagctagaggaaatgaaacatatgactagacaggagtatattgcatacctaagaagaaatagcagtggattttttcgtggtgcgtcaaaatatcgtcgagtaactagacatcatcagcatgggagatggcaagcaaggatagggagagttgcaggaaacaaggatctctacttgggcaaattcagtaagctagctgccttcttttcttgtttatttgtttgtttggagaactcagtgaacgtgatctcccagctggccgaagctgggatgggcggctatgcctcgtacgggcaccacgcctag

SEQ ID NO: 15815 - protein, 137 aa, Sorghum bicolor
  misc_feature: Useful for biocontainment applications
  misc_feature: Functional homolog of the protein sequence given in SEQ ID NO 13650
  misc_feature: The sequence is a functional homolog of SEQ ID NO 104 in the 10/286,264 US patent application
  misc_feature: The sequence is a functional homolog of SEQ ID NO 202 in the 10/374,780 US patent application
  misc_feature: The sequence is a functional homolog of SEQ ID NO 524 in the 11/435,388 US patent application
  misc_feature: The sequence is a functional homolog of SEQ ID NO 574 in the 10/225,066 US patent application
  misc_feature: The sequence is a functional homolog of SEQ ID NO 650 in the 10/412,699 US patent application
  misc_feature: The sequence is a functional homolog of SEQ ID NO 1310 in the 10/374,780 US patent application
  misc_feature: The sequence is a functional homolog of SEQ ID NO 1312 in the 10/374,780 US patent application
  misc_feature: The sequence is a functional homolog of SEQ ID NO 1455 in the 10/412,699 US patent application
  misc_feature: The sequence is a functional homolog of SEQ ID NO 1457 in the 10/412,699 US patent application
  misc_feature: The sequence is a functional homolog of SEQ ID NO 1311 in the 10/374,780 US patent application
  misc_feature: The sequence is a functional homolog of SEQ ID NO 1456 in the 10/412,699 US patent application
  misc_feature: The sequence is a functional homolog of SEQ ID NO 1314 in the 10/374,780 US patent application
  misc_feature: The sequence is a functional homolog of SEQ ID NO 1459 in the 10/412,699 US patent application
  misc_feature: Useful for making plants with altered lignin content
  misc_feature: Useful for making plants with modulated drought sensitivity
  misc_feature: Functional homolog of the protein sequence given in SEQ ID NO 14199
  misc_feature: The sequence is a functional homolog of SEQ ID NO 320 in US patent 7157621
  misc_feature: The sequence is a functional homolog of SEQ ID NO 1070 in the 10/225,066 US patent application
  misc_feature: The sequence is a functional homolog of SEQ ID NO 140 in the 11/375,241 US patent application
  misc_feature: The sequence is a functional homolog of SEQ ID NO 1904 in the 10/412,699 US patent application
  misc_feature: The sequence is a functional homolog of SEQ ID NO 2164 in the 10/374,780 US patent application
  misc_feature: The sequence is a functional homolog of SEQ ID NO 458 in the 11/435,388 US patent application
  misc_feature: The sequence is a functional homolog of SEQ ID NO 1900 in the 10/412,699 US patent application
  misc_feature: The sequence is a functional homolog of SEQ ID NO 358 in the 10/666,642 US patent application
  misc_feature: The sequence is a functional homolog of SEQ ID NO 676 in the 11/435,388 US patent application
  misc_feature: Ceres ANNOT ID no. 8644104
MYNSWLVVEWLSIILLLVLECIFFAKILLLQISSYEKELEEMKHMTRQEYIAYLRRNSSGFFRGASKYRRVTRHHQHGRWQARIGRVAGNKDLYLGKFSKLAAFFSCLFVCLENSVNVISQLAEAGMGGYASYGHHA

SEQ ID NO: 15816 - DNA, 1293 bp, Sorghum bicolor
  misc_feature: Ceres ANNOT ID no. 8644116
  misc_feature: Encodes the peptide sequence at SEQ ID NO 15817
atggcaacaagcaccacggtggccgccgtccgtgagatccggcgtgcgcagcgtgccgacggccccgccgccgtgctcggcatcggcactgcgacgccgccattctgcgtgcttcaggacgacttcccggactactatttccgcgtcacaaacaaggagcacctcacccacctcaaagacacgttcaggcgactatgtcggataaccgggctggagagacgtttctttcaccacactgagcaaatgctcaacgcccacccgagcttcctccacggcaacggggacctcgacgcacggctggacatggtcgccaaggccgctccggagctggccgcgtcggccgccgcgacggccatcgcgaggtggggccgaccagccaccgacatcacccacctggtggtgagcaccagctcggaggcccgcgccccgggcacggacctcgggctggcctcgcgcctgggcctccgcgccggcgtccaccgcaccgtgctccagctcggcggctgctcggccgggtgcgccgcgctgcgcctggccaaggacctcgccgagaacaaccgcggcgcgcgcgtcctcgtggcctgcgtcgagctcaccctcaccggcttccgtgggccccggcagggggacaccttcgacaccctcgtcccacaggcggtgttcagcgacggcgcgggcgcggtcgtcgtcggcgccgacgccgacgccgaaggagacggcggcgagcgtccgctcttcgagatgatggccgcctcgcagaccctggtgcccgggtcgacgcaccttctcaacgtgcggctcggagcgagcggggtcgccggggacgtctccgccaggctgcagtccttcgcggcgcaggacctggaacggtgtctgctcgacgctctcgcgccgctcgggctcggcatcggcgtcggcggcgacggcgaggtgaggtggaacgacctcttttgggcggtgcacccgggcagccgtgggatcttggaccacatcgacgcggctctccggctggagcccggcaagctggcggcgagccggacggttctgagggagtacgggaacatgatgtcggcgacggtgatatttgtgctggacgagctgcgccggcgaatcgacgaggaaggagaagaggccgcgactgagtggggggtcatggtcggctttggaccgggattcactgtcgagactatggttctccatgctactagcactcccacacgttcggacattagcaccgatcgggaagggactgttgccccggtttccgagccggtgctgcccttccaggactaa

SEQ ID NO: 15817 - protein, 430 aa, Sorghum bicolor
  misc_feature: The sequence is a functional homolog of SEQ ID NO 2 in US patent 7202397
  misc_feature: Ceres ANNOT ID no. 8644116
  misc_feature (1)..(412): SWISSPROT Homolog: EC 2.3.1.74 Naringenin-chalcone synthase
  misc_feature (8)..(234): Pfam ID: Chal_sti_synt_N Pfam Description: Chalcone and stilbene synthases, N-terminal domain
  misc_feature (247)..(403): Pfam ID: Chal_sti_synt_C Pfam Description: Chalcone and stilbene synthases, C-terminal domain
MATSTTVAAVREIRRAQRADGPAAVLGIGTATPPFCVLQDDFPDYYFRVTNKEHLTHLKDTFRRLCRITGLERRFFHHTEQMLNAHPSFLHGNGDLDARLDMVAKAAPELAASAAATAIARWGRPATDITHLVVSTSSEARAPGTDLGLASRLGLRAGVHRTVLQLGGCSAGCAALRLAKDLAENNRGARVLVACVELTLTGFRGPRQGDTFDTLVPQAVFSDGAGAVVVGADADAEGDGGERPLFEMMAASQTLVPGSTHLLNVRLGASGVAGDVSARLQSFAAQDLERCLLDALAPLGLGIGVGGDGEVRWNDLFWAVHPGSRGILDHIDAALRLEPGKLAASRTVLREYGNMMSATVIFVLDELRRRIDEEGEEAATEWGVMVGFGPGFTVETMVLHATSTPTRSDISTDREGTVAPVSEPVLPFQD

SEQ ID NO: 15818 - DNA, 2052 bp, Sorghum bicolor
  misc_feature: Ceres ANNOT ID no. 8644157
  misc_feature: Encodes the peptide sequence at SEQ ID NO 15819
atggcgccgtggagcggcctctggggcggcagggccgtcctcgccggcggcgacgcctaccgcggcacccccgtcgtcgtcaggatggagaaccccaacagctggtccatctccgagatcaacgacgacgacgacgatgactacggcgggggccagaggcggcggaggaggaggaggaggggcaagaacgccaagcagatcacctgggtgctgctcctcaacgcgcaccgcgccgcggggtgcctggcgtggctggcctccgccgccgtcgcgctcgggtgcgcggcgcggcgccgcgtcgcggccggccgcacggacgccgacgacggagcgcccgcccccgcccccacccccactccgccgccgacgccgcggcgttccaggctctacgcgttcatccgggcgctgctcctgctgtcgctgttcctcctggccgccgagctcgcggcgcacgccaacggccgccgcctcgccgccgccgcggtgtcgctcggctcgctccacgcctcctgggtgcgcttccgcgccgcctacgtggcgccgccgctccagcggctcgccgacgcctgcgtcgcgctgttcctcgtccagagcgccgaccgcgtcgcccagtgcctcggatgcctctacatccgcctcaggcgcgtcaggcctgagcccgtgtcgccgccggcggtgcccgacgccgaggaccccgacgccggctacttccccatggtgctcgtccagataccaatgtgcaacgagaaggaggtgtaccagcagtcgatcgcggcggtttgcaacttggactggccgaggtccagcctgctggtgcaggtgctggacgactccgacgagcccgtcacgcaggcactgatcagagaggaggtggacaagtggcggcaccacggcgcgcgcatcgtgtaccgccaccgcgtgctcagggacgggtacaaggccggcaacctcaagtcggcgatgagctgcagctacgtcaaggactacgagtacgtggccatcttcgacgccgacttccagccttaccctgacttcctgcggcgcaccgtgccccatttcatggacaatgaggaattggggctggtgcaggcacggtggtcgttcgtgaacaaggacgagaacctgctgacgcggctgcagaacatcaacctgtgcttccacttcgaggtggagcagcaggtgaacggcgtgttcatcaacttcttcgggttcaacggcacggccggggtgtggaggatcagggctctggaggattcaggcggctggatggagcgcaccaccgtcgaggacatggacgtcgcggtcagggcgcatctcaaaggctggaagttcatcttcctcaacgatgtggaggtgtgccagtgcgagttgccggagtcgtatgaggcttacaggaagcagcagcaccggtggcattcaggcccaatgcagctcttcaggctgtgcttgccggacatcatcagatgcaagttgtcggtatggaagaaggcgaacctgatcttgctcttcttcctgctgcggaagctgatcctgcccttctactccttcacgctcttctgcatcatcctaccactaaccatgttcgtgccggaagcttcgctcccggactgggtggtgtgctacgtgccggcactcatgtcgctcctcaacgtggtgccggcgccccggtcgttcccgttcgtgatcccgtacctcctgttcgagaacaccatgtccgtgactaagttcaacgccatggtctccggcctcttccagctccgcggcgcctacgagtgggtcgtcaccaagaagtccggccgttgcccgtcgtcgtcggaacacgagcaggagacgacgaagcagcctgggaaaacgacgacgacagcgacggcgacggcgacggcgaagtacaaccggatgtacaagaaggagctggcgctgtcgctgctgctgctgacggcggccgcccggagcctgctgtcgaagcaagggacgcacttctacttcctgctgttccagggcgtctcgttcctcttggtcggcctcgacctcatcggcgaggacgtcaagtga

SEQ ID NO: 15819 - protein, 683 aa, Sorghum bicolor
  misc_feature: Useful for making plants with altered carbohydrate content
  misc_feature: Functional homolog of the protein sequence given in SEQ ID NO 13855
  misc_feature: Useful for making plants with altered cell wall content and/or composition
  misc_feature: Functional homolog of the protein sequence given in SEQ ID NO 13738
  misc_feature: Ceres ANNOT ID no. 8644157
  misc_feature (237)..(484): SWISSPROT Homolog: EC 2.4.1.12 Cellulose synthase (UDP-forming)
  misc_feature (241)..(416): Pfam ID: Glycos_transf_2 Pfam Description: Glycosyl transferase family 2
MAPWSGLWGGRAVLAGGDAYRGTPVVVRMENPNSWSISEINDDDDDDYGGGQRRRRRRRRGKNAKQITWVLLLNAHRAAGCLAWLASAAVALGCAARRRVAAGRTDADDGAPAPAPTPTPPPTPRRSRLYAFIRALLLLSLFLLAAELAAHANGRRLAAAAVSLGSLHASWVRFRAAYVAPPLQRLADACVALFLVQSADRVAQCLGCLYIRLRRVRPEPVSPPAVPDAEDPDAGYFPMVLVQIPMCNEKEVYQQSIAAVCNLDWPRSSLLVQVLDDSDEPVTQALIREEVDKWRHHGARIVYRHRVLRDGYKAGNLKSAMSCSYVKDYEYVAIFDADFQPYPDFLRRTVPHFMDNEELGLVQARWSFVNKDENLLTRLQNINLCFHFEVEQQVNGVFINFFGFNGTAGVWRIRALEDSGGWMERTTVEDMDVAVRAHLKGWKFIFLNDVEVCQCELPESYEAYRKQQHRWHSGPMQLFRLCLPDIIRCKLSVWKKANLILLFFLLRKLILPFYSFTLFCIILPLTMFVPEASLPDWVVCYVPALMSLLNVVPAPRSFPFVIPYLLFENTMSVTKFNAMVSGLFQLRGAYEWVVTKKSGRCPSSSEHEQETTKQPGKTTTTATATATAKYNRMYKKELALSLLLLTAAARSLLSKQGTHFYFLLFQGVSFLLVGLDLIGEDVK

SEQ ID NO: 15820 - DNA, 2316 bp, Sorghum bicolor
  misc_feature: Ceres ANNOT ID no. 8644135
  misc_feature: Encodes the peptide sequence at SEQ ID NO 15821
atggggacgctatcaatgtctgatgctatccctgccaagaactgggatgattcccctgttaagtttgaggctaacggtggtgacgcgctccccgtccttaaggaggaagagcggctattggagcctgtgaaggatgagctggctgatggaatcttggattccttaccaattgacctggaggccaagaatggcgatgcatcgctcatcactgaagcgatgaaaaaggaggaggaggagcttgaagacacccggctcaaggcggtggaagaagaggaagccaggaagagggaggaggctgcaagactcgcttttgatcctgagacacggtataacaagttagatgaactgctgtcgcagacacaactctattcggagtttctacttgagaacatggatcgaattgctgaagaaaatgttgagactcaagctgaagagccacaggtagaagagaagaagaaagggcgtggccgaaagaggaaagcaaagccagtgtacaatgataagaaggctaagacagcagtggctgccatgcttacaaggtctcgcgaagatcgtcttgcggaagattgtactctctcagaagaagaaaggtgggaaaaagagcaggccaaccttgtgccattattgaccggaggaaagttgaagtcataccagataaagggtgtcaagtggcttatatcattgtggcagaatgggctgaatggaatactggctgatcaaatgggccttgggaaaaccattcagacaattggatttcttgctcatctgaaagggaaaggcatgcatggtccatacttgataatcgctcctctatccactctctcgaactgggtgaatgaaatctcaaggtttactccatctcttgctagtatcatatatcatggagataaggcggcccgggcagagatccgaagaaaatttatgcccaaaaatgctggccctgattttccgatagtagtgacttcatatgagatggccatgtatgatgctaaatttcttgctgtccataggtggaagtatgttattgtggatgagggccatcgtctgaaaaattctaagtgtctattattgagggagctgaagcgtataccaatggataataagcttcttttgactggaacacccctgcagaataatctagcggagctgtggtcactactgaacttcattttgcctgatatattctcgtcacatcaagaatttgagtcatggtttgatttttctgggaaaggaaatggagaaaaagatgaagaaactgatgagaataaaaggctgcatgttgtttcaaagcttcatgctattttacgtccattccttctaaggcggatgaaggaggatgtggaacagctgcttccacggaagaaagagataatcatttatgccaacatgactgaacatcagaagcaaatccagcatcacttggttgaaaaaacatttgacaactacttgaatgaggaatcggatattatattgaagagacctggcattaaggcaaggttgcataatctaatgattcagctgaggaagaattgcaaccatcctgatcttttggaagctcaagttgattcaataggtttatatccacctgttgagaagatcctggaacaatgtggtaaattccaactttttgacaggttactaaattacctgattgaacaaaagcacaaggttctagtattttcgcaatggacaaaagtgttggacattattgagtattaccttgattcaaaaggccatgatgtttgccgaattgatggtagtgtaaaattggaagaaagaaggaggcagatagcagaattcaatgacttgaatagcagtatgcgaatcttcctcctgagcacaagggctggtggacttggcatcaaccttacttctgctgatacctgtatcctctacgacagtgactgggctatggatcgatgccaccggattggccaaacacggccagtgcatgtatataggctggctacgtcacattctgttgagggacggatcatcaagaaagcttttgggaagttgaagctagagcatgtggtgatcggcaagggacagtttgaacaagagagagctaagcctaatgtcttaaatgagggtgaactgctggcgcttctcaaggacgagcaggacgaggaagacaggatgatccagaccgacatcagcgacgaggacctactgaagctgatggaccggagcgacctcttgggcccacccggcggcactaacgctactccacttgtgccgctgaaaggcccaggctgggaggtggtggtgccgaccaagagtggtggtggcatgctctccgcgctcaccagctga

SEQ ID NO: 15821 - protein, 771 aa, Sorghum bicolor
  misc_feature: The sequence is a functional homolog of SEQ ID NO 1241 in the 10/666,642 US patent application
  misc_feature: The sequence is a functional homolog of SEQ ID NO 518 in the 10/666,642 US patent application
  misc_feature: Ceres ANNOT ID no. 8644135
  misc_feature (214)..(472): SWISSPROT Homolog: EC 3.6.1.15 Nucleoside-triphosphatase
  misc_feature (217)..(517): Pfam ID: SNF2_N Pfam Description: SNF2 family N-terminal domain
  misc_feature (573)..(645): Pfam ID: Helicase_C Pfam Description: Helicase conserved C-terminal domain
MGTLSMSDAIPAKNWDDSPVKFEANGGDALPVLKEEERLLEPVKDELADGILDSLPIDLEAKNGDASLITEAMKKEEEELEDTRLKAVEEEEARKREEAARLAFDPETRYNKLDELLSQTQLYSEFLLENMDRIAEENVETQAEEPQVEEKKKGRGRKRKAKPVYNDKKAKTAVAAMLTRSREDRLAEDCTLSEEERWEKEQANLVPLLTGGKLKSYQIKGVKWLISLWQNGLNGILADQMGLGKTIQTIGFLAHLKGKGMHGPYLIIAPLSTLSNWVNEISRFTPSLASIIYHGDKAARAEIRRKFMPKNAGPDFPIVVTSYEMAMYDAKFLAVHRWKYVIVDEGHRLKNSKCLLLRELKRIPMDNKLLLTGTPLQNNLAELWSLLNFILPDIFSSHQEFESWFDFSGKGNGEKDEETDENKRLHVVSKLHAILRPFLLRRMKEDVEQLLPRKKEIIIYANMTEHQKQIQHHLVEKTFDNYLNEESDIILKRPGIKARLHNLMIQLRKNCNHPDLLEAQVDSIGLYPPVEKILEQCGKFQLFDRLLNYLIEQKHKVLVFSQWTKVLDIIEYYLDSKGHDVCRIDGSVKLEERRRQIAEFNDLNSSMRIFLLSTRAGGLGINLTSADTCILYDSDWAMDRCHRIGQTRPVHVYRLATSHSVEGRIIKKAFGKLKLEHVVIGKGQFEQERAKPNVLNEGELLALLKDEQDEEDRMIQTDISDEDLLKLMDRSDLLGPPGGTNATPLVPLKGPGWEVVVPTKSGGGMLSALTS

SEQ ID NO: 15822 - DNA, 1734 bp, Sorghum bicolor
  misc_feature: Ceres ANNOT ID no. 8644265
  misc_feature: Encodes the peptide sequence at SEQ ID NO 15823
atggggcatgcagcagcagagacgtggagaaatcacgaggatccacaccccgtcgcaccatgcacccgcagccgcaggcaacaagctccgacgacgatccaatgccaatccgcaccaccaccatgtcctcctccaatgacgaccccacgccgtcgtcgcacgccgcgagacgtctgtccacatcgcacggcggcagcaataataagaagtccctttttcctggacttggcgcggcatcgtcgccgatcgccctcgcggcggccggcgcggcgctgcttctcgtcgtcctcgtcgtcgtctgctgttgctgctgctgctgctgcaggaggaggaggaggaagcagagggacgcggcgcagcaccagcgcccgccgccgccggaacaccaccacggggtactactgccctcccggcgctcggccgtcgccgcagtggcagaacgggcaggttgctccagcgccaccggcggcagcggtgacgccgggcacgacgacggggcatcacggcggtatactcctgccgccgcccgcgccgccgccgcctctaccgatgcccgcggacacggcggcgttcagctacgaggagctggctcaggcgacgggcgggttctcggaggcgaacctgctggggcagggcgggttcgggtacgtgcaccgcggcgtgctctccgacgggaaggaggtggcggtgaagcagctcaaggccgggagcgggcaaggggagcgcgagttccaggcggaggtggacaccatcagccgcgtgcaccaccgccacctcgtcgcgctcgtcggctactgcatggacggcgcgcgccgcctgctcgtctacgagttcgtgcccaaccacacgctcgagcaccacctccacgggaaagccggagccggagccggagccggccgcctgccggtgatggagtggacgacgcggctccgcatcgccgtcggcgccgccaagggcctcgcgtacctgcacgaggagtgcgaccctcggatcatccaccgcgacatcaagtccgccaacatcctgctcgacgacgacttcgaggccatggtcgccgacttcgggctcgccaagctcaccagcgtcaaccacacgcacgtgtcgacacgcgtcatgggcaccttcggctacctggcgccggagtacgcgtccagcggcaagctcaccgagaagtccgacgtcttctcctacggcgtcatgctgctcgagctgctcaccggccgtcgccccggcgatcgctcctcctatggccaagacggcctcgtcgactgggcgaggcaggcgctgccgcgggcgctggcagacggcaactacgacgagatcgtggacccgaggctgcggggcgactacgacccgacggaggcggcgcgcctggtcgccagcgccgccgccgccgtgcgccacgcggcgcggcgccgccccaagatgagccagatcgtgctggcgctgcagggggccatgccgctggaggagctcaacgacggggtgcgcccgggccacggcgccgcgttcggctccggctcggggtcgtcggggtccgctggctcgggctccgactacggcggctccgacggctcgtcgtacacggcgcagatggagcggatcaggcgggccgcgatgcctagcccggagtacagcgccgactaccctggctctgtcccggagtacggacacccgtcgccggcgagctccgacgagcgggaagaccggcggcatcggggaggtcgccggtga

SEQ ID NO: 15823 - protein, 577 aa, Sorghum bicolor
  misc_feature: Useful for making plants with altered carbohydrate content
  misc_feature: Functional homolog of the protein sequence given in SEQ ID NO 14218
  misc_feature: Ceres ANNOT ID no. 8644265
  misc_feature (191)..(485): SWISSPROT Homolog: EC 2.7.11.1 Non-specific serine/threonine protein kinase
  misc_feature (203)..(483): Pfam ID: Pkinase_Tyr Pfam Description: Protein tyrosine kinase
MGHAAAETWRNHEDPHPVAPCTRSRRQQAPTTIQCQSAPPPCPPPMTTPRRRRTPRDVCPHRTAAAIIRSPFFLDLARHRRRSPSRRPARRCFSSSSSSSAVAAAAAAGGGGGSRGTRRSTSARRRRNTTTGYYCPPGARPSPQWQNGQVAPAPPAAAVTPGTTTGHHGGILLPPPAPPPPLPMPADTAAFSYEELAQATGGFSEANLLGQGGFGYVHRGVLSDGKEVAVKQLKAGSGQGEREFQAEVDTISRVHHRHLVALVGYCMDGARRLLVYEFVPNHTLEHHLHGKAGAGAGAGRLPVMEWTTRLRIAVGAAKGLAYLHEECDPRIIHRDIKSANILLDDDFEAMVADFGLAKLTSVNHTHVSTRVMGTFGYLAPEYASSGKLTEKSDVFSYGVMLLELLTGRRPGDRSSYGQDGLVDWARQALPRALADGNYDEIVDPRLRGDYDPTEAARLVASAAAAVRHAARRRPKMSQIVLALQGAMPLEELNDGVRPGHGAAFGSGSGSSGSAGSGSDYGGSDGSSYTAQMERIRRAAMPSPEYSADYPGSVPEYGHPSPASSDEREDRRHRGGRR

SEQ ID NO: 15824 - DNA, 786 bp, Sorghum bicolor
  misc_feature: Ceres ANNOT ID no. 8644281
  misc_feature: Encodes the peptide sequence at SEQ ID NO 15825
atggcgtccacctcctgcttcctccaccagtccaccgcccgcctcggcgcgtcgccgcgcgtcgcggccgcgccacgcagcgcccagctgttcgtctgcaaggcccagcagaagcagcagcaggacgccgccgccgtggatcagagcgacgtctctcgccgcgccgcgctcgcgctcttcgccggcgtcgccgccgtcggcgccaaggtcagccccgccgccgccgcctacggagaagcagccaacgtgttcggcaagcccaagacgaacacggagtacatcgcgtacaacggcgacgggttcaagctgctgatcccgtccaagtggaaccccagcaaggagcgggagttcccggggcaggtgctccgctacgaggacaacttcgacgccaacagcaacgtctccgtcatcatccagcccacctccaagaagaccatcaccgagtacggctcccccgaggagttcctctcccaggtcgacttcctcctcggcaagcaggccttcggcggcagcaccgactccgagggtggattcgagaccggcgcggtggccacggccaacgtgctggagagctccacgcccgtggtggacggcaagcagtactacagcgtctccgtgctgacaaggacggcggacggcgacgagggcggcaagcaccagctcatcacggccaccgtctccgacggcaagctctacatctgcaaggcgcaggccggcgacaagaggtggttcaagggcgccaggaagggcgtcgagaaggccgccgcctccttcagcgtcgcataa

SEQ ID NO: 15825 - protein, 261 aa, Sorghum bicolor
  misc_feature: Useful for making plants with altered lignin content
  misc_feature: Useful for making plants with modulated nitrogen use efficiency
  misc_feature: Functional homolog of the protein sequence given in SEQ ID NO 14273
  misc_feature: Ceres ANNOT ID no. 8644281
  misc_feature (59)..(261): Pfam ID: PsbP Pfam Description: PsbP
MASTSCFLHQSTARLGASPRVAAAPRSAQLFVCKAQQKQQQDAAAVDQSDVSRRAALALFAGVAAVGAKVSPAAAAYGEAANVFGKPKTNTEYIAYNGDGFKLLIPSKWNPSKEREFPGQVLRYEDNFDANSNVSVIIQPTSKKTITEYGSPEEFLSQVDFLLGKQAFGGSTDSEGGFETGAVATANVLESSTPVVDGKQYYSVSVLTRTADGDEGGKHQLITATVSDGKLYICKAQAGDKRWFKGARKGVEKAAASFSVA

SEQ ID NO: 15826 - DNA, 1032 bp, Sorghum bicolor
  misc_feature: Ceres ANNOT ID no. 8644274
  misc_feature: Encodes the peptide sequence at SEQ ID NO 15827
atggcaaaagagattgtcatggctggcgagcatggcgaaggagaggaggtggtgcttgtggaagacgaggaggaggaagaagacatgcttcccgggttccggtttcaccccaccgacgaggagctggtcaccttctacctccggcggaaggtggccgggaagcgccttagcatcgagatcatcaaggacttcgacatctacaagcacgatccatgggacctcccaaaatcgagctcgatcttgggagagaaggagtggtacttcttctgcctgcgggggaggaagtacaggaacagcatcaggcccaacagggtcaccggctccggcttctggaaggccaccggcatcgaccgccccatccactccgccgcctctggccgcgccggcgaccccatcggcctcaagaagtcgctcgtcttctaccgcggcagtgccggcaagggcaccaagacggagtggatgatgcacgagttccgcctcccgccgcgcgccgagagcgcccacacctcgcccagcgagcaggaggccgaggtgtggaccatctgccggatcttcaggaggaacttcacctacaagaagcatccccagcagcagcagatcgccggcagcagcaaggtttccgccgccgccacggccgccgtcgtgacgacgcagcccggcgagtcaagctccgtcaccggcagcctcgagtcggacaccggggacgagtacacgaacgacctgccgcagccgacgcaagctccggcgatcgtcgacggctacgactacgactacggctacggctacgaccagcagcagggccagtggaacagccacgcgctgcatgcggcggccacggccccgctgccgtcgccgacgatggccgcgttccatcacagcgtgcttagtagccctgcggccggcggcgggcttgacgacatgtactacaaagatgggtcgtccagctgggacgacattggcaggatggtgatggagctgacggaccccagccccggtgtgttctccttctatgacactagatcatatgtttag

SEQ ID NO: 15827 - protein, 343 aa, Sorghum bicolor
  misc_feature: The sequence is a functional homolog of SEQ ID NO 328 in the 10/374,780 US patent application
  misc_feature: The sequence is a functional homolog of SEQ ID NO 852 in the 10/225,066 US patent application
  misc_feature: The sequence is a functional homolog of SEQ ID NO 310 in the 10/666,642 US patent application
  misc_feature: The sequence is a functional homolog of SEQ ID NO 320 in the 10/374,780 US patent application
  misc_feature: The sequence is a functional homolog of SEQ ID NO 850 in the 10/225,066 US patent application
  misc_feature: Useful for making plants with altered terpenoid content
  misc_feature: Functional homolog of the protein sequence given in SEQ ID NO 13140
  misc_feature: The sequence is a functional homolog of SEQ ID NO 890 in the 10/374,780 US patent application
  misc_feature: The sequence is a functional homolog of SEQ ID NO 2012 in the 10/374,780 US patent application
  misc_feature: The sequence is a functional homolog of SEQ ID NO 312 in the 10/412,699 US patent application
  misc_feature: The sequence is a functional homolog of SEQ ID NO 731 in the 11/479,226 US patent application
  misc_feature: The sequence is a functional homolog of SEQ ID NO 2060 in the 10/374,780 US patent application
  misc_feature: The sequence is a functional homolog of SEQ ID NO 516 in the 10/412,699 US patent application
  misc_feature: Useful for making plants with modulated nitrogen use efficiency
  misc_feature: Functional homolog of the protein sequence given in SEQ ID NO 13624
  misc_feature: Ceres ANNOT ID no. 8644274
  misc_feature (29)..(161): Pfam ID: NAM Pfam Description: No apical meristem (NAM) protein
MAKEIVMAGEHGEGEEVVLVEDEEEEEDMLPGFRFHPTDEELVTFYLRRKVAGKRLSIEIIKDFDIYKHDPWDLPKSSSILGEKEWYFFCLRGRKYRNSIRPNRVTGSGFWKATGIDRPIHSAASGRAGDPIGLKKSLVFYRGSAGKGTKTEWMMHEFRLPPRAESAHTSPSEQEAEVWTICRIFRRNFTYKKHPQQQQIAGSSKVSAAATAAVVTTQPGESSSVTGSLESDTGDEYTNDLPQPTQAPAIVDGYDYDYGYGYDQQQGQWNSHALHAAATAPLPSPTMAAFHHSVLSSPAAGGGLDDMYYKDGSSSWDDIGRMVMELTDPSPGVFSFYDTRSYV

SEQ ID NO: 15828 - DNA, 1566 bp, Sorghum bicolor
  misc_feature: Ceres ANNOT ID no. 8644276
  misc_feature: Encodes the peptide sequence at SEQ ID NO 15829
atggcgtgctctcattctcatgagggtcattatcacctcctcatcactggcatcgctgctgcattcgtcgccgtgatgtcgttctttcttcggtattctggtcgtcggcgtctccggtggcgaggtcgtggtggatttccgccggggcctccggggttgcccgtcatcggcaacctgttgtccatggaccagttcacccaccgcggcctggccaagctcgccaaggttcacggcggcttcttccacctccccatcggcttcgccaacgtgttcgtggtgtcctccccggagacggccagggagatccttcaggagcaggccggcgtgttctcgcaccgccccgtgacggccgccatggcgtacgtctcgtacgacctcgccgacatggcgttcgcgcggtacgggccgttctggcgccagatgcgcaagctctgtgtcgtcaagctcttcagccgcgggcgcgaccagtcatggcgcaccgtgcgcgccgaggtggacggcctcgtcaggtccctggcggaggcgggcgccgtcgtcgtcgccaacgtcggcgagctcgccttcaagttcgccaccaacatcactctccgggccgcgttcggggcgcggagccaggaggacgaggcggagttcgtcgccatcatccgggagctctcccagacgttcctggccttcaacgtcgccgacttcgtgccgttcgtcggcttcctcgacctcaacggcatcaacaggaggacgagagcggcgaggcatgccctggacgtgttcatcgaccgcatcatcgacgagcacgtcgccaggtggaagaacggcgacgtggccgccgctgacatggtcgacgacatgatcgcctacctcgccgagacgccggggagagacacgagggcggacggcgtcgagctcaaggatctccggctcaccagagaaaacatcaaaggattaatcatggacatcatgttcggcggcacagagaccgtggcggcgacgctggagtggagcatggtggagctcctgcggagccccggcgagctggagcgcgcgcaggacgagctcgccggcgtggtgggtctcgaccggaaggtggacgagagcgacgtggagaagctgccctacctccggtgcatctgcaaggaggtgctccggctgcacccgccgctgccgctgctccaccgcgagagcctccaggactgcgccgtgggcgggcacgccgtcccgcgcaactcccgcgtctggatcaacatctgggccatgggccgcgacgagaggcactgggaggacgccgacgcgttccgcccctcgaggttcgccggcgccggcgccggcgtcggcggcgacttctggtacttgccgttcgggcacgggcggcggtcgtgccccgggatgcagctggggacgtacgcggtggagcttggcctggccaacctgctgcactgcttccggtggtcgctgccggatggggtggcacccagtgacctcgacgtcggtgacgtttttggcctgacggcgcccagggcccaacgcctgttggcggtgccgtcgccacgcctctcttgcccgttgttctga

SEQ ID NO: 15829 - protein, 521 aa, Sorghum bicolor
  misc_feature: Useful for making plants with altered lignin content
  misc_feature: Functional homolog of the protein sequence given in SEQ ID NO 14138
  misc_feature: Useful for making plants with altered cell wall content and/or composition
  misc_feature: Functional homolog of the protein sequence given in SEQ ID NO 14139
  misc_feature: Ceres ANNOT ID no. 8644276
  misc_feature (67)..(521): SWISSPROT Homolog: EC 1.14.13.88 Flavonoid 3',5'-hydroxylase
  misc_feature (47)..(509): Pfam ID: p450 Pfam Description: Cytochrome P450
MACSHSHEGHYHLLITGIAAAFVAVMSFFLRYSGRRRLRWRGRGGFPPGPPGLPVIGNLLSMDQFTHRGLAKLAKVHGGFFHLPIGFANVFVVSSPETAREILQEQAGVFSHRPVTAAMAYVSYDLADMAFARYGPFWRQMRKLCVVKLFSRGRDQSWRTVRAEVDGLVRSLAEAGAVVVANVGELAFKFATNITLRAAFGARSQEDEAEFVAIIRELSQTFLAFNVADFVPFVGFLDLNGINRRTRAARHALDVFIDRIIDEHVARWKNGDVAAADMVDDMIAYLAETPGRDTRADGVELKDLRLTRENIKGLIMDIMFGGTETVAATLEWSMVELLRSPGELERAQDELAGVVGLDRKVDESDVEKLPYLRCICKEVLRLHPPLPLLHRESLQDCAVGGHAVPRNSRVWINIWAMGRDERHWEDADAFRPSRFAGAGAGVGGDFWYLPFGHGRRSCPGMQLGTYAVELGLANLLHCFRWSLPDGVAPSDLDVGDVFGLTAPRAQRLLAVPSPRLSCPLF

SEQ ID NO: 15830 - DNA, 867 bp, Sorghum bicolor
  misc_feature: Ceres ANNOT ID no. 8644278
  misc_feature: Encodes the peptide sequence at SEQ ID NO 15831
atgtcgacgagcggtggcgctggcgcgcgctcgtggtcgccgccgcggcgggcgagccggtacgagtcgcagaagcggcgggactggcacacattcacgcggtacctggccgcgcaccgcccgccgctggagctgtgccgctgcagcggcgcgcacgtgctcgagttcctgcgctacctcgaccgcttcggcaagacgcgcgtccacgcgccgctctgcgcggcgtacggaggcggcggcggcggcccggcgctggtggccgcggcgccgtgccagtgcccgctgcgccaggcgtggggcagcctcgacgcgctcgtcggccgcctccgcgccgccttcgaggagcgtcacggcgcgcgtgggagtgggacgatctggacgtcgtcgcagtcgcagtcgcagtcgcagcagcccgccgtcgtcgacggcgacgccgccaaccccttcgccgcgcgcgccgtcaggctgtacctgcgcgacgtccgcgacgcgcagtccagggcgcgcggcatctcctacagcaggaagaagaagaagcggagcaagcagcaggacggcgccgccgcagcagcagccgggtgcgcccgcccgcacgtgaacggcgcgacgtcgttaatgcatgccgctgctccgccgcccgcaccgcctccgcctccgcctccaccgccaccaccgccgtactgcctcgccggtgtgcccttcgagttctgtgactacggcaccgtcctcggaggagttaccgccaatggtgcgcctggcttctacctgccgtcgctgttcaacaccttcggcaagctacttattatctatttattgcgttcaaaaacttattatctatttatatctttgagcatttgtataagatag

SEQ ID NO: 15831 - protein, 288 aa, Sorghum bicolor
  misc_feature: Useful for making plants with modulated low light sensitivity
  misc_feature: Functional homolog of the protein sequence given in SEQ ID NO 14143
  misc_feature: Useful for making plants with modulated nitrogen use efficiency
  misc_feature: Functional homolog of the protein sequence given in SEQ ID NO 13352
  misc_feature: Ceres ANNOT ID no. 8644278
MSTSGGAGARSWSPPRRASRYESQKRRDWHTFTRYLAAHRPPLELCRCSGAHVLEFLRYLDRFGKTRVHAPLCAAYGGGGGGPALVAAAPCQCPLRQAWGSLDALVGRLRAAFEERHGARGSGTIWTSSQSQSQSQQPAVVDGDAANPFAARAVRLYLRDVRDAQSRARGISYSRKKKKRSKQQDGAAAAAAGCARPHVNGATSLMHAAAPPPAPPPPPPPPPPPPYCLAGVPFEFCDYGTVLGGVTANGAPGFYLPSLFNTFGKLLIIYLLRSKTYYLFISLSICIR

SEQ ID NO: 15832 - DNA, 1494 bp, Sorghum bicolor
  misc_feature: Ceres ANNOT ID no. 8644279
  misc_feature: Encodes the peptide sequence at SEQ ID NO 15833
atgacggacgaacgccattgccagcaacgcctccacctccacctggggcaccacctccccccttttgcttgtccgctcccgcgtgtccccgattccactcccggctgctgctccgctttcctctccactctgctgccgctgggcctgctggatctgcaccgagcccggcagactagcggtgcaggtgcaccaatccaggcgccgatgctgccctccacccgcggcagcaggccgccgcagaggcccgccgccagatcctgctcctccgccttatcagagatcatggacctgtcgtcgtcggacccgaagcgcaagccgcggtgcctcagcaaggtggtcatgctcgcgctcctcgccgccatgtgcgtcgtcatgctcacccagccaccatgccacaggacaaggcctcccacacccaccctgttctccatccatgagcctggggtcacgcacgtgctagtcaccggtggcgctggctacatcggctcgcacgccgctcttcgcctgctcaaggactccttcagagtcaccatagtggacaatctttcgagagggaatatcggggcgatcaaagttctccagaacctgtttccagagcctgggcggttgcagttcatacaggctgatttaggagatccagaagttaatagaatatttgcagagaacgcatttgatgctgttatgcactttgctgctgtggcctatgttggtgagagcacgcttgaacctcttagatactatcataacatcaccgcaaacactctagtggtgctggaagctatggctacacacaacgtgaagactctcatctactctagcacgtgtgcgacctacggagagcctgagaagatgcccatcactgaaggaactccccagtttccgatcaacccatatggtaaggccaagaaaatggcggaggatatcatcttagacttctcaaagtcaaagagatcagacatggctgtcatgattctaagatacttcaatgtcattggttctgacccagaaggcagattgggtgaagctcctagacctgaattgcgtgagcatggccgtatatcgggggcatgctttgacgcagcactgggaatcattccaggtttaaaggttaaaggtaccgactatgaaacacctgacggcacttgtgtaagagattacattgatgtcaccgaccttgttgatgcccatgtgaaggcgctcaacaaggcacaaagaggcagagttggtatatacaatgttggcactggaaaaggtcggtcagtgaaggagttcgttgatgcctgcaagaaggcaactggagtcgacatcaaggttgactacttccctcgcagaccaggcgactacgcggaggtatacagcgaccctgccaagatcaacaaggagctgaactggacggcgcagcgcaccgacctccatgagagcctcagggtggcgtggacatggcagaaggcgcacaggagtggctatgagccgccacaggctatgattttgtga

SEQ ID NO: 15833 - protein, 497 aa, Sorghum bicolor
  misc_feature: Useful for making plants with altered carbohydrate content
  misc_feature: Functional homolog of the protein sequence given in SEQ ID NO 14274
  misc_feature: Useful for making plants with altered cell wall content and/or composition
  misc_feature: Functional homolog of the protein sequence given in SEQ ID NO 13765
  misc_feature: Ceres ANNOT ID no. 8644279
  misc_feature: Down-regulated in shoot tissues in response to methyl jasmonate treatment
  misc_feature: Down-regulated in shoot tissues in response to aminocyclopropane carboxylic treatment
  misc_feature: Down-regulated in shoot tissues in response to salicylic acid treatment
  misc_feature (141)..(489): SWISSPROT Homolog: EC 5.1.3.5 UDP-arabinose 4-epimerase
  misc_feature (152)..(414): Pfam ID: Epimerase Pfam Description: NAD dependent epimerase/dehydratase family
MTDERHCQQRLHLHLGHHLPPFACPLPRVPDSTPGCCSAFLSTLLPLGLLDLHRARQTSGAGAPIQAPMLPSTRGSRPPQRPAARSCSSALSEIMDLSSSDPKRKPRCLSKVVMLALLAAMCVVMLTQPPCHRTRPPTPTLFSIHEPGVTHVLVTGGAGYIGSHAALRLLKDSFRVTIVDNLSRGNIGAIKVLQNLFPEPGRLQFIQADLGDPEVNRIFAENAFDAVMHFAAVAYVGESTLEPLRYYHNITANTLVVLEAMATHNVKTLIYSSTCATYGEPEKMPITEGTPQFPINPYGKAKKMAEDIILDFSKSKRSDMAVMILRYFNVIGSDPEGRLGEAPRPELREHGRISGACFDAALGIIPGLKVKGTDYETPDGTCVRDYIDVTDLVDAHVKALNKAQRGRVGIYNVGTGKGRSVKEFVDACKKATGVDIKVDYFPRRPGDYAEVYSDPAKINKELNWTAQRTDLHESLRVAWTWQKAHRSGYEPPQAMIL

SEQ ID NO: 15834 - DNA, 1734 bp, Sorghum bicolor; identical to SEQ ID NO: 15822
  misc_feature: Ceres ANNOT ID no. 8644267
  misc_feature: Down-regulated in shoot tissues in response to methyl jasmonate treatment
  misc_feature: Down-regulated in shoot tissues in response to aminocyclopropane carboxylic treatment
  misc_feature: Down-regulated in shoot tissues in response to salicylic acid treatment
  misc_feature: Encodes the peptide sequence at SEQ ID NO 15835

SEQ ID NO: 15835 - protein, 577 aa, Sorghum bicolor; identical to SEQ ID NO: 15823
  misc_feature: Useful for making plants with altered carbohydrate content
  misc_feature: Functional homolog of the protein sequence given in SEQ ID NO 14218
  misc_feature: Ceres ANNOT ID no. 8644267
  misc_feature (191)..(485): SWISSPROT Homolog: EC 2.7.11.1 Non-specific serine/threonine protein kinase
  misc_feature (203)..(483): Pfam ID: Pkinase_Tyr Pfam Description: Protein tyrosine kinase

SEQ ID NO: 15836 - DNA, 2466 bp, Sorghum bicolor
  misc_feature: Ceres ANNOT ID no. 8644322
  misc_feature: Encodes the peptide sequence at SEQ ID NO 15837
atgaggtcttttccccatctgctgctgatcctggtgctactcttgatcctggagaatgtccgagcgcaacccaacagaccacttctgatcaactgcggctcgggttcaagcgccgatgtcgatggcaggacatgggtgggggacgcccgtcctgacggtaccgacttcacggtcacattgcccggagtcattgtcccagctccaaaacctgacggagggggaggagatgcgtacggggacctctacaggactgctcgcgtcttcaacgcgtcgtccacctacaacctcagcgtcgccgccgggagctacttcctccggctccatttcagccagctcttcagcaacctcagcagtggcaaggagtcggtcttcgatgtcacggccaatggcctgaggctgctctccaagttcagtgtccccggggaaatcttctggaggaacgcgaggagcaactccaccagcgatgtcattgtgaaggagtacctgctcaatgtcacctctgcaaagctggaggtcgaatttgcgccggatgccgggtcgtttgccttcatcaatgccatggaggttgtgcctgtgcccggcaactcgatcttcgattcggtcaacaaggtgggtggtgttggggtgaagggccctttcaaccttggagagagtgggattgagaccatgtatagggtgtgtgtgggaggtggcaagattgagaggaaggaggacccgcgcctctggaggaagtgggattcagatgagcattacatattcgctatgaatgctgctcgcagtatcaagaatacatccaacataagctatgtgtcaagtgatgattcggtttctgcgccgctgaggctctatgagacggccagggtaatggaggagacttctgtggtggataagaagttcaatgtgtcttggaggttcagtatagaccctggctttgattacttggttaggctgcatttctgtgagctgcagtatgaggaagcagagcagcgcaagttcaagatctacatcaacagcaagactgctgcagagaactatgatgtgtttgcaaaggctgggggcaagaacaaggcgtttcatgaggacttccttgatgctgccttgtcggaaacggacaccctttgggttcagttgggttccgagtcctctgcgacaagctctgcagctagtgaggcacttttgaatggcatggaaatctttaaggtcagccgcaatggaaatcttggccatccaacaattagaattgggggtatgagtggtggcttggataaaccaaagcggagccccaagtgggtactgatcggtgctgctgtgggtttggtgatttttatctcagttgctgctgctgtttatttctgcttttatctgcatcggaagaaaaacacttcagtgaagaaaacaaaggacaacctgccagctacaccaatggctactaatgctcgctcctcccccactcttcgcacaactggaacatttggtagctgcaggatgggtaggcagttcagtattgcagaaatcaaaacagccaccatgaactttgaggagtccttggtgattggagttggaggatttggcaaggtctacaagggtgaaactgaagatggcactccagtggcaattaagaggggtcatgcacaatctcagcagggtgtgaaggaatttgaaactgagattgagatgctctcaaggctgcgacaccggcaccttgtgtccttgattggctactgtgatgaacaaaatgagatgatcttagtttatgagcacatggcaaatggcacattgagaagccacctttatggaagtgaccttcctgctcttacatggaagcaaaggcttgaaatctgcattggtgcggcaagggggcttcactaccttcacactggacttgagaggggcgtaattcacagggatgtcaagaccaccaatattttgctagatgacaactttgtcgcgaagatggcagattttggcatctcaaaagatggcccgcctttggatcacacccatgtgagtactgctgtcaaagggagttttggttaccttgatccagagtactttatgagacaacagttaactcagagttcagatgtgtactcttttggtgttgtcctgtttgaagtgctttgtgctcgaccagtcatcaatccaaccttaccaagggatcagataaaccttcctgagtgggcattgaagtggaaaaagcagaacttacttgagaccataattgaccctcgattagagggaaattacacactggagtccatcaagcaattcagtgagatagcagaaaaatgccttgcagatgaggggaggaaccgtccttcaattggtgaagtcctgtggcacctagagagtgctttgcagttgcaccaagggcatctgcaaagttcaactgctgatgatctatcagggcatgaattgaagctctctgatgcatctgctaatatatcaggcgcatcaaagaggtag

SEQ ID NO: 15837 - protein, 821 aa, Sorghum bicolor
  misc_feature: Useful for making plants with modulated biotic stress sensitivity
  misc_feature: Functional homolog of the protein sequence given in SEQ ID NO 14099
  misc_feature: Ceres ANNOT ID no. 8644322
  misc_feature (423)..(803): SWISSPROT Homolog: EC 2.7.11.1 Non-specific serine/threonine protein kinase
  misc_feature (512)..(782): Pfam ID: Pkinase Pfam Description: Protein kinase domain
MRSFPHLLLILVLLLILENVRAQPNRPLLINCGSGSSADVDGRTWVGDARPDGTDFTVTLPGVIVPAPKPDGGGGDAYGDLYRTARVFNASSTYNLSVAAGSYFLRLHFSQLFSNLSSGKESVFDVTANGLRLLSKFSVPGEIFWRNARSNSTSDVIVKEYLLNVTSAKLEVEFAPDAGSFAFINAMEVVPVPGNSIFDSVNKVGGVGVKGPFNLGESGIETMYRVCVGGGKIERKEDPRLWRKWDSDEHYIFAMNAARSIKNTSNISYVSSDDSVSAPLRLYETARVMEETSVVDKKFNVSWRFSIDPGFDYLVRLHFCELQYEEAEQRKFKIYINSKTAAENYDVFAKAGGKNKAFHEDFLDAALSETDTLWVQLGSESSATSSAASEALLNGMEIFKVSRNGNLGHPTIRIGGMSGGLDKPKRSPKWVLIGAAVGLVIFISVAAAVYFCFYLHRKKNTSVKKTKDNLPATPMATNARSSPTLRTTGTFGSCRMGRQFSIAEIKTATMNFEESLVIGVGGFGKVYKGETEDGTPVAIKRGHAQSQQGVKEFETEIEMLSRLRHRHLVSLIGYCDEQNEMILVYEHMANGTLRSHLYGSDLPALTWKQRLEICIGAARGLHYLHTGLERGVIHRDVKTTNILLDDNFVAKMADFGISKDGPPLDHTHVSTAVKGSFGYLDPEYFMRQQLTQSSDVYSFGVVLFEVLCARPVINPTLPRDQINLPEWALKWKKQNLLETIIDPRLEGNYTLESIKQFSEIAEKCLADEGRNRPSIGEVLWHLESALQLHQGHLQSSTADDLSGHELKLSDASANISGASKR

SEQ ID NO: 15838 - DNA, 1695 bp, Sorghum bicolor
  misc_feature: Ceres ANNOT ID no. 8644426
  misc_feature: Encodes the peptide sequence at SEQ ID NO 15839
atggcgtcctccatctctgttccagctccaccggctgctccggccactgcggcgccgtcgcaggcgaggcccaagaagccgtcccagctcaacctgaccaccggcaagaccaagaccccggtccccgcgcgcccaatgcgcgccgtgcccgagtggaacccgctccagcgtctcgccgcggcggcgctcgacgcggtggaggaggggctcgtggcgggcttcctggagcgcgcgcacccgctccctcgcaccgccgacccggccgtccagatcgccggcaactacgcgcccgtcggggagcgcccgcccaccggcgacctcccggtgtccggccgcgtcccggcgtgcctcgacggcgtgtacgtccgcaacggcgcgaacccgctccacgcgccgcgcgcggggcaccacctcttcgacggcgacggcatgctccacgccgtgcggctccgcgccgggcgcgccgagtcgtacgcgtgccgcttcaccgagacggcgcgcctcaggcaggagcgcgccatcggcgagctccacggccactcgggcgtggcgcgcctcctcctgttcggtgcgcgctccctctgcggcctgctcgacgcgtcgcggggggtcggggtcgccaacgccggcctggtgtaccatgacaaccgcctcctcgccatgtccgaggacgacctcccctaccacgtgcgcgtcaccgccgacggcgacctcgagaccgtgggccgctacgacttcggcggccagctcgacaccgccatgatcgcgcacccgaagctggacccggccaccggcgagctcttctcgctcagctacaatgtcgtcaccaagccgttcctcaagtacttctacttcaccgccgacggccgcaagtcccccgacgtggagatccccgtcgacgcgcccaccatgatgcacgacttcgccgtcaccgagaaccacgccatcatcccggaccagcagatcgtcttcaagctccaggagatgctgctcggcggctcccccgtggtgtacgacaagaacaagaccgcgcggttcggagtgctgccgaagcgcgccaccgacgcgtcgcggctgcagtgggtggaggtccccgactgcttctgcttccacctctggaacgcgtgggaggacgacgccacgggcgatatcgtggtgatcgggtcctgcatgaccccggccgacgccgtgttcaacgagtccgccgccggcgaggagtccttccgcagcgtgctgtcggagatccggctggacccgcggaccggaacgtcgtcgcggcgcgcggtcctgagcgacgccgaccaggtgaacctggaggccggcatggtgaaccggcagctgctgggcaggaagacgcggtacgcctacctcgccatcgccgagccgtggcccaaggtgtcgggcttcgccaaggtggacctggaggccggcaccgtcgagaagttcatctacggcgagggccggtacggcggcgagccctgcttcgtgccgcgcccggacgcccccgcgggcgcggcggaggacgacgggtacgtgctgtgctacgtgcacgacgagggccgcggcgcgtcggaaatgctcgtcgtcaacgcccgcgacatgcgcgccgaggccgccgtgaagctgccgggccgcgtgccgtacgggttgcacggcaccttcatcgtcggcgaggagctgcagcggcaggcctag

SEQ ID NO: 15839 - protein, 564 aa, Sorghum bicolor
  misc_feature: Useful for making plants with modulated water use efficiency
  misc_feature: Functional homolog of the protein sequence given in SEQ ID NO 14275
  misc_feature: The sequence is a functional homolog of SEQ ID NO 6 in US patent 7049487
  misc_feature: Useful for making plants with modulated drought sensitivity
  misc_feature: Ceres ANNOT ID no. 8644426
  misc_feature (25)..(564): SWISSPROT Homolog: EC 1.13.11.51 9-cis-epoxycarotenoid dioxygenase
  misc_feature (71)..(557): Pfam ID: RPE65 Pfam Description: Retinal pigment epithelial membrane protein
MASSISVPAPPAAPATAAPSQARPKKPSQLNLTTGKTKTPVPARPMRAVPEWNPLQRLAAAALDAVEEGLVAGFLERAHPLPRTADPAVQIAGNYAPVGERPPTGDLPVSGRVPACLDGVYVRNGANPLHAPRAGHHLFDGDGMLHAVRLRAGRAESYACRFTETARLRQERAIGELHGHSGVARLLLFGARSLCGLLDASRGVGVANAGLVYHDNRLLAMSEDDLPYHVRVTADGDLETVGRYDFGGQLDTAMIAHPKLDPATGELFSLSYNVVTKPFLKYFYFTADGRKSPDVEIPVDAPTMMHDFAVTENHAIIPDQQIVFKLQEMLLGGSPVVYDKNKTARFGVLPKRATDASRLQWVEVPDCFCFHLWNAWEDDATGDIVVIGSCMTPADAVFNESAAGEESFRSVLSEIRLDPRTGTSSRRAVLSDADQVNLEAGMVNRQLLGRKTRYAYLAIAEPWPKVSGFAKVDLEAGTVEKFIYGEGRYGGEPCFVPRPDAPAGAAEDDGYVLCYVHDEGRGASEMLVVNARDMRAEAAVKLPGRVPYGLHGTFIVGEELQRQA

SEQ ID NO: 15840 - DNA, 1725 bp, Sorghum bicolor
  misc_feature: Ceres ANNOT ID no. 8644470
  misc_feature: Encodes the peptide sequence at SEQ ID NO 15841
atggggaacacctgcgtgggccccagcaccccctcggaccgccacagcttcttcaacaccgtctccctcgccgtgctctggcgccccccggccgccgccgccgccgccgcccgcgccgagccttccccgaccactgaacccagctcctccactccctccagggcacctgaccccgtcaccatctccgactccgagcacccgccacactccacctccacctccaccgcctcagtcccggccgcagcgccgcccaatcctaacggcaagcccaagcccaaggtgaagcgcgtgcagagcgcgggcctgctcgcgggctccgtgctgaggcgcgactccgagcggctcaaggacctgtacaccctgggcaagaagctcgggcaggggcagttcggcaccacctaccagtgcgtcgagaaggccacggggaagcacttcgcctgcaagtccatcgccaagcggaagctcgtcaacgaggaggacgttgaggacgtgcgccgcgagatccagatcatgcaccacctgtccggccaccccaacgtcgtgtccatcgtcggagcctacgaggacgccgtcgccgtgcacctcgtcatggagctgtgcgccggaggggagctgttcgataggatcatacagcgcgggcactactctgagaaagcagccgcacagttggcccgggtgatcattggggctgtagaagcatgccattcgctcggggtgatgcacagagacctcaagccagagaatttcttgtttgtcaaccaaaaggaggatgcgcctttaaaggctatcgatttcgggctttccatcttcttcaaaccaggtgaaatatttttggatgtcgttggaagtccttattatgttgcccctgaggttctgaagaaacactatggctgtgaggtggatgtgtggagtgccggtgtaatagtttatatcttattgagcggggttcctccattttgggatgaatctgaacgagggatatttgaacaagttctgaaaggcgatcttgatttttcatctgatccctggcccagtatttcagagagtgcaaaggatttggtcaggaagatgctaaaccgtgatcccagaaagagattgactgcacatgaagctctatatggagtggctcctgacaaacctctggattctgctgttttaaccagattgaaacagttttctgcaatgaataaactaaagaagatggcccttagggtcattgctgaaaatttgtccgaagatgaaattgcaggattgagagaaatgttcaaaatgctggacactgacaatagtgggcagatcacgttggaggaactaaaaagtggtttgaagagaattggtgctaacttaaaagactctgaaattacaacactaatggaggcggcagatattgataacagtggttccattgattatggagagttcctagctgcaactttgcatctgaacaaagttgagcgagaagataacctctttgcagcattctcatactttgataaagacagcagcggttacataactcatgatgagctacaaaaagcatgtgaggaatttggtatagaagatgcacacctagaagatatcatccgtgacattgatcaagacaatgatggccggatcgactacaatgagtttgtaacaatgatgcagaagggaaataatccactagggaaaaaagggcactaccagatgagctttggtcttagagaagcattgaagcttggctaa

SEQ ID NO: 15841 - protein, 574 aa, Sorghum bicolor
  misc_feature: The sequence is a functional homolog of SEQ ID NO 2 in US patent 7084323
  misc_feature: Ceres ANNOT ID no. 8644470
  misc_feature (96)..(573): SWISSPROT Homolog: EC 2.7.11.1 Non-specific serine/threonine protein kinase
  misc_feature (119)..(375): Pfam ID: Pkinase Pfam Description: Protein kinase domain
  misc_feature (417)..(445): Pfam ID: efhand Pfam Description: EF hand
  misc_feature (523)..(551): Pfam ID: efhand Pfam Description: EF hand
  misc_feature (489)..(517): Pfam ID: efhand Pfam Description: EF hand
  misc_feature (453)..(481): Pfam ID: efhand Pfam Description: EF hand
MGNTCVGPSTPSDRHSFFNTVSLAVLWRPPAAAAAAARAEPSPTTEPSSSTPSRAPDPVTISDSEHPPHSTSTSTASVPAAAPPNPNGKPKPKVKRVQSAGLLAGSVLRRDSERLKDLYTLGKKLGQGQFGTTYQCVEKATGKHFACKSIAKRKLVNEEDVEDVRREIQIMHHLSGHPNVVSIVGAYEDAVAVHLVMELCAGGELFDRIIQRGHYSEKAAAQLARVIIGAVEACHSLGVMHRDLKPENFLFVNQKEDAPLKAIDFGLSIFFKPGEIFLDVVGSPYYVAPEVLKKHYGCEVDVWSAGVIVYILLSGVPPFWDESERGIFEQVLKGDLDFSSDPWPSISESAKDLVRKMLNRDPRKRLTAHEALYGVAPDKPLDSAVLTRLKQFSAMNKLKKMALRVIAENLSEDEIAGLREMFKMLDTDNSGQITLEELKSGLKRIGANLKDSEITTLMEAADIDNSGSIDYGEFLAATLHLNKVEREDNLFAAFSYFDKDSSGYITHDELQKACEEFGIEDAHLEDIIRDIDQDNDGRIDYNEFVTMMQKGNNPLGKKGHYQMSFGLREALKLG

SEQ ID NO: 15842 - DNA, 2040 bp, Sorghum bicolor
  misc_feature: Ceres ANNOT ID no. 8644513
  misc_feature: Encodes the peptide sequence at SEQ ID NO 15843
atggtgctacccccttggacctccttcttcctcggcatcatcgtgctggccatcgcactctttctgttatccattctccaccgccgccgccacccctctggcaatagcaagtacaacctcccaccgggccctcgaccatggccggtgatcggcaacctgaacttgatcggcccactcccgcaccggtccgtccacgagctctccaagcgctacggctcgctcatgtccctgcgcttcggctccctccccgtcgtcgtcgcctcctccgtcgacatggccaggttcttcctcaagacgcacgacctggcgttcatcgaccgccctcgtaccgcgtccggcaggtacaccggctacaactactccgacatgctgtggtcgccctacggcgcgtactggcggcaggcgcgcaagttctgcaaggccgaggtgttcagcgcggcgcggctgaggtcgcaggagcacgtccgggcggcggaggtgcgcgccatgctgcgcgacctgtacgccgctgggccggcggcggcgccggtgcggctcatggaccacctgttccagctgaccatcaacgtgatctcgctcatggtgctgggcgagaagcacgccgtcgccgtcgatggcgacggcaggtcggcggcgggcggtggcttgccggcgacgcccgaggcgttcaagtggatgatcgaagagttcttcttgctgagcggcaggctcgacgtcggggacatgatcccctggctcagatggctggacccgcatgggcacgtcaggaggttgaagaggcttagggagatgttcgaccatttcctggacaatgttgtggacgagcacagcgagcggcggtggcgagagggcgacgcgttcgtcgccatggacgcggtggacctgctgctggagctcgccgacgatcccaatctagaggtcccaatccagcgagatggcatcaaggcattcacgctgaacctccttgtcggattgccggacacgacgtcggtgaccgtggaatgggccatgtcggagctcctgaggaaccccgacgcgctcgccacggccaccgaggagctggaccgcgtcgtcggccgcgagcgcctcgtcgtcacggagggggacatcccgagcctcccgtacatggaggcggtcgtgaaggagacgatgcggctgcacccggtgtcgccgctgctgacgccccggctgtcgcgcgaggacgtcgtcgtgtccgtgggcgggcacgggcacgggcacgggcacgacatcccggcgggcacgctggtgttcgtcaacgtctgggccatcgcccgcgaccccgccgtgtgggggcggaccgccggcgagttccggccggagcggttcgtcgggagcggcgtggacgtgaaggggcaggacctggagctgctgcccttcgggtccggccgccggatgtgccccggcgtctcgctcgggctgaggatggtccaggtgatcctcgccaacctcgtccacggctacgcgtggaagctcccggacggcgtcgccggggaggagctgagcatggaggagacgttcgggctgtccatgccgcgcaaggtccggctcgacgccgtcgccgagccaaggttgccggcgcacctgtacctcaatgagatccacacggtggcccaggtgagcaagaacgacttcgtggcgtgcaacctgcagggcaacagcagtcagttcaagttctggaactccggcaacgacgtcgtgacgctggacaagcccggcaagatgtggttcatctgcaccaagcacaaccactgccgcaagggcatgaagctcgccatcgacgtcgtcgaccgcaccgtcgtcgtcgccccatccccagccccgctcccgggaactgccccgcctcccccacctcctccgttcggttggccgtcgaccccggccccgccgcccccacctccgttcggttggcggtcgacaccggcgccgcctccgccgcggtctgtggccgtgaggaacgcggtcggcggcgcggtggccgcggcggcagccgccgtggtcgcggccgcgctcgcgttctag

SEQ ID NO: 15843 - protein, 679 aa, Sorghum bicolor
  misc_feature: Useful for making plants with altered carbohydrate content
  misc_feature: Functional homolog of the protein sequence given in SEQ ID NO 14183
  misc_feature: Ceres ANNOT ID no. 8644513
  misc_feature (14)..(536): SWISSPROT Homolog: EC 1.14.13.88 Flavonoid 3',5'-hydroxylase
  misc_feature (41)..(525): Pfam ID: p450 Pfam Description: Cytochrome P450
  misc_feature (531)..(595): Pfam ID: Cu_bind_like Pfam Description: Plastocyanin-like domain
MVLPPWTSFFLGIIVLAIALFLLSILHRRRHPSGNSKYNLPPGPRPWPVIGNLNLIGPLPHRSVHELSKRYGSLMSLRFGSLPVVVASSVDMARFFLKTHDLAFIDRPRTASGRYTGYNYSDMLWSPYGAYWRQARKFCKAEVFSAARLRSQEHVRAAEVRAMLRDLYAAGPAAAPVRLMDHLFQLTINVISLMVLGEKHAVAVDGDGRSAAGGGLPATPEAFKWMIEEFFLLSGRLDVGDMIPWLRWLDPHGHVRRLKRLREMFDHFLDNVVDEHSERRWREGDAFVAMDAVDLLLELADDPNLEVPIQRDGIKAFTLNLLVGLPDTTSVTVEWAMSELLRNPDALATATEELDRVVGRERLVVTEGDIPSLPYMEAVVKETMRLHPVSPLLTPRLSREDVVVSVGGHGHGHGHDIPAGTLVFVNVWAIARDPAVWGRTAGEFRPERFVGSGVDVKGQDLELLPFGSGRRMCPGVSLGLRMVQVILANLVHGYAWKLPDGVAGEELSMEETFGLSMPRKVRLDAVAEPRLPAHLYLNEIHTVAQVSKNDFVACNLQGNSSQFKFWNSGNDVVTLDKPGKMWFICTKHNHCRKGMKLAIDVVDRTVVVAPSPAPLPGTAPPPPPPPFGWPSTPAPPPPPPFGWRSTPAPPPPRSVAVRNAVGGAVAAAAAAVVAAALAF

SEQ ID NO: 15844 - DNA, 1119 bp, Sorghum bicolor
  misc_feature: Ceres ANNOT ID no. 8644633
  misc_feature: Encodes the peptide sequence at SEQ ID NO 15845
atggatccaatgctgaacccggtgaaggaggagagccatggggatggaggagatttgctggcagcaggcacggaggagaccggggacgggccgtccgctgcggtcgccgcggcgccaaggccgatggagggtctgcatgaccctgggccgccgccgttcctcaccaagacgtatgacatggttgacgacccgtccaccgacccggttgtgtcgtggagcgccaccaacaacagcttcgtggtctgggatccacacgccttcgcaaccgtgctgctgcccaggcacttcaagcacaacaacttctccagcttcgtccgccagctcaacacctatggtttcaggaaggtggatcctgatcggtgggaatttgcgaacgagggttttttacggggacagagacagctcctgaagaacatcaggcgtcgaaaacctcctgctcagaatgccacaaaccagcagtcccttgggccataccttgaggtggggcattttggatttgatgcagagattgacaggctgaagagagacaagcagttattgatggcagaagtggtgaagctaaggcaggagcagcagaacacaaaggcaaatctcaaagccatggaggataggctacaagggactgaacagaagcagcagcagatgatggcattcttggcacgtgtcatgcggaatcctgaattcctgaagcacctgatttcccagaatgagatgagaaaggagctccaagatgctatttcaaagaaaagaagacgccgcatcgatcaaggccctgaacttgatgacttgggagctggtagcagcctagagcaaggttcaccggtcctgtttaacccccaggatccggttgaattccttgtcgacggaatcccaactgaccttgagagtccagcttttgatggccaaagcctgatcgagccacaggacattgatattggcagtacctctgagcagcagcaggatatgccccaggaggatttgaatgacaacttctgggagcaattgctgaatgaaggccttggtgaagagaacggtagccctgttatcgaggatgatatgaatgtgctgtccgagaagatgggatttctcaactcagatggcccaacatctaccatttag

SEQ ID NO: 15845 - protein, 372 aa, Sorghum bicolor
  misc_feature: The sequence is a functional homolog of SEQ ID NO 1687 in the 10/412,699 US patent application
  misc_feature: The sequence is a functional homolog of SEQ ID NO 1685 in the 10/412,699 US patent application
  misc_feature: The sequence is a functional homolog of SEQ ID NO 2660 in the 10/374,780 US patent application
  misc_feature: The sequence is a functional homolog of SEQ ID NO 74 in the 10/225,066 US patent application
  misc_feature: The sequence is a functional homolog of SEQ ID NO 926 in the 10/412,699 US patent application
  misc_feature: The sequence is a functional homolog of SEQ ID NO 1686 in the 10/412,699 US patent application
  misc_feature: The sequence is a functional homolog of SEQ ID NO 200 in the 10/225,068 US patent application
  misc_feature: The sequence is a functional homolog of SEQ ID NO 2428 in the 10/374,780 US patent application
  misc_feature: The sequence is a functional homolog of SEQ ID NO 942 in the 11/435,388 US patent application
  misc_feature: Useful for making plants with modulated heat sensitivity
  misc_feature: Functional homolog of the protein sequence given in SEQ ID NO 14276
  misc_feature: The sequence is a functional homolog of SEQ ID NO 2201 in the 10/666,642 US patent application
  misc_feature: The sequence is a functional homolog of SEQ ID NO 865 in the 10/666,642 US patent application
  misc_feature: The sequence is a functional homolog of SEQ ID NO 142 in the 10/666,642 US patent application
  misc_feature: Useful for making plants with modulated biomass
  misc_feature: Functional homolog of the protein sequence given in SEQ ID NO 13700
  misc_feature: The sequence is a functional homolog of SEQ ID NO 2203 in the 10/666,642 US patent application
  misc_feature: The sequence is a functional homolog of SEQ ID NO 2205 in the 10/666,642 US patent application
  misc_feature: The sequence is a functional homolog of SEQ ID NO 2207 in the 10/666,642 US patent application
  misc_feature: The sequence is a functional homolog of SEQ ID NO 1418 in the 10/666,642 US patent application
  misc_feature: The sequence is a functional homolog of SEQ ID NO 378 in the 10/374,780 US patent application
  misc_feature: The sequence is a functional homolog of SEQ ID NO 80 in the 10/225,066 US patent application
  misc_feature: The sequence is a functional homolog of SEQ ID NO 950 in the 10/412,699 US patent application
  misc_feature: Ceres ANNOT ID no. 8644633
  misc_feature (51)..(219): Pfam ID: HSF_DNA-bind Pfam Description: HSF-type DNA-binding
MDPMLNPVKEESHGDGGDLLAAGTEETGDGPSAAVAAAPRPMEGLHDPGPPPFLTKTYDMVDDPSTDPVVSWSATNNSFVVWDPHAFATVLLPRHFKHNNFSSFVRQLNTYGFRKVDPDRWEFANEGFLRGQRQLLKNIRRRKPPAQNATNQQSLGPYLEVGHFGFDAEIDRLKRDKQLLMAEVVKLRQEQQNTKANLKAMEDRLQGTEQKQQQMMAFLARVMRNPEFLKHLISQNEMRKELQDAISKKRRRRIDQGPELDDLGAGSSLEQGSPVLFNPQDPVEFLVDGIPTDLESPAFDGQSLIEPQDIDIGSTSEQQQDMPQEDLNDNFWEQLLNEGLGEENGSPVIEDDMNVLSEKMGFLNSDGPTSTI

SEQ ID NO: 15846 - DNA, 696 bp, Sorghum bicolor
  misc_feature: Ceres ANNOT ID no. 8644665
  misc_feature: Encodes the peptide sequence at SEQ ID NO 15847
atggccgccattccttctcctttgcatccactactcgccatcgtcgccgccgccgccatgctcgtcctcctcctcccctccccgtccctcgccggcgacgccgacctgctccaggacatctgcgtcgctgacctcacgtccaccgtgaaggtgaacgggttcgcctgcaaggccggcgccgtgacgtcggacgacttctacttcaaaggcctcgccgtcgccggcaacaccagcgccaccgccaccggctcggtcgtcaccgccgccaacgtcgagaagatccccggcctgaacacgctgggcgtctccctctcccggatcgactacgcgccgggcggggtgaacccgccgcacacgcacccgcgcgccaccgaggtgatcttcgtcctccagggcacgctggacgtgggcttcgtcaccgcggccggcaaccggctcgtcgccaagaccctctccgcgggggacgtgttcgtgttcccgcgcggcctggtccacttccagcggaacgccggcgacgacgcgcccgccgccgtgctgtcggcgttcaacagccagctccctgggacgcagtcgctcgccgcggcgatgttcgccgccgagccggaggtgccggacgccgtgctgacgaaggcgttccaggtcggtaccaaggaggtggagaagattaaggctaggcttgcacccaaaaagggctga

SEQ ID NO: 15847 - protein, 231 aa, Sorghum bicolor
  misc_feature: Useful for making plants with modulated nitrogen use efficiency
  misc_feature: Functional homolog of the protein sequence given in SEQ ID NO 14277
  misc_feature: Ceres ANNOT ID no. 8644665
  misc_feature (33)..(230): SWISSPROT Homolog: EC 1.15.1.1 Superoxide dismutase
  misc_feature (69)..(220): Pfam ID: Cupin_1 Pfam Description: Cupin
  misc_feature (105)..(182): Pfam ID: Cupin_2 Pfam Description: Cupin domain
MAAIPSPLHPLLAIVAAAAMLVLLLPSPSLAGDADLLQDICVADLTSTVKVNGFACKAGAVTSDDFYFKGLAVAGNTSATATGSVVTAANVEKIPGLNTLGVSLSRIDYAPGGVNPPHTHPRATEVIFVLQGTLDVGFVTAAGNRLVAKTLSAGDVFVFPRGLVHFQRNAGDDAPAAVLSAFNSQLPGTQSLAAAMFAAEPEVPDAVLTKAFQVGTKEVEKIKARLAPKKG

SEQ ID NO: 15848 - DNA, 825 bp, Sorghum bicolor
  misc_feature: Ceres ANNOT ID no. 8644680
  misc_feature: Encodes the peptide sequence at SEQ ID NO 15849
atggcggggcagccgccgccgcccgggggctccgaggacgacttcctcgagcacttcttcgccttcccctccgcggcctccgccgccgccgggggacacgcgggcgccggtgccggcggggaccaccccttccccctcgccctcagcctcgacgccgccgccgagcccaagccggaccgtgaccccgtgcagctcgccggcctcttcccgccggtgttcgctggcgccggcggcgtgcagcaaccgcacctccgcggcccaccgcctccgcaggcgcagccgaagccgggcgagggaggcatggcgccgcagccgccagccccacggcccaaggtgcgcgcgcggcgggggcaggccaccgatccccacagtatcgcggagaggctaaggagagagagaattgcagaaaggatgagggcattgcaggaattggtccccaacacaaacaagacagatagggcagctatgctagatgagatccttgattacgtgaagtttcttaggcttcaagtaaaggttttgagtatgagcagacttggtggtgctggtgcagttgcacagctggttgctgatattccactctcagttaagggtgaggcaagcgacagtgggagcacacagcacatatgggaaaagtggtcaactgatggcacagaaaagcaggtagcgaagctgatggaagaagacatcggggcagcgatgcagttccttcaatccaaagcgctatgcatgatgccgatctcgcttgcaatggcaatctacgacacccaacattcccaggatggccactcactgatgaagcctgagcccaacacatcctcgtag

SEQ ID NO: 15849 - protein, 274 aa, Sorghum bicolor
  misc_feature: The sequence is a functional homolog of SEQ ID NO 1106 in the 10/225,066 US patent application
  misc_feature: The sequence is a functional homolog of SEQ ID NO 220 in the 10/225,068 US patent application
  misc_feature: The sequence is a functional homolog of SEQ ID NO 2368 in the 10/374,780 US patent application
  misc_feature: The sequence is a functional homolog of SEQ ID NO 390 in the 10/412,699 US patent application
  misc_feature: The sequence is a functional homolog of SEQ ID NO 909 in the 11/479,226 US patent application
  misc_feature: The sequence is a functional homolog of SEQ ID NO 1211 in the 11/479,226 US patent application
  misc_feature: The sequence is a functional homolog of SEQ ID NO 546 in the 10/412,699 US patent application
  misc_feature: The sequence is a functional homolog of SEQ ID NO 1488 in the 11/479,226 US patent application
  misc_feature: The sequence is a functional homolog of SEQ ID NO 712 in the 10/412,699 US patent application
  misc_feature: Ceres ANNOT ID no. 8644680
  misc_feature (119)..(168): Pfam ID: HLH Pfam Description: Helix-loop-helix DNA-binding domain
MAGQPPPPGGSEDDFLEHFFAFPSAASAAAGGHAGAGAGGDHPFPLALSLDAAAEPKPDRDPVQLAGLFPPVFAGAGGVQQPHLRGPPPPQAQPKPGEGGMAPQPPAPRPKVRARRGQATDPHSIAERLRRERIAERMRALQELVPNTNKTDRAAMLDEILDYVKFLRLQVKVLSMSRLGGAGAVAQLVADIPLSVKGEASDSGSTQHIWEKWSTDGTEKQVAKLMEEDIGAAMQFLQSKALCMMPISLAMAIYDTQHSQDGHSLMKPEPNTSS

SEQ ID NO: 15850 - DNA, 4836 bp, Sorghum bicolor
  misc_feature: Ceres ANNOT ID no. 8644709
  misc_feature: Encodes the peptide sequence at SEQ ID NO 15851
atgttcctgataatgactgttagtgctattgggtttgcacatgttgtgttaagtgctttgttgactttctttatcttttgcttgtgcatagttgtggcagtggaaatggcacagagtattgtgatgcaaatacatgtattcttcttgcaacaaccacaagattctagtatgataggtctatctaatgtttataaactgaatgtgctgattgatatgctgaccaatgaattttcaggaacaagaagatgcagagcaaagccacaaaagaaggaaaaggaatccacagaaaacagcaaactggagaatggatctcaggatgcaacagaagaggtgcatcatggagtcgaaaaaggtgatggacatgttacccgcaagagaccaaggagagcagcagcgtgttctgatttcaaagagaaatccatacgcttatccgaaaaaaaatctgttgtcatggtcaagaagaatcggatggaggaagaagaaatagatgctgtgagtctgacaaaacttggaccagaagatccaccaccttgccggaagttgattgatttcatcttgcatgatgcagaagggaacccacagccctttgaaatgtcagaaattgatgacttcttcataacagctcttatcatgcccatggatgatgatcttgaaaaagagcgtgaaagaggagtacgatgtgaaggatttgggcgaattgaggactggaatatttctggttatgatgaaggtactcctgtagtctgggtgtcaactgatgttgctgactatgaatgtgtgaaaccagcaaccaattacaaatcttattttgaccacttctatgagaaggctcaggtctgtgttgaagttttcaaaaagcttgcaaaatcagttggtgggaatcctaaccagggtctggatgaattgcttgctagtgttgttcggtcaattaatgccatgaaaggatatagtggaaacatgagcaaagatttggtgatctccattggagaatttgtatacaatcaacttgttggtttggatgagacatcaagcaatgatgatgaaaagtttgctaccctgccagttcttctttctctaagagaccagtgcagatctagggtggaactgaccaagctgccctctaacatctcgaacacgagtctgaaaattaaggacacagtgtgtgaagggacagcggaagaagaagatgatgatgcaaaattagctagattacttcaacaagaagaagaatggaaaatgatgaagaaacagaggggtaggcgtggaacaccatcccagaaaaatgtctatataaaaataagtgaagctgagattgccaatgactatccccttcctgcatactataagccatttagccaagaaatggatgaatacatatttgatagcgatgacagtatattttctgatgatgtgccagtgaggatactcaataactggactctgtacaatgcagattccaggcttatatctttggaattgatccctatgaaatcaggagcagaaaatgatgtggttgtctttggatctggtttcatgagagatgatgatggcagttgctgttctacagctgagtctgtgaaatcgtcgtcttcctccagcaaagctgaccaacaggatgctggagtccctatttatttgagcccaatcaaagaatggcttatagagtttggtggatcaatgatttgtataaccattcggactgatgtggcctggtacaagctacgccaaccaacaaaacaatatgctccatggtgtgagcctgtactgaaaacagcaaggcttgctgttagcatcatcaccctgttaaaagagcagagtcgtgcctcaaaactttcttttgctgatgtcatcaaaaaagtagctgaatttgacaaagggaatcctgcatttatatcttctaacatcgcacttgttgagaggtatattgtggtgcatggacagataatattgcagcagtttgcagattttccagatgagactatccgccggagtgcatttgttagtggtcttttattgaagatggaacagaggaggcatacaaagctagttatgaagaagaaaactcaagtaatgaggggagagaatctgaatccaagtgcagcaatgggtccggcatcgaggagaaaagcgatgcgtgcaacaacaaccaggttgatcaacagaatctggagtgattactatgcacatcatttccctgaagattccaaggagggagatggaaatgaagcaaaagaagttgatgatgaacaagaagaaaatgaagatgaggatgctgaagatgaagggcagattgaagaggataagatctcaaagactccaccatcaacacggtcccgaaagttgctatcacaaacttgtaaggaaataagatgggaaggtgaaacatctgggaaaacatcgtctggagaaactctttacaaatgtgcttatgttagagaactcagaatacctgttggtggaacagtggtgctagaagatgattcaggagacacagtcatgtgttttgttgagtacatgtttcagaaaagtggtggtgcaaaaatggttcacgggaggattctgcaaaaaggttcacataccattcttgacaatgctgcaaatgagagggaggttttcttaactaatgattgtttagaattcaaattagatgacatcaaggaattggtaagtgttgatatccaatcgagaccttggggtcacaagtatagaaaagagaattctgaaactgataaagttgagcaggcgaaagcagaagagagaaagaaaaagggcctgcccatggtatatttctgcaaaagcttatactggcctgagaagggtgccttctttgccctcccccgtgataaaatgggtcttggtagtggtgtatgtagttcttgtgaacatatagagccagattctgatgaattgaaagtactttcgaagaccagctttgtctacagaaaggttacatataatgtcaatgactttttatacataaggcctgattttttctctgaagatgaggatcgtgcaaccttcaaggctggccgaaatgtgggtctaaagccctatgcagtttgtcaaatactggccatccctgaaggagctggatctaaaaaactcaatccagcatcagcaaatataagtgctagaagattttatagaccagatgacatttcgacagccaaagcctatgcatctgatatcagagaggtctactatagtgaagatgtaattgatgtgcctgtggatatgatagagggaaaatgtgaggttagaaagaagaatgatcttgcaagttcagaccttccagtgatgtttgaacatgtatttttctgtgaacttatatatgaccgtgccagtggagctctcaagcagttgcctccaaatgttaggtttatgtccatggtgcaaaaggcaacaattgcttcgaaaaagaacaaaggaaagcagatctgtgagactgatcaaatagattcaggtaaatggttggatgtgccaaaagagaaccgtctagctacgcttgacatttttgctggctgtggaggtttatcagaaggtctgcagcaagctggtgtatcttttacaaaatgggcaattgaatatgaagagcctgctggtgaagcatttagcaaaaatcatccagaggctgtggtctttgtagataactgcaatgttattctaaaggcaattatggataaatgtggggatactgatgactgcatttcaacttctgaagctgctgaacaagcagcaaaacttcctgaactgaacattaataaccttccagtccctggtgaagtagaattcataaatggtggtcctccgtgtcagggattctctgggatgaatagattcaaccaaagcccttggagtaaagttcagtgtgagatgattctagcattcctctcattcgcagagtatttccgtcccagattctttcttttagaaaatgttcggaactttgtttcattcaacaaagggcagaccttccgattagcagttgcatctcttctggagatgggataccaggtccggtttggaattctagaagcaggggcttttggtgttgctcagtccaggaaaagggcattcatttgggctgctgcacctggagagatgcttcctgattggccagagccgatgcatgtgtttgctagccctgagctgaagataacactgcctgatggccaatactatgcagctgccagaagcactgctggtggagcgcctttccgggcgattactgttagagatacaattggggatctgcctaaagtggaaaatggtgccagcaaactcacacttgagtacggaggtgagcccgtgtcctggttccagaagaagataagagggaatatgatggtactgaatgatcacatatccaaggagatgaatgagctgaacctcataaggtgccaacacattccgaaacgaccaggttgtgactggcatgacctaccagacgagaaggtgaagctgtctaatgggcagatggctgacctgataccttggtgcctgcccaacacagccaagagacataatcagtggaaagggctgtacgggaggctggactgggaaggcaacttccccacatctgtcacagacccccagccaatgggcaaggttggcatgtgcttccatcctgaccaggacaggatcattacggtccgagaatgcgctcggtctcagggctttcctgacagctatgagtttgcgggcaacatccagaacaagcaccggcagattggcaatgctgtgcccccgcctcttgcctatgcgctcgggaggaagctgaaggaagctgttgacaacaagcgtcaggaagctggcgtgggcgtccctgcaccatga

SEQ ID NO: 15851 - protein, 1611 aa, Sorghum bicolor
  misc_feature: Useful for making plants with modulated endosperm cell number
  misc_feature: Useful for making plants with modulated endosperm cell size
  misc_feature: Useful for making plants with modulated seed quality
  misc_feature: Functional homolog of the protein sequence given in SEQ ID NO 13523
  misc_feature: Ceres ANNOT ID no. 8644709
  misc_feature: Down-regulated in shoot tissues in response to salicylic acid treatment
  misc_feature (336)..(1601): SWISSPROT Homolog: EC 2.1.1.37 DNA (cytosine-5-)-methyltransferase
  misc_feature (983)..(1122): Pfam ID: BAH Pfam Description: BAH domain
  misc_feature (814)..(946): Pfam ID: BAH Pfam Description: BAH domain
  misc_feature (1166)..(1595): Pfam ID: DNA_methylase Pfam Description: C-5 cytosine-specific DNA methylase
MFLIMTVSAIGFAHVVLSALLTFFIFCLCIVVAVEMAQSIVMQIHVFFLQQPQDSSMIGLSNVYKLNVLIDMLTNEFSGTRRCRAKPQKKEKESTENSKLENGSQDATEEVHHGVEKGDGHVTRKRPRRAAACSDFKEKSIRLSEKKSVVMVKKNRMEEEEIDAVSLTKLGPEDPPPCRKLIDFILHDAEGNPQPFEMSEIDDFFITALIMPMDDDLEKERERGVRCEGFGRIEDWNISGYDEGTPVVWVSTDVADYECVKPATNYKSYFDHFYEKAQVCVEVFKKLAKSVGGNPNQGLDELLASVVRSINAMKGYSGNMSKDLVISIGEFVYNQLVGLDETSSNDDEKFATLPVLLSLRDQCRSRVELTKLPSNISNTSLKIKDTVCEGTAEEEDDDAKLARLLQQEEEWKMMKKQRGRRGTPSQKNVYIKISEAEIANDYPLPAYYKPFSQEMDEYIFDSDDSIFSDDVPVRILNNWTLYNADSRLISLELIPMKSGAENDVVVFGSGFMRDDDGSCCSTAESVKSSSSSSKADQQDAGVPIYLSPIKEWLIEFGGSMICITIRTDVAWYKLRQPTKQYAPWCEPVLKTARLAVSIITLLKEQSRASKLSFADVIKKVAEFDKGNPAFISSNIALVERYIVVHGQIILQQFADFPDETIRRSAFVSGLLLKMEQRRHTKLVMKKKTQVMRGENLNPSAAMGPASRRKAMRATTTRLINRIWSDYYAHHFPEDSKEGDGNEAKEVDDEQEENEDEDAEDEGQIEEDKISKTPPSTRSRKLLSQTCKEIRWEGETSGKTSSGETLYKCAYVRELRIPVGGTVVLEDDSGDTVMCFVEYMFQKSGGAKMVHGRILQKGSHTILDNAANEREVFLTNDCLEFKLDDIKELVSVDIQSRPWGHKYRKENSETDKVEQAKAEERKKKGLPMVYFCKSLYWPEKGAFFALPRDKMGLGSGVCSSCEHIEPDSDELKVLSKTSFVYRKVTYNVNDFLYIRPDFFSEDEDRATFKAGRNVGLKPYAVCQILAIPEGAGSKKLNPASANISARRFYRPDDISTAKAYASDIREVYYSEDVIDVPVDMIEGKCEVRKKNDLASSDLPVMFEHVFFCELIYDRASGALKQLPPNVRFMSMVQKATIASKKNKGKQICETDQIDSGKWLDVPKENRLATLDIFAGCGGLSEGLQQAGVSFTKWAIEYEEPAGEAFSKNHPEAVVFVDNCNVILKAIMDKCGDTDDCISTSEAAEQAAKLPELNINNLPVPGEVEFINGGPPCQGFSGMNRFNQSPWSKVQCEMILAFLSFAEYFRPRFFLLENVRNFVSFNKGQTFRLAVASLLEMGYQVRFGILEAGAFGVAQSRKRAFIWAAAPGEMLPDWPEPMHVFASPELKITLPDGQYYAAARSTAGGAPFRAITVRDTIGDLPKVENGASKLTLEYGGEPVSWFQKKIRGNMMVLNDHISKEMNELNLIRCQHIPKRPGCDWHDLPDEKVKLSNGQMADLIPWCLPNTAKRHNQWKGLYGRLDWEGNFPTSVTDPQPMGKVGMCFHPDQDRIITVRECARSQGFPDSYEFAGNIQNKHRQIGNAVPPPLAYALGRKLKEAVDNKRQEAGVGVPAP

SEQ ID NO: 15852 - DNA, 600 bp, Sorghum bicolor
  misc_feature: Ceres ANNOT ID no. 8644697
  misc_feature: Down-regulated in shoot tissues in response to salicylic acid treatment
  misc_feature: Encodes the peptide sequence at SEQ ID NO 15853
atggagatcgtcgacgccgacaacctgagcgccaccgagctccgcctcggcctgccgggaaccagcagcagcgacgactggcagaagaagccgtcgccctccgtcggggccaagcgcgctctggacgacaccaggagcgaggcctcggggaccagctcgccggccaccgccgcagacctcgacctcgaccacgaccacgacgccgcaccgcctcccaaggcgcaagtcgtcgggtggccgccggtgagggcgtacaggaagaacaccttccaggcggcggcggcggcggccaagaaggccgaccagcagcagcagcagcagggaggagggctgtatgtgaaggtgagcatggacggggcgccgtacctcaggaaggtggacctcagaatgtacaaggggtacagggagctcagggaggcgctggacgccctcttcaccaagtccttctcggccgccgcggcggagggcggcgaccaccagcacgccatcgcgtacgaggacaaggacggcgatctcatgctcgtcggagacgtgccctgggatatgttcatctcctcatgcaagaagctcaggataatgaagggctctgaggccaggtga

SEQ ID NO: 15853 - protein, 199 aa, Sorghum bicolor
  misc_feature: The sequence is a functional homolog of SEQ ID NO 636 in the 11/479,226 US patent application
  misc_feature: The sequence is a functional homolog of SEQ ID NO 656 in the 11/479,226 US patent application
  misc_feature: The sequence is a functional homolog of SEQ ID NO 652 in the 11/479,226 US patent application
  misc_feature: Useful for making plants with altered terpenoid content
  misc_feature: Functional homolog of the protein sequence given in SEQ ID NO 14048
  misc_feature: Useful for making plants with altered alkaloid content
  misc_feature: Functional homolog of the protein sequence given in SEQ ID NO 13611
  misc_feature: Ceres ANNOT ID no. 8644697
  misc_feature (8)..(199): Pfam ID: AUX_IAA Pfam Description: AUX/IAA family
MEIVDADNLSATELRLGLPGTSSSDDWQKKPSPSVGAKRALDDTRSEASGTSSPATAADLDLDHDHDAAPPPKAQVVGWPPVRAYRKNTFQAAAAAAKKADQQQQQQGGGLYVKVSMDGAPYLRKVDLRMYKGYRELREALDALFTKSFSAAAAEGGDHQHAIAYEDKDGDLMLVGDVPWDMFISSCKKLRIMKGSEAR

SEQ ID NO: 15854 - DNA, 1755 bp, Sorghum bicolor
  misc_feature: Ceres ANNOT ID no. 8644816
  misc_feature: Encodes the peptide sequence at SEQ ID NO 15855
atgcgcgccaccacctccgccgcggctccttgcttgccgtggttgcgtagccacggcagggcctcgtcggcggccgcctacaccgccgtggccgcctgcctactcgcgcttgtgaccttcttggtggtggctgccttctgggaccccaggacacaagcttccacctggttcctgtcgtcgtcgtcgtcgtcgtctgcctcgtccttgacgactgccggtggagttggcggtgagcacctcctggccaccgccagttcgtactactccgacggcggcggcggcggcggcaggaacagcactggcaaggaggtgcacgaggaggtccgcggtcagggtggtgatgacgatggcttcctctccttggtcaactccagctccggcggctatggagcgccgccgcctcatcagatctccgtcacgcggcaaccacccgcatcggcaccggcgcccgccgcactggctccggcggcgtctccagtgacggggaactcagatgaggtgatccgagccacgccgcaagttcagaggagcagcgacatcaaattggagcgattagaattaggtctcgcgaaagctcggtcggcgataatggaagccatccgaaacaaggacaagagatctcccttgcctgacaaggattacgtgccaatggggccaatctacagaaatgcccatgcatttcacaggagctacctggaaatggagaagcagctgaaggtgtacgtgtacgaggaaggcgagccgccggtgttccacgacggtccctgccggagcatctactcgacggagggcaggttcatccacgccatggagacggcgacccggctgcggaccagtgacccgagccaagcccacgtcttcttcctccccttcagcgtcgtcaagatggtgaagaccatctacgagccgggatcccacgacatggccccgctgaagcgcaccgtcgccgactacctccgcgtgatctccgacaagtaccccttctggaaccgcagcgccggcgccgaccacttcatgctctcctgccatgactggggcccgtacgtgtcgtcggcgaacgcggagctgttcggcaactccatccgggtgctgtgcaacgccaacacgtcggaagggttcgacctggccaaggacgtgtcgctgccggagatcaacctgcggagcgacgccgtggagaggcaggtaggtggcccgtcggcgtcgcggcgcccgttcctggccttcttcgccggcggcaaccacggtcccgtccgccccgcgctgctcgcgcactggggacccgggagcgggcgagaagacgacccggacgtgcgggtgagcgagtacctgcccacccgcggcggccgcgccggcgcgtcggcggcggcgtacacggacatgatgcggcggagcaggttctgcctgtgccccggcgggtacgaggtggcgtcgccgcggctggcggaggcggtgtacctggagtgcgtccccgtcgtggtggacgacggcgagtacgcgctgccgttcgcggacgtgctcaactgggacgccttcgcggtgagggtgcgcgtcgccgacgtcccgaggatcaaggagatcctgtcggcggtgtcgccgcggcagtacatccggatgcagaggcgggtgaggatggtgcgccggcacttcatggtgcacggcggaccgccgcgccggtacgacgcgttccacatgatcctccactccgtctggctccggaggctcaacgtccggatcgatgctcatgcacaaggctga

SEQ ID NO: 15855 - protein, 584 aa, Sorghum bicolor
  misc_feature: Useful for making plants with altered cell wall content and/or composition
  misc_feature: Functional homolog of the protein sequence given in SEQ ID NO 14278
  misc_feature: Ceres ANNOT ID no. 8644816
  misc_feature (240)..(542): Pfam ID: Exostosin Pfam Description: Exostosin family
MRATTSAAAPCLPWLRSHGRASSAAAYTAVAACLLALVTFLVVAAFWDPRTQASTWFLSSSSSSSASSLTTAGGVGGEHLLATASSYYSDGGGGGGRNSTGKEVHEEVRGQGGDDDGFLSLVNSSSGGYGAPPPHQISVTRQPPASAPAPAALAPAASPVTGNSDEVIRATPQVQRSSDIKLERLELGLAKARSAIMEAIRNKDKRSPLPDKDYVPMGPIYRNAHAFHRSYLEMEKQLKVYVYEEGEPPVFHDGPCRSIYSTEGRFIHAMETATRLRTSDPSQAHVFFLPFSVVKMVKTIYEPGSHDMAPLKRTVADYLRVISDKYPFWNRSAGADHFMLSCHDWGPYVSSANAELFGNSIRVLCNANTSEGFDLAKDVSLPEINLRSDAVERQVGGPSASRRPFLAFFAGGNHGPVRPALLAHWGPGSGREDDPDVRVSEYLPTRGGRAGASAAAYTDMMRRSRFCLCPGGYEVASPRLAEAVYLECVPVVVDDGEYALPFADVLNWDAFAVRVRVADVPRIKEILSAVSPRQYIRMQRRVRMVRRHFMVHGGPPRRYDAFHMILHSVWLRRLNVRIDAHAQG

SEQ ID NO: 15856 - DNA, 2184 bp, Sorghum bicolor
  misc_feature: Ceres ANNOT ID no. 8644868
  misc_feature: Encodes the peptide sequence at SEQ ID NO 15857
atggcgctccaggcatcgtcgtcgccgtccgcgttccgtgcggtaacggccaccgccaacgcttcctgccgccggcagttccaggtgcgcgctcaggtggccggcggcagcagcagcagcagcgtcggagccgacggcgccgggaagatgatgttttccaaggcggagccggcggcggcggccacgtcgtcgggttcctcaggtccgtggaagatcgacttcacctccggcgagaagccggcgacgccgctgctggacacggtgaactacccgctccacatgaagaacctctccacctcggagctggagcagctggcggcggagctccgcgcggagatcgtgcacacggtttccaagaccggcggccacctgagctccagcctgggcgtggtggagctctcggtggcgctgcaccacgtgttcgacacccccgacgacaagatcatctgggacgtcggccaccaggcgtacggccacaagatcctgacggggcggcgctcccggatgcacaccatccggcagacctccggcctggcggggttcccgaagcgcgacgaaagcgcgcacgacgcgttcggcgtgggacacagctccaccagcatctcggcggcgctgggcatggccgtggcgagggacctcctcggccgcaagaaccacgtcgtctccgtcatcggcgacggcgccatgacggccgggcaggcgtacgaggccatgaacaactccggcttcctcgacgccaacatgatcgtggtgctcaacgacaacaagcaggtctccctgccgaccgccacgctcgacggcccgtcgaagcccgtcggcgcgctgagccgggcgctcaccaagctccagtccagcaccaagttccggcgcctccgggaggcggccaagtcggtgacgaagcagatcggcgggccgacgcacgaggtcgccgccaaggtggacgagtacgcgcgcggcatgatgagcgcgtcgggctcgtcgctgttcgaggagctggggctctactacatcggccccgtggacgggcacagcgtcgaggacctggtcaccatcttcgagaaggtgaagtcgatgccggcgccggggcccgtgctgatccacgtcgtgacggagaaaggaaagggttacccgccggcggaggcggcggcggaccggatgcacggcgtcgtcaagttcgagccgtcgacggggaagcagctcaagtccaagtcctcgacgctgtcgtacacgcagtacttcgccgagtcgctgatccgggaggcggacgccgacgacaaggtggtggcgatccacgcggcgatgggcggcggcacggggctcaactacttccagaagcggttcccggagcggtgcttcgacgtgggcatcgcggagcagcacgccgtgacgttcgccgccgggctcgccgcggaagggctgaaacccttctgcgccatctactcgtcgttcctgcagcgagggtacgaccaggtggtgcacgacgtcgacctgcagcggctccccgtgcggttcgcgctggaccgcgcggggctcgtcggcgccgacggccccacgcactgcggcgccttcgacgtgacgtacatggcgtgcctgccgaacatggtggtgatggcgccggccgacgaggcggagctgatgcatatggtggccacggcggcggccatcgacgaccggcccagctgcttccggttcccgcgcgggaacggcgtcggcgccgtcctgccggcggggaacaaggggacgccgatggaggtgggcaggggaagggtgctggtcggcggcaaccgggtggcgctgctcgggtatggtaccatggtgcaggcgtgcctcaaggccgccgaggcgctcaaggagcaggacgtgtacgtgaccgtggccgacgcccggttctgcaagccgctcgacacggggctgatccgggagctcgccgccgagcacgaggtgctcatcaccgccgaggaagggtccattggtggcttcggctcccacgtcgcgcactacctcagcctgacaggactcctcgacgggccactcaaactgagatccatgttcttgccggaccggtacatcgaccatggggcgccgcaggaccagatggaggaggcagggctgacgccgcggcacatcgccgccaccgtgctgtccctgctggggaggccaatggaggccatgcagctcaagtga

SEQ ID NO: 15857 - protein, 727 aa, Sorghum bicolor
  misc_feature: The sequence is a functional homolog of SEQ ID NO 12 in US patent 7132250
  misc_feature: Ceres ANNOT ID no. 8644868
  misc_feature (68)..(727): SWISSPROT Homolog: EC 2.2.1.7 1-deoxy-D-xylulose-5-phosphate synthase
  misc_feature (405)..(571): Pfam ID: Transket_pyr Pfam Description: Transketolase, pyrimidine binding domain
  misc_feature (586)..(709): Pfam ID: Transketolase_C Pfam Description: Transketolase, C-terminal domain
MALQASSSPSAFRAVTATANASCRRQFQVRAQVAGGSSSSSVGADGAGKMMFSKAEPAAAATSSGSSGPWKIDFTSGEKPATPLLDTVNYPLHMKNLSTSELEQLAAELRAEIVHTVSKTGGHLSSSLGVVELSVALHHVFDTPDDKIIWDVGHQAYGHKILTGRRSRMHTIRQTSGLAGFPKRDESAHDAFGVGHSSTSISAALGMAVARDLLGRKNHVVSVIGDGAMTAGQAYEAMNNSGFLDANMIVVLNDNKQVSLPTATLDGPSKPVGALSRALTKLQSSTKFRRLREAAKSVTKQIGGPTHEVAAKVDEYARGMMSASGSSLFEELGLYYIGPVDGHSVEDLVTIFEKVKSMPAPGPVLIHVVTEKGKGYPPAEAAADRMHGVVKFEPSTGKQLKSKSSTLSYTQYFAESLIREADADDKVVAIHAAMGGGTGLNYFQKRFPERCFDVGIAEQHAVTFAAGLAAEGLKPFCAIYSSFLQRGYDQVVHDVDLQRLPVRFALDRAGLVGADGPTHCGAFDVTYMACLPNMVVMAPADEAELMHMVATAAAIDDRPSCFRFPRGNGVGAVLPAGNKGTPMEVGRGRVLVGGNRVALLGYGTMVQACLKAAEALKEQDVYVTVADARFCKPLDTGLIRELAAEHEVLITAEEGSIGGFGSHVAHYLSLTGLLDGPLKLRSMFLPDRYIDHGAPQDQMEEAGLTPRHIAATVLSLLGRPMEAMQLK

SEQ ID NO: 15858 - DNA, 1995 bp, Sorghum bicolor
  misc_feature: Ceres ANNOT ID no. 8644954
  misc_feature: Encodes the peptide sequence at SEQ ID NO 15859
atggagggcctggccgccgtgctgctcctctacgcgctcctcgtcttcgccctcgagtcgccgttcgtctccacctcgctctccggcggtggcgccggggccggtgccgggaccgcgcggaagctccacctctccttcggcggcgcgggcgcgggcgagcacggggcgcccgcgcgccccgccaaggagccccgccccgcggcgggcggggcgtccgtctccgtctctgtctccgcccccggcgccgacggacaggatcgccggctctcgcgcttcgccacgggcctcgacgtccgcctcctcgacaccccgcgctccggcgtgctacgccggtccgtggccgacgccgtcgcggcgggcgcccgcgcgttcgccgacctcgagggcctcgaccctaacgccgtcgcggcgccctcctccggcgaactcgagggcggcggcgccgcggccacggccaggtgcccgcactcgatcgcgctcaccgcggaggagctcggcgcgcaggggggccgcggcgtggtggagctgccctgcgggctcgcgctggggtcccacgtcacggtcgccgcgacgccccgggggccgcacgaggagcggaaccccgcgatcgtggtgctcagggacggggagcggcctgccatggtgtcgcagttcatggtggagctgcaggggctcagggccgtcgaaggggaggacccgccccgcgtgctccacttcaacccgcgcctccgcggggactggagcggccgccccgtcatcgagcagaacacctgctaccgcatgaactggggcgccgcgcagcgctgcgatggttggaggtcacgccccgatgaggagactgtggatgggttggtgaagtgtgagaagtggattagggacgatgatgacaggttggaggaatggaagacatcatcaaagacagcagcatggttgctgaatcggttgatcgggcagaaggaggaggtcaatttcggttggccatttcctttcgtggagggccgcctgtttgttcttactctcagtgctgggttggagggttaccatgtgagcgttgatgggcgacatgtcacttcctttccttaccgcactgggtttgtgctggaggatgctacaggcctgtcactgtatggggacctcgatgtgcattcagtgattgcagggtctttgcccactacacacccaagctttgagccacagaattatctggagttttctactgtttggcaggcccctccgctgcctgatgagccagttgagattttcattggcatcctgtcatcagccaatcattttgctgagcgtatgggtgtgaggacgacatggatgtctgctgtccacaagtcaccaaacagggtggctcgttttttcgttgcactgcatggcagaaacgaggtgaatgtggtgctgaagaaggaagctgaattttttggggacattgtttttgtgccctatctggataactacgatcttgttgttatgaagactcttgcaatatgcgagtatggggttcatgttgtctctgctaaatatgtaatgaagtgcgatgatgatactttcgtgagaattgattcagtagtcactgaaattaagaaggtaccaagtgggagaagtctttacatggggagtatgaatatacaacacagaccgctacgccaagggaaatgggctgtgacttatgaggagtggccagaagaggtgtatccgtcatatgcaaatggccctggatatgttatatcatctgatattgctgaatttatcatgtcagaattcatgaagcaaaagctgaagctcttcaaaatggaagacgtgagcttgggtttgtgggttgagcagttcaataggacaagacctgttgaatacattcacagtggcaagttctgtccatttggatgcgtcgctgactactatactgctcattaccaatcgccaaggctaatgttatgcatgtggcaaaagttactggaaggaagaccagactgttgcaatatgagataa

SEQ ID NO: 15859 - protein, 664 aa, Sorghum bicolor
  misc_feature: Useful for making plants with altered carbohydrate content
  misc_feature: Functional homolog of the protein sequence given in SEQ ID NO 13850
  misc_feature: Ceres ANNOT ID no. 8644954
  misc_feature (421)..(657): SWISSPROT Homolog: EC 2.4.1.134 Galactosylxylosylprotein 3-beta-galactosyltransferase
  misc_feature (171)..(386): Pfam ID: Gal-bind_lectin Pfam Description: Galactoside-binding lectin
  misc_feature (432)..(618): Pfam ID: Galactosyl_T Pfam Description: Galactosyltransferase
MEGLAAVLLLYALLVFALESPFVSTSLSGGGAGAGAGTARKLHLSFGGAGAGEHGAPARPAKEPRPAAGGASVSVSVSAPGADGQDRRLSRFATGLDVRLLDTPRSGVLRRSVADAVAAGARAFADLEGLDPNAVAAPSSGELEGGGAAATARCPHSIALTAEELGAQGGRGVVELPCGLALGSHVTVAATPRGPHEERNPAIVVLRDGERPAMVSQFMVELQGLRAVEGEDPPRVLHFNPRLRGDWSGRPVIEQNTCYRMNWGAAQRCDGWRSRPDEETVDGLVKCEKWIRDDDDRLEEWKTSSKTAAWLLNRLIGQKEEVNFGWPFPFVEGRLFVLTLSAGLEGYHVSVDGRHVTSFPYRTGFVLEDATGLSLYGDLDVHSVIAGSLPTTHPSFEPQNYLEFSTVWQAPPLPDEPVEIFIGILSSANHFAERMGVRTTWMSAVHKSPNRVARFFVALHGRNEVNVVLKKEAEFFGDIVFVPYLDNYDLVVMKTLAICEYGVHVVSAKYVMKCDDDTFVRIDSVVTEIKKVPSGRSLYMGSMNIQHRPLRQGKWAVTYEEWPEEVYPSYANGPGYVISSDIAEFIMSEFMKQKLKLFKMEDVSLGLWVEQFNRTRPVEYIHSGKFCPFGCVADYYTAHYQSPRLMLCMWQKLLEGRPDCCNMR

SEQ ID NO: 15860 - DNA, 477 bp, Sorghum bicolor
  misc_feature: Ceres ANNOT ID no. 8644938
  misc_feature: Encodes the peptide sequence at SEQ ID NO 15861
atgaagacgaccaaggggggcaaggtgatgaaccccaccgacgccttccgcaaggagcagcggaagaaggagctcaagcggaacaaaaaggaaaggaagaaggtgcgggaagttggtattttgaaaaaggatccggaggctatacgtgagcagattgagaaattggagaagatgaaggctgatggtgctctcgacaaggctaggaaacataagaaaagacagcttgaggatacatacaatcttattgttaagaaacgaaaggaatatgaacagaaaatgaaagagaagggtgagcaaccgattatgttcagccatcttgcaccaccaaagaggcggcctacagcagatgaagatgatagagctaatcctaagcctgaggactctgtttactatcatccaaccttaaatccatctggagcaccaccacctggaaaacctcctatgtacaaatcatctatagttagtaatcatcactag

SEQ ID NO: 15861 - protein, 158 aa, Sorghum bicolor
  misc_feature: Useful for making plants with modulated flowering time
  misc_feature: Functional homolog of the protein sequence given in SEQ ID NO 14279
  misc_feature: Ceres ANNOT ID no. 8644938
MKTTKGGKVMNPTDAFRKEQRKKELKRNKKERKKVREVGILKKDPEAIREQIEKLEKMKADGALDKARKHKKRQLEDTYNLIVKKRKEYEQKMKEKGEQPIMFSHLAPPKRRPTADEDDRANPKPEDSVYYHPTLNPSGAPPPGKPPMYKSSIVSNHH

SEQ ID NO: 15862 - DNA, 1023 bp, Sorghum bicolor
  misc_feature: Ceres ANNOT ID no. 8644958
  misc_feature: Encodes the peptide sequence at SEQ ID NO 15863
atggaacctcaattctgcaacagcttctactatggccaccatgccggcgccgccgcctatgcgcatagcgataatagccactacggcctacagcactacgacgacagcctcgtcgtggacagctcatgctactccaatagtgctatggcctcctccggctccggcttccagcagccctcctcctactacgatcctattacgacgtacagcggtgaccactactcttcttcctcgtcgacggcgtgggcggcgtcgtcatggggcgccgatacaccctcccgccaccactaccaacagcagctgctgcattttggcggcggcgctgatgaatactacagctaccagcaggatggcacgggcgcggtggacatggaccagttcagcgctctcatgggagccacctgcatctccaccaccagcagctcctcgagtgcttcgacgacgaacacgccacttgcgtatccctcgccggcgacgacgacagtgcaatccagcgccgtcgtccacggggcgagcccctgcgactacctgctgcagcaggaggcggcgtccggcggcgacgcgccgctgatcggggtgcggaagcggccgtggggcaagttcgcggcggagatcagggactccacgcgcaatggcgagcgcgtgtggatcggcaccttcgacaccccggaggccgccgcgctcgcctacgaccaggccgcctactccatgcgcggccccgccgcggtgctcaacttccccgtcgagcacgtgcaggagtcgctgcgcgcgctggggctcatcagcgacggcgccgcggacgactcgcccgtgcttgcgctgaagcggcgccactgcatccgtaagcgcttgcccaagaacaagaaggcggcggccggcaaggaacagacgaacgcggcgacgagtagccatggccacgggcatgccaagcaaaagccgcaggaagcttcttgcgtgctggagctggaggaccttggggcggattacttggagcagctgctcgccctgtctgatcatcaatga

SEQ ID NO: 15863 - protein, 340 aa, Sorghum bicolor
  misc_feature: Useful for making plants with modulated flowering time
  misc_feature: Functional homolog of the protein sequence given in SEQ ID NO 14280
  misc_feature: The sequence is a functional homolog of SEQ ID NO 162 in the 10/714,887 US patent application
  misc_feature: The sequence is a functional homolog of SEQ ID NO 162 in the 11/435,388 US patent application
  misc_feature: The sequence is a functional homolog of SEQ ID NO 30 in the 10/903,236 US patent application
  misc_feature: Useful for biocontainment applications
  misc_feature: Functional homolog of the protein sequence given in SEQ ID NO 13707
  misc_feature: The sequence is a functional homolog of SEQ ID NO 16 in the 10/903,236 US patent application
  misc_feature: The sequence is a functional homolog of SEQ ID NO 2209 in the 10/666,642 US patent application
  misc_feature: The sequence is a functional homolog of SEQ ID NO 76 in the 10/714,887 US patent application
  misc_feature: The sequence is a functional homolog of SEQ ID NO 76 in the 11/435,388 US patent application
  misc_feature: Ceres ANNOT ID no. 8644958
  misc_feature (188)..(240): Pfam ID: AP2 Pfam Description: AP2 domain
MEPQFCNSFYYGHHAGAAAYAHSDNSHYGLQHYDDSLVVDSSCYSNSAMASSGSGFQQPSSYYDPITTYSGDHYSSSSSTAWAASSWGADTPSRHHYQQQLLHFGGGADEYYSYQQDGTGAVDMDQFSALMGATCISTTSSSSSASTTNTPLAYPSPATTTVQSSAVVHGASPCDYLLQQEAASGGDAPLIGVRKRPWGKFAAEIRDSTRNGERVWIGTFDTPEAAALAYDQAAYSMRGPAAVLNFPVEHVQESLRALGLISDGAADDSPVLALKRRHCIRKRLPKNKKAAAGKEQTNAATSSHGHGHAKQKPQEASCVLELEDLGADYLEQLLALSDHQ

SEQ ID NO: 15864 - DNA, 1017 bp, Sorghum bicolor
  misc_feature: Ceres ANNOT ID no. 8644968
  misc_feature: Encodes the peptide sequence at SEQ ID NO 15865
atggaactccaattcagcagcagctactactatggccatgatgccggcgccgtctccgccgcctacgcgcattgtgactacggcctacaacgctacgacgacagcccctactactccaccagcgctatggcctcttccggcttcttccagccctcctcggccgcgtactacgacgacgatgctgctatcgcttacagtggtgatggtgaccatcacccttcttcctcgtcgacggtgtggggggcgtcgtcgtcaagcgatgccacaccctcccaccaccaacagcagctgctgcattttggcggcggcgctgatgaatactacagctaccagcaggatggcatgggcgcggtggacatggaccagttcagcgttctcatgggagccacctgcatctccaccaccagcagctcctcgagtgcttcgacgacgacgaacacgccacttgcgtatccctcgccggcgacgacgacagtgcaatccagcgccgtcgtccacggggcgagcccctgcgactacctgcagcaggaggcggcgtccggcggcgaccgcgacgcgccgctgatcggggtgcggaagcggccgtggggcaagttcgcggcggagatcagggactccacgcgcaatggcgagcgcgtgtggatcggcaccttcgacacccccgaggccgccgcgctcgcctacgaccaggccgcctactccatgcgcggccccgccgcggtgctcaacttccccgtcgagcacgtgcaggagtcgctgcgcgcgctggggctcatcagcgacggcgccgcggacgactcgcccgtgcttgcgctgaagcggcgccactgcatccgtaagcgcttgcccaagaacaagaaggcggcggccggcaaggaacagacgaaggcggcgacgagtagccatggccatgggcatgccaagcaaaagccgcaggcagcttcttgcgtgctggagctggaggaccttggggcggattacttggagcagctgctcgccctgtcagatcatcaatga

SEQ ID NO: 15865 - protein, 338 aa, Sorghum bicolor
  misc_feature: Useful for making plants with modulated flowering time
  misc_feature: Functional homolog of the protein sequence given in SEQ ID NO 14280
  misc_feature: Useful for biocontainment applications
  misc_feature: Functional homolog of the protein sequence given in SEQ ID NO 13707
  misc_feature: The sequence is a functional homolog of SEQ ID NO 1354 in the 10/666,642 US patent application
  misc_feature: The sequence is a functional homolog of SEQ ID NO 171 in the 11/479,226 US patent application
  misc_feature: The sequence is a functional homolog of SEQ ID NO 18 in the 10/714,887 US patent application
  misc_feature: The sequence is a functional homolog of SEQ ID NO 18 in the 11/435,388 US patent application
  misc_feature: The sequence is a functional homolog of SEQ ID NO 1954 in the 10/374,780 US patent application
  misc_feature: The sequence is a functional homolog of SEQ ID NO 8 in the 10/666,642 US patent application
  misc_feature: The sequence is a functional homolog of SEQ ID NO 8 in the 10/903,236 US patent application
  misc_feature: The sequence is a functional homolog of SEQ ID NO 162 in the 10/714,887 US patent application
  misc_feature: The sequence is a functional homolog of SEQ ID NO 162 in the 11/435,388 US patent application
  misc_feature: The sequence is a functional homolog of SEQ ID NO 30 in the 10/903,236 US patent application
  misc_feature: Ceres ANNOT ID no. 8644968
  misc_feature (186)..(238): Pfam ID: AP2 Pfam Description: AP2 domain
MELQFSSSYYYGHDAGAVSAAYAHCDYGLQRYDDSPYYSTSAMASSGFFQPSSAAYYDDDAAIAYSGDGDHHPSSSSTVWGASSSSDATPSHHQQQLLHFGGGADEYYSYQQDGMGAVDMDQFSVLMGATCISTTSSSSSASTTTNTPLAYPSPATTTVQSSAVVHGASPCDYLQQEAASGGDRDAPLIGVRKRPWGKFAAEIRDSTRNGERVWIGTFDTPEAAALAYDQAAYSMRGPAAVLNFPVEHVQESLRALGLISDGAADDSPVLALKRRHCIRKRLPKNKKAAAGKEQTKAATSSHGHGHAKQKPQAASCVLELEDLGADYLEQLLALSDHQ

SEQ ID NO: 15866 - DNA, 633 bp, Sorghum bicolor
  misc_feature: Ceres ANNOT ID no. 8644995
  misc_feature: Encodes the peptide sequence at SEQ ID NO 15867
atggattcgaggagggtcgtcttggctgtgtccgccatggcggcggcgctgatggtggtgctgtcggcgccggcgggggtgggcggcgacttcgcggcggaccgtgcggagtgctcggacaagctggtggggctggcgacgtgcctgacttacgtgcaggaggatgcgacggcggcggcgccgacgcccgactgctgcgcggggctggagacggtgctgcagagcagccgcaagtgcctgtgcgtgctggtcaaggacagggacgacccaaacctggggctcaagatcaacgtcaccaaggcgctccgcctccccgccgtctgcaacgcccccgccaacatctccgactgcccaaggctgctgaacctgccgccgggctccaaggacgcgcaggtgttcgagcagttcgccaggcaggcggcggcgcagggcaccgcacccagtggcggcggcagcgcggcgaaggcgagcgcgagcccgcagaagagcggagcggccgccggtcacgcgcagcggtggttgggagtggggagcagcagggtcggtggtggtcgtggtgatggcggcgcacgcgcggtggcggtggcgctcgcactcttcgccgccggcccgctcgccttcttgcttggatag

SEQ ID NO: 15867 - protein, 210 aa, Sorghum bicolor
  misc_feature: Useful for making plants with altered carbohydrate content
  misc_feature: Functional homolog of the protein sequence given in SEQ ID NO 14088
  misc_feature: Ceres ANNOT ID no. 8644995
  misc_feature (38)..(117): Pfam ID: Tryp_alpha_amyl Pfam Description: Protease inhibitor/seed storage/LTP family
MDSRRVVLAVSAMAAALMVVLSAPAGVGGDFAADRAECSDKLVGLATCLTYVQEDATAAAPTPDCCAGLETVLQSSRKCLCVLVKDRDDPNLGLKINVTKALRLPAVCNAPANISDCPRLLNLPPGSKDAQVFEQFARQAAAQGTAPSGGGSAAKASASPQKSGAAAGHAQRWLGVGSSRVGGGRGDGGARAVAVALALFAAGPLAFLLG

SEQ ID NO: 15868 - DNA, 1446 bp, Sorghum bicolor
  misc_feature: Ceres ANNOT ID no. 8645003
  misc_feature: Encodes the peptide sequence at SEQ ID NO 15869
atggacacccaagaccaagaagctctccacatcgtcgtgttcccatggctggcgttcggtcacatgatcccattcctggatctctccaagcggctggcgcggcgcggccacgccgtcaccttcgtctccacgccgaggaacgctgccaggctaggcgcagtcccgccggagctcgcagcgcgtctacgcgtcgtcaagcttgacctgcctgccgtcgagggcctcccggacggagccgagtcgacggccgacgtcccgccggagaaggtcgagctcctcaagaaggcgttcgacggtctcgccgcgccgttcgagcgccttgtcaccaagggctgtgccaccgccgccgccggcgactccgaggtggccgcgttctcgaagaagcccgactggatcatcctcgacttcgctcaaaactggatttggccaatcgctcaagaacacaagatcccgtgcgccatgttcctcatcttcacagcaggcttcttggccttcgccggctcgaagcagcagaacgaggcgcagccacgcacgacgacggaggacttcatggtccagccgccgtggataccgttcccgaccaccatgtccttccgccgccacgaggcggagtggatcgccgccgcgtaccggcccaacgcctccggcgtgtccgacgtggaccgcttctggcaggtgcatcacccgagctgccgcctcatcgtcatccgcagctgccccgaggcggagccgcgtctgttcccgctcctaacagacatcttcgccaagcccgccgtgcccgcgagcctcctcctgcccgacgacgaggaagacgcccggggcggtgacgacgggcggtccttctctgacgccatgcggtggctggacgagcagccgcagcggtcggtcatctacgtggcgctcgggagcgaggcgccggtgacggcggaccaggtgcgggagctggcgttcgggctggagctctccggcgcgcgcttcctctgggcggtccggcggcccgtcggccactccggcgagctgctgccggacggtttcgaggcccgcgtggcggggcgcggggtggtgcgcgccgggtgggtgccgcaggtgcgcgtgctggcgcacgccgcggtgggcgcgttcctgacgcactgcggctggggctccaccgtggagagcctcttccggttcggcctcccgctggtgatgctgccgttcataacggaccagggcctcatcgcgcgagccatggccgccagaggggtcggcgtcgaggtgccgagggacgacgctgacggatcgttccgcagggacgacgtcgcggcggcggtgcggcgtgtgatggcggaggatgagggcgaggagctcgcgcgcaatgccagggagatgcagaaggtggtcggcgacagggcaaagcaagagcagtacgtggatgagcttgtggactatttgcagcgttacaaataa

SEQ ID NO: 15869 - protein, 481 aa, Sorghum bicolor
  misc_feature: Useful for making plants with altered carbohydrate content
  misc_feature: Functional homolog of the protein sequence given in SEQ ID NO 14087
  misc_feature: Ceres ANNOT ID no. 8645003
  misc_feature (188)..(479): SWISSPROT Homolog: EC 2.4.1.236 Flavanone 7-O-glucoside 2''-O-beta-L-rhamnosyltransferase
  misc_feature (10)..(481): Pfam ID: UDPGT Pfam Description: UDP-glucoronosyl and UDP-glucosyl transferase
MDTQDQEALHIVVFPWLAFGHMIPFLDLSKRLARRGHAVTFVSTPRNAARLGAVPPELAARLRVVKLDLPAVEGLPDGAESTADVPPEKVELLKKAFDGLAAPFERLVTKGCATAAAGDSEVAAFSKKPDWIILDFAQNWIWPIAQEHKIPCAMFLIFTAGFLAFAGSKQQNEAQPRTTTEDFMVQPPWIPFPTTMSFRRHEAEWIAAAYRPNASGVSDVDRFWQVHHPSCRLIVIRSCPEAEPRLFPLLTDIFAKPAVPASLLLPDDEEDARGGDDGRSFSDAMRWLDEQPQRSVIYVALGSEAPVTADQVRELAFGLELSGARFLWAVRRPVGHSGELLPDGFEARVAGRGVVRAGWVPQVRVLAHAAVGAFLTHCGWGSTVESLFRFGLPLVMLPFITDQGLIARAMAARGVGVEVPRDDADGSFRRDDVAAAVRRVMAEDEGEELARNAREMQKVVGDRAKQEQYVDELVDYLQRYK

SEQ ID NO: 15870 - DNA, 315 bp, Sorghum bicolor
  misc_feature: Ceres ANNOT ID no. 8645000
  misc_feature: Encodes the peptide sequence at SEQ ID NO 15871
atgacgcacgccgggtggagctccctgacggagagcttcctgttcggccacccgctggtgatgctgcccctgttcgccgaccagggcctcaccgcgcggctgatggcggagcggcgggtcggcctggaggtgccgtgggacgactgcggcagcgaggaccgtgcggcgggtgatggtggaggaggaagggaaggagttctcgtgcaacgcaaagcggcaaagggattgcaggaggttctttgggacacggcgaggcaggagcgctgcatcgatgagttggtcgagcacttgctgcagcgccggggagattattag

SEQ ID NO: 15871 - protein, 104 aa, Sorghum bicolor
  misc_feature: Useful for making plants with altered carbohydrate content
  misc_feature: Functional homolog of the protein sequence given in SEQ ID NO 14281
  misc_feature: Ceres ANNOT ID no. 8645000
  misc_feature (1)..(44): SWISSPROT Homolog: EC 2.4.1.115 Anthocyanidin 3-O-glucosyltransferase
MTHAGWSSLTESFLFGHPLVMLPLFADQGLTARLMAERRVGLEVPWDDCGSEDRAAGDGGGGREGVLVQRKAAKGLQEVLWDTARQERCIDELVEHLLQRRGDY

SEQ ID NO: 15872 - DNA, 1242 bp, Sorghum bicolor
  misc_feature: Ceres ANNOT ID no. 8645042
  misc_feature: Encodes the peptide sequence at SEQ ID NO 15873
atggcgagggcgcgcggtggcgccgcgtgggtgctgctggcggcggcgtgggtgctgtgggcggcggcggcggcggaggccaggtcgccgtccgggaggagggtgcaccggcacctcaagcgcctcaacaagccggccgtcaagagcatcgagagtccagatggagacatcatcgactgcgtgcatatctcccaccagccagcctttgatcatcctctcctcaagaaccacacaatacagtttaggccggcgtaccaccctgaaggtctatacgaagatgccaagagcagcataggctcaaacaatgccggtgagaagccgatgctccagatgtggcatcgaaatggcaggtgtccggagggcacggtcccaatcaggagaaccaagaaggatgacctgctccgagctagctccatgaggcggtatggcaggaagcggcatactgctccaaacccgctgtctgttgatcctaacatgctcagtgagggtggtcaccaacacgccatagcgtacgttgagggtgataagtactatggtgcaaaggccaccattaatgtgtgggagcccaagattcagcaggctaacgaatttagcctgtcccagctctggatcttggggggttcatttggggaggatctcaacagcatagaggctggttggcaggttagccctgacctctatggtgacaacaacaccaggttgttcacatactggactagtgatgcataccaggccacagggtgctacaacatgttgtgctccggtttcattcagataaacagcgagatcgccatgggggctagcattttccccatctcgaactacgcaggctcccaatatgatatcagcatcctgatctggaaggaccccaaggaaggcaactggtggatgcagtttggcaaggaatacgtcctgggctactggccatccttcctcttctcctacctcgccgacagcgcatcaatgatcgaatggggcggggaggtggtgaactcggagcccgacggcacgcacacgtcgacgcagatgggcagtgggcacttccccgaggaagggttcggcaaggcgagctacttcaagaacattcaggtggtggacagcagcaaccagctcagcgcccccaagggcgtgggcaccttcaccgagcaatccaactgctacgacgtgcagaacggcaacaatggcgattggggcacctatttctactatggcggccccggcaagaactcgaattgcccatga

SEQ ID NO: 15873 - protein, 413 aa, Sorghum bicolor
  misc_feature: Useful for biocontainment applications
  misc_feature: Functional homolog of the protein sequence given in SEQ ID NO 14085
  misc_feature: Ceres ANNOT ID no. 8645042
MARARGGAAWVLLAAAWVLWAAAAAEARSPSGRRVHRHLKRLNKPAVKSIESPDGDIIDCVHISHQPAFDHPLLKNHTIQFRPAYHPEGLYEDAKSSIGSNNAGEKPMLQMWHRNGRCPEGTVPIRRTKKDDLLRASSMRRYGRKRHTAPNPLSVDPNMLSEGGHQHAIAYVEGDKYYGAKATINVWEPKIQQANEFSLSQLWILGGSFGEDLNSIEAGWQVSPDLYGDNNTRLFTYWTSDAYQATGCYNMLCSGFIQINSEIAMGASIFPISNYAGSQYDISILIWKDPKEGNWWMQFGKEYVLGYWPSFLFSYLADSASMIEWGGEVVNSEPDGTHTSTQMGSGHFPEEGFGKASYFKNIQVVDSSNQLSAPKGVGTFTEQSNCYDVQNGNNGDWGTYFYYGGPGKNSNCP

SEQ ID NO: 15874 - DNA, 2295 bp, Sorghum bicolor
  misc_feature: Ceres ANNOT ID no. 8645125
  misc_feature: Encodes the peptide sequence at SEQ ID NO 15875
atgacggtgacgccgtggatcacggtgagcgacgggacgctggcggtgcgcggccgcacggtgctcaccggcgtgccggacaacgtgtccgcggcgcacgccgccggtgccggcctcgtcgacggggccttcgtcggcgcccacgccgccgagcccaagagccaccacgtcttcaccttcggcacgctccgggactgccggtttctgtgcctgttccggttcaagctatggtggatgacgcagcggatgggcgtctccggccgcgacgtgcctctcgagacccagttcatgctcatcgaggtccctcctgccgccaccgacggcgacggcaaacccgcgtacgtggtgatgctgccgctgctggaggggcagttccgggcggcgctgcaggggaacgaccgcgacgagctggagatctgcgtcgagagcggcgacaaggcggtgcagacggagcagggcgcgcgcatggtatacctccacgccggcgacagccccttcgacgccgtcaccgccgcggtcaaggcggtggagaagcacctgcagacgttccaccaccgagagaggaagaggatgccgtcgttcctcgactggttcggctggtgcacctgggacgccttctacaccgacgtcaccgccggcggcgtcaagcacggcctccagagcctgtccaagggcggcgcgccgccgcggttcctcatcatcgacgacggctggcagcagatcgcctccgacaacaagaagcccgacgaccccaacgtcgccgtccaggagggcgcgcaattcgccagtcggctgacggggatcaaggagaacaccaagttccagaccaagccggacggcgacggcgacggcgacggcgggctgaagcggctggtgtcggagaccaagggcgtgcacggcgtgaagcaggtgtacgtgtggcacgcgatggcggggtactggggcggcgtggcgccgtcgtcggggacagcgatggagcgttacgagccggcgctggcgtacccggtgcagtccccaggcgtgacggcgaaccagccggacatcgtcatggactcgctgtccgtcctgggcctcggcctggtgcacccgcggcgggcgcgggacttctacggcgagctccacgcgtacctggcctcctgcggcgtggacggcgtcaaggtggacgtgcagaacatcatcgagacgctgggcgccggccatggcggccgcgtcgcgctcaccagggcctaccaccgcgcgctcgaggcctccgtggcgcgcagcttccccgacaacggctgcatctcctgcatgtgccacaacaccgacatgctctacagcgccaggcagaccgccgtggtgcgcgcctccgacgacttctacccgcgcgacccggcctcccacaccgtccatgtcgcctccgtcgcctacaacaccgtcttcctcggcgagttcatgcagcccgactgggacatgttccatagcttgcacccggcggcggagtaccacggcgcggcgagggccatcggcggctgcccgatatatgtcagcgacaagccggggaaccacaacttcgagctgctcaggaagctcgtcctccccgacggctccgtgctccgcgcgcagctccccggccggcccacacgcgactgcctcttctccgacccggcgcgcgacggcgcaagcctgctcaagatctggaacctgaacaagtgcggcggcgtggtgggcgtgttcaactgccagggcgccgggtggtgccgcgtgacgaagcggacgcgcgtgcacgacgcggcgccgggcacgctgaccggcgccgtgcgcgccgacgacgtggacgccatagcgcgcgtcgccggcgacggcggcaacgatggcgacaacggcagcaacggcgagtgggacggcgaggccgtggtgtacgcgcaccgcgcgcgggagctggtgcggctgccgcgtggcgccgcgctgcccgtgacgctggcgccgctgcagtacgaggtgttccacgtgtgcccgctccgcgccgccgcgccgggggtggcgttcgcgcccgtggggctgctcgacatgttcaacgccgggggcgccgtcgaggagtgccgcgcagtggacggcggcgggaaggccgtggtggcgctcagggtgcgcgggtgcggccggttcggtgcctactgctcgcgggagccggcgaggtgcctgctggactcggcggaagtggagttcggctacgacgccgacaccggcctcgtgtccgtcgacctgccggtgccggagaaggagatgtaccggtggacgctggagattgtggtctag

SEQ ID NO: 15875 - protein, 764 aa, Sorghum bicolor
  misc_feature: Useful for making plants with altered carbohydrate content
  misc_feature: Functional homolog of the protein sequence given in SEQ ID NO 14032
  misc_feature: Ceres ANNOT ID no. 8645125
  misc_feature: Up-regulated in root tissues in response to methyl jasmonate treatment
  misc_feature: Up-regulated in shoot tissues in response to methyl jasmonate treatment
  misc_feature: Down-regulated in shoot tissues in response to methyl jasmonate treatment
  misc_feature (300)..(749): SWISSPROT Homolog: EC 2.4.1.67 Galactinol--raffinose galactosyltransferase
  misc_feature (7)..(748): Pfam ID: Raffinose_syn Pfam Description: Raffinose synthase or seed imbibition protein Sip1
MTVTPWITVSDGTLAVRGRTVLTGVPDNVSAAHAAGAGLVDGAFVGAHAAEPKSHHVFTFGTLRDCRFLCLFRFKLWWMTQRMGVSGRDVPLETQFMLIEVPPAATDGDGKPAYVVMLPLLEGQFRAALQGNDRDELEICVESGDKAVQTEQGARMVYLHAGDSPFDAVTAAVKAVEKHLQTFHHRERKRMPSFLDWFGWCTWDAFYTDVTAGGVKHGLQSLSKGGAPPRFLIIDDGWQQIASDNKKPDDPNVAVQEGAQFASRLTGIKENTKFQTKPDGDGDGDGGLKRLVSETKGVHGVKQVYVWHAMAGYWGGVAPSSGTAMERYEPALAYPVQSPGVTANQPDIVMDSLSVLGLGLVHPRRARDFYGELHAYLASCGVDGVKVDVQNIIETLGAGHGGRVALTRAYHRALEASVARSFPDNGCISCMCHNTDMLYSARQTAVVRASDDFYPRDPASHTVHVASVAYNTVFLGEFMQPDWDMFHSLHPAAEYHGAARAIGGCPIYVSDKPGNHNFELLRKLVLPDGSVLRAQLPGRPTRDCLFSDPARDGASLLKIWNLNKCGGVVGVFNCQGAGWCRVTKRTRVHDAAPGTLTGAVRADDVDAIARVAGDGGNDGDNGSNGEWDGEAVVYAHRARELVRLPRGAALPVTLAPLQYEVFHVCPLRAAAPGVAFAPVGLLDMFNAGGAVEECRAVDGGGKAVVALRVRGCGRFGAYCSREPARCLLDSAEVEFGYDADTGLVSVDLPVPEKEMYRWTLEIVV

SEQ ID NO: 15876 - DNA, 1263 bp, Sorghum bicolor
  misc_feature: Ceres ANNOT ID no. 8645216
  misc_feature: Up-regulated in root tissues in response to methyl jasmonate treatment
  misc_feature: Up-regulated in shoot tissues in response to methyl jasmonate treatment
  misc_feature: Down-regulated in shoot tissues in response to methyl jasmonate treatment
  misc_feature: Encodes the peptide sequence at SEQ ID NO 15877
atggctggttctctctcagccgtcaagctgtcgtcgtcgacgtcagcatccaccgtaagcggcaagcggccgaccgctacccccaaccatcatcgcgacccctgcccgtgccccttccccgttcgtccccttcccctggccgccgccgcccccaatcccacctcctcgccccctccctttgacccctccggcttcccacgaaccttcctctccttgacccctcctcccctctctatttatccccctccccatccactccccgccctccccaagaatcaccaccactccactccaccacctctctcacctccagcagcagcagcagcagccagccaacaaccgcaccgcagcaagaaccaaccaacagcgacgaacatagcgagggagccaatggtgatgacgacggcggcgcagcagcagcgccgggacgcggaggcggagctgaacctccccccggggttccggttccacccgacggacgaggagctggtggcgcactacctctgcgcgcgggcggccggtcgccgcccgccggtgtccatcatcgccgaggtcgacctgtaccgcttcgacccctgggacctccccgagcgcgccctcttcggccgccgcgagtggtacttcttcacgccgcgcgaccgcaagtaccccaacggctcccgacccaaccgcgccgcgggctccgggtactggaaggcgaccggcgccgacaagcccgtggagcacaggggcaggacggtcggcatcaagaaggcgctcgtgttctaccacggcaagccgccccgtggggtcaagaccgagtggatcatgcacgagtaccgcctcgccgacgccggcggcgcccgcgccaagaagtccggcaacggcacgctcaggttggatgactgggtgctgtgccggctgtacaacaagaagaacgagtgggagaagatgcagcagcagaaggagaagaaggagatggaatcggaggcgtcgctctcgcactccgacacgcggacgccggagtcggagatcgacgacgacccgttcccggagctggcctcgctgccggcgctcgacgacatggtgggtctagccccggccgccggcgccatcctgcccaaggaggaggtggaggacttcggcgaccttggcggcgacgactggctcgcggggatcaacctcgacgacctgcagatgcccggggacgccgacttctttggcaacatgctgtcgccgatggccgccaagatggagcaggacgccggcttccccttcttctga

SEQ ID NO: 15877 - protein, 420 aa, Sorghum bicolor
  misc_feature: The sequence is a functional homolog of SEQ ID NO 891 in the 10/374,780 US patent application
  misc_feature: Useful for making plants with altered terpenoid content
  misc_feature: Functional homolog of the protein sequence given in SEQ ID NO 13966
  misc_feature: The sequence is a functional homolog of SEQ ID NO 2060 in the 10/374,780 US patent application
  misc_feature: The sequence is a functional homolog of SEQ ID NO 516 in the 10/412,699 US patent application
  misc_feature: The sequence is a functional homolog of SEQ ID NO 2012 in the 10/374,780 US patent application
  misc_feature: The sequence is a functional homolog of SEQ ID NO 312 in the 10/412,699 US patent application
  misc_feature: The sequence is a functional homolog of SEQ ID NO 731 in the 11/479,226 US patent application
  misc_feature: The sequence is a functional homolog of SEQ ID NO 102 in the 10/374,780 US patent application
  misc_feature: The sequence is a functional homolog of SEQ ID NO 886 in the 10/225,066 US patent application
  misc_feature: The sequence is a functional homolog of SEQ ID NO 1157 in the 11/479,226 US patent application
  misc_feature: The sequence is a functional homolog of SEQ ID NO 1416 in the 10/666,642 US patent application
  misc_feature: The sequence is a functional homolog of SEQ ID NO 30 in the 10/286,264 US patent application
  misc_feature: The sequence is a functional homolog of SEQ ID NO 430 in the 11/435,388 US patent application
  misc_feature: The sequence is a functional homolog of SEQ ID NO 518 in the 10/412,699 US patent application
  misc_feature: Useful for making plants with modulated water use efficiency
  misc_feature: Useful for making plants with modulated oxidative stress sensitivity
  misc_feature: Functional homolog of the protein sequence given in SEQ ID NO 13621
  misc_feature: The sequence is a functional homolog of SEQ ID NO 1036 in the 10/225,066 US patent application
  misc_feature: The sequence is a functional homolog of SEQ ID NO 216 in the 10/666,642 US patent application
  misc_feature: The sequence is a functional homolog of SEQ ID NO 2608 in the 10/374,780 US patent application
  misc_feature: The sequence is a functional homolog of SEQ ID NO 658 in the 11/435,388 US patent application
  misc_feature: The sequence is a functional homolog of SEQ ID NO 880 in the 10/412,699 US patent application
  misc_feature: Useful for making plants with modulated light quality response
  misc_feature: Functional homolog of the protein sequence given in SEQ ID NO 13870
  misc_feature: The sequence is a functional homolog of SEQ ID NO 316 in the 10/412,699 US patent application
  misc_feature: The sequence is a functional homolog of SEQ ID NO 738 in the 11/479,226 US patent application
  misc_feature: The sequence is a functional homolog of SEQ ID NO 852 in the 10/374,780 US patent application
  misc_feature: The sequence is a functional homolog of SEQ ID NO 2346 in the 10/374,780 US patent application
  misc_feature: The sequence is a functional homolog of SEQ ID NO 238 in the 10/225,068 US patent application
  misc_feature: The sequence is a functional homolog of SEQ ID NO 338 in the 10/412,699 US patent application
  misc_feature: The sequence is a functional homolog of SEQ ID NO 774 in the 11/479,226 US patent application
  misc_feature: Useful for making plants with modulated nitrogen use efficiency
  misc_feature: Functional homolog of the protein sequence given in SEQ ID NO 13624
  misc_feature: The sequence is a functional homolog of SEQ ID NO 26 in the 10/286,264 US patent application
  misc_feature: The sequence is a functional homolog of SEQ ID NO 336 in the 10/412,699 US patent application
  misc_feature: The sequence is a functional homolog of SEQ ID NO 770 in the 11/479,226 US patent application
  misc_feature: The sequence is a functional homolog of SEQ ID NO 2470 in the 10/374,780 US patent application
  misc_feature: The sequence is a functional homolog of SEQ ID NO 798 in the 10/225,066 US patent application
  misc_feature: The sequence is a functional homolog of SEQ ID NO 344 in the 10/666,642 US patent application
  misc_feature: Ceres ANNOT ID no. 8645216
  misc_feature (150)..(276): Pfam ID: NAM Pfam Description: No apical meristem (NAM) protein
MAGSLSAVKLSSSTSASTVSGKRPTATPNHHRDPCPCPFPVRPLPLAAAAPNPTSSPPPFDPSGFPRTFLSLTPPPLSIYPPPHPLPALPKNHHHSTPPPLSPPAAAAAASQQPHRSKNQPTATNIAREPMVMTTAAQQQRRDAEAELNLPPGFRFHPTDEELVAHYLCARAAGRRPPVSIIAEVDLYRFDPWDLPERALFGRREWYFFTPRDRKYPNGSRPNRAAGSGYWKATGADKPVEHRGRTVGIKKALVFYHGKPPRGVKTEWIMHEYRLADAGGARAKKSGNGTLRLDDWVLCRLYNKKNEWEKMQQQKEKKEMESEASLSHSDTRTPESEIDDDPFPELASLPALDDMVGLAPAAGAILPKEEVEDFGDLGGDDWLAGINLDDLQMPGDADFFGNMLSPMAAKMEQDAGFPFF

SEQ ID NO: 15878 - DNA, 1620 bp, Sorghum bicolor
  misc_feature: Ceres ANNOT ID no. 8645308
  misc_feature: Encodes the peptide sequence at SEQ ID NO 15879
atggcttcgcctgcgataccattcgcccctctcacgtcccatcgcgccgttccctttgtcttggggtgtcctcctccatggccaccgcgcccgccgcctgccgctcccggacggccgccgcgccccgacgctgctgcagctgctagactgctagaggaggaggccagggcaggcagctcgcgagctcgatcgcctgccggccggcccgagctggagtcgatggtgctggatctcaatgccgagtcgccgacggccggctcggcctcggccacctcgagctccagcggcgtcttccggttcgacctgctcggagggacacccgacgaggagggttgctcgccctcgccgcccgttgtgacgcgccagctcttccccttgccgtcgtacccggacgctgctgcagctcccaccgccgcctcgaacgggtcgccgccgccgccgcaggcggcagggccatgggcgcgccgcgcagcggatctcgtggcgccggcgctgggacagggacagggacagggggcggtggttatgcctgcgccttcgtcgccgcccgcggctgtgtctccagccgccgggaagaagagccgacgggggcccaggtcgcggagctcgcagtacaggggcgtcaccttctacaggaggaccggccgctgggagtcacacatctgggactgcgggaagcaggtctatctgggtggatttgatactgcccacgccgcagcaagggcctatgatcgtgctgcaatcaagttcagaggccttgacgcagacatcaatttccagttgaaggactatgaggatgatttgaagcagatgaagaattggaccaaggaggaatttgttcacatactccgacggcaaagcactgggtttgccagggggagctcaaagtaccgcggtgtgacactgcacaagtgtggtcggtgggaagctcggatgggtcagcttctgggaaagaagtacatctaccttgggctgtttgacagtgaaatcgaagcagcaagagcgtatgacagggcagccattcgcttcaacggaccggatgctgttactaacttcgattctagttcctatgatggagatgtcccacttccaacggcaatcgagaaagatgtggttgatggggacatccttgatctgaatttgaggatttcacaacctaatgtgcatgatctcaaaagtgatggtaccctgactggttttggattaggttgtaattctcctgaagcttcaagctccattgtttctcagccaataagccctcagtggcctgtgcatcctcacagcacaccgatgcaactccagcatccacatctgtatgcgtctccttgtccaggcttctttgtgaacctcagggaggcgcctatggaggaggagaaacgggcagagcgggcgggtcccgagccggcgttcccctcttgggcatggcaaacgcagggctcccctgccccgtttctccctgccactgctactgcagcatcatcaggattctctacagccgccaccaccaccggcgtggacgcggccacagccgcccgcagcgtgccgccgtccttgtccggtggcccccggcagttgttctccggctaccagctccagctccgcttccccccaaccgcctga

SEQ ID NO: 15879 - protein, 539 aa, Sorghum bicolor
  misc_feature: Useful for biocontainment applications
  misc_feature: Functional homolog of the protein sequence given in SEQ ID NO 14008
  misc_feature: Useful for making plants with modulated biomass
  misc_feature: Functional homolog of the protein sequence given in SEQ ID NO 13414
  misc_feature: The sequence is a functional homolog of SEQ ID NO 1785 in the 11/479,226 US patent application
  misc_feature: Useful for making plants with modulated flowering time
  misc_feature: Ceres ANNOT ID no. 8645308
  misc_feature (203)..(253): Pfam ID: AP2 Pfam Description: AP2 domain
  misc_feature (295)..(346): Pfam ID: AP2 Pfam Description: AP2 domain
MASPAIPFAPLTSHRAVPFVLGCPPPWPPRPPPAAPGRPPRPDAAAAARLLEEEARAGSSRARSPAGRPELESMVLDLNAESPTAGSASATSSSSGVFRFDLLGGTPDEEGCSPSPPVVTRQLFPLPSYPDAAAAPTAASNGSPPPPQAAGPWARRAADLVAPALGQGQGQGAVVMPAPSSPPAAVSPAAGKKSRRGPRSRSSQYRGVTFYRRTGRWESHIWDCGKQVYLGGFDTAHAAARAYDRAAIKFRGLDADINFQLKDYEDDLKQMKNWTKEEFVHILRRQSTGFARGSSKYRGVTLHKCGRWEARMGQLLGKKYIYLGLFDSEIEAARAYDRAAIRFNGPDAVTNFDSSSYDGDVPLPTAIEKDVVDGDILDLNLRISQPNVHDLKSDGTLTGFGLGCNSPEASSSIVSQPISPQWPVHPHSTPMQLQHPHLYASPCPGFFVNLREAPMEEEKRAERAGPEPAFPSWAWQTQGSPAPFLPATATAASSGFSTAATTTGVDAATAARSVPPSLSGGPRQLFSGYQLQLRFPPTA

SEQ ID NO: 15880 - DNA, 1521 bp, Sorghum bicolor
  misc_feature: Ceres ANNOT ID no. 8645324
  misc_feature: Encodes the peptide sequence at SEQ ID NO 15881
atggccgcaccgccgtcgtggcaacggcacgcagctgctgccgtcgttgtttccgtgtccctcctcatcctcgtcgtagcgccgtcgtccaccaccgctatcggcgtcaactacggcaccaagggcgacaacctcccgccgccggcgacggtggcgtcgttcctggccaaccgcacccgcatcgaccgcgtgaagctgttcgacacgaacccggacatggtccgcgccttcgccggcacgggcatcgcgctcatggtcaccgcgggcaacggcgacatccccaagctcgcgaccaaggacggcgcggcggcgtgggtgtccgccaacgtggcgccgtactaccccaagacggacatctcgctcgtcctcgtcgggaacgagatcatggacacgggcgacgcgtccctcatctccaacctggtgcccgccatgcgcgcgctcagggcggcgctggtggcggcggggttccgcaagatccgcgtctcgacgccgcactccctgggcatccttgccggcgcctccgagccgccgtcggcgagccggttccgcgacggctgggaccgcgccgtgttcgcgccgatgctggcgttccaccggcagagcaggtcgccgttcatggtgaacccgtacccgtacttcgggtacaacggcgcgacgctcccctacgcgctggcgcggccggacaacaagctgggcgtgacggaccccggcacgggcatcacctacaccagcatgttcgaggcgcagctggactcggtgtactcggcgatgaagaagctcggcttcgacgacgtggagatcgcggtgggggagaccgggtggccaaccaaggccatggacgggcagatcggcgtcagcaacgccgacgcggcggagtacaaccggtacctcatcggcgaggccggcggcgggtccggcacgccgctgatgcccaagcgcaccttcgagacgtacatcttcgcgctcttcaacgagaacctcaagccgggccccgtcgccgagcgcaacttcggcctcttctacgccaacctcacgccggtgtacgacgtcggcctcatgaaagacggggtgaagacaggggctgcgccggcgccggcgccggcgccggcagctacggtggcgtctgcccctgaatccaaggctgccaagaaagatgaagtggaggcggccgcggcacctgaagagacggacgcgtccgcgtcgacgcctgcgccgtcgtccgtggaggacgaaggttcatccgaggccaccggaccgtcgccgtcgtcagagaagggtgattcgaccgacgaagacaagacgacggaggaggaaggaggggatgcgccgccaccggcggcggcagcggccagcgggcatgccgatgagtcgtcggagacagtagcaaaggacggcgatgctgctggaggcggtaaaacgccggcgccggcgggtgcagagtctcacggcggcaacctcagagtccccgtctcgtccgtccttacaattgctctgtcgtctctagctcttgttggcatctaa

SEQ ID NO: 15881 - protein, 506 aa, Sorghum bicolor
  misc_feature: Useful for making plants with altered cell wall content and/or composition
  misc_feature: Functional homolog of the protein sequence given in SEQ ID NO 14282
  misc_feature: Useful for making plants with altered carbohydrate content
  misc_feature: Functional homolog of the protein sequence given in SEQ ID NO 14283
  misc_feature: Ceres ANNOT ID no. 8645324
  misc_feature (34)..(356): SWISSPROT Homolog: EC 3.2.1.39 Glucan endo-1,3-beta-D-glucosidase
  misc_feature (34)..(352): Pfam ID: Glyco_hydro_17 Pfam Description: Glycosyl hydrolases family 17
MAAPPSWQRHAAAAVVVSVSLLILVVAPSSTTAIGVNYGTKGDNLPPPATVASFLANRTRIDRVKLFDTNPDMVRAFAGTGIALMVTAGNGDIPKLATKDGAAAWVSANVAPYYPKTDISLVLVGNEIMDTGDASLISNLVPAMRALRAALVAAGFRKIRVSTPHSLGILAGASEPPSASRFRDGWDRAVFAPMLAFHRQSRSPFMVNPYPYFGYNGATLPYALARPDNKLGVTDPGTGITYTSMFEAQLDSVYSAMKKLGFDDVEIAVGETGWPTKAMDGQIGVSNADAAEYNRYLIGEAGGGSGTPLMPKRTFETYIFALFNENLKPGPVAERNFGLFYANLTPVYDVGLMKDGVKTGAAPAPAPAPAATVASAPESKAAKKDEVEAAAAPEETDASASTPAPSSVEDEGSSEATGPSPSSEKGDSTDEDKTTEEEGGDAPPPAAAAASGHADESSETVAKDGDAAGGGKTPAPAGAESHGGNLRVPVSSVLTIALSSLALVGI

SEQ ID NO: 15882 - DNA, 645 bp, Sorghum bicolor
  misc_feature: Ceres ANNOT ID no. 8645319
  misc_feature: Encodes the peptide sequence at SEQ ID NO 15883
atggcggcgccgccggcgagggcccgggccgactacgactacctcatcaagctgctcctcatcggcgatagcggtgttggtaaaagttgtctccttttacggttctcagatggctccttcaccactagctttatcaccaccattgggattgacttcaaaataagaacagttgagcttgatggtaagcgcataaagttacagatatgggatactgctggtcaagaacgttttcgaactattacaaccgcctactacaggggtgcaatgggaattttgcttgtctatgatgttactgatgagtcatctttcaataatataagaaactggattaggaacattgagcaacatgcttccgacaatgtgaataaaattttggtaggcaacaaagctgacatggatgaaagcaaacgggctgtaccgacttcaaaagggcaggctcttgctgatgagtacggcatcaagttttttgaaacgagtgccaagaccaacctgaacgtggagcaggttttcttctccatagcaagagatatcaagcaaagacttgctgaatctgattcaaagccagaggaccgcacgatcagtattaacagacctgagggtggtgaggcttcggcgtcacaaaaatcagcttgctgcggatcgtga

SEQ ID NO: 15883 - protein, 214 aa, Sorghum bicolor
  misc_feature: Useful for making plants with altered lignin content
  misc_feature: Functional homolog of the protein sequence given in SEQ ID NO 13211
  misc_feature: Useful for making plants with modulated oxidative stress sensitivity
  misc_feature: Functional homolog of the protein sequence given in SEQ ID NO 13074
  misc_feature: Ceres ANNOT ID no. 8645319
  misc_feature (16)..(143): SWISSPROT Homolog: EC 2.7.11.1 Non-specific serine/threonine protein kinase
  misc_feature (17)..(179): Pfam ID: Ras Pfam Description: Ras family
  misc_feature (17)..(131): Pfam ID: Miro Pfam Description: Miro-like protein
MAAPPARARADYDYLIKLLLIGDSGVGKSCLLLRFSDGSFTTSFITTIGIDFKIRTVELDGKRIKLQIWDTAGQERFRTITTAYYRGAMGILLVYDVTDESSFNNIRNWIRNIEQHASDNVNKILVGNKADMDESKRAVPTSKGQALADEYGIKFFETSAKTNLNVEQVFFSIARDIKQRLAESDSKPEDRTISINRPEGGEASASQKSACCGS

SEQ ID NO: 15884 - DNA, 1542 bp, Sorghum bicolor
  misc_feature: Ceres ANNOT ID no. 8645388
  misc_feature: Encodes the peptide sequence at SEQ ID NO 15885
atggcgtgccccgcggcgccgcatgcgagcgcggccttcttcgccagacccgctgcgccgctgcccgcgcgccccgcctcgtccccgggcgcggacccgcgccgcgcgttgtcggcctcctccaccaccacaaccagcttcgtcctcgccgacgccccccgggggatcaaggaggagcaggcggacgcgggcgctcaggcggcggcggtggcgcggagggacgtcagcccggacacggtggcctccatcatcctcggcggtggcgctggtacgcgcctcttcccgctcacgcggaccagagccaagcccgcggtgcccgtcgggggatgctacaggctcatcgacatcccgatgagcaactgcataaacagcaagatcaacaagatctacgtcctcacccagttcaattcccagtctctcaatcgccacatcgcacggacatacaactttggcgagggagttggattcagtggtgggtctgtggaggtgctggcagctacacagacagctggggaatccggaaagaaatggttccagggaacagcagatgctgtcaggcagttcctctggctttttgaggacgcaagactcaaatgtatagaaaacatactgattctgtctggtgatcatctgtataggatggattacatggactttgtgcagaagcatgttgactctggtgctgatatttcagttgcgtgtgttcctatggatgaaagtcgagcatctgattttggattgatgaaggccgacaggaatggtcgcatcactgatttccttgaaaagcccaagggtgaaaatttgaaatcaatgcaagtggatatgggattgtttggattatccccagagtttgcaagtacatacaaatacatggcttcaatgggaatatatgtatttaaggcagatgttctcagaaagcttctgagagggcattatcctactgctaatgattttggctcagaagtgattccaatggctgcaaaagattatgatgtgcaggcttatttgtttgatggttactgggaagatattgggacaataaagtctttctttgaagcaaaccttgctctcaccgatcagtttcccaacttctatttttatgatcccgtgaagcctatttttacatctcctagatttttacctccaaccaaggtagaaaattgcaaggttttgaactctataatttcacatggctgctttctaaccgagtgcagtgttgagcactctgtcattggtatccgctcaagattagaactgggggtgcagctcaaggacaccatgatgatgggggcagattactaccagactgaagttgagagattatctgaactgtcagttggaaaagttccagttggtgttggagagaacactaaaataaggaactgtatcattgataaaaatgctcgaattgggaagaatgtagtcattatgaactctgagaatgtgcaagaagcagacaggacagctgaaggatattacattcgttctgggataactgtggtgctcaagaatgcagtaattctgaatggtacaacaatttag

SEQ ID NO: 15885 - protein, 513 aa, Sorghum bicolor
  misc_feature: The sequence is a functional homolog of SEQ ID NO 38 in US patent 7312378
  misc_feature: The sequence is a functional homolog of SEQ ID NO 39 in US patent 7312378
  misc_feature: The sequence is a functional homolog of SEQ ID NO 37 in US patent 7312378
  misc_feature: Ceres ANNOT ID no. 8645388
  misc_feature (77)..(513): SWISSPROT Homolog: EC 2.7.7.27 Glucose-1-phosphate adenylyltransferase
  misc_feature (81)..(360): Pfam ID: NTP_transferase Pfam Description: Nucleotidyl transferase
MACPAAPHASAAFFARPAAPLPARPASSPGADPRRALSASSTTTTSFVLADAPRGIKEEQADAGAQAAAVARRDVSPDTVASIILGGGAGTRLFPLTRTRAKPAVPVGGCYRLIDIPMSNCINSKINKIYVLTQFNSQSLNRHIARTYNFGEGVGFSGGSVEVLAATQTAGESGKKWFQGTADAVRQFLWLFEDARLKCIENILILSGDHLYRMDYMDFVQKHVDSGADISVACVPMDESRASDFGLMKADRNGRITDFLEKPKGENLKSMQVDMGLFGLSPEFASTYKYMASMGIYVFKADVLRKLLRGHYPTANDFGSEVIPMAAKDYDVQAYLFDGYWEDIGTIKSFFEANLALTDQFPNFYFYDPVKPIFTSPRFLPPTKVENCKVLNSIISHGCFLTECSVEHSVIGIRSRLELGVQLKDTMMMGADYYQTEVERLSELSVGKVPVGVGENTKIRNCIIDKNARIGKNVVIMNSENVQEADRTAEGYYIRSGITVVLKNAVILNGTTI

SEQ ID NO: 15886 - DNA, 1563 bp, Sorghum bicolor
  misc_feature: Ceres ANNOT ID no. 8645417
  misc_feature: Encodes the peptide sequence at SEQ ID NO 15887
atgctcagctcaagcaggaagatgagtagatccgcgactgtaaggggggcaataatttcctattggatttttcaggttcttttggttttcacaaccattgttgctcagacccaatgggctagtgtatggggcatgtactgcgaggacttgacagcaagtgtagagaggccacacagtgcctcaataacggattttggtgctgttggagatggtgcgactcttaacacgaaagcatttcagaatgcactcttctacctcaattcatttgcgaagaagggcggagcgcagctgtttgtgcctgctggaaggtggctgaccgggagttttagtctaatcagccatctcacactctcactggacaaggacgcagtaattcttggatcaacagactcctctgactggccagttattgatgctcttccatcctatgggcgtggtagagaactacccggtaaaagacatcaaagtttaatatttggatccaatcttactgatgtaataataactggttccaatggcaccattgatggccaaggtgcagtttggtgggactggtttcacaaccacacattgaattatactagaccaccgcttgttgaactgatgtactctaccagagtagttatttccaacctaaccttcataaattcaccattttggaatatccatccagtatactgcaggttcccttttgagcattcctctctgtcatttattactgaaactgttttttcccggatgaacagccaagtcctggcccagcatctcacgatcctagcacctatcagttcaccaaacaccgatggcattgatccagactcatctacaaacgtttgcattgaagattgttacatcagaaatggcgatgacattgttgtcatcaagagtgggtgggatgagtatggcatctcttttgctcatcctagctccaacattagcatccgcaacatcacaggacagacaaggaacagcgctgggctcgcctttggaagcgagatgtcaggtggtatatcagacgttcgagcagagggcatccggatcgtcaactcagtgcatgggatcagaatcaagacagccccagggcgcggaggatacgtgaagaacgtgtatgtagccgatgtgagctttgacaacgtttccatagccatcaggatcactggaaactacggtgaacaccctgatgataggtacaacaagagtgcacttcccaccataagcaacataactatcaaggatgttgtgggtgtcaacattggtgttgcaggaatgttgcagggcatcccaggggataacttcagcaatatttgcttatcaaatgtgtctctcagtgtcagatctacagatccatggaattgttcactcgtcgaagggtattcgaactctgtgtcaccagaggtatgcgagcaactaagaaccagtccagggcccggacaaatttgctacggcagtaattatccagccgctgcagcacagccacagccacagccacagccgctgcagaaatcaagtgctagccggctggtaaatcctttcctttcgataagttggtttctatgtaggtaa

SEQ ID NO: 15887 - protein, 520 aa, Sorghum bicolor
  misc_feature: Useful for making plants with altered carbohydrate content
  misc_feature: Functional homolog of the protein sequence given in SEQ ID NO 13672
  misc_feature: Useful for making plants with altered cell wall content and/or composition
  misc_feature: Functional homolog of the protein sequence given in SEQ ID NO 13673
  misc_feature: Ceres ANNOT ID no. 8645417
  misc_feature (251)..(476): SWISSPROT Homolog: EC 3.2.1.15 Polygalacturonase
  misc_feature (51)..(179): SWISSPROT Homolog: EC 3.2.1.82 Exo-poly-alpha-galacturonosidase
  misc_feature (91)..(467): Pfam ID: Glyco_hydro_28 Pfam Description: Glycosyl hydrolases family 28
MLSSSRKMSRSATVRGAIISYWIFQVLLVFTTIVAQTQWASVWGMYCEDLTASVERPHSASITDFGAVGDGATLNTKAFQNALFYLNSFAKKGGAQLFVPAGRWLTGSFSLISHLTLSLDKDAVILGSTDSSDWPVIDALPSYGRGRELPGKRHQSLIFGSNLTDVIITGSNGTIDGQGAVWWDWFHNHTLNYTRPPLVELMYSTRVVISNLTFINSPFWNIHPVYCRFPFEHSSLSFITETVFSRMNSQVLAQHLTILAPISSPNTDGIDPDSSTNVCIEDCYIRNGDDIVVIKSGWDEYGISFAHPSSNISIRNITGQTRNSAGLAFGSEMSGGISDVRAEGIRIVNSVHGIRIKTAPGRGGYVKNVYVADVSFDNVSIAIRITGNYGEHPDDRYNKSALPTISNITIKDVVGVNIGVAGMLQGIPGDNFSNICLSNVSLSVRSTDPWNCSLVEGYSNSVSPEVCEQLRTSPGPGQICYGSNYPAAAAQPQPQPQPLQKSSASRLVNPFLSISWFLCR

SEQ ID NO: 15888 - DNA, 1035 bp, Sorghum bicolor
  misc_feature: Ceres ANNOT ID no. 8645444
  misc_feature: Encodes the peptide sequence at SEQ ID NO 15889
atggaggagggcaaagttccaattctttcacttgaagcattgcatcaattggacatatttatcttcaacttagcagttacacatgtggttctcagtgttcttacttttgtcgttggagttgcacagacaaaaaactggaggcattgggaaggaaagatccaacagaatgatgatagtggtactcaaacaatcaaacatgttcaagaattcaagtttgtccgagatcactttaaagggcaaggaatacgttggaagatttttggctggatgaggtctttcttcaagcaattctatgggtcactcactgaggaggactacatagccatgcgacttggcttcattgagaaacactgcaggggaaacccaaaattcaatttctacaactacatgattagagcatttgaggcagattacaagaaagtcgttggtataagttggtacctttgggctttgctaatggtattcttgctgctgaatgttcatggatggtatgtctacacatggttatcattggtccctttcattctgctacttgtgattggatgtaagatggagcatgttattactgagatggctgttgaggttgcacagaaacatacagcaatagaaggggacgtggtcgttgctccatcagatgattttttttggttccataggcctaaagtggtcctctatttgatccacttcattctatttcagatagcgtttgagattgcatttttcttctggttgttggtagcatacgggtatgaatcatgcattatgggaaagcacgcacatgctattactcgacttgtattaagtattgccagtcgaatcttatgtggttacagcaccctacctctctatgtgattgtctcccatatgggaagttcattcaacaaagcaatatttgatgataatgtatctgaagaccttgccaactgggctcaaagtgctagaaggcgtaacaaaaggaacaaaacaaatgttgatgcagccaactcgtctattgatgagagacatggtggtgtggttcaaatgacaaatgcatga

SEQ ID NO: 15889 - protein, 344 aa, Sorghum bicolor
  misc_feature: Useful for making plants with modulated biotic stress sensitivity
  misc_feature: Functional homolog of the protein sequence given in SEQ ID NO 13615
  misc_feature: Ceres ANNOT ID no. 8645444
  misc_feature (1)..(344): Pfam ID: Mlo Pfam Description: Mlo family
MEEGKVPILSLEALHQLDIFIFNLAVTHVVLSVLTFVVGVAQTKNWRHWEGKIQQNDDSGTQTIKHVQEFKFVRDHFKGQGIRWKIFGWMRSFFKQFYGSLTEEDYIAMRLGFIEKHCRGNPKFNFYNYMIRAFEADYKKVVGISWYLWALLMVFLLLNVHGWYVYTWLSLVPFILLLVIGCKMEHVITEMAVEVAQKHTAIEGDVVVAPSDDFFWFHRPKVVLYLIHFILFQIAFEIAFFFWLLVAYGYESCIMGKHAHAITRLVLSIASRILCGYSTLPLYVIVSHMGSSFNKAIFDDNVSEDLANWAQSARRRNKRNKTNVDAANSSIDERHGGVVQMTNA

SEQ ID NO: 15890 - DNA, 1341 bp, Sorghum bicolor
  misc_feature: Ceres ANNOT ID no. 8645466
  misc_feature: Encodes the peptide sequence at SEQ ID NO 15891
atggccccgccgccgcggcctctcctcgctacttccctcctctccctcctcctcctcgtcctactgcacggccactcgccgcgcgccgccgcggcggcggcggtttcgccgtcgtctctcggtgacgacctcctgggcgcggccggcgcgccgggtttcgcggcgtggctgcgcggcctgcggcgtcgcatccacgagcgccccgagctcgccttccaggagcaccgcaccagcgagctcgtccgcgccgagctcgacgcgatcggggtgccgtacgcgtggcccgtcgcgcagacgggcgtcgtggcgaccatcgcccccggcggcggcggcagagccagcgatgggccggtcgtcgcgctccgggcggacatggacgcgctacccttgcaggaattggtagactgggaacacaagagcaaggaaagtggaaagatgcatgcttgtggacatgatgctcacacaacgatgcttcttggggcagctaaattgcttcatgctcggaaggatgatttgaagggtactgtgaggcttatcttccagccaggagaagaaggtcacgctggcgcttatcatgttatcaaagaaggtgtcctggacgatgtgtcagccattttcggcttgcatgttgatccaagacttcctgtaggcaccgtttcctccagaccagggccatttctagcagcatcaggtagatttttggtgacgatcaatggaaaaggcggacatgctgcagggccccaggatgctgtggatcccattgttgcagcatcctctgccatcgtcagccttcagatgcttgttgcccgggaaattgatcctctgcaggctgcagtggtctcggtgacgttcatgaaaggaggtgatgctcacaatgtcattccggagaaagtatccttcggtggtaccttcaggagcttgacaacagaaggcttttcgtatcttatgaagaggatcaaagagatcatagaagctcaagccaccgtccaccgctgcaccgccgtcatcgacttcatggaggaggagctccgtccatatccagcaactgtaaacgatgaagggatgtaccatcacgccagagaagtggcggagaccatgcttgggcaggagaacgtgagggtaggcgcccaattaatgggcgctgaggatttttccttctatgcgcagaaatttgcaggggcgttcttctttattggagtccgcaacaagagcatggaggcaatgtatcccctgcactccccttactttgtgattgatgaggatgtgctccctgtaggagctgccttccacgctgcagtagcgatggagtacctgatcaaacatacagccgcggcaaactga

SEQ ID NO: 15891 - protein, 446 aa, Sorghum bicolor
  misc_feature: Useful for making plants with modulated nitrogen use efficiency
  misc_feature: Functional homolog of the protein sequence given in SEQ ID NO 14076
  misc_feature: Ceres ANNOT ID no. 8645466
  misc_feature (60)..(438): SWISSPROT Homolog: EC 3.5.1.32 Hippurate hydrolase
  misc_feature (120)..(436): Pfam ID: Peptidase_M20 Pfam Description: Peptidase family M20/M25/M40
MAPPPRPLLATSLLSLLLLVLLHGHSPRAAAAAAVSPSSLGDDLLGAAGAPGFAAWLRGLRRRIHERPELAFQEHRTSELVRAELDAIGVPYAWPVAQTGVVATIAPGGGGRASDGPVVALRADMDALPLQELVDWEHKSKESGKMHACGHDAHTTMLLGAAKLLHARKDDLKGTVRLIFQPGEEGHAGAYHVIKEGVLDDVSAIFGLHVDPRLPVGTVSSRPGPFLAASGRFLVTINGKGGHAAGPQDAVDPIVAASSAIVSLQMLVAREIDPLQAAVVSVTFMKGGDAHNVIPEKVSFGGTFRSLTTEGFSYLMKRIKEIIEAQATVHRCTAVIDFMEEELRPYPATVNDEGMYHHAREVAETMLGQENVRVGAQLMGAEDFSFYAQKFAGAFFFIGVRNKSMEAMYPLHSPYFVIDEDVLPVGAAFHAAVAMEYLIKHTAAAN

SEQ ID NO: 15892 - DNA, 336 bp, Sorghum bicolor
  misc_feature: Ceres ANNOT ID no. 8645683
  misc_feature: Encodes the peptide sequence at SEQ ID NO 15893
atggccagcccagcccactcgcgtgcactgaagttagagcggcggctcctatgcgggtacggcaccgaggccgcctccttcagcaccggcttcctagccgccgctagccccgcgctgtaccgtgctggcatcggctgcggcgcctgcttccaggtgcagtgcaaggataagaagctctgtgccgcggcggcagccagggtagtggtaacggaccgcgccaggaccaaccgcaccgactttgtgctcagcagcaccgcattcgcggccatggtgcgccccggcatgaccaaacgcctcgccggcctccgcaccgtcgatgtcgagtacacgaggtaa

SEQ ID NO: 15893 - protein, 111 aa, Sorghum bicolor
  misc_feature: Useful for making plants with altered carbohydrate content
  misc_feature: Functional homolog of the protein sequence given in SEQ ID NO 14284
  misc_feature: Ceres ANNOT ID no. 8645683
  misc_feature (32)..(109): Pfam ID: DPBB_1 Pfam Description: Rare lipoprotein A (RlpA)-like double-psi beta-barrel
MASPAHSRALKLERRLLCGYGTEAASFSTGFLAAASPALYRAGIGCGACFQVQCKDKKLCAAAAARVVVTDRARTNRTDFVLSSTAFAAMVRPGMTKRLAGLRTVDVEYTR

SEQ ID NO: 15894 - DNA, 2085 bp, Sorghum bicolor
  misc_feature: Ceres ANNOT ID no. 8645787
  misc_feature: Encodes the peptide sequence at SEQ ID NO 15895
atggctgtctttcttccctgcaacgacgccggcatctgcatggtctgcggcgtggccgtgcaatccgaggacgaactgctacgctgctccacctgcgtcaccctgtggcactccccttgcctctcgaatccccccgcggtctccgatgccgcgacctggagctgccccggctgctccgtcgtcgtcgtcgaccctgcacctgcagctgcccgcgcggcggcccctgcgactgcgacaacaggaggcgagctcatcgtcgcggccgtccgcgcgatcgaggccgacaccaccctctccaatgcagagaaggcgcgacgccggcaaaaccttctcgctggccgatctgcacccgatgatgtcgacgacagcgcagaggacggcgtcctcaacatcctcggcgaaagcttcagctgcgccttctgcttggagctgctggatcgccctgtcactacaccatgtgggcacaatttttgcctgaagtgcttcaacggatggacacgtaagggaaaaagggcatgtgcaaaatgtcgtcaaccgatcccgtccaaaatggtgcaacaacctagaattaactctaaaatggatgaagtcatccgtaaggccaggatgccaaagacaactaattcaactggcttagtagattcacatcgccattatatacagaatgttgataagcccgacagggcatatacaactaaaagggccaagcgacctggaaaagcaaatgcttcaagtggcaagatttttgtgacaactgaacccgatcattttggaccgatccttcccaaacatgaccccatgagggaaattggcgtcaaagttggagaaacatgggcagatagattggaatgcagacaatggggtgctcatttccctcatatagctggaattgctgggcagagcggaaagggtgctcagtcagtcgccctatctggaggctatgaagatgacgaagatcatggggattggtttctttatactggaagtggcgggagggatctaagtggaaacaagagaacaaataaagagcaaggattcgatcaaacatttaggaacatgaacgaggctcttcgacaaagctgcttgtcgggtcaccctgttcgggttgtgcggtcgcataaagtgaaacactctttgtacgctcctaaattgggcgtgaggtatgatggaatttacagaattgagaaatgttggaggaagattggtattcaggggaagttcaaagtctgcaggtatctctttgtacgctgtgacaatgaaccagcaccttggaccaggccattgcccgacattccggagttagaaaatgcaactgatatatatgagagagatgagcaaccttcatggggctacgatgagagagaacgctgctggaaatggatgcgtgatgaaccgcagccaacaaggataaagaatgctggcaaacaagtccagagaagagcaaggtctaacactaaaagacttctgaaagaatttagttgttctatctgctgcaaagtgatgacagaaccactctctgctccctgtggtgacaacttctgcaagacttgtttgctgggggcatatgataagcagtcctccgtgagagaaagaagcggtggcggtcgtacccttagggctcagaagatcgtgaagagatgcccatcctgtagaattgacatcagtgacttcctagtggatccacagatcaaccgagacataatgaatgtgattgagtctctgcaactgaaactcgaagaaggtaacaccaccaaggacataccatatggtggtggtgacatggctgaggaattccatgatgatgaacaagaggaaaatgatggcggcggtatggagatggatgaggctggttgtagctttgatgtcgaagagggagacaatgctgaggatcatgaggataacccagctgatatggatgatgatgcttgtggcgaaattgtggttggaatcaaagaagaagggcagcagcctgaccagaaacgcaagggtgacactgacattggcactgatggtcctaataaaaggacgacaaccagagttggcgtgggacaacagaacagcaagggcgatgaggcaggcatgtaa

SEQ ID NO: 15895 - protein, 694 aa, Sorghum bicolor
  misc_feature: The sequence is a functional homolog of SEQ ID NO 2314 in the 10/374,780 US patent application
  misc_feature: The sequence is a functional homolog of SEQ ID NO 522 in the 10/225,066 US patent application
  misc_feature: Ceres ANNOT ID no. 8645787
  misc_feature (305)..(421): SWISSPROT Homolog: EC 2.1.1.43 Histone-lysine N-methyltransferase
  misc_feature (262)..(420): Pfam ID: YDG_SRA Pfam Description: YDG/SRA domain
  misc_feature (138)..(176): Pfam ID: zf-C3HC4 Pfam Description: Zinc finger, C3HC4 type (RING finger)
  misc_feature (494)..(550): Pfam ID: zf-C3HC4 Pfam Description: Zinc finger, C3HC4 type (RING finger)
  misc_feature (12)..(61): Pfam ID: PHD Pfam Description: PHD-finger
MAVFLPCNDAGICMVCGVAVQSEDELLRCSTCVTLWHSPCLSNPPAVSDAATWSCPGCSVVVVDPAPAAARAAAPATATTGGELIVAAVRAIEADTTLSNAEKARRRQNLLAGRSAPDDVDDSAEDGVLNILGESFSCAFCLELLDRPVTTPCGHNFCLKCFNGWTRKGKRACAKCRQPIPSKMVQQPRINSKMDEVIRKARMPKTTNSTGLVDSHRHYIQNVDKPDRAYTTKRAKRPGKANASSGKIFVTTEPDHFGPILPKHDPMREIGVKVGETWADRLECRQWGAHFPHIAGIAGQSGKGAQSVALSGGYEDDEDHGDWFLYTGSGGRDLSGNKRTNKEQGFDQTFRNMNEALRQSCLSGHPVRVVRSHKVKHSLYAPKLGVRYDGIYRIEKCWRKIGIQGKFKVCRYLFVRCDNEPAPWTRPLPDIPELENATDIYERDEQPSWGYDERERCWKWMRDEPQPTRIKNAGKQVQRRARSNTKRLLKEFSCSICCKVMTEPLSAPCGDNFCKTCLLGAYDKQSSVRERSGGGRTLRAQKIVKRCPSCRIDISDFLVDPQINRDIMNVIESLQLKLEEGNTTKDIPYGGGDMAEEFHDDEQEENDGGGMEMDEAGCSFDVEEGDNAEDHEDNPADMDDDACGEIVVGIKEEGQQPDQKRKGDTDIGTDGPNKRTTTRVGVGQQNSKGDEAGM

SEQ ID NO: 15896 - DNA, 189 bp, Sorghum bicolor
  misc_feature: Ceres ANNOT ID no. 8645771
  misc_feature: Encodes the peptide sequence at SEQ ID NO 15897
atggggctcgtgttcgggaagctcttcagccggctcttcgccaagaagaagatgcggatcctcatggtcggcctcgacgccaccggtaaaatcaccatcctctacaagctcaagctcggcgagatcgtcaccatcacatggatattcaaagatattttagacgttagggggggcaatggaccctgctag

SEQ ID NO: 15897 - protein, 62 aa, Sorghum bicolor
  misc_feature: Useful for making plants with altered alkaloid content
  misc_feature: Useful for making plants with altered lignin content
  misc_feature: Functional homolog of the protein sequence given in SEQ ID NO 12945
  misc_feature: Useful for making plants with altered terpenoid content
  misc_feature: Functional homolog of the protein sequence given in SEQ ID NO 13081
  misc_feature: Ceres ANNOT ID no. 8645771
MGLVFGKLFSRLFAKKKMRILMVGLDATGKITILYKLKLGEIVTITWIFKDILDVRGGNGPC

SEQ ID NO: 15898 - DNA, 870 bp, Sorghum bicolor
  misc_feature: Ceres ANNOT ID no. 8645781
  misc_feature: Encodes the peptide sequence at SEQ ID NO 15899
atgaacgtgaagggcggcggccggattccggtgcccccgccgggggccagcgcgctggtcaaggtggccgtgttcggcggcgccgccgtgtacgccgccatgaacagcctctacaacgtcgagggtggccaccgcgccatcgtcttcaaccgcatccagggcatcaaggacaaggtataccccgaagggactcactttatgattccatggtttgaacggccaatcatttatgatgtccgcgctcgaccgaatcttgttgagagtacttctgggagccgggatcttcagatggtgaaaattggtctccgtgtcctcacaaggcctatgccagagaggctaccacatatctacagaactctgggagagaacttcaatgagagagttctgccttcaatcatccatgaaacactgaaagctgttgttgctcaatacaatgctagtcagctgatcacacagagagagactgtgagtagggagattaggaagatactgactgagagggctcgattcttcaacattgctcttgatgatgtctctatcacaagcctgagcttcgggaaggagttcactcatgccattgaagccaagcaggttgctgcacaggaagctgagcgtgctaagttcattgtcgagaaagctgagcaagataagagaagtgcaattatcagggctcagggagaggctaagagtgccgagctgattggtcaagccatagcgaacaaccctgccttccttgccctgaggcagattgaagctgcaagggagatctcccacacgatttcgtcctccgccaacaaggtgttcctggactccaacgacctgctgctcaacctccagcagctgaatgtgtcgagcaagcagaagaaatga

SEQ ID NO: 15899 - protein, 289 aa, Sorghum bicolor
  misc_feature: Useful for making plants with modulated biomass
  misc_feature: Functional homolog of the protein sequence given in SEQ ID NO 14075
  misc_feature: Ceres ANNOT ID no. 8645781
  misc_feature (38)..(217): Pfam ID: Band_7 Pfam Description: SPFH domain / Band 7 family
MNVKGGGRIPVPPPGASALVKVAVFGGAAVYAAMNSLYNVEGGHRAIVFNRIQGIKDKVYPEGTHFMIPWFERPIIYDVRARPNLVESTSGSRDLQMVKIGLRVLTRPMPERLPHIYRTLGENFNERVLPSIIHETLKAVVAQYNASQLITQRETVSREIRKILTERARFFNIALDDVSITSLSFGKEFTHAIEAKQVAAQEAERAKFIVEKAEQDKRSAIIRAQGEAKSAELIGQAIANNPAFLALRQIEAAREISHTISSSANKVFLDSNDLLLNLQQLNVSSKQKK

SEQ ID NO: 15900 - DNA, 411 bp, Sorghum bicolor
  misc_feature: Ceres ANNOT ID no. 8645901
  misc_feature: Encodes the peptide sequence at SEQ ID NO 15901
atggggcaaccatggagcagcgcgaggcaactgcagggtggctgcggggcaatgcccttctccttcctcgtccttctcgccggagacgatgttaataaagtaatgacatttgagaatgtgaagaggtggttgaaggagctccgggaccatgctgactcaaacatcgttgtcataaacttgcattctgtcgtggttgaggatgctgcaaggtttgcagacatcgaaggtttgttcttcatcgagaccactgcagttgatgcaacaaatgtcgagaaagctttccagactattctacgtgagatctacagaataatcagcaagaagcccctgtcttctgaggaagaggcacaatccattcaagtgtcagccacaaattctaatgctcttagatcatggtgctgctcttcttag

SEQ ID NO: 15901 - protein, 136 aa, Sorghum bicolor
  misc_feature: Useful for making plants with altered lignin content
  misc_feature: Functional homolog of the protein sequence given in SEQ ID NO 13076
  misc_feature: Ceres ANNOT ID no. 8645901
  misc_feature (24)..(103): Pfam ID: Ras Pfam Description: Ras family
MGQPWSSARQLQGGCGAMPFSFLVLLAGDDVNKVMTFENVKRWLKELRDHADSNIVVINLHSVVVEDAARFADIEGLFFIETTAVDATNVEKAFQTILREIYRIISKKPLSSEEEAQSIQVSATNSNALRSWCCSS

SEQ ID NO: 15902 - DNA, 1491 bp, Sorghum bicolor
  misc_feature: Ceres ANNOT ID no. 8645933
  misc_feature: Encodes the peptide sequence at SEQ ID NO 15903
atgaatgcccatgcccacccagttgtggcctccacggcgttcgcccatgccctcctgccaaactccagcagcattcgatcacgacgcaccccactccgcccaatttttgcagtgccgccgccagcccttggacaactcccgacgactctccgagcaacaaccaagacgcttctgcacccaacgacgacgccgcccgtcgtcaccaccaccgctgaccgtgctgaaagcgttttcgccggcaccggcgaccgcttccacgtgatggacttccaccacgtcgagttctggtgcgccgacgccgcctccgctgccggccgcttctccttcgcgctcggcgtgccactcgccgcgcagtccgacctcaccacggggaacaccgcgcacgcttcccgcctgctgcggtcgcgctctggacctctcgcgctcctcttcaccgccccgtacgcgcggcacatcggcgcccgccccgacgccgacgcaacgtccgcctcctcccccgtggtgccctccttctcggccgacgccgcgcgccgcttcgccgccgactacggcggcctcgcggtgcgcgccgtcgcggtccgtgtctccgacgccgccgaggcgttccgcgccagcgtcgccgcgggtgcgcgcccggccttcgctcccgctgagctcggccacggcttcgtgtttgccgaagtcgagctctacggagacgccgtcctccgtttcgtgagctacccggacgacacgggcggcgtggccttcctccccgggttcgagaacgtcgcaaactcatcagcgtgcccggcgccggactacggactcaaccggttcgaccacatcgtcggcggcgtgccggacctggctccggtcgccgcgtacatcgccggcttcacgggcttccacgaattcgacagggtcaacggcgacgaaataggcacggccgagagctcgctcaacggcctggtgctggcggacagctcggagaaggtgctcctcacgctgctggagccggtgcagggcaccaagcgccggagccagatacagacgttcctggaccaccatggcgggccaggagtgcagcacctggccatgaccagtgacgaccttctcggcacgctgagggagatacgtgcgcggtcctccatgggcggcttcgagctcctgccaccgccgccgcccagctactatgacggcgtaaagcggctcgccggggatgtgctgtcggaggcgcagattaacgagtgccaagagctcggcgtgcgggtggacagggctgacaatggcggagttgtgctccaaaccttcaccaaggctgctggagacaggccaaccttgctcttggagtttatccagaggatcggctgcgtggagatagatgagaacgggaaggaataccagaggggtggctgcggcggttttgccaaggataacgtcattcatttggtgaaatccattgaggactatgacaaaactcttgacgctcctgcccatgtggcttcctaa

SEQ ID NO: 15903 - protein, 496 aa, Sorghum bicolor
  misc_feature: Useful for making plants with altered tocopherol content
  misc_feature: Functional homolog of the protein sequence given in SEQ ID NO 13376
  misc_feature: Ceres ANNOT ID no. 8645933
  misc_feature (219)..(495): SWISSPROT Homolog: EC 1.13.11.27 4-hydroxyphenylpyruvate dioxygenase
MNAHAHPVVASTAFAHALLPNSSSIRSRRTPLRPIFAVPPPALGQLPTTLRATTKTLLHPTTTPPVVTTTADRAESVFAGTGDRFHVMDFHHVEFWCADAASAAGRFSFALGVPLAAQSDLTTGNTAHASRLLRSRSGPLALLFTAPYARHIGARPDADATSASSPVVPSFSADAARRFAADYGGLAVRAVAVRVSDAAEAFRASVAAGARPAFAPAELGHGFVFAEVELYGDAVLRFVSYPDDTGGVAFLPGFENVANSSACPAPDYGLNRFDHIVGGVPDLAPVAAYIAGFTGFHEFDRVNGDEIGTAESSLNGLVLADSSEKVLLTLLEPVQGTKRRSQIQTFLDHHGGPGVQHLAMTSDDLLGTLREIRARSSMGGFELLPPPPPSYYDGVKRLAGDVLSEAQINECQELGVRVDRADNGGVVLQTFTKAAGDRPTLLLEFIQRIGCVEIDENGKEYQRGGCGGFAKDNVIHLVKSIEDYDKTLDAPAHVAS

SEQ ID NO: 15904 - DNA, 165 bp, Sorghum bicolor
  misc_feature: Ceres ANNOT ID no. 8645977
  misc_feature: Encodes the peptide sequence at SEQ ID NO 15905
atgatgttaagaatacccaacaattatgaaagggatgaccgaattctgccattcaaagtgaacaaagacccaagcattttattaaacaatgaggacactccatggttaagggatgatcataaccaaaggtcatatatcaagaagttcattcttgtgcccgcgtga

SEQ ID NO: 15905 - protein, 54 aa, Sorghum bicolor
  misc_feature: The sequence is a functional homolog of SEQ ID NO 1066 in the 10/374,780 US patent application
  misc_feature: The sequence is a functional homolog of SEQ ID NO 1308 in the 10/412,699 US patent application
  misc_feature: Ceres ANNOT ID no. 8645977
MMLRIPNNYERDDRILPFKVNKDPSILLNNEDTPWLRDDHNQRSYIKKFILVPA

SEQ ID NO: 15906 - DNA, 1212 bp, Sorghum bicolor
  misc_feature: Ceres ANNOT ID no. 8646137
  misc_feature: Encodes the peptide sequence at SEQ ID NO 15907
atgaagtcggccacctcgctcctcctcggcgccgcgctcgccaccgccttcttcctgctctacacctccctctgccgcgacctcgtcggcgccgccgcgcccagcaggtcatcagccaccccggcgccgcggtgggaggagcaggagaccaacacgacagctgcgggggttgctcctcaccagcaggagggcaccaaacatgtggctgcgagtagcggcgacgccgatggtgacgacgacggcgccgccgccacaacagaggagaagaaaggtcagagcgagaagcagcagccgcggtttgtgatgcctgccacgtcagcccagctgcagcagaagaagaagaaaagttcaccaccaccgtcccaggatctagcggacctactccggcgagcggcgacggcggacaagacggtgctgatgacggcgatcaacgaggcatgggcagcgccaggttcattcctggacctgttcctggagagcttccggcacggcgaggacacgtcgcaccttccgcggcacctggtgatcgtggccatggacgccaaagccttggcgcggtgcaccgccgtgcacccgttctgctactggttccgcgccggcgacggcaaggacttcgcggcggagcagaagtacatgaagggggactacctggagatgatgtggcgccggaacgcgctgcagcaggccgtgctggagctgggctacagcttcctcttcacggacgtggacatcctgtggttccggccgccgttcccgcgcctgccgcggggcgcgcaggtcgtcatgtcgtccgacttcttcgtcggcgacgtcgactcgccccacaactaccccaacggcgggctcctctacgtccggtcgtcgccggccaccgtggggttctaccgccactggcaggcgtcgagggcgaggttcccgggccaccacgagcagtacgtcttcgacaagatcgtcaaggaagggtcgtacgccgccgccgcccccggcgcccgggtgcagttcctcgacacggccgtcttcggcgggttctgccagcacggcgacgacctagggaaggtggccaccatgcacgccaactgctgcgtcgggctggaaaacaagctcttcgacctcaagaacgtgctccaggactggaagacgtacagggcgcgcgccagagccggcaacgcgcagggattctcctggcgggtgcccgggagatgcatacactga

SEQ ID NO: 15907 - protein, 403 aa, Sorghum bicolor
  misc_feature: Useful for making plants with altered carbohydrate content
  misc_feature: Functional homolog of the protein sequence given in SEQ ID NO 14285
  misc_feature: Ceres ANNOT ID no. 8646137
MKSATSLLLGAALATAFFLLYTSLCRDLVGAAAPSRSSATPAPRWEEQETNTTAAGVAPHQQEGTKHVAASSGDADGDDDGAAATTEEKKGQSEKQQPRFVMPATSAQLQQKKKKSSPPPSQDLADLLRRAATADKTVLMTAINEAWAAPGSFLDLFLESFRHGEDTSHLPRHLVIVAMDAKALARCTAVHPFCYWFRAGDGKDFAAEQKYMKGDYLEMMWRRNALQQAVLELGYSFLFTDVDILWFRPPFPRLPRGAQVVMSSDFFVGDVDSPHNYPNGGLLYVRSSPATVGFYRHWQASRARFPGHHEQYVFDKIVKEGSYAAAAPGARVQFLDTAVFGGFCQHGDDLGKVATMHANCCVGLENKLFDLKNVLQDWKTYRARARAGNAQGFSWRVPGRCIH

SEQ ID NO: 15908 - DNA, 1452 bp, Sorghum bicolor
  misc_feature: Ceres ANNOT ID no. 8646206
  misc_feature: Encodes the peptide sequence at SEQ ID NO 15909
atgaggagccgggcgagggcggcgctgctggccgcgctgggcgccgcggagctgctcctcagcgcggtcgtccacctgggctacgccttctacatcttcggcaccgccgtcatcgccgacgtctccgcctccctcgtgaacaaggcccttatgcccggcggcggcgtggccaagggcgtcgccgtcgagggcgaggacgaggccgcggtggtgctcgacggatccgtcccgcccatcgtgctggtgcacggcatcttcggcttcggcaaaggcaggctgggcgggctgtcctacttcgccggcgcggagaagaaggacgaccgggtgctggtgccggacctgggctcgctcaccagcgtccacgacagggcccgggagctcttctactacctgaaaggcgggcaggtggactacggcgaggagcacagccgtgcgtccggccactcccggttcggccgcacctacgcgcgaggccactacccggtgtgggacgaggaccacccggtgcacctggtgggccactcggccggcgcgcaggtgatccgcctgctgcagcagatgctccacgacggcgagttcgagggccacgccgacgacacctcggagcggtgggtgctgagcgtcacctcactctccggcgcgctcaacggcaccacgcgcgcctacatcgacgggatgcgcgccgacgacgacgacaaggacggcgagggctggcggtcgctgcggcccgtgtgcctcctccagatctgccgcgtcggcagcgtgctctaccactggctcgacctcccatggctcaaccgctactacgacttcggcttcgaccacttcggcatgtcgcggcgcgtcgtcggcgtgtccgggctcgcggacctcctgctcggcggcgacggcaacggcaggcgagggcccttcgccacgggggactggatcgtgcccgacctcaccatccagggcgccgccaggatcaacgcccgggtaagcacgttcccgggcaccttctacttcagctacgccagccggcgcaccaccgccagggcacctggcggcgccaccgtgccgtccggggtgacgacgatccacccgctgctcttcctccgcgtcctgcagatgtgccgctggcgctaccccgccggcgcgccgtacccggggtacagggacgaggactgggaggacaacgacggcgcgctcaacaccttctccatgacgcacccgaggatccccgtcgagcatcccagcgtgcgggtggagaacgatgaggactgccatccgctgcggccggggatctggtactacaagatcgtggaggcggaccacatggcgttcgtcatcaaccggcggcgaggaggcgtgcagttcgacctcgtctacgacagcatcttccacaactgccggaagcatgtcttccggcggactgccccgccgccgacgctcccggatcagagtcagagctga

SEQ ID NO: 15909 - protein, 483 aa, Sorghum bicolor
  misc_feature: Useful for making plants with modulated cold sensitivity
  misc_feature: Functional homolog of the protein sequence given in SEQ ID NO 12936
  misc_feature: Ceres ANNOT ID no. 8646206
  misc_feature (114)..(342): SWISSPROT Homolog: EC 3.1.1.3 Triacylglycerol lipase
MRSRARAALLAALGAAELLLSAVVHLGYAFYIFGTAVIADVSASLVNKALMPGGGVAKGVAVEGEDEAAVVLDGSVPPIVLVHGIFGFGKGRLGGLSYFAGAEKKDDRVLVPDLGSLTSVHDRARELFYYLKGGQVDYGEEHSRASGHSRFGRTYARGHYPVWDEDHPVHLVGHSAGAQVIRLLQQMLHDGEFEGHADDTSERWVLSVTSLSGALNGTTRAYIDGMRADDDDKDGEGWRSLRPVCLLQICRVGSVLYHWLDLPWLNRYYDFGFDHFGMSRRVVGVSGLADLLLGGDGNGRRGPFATGDWIVPDLTIQGAARINARVSTFPGTFYFSYASRRTTARAPGGATVPSGVTTIHPLLFLRVLQMCRWRYPAGAPYPGYRDEDWEDNDGALNTFSMTHPRIPVEHPSVRVENDEDCHPLRPGIWYYKIVEADHMAFVINRRRGGVQFDLVYDSIFHNCRKHVFRRTAPPPTLPDQSQS

SEQ ID NO: 15910 - DNA, 1545 bp, Sorghum bicolor
  misc_feature: Ceres ANNOT ID no. 8646237
  misc_feature: Encodes the peptide sequence at SEQ ID NO 15911
atgggcctctgctcctcctgcaccgccgcccgggccgcctccgaccccggcgccgcagccgcgggtgacgccgcggccgcggccgcgaagaaggggcgcgggatcgtcgcgtgcgggaagcggaccgacttcggctacgacaaggacttcgaggcgcgctactcgctcgggaagctgctgggccacggccagttcggctacaccttcgccgccgtcgatcgcgcctcctccgagcgcgtcgccgtcaagcgcatcgacaagaacaagatggtccttcctgtcgctgttgaagacgtaaagcgagaagttaaaatattgaaggcattacaaggtcacgaaaatgttgtacacttttacaatgcattcgaagatgacaactatgtttatatagtcatggaattatgcgagggtggcgagctacttgatcggatattagccaagaaagatagccgttatagtgagaaagatgctgcggtagttgtccgacagatgctcaaggttgcagctgagtgccacctgcatggtttggttcatcgggacatgaaacctgagaacttcctattcaaatcaacaaaggaggactcgccccttaaggctacagattttggtctttcagacttcataaaaccagggcggcaattccgtgacattgtcggaagtgcctactatgtagcaccagaagtactcaaacgcaagtcagggccagaatccgatgtttggagtataggtgttataacctatattttgctgtgtggaagacgacctttctgggacaaaactgaagatgggatatttaaagaggtcttaaaaaacaagccagatttccgccgcaagccttggccaaacattacttcgagtgcaaaagattttgtacaaaaattactagttaaggatccccgtgtgagactaactgctgcacaggcattatcacatgattgggtgagagaaggaggaaaggcatctgaaatacccttggatatatcagtattacataatatgcgacagtttgtgaaatacagtcgtttcaagcaatttgctttaagggcattagcatctacattaaactcagaagagctgtccgatctgcgtgatcagttcaacgctattgacgttgacaaaaatggaacgattagtctggaggaactgaagcaggctcttgcaaaggatgtcccatggagattaaagggtccacgtgttttagagatcattgaagcgattgacagtaatacagatgggctagttgattttgaagagtttgttgctgcaacactacacatgcatcagctggtggaacatgatactgagaagtggaaatcattgtctcaagctgcatttgataaatttgatgttgacagagatggctacatcacatctgatgaacttagaatgcatacaggaatgaagggttctattgatcccctcctggaggaagctgacattgacaaagatggcaagataagcctagatgagtttcgtcggctcttgaagactgcaagcatgagcgcacgcaatgtacaaactcctaggggtgttcgcgtgtcatag

SEQ ID NO: 15911 - protein, 514 aa, Sorghum bicolor
  misc_feature: The sequence is a functional homolog of SEQ ID NO 2 in US patent 7084323
  misc_feature: Ceres ANNOT ID no. 8646237
  misc_feature (39)..(502): SWISSPROT Homolog: EC 2.7.11.1 Non-specific serine/threonine protein kinase
  misc_feature (54)..(314): Pfam ID: Pkinase Pfam Description: Protein kinase domain
  misc_feature (361)..(389): Pfam ID: efhand Pfam Description: EF hand
  misc_feature (470)..(498): Pfam ID: efhand Pfam Description: EF hand
  misc_feature (398)..(426): Pfam ID: efhand Pfam Description: EF hand
  misc_feature (440)..(468): Pfam ID: efhand Pfam Description: EF hand
MGLCSSCTAARAASDPGAAAAGDAAAAAAKKGRGIVACGKRTDFGYDKDFEARYSLGKLLGHGQFGYTFAAVDRASSERVAVKRIDKNKMVLPVAVEDVKREVKILKALQGHENVVHFYNAFEDDNYVYIVMELCEGGELLDRILAKKDSRYSEKDAAVVVRQMLKVAAECHLHGLVHRDMKPENFLFKSTKEDSPLKATDFGLSDFIKPGRQFRDIVGSAYYVAPEVLKRKSGPESDVWSIGVITYILLCGRRPFWDKTEDGIFKEVLKNKPDFRRKPWPNITSSAKDFVQKLLVKDPRVRLTAAQALSHDWVREGGKASEIPLDISVLHNMRQFVKYSRFKQFALRALASTLNSEELSDLRDQFNAIDVDKNGTISLEELKQALAKDVPWRLKGPRVLEIIEAIDSNTDGLVDFEEFVAATLHMHQLVEHDTEKWKSLSQAAFDKFDVDRDGYITSDELRMHTGMKGSIDPLLEEADIDKDGKISLDEFRRLLKTASMSARNVQTPRGVRVS

SEQ ID NO: 15912 - DNA, 786 bp, Sorghum bicolor
  misc_feature: Ceres ANNOT ID no. 8646250
  misc_feature: Encodes the peptide sequence at SEQ ID NO 15913
atgggccgcgtgatccgcgctcagcgtaagggtgcggggtccgtgttcaagtcgcacacccaccaccgcaagggccctgcccggttccggtccctcgacttcggcgagcgcaacgggtacctcaagggcgtggtcaccgacgtcatccacgacccgggccgcggcgcgccgctggccaaggtcaccttccgccacccgttccgctacaagcaccagaaggagctcttcgtcgctgctgagggcatgtacacgggccagttcgtctactgcggacgccgtgctacgctctctatcggcaacgtcctgccgctcagggggatccccgagggtgccgtcgtctgcaacgttgagcaccacgttggggaccgcggcgtctttgccagggcgtctggggactacgctatcgtcatcagccataacccagacaacggcacatcaaggatcaagctcccgtctggtgctaagaagattgtcccaagtagctgccgtgccatgatcgggcaggtcgctggtggtggcaggactgagaagccaatgctgaaggctggcaatgcctaccacaagtaccgtgtgaagaggaactgctggcctaaggtgcgtggtgtggccatgaaccctgttgagcatcctcatggaggaggtaaccaccagcacattggtcatgcctccactgtccgccgtgatgctcctcctggccagaaggttggtctcattgccgcgaggaggactggtcgtcttaggggccaagctgctgctactgctgccaaggctgacaaggccacttaa

SEQ ID NO: 15913 - protein, 261 aa, Sorghum bicolor
  misc_feature: Useful for making plants with modulated nitrogen use efficiency
  misc_feature: Functional homolog of the protein sequence given in SEQ ID NO 14286
  misc_feature: Ceres ANNOT ID no. 8646250
  misc_feature (96)..(231): Pfam ID: Ribosomal_L2_C Pfam Description: Ribosomal Proteins L2, C-terminal domain
  misc_feature (11)..(90): Pfam ID: Ribosomal_L2 Pfam Description: Ribosomal Proteins L2, RNA binding domain
MGRVIRAQRKGAGSVFKSHTHHRKGPARFRSLDFGERNGYLKGVVTDVIHDPGRGAPLAKVTFRHPFRYKHQKELFVAAEGMYTGQFVYCGRRATLSIGNVLPLRGIPEGAVVCNVEHHVGDRGVFARASGDYAIVISHNPDNGTSRIKLPSGAKKIVPSSCRAMIGQVAGGGRTEKPMLKAGNAYHKYRVKRNCWPKVRGVAMNPVEHPHGGGNHQHIGHASTVRRDAPPGQKVGLIAARRTGRLRGQAAATAAKADKAT

SEQ ID NO: 15914 - DNA, 102 bp, Sorghum bicolor
  misc_feature: Ceres ANNOT ID no. 8646277
  misc_feature: Encodes the peptide sequence at SEQ ID NO 15915
atgcagatctttatgaagaccctcactagcaagaccatcaccctcaaggttgagtcctcggacacaattgacaatatcaaggcaaagatccaggacaattag

SEQ ID NO: 15915 - protein, 33 aa, Sorghum bicolor
  misc_feature: Useful for making plants with modulated cold sensitivity
  misc_feature: Functional homolog of the protein sequence given in SEQ ID NO 13521
  misc_feature: Useful for making plants with modulated nitrogen use efficiency
  misc_feature: Functional homolog of the protein sequence given in SEQ ID NO 13585
  misc_feature: Ceres ANNOT ID no. 8646277
MQIFMKTLTSKTITLKVESSDTIDNIKAKIQDN

SEQ ID NO: 15916 - DNA, 3264 bp, Sorghum bicolor
  misc_feature: Ceres ANNOT ID no. 8646359
  misc_feature: Encodes the peptide sequence at SEQ ID NO 15917
atggaggcgagcgccgggctggtggccggctcccacaaccgcaacgagctcgtcgtcatccgccgcgacggcgatcccgggccgaagccgctgcgggagcagaacgggcaggtgtgccagatttgcggcgacgacgtcggccttgcccccggcggggagcccttcgtggcgtgcaacgagtgcgccttccccgtctgccgggactgctacgagtacgagcgccgggagggcacgcagaactgcccccagtgcaagacccgatacaagcgcctcaagggctgccagcgtgtgaccggtgatgaggaggaggacggcgtcgatgacatcgacaacgagttcaactggaacggccatgactcgcagtctgtggccgagtccatgctctatggtcacatgagctacggccgtggaggcgacgctaatggcgtgccacaacctttccagctcaaccccaatgttccactcctcaccaatgggcagatggtcgatgacatcccaccggagcagcacgcgctggtgccttctttcatgggcggtgggggaaagaggatccatccccttccttatgcggatcccagcttacctgtgcaacccaggtctatggacccatccaaggatcttgctgcatatgggtatggtagtgttgcttggaaggagcggatggagagttggaagcagaggcaggagaggatgcaccagacgaggaacgatggtggtggtgatgacggtgatgatgctgatctaccactaatggatgaagcaagacaaccgctgtccaggaaaattccgattccatcaagccagatcaatccatataggatgattatcattattcggcttgtggttttggggttcttcttccactaccgagtgatgcatccggtgaatgatgcatttgctttgtggctcatatcggttatctgtgaaatctggtttgccatgtcttggattcttgatcaattcccaaagtggttccctattgagagagagacttacctagatcggctgtcactgaggtttgacaaggaaggccagccatctcaacttgctccaattgatttttttgtcagtacagttgatccgttaaaggaacctcctttggtcacagcaaatactgttctgtctatccttgcggtggattatcctgttgataaggtttcttgctatgtttctgatgatggtgccgcaatgctaacgtttgaagcattatctgaaacatctgaatttgcaaagaaatgggttcctttctgcaaaaggtacaatattgaacctcgtgctccagagtggtacttccaacagaagatagactacttgaaagacaaggtggcagcaagttttgttagggagaggagagcaatgaagagagagtatgaggaattcaaggtcagaatcaatgccttggttgctaaagcacagaaagttcctgaagaaggatggacaatgcaagatggaaccccctggcctggaaacaatgttcgtgatcatcctggaatgattcaggtcttccttggccaaagtggaggtcttgactgtgagggaaatgaactgccacgattggtttatgtttcaagagagaaacggccaggctatgaccatcataagaaagctggtgctatgaatgcattggtccgagtctctgctgtactaacaaatgctccatatttgttaaacttggattgtgatcactacatcaacaacagcaaggctataaaggaagcaatgtgttttatgatggaccctttactaggaaagaaggtttgctatgtacagttccctcaaagatttgatgggattgatcgccatgaccgatatgctaacaggaatgttgtctttttcgatatcaatatgaaaggtttggatggtattcagggtccgatttatgtcggtactggatgtgtatttagaaggcaggcattatatggttatgatgcccccaaaacaaagaagccaccatcaaggacttgcaactgctggccgaagtggtgcttttgctgttgctgctttggtaataggaagcacaagaagaagactaccaaaccaaaaacggagaagaaaaaattattatttttcaagaaagaagaaaatcaatcccctgcatatgctcttggtgaaattgatgaagctgctccaggagctgagaatgaaaaagctggtattgtaaatcaacaaaaattagaaaagaaatttggtcagtcttctgtctttgttacatccacactgctcgagaatggtggaaccttgaagagtgcaagtcctgcttctcttttgaaagaagctatacatgtcattagttgcggttatgaagacaagacagactggggaaaagagattggctggatttatggatcagttacagaagatattctaactggtttcaaaatgcattgtcatggttggcggtcaatttactgcatacctaaacgggttgcattcaaaggttctgcacctctgaatctttcagatcgtcttcaccaggtgcttcgttgggctcttgggtctattgaaatcttcttcagcaatcattgccctctttggtatgggtatggcggtggcctgaaatttctggaaagattttcctacatcaactccattgtgtatccttggacatctattccccttttggcttactgtacattgcctgccatttgtttattgacggggaaatttatcactccagagttgaataatgttgccagcctgtggttcatgtcactctttatttgcatttttgctacaagcatcctagaaatgagatggagtggtgttggaattgatgattggtggaggaatgagcagttctgggtcattggaggtgtgtcctcgcacctctttgctgtgttccagggacttctcaaggtcatagctggtgttgatacaagcttcactgtgacatcaaagggtggagatgatgaggagttctcagagctgtatacattcaaatggactaccttattgatacctcctaccactttgctcctattgaacttcattggtgtggttgctggtgtttccaacgcaatcaataacggatatgagtcatggggtcccctctttgggaagctcttctttgcattttgggtgattgtccatctgtatcccttcctcaaaggtttggttggaaggcaaaacaggacaccaacaattgtcatcgtgtggtccattctgctggcttcaatcttctcactcctttgggttcggattgatcctttccttgcaaaggatgatggtccacttcttgaggagtgtggtttggattgcaactag

SEQ ID NO: 15917 - protein, 1087 aa, Sorghum bicolor
  misc_feature: The sequence is a functional homolog of SEQ ID NO 26 in US patent 7312377
  misc_feature: Useful for making plants with altered cell wall content and/or composition
  misc_feature: Functional homolog of the protein sequence given in SEQ ID NO 14084
  misc_feature: Useful for making plants with modulated biomass
  misc_feature: Functional homolog of the protein sequence given in SEQ ID NO 14061
  misc_feature: Useful for making plants with altered carbohydrate content
  misc_feature: Functional homolog of the protein sequence given in SEQ ID NO 13628
  misc_feature: Useful for making plants with modulated plant growth and development
  misc_feature: Functional homolog of the protein sequence given in SEQ ID NO 13629
  misc_feature: Ceres ANNOT ID no. 8646359
  misc_feature: Down-regulated in root tissues in response to methyl jasmonate treatment
  misc_feature: Up-regulated in shoot tissues in response to methyl jasmonate treatment
  misc_feature (23)..(1086): SWISSPROT Homolog: EC 2.4.1.12 Cellulose synthase (UDP-forming)
  misc_feature (257)..(1081): Pfam ID: Cellulose_synt Pfam Description: Cellulose synthase
MEASAGLVAGSHNRNELVVIRRDGDPGPKPLREQNGQVCQICGDDVGLAPGGEPFVACNECAFPVCRDCYEYERREGTQNCPQCKTRYKRLKGCQRVTGDEEEDGVDDIDNEFNWNGHDSQSVAESMLYGHMSYGRGGDANGVPQPFQLNPNVPLLTNGQMVDDIPPEQHALVPSFMGGGGKRIHPLPYADPSLPVQPRSMDPSKDLAAYGYGSVAWKERMESWKQRQERMHQTRNDGGGDDGDDADLPLMDEARQPLSRKIPIPSSQINPYRMIIIIRLVVLGFFFHYRVMHPVNDAFALWLISVICEIWFAMSWILDQFPKWFPIERETYLDRLSLRFDKEGQPSQLAPIDFFVSTVDPLKEPPLVTANTVLSILAVDYPVDKVSCYVSDDGAAMLTFEALSETSEFAKKWVPFCKRYNIEPRAPEWYFQQKIDYLKDKVAASFVRERRAMKREYEEFKVRINALVAKAQKVPEEGWTMQDGTPWPGNNVRDHPGMIQVFLGQSGGLDCEGNELPRLVYVSREKRPGYDHHKKAGAMNALVRVSAVLTNAPYLLNLDCDHYINNSKAIKEAMCFMMDPLLGKKVCYVQFPQRFDGIDRHDRYANRNVVFFDINMKGLDGIQGPIYVGTGCVFRRQALYGYDAPKTKKPPSRTCNCWPKWCFCCCCFGNRKHKKKTTKPKTEKKKLLFFKKEENQSPAYALGEIDEAAPGAENEKAGIVNQQKLEKKFGQSSVFVTSTLLENGGTLKSASPASLLKEAIHVISCGYEDKTDWGKEIGWIYGSVTEDILTGFKMHCHGWRSIYCIPKRVAFKGSAPLNLSDRLHQVLRWALGSIEIFFSNHCPLWYGYGGGLKFLERFSYINSIVYPWTSIPLLAYCTLPAICLLTGKFITPELNNVASLWFMSLFICIFATSILEMRWSGVGIDDWWRNEQFWVIGGVSSHLFAVFQGLLKVIAGVDTSFTVTSKGGDDEEFSELYTFKWTTLLIPPTTLLLLNFIGVVAGVSNAINNGYESWGPLFGKLFFAFWVIVHLYPFLKGLVGRQNRTPTIVIVWSILLASIFSLLWVRIDPFLAKDDGPLLEECGLDCN

SEQ ID NO: 15918 - DNA, 1524 bp, Sorghum bicolor
  misc_feature: Ceres ANNOT ID no. 8646574
  misc_feature: Down-regulated in root tissues in response to methyl jasmonate treatment
  misc_feature: Up-regulated in shoot tissues in response to methyl jasmonate treatment
  misc_feature: Encodes the peptide sequence at SEQ ID NO 15919
atgctggcgtggaaggagaaggtggcggaccgcctcgctcgcctcctcgccgactcccctgtctccccctccccggcacaggccgccgtcgcgccaccgcaggcaaaatctttcccagcagaaccttttattccccccaagacatcatcattatcttcgtatgtattttccctcctaccaacctcaaacttggggcatgagcagaattcaccttgttctgagactttgagaccattacctcctgaatcacttcctaagaaatggagagggagtaatttaacatggaaagatcctcccctggaattgagtgaggagtctgggtctgaaagtgagagagatgaaaggaatgggaatttcggtagcgaccaggtccttcagtcatacaggtccataaataactcaaatggaaatgaggaaacatcgacttcagattgtgcgggcactcttcgttatctgactgaaaagtctatgtttgtgtctccaaaactatttgcattctttcaatcttctctccctgggaccttgaaggggtgccactgggtattgctatatagcacctggaagcatgggatatctctaagaacacttcttcgtagaagtgagaatattcagggtccatgcctattgattgtcggagatatgcaaggggctgtgtttggtggcttattgaacagtcctctgcggccaacagagaaaaggaaatatcagggaacaaaccagacgtttgtgttcacaacgatacatggtgaacctagacttttcagaccaacgggtgcaaacagattctattatttgtgcttgaatgatgctttagcatttggaggtggtggaagcttcgcattgtgtgttgatgaagatctgttacatggaagcagtggatcatgtgagacatttggaaactcatgcttggcacatagtccagagtttgaactaaagaatgtggagcctcgagcgcgactggggactcgcagtcgcgtccatggcggcgcaacggaccaaccaccgcttcagctctgtgaggccgtcgtgcggcgcctcttccctaacggttttgtgcccgagctcgccacggaccttgttgatgagcactacacgtatcgcgcacgtgagcagctctgtagggcgccgctcgtgccgttccgccgtgtgctcaagcttcccaaggtcatctcagcgcgtgtgtgggagtccatcgtgtacatccgcgtcgcctccgtggccatgaagaactacaagtatctcttcctcaagcacgacgttgactgcttcaacgcctatatcaccgatgtcaagtccggcaagaagcggattgccacgggtgcattgctccccatggtcgacgacatgcgtaggctcggcatgctgagcaactacgtcgccgtgtgtgacgtgttcgggagcatgcccaaccaacccatggtccgtcatgccaggcacacaaatacaccacacgccatcacaattcccatctgcaggttcgcttcttcctgcagttcctctcagactccacatcgggagatgtaa

SEQ ID NO: 15919 - protein, 507 aa, Sorghum bicolor
  misc_feature: Useful for making plants with altered protein content
  misc_feature: Functional homolog of the protein sequence given in SEQ ID NO 13487
  misc_feature: Ceres ANNOT ID no. 8646574
  misc_feature (182)..(319): Pfam ID: TLD Pfam Description: TLD
MLAWKEKVADRLARLLADSPVSPSPAQAAVAPPQAKSFPAEPFIPPKTSSLSSYVFSLLPTSNLGHEQNSPCSETLRPLPPESLPKKWRGSNLTWKDPPLELSEESGSESERDERNGNFGSDQVLQSYRSINNSNGNEETSTSDCAGTLRYLTEKSMFVSPKLFAFFQSSLPGTLKGCHWVLLYSTWKHGISLRTLLRRSENIQGPCLLIVGDMQGAVFGGLLNSPLRPTEKRKYQGTNQTFVFTTIHGEPRLFRPTGANRFYYLCLNDALAFGGGGSFALCVDEDLLHGSSGSCETFGNSCLAHSPEFELKNVEPRARLGTRSRVHGGATDQPPLQLCEAVVRRLFPNGFVPELATDLVDEHYTYRAREQLCRAPLVPFRRVLKLPKVISARVWESIVYIRVASVAMKNYKYLFLKHDVDCFNAYITDVKSGKKRIATGALLPMVDDMRRLGMLSNYVAVCDVFGSMPNQPMVRHARHTNTPHAITIPICRFASSCSSSQTPHREM

SEQ ID NO: 15920 - DNA, 1227 bp, Sorghum bicolor
  misc_feature: Ceres ANNOT ID no. 8646673
  misc_feature: Encodes the peptide sequence at SEQ ID NO 15921
atgggctcgccaagcgcgaaacgcttctccctgcgcagcatcggatccgcagtggcgaccatcttcctcgtgctgctgttgatcgtcgccggcggcgtcgccacacttcatcacacggacaacacgccggcacggggcggcatcgtccctgtaaacgatcacctccttccgcgcaaaatacttcgacgactcgaggtcatcgaagaagccagcagcagcagcaacatcgacttcgcaaaccaacaacacaggccgccgccgccgcggctgccaagaggactcgtccatgaaaccaccaacctggagatggaaccgtcactagccggcgaccccgagcacaggcatgcagcagcagcagcggcaacaaagcccaagagcctcctggcggtccccgtagggatcaagaacaaggcggtcgtggacaagctggtgtccaagttcctcgccgccgacgacgacttcaccgtgatgctgttccactacgacggcgcggtggagcagtggggcgacctggagtggtcgggccgggcggtgcacgtggcggcgcgagggcagaccaagtggtggttcgccaagcggttcctgcacccggacgtggtggcggagtacgactacgtcttcgtgtgggacgaggacgtcgaggtcgacgccttcgaccccgtcaggtacctcgacgtcgtgcggagggagggcctcgaggtgtcgcagccggcgctggaccgccgctccgagatccaccacgccatcacggcgcgcgcgctgctgccgacggcggacggcgtgcaccggcgcgtgcggaacgcccgctgcggcggcggcggcggcgacagcggcacgggcccgccgtgcgcggggtgggtggaggtgatggtgcccgtgttctctcgcgcggcgtggcggtgcgcgtgggggatggtgcagaacgacctcatccacggctggggcctcgactacaggctcggatactgcgcgcggggcgaccgcgcgatcaatgttggcgtcgtcgacagcgagtacgtgctccaccgcggcgtccccatgctcagtgacggcggcacggcgacgccgtcggcggggcgcgcggcggtgaggttgcggtcgttcaaggagatgcaggtattcaacaggaggtgggaggtggctgctgcggaggacgattcctggaccgatccttatcctacgtccggcagcagagcctcggacggcgaggtgaagtcgtcaagatga

SEQ ID NO: 15921 - protein, 408 aa, Sorghum bicolor
  misc_feature: Useful for biocontainment applications
  misc_feature: Functional homolog of the protein sequence given in SEQ ID NO 12967
  misc_feature: Ceres ANNOT ID no. 8646673
MGSPSAKRFSLRSIGSAVATIFLVLLLIVAGGVATLHHTDNTPARGGIVPVNDHLLPRKILRRLEVIEEASSSSNIDFANQQHRPPPPRLPRGLVHETTNLEMEPSLAGDPEHRHAAAAAATKPKSLLAVPVGIKNKAVVDKLVSKFLAADDDFTVMLFHYDGAVEQWGDLEWSGRAVHVAARGQTKWWFAKRFLHPDVVAEYDYVFVWDEDVEVDAFDPVRYLDVVRREGLEVSQPALDRRSEIHHAITARALLPTADGVHRRVRNARCGGGGGDSGTGPPCAGWVEVMVPVFSRAAWRCAWGMVQNDLIHGWGLDYRLGYCARGDRAINVGVVDSEYVLHRGVPMLSDGGTATPSAGRAAVRLRSFKEMQVFNRRWEVAAAEDDSWTDPYPTSGSRASDGEVKSSR

SEQ ID NO: 15922 - DNA, 924 bp, Sorghum bicolor
  misc_feature: Ceres ANNOT ID no. 8646714
  misc_feature: Encodes the peptide sequence at SEQ ID NO 15923
atggcggcgaagctgtgcacattactgctggctgcagtggtcgtgctctcacttctagtgagccccattgcttgcagccgcaagctcagcaagaccaagcccaagacaaagcctgcagccagagtcatccacaagccagcggccgcgcctgctgtcaaagccagccacaagccggcaactcctgccaagtcccacaccaaccacaccactctctatggctccggcggctggctgtccggcgccggcgccacgtactacggcgcccctaacggcgacggcggtgaaggcggcgcgtgcggctaccagaccgccgtcgggaagcagccgttcgactcgatgatcgccgcggggagcgcgccgctttacaggggaggcgagggctgcggcgcctgctacgaggtgaaatgcacgagcaacgcggcgtgctccggccagccggtgaccatcgtcatcacggacctgtccccgggcgggctgttcccgggcgaggtcgcgcacttcgacatgagcggcacggccatgggcgccatggcgaagcccgggcgcggcatggccgacaaggtccgcgccggcggcgtcgtgagggtccagtacaggagggtgccgtgcaagtaccccggcgtgaacgtcgccttcaaggtggaccagggcgccaacccgttctacttcaacgtgctcatcgagttcgaggacgacgacggcgacctcagcgccgtcgacctgatggaggccggcagcagcgtgtggacgcccatggcgcacaactggggcgcaacgtggcgcctcaacaacggcaggaggctcagagcgccgttcgggctccggctcacctccgactccggcagggtgctcgtcgccagcaacgccatcccggccgcgtggacgcccggcaagacctaccgttccttggtcaactacccctga

SEQ ID NO: 15923 - protein, 307 aa, Sorghum bicolor
  misc_feature: Useful for making plants with altered carbohydrate content
  misc_feature: Functional homolog of the protein sequence given in SEQ ID NO 13767
  misc_feature: Ceres ANNOT ID no. 8646714
  misc_feature (210)..(291): Pfam ID: Pollen_allerg_1 Pfam Description: Pollen allergen
  misc_feature (114)..(198): Pfam ID: DPBB_1 Pfam Description: Rare lipoprotein A (RlpA)-like double-psi beta-barrel
MAAKLCTLLLAAVVVLSLLVSPIACSRKLSKTKPKTKPAARVIHKPAAAPAVKASHKPATPAKSHTNHTTLYGSGGWLSGAGATYYGAPNGDGGEGGACGYQTAVGKQPFDSMIAAGSAPLYRGGEGCGACYEVKCTSNAACSGQPVTIVITDLSPGGLFPGEVAHFDMSGTAMGAMAKPGRGMADKVRAGGVVRVQYRRVPCKYPGVNVAFKVDQGANPFYFNVLIEFEDDDGDLSAVDLMEAGSSVWTPMAHNWGATWRLNNGRRLRAPFGLRLTSDSGRVLVASNAIPAAWTPGKTYRSLVNYP

SEQ ID NO: 15924 - DNA, 1116 bp, Sorghum bicolor
  misc_feature: Ceres ANNOT ID no. 8646768
  misc_feature: Encodes the peptide sequence at SEQ ID NO 15925
atggcccatgatcctactacggtgcgcatgccatgccatggactcctacaggtccgcgccatcccacggacgagatcacaacgtgcgcgatcaccactacttgctaagtctacacagctagaagggcggaaggcctttgcatggacgcagcatgcatcagggcttacagacggacttcacttgggtaagatcgagtccagcaggtttcctatctatagccggagtggatcgagatcggagcaaattaagcttggattatcaacagtgtccactctggaggccggcggcgcccctgactacgctgaccctccgccggcgccgctggtggacatcgacgagctcgggaaatggtccctataccgcgccgtgatcgccgagttcgtggcgacgctgctgttcctgtacatcaccgtggccacggtgatcgggtacaagcagcagacggaggcgtcggcatcgggcagggacgccgcgtgcggcggcggcgtgggcatccttgtcatcgcgtgggcgttcggcggcatgatcttcatcctcgtctactgcactgccggcatctccggtggccacatcaacccggccgtcactttcggcctcttcttggcgcgcaaggtgtccctggtgcgcgcgatcctgtacatggccgcgcagagcctcggcgccatctgcggcgtcgcgctcgtcaagggattccagagcggattctacgcgcgctacggcggcggcgccaacggggtcagtgccgagtactccaccggcacagggctcgctgccgagatcatcggcaccttcgtgctcgtctacaccgtcttctcggccaccgaccccaagcgcaatgcccgcgactcccacgtcccggtgttggcgccgcttccgattggattcgctgtgttcgtggttcacctggcgactatcccgatcaccggcaccgggatcaatccggcgaggagcctcggcgccgccgtcgtgtacaacaacagcaaggcctggagcgaccagtggatcttttgggtgggtccgttcatcggcgcggcgatcgcagcgctctaccaccagatcgtcctccgcgccagcggcaggggttacggctcccgctccttccggagctacgcctag

SEQ ID NO: 15925 - protein, 371 aa, Sorghum bicolor
  misc_feature: Useful for making plants with modulated drought sensitivity
  misc_feature: Functional homolog of the protein sequence given in SEQ ID NO 14287
  misc_feature: Useful for making plants with modulated cold sensitivity
  misc_feature: Functional homolog of the protein sequence given in SEQ ID NO 14288
  misc_feature: Useful for making plants with modulated water use efficiency
  misc_feature: Functional homolog of the protein sequence given in SEQ ID NO 14289
  misc_feature: Ceres ANNOT ID no. 8646768
  misc_feature (113)..(351): Pfam ID: MIP Pfam Description: Major intrinsic protein
MAHDPTTVRMPCHGLLQVRAIPRTRSQRARSPLLAKSTQLEGRKAFAWTQHASGLTDGLHLGKIESSRFPIYSRSGSRSEQIKLGLSTVSTLEAGGAPDYADPPPAPLVDIDELGKWSLYRAVIAEFVATLLFLYITVATVIGYKQQTEASASGRDAACGGGVGILVIAWAFGGMIFILVYCTAGISGGHINPAVTFGLFLARKVSLVRAILYMAAQSLGAICGVALVKGFQSGFYARYGGGANGVSAEYSTGTGLAAEIIGTFVLVYTVFSATDPKRNARDSHVPVLAPLPIGFAVFVVHLATIPITGTGINPARSLGAAVVYNNSKAWSDQWIFWVGPFIGAAIAALYHQIVLRASGRGYGSRSFRSYA

SEQ ID NO: 15926 - DNA, 861 bp, Sorghum bicolor
  misc_feature: Ceres ANNOT ID no. 8646776
  misc_feature: Encodes the peptide sequence at SEQ ID NO 15927
atgggcaaggaggtggacgtgtccactctggaggccggcggtgtccgtgactatgcggaccctccgccggcgccgctgattgacatcgacgagctcggcaagtggtccctgtaccgcgccgtgatcgccgagttcgtggccacgctgctgtttctgtacattacggtggccacagtgatcgggtacaagcaccagactgacgcgacggcgtcgggcgccgacgcggcgtgcggcggcgtgggcatcctcggcatcgcgtgggcgttcggcggcatgatcttcatcctcgtctactgcaccgccggcatctccggtggccacattaatccggcagtcacgttcggcctcttcctggcgcggaaggtgtccctggtgcgcgcgatcctgtacatggccgcgcagagcctcggtgccatctgcggcgtcgcgcttgtcaaggggttccagagcggattctacgcacgctacggcggcggcgccaacgaggtcagtcccgggtactccaccggcacggggctcgccgccgagatcatcggcaccttcgtgctggtgtacaccgtcttctccgccaccgaccccaagcgcaacgcccgcgattcccacgttccggtgttggcaccgcttccgattggattcgctgtgttcatggtgcacctggcgacgatcccaatcaccggcacggggatcaacccggcgaggagcctcggcgccgccgtcgtgtacaacaacagcaaggcctggagcgaccagtggatcttctgggttggtccgttcatcggcgccgcaatcgcagcgctgtaccaccagatcgtcctccgcgccagcgccagggggtacggctccttccggagcaatgcctag

SEQ ID NO: 15927 - protein, 286 aa, Sorghum bicolor
  misc_feature: Useful for making plants with modulated drought sensitivity
  misc_feature: Functional homolog of the protein sequence given in SEQ ID NO 14287
  misc_feature: Useful for making plants with modulated cold sensitivity
  misc_feature: Functional homolog of the protein sequence given in SEQ ID NO 14288
  misc_feature: Useful for making plants with modulated water use efficiency
  misc_feature: Functional homolog of the protein sequence given in SEQ ID NO 14289
  misc_feature: Ceres ANNOT ID no. 8646776
  misc_feature (31)..(268): Pfam ID: MIP Pfam Description: Major intrinsic protein
MGKEVDVSTLEAGGVRDYADPPPAPLIDIDELGKWSLYRAVIAEFVATLLFLYITVATVIGYKHQTDATASGADAACGGVGILGIAWAFGGMIFILVYCTAGISGGHINPAVTFGLFLARKVSLVRAILYMAAQSLGAICGVALVKGFQSGFYARYGGGANEVSPGYSTGTGLAAEIIGTFVLVYTVFSATDPKRNARDSHVPVLAPLPIGFAVFMVHLATIPITGTGINPARSLGAAVVYNNSKAWSDQWIFWVGPFIGAAIAALYHQIVLRASARGYGSFRSNA

SEQ ID NO: 15928 - DNA, 1506 bp, Sorghum bicolor
  misc_feature: Ceres ANNOT ID no. 8646835
  misc_feature: Encodes the peptide sequence at SEQ ID NO 15929
atggacctcgtgctcctggagaaggccctgctgggcctgttcgcggcggcggtgctcgctgtcgccgtggcgaagctaaccggcaagcgctaccgcctgccccctggccccgcgggcgcccccgtggtgggcaactggctgcaggtcggcgacgacctcaaccaccgcaacctgatgtccctcgccaagcggttcggcgacatcttcctcctccggatgggcgtccgcaacctggtggtggtctccaccccggagctcgccaaggaggtgctccacacgcagggcgtggagttcggctcccgcacccgcaacgtcgtcttcgacatcttcacggggaaaggccaggacatggtgttcaccgtgtacggcgaccactggcggaagatgcggcggatcatgacggtgcccttcttcaccaacaaggtggtggcgcagaaccgcgtcgggtgggaggaggaggcccgcctcgtggtggaggacgtgaggaaggacccgcgcgccgccgccgagggcgtcgtgatccggaggcggctgcagctcatgatgtacaacgacatgttccgcatcatgttcgacacaaggtttgagagcgagcaggatccgctcttcaacaagctcaaggcgctcaacgccgagaggagccgactgtcgcagagcttcgagtacaactacggtgacttcatccccgtcctccgcccgttcctccgtggctacctcaaccgctgccatgacctcaagacgcgccgcatgaaggtgtttgaggacaacttcgtccaggaacgcaagaaggtgatggctcagactggtgagatccggtgcgccatggaccacatcctcgaggccgagaggaaaggcgagatcaaccatgacaacgtcctctacatcgttgagaacatcaacgtcgcagcgatcgagacgacactgtggtcgatcgagtggggcatcgcggagctggtgaaccacccggccatccagtccaagctccgggaggagatggactcggtgctgggcgccggcgtgcctgtgacggagccggacctcgagcgcctcccctacctccaggccatcgtcaaggagacgctccgcctgcgcatggccatcccgctgctggtgccccacatgaacctcaacgacggcaagctcgccggctacgacatccccgccgagtccaagatcctcgtcaacgcctggttcctcgccaacgaccccaagaggtgggtgcggcccgacgagttccggcccgagcgcttcctggaggaggagaagaccgtggaggcacacggcaacgacttccgcttcgtgcccttcggcgtcggccgccggagctgccccgggatcatcctcgcgctgcctatcatcggcatcaccctgggcaggctggtgcagaacttccagctgctgccgccgccggggcaggacaagatcgacaccacggagaagcccggccagttcagcaaccagatcgctaagcatgccacaatcgtctgcaagcccctcgaggcctag

SEQ ID NO: 15929 - protein, 501 aa, Sorghum bicolor
  misc_feature: Useful for making plants with altered carbohydrate content
  misc_feature: Functional homolog of the protein sequence given in SEQ ID NO 14290
  misc_feature: Useful for biocontainment applications
  misc_feature: Useful for making plants with altered cell wall content and/or composition
  misc_feature: Useful for making plants with modulated biomass
  misc_feature: Useful for making plants with modulated flowering time
  misc_feature: Functional homolog of the protein sequence given in SEQ ID NO 14291
  misc_feature: The sequence is a functional homolog of SEQ ID NO 8 in US patent 7148406
  misc_feature: Useful for making plants with altered lignin content
  misc_feature: Functional homolog of the protein sequence given in SEQ ID NO 14292
  misc_feature: Ceres ANNOT ID no. 8646835
  misc_feature (1)..(498): SWISSPROT Homolog: EC 1.14.13.11 Trans-cinnamate 4-monooxygenase
  misc_feature (34)..(495): Pfam ID: p450 Pfam Description: Cytochrome P450
MDLVLLEKALLGLFAAAVLAVAVAKLTGKRYRLPPGPAGAPVVGNWLQVGDDLNHRNLMSLAKRFGDIFLLRMGVRNLVVVSTPELAKEVLHTQGVEFGSRTRNVVFDIFTGKGQDMVFTVYGDHWRKMRRIMTVPFFTNKVVAQNRVGWEEEARLVVEDVRKDPRAAAEGVVIRRRLQLMMYNDMFRIMFDTRFESEQDPLFNKLKALNAERSRLSQSFEYNYGDFIPVLRPFLRGYLNRCHDLKTRRMKVFEDNFVQERKKVMAQTGEIRCAMDHILEAERKGEINHDNVLYIVENINVAAIETTLWSIEWGIAELVNHPAIQSKLREEMDSVLGAGVPVTEPDLERLPYLQAIVKETLRLRMAIPLLVPHMNLNDGKLAGYDIPAESKILVNAWFLANDPKRWVRPDEFRPERFLEEEKTVEAHGNDFRFVPFGVGRRSCPGIILALPIIGITLGRLVQNFQLLPPPGQDKIDTTEKPGQFSNQIAKHATIVCKPLEA

SEQ ID NO: 15930 - DNA, 1506 bp, Sorghum bicolor; identical to SEQ ID NO: 15928
  misc_feature: Ceres ANNOT ID no. 8646834
  misc_feature: Encodes the peptide sequence at SEQ ID NO 15931

SEQ ID NO: 15931 - protein, 501 aa, Sorghum bicolor; identical to SEQ ID NO: 15929
  misc_feature: Useful for making plants with altered carbohydrate content
  misc_feature: Functional homolog of the protein sequence given in SEQ ID NO 14290
  misc_feature: Useful for biocontainment applications
  misc_feature: Useful for making plants with altered cell wall content and/or composition
  misc_feature: Useful for making plants with modulated biomass
  misc_feature: Useful for making plants with modulated flowering time
  misc_feature: Functional homolog of the protein sequence given in SEQ ID NO 14291
  misc_feature: The sequence is a functional homolog of SEQ ID NO 8 in US patent 7148406
  misc_feature: Useful for making plants with altered lignin content
  misc_feature: Functional homolog of the protein sequence given in SEQ ID NO 14292
  misc_feature: Ceres ANNOT ID no. 8646834
  misc_feature (1)..(498): SWISSPROT Homolog: EC 1.14.13.11 Trans-cinnamate 4-monooxygenase
  misc_feature (34)..(495): Pfam ID: p450 Pfam Description: Cytochrome P450

SEQ ID NO: 15932 - DNA, 591 bp, Sorghum bicolor
  misc_feature: Ceres ANNOT ID no. 8647264
  misc_feature: Encodes the peptide sequence at SEQ ID NO 15933
atgggcgccgggagcacttgggagggcgaccgaggcgcaaacccggatggagggggctgggacgtcggcgtgcctgggccgggcaccggaaagcttggtggaggggacatggatgagggcgtgcccatgccagccattggagtgaccggtggcagcggctggaagggggcacgtggaggtgtaggtgttggcaaggaggcagatgttgcagtcaaaatacttatggagcaggattttcacccagagcgtttcagggaatttatgagagaggttgcaatcatgaaaagtctgagacatccaaatattgtcctattcatgggtgctgttactgaaccaccaaacctgtctatagttacagaatacttgtctaggggcagtttgtataaacttttgcacaggagtggtgcaaaggaagttctagatgaaagacgccgattaaacatggcatttgacgtggccaaaggaatgaattacctgcatcgacgcagccctcctattgttcatcgtgatctgaagtctccaaatcttctagttgacaagaagtatactgtcaaagtatggttaatgaacctcatatcttattgcatttaa

SEQ ID NO: 15933 - protein, 196 aa, Sorghum bicolor
  misc_feature: The sequence is a functional homolog of SEQ ID NO 48 in US patent 7317140
  misc_feature: Ceres ANNOT ID no. 8647264
  misc_feature (67)..(186): SWISSPROT Homolog: EC 2.7.11.1 Non-specific serine/threonine protein kinase
  misc_feature (55)..(196): Pfam ID: Pkinase_Tyr Pfam Description: Protein tyrosine kinase
MGAGSTWEGDRGANPDGGGWDVGVPGPGTGKLGGGDMDEGVPMPAIGVTGGSGWKGARGGVGVGKEADVAVKILMEQDFHPERFREFMREVAIMKSLRHPNIVLFMGAVTEPPNLSIVTEYLSRGSLYKLLHRSGAKEVLDERRRLNMAFDVAKGMNYLHRRSPPIVHRDLKSPNLLVDKKYTVKVWLMNLISYCI

SEQ ID NO: 15934 - DNA, 189 bp, Sorghum bicolor
  misc_feature: Ceres ANNOT ID no. 8647503
  misc_feature: Encodes the peptide sequence at SEQ ID NO 15935
atgccggagggcttctgttgctgcccatcccgcacacaacgaggccatcctatccgtggactcgtaccagagcatgtacacatagctgctctactctgtggcctcgtccaccgcaccaacgtgatgcgcgtcggcgctgtgttcgcttcaaacttcctccgcaccatctgtttcctcgacaagcagtag

SEQ ID NO: 15935 - protein, 62 aa, Sorghum bicolor
  misc_feature: Useful for making plants with modulated biomass
  misc_feature: Useful for making plants with modulated light quality response
  misc_feature: Useful for making plants with modulated low light sensitivity
  misc_feature: Functional homolog of the protein sequence given in SEQ ID NO 14293
  misc_feature: Ceres ANNOT ID no. 8647503
MPEGFCCCPSRTQRGHPIRGLVPEHVHIAALLCGLVHRTNVMRVGAVFASNFLRTICFLDKQ

SEQ ID NO: 15936 - DNA, 900 bp, Sorghum bicolor
  misc_feature: Ceres ANNOT ID no. 8647573
  misc_feature: Encodes the peptide sequence at SEQ ID NO 15937
atggctcccaagcggcgcggaaacaaggtggtgggctccgtggtgaagaccaaagtggtgcaggagaccgtggaggtcattgtcgccgacgacgatgatacggcggaggcggagcagcagatggtcccggaggcccttgccgtggcgccttccgccgtggacgtctccggctccacggtggtgcacgtcgtcgaggtcactaccccggacggcggcgacaatgccaccggctccaatgtgaagcagcccgccgtcgccaagagaggccgtggcaggcgcgaggaggagaaggagaagcagccggctccgccggaggattctgtactcgtgccgcagagccaggagacgcaggaccccaacgaggaggaggaggatcaggaggacgccagcaagaagaagaagcagaagcagaagcagcgccagcaagacgaggacgacgaggcgcagccggagactccgcgggtggcgtcggagaggaagaaagcaacaccaaagaaggcgaaggcgaaggcgcagccgcagcagcaggcgggtggcggtggcgacgccggcaagaagcggccgaaggcgcggcgccggctggggcaggccagcgccggaggcgacgccggcatgggcggcgtcggagggtacaagcggtacgtctggcgcgtgctgaagcaggtgcacccggacctcggggtgtcggggcacgccatgcaggtgctggacatgatgatggccgacatgttcgagcgcctggcggacgaggcggcgcgcctgtccaaggccacggggaggatgacgctcacctcccgcgaggtgcagagcgccgtcaggcttgtgctccccggggacctgggcaagcacgccatcgctgagggcaccaaagccatctccaagtacatgtcctacgcctag

SEQ ID NO: 15937 - protein, 299 aa, Sorghum bicolor
  misc_feature: Useful for biocontainment applications
  misc_feature: Useful for making plants with modulated flowering time
  misc_feature: Functional homolog of the protein sequence given in SEQ ID NO 13102
  misc_feature: Ceres ANNOT ID no. 8647573
  misc_feature (205)..(275): Pfam ID: Histone Pfam Description: Core histone H2A/H2B/H3/H4
MAPKRRGNKVVGSVVKTKVVQETVEVIVADDDDTAEAEQQMVPEALAVAPSAVDVSGSTVVHVVEVTTPDGGDNATGSNVKQPAVAKRGRGRREEEKEKQPAPPEDSVLVPQSQETQDPNEEEEDQEDASKKKKQKQKQRQQDEDDEAQPETPRVASERKKATPKKAKAKAQPQQQAGGGGDAGKKRPKARRRLGQASAGGDAGMGGVGGYKRYVWRVLKQVHPDLGVSGHAMQVLDMMMADMFERLADEAARLSKATGRMTLTSREVQSAVRLVLPGDLGKHAIAEGTKAISKYMSYA

SEQ ID NO: 15938 - DNA, 1287 bp, Sorghum bicolor
  misc_feature: Ceres ANNOT ID no. 8647624
  misc_feature: Encodes the peptide sequence at SEQ ID NO 15939
atgaggaggcttttacgtcgtacaacaagaagcacaggcagagctggtgctaaggcgccgttgatgttatggtgggcagcaccggccatctgctctgcgcttctcgccgtcctgctcgcctccagatcatcgttctacctccggcagcctgcttctcctccctacacctcccccggggcggaagcggaagcagaagcggaagcggaagagggccggcaccaccaccaccggcgccgggcgtgcgacgaccaggccaggtgggtggccaagatggcgtccctgcacaacgccaccctggtcctcaccgtcgaccacaagggctgcggcaactacaccagactgcagaaggccgtggacgccgtgcccgactacgccgcggcgcgcacgctgatcgccgtcgacgcgggggtgtacgcggagaaggtggtggtgtggagcaacaagacgggcgtcacgctgcagggccgcggcaacctcaacaccaccatcgtctggaacgacaccgccaactccagcggcggcaccttctacagcgccaccgtcgccgtcctcgccgccaacttcgtggcctacaacgtcagcgtccagaacacggctgcccccgcggacccggggggctcgggcggccaggcggtggcgctgcgcgtcgccggcgaccaggccgccttctactggtgcggcttctacagctcgcaggacacactgctggacgagcagggccgccacttgttccgcggctgctacgtcgagggctccatcgacttcatcttcggcaacgcgcgctccctctacctcggctgcaccatcagctccgtcgccaacgccgccgcgggcggcaccgtcacggggagcgtcacggcgcacggccgcgcgtcgccggccgagaagacgggcttcgcgttcgtgggctgcaccgtcgtgggcacggggcaggtgtggctgggcagggcgtggggcccctacgccaccgtcgtcttcgccaggacgtacctctccgctgtcgtcgcgcccggggcatggaacgactggaacgaccccgccaggcagcagtcggtgttcttcggggagtacgactgcacgggccccggcgccagcggtggcaccgtgcagagggtggcctacgcgaggcagctggaccagcgccaggccgcgccattcatggacgtctcctacatcgacggcaaccagtgggcggtgccccctctgcttccgcccatgcagggcgccgccggcgaggacatcatcgtatctgctgaattcagtcatggccaggccggcatcatgtaa

SEQ ID NO: 15939 - protein, 428 aa, Sorghum bicolor
  misc_feature: Useful for making plants with altered cell wall content and/or composition
  misc_feature: Functional homolog of the protein sequence given in SEQ ID NO 14294
  misc_feature: Ceres ANNOT ID no. 8647624
  misc_feature (82)..(397): SWISSPROT Homolog: EC 3.1.1.11 Pectinesterase
  misc_feature (100)..(395): Pfam ID: Pectinesterase Pfam Description: Pectinesterase
MRRLLRRTTRSTGRAGAKAPLMLWWAAPAICSALLAVLLASRSSFYLRQPASPPYTSPGAEAEAEAEAEEGRHHHHRRRACDDQARWVAKMASLHNATLVLTVDHKGCGNYTRLQKAVDAVPDYAAARTLIAVDAGVYAEKVVVWSNKTGVTLQGRGNLNTTIVWNDTANSSGGTFYSATVAVLAANFVAYNVSVQNTAAPADPGGSGGQAVALRVAGDQAAFYWCGFYSSQDTLLDEQGRHLFRGCYVEGSIDFIFGNARSLYLGCTISSVANAAAGGTVTGSVTAHGRASPAEKTGFAFVGCTVVGTGQVWLGRAWGPYATVVFARTYLSAVVAPGAWNDWNDPARQQSVFFGEYDCTGPGASGGTVQRVAYARQLDQRQAAPFMDVSYIDGNQWAVPPLLPPMQGAAGEDIIVSAEFSHGQAGIM

SEQ ID NO: 15940 - DNA, 741 bp, Sorghum bicolor
  misc_feature: Ceres ANNOT ID no. 8647706
  misc_feature: Encodes the peptide sequence at SEQ ID NO 15941
atggccacggacgcggcgttggacaccggcggggacgacatgcagcacctgctcaacgcgctgatgctcgacatggccgccgagtccgactccttctcagacgacatggaggccgcctcctccgagtcctcctcctccgcctgctcggccaacagccacgaggccagccggcggccgccgccgccgcagcagcagcagcagccggacgacggcgaccgcaccaccagcgatgacaacaacaaatgttccaagaagcagcagcagcagcctttcatcggcgtgcgcaagcgtccgtggggcaagttcgcggccgagatccgcgactcgacgcgcaagggcgcccgcgtgtggctgggcaccttcgacagccccgaggccgcggcgatggcctacgaccaggcagccttctccgtgcgcggcgccgccgccgtgctcaacttccccgtggagcgcgtgcaggagtcgctgcgcgcgctcgcgctctcctccgccgccgcctctgccccgggcggctcccctgtcctggcgctcaagcgccgccactccatacgcaagcgctccccgaacaagaacaagaggcagcaggagcagcagcagcagcaccaacaggtggccgtggccgccgcaccacagcagcagccgccgccgtgccccggcggcaacgttgtggagctggaggacctcggcgccgattaccttgacgagctcctccgggtgtcgtccgagttcgattggcaataa

SEQ ID NO: 15941 - protein, 246 aa, Sorghum bicolor
  misc_feature: Useful for making plants with modulated flowering time
  misc_feature: Functional homolog of the protein sequence given in SEQ ID NO 14280
  misc_feature: The sequence is a functional homolog of SEQ ID NO 1464 in the 10/666,642 US patent application
  misc_feature: The sequence is a functional homolog of SEQ ID NO 170 in the 10/225,066 US patent application
  misc_feature: The sequence is a functional homolog of SEQ ID NO 2 in the 10/903,236 US patent application
  misc_feature: The sequence is a functional homolog of SEQ ID NO 278 in the 10/666,642 US patent application
  misc_feature: The sequence is a functional homolog of SEQ ID NO 332 in the 10/374,780 US patent application
  misc_feature: The sequence is a functional homolog of SEQ ID NO 46 in the 10/225,068 US patent application
  misc_feature: The sequence is a functional homolog of SEQ ID NO 8 in the 10/714,887 US patent application
  misc_feature: The sequence is a functional homolog of SEQ ID NO 8 in the 11/435,388 US patent application
  misc_feature: Useful for biocontainment applications
  misc_feature: Functional homolog of the protein sequence given in SEQ ID NO 13707
  misc_feature: The sequence is a functional homolog of SEQ ID NO 164 in the 10/714,887 US patent application
  misc_feature: The sequence is a functional homolog of SEQ ID NO 164 in the 11/435,388 US patent application
  misc_feature: The sequence is a functional homolog of SEQ ID NO 32 in the 10/903,236 US patent application
  misc_feature: The sequence is a functional homolog of SEQ ID NO 14 in the 10/903,236 US patent application
  misc_feature: The sequence is a functional homolog of SEQ ID NO 1737 in the 10/374,780 US patent application
  misc_feature: The sequence is a functional homolog of SEQ ID NO 2129 in the 10/666,642 US patent application
  misc_feature: The sequence is a functional homolog of SEQ ID NO 74 in the 10/714,887 US patent application
  misc_feature: The sequence is a functional homolog of SEQ ID NO 74 in the 11/435,388 US patent application
  misc_feature: The sequence is a functional homolog of SEQ ID NO 160 in the 10/714,887 US patent application
  misc_feature: The sequence is a functional homolog of SEQ ID NO 160 in the 11/435,388 US patent application
  misc_feature: The sequence is a functional homolog of SEQ ID NO 28 in the 10/903,236 US patent application
  misc_feature: Useful for making plants with altered lutein content
  misc_feature: Useful for making plants with modulated biomass
  misc_feature: Functional homolog of the protein sequence given in SEQ ID NO 13470
  misc_feature: Useful for making plants with altered lignin content
  misc_feature: Functional homolog of the protein sequence given in SEQ ID NO 13219
  misc_feature: Ceres ANNOT ID no. 8647706
  misc_feature (89)..(141): Pfam ID: AP2 Pfam Description: AP2 domain
MATDAALDTGGDDMQHLLNALMLDMAAESDSFSDDMEAASSESSSSACSANSHEASRRPPPPQQQQQPDDGDRTTSDDNNKCSKKQQQQPFIGVRKRPWGKFAAEIRDSTRKGARVWLGTFDSPEAAAMAYDQAAFSVRGAAAVLNFPVERVQESLRALALSSAAASAPGGSPVLALKRRHSIRKRSPNKNKRQQEQQQQHQQVAVAAAPQQQPPPCPGGNVVELEDLGADYLDELLRVSSEFDWQ

SEQ ID NO: 15942 - DNA, 390 bp, Sorghum bicolor
  misc_feature: Ceres ANNOT ID no. 8647700
  misc_feature: Encodes the peptide sequence at SEQ ID NO 15943
atggacgacggcggaggcgagccgaccaagtaccgcggcgtgcggcggcggccgtggggcaagtacgcggcggagatccgcgactcgagccgccacggagtgcgcatctggctgggcaccttcgacaccgccgaggaggccgccagagcgtacgaccgatccgcctactccatgcgcggcgccaacgccgtgctcaacttcccggaggacgcggccgtctatgccgcggccttccgcggcggctccggtggatcctcctcgtcgtccagacagcagcagcacggcggcagggacgtgatcgagttcgagtacctcgacgacgaggtgctgcaggagatgctcaagagccacgagccgtcgtcgtcgtccgcgcggaataagaagaagtag

SEQ ID NO: 15943 - protein, 129 aa, Sorghum bicolor
  misc_feature: The sequence is a functional homolog of SEQ ID NO 20 in the 10/903,236 US patent application
  misc_feature: The sequence is a functional homolog of SEQ ID NO 2213 in the 10/666,642 US patent application
  misc_feature: The sequence is a functional homolog of SEQ ID NO 80 in the 10/714,887 US patent application
  misc_feature: The sequence is a functional homolog of SEQ ID NO 80 in the 11/435,388 US patent application
  misc_feature: The sequence is a functional homolog of SEQ ID NO 166 in the 10/714,887 US patent application
  misc_feature: The sequence is a functional homolog of SEQ ID NO 166 in the 11/435,388 US patent application
  misc_feature: The sequence is a functional homolog of SEQ ID NO 34 in the 10/903,236 US patent application
  misc_feature: The sequence is a functional homolog of SEQ ID NO 162 in the 10/714,887 US patent application
  misc_feature: The sequence is a functional homolog of SEQ ID NO 162 in the 11/435,388 US patent application
  misc_feature: The sequence is a functional homolog of SEQ ID NO 30 in the 10/903,236 US patent application
  misc_feature: Useful for biocontainment applications
  misc_feature: Functional homolog of the protein sequence given in SEQ ID NO 13707
  misc_feature: The sequence is a functional homolog of SEQ ID NO 10 in the 10/903,236 US patent application
  misc_feature: The sequence is a functional homolog of SEQ ID NO 1735 in the 10/374,780 US patent application
  misc_feature: The sequence is a functional homolog of SEQ ID NO 2125 in the 10/666,642 US patent application
  misc_feature: The sequence is a functional homolog of SEQ ID NO 690 in the 10/666,642 US patent application
  misc_feature: The sequence is a functional homolog of SEQ ID NO 70 in the 10/714,887 US patent application
  misc_feature: The sequence is a functional homolog of SEQ ID NO 70 in the 11/435,388 US patent application
  misc_feature: The sequence is a functional homolog of SEQ ID NO 1466 in the 10/666,642 US patent application
  misc_feature: The sequence is a functional homolog of SEQ ID NO 2136 in the 10/374,780 US patent application
  misc_feature: The sequence is a functional homolog of SEQ ID NO 36 in the 10/714,887 US patent application
  misc_feature: The sequence is a functional homolog of SEQ ID NO 36 in the 11/435,388 US patent application
  misc_feature: The sequence is a functional homolog of SEQ ID NO 368 in the 10/225,066 US patent application
  misc_feature: The sequence is a functional homolog of SEQ ID NO 6 in the 10/903,236 US patent application
  misc_feature: The sequence is a functional homolog of SEQ ID NO 200 in the 10/714,887 US patent application
  misc_feature: The sequence is a functional homolog of SEQ ID NO 200 in the 11/435,388 US patent application
  misc_feature: The sequence is a functional homolog of SEQ ID NO 36 in the 10/903,236 US patent application
  misc_feature: The sequence is a functional homolog of SEQ ID NO 1354 in the 10/666,642 US patent application
  misc_feature: The sequence is a functional homolog of SEQ ID NO 171 in the 11/479,226 US patent application
  misc_feature: The sequence is a functional homolog of SEQ ID NO 18 in the 10/714,887 US patent application
  misc_feature: The sequence is a functional homolog of SEQ ID NO 18 in the 11/435,388 US patent application
  misc_feature: The sequence is a functional homolog of SEQ ID NO 1954 in the 10/374,780 US patent application
  misc_feature: The sequence is a functional homolog of SEQ ID NO 8 in the 10/666,642 US patent application
  misc_feature: The sequence is a functional homolog of SEQ ID NO 8 in the 10/903,236 US patent application
  misc_feature: The sequence is a functional homolog of SEQ ID NO 14 in the 10/903,236 US patent application
  misc_feature: The sequence is a functional homolog of SEQ ID NO 1737 in the 10/374,780 US patent application
  misc_feature: The sequence is a functional homolog of SEQ ID NO 2129 in the 10/666,642 US patent application
  misc_feature: The sequence is a functional homolog of SEQ ID NO 74 in the 10/714,887 US patent application
  misc_feature: The sequence is a functional homolog of SEQ ID NO 74 in the 11/435,388 US patent application
  misc_feature: The sequence is a functional homolog of SEQ ID NO 1462 in the 10/666,642 US patent application
  misc_feature: The sequence is a functional homolog of SEQ ID NO 2134 in the 10/374,780 US patent application
  misc_feature: The sequence is a functional homolog of SEQ ID NO 34 in the 10/714,887 US patent application
  misc_feature: The sequence is a functional homolog of SEQ ID NO 34 in the 11/435,388 US patent application
  misc_feature: The sequence is a functional homolog of SEQ ID NO 364 in the 10/225,066 US patent application
  misc_feature: The sequence is a functional homolog of SEQ ID NO 4 in the 10/903,236 US patent application
  misc_feature: The sequence is a functional homolog of SEQ ID NO 1464 in the 10/666,642 US patent application
  misc_feature: The sequence is a functional homolog of SEQ ID NO 170 in the 10/225,066 US patent application
  misc_feature: The sequence is a functional homolog of SEQ ID NO 2 in the 10/903,236 US patent application
  misc_feature: The sequence is a functional homolog of SEQ ID NO 278 in the 10/666,642 US patent application
  misc_feature: The sequence is a functional homolog of SEQ ID NO 332 in the 10/374,780 US patent application
  misc_feature: The sequence is a functional homolog of SEQ ID NO 46 in the 10/225,068 US patent application
  misc_feature: The sequence is a functional homolog of SEQ ID NO 8 in the 10/714,887 US patent application
  misc_feature: The sequence is a functional homolog of SEQ ID NO 8 in the 11/435,388 US patent application
  misc_feature: The sequence is a functional homolog of SEQ ID NO 164 in the 10/714,887 US patent application
  misc_feature: The sequence is a functional homolog of SEQ ID NO 164 in the 11/435,388 US patent application
  misc_feature: The sequence is a functional homolog of SEQ ID NO 32 in the 10/903,236 US patent application
  misc_feature: Useful for making plants with altered lutein content
  misc_feature: Useful for making plants with modulated biomass
  misc_feature: Useful for making plants with modulated flowering time
  misc_feature: Functional homolog of the protein sequence given in SEQ ID NO 13470
  misc_feature: The sequence is a functional homolog of SEQ ID NO 160 in the 10/714,887 US patent application
  misc_feature: The sequence is a functional homolog of SEQ ID NO 160 in the 11/435,388 US patent application
  misc_feature: The sequence is a functional homolog of SEQ ID NO 28 in the 10/903,236 US patent application
  misc_feature: The sequence is a functional homolog of SEQ ID NO 22 in the 10/903,236 US patent application
  misc_feature: The sequence is a functional homolog of SEQ ID NO 2215 in the 10/666,642 US patent application
  misc_feature: The sequence is a functional homolog of SEQ ID NO 82 in the 10/714,887 US patent application
  misc_feature: The sequence is a functional homolog of SEQ ID NO 82 in the 11/435,388 US patent application
  misc_feature: The sequence is a functional homolog of SEQ ID NO 2217 in the 10/666,642 US patent application
  misc_feature: The sequence is a functional homolog of SEQ ID NO 24 in the 10/903,236 US patent application
  misc_feature: The sequence is a functional homolog of SEQ ID NO 84 in the 10/714,887 US patent application
  misc_feature: The sequence is a functional homolog of SEQ ID NO 84 in the 11/435,388 US patent application
  misc_feature: Useful for making plants with altered cell wall content and/or composition
  misc_feature: Useful for making plants with altered lignin content
  misc_feature: Useful for making plants with altered terpenoid content
  misc_feature: Useful for making plants with altered tocopherol content
  misc_feature: Functional homolog of the protein sequence given in SEQ ID NO 14295
  misc_feature: Useful for making plants with altered alkaloid content
  misc_feature: Functional homolog of the protein sequence given in SEQ ID NO 14296
  misc_feature: The sequence is a functional homolog of SEQ ID NO 1000 in the 10/412,699 US patent application
  misc_feature: The sequence is a functional homolog of SEQ ID NO 501 in the 10/374,780 US patent application
  misc_feature: The sequence is a functional homolog of SEQ ID NO 1356 in the 10/666,642 US patent application
  misc_feature: The sequence is a functional homolog of SEQ ID NO 1726 in the 10/412,699 US patent application
  misc_feature: The sequence is a functional homolog of SEQ ID NO 191 in the 11/479,226 US patent application
  misc_feature: The sequence is a functional homolog of SEQ ID NO 2230 in the 10/374,780 US patent application
  misc_feature: The sequence is a functional homolog of SEQ ID NO 50 in the 10/412,699 US patent application
  misc_feature: The sequence is a functional homolog of SEQ ID NO 788 in the 10/225,066 US patent application
  misc_feature: The sequence is a functional homolog of SEQ ID NO 1756 in the 10/374,780 US patent application
  misc_feature: The sequence is a functional homolog of SEQ ID NO 10 in the 10/666,642 US patent application
  misc_feature: The sequence is a functional homolog of SEQ ID NO 54 in the 10/412,699 US patent application
  misc_feature: The sequence is a functional homolog of SEQ ID NO 1755 in the 10/374,780 US patent application
  misc_feature: The sequence is a functional homolog of SEQ ID NO 1769 in the 10/374,780 US patent application
  misc_feature: The sequence is a functional homolog of SEQ ID NO 40 in the 10/903,236 US patent application
  misc_feature: The sequence is a functional homolog of SEQ ID NO 151 in the 11/479,226 US patent application
  misc_feature: The sequence is a functional homolog of SEQ ID NO 32 in the 10/412,699 US patent application
  misc_feature: The sequence is a functional homolog of SEQ ID NO 2224 in the 10/374,780 US patent application
  misc_feature: The sequence is a functional homolog of SEQ ID NO 502 in the 10/225,066 US patent application
  misc_feature: The sequence is a functional homolog of SEQ ID NO 1884 in the 10/374,780 US patent application
  misc_feature: The sequence is a functional homolog of SEQ ID NO 1195 in the 10/666,642 US patent application
  misc_feature: The sequence is a functional homolog of SEQ ID NO 1419 in the 11/479,226 US patent application
  misc_feature: The sequence is a functional homolog of SEQ ID NO 668 in the 10/412,699 US patent application
  misc_feature: The sequence is a functional homolog of SEQ ID NO 1781 in the 11/479,226 US patent application
  misc_feature: The sequence is a functional homolog of SEQ ID NO 270 in the 10/374,780 US patent application
  misc_feature: The sequence is a functional homolog of SEQ ID NO 4 in the 10/225,066 US patent application
  misc_feature: The sequence is a functional homolog of SEQ ID NO 24 in the 10/225,066 US patent application
  misc_feature: The sequence is a functional homolog of SEQ ID NO 36 in the 11/375,241 US patent application
  misc_feature: The sequence is a functional homolog of SEQ ID NO 440 in the 10/374,780 US patent application
  misc_feature: The sequence is a functional homolog of SEQ ID NO 1028 in the 10/225,066 US patent application
  misc_feature: The sequence is a functional homolog of SEQ ID NO 2222 in the 10/374,780 US patent application
  misc_feature: The sequence is a functional homolog of SEQ ID NO 40 in the 10/412,699 US patent application
  misc_feature: The sequence is a functional homolog of SEQ ID NO 1435 in the 11/479,226 US patent application
  misc_feature: The sequence is a functional homolog of SEQ ID NO 2504 in the 10/374,780 US patent application
  misc_feature: The sequence is a functional homolog of SEQ ID NO 618 in the 10/225,066 US patent application
  misc_feature: The sequence is a functional homolog of SEQ ID NO 674 in the 10/412,699 US patent application
  misc_feature: The sequence is a functional homolog of SEQ ID NO 2820 in the 10/374,780 US patent application
  misc_feature: The sequence is a functional homolog of SEQ ID NO 442 in the 10/225,066 US patent application
  misc_feature: The sequence is a functional homolog of SEQ ID NO 106 in the 10/225,066 US patent application
  misc_feature: The sequence is a functional homolog of SEQ ID NO 2340 in the 10/374,780 US patent application
  misc_feature: The sequence is a functional homolog of SEQ ID NO 620 in the 11/479,226 US patent application
  misc_feature: The sequence is a functional homolog of SEQ ID NO 718 in the 10/225,066 US patent application
  misc_feature: The sequence is a functional homolog of SEQ ID NO 1194 in the 10/666,642 US patent application
  misc_feature: The sequence is a functional homolog of SEQ ID NO 489 in the 10/374,780 US patent application
  misc_feature: The sequence is a functional homolog of SEQ ID NO 682 in the 10/666,642 US patent application
  misc_feature: The sequence is a functional homolog of SEQ ID NO 989 in the 10/412,699 US patent application
  misc_feature: The sequence is a functional homolog of SEQ ID NO 2848 in the 10/374,780 US patent application
  misc_feature: The sequence is a functional homolog of SEQ ID NO 456 in the 10/225,066 US patent application
  misc_feature: The sequence is a functional homolog of SEQ ID NO 183 in the 11/479,226 US patent application
  misc_feature: The sequence is a functional homolog of SEQ ID NO 2226 in the 10/374,780 US patent application
  misc_feature: The sequence is a functional homolog of SEQ ID NO 4 in US patent 7259297
  misc_feature: The sequence is a functional homolog of SEQ ID NO 42 in the 10/412,699 US patent application
  misc_feature: The sequence is a functional homolog of SEQ ID NO 786 in the 10/225,066 US patent application
  misc_feature: The sequence is a functional homolog of SEQ ID NO 826 in the 11/435,388 US patent application
  misc_feature: The sequence is a functional homolog of SEQ ID NO 632 in the 11/479,226 US patent application
  misc_feature: The sequence is a functional homolog of SEQ ID NO 844 in the 11/435,388 US patent application
  misc_feature: The sequence is a functional homolog of SEQ ID NO 488 in the 10/374,780 US patent application
  misc_feature: The sequence is a functional homolog of SEQ ID NO 490 in the 10/374,780 US patent application
  misc_feature: The sequence is a functional homolog of SEQ ID NO 681 in the 10/666,642 US patent application
  misc_feature: The sequence is a functional homolog of SEQ ID NO 683 in the 10/666,642 US patent application
  misc_feature: The sequence is a functional homolog of SEQ ID NO 988 in the 10/412,699 US patent application
  misc_feature: The sequence is a functional homolog of SEQ ID NO 990 in the 10/412,699 US patent application
  misc_feature: The sequence is a functional homolog of SEQ ID NO 159 in the 11/479,226 US patent application
  misc_feature: The sequence is a functional homolog of SEQ ID NO 2218 in the 10/374,780 US patent application
  misc_feature: The sequence is a functional homolog of SEQ ID NO 36 in the 10/412,699 US patent application
  misc_feature: The sequence is a functional homolog of SEQ ID NO 466 in the 11/435,388 US patent application
  misc_feature: The sequence is a functional homolog of SEQ ID NO 492 in the 10/225,066 US patent application
  misc_feature: The sequence is a functional homolog of SEQ ID NO 174 in the 11/375,241 US patent application
  misc_feature: The sequence is a functional homolog of SEQ ID NO 804 in the 11/435,388 US patent application
  misc_feature: The sequence is a functional homolog of SEQ ID NO 172 in the 11/375,241 US patent application
  misc_feature: The sequence is a functional homolog of SEQ ID NO 800 in the 11/435,388 US patent application
  misc_feature: The sequence is a functional homolog of SEQ ID NO 170 in the 11/375,241 US patent application
  misc_feature: The sequence is a functional homolog of SEQ ID NO 798 in the 11/435,388 US patent application
  misc_feature: Ceres ANNOT ID no. 8647700
  misc_feature (9)..(61): Pfam ID: AP2 Pfam Description: AP2 domain
MDDGGGEPTKYRGVRRRPWGKYAAEIRDSSRHGVRIWLGTFDTAEEAARAYDRSAYSMRGANAVLNFPEDAAVYAAAFRGGSGGSSSSSRQQQHGGRDVIEFEYLDDEVLQEMLKSHEPSSSSARNKKK

SEQ ID NO: 15944 - DNA, 1584 bp, Sorghum bicolor
  misc_feature: Ceres ANNOT ID no. 8647813
  misc_feature: Encodes the peptide sequence at SEQ ID NO 15945
atgccgccgtcgtccgtgatgcgcgcggcctggcaggcggtgcggtggtccgtggtggtgccgacgctgcaggtcgccgtgtacgtctgcgccgccatgtcgctgatgctcttcctcgagcgcctctacatggcggccgtgatcaccgggctctggctgcgccggcgccgcaataagcagcgctcccgacgccgcctcgccgacgagctggacgacgacgacctggaggccggcgacgacgaccactgctgccccatggtcctggtccagatccccatgttcaacgagggacaggtgtaccgtctgtccatcggagcggcgtgcgggatgtcatggccatcggaccggctggtgatccaagtgctggacgactcgacgaacccggccatcagggagctggtggaggtggagtgcttgcggtgggcgggcaagggcgtgcgcatccgctacgagaaccgcagcaaccgcaacgggtacaaggccggcgccatgcgcgagggcctcaagaagcactacgccagggagtgcgagttcgtggccatcttcgacgccgacttccagccggactcggacttcctccggcgcacggtcccgctgctgcagcgcgaccccggcgtcgccctggtgcaggcccgctggcgctacgtcaacgccgacgactgcatcctcacccgcatccaggagatgtccctcaactaccacttcgccgtggagcaggaggtgggctccgcctgccacgccttcttcggcttcaacggcacggccggggtgtggcgcgtcgccgcgctggcggacgccggcgggtggaaggagcgcaccactgtggaggacatggacctggccgtgcgcgccagcctccgcggctggcgcttcgtctacgtcggcgacctcgtcgtgcgcaacgagctgcccagcaccttcaaggcgtaccgctaccagcagcaccggtggtcgtgcggccccgccaacctgttccgcaaggtgctgccggagatcctccgcagcgaccgggtgtcgctggggaagaagctgcacctcctctacgccttcttcttcgtcaggaaggtggtggcgcacctcgtcactttcctcttctactgcgtcgtcatcccggcatgcgtgctggtgcagggcgacgtgcgactgcccaagtacgtggccatgtacgtgccggcgctcatcacgctgctcaacgccgcctgcacgccaaggtcctgccacctcctcatcttctggatcctcttcgagaacgtcatgtccatgcaccgatccaaggccgccgtcatcggactgctggaggccagccgcgccaacgagtgggtggtcaccgacaagctcggcagcggcaaggctgctccggtggtcgcgaggaagaagaaacagcaggtgctccggagcaggtgctgcagcacgaggcgggagatgcatgtgctggagctcgccatgggggcgtgcctgctctattgcgccgtctacgacattgtcttcttcggccgcgaccactactacatgtacctgctcctgcaatcggcggcggcctttatcgttggcttcggctacgtgggagcctcggcaccctcctga

SEQ ID NO: 15945 - protein, 527 aa, Sorghum bicolor
  misc_feature: Useful for making plants with altered cell wall content and/or composition
  misc_feature: Functional homolog of the protein sequence given in SEQ ID NO 13963
  misc_feature: Useful for making plants with altered carbohydrate content
  misc_feature: Functional homolog of the protein sequence given in SEQ ID NO 13964
  misc_feature: Ceres ANNOT ID no. 8647813
  misc_feature (85)..(447): SWISSPROT Homolog: EC 2.4.1.12 Cellulose synthase (UDP-forming)
  misc_feature (88)..(263): Pfam ID: Glycos_transf_2 Pfam Description: Glycosyl transferase family 2
MPPSSVMRAAWQAVRWSVVVPTLQVAVYVCAAMSLMLFLERLYMAAVITGLWLRRRRNKQRSRRRLADELDDDDLEAGDDDHCCPMVLVQIPMFNEGQVYRLSIGAACGMSWPSDRLVIQVLDDSTNPAIRELVEVECLRWAGKGVRIRYENRSNRNGYKAGAMREGLKKHYARECEFVAIFDADFQPDSDFLRRTVPLLQRDPGVALVQARWRYVNADDCILTRIQEMSLNYHFAVEQEVGSACHAFFGFNGTAGVWRVAALADAGGWKERTTVEDMDLAVRASLRGWRFVYVGDLVVRNELPSTFKAYRYQQHRWSCGPANLFRKVLPEILRSDRVSLGKKLHLLYAFFFVRKVVAHLVTFLFYCVVIPACVLVQGDVRLPKYVAMYVPALITLLNAACTPRSCHLLIFWILFENVMSMHRSKAAVIGLLEASRANEWVVTDKLGSGKAAPVVARKKKQQVLRSRCCSTRREMHVLELAMGACLLYCAVYDIVFFGRDHYYMYLLLQSAAAFIVGFGYVGASAPS

SEQ ID NO: 15946 - DNA, 1281 bp, Sorghum bicolor
  misc_feature: Ceres ANNOT ID no. 8647816
  misc_feature: Encodes the peptide sequence at SEQ ID NO 15947
atgggcatcttgtgttgcttccagtcccacaccggcgacgggaccgcccaccatgatcattttgtggcttcgtccccggctacctcttcgtcctctgtcccctcgtcgtaccgtcgtgctccccccgagcggcagtccgccggcgtggagaagagcagcaggaggaacgacagcatcgacaacagcaacctggtcgccctcgtcaacgacatcgtcaccgagtcagtgagctaccatcacaggcgggtggccgaggagatcctcaagatgggcaaggcgggcaaggtgacggcgcgcgccttcacgtacgccgagctgtgcgaggccacgggcgggttccggccggagtcgctgctgggcgagggcggcttcggccccgtctacaggggccgcctgggctcgtcgtcgggaccggaggtggccgtcaagcagctggaccgcaacggcatgcagggcacgcgcgagttcctggtggaggcgctcatgctcagcctgctcaagcaccccaacctggtgacgctgctgggcttctgcaccgacgccgaccaccgcatgctcatctacgagtacatgccgctggggtccctggaggaccacctgctggacctgccgccggggcgcgcgccgctcgactgggcgacgcgcatgggcgtcgcgcaggacgccgcgcgcggcctcgagtacctgcacgacgccgcgcagccgcccgtgatctaccgcgacttcaaggcctccaacatcctgctcgacaccggcttccgcgcacgcctctccgacttcgggctcgccaaggtcggccccgtcggcgacaagacacacgtctccacgcgcgtcatgggcacctacggctactgcgcaccggagtacgcgctcacgggcaagctcaccaccatgtccgacgtctacagcttcggcgtcgtcttcctcgagatcatcaccggcagccgcgccatcgacaccaccaggccgccagacaagcacaacctcgtcctctgggccggcccgcgattcaaggacaagcgacggttcgccgagatggccgacccgctgctccagggcgcatacccaaccaagggactctaccaggcgctcgccatcgcagccatgtgcctccaggaggatgccaccatgcgccccgtcatcagcgacgtcgtcaccgcgctcgagtacctcaccgttgcaggcggaggcgccgctgacgaagaaccggctccggatcccaagcagcagcagcagcagcagcaaatagacgttatcggccacgccgacgaccaagcgtaa

SEQ ID NO: 15947 - protein, 426 aa, Sorghum bicolor
  misc_feature: Useful for making plants with modulated drought sensitivity
  misc_feature: Functional homolog of the protein sequence given in SEQ ID NO 14078
  misc_feature: Ceres ANNOT ID no. 8647816
  misc_feature (85)..(391): SWISSPROT Homolog: EC 2.7.11.1 Non-specific serine/threonine protein kinase
  misc_feature (113)..(388): Pfam ID: Pkinase_Tyr Pfam Description: Protein tyrosine kinase
MGILCCFQSHTGDGTAHHDHFVASSPATSSSSVPSSYRRAPPERQSAGVEKSSRRNDSIDNSNLVALVNDIVTESVSYHHRRVAEEILKMGKAGKVTARAFTYAELCEATGGFRPESLLGEGGFGPVYRGRLGSSSGPEVAVKQLDRNGMQGTREFLVEALMLSLLKHPNLVTLLGFCTDADHRMLIYEYMPLGSLEDHLLDLPPGRAPLDWATRMGVAQDAARGLEYLHDAAQPPVIYRDFKASNILLDTGFRARLSDFGLAKVGPVGDKTHVSTRVMGTYGYCAPEYALTGKLTTMSDVYSFGVVFLEIITGSRAIDTTRPPDKHNLVLWAGPRFKDKRRFAEMADPLLQGAYPTKGLYQALAIAAMCLQEDATMRPVISDVVTALEYLTVAGGGAADEEPAPDPKQQQQQQQIDVIGHADDQA

SEQ ID NO: 15948 - DNA, 747 bp, Sorghum bicolor
  misc_feature: Ceres ANNOT ID no. 8647984
  misc_feature: Encodes the peptide sequence at SEQ ID NO 15949
atgtggaggctaaagatctcaaaaggaggaggcccatggatgcagacggtgagtgagttccatggccggcaggtgtgggagttcgacccagacgccggcaccgacgaggagcgcgccaaggtggagctgcttcgccaggacttcacggagaaccgcttccggaggagggaatcgcaggatctactcatgcgcatgcagctcactggagaaaagcatctgcgcgcggatatgcccgcggccacgaagctagcggatggcgacgaggtgacggaagaaattctgcacgagtcgctgagacgagctgaagatggtcactggcctggtgattacagtgggattatgtacctgcagcccttctggatcttcgcgttgcacatcactggatcaatcgacgctgtcctatcaaaagagcatatacgtgagatatgccgccatatctacaaccatcagaacgaggacggcggatggggcttcaacattttggacgagagtgccatgtttggcacgtgcttgaactatgccaccctgaggcttctcggtgaggcgcataacgatgaactagccaaaggtcgcgcatggatcctgtcccatggcactgcaactgcagcaccacaatgggcaaagatattactctcggttattggcgtatatgattggcggggtaataatccagttgttcctgaactatggttggtcccacgttttcttcccattcacccaggtatatatattcttttgatgctatag

SEQ ID NO: 15949 - protein, 248 aa, Sorghum bicolor
  misc_feature: The sequence is a functional homolog of SEQ ID NO 15 in US patent 7186884
  misc_feature: The sequence is a functional homolog of SEQ ID NO 6 in US patent 7122717
  misc_feature: Ceres ANNOT ID no. 8647984
  misc_feature (1)..(241): SWISSPROT Homolog: EC 5.4.99.8 Cycloartenol synthase
  misc_feature (137)..(180): Pfam ID: Prenyltrans Pfam Description: Prenyltransferase and squalene oxidase repeat
MWRLKISKGGGPWMQTVSEFHGRQVWEFDPDAGTDEERAKVELLRQDFTENRFRRRESQDLLMRMQLTGEKHLRADMPAATKLADGDEVTEEILHESLRRAEDGHWPGDYSGIMYLQPFWIFALHITGSIDAVLSKEHIREICRHIYNHQNEDGGWGFNILDESAMFGTCLNYATLRLLGEAHNDELAKGRAWILSHGTATAAPQWAKILLSVIGVYDWRGNNPVVPELWLVPRFLPIHPGIYILLML

SEQ ID NO: 15950 - DNA, 807 bp, Sorghum bicolor
  misc_feature: Ceres ANNOT ID no. 8647978
  misc_feature: Encodes the peptide sequence at SEQ ID NO 15951
atggatggaggaagcaagatcactgggcggttttggtgcttcacgaggattacgtacatgtcaatagcttatctttatggcaaaaaatttgttggtccaattacaccaactatattagcactaagggatgaactctatagttggccatatgacaagatcgattggagtaaagctcgtaatgcttgtgccaaggtttgtcactatccttcaacggttgaatgtacgtcctcagtgatgcatgctttaatattatttaggaagattaatccagagtaccgcagtaaagagataaaggattatgtgaacaaagcagtcatatttattgagaataatcaaaagaaggatggatcctggtacggcacttggggcatatgttttgtctatgggaccctctatgcaataaaaggcttaattgctgctgggagaaattatgagaacagcatttgcatcaggaaagcatgtaaattttttatctcaacacaactcaaaactggtggctggggagagagctttctttcctgtgaaagacaggtctatgtagaaggtcatagtacacatgctgtacaaactgcttgggcgatgctagctttgatttatgctggacagatggaacgagacccaacaccattacatcgagcagcaaaagtattgattaatatgcagtttgagacaggagactatcctcaacaagaacatgttggcaacaccaactcttctgtttacttcaactaccccaactaccgcattttgtttccaatttgggcacttggggagtatcgccgtaaactatttgccaagaataattaa

SEQ ID NO: 15951 - protein, 268 aa, Sorghum bicolor
  misc_feature: The sequence is a functional homolog of SEQ ID NO 15 in US patent 7186884
  misc_feature: The sequence is a functional homolog of SEQ ID NO 6 in US patent 7122717
  misc_feature: Ceres ANNOT ID no. 8647978
  misc_feature (65)..(260): SWISSPROT Homolog: EC 5.4.99.8 Cycloartenol synthase
  misc_feature (99)..(141): Pfam ID: Prenyltrans Pfam Description: Prenyltransferase and squalene oxidase repeat
  misc_feature (148)..(201): Pfam ID: Prenyltrans Pfam Description: Prenyltransferase and squalene oxidase repeat
MDGGSKITGRFWCFTRITYMSIAYLYGKKFVGPITPTILALRDELYSWPYDKIDWSKARNACAKVCHYPSTVECTSSVMHALILFRKINPEYRSKEIKDYVNKAVIFIENNQKKDGSWYGTWGICFVYGTLYAIKGLIAAGRNYENSICIRKACKFFISTQLKTGGWGESFLSCERQVYVEGHSTHAVQTAWAMLALIYAGQMERDPTPLHRAAKVLINMQFETGDYPQQEHVGNTNSSVYFNYPNYRILFPIWALGEYRRKLFAKNN

SEQ ID NO: 15952 - DNA, 525 bp, Sorghum bicolor
  misc_feature: Ceres ANNOT ID no. 8649079
  misc_feature: Encodes the peptide sequence at SEQ ID NO 15953
atgccaacagcagagacgacgacgcccgtgccgccagcgctctccgggcaaggccggacagtttgcgtcaccggagctggagggttcatcgcctcctggcttgtcaagcgcctcctcgagaagggttacacagtccgtggcacggtcaggaaccctgtcgatccaaagaacgaccacctgagggcccttgacggcgccgccgatcgcctcgtcctcctgcgtgccgatctgctggatccagaaagccttgtcgaggccttctccggctgcgacggcgtcttccacgccgcctccccggtcaccgatgaccctgagatgatgatcgagccagcaatccggggcacacaatatgtgatgacggcggcggcagacaccggcgtcaagcgcgtcgtgttcacgtcctccatcggcacagtgtacatgaacccctaccgtgaacccaacaagcctgtcgacgacacctgctggagcgatcttgagtattgcaagaatacacagaatgagagaactaatgatcatatatag

SEQ ID NO: 15953 - protein, 174 aa, Sorghum bicolor
  misc_feature: Useful for making plants with altered carbohydrate content
  misc_feature: Functional homolog of the protein sequence given in SEQ ID NO 14297
  misc_feature: Useful for making plants with altered cell wall content and/or composition
  misc_feature: Useful for making plants with altered lignin content
  misc_feature: Functional homolog of the protein sequence given in SEQ ID NO 13818
  misc_feature: Ceres ANNOT ID no. 8649079
  misc_feature (16)..(166): SWISSPROT Homolog: EC 1.1.1.219 Dihydrokaempferol 4-reductase
  misc_feature (21)..(174): Pfam ID: Epimerase Pfam Description: NAD dependent epimerase/dehydratase family
MPTAETTTPVPPALSGQGRTVCVTGAGGFIASWLVKRLLEKGYTVRGTVRNPVDPKNDHLRALDGAADRLVLLRADLLDPESLVEAFSGCDGVFHAASPVTDDPEMMIEPAIRGTQYVMTAAADTGVKRVVFTSSIGTVYMNPYREPNKPVDDTCWSDLEYCKNTQNERTNDHI

SEQ ID NO: 15954 - DNA, 900 bp, Sorghum bicolor
  misc_feature: Ceres ANNOT ID no. 8651609
  misc_feature: Encodes the peptide sequence at SEQ ID NO 15955
atggcgaccgccatttcctctctagtaactcctccagccctccaccgccgctgcctaagccctgcctccgtctccgtctccgcccctatccgtatctccttccgggccgccgcggcgtctcaggcgtggcgccggggcttggcgctgcgggtgtcagcctcctcggcggtgctcgaggcgccagaggtggtggcggcgcggaagctctacgttggaaatgtccccaggaccgtcaccaatgacgagctccgcgacatgttcgccgcgcacggcaccgttgagcgggccgaggttatgtacgacaagtataccaatcgcagccgacggtttgggtttgtcacgatgagcactgtggaagaggccaatgctgcagtagaggctctcaatgggactgaggttggtggtagaaaaattaaagtgaatgtcacagagagcttcttaccgaacattgaccgatcagcacctgaatcggaacctgtatttgtggatagtcagtacaaggtttatgttggtaatcttgcgaagaatgtaacaacggaagttcttaaaaacttcttctctgaaaaggggaagatcctcagtgcaacagtctcccacattccggggacctcgaagtcaaaggggtatggctttgtcacattctcttctgaggaagaagttgaagctgctgttgctactttcaataacgcggtaagcttctcttgcatattttacgcatttctgccatttctttgctacctcataaaacagtcaccatttggtgattgccaaacaaaaatgttgtgctgcattcttctatcttatcatttaggtgaaaatagatggaaatatggatttaacttactgactgttatgtgtacagatgagttagaattacatgatctgaactacttcaactga

SEQ ID NO: 15955 - protein, 299 aa, Sorghum bicolor
  misc_feature: Useful for making plants with altered alkaloid content
  misc_feature: Functional homolog of the protein sequence given in SEQ ID NO 14298
  misc_feature: Ceres ANNOT ID no. 8651609
  misc_feature (69)..(140): Pfam ID: RRM_1 Pfam Description: RNA recognition motif. (a.k.a. RRM, RBD, or RNP domain)
  misc_feature (168)..(239): Pfam ID: RRM_1 Pfam Description: RNA recognition motif. (a.k.a. RRM, RBD, or RNP domain)
MATAISSLVTPPALHRRCLSPASVSVSAPIRISFRAAAASQAWRRGLALRVSASSAVLEAPEVVAARKLYVGNVPRTVTNDELRDMFAAHGTVERAEVMYDKYTNRSRRFGFVTMSTVEEANAAVEALNGTEVGGRKIKVNVTESFLPNIDRSAPESEPVFVDSQYKVYVGNLAKNVTTEVLKNFFSEKGKILSATVSHIPGTSKSKGYGFVTFSSEEEVEAAVATFNNAVSFSCIFYAFLPFLCYLIKQSPFGDCQTKMLCCILLSYHLGENRWKYGFNLLTVMCTDELELHDLNYFN

SEQ ID NO: 15956 - DNA, 1428 bp, Sorghum bicolor
  misc_feature: Ceres ANNOT ID no. 8651851
  misc_feature: Encodes the peptide sequence at SEQ ID NO 15957
atggaggaggatttttgcgaaaggaaggaggaggaattagtgggggaggttggtcgcgacgccgatatgtttaaattcgctcccacgggaagtcgaacccaggagtacatggaactatcgaaggatacaaagacgatgaagagtgaaagtgcatttgcccctgttgtggttttgccgcccctgcaccccggccttatccccacctggccctctgcccctcgcctccccctttaccggggtccgcgcaccagcatccttcggcagccgtggtcccgctgccgctcgcttcgcctaccgatccgtgtccgtgcgagacgcgggaggtatttgcgccggaggcaggccaggatgttctccggcgactggacgccgccgtgcggcagctgctgcaccaagaagtacgcgagcctcgtgcagatcccatggagggtgttctgcaagaaggggtgcaacgcggacggcgacacctgggatgagtgcataggaaaatgtactgaaatatgctacaaagatccggtgttagaagatcgccagtggagcgcctatattgatcgatctccagggcaggatagttattttagggctgttagcattaacaccgagtttcaggctgtggaaatggtgaattcttgcatggctgaaaggacagagatgaaaattgaagaagtatatttacatggttccaacttaattggctgtagttacaaaggcctttgccgactgcttgtgtatgaacatatgtgcaatggttctcttgattcccatctcttcgaaaggaatgatgctgcggctgtcctagactggagcaccagatatcagatagctattggagttgctagaggattgtccaacctgcatcagagttgtcaccagtgcatcatacactgtgacatcaagccagaaaacatacttctcgatgaatcctttgtgcctaaaattgcagactttgggttggcatcggtcataggcagggattttagccgggttctaactacgtttaaaggaactatggggtatcttgccccagagtggctcagcggagttcctatcacgtcaaaagtagatgtttacagctttggtatggtactgatggaaatcatatcaggaagaaggaatgcatctgtggtatgcagtaacaatagtaggggccatgttacttatttccctgtgcatgccatgagccagcttcatgagggggatgttgagagcttgatggatccaaatttacatggagactttagcttggaggaggctgagagagtttgcaaagtagcatgctggtgtatccaggacaatgagtctgaacggccaacaatgggtgaagtagttcgggttcttgagggtctacaggaccttgatattcctcccatgccaagactgcttgcggctattacagaaataaaatgctccagcgtggctacaatgtaa

SEQ ID NO: 15957 - protein, 475 aa, Sorghum bicolor
  misc_feature: Useful for making plants with modulated nitrogen use efficiency
  misc_feature: Functional homolog of the protein sequence given in SEQ ID NO 14299
  misc_feature: Ceres ANNOT ID no. 8651851
  misc_feature (215)..(448): SWISSPROT Homolog: EC 2.7.11.1 Non-specific serine/threonine protein kinase
  misc_feature (193)..(446): Pfam ID: Pkinase Pfam Description: Protein kinase domain
MEEDFCERKEEELVGEVGRDADMFKFAPTGSRTQEYMELSKDTKTMKSESAFAPVVVLPPLHPGLIPTWPSAPRLPLYRGPRTSILRQPWSRCRSLRLPIRVRARRGRYLRRRQARMFSGDWTPPCGSCCTKKYASLVQIPWRVFCKKGCNADGDTWDECIGKCTEICYKDPVLEDRQWSAYIDRSPGQDSYFRAVSINTEFQAVEMVNSCMAERTEMKIEEVYLHGSNLIGCSYKGLCRLLVYEHMCNGSLDSHLFERNDAAAVLDWSTRYQIAIGVARGLSNLHQSCHQCIIHCDIKPENILLDESFVPKIADFGLASVIGRDFSRVLTTFKGTMGYLAPEWLSGVPITSKVDVYSFGMVLMEIISGRRNASVVCSNNSRGHVTYFPVHAMSQLHEGDVESLMDPNLHGDFSLEEAERVCKVACWCIQDNESERPTMGEVVRVLEGLQDLDIPPMPRLLAAITEIKCSSVATM

SEQ ID NO: 15958 - DNA, 1218 bp, Sorghum bicolor
  misc_feature: Ceres ANNOT ID no. 8651870
  misc_feature: Encodes the peptide sequence at SEQ ID NO 15959
atggcaagaagccggccgggcattctgctctccgtggcggccctcgccgttgcggcggtggcggcactggcgccggcgccggtggccgcgacaaagtacaacatcaccaagattctggcaccgtacaaggagtactccaagttcaacgagatgctgtccaagacgcggctggcgtacgacatcaaccggcggcagaccatcaccgtgctggccgtcgacaactctgccatgtcggcgctcgaccactactcgctgcagacgatccggcacatcctgtcgctgcacgtcctcgtcgactactacggggataagaagctcaagaagcttgcccacggcgccaccgcctcctcctccatgttccaggctaccgggtcggcgtccggcatgtcggggtacgtgaacatcacccgaaaagacggcaaggtgagtttcatgacggaggacgccgacgacacggcgaagccgtcccggtacgtcaagtccgtgaaggagtacccctacgacatcgcggtgctccaggtgagctccatcatctcgtcggcggaggcggaggcgcccgtcccggccccggcgcccgtggacctggtggagctcctctccaagcgctactgcaagtcgttcgcgtccctgctctccgccgacgccgaggcgttccgcgccgccaacgagagcaaggacaacggcctcacgctcttctgccccgtggactcggccgtcgcgtcgttcgcggccacctacaagaacctgacggccaaggccaagacggccatcctcctctaccacgccgtgccggactacttctcgctgcagctgctcaagtccaacaacggcatggtcaccacgctcgccaccgccagcgagaagaagatggactacagctacgacgtcaagaacaaggacgagacggtcacgctgcagaccagggtcgtcacgtccagcgtcaccgccaccgtcggcgacatggagccgctggcagtctacgccgtcgacaagttcctgcagcccaaggagctgttcaaggtcgtcgaggcgcccgcgccggcgccggagccgtcgtccaagaagaagaaggccggtcgcggcgggggtgacgacgacgacgattcctccgacgattccacggccgatgcggaaaagggcgacgccgcaccggctctgctcgcgcgatgggtagtcaccgcggccgccgcggcggtagctgcatatgcgttgatctga

SEQ ID NO: 15959 - protein, 405 aa, Sorghum bicolor
  misc_feature: Useful for making plants with altered carbohydrate content
  misc_feature: Functional homolog of the protein sequence given in SEQ ID NO 14300
  misc_feature: Ceres ANNOT ID no. 8651870
  misc_feature (203)..(335): Pfam ID: Fasciclin Pfam Description: Fasciclin domain
MARSRPGILLSVAALAVAAVAALAPAPVAATKYNITKILAPYKEYSKFNEMLSKTRLAYDINRRQTITVLAVDNSAMSALDHYSLQTIRHILSLHVLVDYYGDKKLKKLAHGATASSSMFQATGSASGMSGYVNITRKDGKVSFMTEDADDTAKPSRYVKSVKEYPYDIAVLQVSSIISSAEAEAPVPAPAPVDLVELLSKRYCKSFASLLSADAEAFRAANESKDNGLTLFCPVDSAVASFAATYKNLTAKAKTAILLYHAVPDYFSLQLLKSNNGMVTTLATASEKKMDYSYDVKNKDETVTLQTRVVTSSVTATVGDMEPLAVYAVDKFLQPKELFKVVEAPAPAPEPSSKKKKAGRGGGDDDDDSSDDSTADAEKGDAAPALLARWVVTAAAAAVAAYALI

SEQ ID NO: 15960 - DNA, 762 bp, Sorghum bicolor
  misc_feature: Ceres ANNOT ID no. 8651937
  misc_feature: Encodes the peptide sequence at SEQ ID NO 15961
atggataagaattcattgaattatgcaaggatcaacaggaagcttctagaggacacgggaagacaccacgatgaagcaggaccagaggcaccgccaggcggtataggatgcactcaatgtgtacgagcttgcatgacagatgtattagaaatgataccttgggatggaagtaaagctaagcaaattgcttccgcgccaagaacagaagattgtgtgggttgtaagagatgcaaatccgcctgcccaacagaatttttaagtgtccgcgtttatttagggcctgaaatatctgttgcttatccagctatggcatatatggcaagcaaaaggattcagaaggaactcatggatctgcagaaggacccaccgacatcatgcagtgcagggcctgctggagaggatctattccactggcaggccacaatcatgggccctagcgacagcccctatgcaggaggggttttctttgttaatatccattttcctcctgactacccctttaagcctccaaaagtgaacttccaaacaaaagtttatcacccaaacatcaactctaatgggagcatttgccttgatatcctcaaggagcaatggagccctgcactgaccatatcaaaagtcctcctctccatcagctcgctcctcactgaccccaacccggacgacccccttgtccctgagatcgcgcacatgtacaagaaccagaggcagcgctatgaggaaactgcgcgggcctggacccagaagtacgcaatgggctga

SEQ ID NO: 15961 - protein, 253 aa, Sorghum bicolor
  misc_feature: Useful for biocontainment applications
  misc_feature: Functional homolog of the protein sequence given in SEQ ID NO 13996
  misc_feature: Ceres ANNOT ID no. 8651937
  misc_feature (106)..(253): SWISSPROT Homolog: EC 6.3.2.19 Ubiquitin--protein ligase
  misc_feature (36)..(114): SWISSPROT Homolog: EC 1.8.98.1 CoB--CoM heterodisulfide reductase
  misc_feature (110)..(247): Pfam ID: UQ_con Pfam Description: Ubiquitin-conjugating enzyme
  misc_feature (64)..(87): Pfam ID: Fer4 Pfam Description: 4Fe-4S binding domain
MDKNSLNYARINRKLLEDTGRHHDEAGPEAPPGGIGCTQCVRACMTDVLEMIPWDGSKAKQIASAPRTEDCVGCKRCKSACPTEFLSVRVYLGPEISVAYPAMAYMASKRIQKELMDLQKDPPTSCSAGPAGEDLFHWQATIMGPSDSPYAGGVFFVNIHFPPDYPFKPPKVNFQTKVYHPNINSNGSICLDILKEQWSPALTISKVLLSISSLLTDPNPDDPLVPEIAHMYKNQRQRYEETARAWTQKYAMG

SEQ ID NO: 15962 - DNA, 450 bp, Sorghum bicolor
  misc_feature: Ceres ANNOT ID no. 8652298
  misc_feature: Encodes the peptide sequence at SEQ ID NO 15963
atgacagtatgtggtttacaggatgagttgccgatgaggatggttgccgataaaggagagggtgatacccttgattaccttgggattcctggattccgaattgctggcggtcaaggtgttattgtaattgctatctgccaagcccttttgatggttggacctgaatatgcgaggtactgtgggatcgaggcactagaaccattgggaatatatcttcccggtgacataaactacccaggaggagcactttttgatcccttgggcctgtccaaggatcccgtggcatttgaagatctcaaggtgaaagaaatcaagaacggtcgcctggcgatggtagcatggttaggattttacatccaggcggctgtgactggcaagggccctgtacagaacctggttgaacacttgtctgacccactccataataatatcctgtcctccttccactaa

SEQ ID NO: 15963 - protein, 149 aa, Sorghum bicolor
  misc_feature: Useful for making plants with modulated nitrogen use efficiency
  misc_feature: Functional homolog of the protein sequence given in SEQ ID NO 14301
  misc_feature: Ceres ANNOT ID no. 8652298
  misc_feature (5)..(122): Pfam ID: Chloroa_b-bind Pfam Description: Chlorophyll A-B binding protein
MTVCGLQDELPMRMVADKGEGDTLDYLGIPGFRIAGGQGVIVIAICQALLMVGPEYARYCGIEALEPLGIYLPGDINYPGGALFDPLGLSKDPVAFEDLKVKEIKNGRLAMVAWLGFYIQAAVTGKGPVQNLVEHLSDPLHNNILSSFH

SEQ ID NO: 15964 - DNA, 2670 bp, Sorghum bicolor
  misc_feature: Ceres ANNOT ID no. 8652395
  misc_feature: Encodes the peptide sequence at SEQ ID NO 15965
atggcggccgtgacaagaacgctattggaaacaaggaaaagagcaagaggaggaagaggaagcaaacagcaaccaaacaaggcacaggcatacctttctgccactgccatgcccaggggacaggaagctctgtgcctcaaggcctctacgcactaccccacgctctttgacaactttcagagagagcttcgtgatgtcctgctgcagcagcaagaagagggccttgttaccgactggcgctctacgcgttcgtggatgcttatgaaagaaatggctagatcagctgagcatcggacagccgcacgcagacctacagctcctgttatgcacaagcacactacacttggcataagcctggacaggacaaggctgatgcaggctaaaatagatgagtttgttcagaagatgaccggccttcttcaactagaacgagatgcagaactggatgtaacccagaccacccaggatgagttgatgagtgccagttcaatgatggatggaaagtcaaagaagccagtggagtatttggtaactcatggtcaggcccaagaggagtgtgacaccatttgcaatttgaaagttatcagtagttcaactggattaactggtcaacatctagtcttatttagagtcgagggaagccaaaaacttccaccaaccagactctctcctggagacatggtttgtgtgagaacgtgcaacagccagggcgaggttgccactacttcttgcatggaagcctttgtccataatctcggtgaggatggatgcagcatcacagtggcattgaaatcacgacgcagtgatcctaccttctccaagtttcttgggaaaattgcgcggattgatcgcatacaggctctagcagatgcagtgacatacgagaagagagggttacagaaaagaaatgcatccattggggtagtagccactctgtttggagacaaggaagatgtgatgaagctggagggaaataatctgatggattgtggtggatcagaagtacctgatgatggtttgttggagaggcacagctacagctttgatacctctcagtcaagggctcttgcactggccttggacaaggagaggcctgtcctagttatccaagggcctcctggaacaggcaagactcgtttacttagctatcttatcacgtgtgttgcgcgccggggtgaacgtgttctcgtgacagctccaagcaacgcagcgattgataacatagtggagagtttatcaagaagtggactgaaaattgtacgagttggaaatccttctaggatatctccatctgtcacttcaatgtccttgggagagatcgttaccaagaggcttgaaaaattcacccaagagtttgagaggaaaaaatatgccttgagaaaggacttgaagcgttgcatacaggacgacgattctttagcttcaggtattcgtcaacgattgaaaaagctcggcaaggactataagaaggaggagaaggaagcaatcagggaggttctgtcaaatgctgaggtggtgctatcaactaatacaggggcagccgacccactgatcaggggaatgggttgctttgacctggtaattatagatgaagctggacaagcaactgagccctcatgttggatccctatactacagggaaagcgttgcattcttgcaggtgatcaccgtcagcttgcaccagtaatattatcaagagaggctatggaaggtgggctaggaatatctttgttagaaagggcttcatcactgcatgatggactgctcactacaacattaacaacacaataccgaatgcatgaatctatagcaagttgggcatcaaaggagatgtatgatggattgctccaatcgttcccacctgttgcttctcgacttcttgtcgattatccatttgtcaagttaacgaacacaagtgcttgtgaacagtacaagttccagttcacagcttgcctcttggcccattcggtctttttacccatcaaacatgttgagacccaagatttcactcaaggtcaaagtctaactaggccagtaggaaggcacctcgacaatgcttctaaggaagagacctacattgtgagtgcttccgtgctgaccactagtaaggccacctggatgactcagtgtgccttgcttttacttgatactcgaaaggaatatggaagtctaaatattgactgtgaggagagtttagacctagctggtactggttcattttacaacaatggtgaggcggatatagttgcacaacatgttttcaatctcatacaatgtggagtccctccaacttcaattgttgttcagtccccttacatcgcacaagtacaattgttacggggaagactagaagaatatccagtggcttccaatgttgaggtttcaacaatagacagcttccagggtcgggaagcagatgcagttgtcatatccatggttcggtcaaactccttgggagcagtagggttccttggtgatataaggcgcatgaatgtagctattacaagggcaaggtcacatgttgcagtggtgtgtgatacttctactatttgtaacaatgctttcctagcaaggctccttcgccatatccggcagcatggtcaggttagacatgtggaacccagttccttcgatgggggctttgatctaccagccttaccctcaggttag

SEQ ID NO: 15965 - protein, 889 aa, Sorghum bicolor
  misc_feature: Useful for making plants with modulated salt sensitivity
  misc_feature: Functional homolog of the protein sequence given in SEQ ID NO 13507
  misc_feature: Ceres ANNOT ID no. 8652395
  misc_feature (345)..(549): Pfam ID: ResIII Pfam Description: Type III restriction enzyme, res subunit
MAAVTRTLLETRKRARGGRGSKQQPNKAQAYLSATAMPRGQEALCLKASTHYPTLFDNFQRELRDVLLQQQEEGLVTDWRSTRSWMLMKEMARSAEHRTAARRPTAPVMHKHTTLGISLDRTRLMQAKIDEFVQKMTGLLQLERDAELDVTQTTQDELMSASSMMDGKSKKPVEYLVTHGQAQEECDTICNLKVISSSTGLTGQHLVLFRVEGSQKLPPTRLSPGDMVCVRTCNSQGEVATTSCMEAFVHNLGEDGCSITVALKSRRSDPTFSKFLGKIARIDRIQALADAVTYEKRGLQKRNASIGVVATLFGDKEDVMKLEGNNLMDCGGSEVPDDGLLERHSYSFDTSQSRALALALDKERPVLVIQGPPGTGKTRLLSYLITCVARRGERVLVTAPSNAAIDNIVESLSRSGLKIVRVGNPSRISPSVTSMSLGEIVTKRLEKFTQEFERKKYALRKDLKRCIQDDDSLASGIRQRLKKLGKDYKKEEKEAIREVLSNAEVVLSTNTGAADPLIRGMGCFDLVIIDEAGQATEPSCWIPILQGKRCILAGDHRQLAPVILSREAMEGGLGISLLERASSLHDGLLTTTLTTQYRMHESIASWASKEMYDGLLQSFPPVASRLLVDYPFVKLTNTSACEQYKFQFTACLLAHSVFLPIKHVETQDFTQGQSLTRPVGRHLDNASKEETYIVSASVLTTSKATWMTQCALLLLDTRKEYGSLNIDCEESLDLAGTGSFYNNGEADIVAQHVFNLIQCGVPPTSIVVQSPYIAQVQLLRGRLEEYPVASNVEVSTIDSFQGREADAVVISMVRSNSLGAVGFLGDIRRMNVAITRARSHVAVVCDTSTICNNAFLARLLRHIRQHGQVRHVEPSSFDGGFDLPALPSG

SEQ ID NO: 15966 - DNA, 408 bp, Sorghum bicolor
  misc_feature: Ceres ANNOT ID no. 8652626
  misc_feature: Encodes the peptide sequence at SEQ ID NO 15967
atggtaaacttttcagggacttctgtagcaaatgcttcgattgatcctgctcagtctttacatggcagcaatctttcaccaccaacagtactacagtttgggaagacgaggaagctatctgagcgagctgaccctagaaatcggcagctcttgcaaaaacggcagttcttccattctcacagagcgcagccaatggcactggaacaagtgttctcggaccgtgatagtgaagatgaagttgatgatgatattgctgactttgaggatagaagaatgcttgatgattttgttgatgttacaaaagatgaaaaacttattatgcatatgtggaattcatttgttcgaaaacaaaggttagtcctatccataaattcccataattctgattatcataataggcatgtgtga

SEQ ID NO: 15967 - protein, 135 aa, Sorghum bicolor
  misc_feature: Useful for making plants with modulated flowering time
  misc_feature: Functional homolog of the protein sequence given in SEQ ID NO 14302
  misc_feature: Ceres ANNOT ID no. 8652626
MVNFSGTSVANASIDPAQSLHGSNLSPPTVLQFGKTRKLSERADPRNRQLLQKRQFFHSHRAQPMALEQVFSDRDSEDEVDDDIADFEDRRMLDDFVDVTKDEKLIMHMWNSFVRKQRLVLSINSHNSDYHNRHV

SEQ ID NO: 15968 - DNA, 111 bp, Sorghum bicolor
  misc_feature: Ceres ANNOT ID no. 8652993
  misc_feature: Encodes the peptide sequence at SEQ ID NO 15969
atggattcccgcgggatgtacaaagtccagtggaatcagtgcaccgaagaggaggctgtttgtaatagagaagaggatctaagaaaaacacacccgcagtggtttgagtaa

SEQ ID NO: 15969 - protein, 36 aa, Sorghum bicolor
  misc_feature: The sequence is a functional homolog of SEQ ID NO 1584 in the 10/374,780 US patent application
  misc_feature: The sequence is a functional homolog of SEQ ID NO 1586 in the 10/374,780 US patent application
  misc_feature: The sequence is a functional homolog of SEQ ID NO 1585 in the 10/374,780 US patent application
  misc_feature: The sequence is a functional homolog of SEQ ID NO 1583 in the 10/374,780 US patent application
  misc_feature: Ceres ANNOT ID no. 8652993
MDSRGMYKVQWNQCTEEEAVCNREEDLRKTHPQWFE

SEQ ID NO: 15970 - DNA, 2520 bp, Sorghum bicolor
  misc_feature: Ceres ANNOT ID no. 8653130
  misc_feature: Encodes the peptide sequence at SEQ ID NO 15971
atggatcggtcagctgcagtcttgctgctcctcctcctgctgctgccgccgccatgcgcacccgacgaccgcctggtcctcgacaagcctctcaccgccggcaccaccatagtatccggcggcggcggcttcgccctgggcttcttctcccccaccaccgactccactccggccaacaacaacaacaagctgtacctcggcatatggtacgccgacgacgtcccaacgcgcaccgtggtgtgggtggccaacagagacgccccggccaccaacaccaccgcacctacgctgtccctaaccaacacggccaacctcgtcgtgtccgacggcagcggccgtgtcctctggacgaccaacgtcaccggcgtcgtcgtccccaccacctcctcctccccgtcccccaccgcggttctcctcgacaccgggaacctcgtggtccggcacccgaacggcagcaccttgtggcagagcttcgagcacccggccgactcgttcctccccggcatgaagctccgggtcaactacggcacgcgcgccggcgacgagcgccgcctggtgtcgtggaggacccccgacgacccttcgccggggagcttcgcctacgccgtggacccggacacggcgctgcagatcttcctctggaacgggacgcgcccgctgatgcgcgacgggccatggacgggctactccgtcgccagcaagtaccaggccaacgccagcgtcttcgtctaccaggccgtcgtcagcaccgacgaggagatctacctcacctacaccctctccgacggcgctgcgcgcaccaggttcgtcgtcacggccgccggccagtaccagctccagagctggagcgccagctcgtcggcgtggacggtcctcggctcctggccgacctgggagtgcaaccgctacggccactgcgggcgctacggctactgcgacaacaccatggccgcgccgacgtgcaggtgcctcgacggcttcgagcctgccgactccaaggagtggacccgcggcgtcttctcgcagggttgccggcgacaggagccgctgcggtgcgccgacggcgacggattcttggccttgccggggatgaaatcgccggacaggttcgtgctcgtcgccaaccgaaccttggacgagtgccgggcggcgtgcaccggcaactgctcctgtgtggcctacgcttatgccaacctgagcaccaccaagaagacgggcgacgtgacgaggtgcttggtgtgggccggcgacctcatcgacacggagaagcaggtagggaacgtggtcgccgccgacacgctgtacatccggctctcaaacttggatgcaggtgtcgacagacgaaagagcaataatgcactgaggattgctctgcctacggttttgacaagtagcattctcataatcacagtcattttccttgcctggtttaaattcaaaggacgtatgagggggaataatgaggataacaataagataagtcatggtggtacgagtatctctgatgacctcgctgaaggaagctcagcacaagatttcgaacttcccttcgtcaaatttgaggatattgaggctgcgactcacaatttctcagaggcgtataagattggacaaggaggctttgggaaagtgtacaaggaagttgctatcaaaaggctaagtaaagattcagaacaaggaaccgtggaattcaggaatgaagctattctaattgccaaattgcaacatagaaatttggttcggctgcttggttgcagcgtggagggtggtgaaaaaatcctgatatatgaatatttgcctaatagaagcttagatgctatcctttttgataattcaagaaaagtgttgctagattggccaacacggtttaatataatcaaaggggttgcaaggggacttctttacttgcaccaagattcaagattgaccatagttcatagagatctcaaagctgccaatgttttgctcgacgcagagatgagacccaagatagcagactttggtatggcaaggatctttagtgacaaccagaaaaatgcaaatacgcgacgagtcgtgggaacatatggctacatggctcctgagtatgcaatggaaggagtcttctctatcaagtctgatgtctatagctttggcgtcttgatcttggagcttgtaactggtataaggagaagcacttttaacaaaatcaagaactttcccaaccttatgatctatgcatggaatatgtggaaagaatggaagggaaaagatttggcagacccttgtattatagatacttgttcgttggatgaagtgttactttgtagtcatatggcactcttgtgtgcccaagaaaatcctgatgatagaccacttatgtcatctgttgtgttggccttggagaatggaagcactacattgccaccacctaataaccctgggcattatggacatgggagtagtgatacggagctaacaagagatagaactgataactctatgaattttcttactctcacgagtgtggagggacgataa

SEQ ID NO: 15971 - protein, 839 aa, Sorghum bicolor
  misc_feature: Useful for making plants with modulated biomass
  misc_feature: Functional homolog of the protein sequence given in SEQ ID NO 14141
  misc_feature: Ceres ANNOT ID no. 8653130
  misc_feature (520)..(794): SWISSPROT Homolog: EC 2.7.11.1 Non-specific serine/threonine protein kinase
  misc_feature (76)..(195): Pfam ID: B_lectin Pfam Description: D-mannose binding lectin
  misc_feature (530)..(794): Pfam ID: Pkinase Pfam Description: Protein kinase domain
  misc_feature (352)..(421): Pfam ID: PAN_2 Pfam Description: PAN-like domain
  misc_feature (209)..(335): Pfam ID: S_locus_glycop Pfam Description: S-locus glycoprotein family
MDRSAAVLLLLLLLLPPPCAPDDRLVLDKPLTAGTTIVSGGGGFALGFFSPTTDSTPANNNNKLYLGIWYADDVPTRTVVWVANRDAPATNTTAPTLSLTNTANLVVSDGSGRVLWTTNVTGVVVPTTSSSPSPTAVLLDTGNLVVRHPNGSTLWQSFEHPADSFLPGMKLRVNYGTRAGDERRLVSWRTPDDPSPGSFAYAVDPDTALQIFLWNGTRPLMRDGPWTGYSVASKYQANASVFVYQAVVSTDEEIYLTYTLSDGAARTRFVVTAAGQYQLQSWSASSSAWTVLGSWPTWECNRYGHCGRYGYCDNTMAAPTCRCLDGFEPADSKEWTRGVFSQGCRRQEPLRCADGDGFLALPGMKSPDRFVLVANRTLDECRAACTGNCSCVAYAYANLSTTKKTGDVTRCLVWAGDLIDTEKQVGNVVAADTLYIRLSNLDAGVDRRKSNNALRIALPTVLTSSILIITVIFLAWFKFKGRMRGNNEDNNKISHGGTSISDDLAEGSSAQDFELPFVKFEDIEAATHNFSEAYKIGQGGFGKVYKEVAIKRLSKDSEQGTVEFRNEAILIAKLQHRNLVRLLGCSVEGGEKILIYEYLPNRSLDAILFDNSRKVLLDWPTRFNIIKGVARGLLYLHQDSRLTIVHRDLKAANVLLDAEMRPKIADFGMARIFSDNQKNANTRRVVGTYGYMAPEYAMEGVFSIKSDVYSFGVLILELVTGIRRSTFNKIKNFPNLMIYAWNMWKEWKGKDLADPCIIDTCSLDEVLLCSHMALLCAQENPDDRPLMSSVVLALENGSTTLPPPNNPGHYGHGSSDTELTRDRTDNSMNFLTLTSVEGR

SEQ ID NO: 15972 - DNA, 420 bp, Sorghum bicolor
  misc_feature: Ceres ANNOT ID no. 8653511
  misc_feature: Encodes the peptide sequence at SEQ ID NO 15973
atgcagatcttcgtgaagacgctgacggggaagacggtgacgctggaggtggagagcagcgacaccgtcgccaatgtcaaggccaagatccaggacaaggaaggcatcccgccggaccagcagcggctcatcttcgccggcaagcagctggaggacgagcgcaccctggccgactacaacatccagaaggagtcgacgctgcaccttgtgctccgcctccgcggcggcggcggcaagggcggcagctaccccaagatcgacctcaacctgctccagctcgcgctcaagtaccgccagcacaagatgatctgccgcaagtgctacgctcgcaactccgtcagggccgaaaactgccgcaagaagaagtgcggccacaccagcgactctgatgatttacctgtgttaaaagcgttaagttga

SEQ ID NO: 15973 - protein, 139 aa, Sorghum bicolor
  misc_feature: Useful for making plants with modulated nitrogen use efficiency
  misc_feature: Functional homolog of the protein sequence given in SEQ ID NO 13585
  misc_feature: Useful for making plants with modulated cold sensitivity
  misc_feature: Useful for making plants with modulated flowering time
  misc_feature: Functional homolog of the protein sequence given in SEQ ID NO 14303
  misc_feature: Ceres ANNOT ID no. 8653511
  misc_feature (10)..(67): SWISSPROT Homolog: EC 3.1.2.15 Ubiquitin thiolesterase
  misc_feature (6)..(74): Pfam ID: ubiquitin Pfam Description: Ubiquitin family
  misc_feature (85)..(136): Pfam ID: Ribosomal_L40e Pfam Description: Ribosomal L40e family
MQIFVKTLTGKTVTLEVESSDTVANVKAKIQDKEGIPPDQQRLIFAGKQLEDERTLADYNIQKESTLHLVLRLRGGGGKGGSYPKIDLNLLQLALKYRQHKMICRKCYARNSVRAENCRKKKCGHTSDSDDLPVLKALS

SEQ ID NO: 15974 - DNA, 1506 bp, Sorghum bicolor
  misc_feature: Ceres ANNOT ID no. 8653537
  misc_feature: Encodes the peptide sequence at SEQ ID NO 15975
atggggctcgcgccgccggagctgggccagttcgacgggtgggagagctccggggaggaggagcgggagcgggagcgctggggctggtgccgacgcagccgccgccgcagcagcagcaggcgccgcgcgggcgcggcacccaaggacgacgacgccgcggtcgccaccggctgctgcatccgcctctggcccgtcgggacgtgcccgccgcaggcgccgccgcgcaggtccaaggtcgacacctccaccagcagcgccagcacgcacggcgcagagaagtcgacagaaaatggtagcaggaatcaacctgtcgcattggtagtctcaggttctacaactactagtaacgctgaaagcagttcatccgcatctaaagttggagaagagataaaagttgcctcccagctgcgcaagtttgcattcaatgatctaaaatgtgctactcggaacttcaggcctgaaagtctccttggagaagggggttttggatgtgtttttaaagggtggattgaagagaacggaactgcacccgtgaaacctggtacaggtctcacagttgctgtcaagacgctaaaccatgatgggcttcaagggcacaaagaatgggtggctgaagttgattttcttggaaatcttcaccatcccaatttggtcaggttgattggatattgtgttgaagatgaccaaaggttgctggtgtatgaattcatgcctcgaggcagtttggataaccatctttttcgaaggtctcttcctcttccatgggctatcagaatgaaggttgcacttggagcagcaaagggtctggctttccttcatgaagaagcagaaagaccagtcatttatcgtgattttaaaacatctaatatactactggatgcggagtataatgcaaagctctccgattttgggcttgcgaaagatggacctgtaggtgataaaactcatgtctctactcgagtaatgggaacctatggatatgcagcaccagaatatgtcatgactggtcatctgacatcaaagagtgatgtctacagctttggggttgtgcttcttgagatgatgtcagggcgcagatcaatggacaagaatcgccctaacggcgagcacaaccttgttgaatgggcgcgccccctcctaggagagaggcagcgcttctacaagctaatcgaccctcgcctggagggcaacttctcagtgaagggcgcccagaaggccgcccagctagcgcgcgcctgcctcagccgggaccccaaggcgcggcccttgatgagccaggtggtggaggtcctcaagccactgcagaacctcaaggacatggcaagtgcctcctacttcttccagacgatgcaagctgagcggtcgagcagcatgaacgggaggagcagccatggcctcaagacgcagagcccattcgggcggaacgggcagccgcccatgaggagcctctctgatggccctcgcgcctccccgttccgctactcaccaaagccgaacgtgaaatga

SEQ ID NO: 15975 - protein, 501 aa, Sorghum bicolor
  misc_feature: Useful for making plants with modulated drought sensitivity
  misc_feature: Functional homolog of the protein sequence given in SEQ ID NO 14078
  misc_feature: Useful for making plants with modulated heat sensitivity
  misc_feature: Functional homolog of the protein sequence given in SEQ ID NO 14079
  misc_feature: Ceres ANNOT ID no. 8653537
  misc_feature (129)..(473): SWISSPROT Homolog: EC 2.7.11.1 Non-specific serine/threonine protein kinase
  misc_feature (151)..(431): Pfam ID: Pkinase Pfam Description: Protein kinase domain
MGLAPPELGQFDGWESSGEEERERERWGWCRRSRRRSSSRRRAGAAPKDDDAAVATGCCIRLWPVGTCPPQAPPRRSKVDTSTSSASTHGAEKSTENGSRNQPVALVVSGSTTTSNAESSSSASKVGEEIKVASQLRKFAFNDLKCATRNFRPESLLGEGGFGCVFKGWIEENGTAPVKPGTGLTVAVKTLNHDGLQGHKEWVAEVDFLGNLHHPNLVRLIGYCVEDDQRLLVYEFMPRGSLDNHLFRRSLPLPWAIRMKVALGAAKGLAFLHEEAERPVIYRDFKTSNILLDAEYNAKLSDFGLAKDGPVGDKTHVSTRVMGTYGYAAPEYVMTGHLTSKSDVYSFGVVLLEMMSGRRSMDKNRPNGEHNLVEWARPLLGERQRFYKLIDPRLEGNFSVKGAQKAAQLARACLSRDPKARPLMSQVVEVLKPLQNLKDMASASYFFQTMQAERSSSMNGRSSHGLKTQSPFGRNGQPPMRSLSDGPRASPFRYSPKPNVK

SEQ ID NO: 15976 - DNA, 1146 bp, Sorghum bicolor
  misc_feature: Ceres ANNOT ID no. 8653672
  misc_feature: Encodes the peptide sequence at SEQ ID NO 15977
atggcgaagcctagcgtggcggcggtgccggaggttgttggcgtgccagcagcagcgcaggcgacgacgctgttcccgtacccgccaccgcgtggcgccgggatcacagccgccgtcgtgcgccgcaagtgcctgcaggtggagctcggcgcgggggcggccgggccgctgctgggcggcgcgtgctggggcgtggagtcgatgcgcgcgtcgtcccccacgcacgccaaggccgccgccgcgctcgccgccggcgtcgacgaggagcgccgcgccgcctggacggtgcggcacccgtcggcgctgggcaagttcgagcagatcgtggcggcgtccgagggcaagcggatcgtcatgttcctcgactacgacggcacgctgtcgcccatcgtggacgaccccgacgccgccttcatgagcgagacgatgcggatggccgtgcgtagcgtcgccaagcatttcccgacggcgatcgtgagcgggcggtgccgggacaaggtgttcgagttcgtgaagctggcggagctgtactacgccggcagccacggcatggacatcagaggcccagccaaggcctcttcccggcacgcaaaggccaaggcaaaaggcgttctgttccagccggcgagcgagttcctgcccatgatcgaggaggtgcacgaccgccttgtcgagacgacgcgctgcatcccgggggccaaggtggagaacaacaagttctgcgtctccgtccacttcagatgcgtcgacgaaaagatgtggggcgagctgtcagagtcggtgaagggcgtgctgcgggagtacccgaagctgcggctgacacaggggcggatggtgttcgaggtgcgtcccaccatcaaatgggacaagggcaaggccctcgagttcctgctcgagtcgctcggcttcgcggactgcagcaacgtcctgcccgtgtacatcggcgacgaccgcaccgacgaggacgccttcaaggtgctgcggcgccggggccagggccacggcgtcgggatcctcgtgtccaagcaccccaaggagacgtccgcctcctactccctccaagagcccgccgaggtgatggagttcttgctgcggctcgtcgagtggaagcaactctccagggcaaggctcatcaggctgcaatga

SEQ ID NO: 15977 - protein, 381 aa, Sorghum bicolor
  misc_feature: Useful for making plants with modulated flowering time
  misc_feature: Useful for making plants with modulated low light sensitivity
  misc_feature: Functional homolog of the protein sequence given in SEQ ID NO 13725
  misc_feature: Useful for making plants with modulated drought sensitivity
  misc_feature: Functional homolog of the protein sequence given in SEQ ID NO 13424
  misc_feature: Useful for making plants with modulated water use efficiency
  misc_feature: Functional homolog of the protein sequence given in SEQ ID NO 13348
  misc_feature: The sequence is a functional homolog of SEQ ID NO 16 in US patent 7214858
  misc_feature: Ceres ANNOT ID no. 8653672
  misc_feature (120)..(331): SWISSPROT Homolog: EC 3.1.3.12 Trehalose-phosphatase
  misc_feature (120)..(357): Pfam ID: Trehalose_PPase Pfam Description: Trehalose-phosphatase
MAKPSVAAVPEVVGVPAAAQATTLFPYPPPRGAGITAAVVRRKCLQVELGAGAAGPLLGGACWGVESMRASSPTHAKAAAALAAGVDEERRAAWTVRHPSALGKFEQIVAASEGKRIVMFLDYDGTLSPIVDDPDAAFMSETMRMAVRSVAKHFPTAIVSGRCRDKVFEFVKLAELYYAGSHGMDIRGPAKASSRHAKAKAKGVLFQPASEFLPMIEEVHDRLVETTRCIPGAKVENNKFCVSVHFRCVDEKMWGELSESVKGVLREYPKLRLTQGRMVFEVRPTIKWDKGKALEFLLESLGFADCSNVLPVYIGDDRTDEDAFKVLRRRGQGHGVGILVSKHPKETSASYSLQEPAEVMEFLLRLVEWKQLSRARLIRLQ

SEQ ID NO: 15978 - DNA, 942 bp, Sorghum bicolor
  misc_feature: Ceres ANNOT ID no. 8653685
  misc_feature: Encodes the peptide sequence at SEQ ID NO 15979
atgctgcggaggacgctgccggcgttgcgctcggtgaaggatggcgcggcagggcaggccggcaaggtcgacgcgcacttcccgtcgctgcgtggacacccggcggcgcgcgccaacgcccgcgaggccgccgaggggcaggcccggctgtccgcggaggaggaggaccgccgcaagcgcgacggcagggcaacgacgacggtgaaggagttccaggtgtaccggtggaacccggactcgccggcggggcggccgttcctgcagtcctacctggtggacctggccagctgcgggcccatggtgctggacgtgctgcagaagatcaaggcggagcaggactcgacgctggcgttccggcggtcgtgccgggagggcatctgcgggtcgtgctccatgagcatcgacggcgtgaacacggtggcgtgcctcaagcccgtggacgcggacacgtcgcggccgagcatggtcacgccgctgccgcacatgtacgtggtcaaggacctcgtcgtggacctcaccaacttctaccagcagtacaggtccgtggagccgtggctcaagaccaagaggagggcgtcgtcggcgtccgagggcgaagcaacgacgacgcgccgcgagcacctgcagtcgccggcgcagcggaagaagctggacgggctgtacgagtgcatcctgtgcgcgtgctgcagcacggcgtgcccgtcctactggtggaactcggaggcgttcctgggccccgccgcgctgctgcacgcctaccgctgggtctccgacagccgggacgactacggccgggagcggatacagtcgctgtcggaagggtgggacaagatgtacaggtgcaggatgatcaagagctgcacggcgacgtgccccaagagcctcgaccccgccgccgccatctccgccatgaaggcattgcaccagctccgcaaggcctga

SEQ ID NO: 15979 - protein, 313 aa, Sorghum bicolor
  misc_feature: Useful for making plants with modulated biomass
  misc_feature: Functional homolog of the protein sequence given in SEQ ID NO 14304
  misc_feature: Ceres ANNOT ID no. 8653685
  misc_feature (7)..(310): SWISSPROT Homolog: EC 1.3.5.1 Succinate dehydrogenase (ubiquinone)
MLRRTLPALRSVKDGAAGQAGKVDAHFPSLRGHPAARANAREAAEGQARLSAEEEDRRKRDGRATTTVKEFQVYRWNPDSPAGRPFLQSYLVDLASCGPMVLDVLQKIKAEQDSTLAFRRSCREGICGSCSMSIDGVNTVACLKPVDADTSRPSMVTPLPHMYVVKDLVVDLTNFYQQYRSVEPWLKTKRRASSASEGEATTTRREHLQSPAQRKKLDGLYECILCACCSTACPSYWWNSEAFLGPAALLHAYRWVSDSRDDYGRERIQSLSEGWDKMYRCRMIKSCTATCPKSLDPAAAISAMKALHQLRKA

SEQ ID NO: 15980 - DNA, 462 bp, Sorghum bicolor
  misc_feature: Ceres ANNOT ID no. 8653750
  misc_feature: Encodes the peptide sequence at SEQ ID NO 15981
atgatgagcagcaacagcggcggcggcgcaggaggctctggcgggggcatgggtccgggagtgggtggaggcggggacgggcggcatgacgatgaggctgcacttaccgagttcctctcatcgctcatggactacacccccacgattcccgacgagctggtggagcactacctcggccgcagcgggttccactgccccgaccttcgcctaacgagactggttgctgtagccacccagaagttcctatcagacattgctagtgattctcttcaacactgcaaggccagggtagcagcacctatcaaagacaataagagcaaacagcctaaggatagacgtcttgtattaaccatggatgatctttctaaagctttgcgtgagcatggtgtgaacttgaaacacccggagtacttcgcagacagcccttcagcaggaatggctccttcgacaagagaggagtag

SEQ ID NO: 15981 - protein, 153 aa, Sorghum bicolor
  misc_feature: Useful for making plants with altered terpenoid content
  misc_feature: Functional homolog of the protein sequence given in SEQ ID NO 12990
  misc_feature: Useful for making plants with altered lignin content
  misc_feature: Functional homolog of the protein sequence given in SEQ ID NO 13033
  misc_feature: Ceres ANNOT ID no. 8653750
  misc_feature (47)..(97): Pfam ID: TFIID_30kDa Pfam Description: Transcription initiation factor TFIID 23-30kDa subunit
MMSSNSGGGAGGSGGGMGPGVGGGGDGRHDDEAALTEFLSSLMDYTPTIPDELVEHYLGRSGFHCPDLRLTRLVAVATQKFLSDIASDSLQHCKARVAAPIKDNKSKQPKDRRLVLTMDDLSKALREHGVNLKHPEYFADSPSAGMAPSTREE

SEQ ID NO: 15982 - DNA, 2586 bp, Sorghum bicolor
  misc_feature: Ceres ANNOT ID no. 8653783
  misc_feature: Encodes the peptide sequence at SEQ ID NO 15983
atggttctgaagtcgtacacaaatctgctagatatgtgttgtgaagatgtgttccaacaacctttaagatctcttcctcatgtggtgacctctcctggcatcatatctgaccctgattgtgaaagtagtaatgatggcaacttggttggttctacgcatatttgttttaagagaaaaattattgttgcaaatttccttcctatgatctgtgcaaaaaatgaagctaccggtgaatggtcctttgccatggatgataatcaacttcttgttcaacttaaagatggttttccaattgataatgaagttatttatgtgggtagcttgaatgttcaagttgatcctagtgagcaagatcgagtttctcaaaagctcttcaaggaacacagatgcatacctacttttctcccagctgacctccagcagcaattctatcacatattctgcaaacagcacctatggccactttttcattatatgcttcctgtttgtcatgacaaaggtgagctctttgatcgctccctttttcaagcctatgtgcgggccaacaaaatttttgctgacaaagttgtggaggcagtcaattcagatgatgattgtgtgtgggttcatgattatcacctcatgcttatcccaacctttttaagaaagaaactgcaccggatcaaagttggtttcttcctccacagcccatttccctcgtctgagatctataggacactgccagtgcgggatgaaattctaaaatcacttcttaatgctgacctcattggctttcaaacttttgactatgcccgccacttcctttcatgttgcagcaggctgttaggccttaattatgagtcaaaacgtggccacataggtatagagtacttcggccgaacagtgagcctcaagattcttgctgcaggtgtacatgttggtcggcttgagtccatgttgaagttgcctgctacaattaacaaggttcaagaaattgagagtagatatagtggcaagttggtaatcttaggtgtagatgacatggacatctttaaaggtatcagtctaaaattgcttggcttggagcttcttctggaaagaacacctaagcttcgagggaaggttgtccttgtacagattgttaatcctgcaagaagcattggaaaagacgttgaggaagcaaaatatgaagctgtatccgtagctcaaaggataaatgataaatatggttctgcgaattacaagcctgttgtcctcattgactattcaatacctttctatgaaaagattgcattttatgctgcatctgactgttgtatcgtaaatgctgtgagggatggcatgaatttgataccctatgagtacactgtatgcaggcagggaaatgaggacattgataagctcagaggtgttaataagagctcatctcacacaagcacacttattgtgtctgaatttgtgggttgctctccatctcttagtggagctttcagggtaaatccttggagtatggaagatgtggctgatgcattatacaatgcaacagatctaacacaatatgagaagaatctgcgccatgaaaagcactatcgctatgtcaggtctcatgatgttgcttactgggcacacagctttgaccaggatctggagagagcatgcagagagcaatatagccaaagatgttggacaactgggtttggtttaaattttagaattattgctctttcacctggattcagaagactgtctctagaacacctaacctcatcttataagaaggctaacaggaggatgatatttctggactatgatgggactcttgtgccgcaggcatcacacgacaaatctccaagtgctgaacttatttctatccttaacagcctgtgcaatgatatgaagaacacagtatttatagtcagtggacgaggaagagattccctaagtgagtggtttgtttcatgcgagaaccttggtattgctgctgaacatggttactttatcagatggaacaaagcagctgaatgggagacaagtttgtcaggtcttcattctgaatggaaactcattgtggagcctatcatgcatttatatatggaaacaactgatgggtccttcatagagcaaaaagagagtgctctggtatggcactatcagaacacagatcatgactttggcttgtgccaggcaaaggagctagtgggccatctggagcgagtcctatcaaatgaacctgttgctgtgaggcgaggccatcagattgtagaagttaaacctcagggagttaacaaggggatttctgtggacaagatcattcagaccatggtcagtaaaggggatgtaccagatcttttgatgtgcatcggaaacgatcgatcggatgaggacatgtttgagagcatcaataaagctacctccctttctgagcctgccattccagaagtatttgcctgttccgttggcccaaaggccagcaaagcaaactactatgtcgatggctgcagcgaagtaatcagattactgaagggtgtcacagccatttcaccccaaaaggatactgtcagccatagccatgcggtcttcaaggatacactcgaggttatcagctga

SEQ ID NO: 15983 - protein, 861 aa, Sorghum bicolor
  misc_feature: Useful for making plants with altered carbohydrate content
  misc_feature: Functional homolog of the protein sequence given in SEQ ID NO 14000
  misc_feature: Ceres ANNOT ID no. 8653783
  misc_feature: Up-regulated in root tissues in response to salicylic acid treatment
  misc_feature (51)..(544): SWISSPROT Homolog: EC 2.4.1.15 Alpha,alpha-trehalose-phosphate synthase (UDP-forming)
  misc_feature (57)..(544): Pfam ID: Glyco_transf_20 Pfam Description: Glycosyltransferase family 20
  misc_feature (593)..(827): Pfam ID: Trehalose_PPase Pfam Description: Trehalose-phosphatase
MVLKSYTNLLDMCCEDVFQQPLRSLPHVVTSPGIISDPDCESSNDGNLVGSTHICFKRKIIVANFLPMICAKNEATGEWSFAMDDNQLLVQLKDGFPIDNEVIYVGSLNVQVDPSEQDRVSQKLFKEHRCIPTFLPADLQQQFYHIFCKQHLWPLFHYMLPVCHDKGELFDRSLFQAYVRANKIFADKVVEAVNSDDDCVWVHDYHLMLIPTFLRKKLHRIKVGFFLHSPFPSSEIYRTLPVRDEILKSLLNADLIGFQTFDYARHFLSCCSRLLGLNYESKRGHIGIEYFGRTVSLKILAAGVHVGRLESMLKLPATINKVQEIESRYSGKLVILGVDDMDIFKGISLKLLGLELLLERTPKLRGKVVLVQIVNPARSIGKDVEEAKYEAVSVAQRINDKYGSANYKPVVLIDYSIPFYEKIAFYAASDCCIVNAVRDGMNLIPYEYTVCRQGNEDIDKLRGVNKSSSHTSTLIVSEFVGCSPSLSGAFRVNPWSMEDVADALYNATDLTQYEKNLRHEKHYRYVRSHDVAYWAHSFDQDLERACREQYSQRCWTTGFGLNFRIIALSPGFRRLSLEHLTSSYKKANRRMIFLDYDGTLVPQASHDKSPSAELISILNSLCNDMKNTVFIVSGRGRDSLSEWFVSCENLGIAAEHGYFIRWNKAAEWETSLSGLHSEWKLIVEPIMHLYMETTDGSFIEQKESALVWHYQNTDHDFGLCQAKELVGHLERVLSNEPVAVRRGHQIVEVKPQGVNKGISVDKIIQTMVSKGDVPDLLMCIGNDRSDEDMFESINKATSLSEPAIPEVFACSVGPKASKANYYVDGCSEVIRLLKGVTAISPQKDTVSHSHAVFKDTLEVIS

SEQ ID NO: 15984 - DNA, 585 bp, Sorghum bicolor
  misc_feature: Ceres ANNOT ID no. 8653805
  misc_feature: Up-regulated in root tissues in response to salicylic acid treatment
  misc_feature: Encodes the peptide sequence at SEQ ID NO 15985
atgtccctcctgctgaaccaccctgccgcgctgacaagagctcaagaagaaatcgatgcatgcatagggcaaccggcggtgcgcctactcgaggcgaccgatctcccaaagctgcactacctttggtgcatcatcatggagacattccgtctatacccgccggcgccgcttctcgttcctcatgaatcctcagctgactgcacggtaagcgggtttcacatacccatggggacaatgctcctggtgaatacgtttgcaatccacagggatcctgaactatgggatagacctgcaagcttcatcccagaaaggtttgagggtgggaatagtgaaggcaagatgttcatcccatttggtatgggaaggagacgatgcccagcggagaacttgggcatgcagatggtaggccttgctctagggactatgatccagtgcttcaattgggaaagagtgggagaggatcttgtggacatgaccgagggatctggtttaacattgcccaaagaggtgccactggaggccttctatgaaccccgcgcttccatggttaatctgctttcggagattgagttagaagtgttgtga

SEQ ID NO: 15985 - protein, 194 aa, Sorghum bicolor
  misc_feature: Useful for making plants with modulated nitrogen use efficiency
  misc_feature: Functional homolog of the protein sequence given in SEQ ID NO 14305
  misc_feature: Ceres ANNOT ID no. 8653805
  misc_feature (1)..(179): SWISSPROT Homolog: EC 1.14.13.89 Isoflavone 2'-hydroxylase
MSLLLNHPAALTRAQEEIDACIGQPAVRLLEATDLPKLHYLWCIIMETFRLYPPAPLLVPHESSADCTVSGFHIPMGTMLLVNTFAIHRDPELWDRPASFIPERFEGGNSEGKMFIPFGMGRRRCPAENLGMQMVGLALGTMIQCFNWERVGEDLVDMTEGSGLTLPKEVPLEAFYEPRASMVNLLSEIELEVL

SEQ ID NO: 15986 - DNA, 648 bp, Sorghum bicolor
  misc_feature: Ceres ANNOT ID no. 8653863
  misc_feature: Encodes the peptide sequence at SEQ ID NO 15987
atggcgcggcggggcacggaggcgttcccgagcctgggcgcgcactgcgacgagcccgactgcaaccagctcgacttcctgcccttcgactgcgacggctgcggcaaggtcttctgcgccgcgcaccggacctaccgggaccacggctgcgccaaggcggcggaccagggccgcaccgtcgtcgtctgcccggactgcggcgactccatcgagaggctcgtcccggggcaggacgagcgggagatcctggcggcgcacgcgcggtcgcggcgctgcgacccggccaagaatcgcaagccccggtgccccgcgcgccggtgcaaggagcagctcaccttctccaacacccaccactgcaagggctgcgttcccggccgaccacgactgcgccgccagcgcacgcgccgcggcgggggcggcggcggcggcggcgaggagggccggcggggagtgcggccgtggcgcgcggaaggaagggaacggcggcggctgggcgctgccggcgtccatccggagcctcaagatcttttgaggcctgcctggggggatggggcgtgccattctgtcacgttgcagccacgtcttcagcagcgaaaaaaactgctcgtccagatgggatgccgaccatgcggtccacatattccatag

SEQ ID NO: 15987 - protein, 215 aa, Sorghum bicolor
  misc_feature: Useful for making plants with altered alkaloid content
  misc_feature: Useful for making plants with altered terpenoid content
  misc_feature: Functional homolog of the protein sequence given in SEQ ID NO 14306
  misc_feature: Ceres ANNOT ID no. 8653863
  misc_feature (16)..(58): Pfam ID: zf-AN1 Pfam Description: AN1-like Zinc finger
MARRGTEAFPSLGAHCDEPDCNQLDFLPFDCDGCGKVFCAAHRTYRDHGCAKAADQGRTVVVCPDCGDSIERLVPGQDEREILAAHARSRRCDPAKNRKPRCPARRCKEQLTFSNTHHCKGCVPGRPRLRRQRTRRGGGGGGGGEEGRRGVRPWRAEGRERRRLGAAGVHPEPQDLLRPAWGDGACHSVTLQPRLQQRKKLLVQMGCRPCGPHIP

SEQ ID NO: 15988 - DNA, 1119 bp, Sorghum bicolor
  misc_feature: Ceres ANNOT ID no. 8653879
  misc_feature: Encodes the peptide sequence at SEQ ID NO 15989
atggaagagcagcaacaacaggagatgaatactgctagcattggcggaggcctcaccctacctccagggttccgcttccacccaagtgacaatgagattgtcagcatctacctcatgaacaaggtgcataataggggtttcaccagcacaatcattgcagaggtcgacctaaacaagacagagccatgggaccttccacaggaggcaaaaataggcgagaaagagtggtacttcttctaccagaaggaccgaaagtacccatcaggcctaagggcaaacagggccacaaagggcggttactggaaagcaaccggcagggacaaggaggtcgacaataccacacaaggggtggtgttgctcattggcatgaagaagacacttgtcttctacaggggcaaggctcccaagggtgacaaaacaaactgggtgatgcacgagtacaggctcgaagggagcagtaggctccccgacccggcatctgcatctagctcggcctcaaacgtcttggccatgaaagcttcagcttccaaggatgagtgggtggtctgtcgtgtgtttgacaagaccactagtatcaagaagatgactacaccagtgtacaaggtggccatggctagcgctgagattggtcagaatcagaacaacaccccggccatccccatccccatgcccctacagcagccgctacccgtgcccatgccgatggaatctcccatcctacgagacttcgccacatgcccagtggcaccctattttcccaacactggtgcggacatgccacccatgatgtcgtctatggaaggtatcgatggcaccagcagcctccaaatcaatgacaccctatttggcaattcgatagcaacgccgccgcagatggacttgtaccaccatatgggcatgggggttgcagctgtccatatgggcattggggtagctggccagatggatatggcagcaactggcactgatggctttgatcttgctacgcctatgccgccctcgatggcatcacagaaggacgagcaggctaatgtcgctaagatgtggtcgatgatgtctgttgctggcccagggtctgtgaaccccagcactgagagggatgacatatggaagtactaa

SEQ ID NO: 15989 - protein, 372 aa, Sorghum bicolor
  misc_feature: The sequence is a functional homolog of SEQ ID NO 2346 in the 10/374,780 US patent application
  misc_feature: The sequence is a functional homolog of SEQ ID NO 238 in the 10/225,068 US patent application
  misc_feature: The sequence is a functional homolog of SEQ ID NO 338 in the 10/412,699 US patent application
  misc_feature: The sequence is a functional homolog of SEQ ID NO 774 in the 11/479,226 US patent application
  misc_feature: The sequence is a functional homolog of SEQ ID NO 476 in the 10/666,642 US patent application
  misc_feature: Useful for making plants with altered lignin content
  misc_feature: Functional homolog of the protein sequence given in SEQ ID NO 13250
  misc_feature: Useful for making plants with altered carbohydrate content
  misc_feature: Functional homolog of the protein sequence given in SEQ ID NO 13622
  misc_feature: The sequence is a functional homolog of SEQ ID NO 2470 in the 10/374,780 US patent application
  misc_feature: The sequence is a functional homolog of SEQ ID NO 798 in the 10/225,066 US patent application
  misc_feature: Useful for making plants with altered cell wall content and/or composition
  misc_feature: Functional homolog of the protein sequence given in SEQ ID NO 13620
  misc_feature: The sequence is a functional homolog of SEQ ID NO 2060 in the 10/374,780 US patent application
  misc_feature: The sequence is a functional homolog of SEQ ID NO 516 in the 10/412,699 US patent application
  misc_feature: Useful for making plants with modulated nitrogen use efficiency
  misc_feature: Functional homolog of the protein sequence given in SEQ ID NO 13624
  misc_feature: Ceres ANNOT ID no. 8653879
  misc_feature (20)..(150): Pfam ID: NAM Pfam Description: No apical meristem (NAM) protein
MEEQQQQEMNTASIGGGLTLPPGFRFHPSDNEIVSIYLMNKVHNRGFTSTIIAEVDLNKTEPWDLPQEAKIGEKEWYFFYQKDRKYPSGLRANRATKGGYWKATGRDKEVDNTTQGVVLLIGMKKTLVFYRGKAPKGDKTNWVMHEYRLEGSSRLPDPASASSSASNVLAMKASASKDEWVVCRVFDKTTSIKKMTTPVYKVAMASAEIGQNQNNTPAIPIPMPLQQPLPVPMPMESPILRDFATCPVAPYFPNTGADMPPMMSSMEGIDGTSSLQINDTLFGNSIATPPQMDLYHHMGMGVAAVHMGIGVAGQMDMAATGTDGFDLATPMPPSMASQKDEQANVAKMWSMMSVAGPGSVNPSTERDDIWKY

SEQ ID NO: 15990 - DNA, 1032 bp, Sorghum bicolor
  misc_feature: Ceres ANNOT ID no. 8653921
  misc_feature: Encodes the peptide sequence at SEQ ID NO 15991
atggcgtctcccccgctgctgctgctgctgccgatgcacgcgctcgccgtagtcctcgtgctcgccctgtccgcccgcggcgccgaggccaggccgccgccgccgctccacggcgtgcgcccgctcgccttcgacgaggggtacacccagatcttcggcagcgccaacctcgcgctcctccgcgacggccggcgcgtccgcctcacgctcgacgagtccaccggcgccgggttcgcatcgcaggacgtcttcctccacggcttcttcagcgccgccatcaagctgcccgccgactacgcggcgggcgtcgtcgtcgcgttctacctgtccaacggcgacgtgtacgagaagacgcacgacgagctggacttcgagttcctgggcaacgtgcgcgggcgcgagtggcgggtgcagaccaacgtgtacggcaacggcagcacccacgccggccgggaggagcgctacgacctccccttcgaccccaccgacgacttccaccactactccatcctctggaccaacgaccgcatcatcttctacgtcgacgagactccgatcagggaggtggtgcggacgtcggcgatgggcgcggcgttcccgtccaagcccatgtccctgtacgccaccatctgggacggctcctcctgggcgacgctgggcggccggtaccgcgtcaactacaagtacgcgccgttcgtggccgagttcgccgacctcgccatccagggctgcgccgtcgaccccaccgacctctcctcggcctccgcggcggcgtcgtgcggcgcgggcctgggcgcgctcgccgtgtccgtgtccgcggagcagctcgcggccatggcggcgttccggcgcgcccacacctcctactcctactgccacgaccggcggcggtaccccgtggcgctgtcggagtgcgggtccggcaaggggctcctccccagccgcatgttcggccccgacgggatgaagcagcaccggcgccacagggccgcgccgcgcggtcaccgtggcgcccaggacgacgtcatgtga

SEQ ID NO: 15991 - protein, 343 aa, Sorghum bicolor
  misc_feature: Useful for making plants with altered carbohydrate content
  misc_feature: Functional homolog of the protein sequence given in SEQ ID NO 14227
  misc_feature: Useful for making plants with altered cell wall content and/or composition
  misc_feature: Functional homolog of the protein sequence given in SEQ ID NO 14228
  misc_feature: Ceres ANNOT ID no. 8653921
  misc_feature (44)..(305): SWISSPROT Homolog: EC 2.4.1.207 Xyloglucan:xyloglucosyl transferase
  misc_feature (44)..(229): Pfam ID: Glyco_hydro_16 Pfam Description: Glycosyl hydrolases family 16
  misc_feature (260)..(305): Pfam ID: XET_C Pfam Description: Xyloglucan endo-transglycosylase (XET) C-terminus
MASPPLLLLLPMHALAVVLVLALSARGAEARPPPPLHGVRPLAFDEGYTQIFGSANLALLRDGRRVRLTLDESTGAGFASQDVFLHGFFSAAIKLPADYAAGVVVAFYLSNGDVYEKTHDELDFEFLGNVRGREWRVQTNVYGNGSTHAGREERYDLPFDPTDDFHHYSILWTNDRIIFYVDETPIREVVRTSAMGAAFPSKPMSLYATIWDGSSWATLGGRYRVNYKYAPFVAEFADLAIQGCAVDPTDLSSASAAASCGAGLGALAVSVSAEQLAAMAAFRRAHTSYSYCHDRRRYPVALSECGSGKGLLPSRMFGPDGMKQHRRHRAAPRGHRGAQDDVM

SEQ ID NO: 15992 - DNA, 1629 bp, Sorghum bicolor
  misc_feature: Ceres ANNOT ID no. 8653890
  misc_feature: Encodes the peptide sequence at SEQ ID NO 15993
atgagccggggccgcgcacgccggcggccggttcctggcagcgtcgacatccgcttcggcgcgctcctcctcctcctcctcctggcgtccgccgtcctgctggcagcagcgtcgtcgtcggaggaggaggaggtggactacggggcggcgctgtccaagagcctgctctacttcgaggcgcagcggtcggggcgcctgccgcacaaccagcgcgtgccgtggcgtggccactcgggcctcaccgacgggctgcagcaaggggtggacctcgtcggcggctactacgacgccggggaccacgtcaagttcggcctgcccatggccttcaccgtcaccatgctctcctggggcgccatcgacttcgccgacgacgtcgccgccgccggcgagtggggccacacgctcgaggccatcaagtggggcaccgactacttcgtcaaggcgcacacagagcccttcgtctactgggcagaggtgggggacggcgacacggaccactactgctggcagcggcccgaggacatgacgacgtcgcggcaggcgtaccgtatcgacaaggacaacccgggctccgacctcgccggcgagaccgccgccgcgctcgccgcggcatccatcgtgttccgccgctccaacccgcattactcccacctcctcctgcaccacgcccagcagctgttcgagttcggcgaccggtaccgcggcacgtacgacagcagcatcgcggaggtgcgcagctactacgcgtccgtgagcgggtaccaggacgagctgctgtgggcggcgctgtggctgcaccgcgccacgggacgcgacgactacctccgctacgccgtcgacaaggccgagtccttcggcggcgtcggctgggccatgaccgagttcagctgggacgtcaagtacgccggcgtccaggtcctcgcagccaagctgctgctggagggcgatccgggagccctgaagcacggcgcggtgctggagcagtacaaggcgaaggcggagcactacctgtgcgcgtgcctgggccggaacggcggcggcaacggcagcgacaacgtggagcggagccccggcgggatgctgtacgtgcggcagtggaacaacctccagtacgtctccagcgccgccttcctcctcaccgcctactcccgctacctctccgactccggcggcggcggcctcctcctccgctgccccgcgggcggcggccccgccgcgccgtccgacctgctggccctggcgcgctcgcaggcggactacatcctgggccgcaacccgctgcggctcagctacatggtcggctacggccgccggtacccggtccgcgtgcaccaccgcggcgcctccatcgtcgcgcacaaggccaacagccgcttcatcggctgcatgcaggggttcgacgactggttcggccggggacggcccaaccccaacgtgctcgccggcgccatcgtcggcgggcccaactgcagggacgagttccgggacgaccgcgggaactacatgcagaccgaggcgtgcacctacaacacggcgcccatggtcggcgtcttcgccaggctgcaccgcctcgcgacggcggaggggtgccgccggagagggatggccgatgaggcggagtgtagataa

SEQ ID NO: 15993 - protein, 542 aa, Sorghum bicolor
  misc_feature: Useful for making plants with altered carbohydrate content
  misc_feature: Functional homolog of the protein sequence given in SEQ ID NO 13874
  misc_feature: Useful for making plants with altered cell wall content and/or composition
  misc_feature: Useful for making plants with altered lignin content
  misc_feature: Functional homolog of the protein sequence given in SEQ ID NO 13875
  misc_feature: Ceres ANNOT ID no. 8653890
  misc_feature (48)..(527): SWISSPROT Homolog: EC 3.2.1.4 Cellulase
  misc_feature (46)..(519): Pfam ID: Glyco_hydro_9 Pfam Description: Glycosyl hydrolase family 9
MSRGRARRRPVPGSVDIRFGALLLLLLLASAVLLAAASSSEEEEVDYGAALSKSLLYFEAQRSGRLPHNQRVPWRGHSGLTDGLQQGVDLVGGYYDAGDHVKFGLPMAFTVTMLSWGAIDFADDVAAAGEWGHTLEAIKWGTDYFVKAHTEPFVYWAEVGDGDTDHYCWQRPEDMTTSRQAYRIDKDNPGSDLAGETAAALAAASIVFRRSNPHYSHLLLHHAQQLFEFGDRYRGTYDSSIAEVRSYYASVSGYQDELLWAALWLHRATGRDDYLRYAVDKAESFGGVGWAMTEFSWDVKYAGVQVLAAKLLLEGDPGALKHGAVLEQYKAKAEHYLCACLGRNGGGNGSDNVERSPGGMLYVRQWNNLQYVSSAAFLLTAYSRYLSDSGGGGLLLRCPAGGGPAAPSDLLALARSQADYILGRNPLRLSYMVGYGRRYPVRVHHRGASIVAHKANSRFIGCMQGFDDWFGRGRPNPNVLAGAIVGGPNCRDEFRDDRGNYMQTEACTYNTAPMVGVFARLHRLATAEGCRRRGMADEAECR

SEQ ID NO: 15994 - DNA, 1068 bp, Sorghum bicolor
  misc_feature: Ceres ANNOT ID no. 8653893
  misc_feature: Encodes the peptide sequence at SEQ ID NO 15995
atgagccggggccgcgcacgccggcggccggttcctggcagcgtcgacatccgcttcggcgcgctcctcctcctcctcctcctggcgtccgccgtcctgctggcagcagcgtcgtcgtcggaggaggaggaggtggactacggggcggcgctgtccaagagcctgctctacttcgaggcgcagcggtcggggcgcctgccgcacaaccagcgcgtgccgtggcgtggccactcgggcctcaccgacgggctgcagcaaggggtggacctcgtcggcggctactacgacgccggggaccacgtcaagttcggcctgcccatggccttcaccgtcaccatgctctcctggggcgccatcgacttcgccgacgacgtcgccgccgccggcgagtggggccacacgctcgaggccatcaagtggggcaccgactacttcgtcaaggcgcacacagagcccttcgtctactgggcagaggtgggggacggcgacacggaccactactgctggcagcggcccgaggacatgacgacgtcgcggcaggcgtaccgtatcgacaaggacaacccgggctccgacctcgccggcgagaccgccgccgcgctcgccgcggcatccatcgtgttccgccgctccaacccgcattactcccacctcctcctgcaccacgcccagcagctgttcgagttcggcgaccggtaccgcggcacgtacgacagcagcatcgcggaggtgcgcagctactacgcgtccgtgagcgggtaccaggacgagctgctgtgggcggcgctgtggctgcaccgcgccacgggacgcgacgactacctccgctacgccgtcgacaaggccgagtccttcggcggcgtcggctgggccatgaccgagttcagctgggacgtcaagtacgccggcgtccaggtcctcgcagccaaggaatgcaggacagtgccgctcgctgctgctgtgcccgcatcgcaccgtacgcaacgcacatcagtttcgacgatggatgcatggagggctcatggctggccctggccgggttcgttcgtggttagcaacggaagttaa

SEQ ID NO: 15995 - protein, 355 aa, Sorghum bicolor
  misc_feature: Useful for making plants with altered carbohydrate content
  misc_feature: Functional homolog of the protein sequence given in SEQ ID NO 13874
  misc_feature: Useful for making plants with altered cell wall content and/or composition
  misc_feature: Useful for making plants with altered lignin content
  misc_feature: Functional homolog of the protein sequence given in SEQ ID NO 13875
  misc_feature: Useful for biocontainment applications
  misc_feature: Useful for making plants with modulated nitrogen use efficiency
  misc_feature: Functional homolog of the protein sequence given in SEQ ID NO 13445
  misc_feature: Ceres ANNOT ID no. 8653893
  misc_feature (48)..(310): SWISSPROT Homolog: EC 3.2.1.4 Cellulase
  misc_feature (46)..(354): Pfam ID: Glyco_hydro_9 Pfam Description: Glycosyl hydrolase family 9
MSRGRARRRPVPGSVDIRFGALLLLLLLASAVLLAAASSSEEEEVDYGAALSKSLLYFEAQRSGRLPHNQRVPWRGHSGLTDGLQQGVDLVGGYYDAGDHVKFGLPMAFTVTMLSWGAIDFADDVAAAGEWGHTLEAIKWGTDYFVKAHTEPFVYWAEVGDGDTDHYCWQRPEDMTTSRQAYRIDKDNPGSDLAGETAAALAAASIVFRRSNPHYSHLLLHHAQQLFEFGDRYRGTYDSSIAEVRSYYASVSGYQDELLWAALWLHRATGRDDYLRYAVDKAESFGGVGWAMTEFSWDVKYAGVQVLAAKECRTVPLAAAVPASHRTQRTSVSTMDAWRAHGWPWPGSFVVSNGS

SEQ ID NO: 15996 - DNA, 357 bp, Sorghum bicolor
  misc_feature: Ceres ANNOT ID no. 8653950
  misc_feature: Encodes the peptide sequence at SEQ ID NO 15997
atggactacaaagcgcgctggccgccgccagccggcggctttaagcagctgagagccaacactgctgggagcagggttcagagagacgacgacgacgtcacgatcaaggtgctcttctgcgggctttgccacaccaacctccacgtcatcaagaacgagtttggaaacaccatgtaccttgtcgtccccggacatgaggtcatcggcgtcgtcacggacgtcggccgtggcgtgaccaagttcaaggctggcgacacggccaaacgaacgaggcctaagtgtttaggcaccctcaattccaagttgtcctggttggagtacgcagccattgcatgtcatgcagattggagattctag

SEQ ID NO: 15997 - protein, 118 aa, Sorghum bicolor
  misc_feature: Useful for making plants with altered cell wall content and/or composition
  misc_feature: Functional homolog of the protein sequence given in SEQ ID NO 14307
  misc_feature: The sequence is a functional homolog of SEQ ID NO 2 in US patent 7288696
  misc_feature: Ceres ANNOT ID no. 8653950
  misc_feature (31)..(86): SWISSPROT Homolog: EC 1.1.1.195 Cinnamyl-alcohol dehydrogenase
  misc_feature (30)..(112): Pfam ID: ADH_N Pfam Description: Alcohol dehydrogenase GroES-like domain
MDYKARWPPPAGGFKQLRANTAGSRVQRDDDDVTIKVLFCGLCHTNLHVIKNEFGNTMYLVVPGHEVIGVVTDVGRGVTKFKAGDTAKRTRPKCLGTLNSKLSWLEYAAIACHADWRF

SEQ ID NO: 15998 - DNA, 2919 bp, Sorghum bicolor
  misc_feature: Ceres ANNOT ID no. 8653930
  misc_feature: Encodes the peptide sequence at SEQ ID NO 15999
atggtgtcgagatcctactccaacctcctggagctcgcctccggcggcagcggcagcggcagcgacccgctgccgcagctggggcgccgacggatacctcgcgtggtgacggcgtccggcattgtgccggacctcgacgtctccgacgacgacgcggacgcggacgccgcctccgcggcctccgaccactcctcgcacgcgccgcgggagcgcgtcatcatcgtcgccaaccagctcccggtgcgcgcctcccgccgcgccgccggcggcggcggctgggacttcgcgtgggaccaggacagcctcctgctgcaggtcaaggacagcctccgcgcgcaccacggccgcgcggacatggagttcgtctacgtcggcggcctccgcgacgacgtgccgcccgcggagcacgacgaggtcgcgcacgagctcctcgagggcttcggctgcgtgcccaccttcctgcccgccgacctccgctcccgcttctaccacggcttctgcaagcagcagctctggccactgttccattacatgctgccactgtcgccggagctaggtggccgcttcgaccgcctcctgtggcaggcctacgtttcggtcaacaagatcttcgccgacaagatcctggaggtgatcagccccgacgaagacttcgtgtgggtgcacgattaccatctcatggtgctcccgacgttcctgcgcaagcgcttcaaccgggtcaagcttggcttcttcctccatagcccgttcccgtcctcggagatctacaagaccctgcctgtgcgtgaggagctgctccggtcgctgctgaatgccgatctgattgggttccacacttttgattatgccagacacttcttgtcatgttgcagcaggatgctcggattgaagtatgagtcgcagaggggctacattgctctggagtattacggtcggacagttactatcaagatcttgcctgtgggagttcacttggagcagttacagtcagtcctcaacctcccggagcttggggtcaaggttggcgagcttctgaaacagttccgtcatcggaatcggctgctgttgcttggtgttgatgacatggatatctttaaaggaattagtttgaagcttttggcatttgagcagctcctgatgcagcatccagaatggcggggaagggtggtgcttgttcagattgccaatccagcaagggggcgaggaaaggatgtgaaggaggtacaggaagagagtgatgcgatggtgaagcgcatcaacgatgcattcgggcagccagattaccagccggtgatactgatcgataagcctctgcagttctatgagaggatggcttactatgttgtcgcggagtgctgtttggttactgcagtgagggatggcatgaatctgatcccatatgagtacataattgctcgacaagggaatgagaagatagatagtatcctaggtcttggcccggcttcaaggaagaagagcatgcttgttgtgtcagagttcatcgggtgctcgccctcactgagcggtgctatccgtgtgaacccttggaacattgattcagtggccgacgcaatggactatgcattggagatgcctgaaggggagaaggtgttgagacatgagaagcatcacagatatgtgagcacacatgatgttgggtactgggctaacagcttcctgcaagatcttgagcggatttgcctggaccataacaggaggcgttgctggggcataggatttgggctaaagttcagggtcgtagcgctggatccaaacttcaagaagcttgcggttgagcacttggtctcggcctaccggaggacaacaaagcgcgtcattctcttggactatgatgggacgctgatgcctcagacttcgttcggtaagagtcctacctcaaggacgatagaggtgttgaacagcctttgccgtgacaagaacaacatggtcttccttgtgagtgcaaagagccggatgactttaaacgagtggttcttaccatgtgagagccttgggctagcagctgagcacggctacttcctcaggctgagaagagatgcagaatgggagacagcatgcgttcctgcgatagactgcagctggaagcaaatcgcagaacctgtgatgaagacctatactgagactacagacgggtcgacaattgagaacaaggaaaccgctatcgtttggtgctacgaggatgctgatcctgatttcggatcttgccaggccaaggagctccacgagcatctcgagagtgtgctttcaaacgagccggtatcagtgaaagctggacccaaccttgttgaggtgaagccacagggcgtaagcaagggcctggtggcgaagcggatcctctccacgatgcaggagcggggcgacctgccggacttcgtcctgtgcgtgggcgacgaccggtccgacgaggacatgttcgaggtgatcacgacggcggcgaggggagtgtccctgcaggccgaggcggaggtgtttgcgtgcacggtggggcgcaagcccagcaaggccaagtactaccttgacgaccccgcggacatcgtgcgcctcgtccagggcctcgccaacgtctccgacgacgaccagacgcacgccccgccactcccgacggacaccgtaccgagctgtacttggatacagtacagaatacacatgcccggggtgcgacacggtagtgatcgtgtcgtgcctgtgcaggccaacaactgcggggatctctttctccagtgcgaactagttagtgcctttgcggttggagacgctagcgctggcgtgtggcgtctttgcctccgtgtctcgtcggtcccatcatcgcaaggactactacaagatcccgacgccgccgacgaggggtgggcgatgacatccgccgtggcgtcaacacgcacgcgggtgagtgagtga

SEQ ID NO: 15999 - protein, 972 aa, Sorghum bicolor
  misc_feature: Useful for making plants with altered carbohydrate content
  misc_feature: Functional homolog of the protein sequence given in SEQ ID NO 13884
  misc_feature: Ceres ANNOT ID no. 8653930
  misc_feature: Down-regulated in shoot tissues in response to aminocyclopropane carboxylic treatment
  misc_feature: Down-regulated in shoot tissues in response to salicylic acid treatment
  misc_feature: Up-regulated in shoot tissues in response to methyl jasmonate treatment
  misc_feature: Up-regulated in root tissues in response to methyl jasmonate treatment
  misc_feature: Up-regulated in root tissues in response to salicylic acid treatment
  misc_feature (151)..(564): SWISSPROT Homolog: EC 3.1.3.12 Trehalose-phosphatase
  misc_feature (70)..(565): Pfam ID: Glyco_transf_20 Pfam Description: Glycosyltransferase family 20
  misc_feature (614)..(850): Pfam ID: Trehalose_PPase Pfam Description: Trehalose-phosphatase
MVSRSYSNLLELASGGSGSGSDPLPQLGRRRIPRVVTASGIVPDLDVSDDDADADAASAASDHSSHAPRERVIIVANQLPVRASRRAAGGGGWDFAWDQDSLLLQVKDSLRAHHGRADMEFVYVGGLRDDVPPAEHDEVAHELLEGFGCVPTFLPADLRSRFYHGFCKQQLWPLFHYMLPLSPELGGRFDRLLWQAYVSVNKIFADKILEVISPDEDFVWVHDYHLMVLPTFLRKRFNRVKLGFFLHSPFPSSEIYKTLPVREELLRSLLNADLIGFHTFDYARHFLSCCSRMLGLKYESQRGYIALEYYGRTVTIKILPVGVHLEQLQSVLNLPELGVKVGELLKQFRHRNRLLLLGVDDMDIFKGISLKLLAFEQLLMQHPEWRGRVVLVQIANPARGRGKDVKEVQEESDAMVKRINDAFGQPDYQPVILIDKPLQFYERMAYYVVAECCLVTAVRDGMNLIPYEYIIARQGNEKIDSILGLGPASRKKSMLVVSEFIGCSPSLSGAIRVNPWNIDSVADAMDYALEMPEGEKVLRHEKHHRYVSTHDVGYWANSFLQDLERICLDHNRRRCWGIGFGLKFRVVALDPNFKKLAVEHLVSAYRRTTKRVILLDYDGTLMPQTSFGKSPTSRTIEVLNSLCRDKNNMVFLVSAKSRMTLNEWFLPCESLGLAAEHGYFLRLRRDAEWETACVPAIDCSWKQIAEPVMKTYTETTDGSTIENKETAIVWCYEDADPDFGSCQAKELHEHLESVLSNEPVSVKAGPNLVEVKPQGVSKGLVAKRILSTMQERGDLPDFVLCVGDDRSDEDMFEVITTAARGVSLQAEAEVFACTVGRKPSKAKYYLDDPADIVRLVQGLANVSDDDQTHAPPLPTDTVPSCTWIQYRIHMPGVRHGSDRVVPVQANNCGDLFLQCELVSAFAVGDASAGVWRLCLRVSSVPSSQGLLQDPDAADEGWAMTSAVASTRTRVSE

SEQ ID NO: 16000 - DNA, 1719 bp, Sorghum bicolor
  misc_feature: Ceres ANNOT ID no. 8653949
  misc_feature: Down-regulated in shoot tissues in response to aminocyclopropane carboxylic treatment
  misc_feature: Down-regulated in shoot tissues in response to salicylic acid treatment
  misc_feature: Up-regulated in shoot tissues in response to methyl jasmonate treatment
  misc_feature: Up-regulated in root tissues in response to methyl jasmonate treatment
  misc_feature: Up-regulated in root tissues in response to salicylic acid treatment
  misc_feature: Encodes the peptide sequence at SEQ ID NO 16001
atgggtgagggaaccgtttctctgtttcggtgggtttaccccgcggtctcccccacgatatcagcccggcccttaccccttcgacttcctcgcctcagccctcattcattcacctcccttctctctcacccgaagtccgctccgttccccgagctctccgtcgtcttggccgaggctcccccgagctcgatgtcggacgcgccggaagctggagggtcaagcgcgatgcggcgcagtctccgtcgctacgaaggtgccaccgggtgcccatgcttctccgaccgtgaagagccacggcgtggtccggccgccgttgtccacagcgacgacacagcgtcgaggatgcaatctgacaacagcgacagtgcggttcctgacgcggtcctagagccagagtggtcaggcttgggcattgttcgtatacccaagtgtgctcattctcgccatgcgacgctgaagaaggcaatcggtggcaagcacgcaggccgccgcttcctggggctccctgttcgcctatttaagctgtgctcggaagttaccaacggcgtaccacacctagagcttcattcttctgaacggaaaagccaagcaaggttgaagaggcagatcaagcgagctctaatagttttcatggatatggagcagggctgcaagacggctcacgggtgggctgccagggatgcctccggccacctctccccttacagcttctcagcaaggattcagggggacgccgacgtgacgatcaaggtgctcttctgtggcatctgccacacggacctccacgtcatcaagaacgagtggggcaacgcaatgtaccccgtcgtcccagggcacgaggtcgtcggcgtcgtcacggacgtcggccatggcgtcaccaagttcaaggctggggacacggtgggcgtgggctacttcgtcgactcctgccggacctgcgagagctgcagcacggggcacgagaactactgccctgacctcgtcctcacctccaacggcgtggaccaccaccaccacggcgccaccaccaagggaggcttctccgacgtgctcgtcgtcagccaggacttcgtcgtccgcgtcccggagagcctccctctcgacggcgccgcgccgctgctctgcgccggggtcaccgtgtacagccccatggcgcagtacgcgctcaacgagcccggcaagcacctcggcgtcgtcggtctcggtggcctaggccacatggccgtcaagttcgccaaggcgttcggcatgacggtcaccgtcatcagctcgtcgcccggcaagcgcgacgaggcgctcggacgccttggcgccgacgcgttcttggtcagccacgacgccgcgcaaatgaaggcagcagcggccacgttggacggcatcatcgacacggtgtcagcggggcaccagatcgtgccgctgctggcgctactgaagcccatggggcagatggtggtcgtcggcgcgccaagcacgccgctggagctgccggcgtacgccatcatcaccggcgggaagcgggtggccgggaacggcgtggggagtgtcgccgactgccaggcgatgctggacttcgcaggagagcatggcgtcaccgctgacattgaggtggtgcagatggactacgtcaacacagcgatcgagcggctcgagaagaacgatgtgaggtatcgcttcgtcattgacgtcgcgggcagcaagatggaggagaccgttgcttaa

SEQ ID NO: 16001 - protein, 572 aa, Sorghum bicolor
  misc_feature: The sequence is a functional homolog of SEQ ID NO 2 in US patent 7288696
  misc_feature: Useful for making plants with altered cell wall content and/or composition
  misc_feature: Functional homolog of the protein sequence given in SEQ ID NO 14308
  misc_feature: Ceres ANNOT ID no. 8653949
  misc_feature (212)..(571): SWISSPROT Homolog: EC 1.1.1.255 Mannitol dehydrogenase
  misc_feature (244)..(361): Pfam ID: ADH_N Pfam Description: Alcohol dehydrogenase GroES-like domain
  misc_feature (392)..(527): Pfam ID: ADH_zinc_N Pfam Description: Zinc-binding dehydrogenase
MGEGTVSLFRWVYPAVSPTISARPLPLRLPRLSPHSFTSLLSHPKSAPFPELSVVLAEAPPSSMSDAPEAGGSSAMRRSLRRYEGATGCPCFSDREEPRRGPAAVVHSDDTASRMQSDNSDSAVPDAVLEPEWSGLGIVRIPKCAHSRHATLKKAIGGKHAGRRFLGLPVRLFKLCSEVTNGVPHLELHSSERKSQARLKRQIKRALIVFMDMEQGCKTAHGWAARDASGHLSPYSFSARIQGDADVTIKVLFCGICHTDLHVIKNEWGNAMYPVVPGHEVVGVVTDVGHGVTKFKAGDTVGVGYFVDSCRTCESCSTGHENYCPDLVLTSNGVDHHHHGATTKGGFSDVLVVSQDFVVRVPESLPLDGAAPLLCAGVTVYSPMAQYALNEPGKHLGVVGLGGLGHMAVKFAKAFGMTVTVISSSPGKRDEALGRLGADAFLVSHDAAQMKAAAATLDGIIDTVSAGHQIVPLLALLKPMGQMVVVGAPSTPLELPAYAIITGGKRVAGNGVGSVADCQAMLDFAGEHGVTADIEVVQMDYVNTAIERLEKNDVRYRFVIDVAGSKMEETVA

SEQ ID NO: 16002 - DNA, 1083 bp, Sorghum bicolor
  misc_feature: Ceres ANNOT ID no. 8653951
  misc_feature: Encodes the peptide sequence at SEQ ID NO 16003
atggagcaagtaagcaaggcggcgctcgggtgggctgcgagggacgcctccggacacctctccccttacagcttctcgagggttctgagagacggcgacgtgacgatcaaggtgctcttctgcggggtctgccacaccgacctccacatcatcaagaacgagtggggcaacgcactgtaccccgtcgttcccgggcacgaggtcgtcggcgtcgtcacggacgtcggcgccggcgtgaccaagttcaaggccggcgacacggtgggcgtgggctacttcatcgactcgtgccgcacctgcgagagctgcagcacggggcacgagaactactgccccgacctcgtcctcacctccaacggcgtagcccgcgacggcggcgtgacgacgacgacgaccacgcagggtggcttctccgacgtggtggtggtggaccagcactacgtcgtcagggtccccgcgagcctgcctccggacggggccgcgccgctgctctgcgccggcgtcacggtgtacagccccatggtggagtacggcctcaacgtgcccgggaagcgcctcggcgtcgtgggactcggtggcctcggccacatcgccgtcaagttcggcaaggcgttcgggatggcggtcacggtgatcagctcgtcccctgccaagcgtggagaggccatcgagcgccttggcgccgacgagttcttggtcagccgcgacaccgagcagatgaaggcggcggcaggcacgatggacggcatcatcgacacggtgtcagcggggcacccgatcgtgccgctgctggcgctactgaagcccatggggcagatggtgatcgtcggcgcgccaagcacgccgctggagctgccggcgtacgccatcatcacgggcgggaagcgggtggccgggaacggagtggggagtatcgccgactgccaggcgatgctggacttcgcggggcagcacggcatcaccgcggacatcgagctcgttaggatggactacgtcaacacggccatggagcggctggagaggaacgacgtcaggtaccggttcgtcgttgatgtcgctggcagtctgggcgccgctgcttaa

SEQ ID NO: 16003 - protein, 360 aa, Sorghum bicolor
  misc_feature: The sequence is a functional homolog of SEQ ID NO 2 in US patent 7288696
  misc_feature: Useful for making plants with altered cell wall content and/or composition
  misc_feature: Functional homolog of the protein sequence given in SEQ ID NO 14308
  misc_feature: Ceres ANNOT ID no. 8653951
  misc_feature (8)..(356): SWISSPROT Homolog: EC 1.1.1.255 Mannitol dehydrogenase
  misc_feature (31)..(151): Pfam ID: ADH_N Pfam Description: Alcohol dehydrogenase GroES-like domain
  misc_feature (182)..(317): Pfam ID: ADH_zinc_N Pfam Description: Zinc-binding dehydrogenase
MEQVSKAALGWAARDASGHLSPYSFSRVLRDGDVTIKVLFCGVCHTDLHIIKNEWGNALYPVVPGHEVVGVVTDVGAGVTKFKAGDTVGVGYFIDSCRTCESCSTGHENYCPDLVLTSNGVARDGGVTTTTTTQGGFSDVVVVDQHYVVRVPASLPPDGAAPLLCAGVTVYSPMVEYGLNVPGKRLGVVGLGGLGHIAVKFGKAFGMAVTVISSSPAKRGEAIERLGADEFLVSRDTEQMKAAAGTMDGIIDTVSAGHPIVPLLALLKPMGQMVIVGAPSTPLELPAYAIITGGKRVAGNGVGSIADCQAMLDFAGQHGITADIELVRMDYVNTAMERLERNDVRYRFVVDVAGSLGAAA

SEQ ID NO: 16004 - DNA, 1083 bp, Sorghum bicolor
  misc_feature: Ceres ANNOT ID no. 8653953
  misc_feature: Encodes the peptide sequence at SEQ ID NO 16005
atggaggagaaagccggccaggcggcgttcggatgggcggccagggacgccaccggcgtcctctccccctacaacttctccagaaggtgggttcctaaagacgacgatgtcacaatcaaggtgctctactgcgggatctgccataccgatctccacatcatcaagaacgactggggaaacgccatgtaccctgtcgtccccgggcacgagatcgtcggcgtggtgaccggcgtcggcggcggcgtcacgcggttcaaggccggcgacacggtcggcgtgggctacttcgtcggctcctgccgctcctgcgacagctgcggcaaggggaacgagaactactgcgccggggtggtgcagacctccaacggcgtcgactacgcgcacggcggcgtgcccaccaaggggggattctccgacgtcatcgtcgtgaacgagcactacgtggtccgcgtcccggacggcctggcgctggaccgcaccgcgccgctgctctgcgccggcgtcaccgtgtacagccccatgatgcgccacggcctcaacgagcccggcaagcatctgggcgtcgtcgggctcggcggcctcggccacgtcgccgtcaagttcggcaaggcgttcgggatgaaggtcaccgtcatcagcacgtccgcgagcaagcgtcaggaggcgatcgagagcctcggcgcggacgagttcttgatcagccgggacccggaggagatgaaggcggcgacgggcaccatggacggcatcatcgacacggtatcggcgtggcacccgatcacgccactgcttgcgctgctgaagccgttggggcagatggtggtcgtgggagggccgagcaagccgctagagctgccggcgtacgccatcgtgccgggcgggaagggcgtggctgggaacagcgtcggcagcgtcggggactgccaggccatgcttgagttcgcggggaagcacggcatcggcgccgaggtggaagtcatcaagatggactacgtcaacacggcgatcgagcggctcgagaagaacgacgttcgctaccgcttcgtcatcgacgtcgccggcagcctcggctctgctgcttag

SEQ ID NO: 16005 - protein, 360 aa, Sorghum bicolor
  misc_feature: The sequence is a functional homolog of SEQ ID NO 2 in US patent 7288696
  misc_feature: Useful for making plants with altered cell wall content and/or composition
  misc_feature: Functional homolog of the protein sequence given in SEQ ID NO 14308
  misc_feature: Ceres ANNOT ID no. 8653953
  misc_feature: Up-regulated in root tissues in response to salicylic acid treatment
  misc_feature (9)..(356): SWISSPROT Homolog: EC 1.1.1.255 Mannitol dehydrogenase
  misc_feature (34)..(151): Pfam ID: ADH_N Pfam Description: Alcohol dehydrogenase GroES-like domain
  misc_feature (182)..(317): Pfam ID: ADH_zinc_N Pfam Description: Zinc-binding dehydrogenase
MEEKAGQAAFGWAARDATGVLSPYNFSRRWVPKDDDVTIKVLYCGICHTDLHIIKNDWGNAMYPVVPGHEIVGVVTGVGGGVTRFKAGDTVGVGYFVGSCRSCDSCGKGNENYCAGVVQTSNGVDYAHGGVPTKGGFSDVIVVNEHYVVRVPDGLALDRTAPLLCAGVTVYSPMMRHGLNEPGKHLGVVGLGGLGHVAVKFGKAFGMKVTVISTSASKRQEAIESLGADEFLISRDPEEMKAATGTMDGIIDTVSAWHPITPLLALLKPLGQMVVVGGPSKPLELPAYAIVPGGKGVAGNSVGSVGDCQAMLEFAGKHGIGAEVEVIKMDYVNTAIERLEKNDVRYRFVIDVAGSLGSAA

SEQ ID NO: 16006 - DNA, 1287 bp, Sorghum bicolor
  misc_feature: Ceres ANNOT ID no. 8653996
  misc_feature: Up-regulated in root tissues in response to salicylic acid treatment
  misc_feature: Encodes the peptide sequence at SEQ ID NO 16007
atgaagccgcgggcgctcctggagcgcctagcccgccccttctcctcctcccgccgcgcgtcgtccgaccgcgagagggaggaggaggcggacctggaggcgatcgcggcgcgtgagcagcgcgcgttccggtacgagacgctggcggcggcgacgcggggattctcggagaagaaccggctggggcagggcgggttcggccccgtctaccggggccgcctggaggacggccgcgacgtggccgtcaagcgcctgggcgccgggtcacggcagggcgcccgggagttccggaacgaggccacgctgctctcccgggtgcagcaccggaacgtggtcaacctcatcggctactgcgcccgcggcgccgacgacaagctgctggtgtacgagtacgtgcccaacgagagcctcgacaagatcctcttctccccttcctcctcctccaatcactccagcagcaacagcgaccgatcacgacgagcggagctgacctggccgcggcggcacgaggtcgtggtcggcgtggcgcgtggcctgctctacctccacgaggacgcgcacacgcccatcatccaccgcgacatcaaggctagcaacatcctcctggacgaccggtgggtgcccaagatcgccgacttcggcatggcccggctcttcccggaggccggcgacggtcactctcgtgtccatacccgtgtcgccggcactaacgggtacatggcgcccgagtacctcatgcacggcgacctctccaccaaggccgacgtcttcagcttcggcgtggtggttctcgagatcgtctcgggccgcaagaactccgcctttgtcccacccccggacgccgaggcagacagcctcctggaatacgcctggagactgtacaagaaaggtcggaccctggagttgcttgaccccgcggtgaagtcgtcggcggtgccggagcaggtcgagctgtgcgtgcggatcgggctgctgtgcgtgcaggccgacccgcggctgcggccggacatgaagcgcgtggtgatcatcctgtccaagaagcagagcaagctcgaggagccgacgcgtccgggggtgcccgggtcgcggtaccggcggaggccccacggcctgcgcggctcgcactactctgccgggtcatcgtccggcaccagctcgccgtctacgtccgcaacgacgtcgcacgcgtcagcgtcggcgtcggcctccaacgccatgacgacgtcgagcacgcacaccatgagaagccaaggcttgccctcgcaccgagaagacgaggagtcgtag

SEQ ID NO: 16007 - protein, 428 aa, Sorghum bicolor
  misc_feature: Useful for making plants with altered cell wall content and/or composition
  misc_feature: Functional homolog of the protein sequence given in SEQ ID NO 14140
  misc_feature: Ceres ANNOT ID no. 8653996
  misc_feature (43)..(372): SWISSPROT Homolog: EC 2.7.11.1 Non-specific serine/threonine protein kinase
  misc_feature (55)..(342): Pfam ID: Pkinase Pfam Description: Protein kinase domain
MKPRALLERLARPFSSSRRASSDREREEEADLEAIAAREQRAFRYETLAAATRGFSEKNRLGQGGFGPVYRGRLEDGRDVAVKRLGAGSRQGAREFRNEATLLSRVQHRNVVNLIGYCARGADDKLLVYEYVPNESLDKILFSPSSSSNHSSSNSDRSRRAELTWPRRHEVVVGVARGLLYLHEDAHTPIIHRDIKASNILLDDRWVPKIADFGMARLFPEAGDGHSRVHTRVAGTNGYMAPEYLMHGDLSTKADVFSFGVVVLEIVSGRKNSAFVPPPDAEADSLLEYAWRLYKKGRTLELLDPAVKSSAVPEQVELCVRIGLLCVQADPRLRPDMKRVVIILSKKQSKLEEPTRPGVPGSRYRRRPHGLRGSHYSAGSSSGTSSPSTSATTSHASASASASNAMTTSSTHTMRSQGLPSHREDEES

SEQ ID NO: 16008 - DNA, 555 bp, Sorghum bicolor
  misc_feature: Ceres ANNOT ID no. 8653999
  misc_feature: Encodes the peptide sequence at SEQ ID NO 16009
atggatgctgccggccaaatcaagctgcagcagcaacaccaaccgccatgcagtgacaacaacttcagcttgttggccgccgccgccgactcctcctcctggccgccgccacaggtaaggtcgccgccgtcgtcgtcatcgtcgtcgtcctacacctgcgggtactgcaagaaggagttcaggtcagcacaagggctgggagggcacatgaacgtccacaggttggacagggccaggctgatccaccagcagtacatgtcgtcgtcgtcacaccgtactgctccccctcccagcaaccctaaccctagttgcgcagttcttgatcttgggctcagcttgtcgtcgctgctagcgcgcggcggcggcgatggaggcggcttgcctgttccgttagaaaagcagctgggcgaccgtttctcctctgcatcgtccgctgctgcgactaatgactactactccgaggtgaagaacttggagttgaggatgggagcgtgcagtcatggcggcgatggcacggaagaacgtctggatcttcagcttagactgggctactag

SEQ ID NO: 16009 - protein, 184 aa, Sorghum bicolor; identical to SEQ ID NO: 13411
  misc_feature: Useful for making plants with modulated biomass
  misc_feature: Functional homolog of the protein sequence given in SEQ ID NO 13411
  misc_feature: Ceres ANNOT ID no. 8653999
  misc_feature (51)..(73): Pfam ID: zf-C2H2 Pfam Description: Zinc finger, C2H2 type

SEQ ID NO: 16010 - DNA, 966 bp, Sorghum bicolor
  misc_feature: Ceres ANNOT ID no. 8654030
  misc_feature: Encodes the peptide sequence at SEQ ID NO 16011
atggaaggtgatggtgacgggcgacgcgccgcgcccgggccgctgccgccgggcttccggttccggccgactgacgaggagctgctcacgcattacctcgctccgaaggtggccgacgccggcttcgaccccgccgcgctccgtgaggtcgacctgtacaaggccgagccctgggacctgctgccggccgagggcggagaggacggcggcggcgtcggctacttcttctgcaggaggagcgtcaagttcccgtcgggcctgaggaccaaccgagccacgcgtgccgggtactggaagtccaccgggaaggacagggtggtggtggcgagcaggagcagcagcagccgtggtgacgacgactgtcccctcggcgtgaggaagacgctcgtcttctaccgcggccgcgcgcctacaggccacaagaccagctggatcatgcacgagtaccgcctgctccacggccatggatacacatctccagtagtgcatgcaacagcaggagcccaaagtgagtgggtgatttgcaggatgttcatgaaaaaggcaccaggagaaacgagccagccggagcaggaggaggcagttcttcaccctcctctcgaagatcatatgcagccgccgccagtcgatgactgcggtggcgagacgccggcgccggcggcggcagcttccgactcggatcatcagcacgtgaactgcttctccaatattgctcttgctatggtcccgggtgacactaatttccatggaatagagagcatgctgcagctgaaccgccatggccatgaagagctgtggatgaactatccagagtcaacctatccacccgtagcggcggcatcgacctcaggctcagcagaagcagctctgcgactccgtgacgagctggtcgcagatagcagctttgatctgctaccgcagctgctcgactacgacgaggcctttccgtttcttcaggacttctga

SEQ ID NO: 16011 - protein, 321 aa, Sorghum bicolor
  misc_feature: Useful for making plants with altered terpenoid content
  misc_feature: Functional homolog of the protein sequence given in SEQ ID NO 13140
  misc_feature: The sequence is a functional homolog of SEQ ID NO 2346 in the 10/374,780 US patent application
  misc_feature: The sequence is a functional homolog of SEQ ID NO 238 in the 10/225,068 US patent application
  misc_feature: The sequence is a functional homolog of SEQ ID NO 338 in the 10/412,699 US patent application
  misc_feature: The sequence is a functional homolog of SEQ ID NO 774 in the 11/479,226 US patent application
  misc_feature: The sequence is a functional homolog of SEQ ID NO 326 in the 10/412,699 US patent application
  misc_feature: The sequence is a functional homolog of SEQ ID NO 760 in the 11/479,226 US patent application
  misc_feature: Ceres ANNOT ID no. 8654030
  misc_feature (15)..(152): Pfam ID: NAM Pfam Description: No apical meristem (NAM) protein
MEGDGDGRRAAPGPLPPGFRFRPTDEELLTHYLAPKVADAGFDPAALREVDLYKAEPWDLLPAEGGEDGGGVGYFFCRRSVKFPSGLRTNRATRAGYWKSTGKDRVVVASRSSSSRGDDDCPLGVRKTLVFYRGRAPTGHKTSWIMHEYRLLHGHGYTSPVVHATAGAQSEWVICRMFMKKAPGETSQPEQEEAVLHPPLEDHMQPPPVDDCGGETPAPAAAASDSDHQHVNCFSNIALAMVPGDTNFHGIESMLQLNRHGHEELWMNYPESTYPPVAAASTSGSAEAALRLRDELVADSSFDLLPQLLDYDEAFPFLQDF

SEQ ID NO: 16012 - DNA, 1197 bp, Sorghum bicolor
  misc_feature: Ceres ANNOT ID no. 8654050
  misc_feature: Encodes the peptide sequence at SEQ ID NO 16013
atggatgagagagctgatatggacaagtctgatgaggttcttcttccaggtttccggttccatcctacagatgaagagctcataagcttttatctcaagagaaagattcagcaaaaacctgtgtccattgagctcattaggcagctggacatctacaagtatgatccatgggatctcccaaagcttgcgagcaccggggagaaggaatggtacttttactgcccaagggaccggaaatatcggaatagtgctagaccaaatagagtcacaggagctggattctggaaagcaacaggaacagataggccagtttactcttctgaagggaccaagtgcataggcctgaagaagtccctagtcttttacaaagggagagcagcgagaggaatcaagactgactggatgatgcatgagtacaggcttccttcacttaatgacccctcacgtcctaaaacaccaaaagacaaaaatattccagccaacgatgcatgggctatttgcaggatatttaaaaagcctaattctgtggcacaaagagtgctatctcactcctggggtcctcaatcaattacaacaacagaaccagagctgttatctgctttgcagtccatacaagcttcccattttgcattggaaagctccacttgctcagcaaatcgattcaacagccaacagtgtctgcaggagaatcttaacaattcccaggacggctctccatgtaaagtcataactttcaaccgtagcctatctctaccatcagagaaagacatccatagtagttatgtttcaaaaaaagacatacatagtagttcagtcatcttgccattagaaatacaatctcagcagaaatcatcagatgccacatcagtgcttctaagcatggcccctggaatactcaacagtatgaatgaagctataccaaacacagagtttggactgcttgaaccatctaatggatatattgttgattgggctacagactcgagtggaggtattggaaatagtgatggtgacacatatacaagaaaatctggttacttaatggcacacctcatgcaacttcatgcgactacgctgtccggtcccgtgaagccttctatttgcgtgccatgggactcgatgtttagcaaataccttatcttgctgattaatggtagtgtacttgtgttcaacattacggtcttggacaaatcataa

SEQ ID NO: 16013 - protein, 398 aa, Sorghum bicolor
  misc_feature: The sequence is a functional homolog of SEQ ID NO 2592 in the 10/374,780 US patent application
  misc_feature: The sequence is a functional homolog of SEQ ID NO 288 in the 10/225,066 US patent application
  misc_feature: The sequence is a functional homolog of SEQ ID NO 320 in the 10/374,780 US patent application
  misc_feature: The sequence is a functional homolog of SEQ ID NO 850 in the 10/225,066 US patent application
  misc_feature: The sequence is a functional homolog of SEQ ID NO 328 in the 10/374,780 US patent application
  misc_feature: The sequence is a functional homolog of SEQ ID NO 852 in the 10/225,066 US patent application
  misc_feature: The sequence is a functional homolog of SEQ ID NO 310 in the 10/666,642 US patent application
  misc_feature: Useful for making plants with altered cell wall content and/or composition
  misc_feature: Useful for making plants with altered lignin content
  misc_feature: Functional homolog of the protein sequence given in SEQ ID NO 13620
  misc_feature: The sequence is a functional homolog of SEQ ID NO 808 in the 10/225,066 US patent application
  misc_feature: The sequence is a functional homolog of SEQ ID NO 926 in the 11/435,388 US patent application
  misc_feature: The sequence is a functional homolog of SEQ ID NO 98 in the 10/374,780 US patent application
  misc_feature: Useful for making plants with modulated oxidative stress sensitivity
  misc_feature: Functional homolog of the protein sequence given in SEQ ID NO 13621
  misc_feature: The sequence is a functional homolog of SEQ ID NO 316 in the 10/412,699 US patent application
  misc_feature: The sequence is a functional homolog of SEQ ID NO 738 in the 11/479,226 US patent application
  misc_feature: The sequence is a functional homolog of SEQ ID NO 890 in the 10/374,780 US patent application
  misc_feature: The sequence is a functional homolog of SEQ ID NO 1036 in the 10/225,066 US patent application
  misc_feature: The sequence is a functional homolog of SEQ ID NO 216 in the 10/666,642 US patent application
  misc_feature: The sequence is a functional homolog of SEQ ID NO 2608 in the 10/374,780 US patent application
  misc_feature: The sequence is a functional homolog of SEQ ID NO 658 in the 11/435,388 US patent application
  misc_feature: The sequence is a functional homolog of SEQ ID NO 880 in the 10/412,699 US patent application
  misc_feature: Useful for making plants with modulated water use efficiency
  misc_feature: The sequence is a functional homolog of SEQ ID NO 745 in the 11/479,226 US patent application
  misc_feature: Useful for making plants with modulated nitrogen use efficiency
  misc_feature: Functional homolog of the protein sequence given in SEQ ID NO 13624
  misc_feature: Ceres ANNOT ID no. 8654050
  misc_feature (14)..(142): Pfam ID: NAM Pfam Description: No apical meristem (NAM) protein
MDERADMDKSDEVLLPGFRFHPTDEELISFYLKRKIQQKPVSIELIRQLDIYKYDPWDLPKLASTGEKEWYFYCPRDRKYRNSARPNRVTGAGFWKATGTDRPVYSSEGTKCIGLKKSLVFYKGRAARGIKTDWMMHEYRLPSLNDPSRPKTPKDKNIPANDAWAICRIFKKPNSVAQRVLSHSWGPQSITTTEPELLSALQSIQASHFALESSTCSANRFNSQQCLQENLNNSQDGSPCKVITFNRSLSLPSEKDIHSSYVSKKDIHSSSVILPLEIQSQQKSSDATSVLLSMAPGILNSMNEAIPNTEFGLLEPSNGYIVDWATDSSGGIGNSDGDTYTRKSGYLMAHLMQLHATTLSGPVKPSICVPWDSMFSKYLILLINGSVLVFNITVLDKS

SEQ ID NO: 16014 - DNA, 1137 bp, Sorghum bicolor
  misc_feature: Ceres ANNOT ID no. 8654070
  misc_feature: Encodes the peptide sequence at SEQ ID NO 16015
atggacgtcaagtacaagcccgtcatgttccccaacggcgccgccctcaagaaggcagtaaagccggcggccgtggcgccggccggggagccgctgtaccgggagtgcctcaagaaccacgccgccagcctgggcggccacgccgtggacgggtgcggcgagttcatgccctcccccggggccaaccccgccgacccgacgtcgctcaagtgcgccgcgtgcgggtgccaccgcaacttccaccgccggacgctggagggctcacccccgccgccgcatgcgcccgcgccgctggcgctcccgccgccggcgagcgtgctgatgcacggccatccgcaccgcggcggggaggagacgcccgaggaccgacaccacccgggcgtcgtcgacgccgacgactccgattccgactcggagggctcggagtacgacgaggagcggtcggtgtccccgccccctcccccgcacgcgccgtcgcaccaccacgtgccggcgccggtggcgcagcagcccccgccctacttcgcgacggcgccgcacatgctgctctcgcttggctccggcggcgcgcccggggccgtggtggcagcggccgcgtccgcggcgcagaggctgcaggccccagcaccccagcagctgacgccgtccagcgcgccgccgggccccggcggggtcggcgcgatgccgatgccccggaagcggttccgcaccaagttcaccgccgagcagaagcagcggatgcaggagctgtcggagcggctcgggtggcggctgcagaagcgcgacgaggccatcgtcgacgagtggtgccgcgacatcggcgtcggcaagggcgtcttcaaggtctggatgcacaacaacaagcacaacttcctgggcggccacagcgcccgccgcagcgcctcagcctccgcctccgcaggcgcctgcgcgccgctccaaaccccaggcggcgctgctgcaccgtcgtcattcaacccgtccaggatcacccctccgcctcccgtcctcacctcttccccgaccagcgccacaggcttcaacatcaacggcgccgcctcctcggcgcccaccgtcgtcaccgccgaccacacggacaacgccgccaacggagcttcatcgccgcagtccgcttaa

SEQ ID NO: 16015 - protein, 378 aa, Sorghum bicolor
  misc_feature: Useful for making plants with modulated low light sensitivity
  misc_feature: Functional homolog of the protein sequence given in SEQ ID NO 13756
  misc_feature: Useful for biocontainment applications
  misc_feature: Useful for making plants with modulated biomass
  misc_feature: Useful for making plants with modulated flowering time
  misc_feature: Functional homolog of the protein sequence given in SEQ ID NO 13913
  misc_feature: Ceres ANNOT ID no. 8654070
  misc_feature (28)..(89): Pfam ID: ZF-HD_dimer Pfam Description: ZF-HD protein dimerisation region
MDVKYKPVMFPNGAALKKAVKPAAVAPAGEPLYRECLKNHAASLGGHAVDGCGEFMPSPGANPADPTSLKCAACGCHRNFHRRTLEGSPPPPHAPAPLALPPPASVLMHGHPHRGGEETPEDRHHPGVVDADDSDSDSEGSEYDEERSVSPPPPPHAPSHHHVPAPVAQQPPPYFATAPHMLLSLGSGGAPGAVVAAAASAAQRLQAPAPQQLTPSSAPPGPGGVGAMPMPRKRFRTKFTAEQKQRMQELSERLGWRLQKRDEAIVDEWCRDIGVGKGVFKVWMHNNKHNFLGGHSARRSASASASAGACAPLQTPGGAAAPSSFNPSRITPPPPVLTSSPTSATGFNINGAASSAPTVVTADHTDNAANGASSPQSA

SEQ ID NO: 16016 - DNA, 360 bp, Sorghum bicolor
  misc_feature: Ceres ANNOT ID no. 8654055
  misc_feature: Encodes the peptide sequence at SEQ ID NO 16017
atggtgcagcgtctgacctaccgcaagcggcacagctatgccacaaagtccaaccagacgcgggtcgtcaagacccctggtggtaagctcgtgtaccagtacaccaagaagagagccagcgggcccaagtgccccgtgaccgggaagaagatccaggggattccccatcttaggcctgctgagtacaaaaggtccaggttgtctaggaaccgcagaactgtgaaccgcccatatggtggagtgctctctggaactgcagttagagaaaggatcatccgtgctttcctggttgaagagcagaagattgtcaagaaggtgttgaaattacagaagaccaaagacaaaacttcctcaaagtaa

SEQ ID NO: 16017 - protein, 119 aa, Sorghum bicolor
  misc_feature: Useful for making plants with modulated nitrogen use efficiency
  misc_feature: Functional homolog of the protein sequence given in SEQ ID NO 14309
  misc_feature: Ceres ANNOT ID no. 8654055
  misc_feature (5)..(103): Pfam ID: Ribosomal_L34e Pfam Description: Ribosomal protein L34e
MVQRLTYRKRHSYATKSNQTRVVKTPGGKLVYQYTKKRASGPKCPVTGKKIQGIPHLRPAEYKRSRLSRNRRTVNRPYGGVLSGTAVRERIIRAFLVEEQKIVKKVLKLQKTKDKTSSK

SEQ ID NO: 16018 - DNA, 339 bp, Sorghum bicolor
  misc_feature: Ceres ANNOT ID no. 8654074
  misc_feature: Encodes the peptide sequence at SEQ ID NO 16019
atggccggcaggctgctgctcctcctcctcctcgccgttggtggccttcttgccgtctccatggccgagcacgaggtgctggccaaggggagtgacgagcatgacgacaatgtgtaccaagtgagcaagggaggacagggcagcctcaaaagctaccagtgctcgccgcagtgctcccggcggtgcggcaacacgcggtacaagaagccgtgcctcttcttctgcaacaagtgctgcaacacgtgcctgtgcgtgccgtcgggctactacggcaacaagggcgagtgcccctgctacaacaactggaagaccaagcgcgggggaccaaagtgcccgtga

SEQ ID NO: 16019 - protein, 112 aa, Sorghum bicolor
  misc_feature: Useful for making plants with altered alkaloid content
  misc_feature: Useful for making plants with modulated nitrogen use efficiency
  misc_feature: Functional homolog of the protein sequence given in SEQ ID NO 12973
  misc_feature: Ceres ANNOT ID no. 8654074
  misc_feature (1)..(112): Pfam ID: GASA Pfam Description: Gibberellin regulated protein
MAGRLLLLLLLAVGGLLAVSMAEHEVLAKGSDEHDDNVYQVSKGGQGSLKSYQCSPQCSRRCGNTRYKKPCLFFCNKCCNTCLCVPSGYYGNKGECPCYNNWKTKRGGPKCP

SEQ ID NO: 16020 - DNA, 1440 bp, Sorghum bicolor
  misc_feature: Ceres ANNOT ID no. 8654098
  misc_feature: Encodes the peptide sequence at SEQ ID NO 16021
atggcgagatcagggcgggaaggggaggaacggaagctggtgctgggcaagtacgagctgggccgcctgctggggcagggcaccttcgccaaggtctactacgcgcgggacctgagctcctccggcgccgccggtggtacgggcagcggcggcagcagcagcagcagcagcgtggccatcaaggtgatcgacaaggcgcggctgcggcgcacggaggggatggtggagcagctgcggcgtgagatctccatcatgcggatggtgcggcaccccaacgtggtgggcatccgggaggtgctcgccagccgctcccgcgtcttcgtcgtcatggagtacgcgcgcggcggggagctcttcgccaaggtcgcccggggccgcctcaccgaggaccacgcccgccgctacttccagcagctcgtcgccgccgtcggcttctgccaccgccgcggcgtcgcgcaccgggacctcaagcccgagaacctgctgctggacgaggaaggccggctcaaggtcaccgacttcgggctcgccgcgctccccgagcagctgcgccacgacggcctcctccacacgcagtgcggcaccccggcgtacgtcgcccccgaggtgctccggaagcgcggctacgacggcgcccgcgccgacctctggtcctgcggcgtcgtcctctacgtcctgctctgcgggttcctcccgttccagcacgacaactacgtcaagatgtaccagaagatcttcaaggcagagtaccaggtgccgccctgggtctccggcgacgcgcgacgcctcatcgcgcgcctgctcgtcgtcgaccccgcgaagcgcgcctccatcgcggagatcatgtgcacgccgtggttcaggaagggcttcgtgccgccagtcctttcaccgccggtaacgcccccgaagaaacggctggacgaggaccacgacgccgccggcgacctcttcgacaccgacgacgacgacaacagcagcagctgcagcaactctggcgccaccgccacctcgcctcggtcctgcaacgcgttccagctcatctcctccatgtcctccgggttcgacctgtcggggctgttcgagaacgagcagaaggccgcgaccgtgttcacggcccgcgcggcggcggccaccgtggtggagaagctggagtccgtagcgcgcaccctggggttcgagatcaccagggggaaggagagcgggaaggtgaggatggaggccaaggccgagggcacaaacgggcggctcgcggtcaccgccgaggtgctcgaggtggccgtggacgtggccgtcgtcgagttcgcgcacgacgccggggacgcgctggacttcaacaagttctgcgcggtggacgtccgcccggggctcgcggagatcgtctgggcgtggcagggcgacagcccgcccgcgccggccgccgccgtcgggaccgcgtga

SEQ ID NO: 16021 - protein, 479 aa, Sorghum bicolor
  misc_feature: Useful for making plants with modulated biomass
  misc_feature: Functional homolog of the protein sequence given in SEQ ID NO 14256
  misc_feature: Useful for making plants with modulated salt sensitivity
  misc_feature: Functional homolog of the protein sequence given in SEQ ID NO 14255
  misc_feature: Ceres ANNOT ID no. 8654098
  misc_feature (10)..(290): SWISSPROT Homolog: EC 2.7.11.1 Non-specific serine/threonine protein kinase
  misc_feature (18)..(287): Pfam ID: Pkinase Pfam Description: Protein kinase domain
  misc_feature (338)..(397): Pfam ID: NAF Pfam Description: NAF domain
MARSGREGEERKLVLGKYELGRLLGQGTFAKVYYARDLSSSGAAGGTGSGGSSSSSSVAIKVIDKARLRRTEGMVEQLRREISIMRMVRHPNVVGIREVLASRSRVFVVMEYARGGELFAKVARGRLTEDHARRYFQQLVAAVGFCHRRGVAHRDLKPENLLLDEEGRLKVTDFGLAALPEQLRHDGLLHTQCGTPAYVAPEVLRKRGYDGARADLWSCGVVLYVLLCGFLPFQHDNYVKMYQKIFKAEYQVPPWVSGDARRLIARLLVVDPAKRASIAEIMCTPWFRKGFVPPVLSPPVTPPKKRLDEDHDAAGDLFDTDDDDNSSSCSNSGATATSPRSCNAFQLISSMSSGFDLSGLFENEQKAATVFTARAAAATVVEKLESVARTLGFEITRGKESGKVRMEAKAEGTNGRLAVTAEVLEVAVDVAVVEFAHDAGDALDFNKFCAVDVRPGLAEIVWAWQGDSPPAPAAAVGTA

SEQ ID NO: 16022 - DNA, 462 bp, Sorghum bicolor
  misc_feature: Ceres ANNOT ID no. 8654138
  misc_feature: Encodes the peptide sequence at SEQ ID NO 16023
atgcagatcttcgtgaagaccctgacggggaagaccatcaccctcgaggtggagagcagcgacaccatcgacaacgtcaaggccaaaatccaggacaaggaagggattcccccagatcaacagcgactgatattcgctggcaagcagctggaggatggccgcacactggctgactacaacatccaaaaggagtcaactcttcatttggtcctcaggcttcggggtggaaccatgatcaaggtcaaaactctcactgggaaagagatcgagatcgacatagaacccactgacacgattgataggatcaaggagcgtgttgaagagaaagaaggcattcctcccgtgcagcaaaggctcatctatgctggtaagcagcttgccgatgacaagaccgcaaaggactacaacatcgagggtggttctgtcctccatcttgtccttgctctgaggggtggttactag

SEQ ID NO: 16023 - protein, 153 aa, Sorghum bicolor
  misc_feature: Useful for making plants with modulated nitrogen use efficiency
  misc_feature: Functional homolog of the protein sequence given in SEQ ID NO 13585
  misc_feature: Useful for making plants with modulated cold sensitivity
  misc_feature: Useful for making plants with modulated flowering time
  misc_feature: Functional homolog of the protein sequence given in SEQ ID NO 14303
  misc_feature: Ceres ANNOT ID no. 8654138
  misc_feature (6)..(74): Pfam ID: ubiquitin Pfam Description: Ubiquitin family
  misc_feature (82)..(150): Pfam ID: ubiquitin Pfam Description: Ubiquitin family
MQIFVKTLTGKTITLEVESSDTIDNVKAKIQDKEGIPPDQQRLIFAGKQLEDGRTLADYNIQKESTLHLVLRLRGGTMIKVKTLTGKEIEIDIEPTDTIDRIKERVEEKEGIPPVQQRLIYAGKQLADDKTAKDYNIEGGSVLHLVLALRGGY

SEQ ID NO: 16024 - DNA, 1302 bp, Sorghum bicolor
  misc_feature: Ceres ANNOT ID no. 8654155
  misc_feature: Encodes the peptide sequence at SEQ ID NO 16025
atgaaggtggaggtggtggagacgacgctggtgccgccgagcgaggcgacgccgcggcacgcgctgtggctgtccaacctggacctggcggtgcccaagacccacacgccgctcgtctactactacccgaggccgcccgaccccgaccccgagcccgacgccgacgcgcccgccggggaggggtcgttcttcgacccggcgcgcctgcgggaggcgctcgccagcgcgctggtggcgttctacccgctggcggggcggctcgtggtcggccagggcgggcggatcgagatcgactgcaccggcgagggcgcgctgttcgtcgtcgcgcgcgccgacttcaccggggacgacatgttcagggacttcgagccgtcccccgaggcgcgccgcctgctcgtgcccttcgccgaatccggcgacccgccctgcgtgctcgccatggtccaggtgaccttcctcaagtgcggcggcgtggccgtgggcacgggcatgcaccacgtcacgatggacggcgcgggcgcgatccagttcatccgggcgtggacggcgctggcgcgcggggagtcccccacgtgggcgccgtcccacgaccggacgctcctccgcgcgcgctccccgccgcacgtgcccttcgagcacccggtctactcgccggcctacctcaacgggtccccgcgtcccttcgtgacgcgcgtctacaccgtcccgcccaagctcctggcgggcatccggtcgcggtgcgcgccgggggcgtccacgtactgcgcggtgaccgcgcacctgtggcgcgccatgtgcgtggcgcgtgcgctccccgccgacggcgagacgcggctccgcgtgcccgccaacgtccggcagcggctccggccgccgctcccggccacctacttcggcaacgccatcgtgcgggacctggtgaccgtgaaggtgggcgacgtgctgtcgcagccgctcgggttcgtggcggaccggatcaagcgcgccgtgtcccgcgtcgacgacgccttggtgcgctccgtcgtcgactacctggagctggaggccgagaagggcaaccaggcggcgcgcgggcagttcatgccggagtccgacctctgggtcgtcagctggctcggcatgcccatccacgacgccgacttcggctggggccgccccgggttcgtggcgcccgcgcagatgttcggcagcggcacggcctatgtgacgcagggctacgacaaggacgaccccatcaacgtcctcttcgcgctcgagcctgagtacctgcagaccttcgagaaggcattctacggggagtga

SEQ ID NO: 16025 - protein, 433 aa, Sorghum bicolor
  misc_feature: Useful for making plants with altered carbohydrate content
  misc_feature: Functional homolog of the protein sequence given in SEQ ID NO 14310
  misc_feature: Ceres ANNOT ID no. 8654155
  misc_feature (1)..(431): SWISSPROT Homolog: EC 2.3.1.144 Anthranilate N-benzoyltransferase
  misc_feature (1)..(433): Pfam ID: Transferase Pfam Description: Transferase family
MKVEVVETTLVPPSEATPRHALWLSNLDLAVPKTHTPLVYYYPRPPDPDPEPDADAPAGEGSFFDPARLREALASALVAFYPLAGRLVVGQGGRIEIDCTGEGALFVVARADFTGDDMFRDFEPSPEARRLLVPFAESGDPPCVLAMVQVTFLKCGGVAVGTGMHHVTMDGAGAIQFIRAWTALARGESPTWAPSHDRTLLRARSPPHVPFEHPVYSPAYLNGSPRPFVTRVYTVPPKLLAGIRSRCAPGASTYCAVTAHLWRAMCVARALPADGETRLRVPANVRQRLRPPLPATYFGNAIVRDLVTVKVGDVLSQPLGFVADRIKRAVSRVDDALVRSVVDYLELEAEKGNQAARGQFMPESDLWVVSWLGMPIHDADFGWGRPGFVAPAQMFGSGTAYVTQGYDKDDPINVLFALEPEYLQTFEKAFYGE

SEQ ID NO: 16026 - DNA, 126 bp, Sorghum bicolor
  misc_feature: Ceres ANNOT ID no. 8654170
  misc_feature: Encodes the peptide sequence at SEQ ID NO 16027
atgacatcgatgaatctgtcgagcaacttgctgaacgggacgatcccgacgtccctgtgccggctgaagaacctagagcggcttgcactgtccaacaactccctaatcggcgaaattccagcgtga

SEQ ID NO: 16027 - protein, 41 aa, Sorghum bicolor
  misc_feature: The sequence is a functional homolog of SEQ ID NO 2 in US patent 7135625
  misc_feature: Useful for making plants with altered oil content
  misc_feature: Functional homolog of the protein sequence given in SEQ ID NO 14311
  misc_feature: Ceres ANNOT ID no. 8654170
  misc_feature (4)..(41): SWISSPROT Homolog: EC 2.7.11.1 Non-specific serine/threonine protein kinase
MTSMNLSSNLLNGTIPTSLCRLKNLERLALSNNSLIGEIPA

SEQ ID NO: 16028 - DNA, 1188 bp, Sorghum bicolor
  misc_feature: Ceres ANNOT ID no. 8654182
  misc_feature: Encodes the peptide sequence at SEQ ID NO 16029
atggcgaagcctcgcaagaacagcgccgccgccaacaacaacaacagcagcagcaacggcgccggcgacctgacgccgcgcgcgaagccgaagcgcacgcggaagagcgtgccccgggagtcccccacgcagcgcagctccgtctaccgcggcgtcacacggcaccggtggacggggaggttcgaggctcacctgtgggacaagaacagctggaacgagtcccagaacaagaagggcaagcaaggcgcgtacgacgacgaggaggcagcggcgcgggcgtatgacttggcggcattgaagtactggggccccgacaccatcctcaacttcccggcgtctgcatatgaaggagagatgaaaggaatggagggccagtccagggaagagtatattggatccttgaggaggaaaagcagtgggttctccagaggtgtctccaaataccgaggtgtcgcgagacatcaccacaacgggagatgggaggcgaggatcggtcgtgttttcggaaacaagtatctctacctcgggacttacgcgacgcaggaggaggcggcgatggcgtacgacatggcggcgatcgagtaccgtggcctgaacgccgtcacaaacttcgacctcagccgctacatcaagtggctccgcccgggcgccggcgggatggcagccgcggcggcggcggcgcagaacccgcacccgatgctgggcggcctggcgcagcagctgctgctgccgccgccggcggacaccaccaccaccgacggcgccggcgccgcggcgttccagcacgaccaccacggcgccgaggcgttcccgctgccgcccaggacgtcgctgggccacacgcccacgacgtcggcgctcagcctgctgctgcagtcgcccaagttcaaggagatgatccagcggaccgagagcggcaccaccaccactaccaccacgacatcgtcgttgtcctcgtcgccgccgcccacgccgtccccgtccccgccgcggcggtcgccagcgccgacgcagccgccggtgcaggcggcggccagggacgcctcgccgcaccagcgcggcttccccgaggacgtacagacattcttcggctgcgaggacaccgcgggcatcgacgtggaagccctcttctttggcgacctcgccgcgtacgcgacgccggcgttccacttcgagatggacttgtag

SEQ ID NO: 16029 - protein, 395 aa, Sorghum bicolor
  misc_feature: The sequence is a functional homolog of SEQ ID NO 1070 in the 10/225,066 US patent application
  misc_feature: The sequence is a functional homolog of SEQ ID NO 140 in the 11/375,241 US patent application
  misc_feature: The sequence is a functional homolog of SEQ ID NO 1904 in the 10/412,699 US patent application
  misc_feature: The sequence is a functional homolog of SEQ ID NO 2164 in the 10/374,780 US patent application
  misc_feature: The sequence is a functional homolog of SEQ ID NO 458 in the 11/435,388 US patent application
  misc_feature: The sequence is a functional homolog of SEQ ID NO 1900 in the 10/412,699 US patent application
  misc_feature: The sequence is a functional homolog of SEQ ID NO 358 in the 10/666,642 US patent application
  misc_feature: The sequence is a functional homolog of SEQ ID NO 676 in the 11/435,388 US patent application
  misc_feature: Useful for biocontainment applications
  misc_feature: Functional homolog of the protein sequence given in SEQ ID NO 13650
  misc_feature: Ceres ANNOT ID no. 8654182
  misc_feature (146)..(198): Pfam ID: AP2 Pfam Description: AP2 domain
  misc_feature (47)..(104): Pfam ID: AP2 Pfam Description: AP2 domain
MAKPRKNSAAANNNNSSSNGAGDLTPRAKPKRTRKSVPRESPTQRSSVYRGVTRHRWTGRFEAHLWDKNSWNESQNKKGKQGAYDDEEAAARAYDLAALKYWGPDTILNFPASAYEGEMKGMEGQSREEYIGSLRRKSSGFSRGVSKYRGVARHHHNGRWEARIGRVFGNKYLYLGTYATQEEAAMAYDMAAIEYRGLNAVTNFDLSRYIKWLRPGAGGMAAAAAAAQNPHPMLGGLAQQLLLPPPADTTTTDGAGAAAFQHDHHGAEAFPLPPRTSLGHTPTTSALSLLLQSPKFKEMIQRTESGTTTTTTTTSSLSSSPPPTPSPSPPRRSPAPTQPPVQAAARDASPHQRGFPEDVQTFFGCEDTAGIDVEALFFGDLAAYATPAFHFEMDL

SEQ ID NO: 16030 - DNA, 447 bp, Sorghum bicolor
  misc_feature: Ceres ANNOT ID no. 8654232
  misc_feature: Encodes the peptide sequence at SEQ ID NO 16031
atgatgagcagcaacagcggcggcagcgcaggaggccctggtgggggcatgggtccgggagtgggtggaggtggggacgggcggcatgacgacgaggccgcactcaccgagttcctttcatccctcatggactacacccccacgattcccgacgagctggtggagcactacctcggccgcagcgggttccactgtcccgaccttcgcctaacgagactggttgctgtagccacccagaagttcctagcagacattgctagtgattctcttcaggtagctgcacctatcaaagacaataagagcaagcagcctaaggatagacgtcttgtattaaccatggatgatctttctaaagctttgcgtgagcacggtgtgaacttgaaacacccggagtactttgcagacagcccttcagcaggaatggctccttcgacaagagaggagtag

SEQ ID NO: 16031 - protein, 148 aa, Sorghum bicolor
  misc_feature: Useful for making plants with altered terpenoid content
  misc_feature: Functional homolog of the protein sequence given in SEQ ID NO 12990
  misc_feature: Useful for making plants with altered lignin content
  misc_feature: Functional homolog of the protein sequence given in SEQ ID NO 13033
  misc_feature: Ceres ANNOT ID no. 8654232
  misc_feature (51)..(147): SWISSPROT Homolog: EC 2.1.1.35 tRNA (uracil-5-)-methyltransferase
  misc_feature (47)..(98): Pfam ID: TFIID_30kDa Pfam Description: Transcription initiation factor TFIID 23-30kDa subunit
MMSSNSGGSAGGPGGGMGPGVGGGGDGRHDDEAALTEFLSSLMDYTPTIPDELVEHYLGRSGFHCPDLRLTRLVAVATQKFLADIASDSLQVAAPIKDNKSKQPKDRRLVLTMDDLSKALREHGVNLKHPEYFADSPSAGMAPSTREE

SEQ ID NO: 16032 - DNA, 1887 bp, Sorghum bicolor
  misc_feature: Ceres ANNOT ID no. 8654272
  misc_feature: Encodes the peptide sequence at SEQ ID NO 16033
atgtcgtcgtcggcgttcggcgacttcggtccgctcaccgagcgccgcaaagccgagaatgcgcggaagcagcgcaggcgcatcatgatcgccgccgggaccgtcaccatcatcatcctactcatcgtcatgggcagcgccgcggtcgcgtacaacgggaagaagtcgtccggcgatggcggcggccacaagtcttcttcttccaagggctcgtcgtcgccagccaaaggcaagtcggactcggactcggaatcggagtcggagtcggagtcggcgtcggactcgaagacggacctgaaggccgtgtccaagagcatcaaggcgatgtgctcgcagacagactacacggccgcgtgcgagaagagccttggcaaggccgcgaacgccagctcgtcgtcgcccaaggacatcgtccgcagcgccgtggaggtgatcggcgacgccatcagccaggcgttcgaccgcgcggacctgatcctgagcaacgacccgcgcgtgaaggccgccgtcgccgactgcaaggaggtgttcgcggacgccaaggacgacctcaacagcacgctcaagggcgtcgacgacaaggacggcatctccaagcagagctaccagctgcgcatctggctcagcgccgtcatcgccaacatggagacgtgcatcgacgggttccccgacgacgagttcaaggccaaggtgaaggagtcgttcaccgacgggaaggagctcaccagcaacgccatggcgctcatcgagaaggggtcatcgctcctctccgtactcaagggcggctcgaaacgacggttgctcgaggaggaggaggaaggcgcggcgtcggcgtcgcaagccgggccagcactcgacaaggacggcatcccggagtgggtgcccgacggtgagcggagggtgctcaagggcggcggcttcaagaacacactcaaggcgaacgtggtggtggcgaaggacggcagcggcaagttcaagaccatcaacgaggcgctcgccgccatgccaaagacctacgacggaagatacgtgatccaagtgaaggagggggtgtacgaggagtacgtgaccatcaccaggaccatgaagaacgtgaccttcttaggtgacggctccaagaagtccatcgtcaccggcaagaagagcttcgccgacgggatcacgactttcaagacagcaaccttcactgcgcaagccgacgggttcatggcgatcgggatgggtttccagaacacggccggcgcggagaagcaccaggcggtggcgctgctggtgcagtctgacaagtccatcttcctcaactgcaagatggaagggttccaggacacgctgtacgcgcactccaaggcgcagttctaccgcaactgcatcatctccggcacggtggacttcatcttcggcgacgcggcggcggtgttccagaactgcatcctcatcctgcgccgcccgatggacaaccagcagaacatcgtgacggcgcagggccgcgcggacgcgcgcgaggccacggggttcgtgctccagaagtgcgagttccaggcggaggcggcgctccgggacgccggcaagccggccatccgcaactacctgggccggccctggcgcgagtgctcgcgcaccgtcttcatggagtcggagatcccggacttcatcgacaaggccgggtacctgccctggaacggcgacttcgggctcaagacgctgtggtacggcgagttcggcaacaccgggcccggcgcaaacacggcggggcgcgtcaactggccggggttcaagaaggtgatcagcaaggcggacgcgagcaagttcacggtcgagaacttcctgcacgcccagccatggatcgaccccacaggcacgccggtgaagtacgacctgttcacatga

SEQ ID NO: 16033 - protein, 628 aa, Sorghum bicolor
  misc_feature: Useful for making plants with altered cell wall content and/or composition
  misc_feature: Functional homolog of the protein sequence given in SEQ ID NO 14312
  misc_feature: Ceres ANNOT ID no. 8654272
  misc_feature (106)..(626): SWISSPROT Homolog: EC 3.1.1.11 Pectinesterase
  misc_feature (314)..(612): Pfam ID: Pectinesterase Pfam Description: Pectinesterase
  misc_feature (100)..(248): Pfam ID: PMEI Pfam Description: Plant invertase/pectin methylesterase inhibitor
MSSSAFGDFGPLTERRKAENARKQRRRIMIAAGTVTIIILLIVMGSAAVAYNGKKSSGDGGGHKSSSSKGSSSPAKGKSDSDSESESESESASDSKTDLKAVSKSIKAMCSQTDYTAACEKSLGKAANASSSSPKDIVRSAVEVIGDAISQAFDRADLILSNDPRVKAAVADCKEVFADAKDDLNSTLKGVDDKDGISKQSYQLRIWLSAVIANMETCIDGFPDDEFKAKVKESFTDGKELTSNAMALIEKGSSLLSVLKGGSKRRLLEEEEEGAASASQAGPALDKDGIPEWVPDGERRVLKGGGFKNTLKANVVVAKDGSGKFKTINEALAAMPKTYDGRYVIQVKEGVYEEYVTITRTMKNVTFLGDGSKKSIVTGKKSFADGITTFKTATFTAQADGFMAIGMGFQNTAGAEKHQAVALLVQSDKSIFLNCKMEGFQDTLYAHSKAQFYRNCIISGTVDFIFGDAAAVFQNCILILRRPMDNQQNIVTAQGRADAREATGFVLQKCEFQAEAALRDAGKPAIRNYLGRPWRECSRTVFMESEIPDFIDKAGYLPWNGDFGLKTLWYGEFGNTGPGANTAGRVNWPGFKKVISKADASKFTVENFLHAQPWIDPTGTPVKYDLFT

SEQ ID NO: 16034 - DNA, 462 bp, Sorghum bicolor
  misc_feature: Ceres ANNOT ID no. 8654264
  misc_feature: Encodes the peptide sequence at SEQ ID NO 16035
atggcacccaaggcggagaagaagccggcggcgaagaagcccgcggaggaggagcccgcgaccgagaaggcggagaaggccccggcggggaagaagcccaaggccgagaagcggctccccgcgggcaagtccgccggcaaggagggcggcgagggcaagaaggggaagaagaaggcgaagaagtccgtggagacctacaagatctacatcttcaaggtgctcaagcaggtgcacccggacatcggcatctcgtccaaggccatgtccatcatgaactccttcatcaacgacatcttcgagaagcttgcggccgagtccgccaagctggcgcgctacaacaagaagcccaccatcacctcccgcgagatccagacctcggtgcgcctcgtcctccccggcgagctcgccaagcacgccgtctccgagggcaccaaggctgtcaccaagttcacctcttcttag

SEQ ID NO: 16035 - protein, 153 aa, Sorghum bicolor
  misc_feature: Useful for biocontainment applications
  misc_feature: Useful for making plants with modulated flowering time
  misc_feature: Functional homolog of the protein sequence given in SEQ ID NO 13102
  misc_feature: Ceres ANNOT ID no. 8654264
  misc_feature (60)..(130): Pfam ID: Histone Pfam Description: Core histone H2A/H2B/H3/H4
MAPKAEKKPAAKKPAEEEPATEKAEKAPAGKKPKAEKRLPAGKSAGKEGGEGKKGKKKAKKSVETYKIYIFKVLKQVHPDIGISSKAMSIMNSFINDIFEKLAAESAKLARYNKKPTITSREIQTSVRLVLPGELAKHAVSEGTKAVTKFTSS

SEQ ID NO: 16036 - DNA, 696 bp, Sorghum bicolor
  misc_feature: Ceres ANNOT ID no. 8654323
  misc_feature: Encodes the peptide sequence at SEQ ID NO 16037
atggagtacgaacgagtacgacgtgattatataatcctcccagctcctgcatgccagactctctccatccctttcccagttctcatcaagctcttcagagatccaagaaaccatctctgcggaggtgtacggtggcggctgactgtccgtgtgcgtgtgttcgtcatgggcgacgacggcgcgaaggcggcggcgacgggcatcaagcagatcgtgcggctgcgagagctgctgcacaagtggcacttgatggcgctgggcgcgaagcagcagcgggatcatcaggaggacgacgaggaccacgccggcggcggcgtgccggatcaggatgcggtggcgtcggcgatcccgccgttcgtgctgcggcggctgcggcgcgcggagacggcggactcggtgctgtcggacgacgagagctacagccctgagccgccgccggacgttccccggggctactgccccgtgtacgtcgggccggagcagcggcggttcgtgatcccgaccagctacctggcgcaccccgtgttccggctcctgctggagaaggccgaggaggagttcgggttccggcaccagggcgcgctcgccatcccctgcgagaccgaggccttcaagtacatcctccagtgcgtcgagcgccacgacaagggcctcgccgccgccgccgccggcgacggtacgttcacacgtggttaa

SEQ ID NO: 16037 - protein, 231 aa, Sorghum bicolor
  misc_feature: Useful for making plants with modulated cold sensitivity
  misc_feature: Functional homolog of the protein sequence given in SEQ ID NO 13454
  misc_feature: Ceres ANNOT ID no. 8654323
  misc_feature (120)..(212): Pfam ID: Auxin_inducible Pfam Description: Auxin responsive protein
MEYERVRRDYIILPAPACQTLSIPFPVLIKLFRDPRNHLCGGVRWRLTVRVRVFVMGDDGAKAAATGIKQIVRLRELLHKWHLMALGAKQQRDHQEDDEDHAGGGVPDQDAVASAIPPFVLRRLRRAETADSVLSDDESYSPEPPPDVPRGYCPVYVGPEQRRFVIPTSYLAHPVFRLLLEKAEEEFGFRHQGALAIPCETEAFKYILQCVERHDKGLAAAAAGDGTFTRG

SEQ ID NO: 16038 - DNA, 306 bp, Sorghum bicolor
  misc_feature: Ceres ANNOT ID no. 8654311
  misc_feature: Encodes the peptide sequence at SEQ ID NO 16039
atgctgtcctcttgtttacctgtactagctccgccagatcgggtatccccgcgcaaggcatcctacctccatgaccttgcctgcaagttcgcctttaggatcatctctgccgccgccattgtcaacatggacgaccactccgttgccaccatgctcaccaatgtcaaaggcatcggcacctggagcatccacatgttcatgatcttctcccttgcacaccatgatgtagtgcgagtagtggtgtccacaaagacatgcctcgcctgtcacagatggataagttgtgcaaatagtggtgccccctag

SEQ ID NO: 16039 - protein, 101 aa, Sorghum bicolor
  misc_feature: Useful for making plants with modulated nitrogen use efficiency
  misc_feature: Functional homolog of the protein sequence given in SEQ ID NO 14313
  misc_feature: Ceres ANNOT ID no. 8654311
  misc_feature (15)..(76): SWISSPROT Homolog: EC 3.2.2.21 DNA-3-methyladenine glycosylase II
MLSSCLPVLAPPDRVSPRKASYLHDLACKFAFRIISAAAIVNMDDHSVATMLTNVKGIGTWSIHMFMIFSLAHHDVVRVVVSTKTCLACHRWISCANSGAP

SEQ ID NO: 16040 - DNA, 2892 bp, Sorghum bicolor
  misc_feature: Ceres ANNOT ID no. 8654342
  misc_feature: Encodes the peptide sequence at SEQ ID NO 16041
atggcggcgagtggcaagctctcggcgaagccctccccgtcgccgacggtcgctcccgcctcgcgccccaaattcacagccgttaccttcctcggtgactgtgacgacgacgacgacttccaacctcctcgcccccgcccattgaagccttgcaatggcgccgccgcacttcggctccgcaagaagctcaaggcttcatcctcctccgcttcctccgggaaggagaacagttccgccgccggtggtgccgttgctgcggtggggatcgcctcgacagccgcgaaggatgccggaaccctagccacctgctcaagggttagtggcggcgttcccaaatcgaagaaacgaaaggccggagaaatttgcggcctctcgaggtacggatctgatagcaccaaactaagttgtaaaccgaagataggattggatagatatggatatggcaaagggagctccagttccttgcccaattcgttagaatcgagggttttggcgctcggtgcggtatgtgatttgggagttgggcgctgtgaggtggctcaagtagctggtaccttagttcttgaggaggggcacgccacagaggagctggctggctctgagtgtgatcctccaaaaacggagaagaagctgggcagttctggagctgtagagggacattatgactccaggttgattgaaccggggcttattgaatcagatgcaaaccgggagtctgtaactgcttgttcatatgattcagaagtgcttgattcagggattcttggctcactgactgataaacaggacacgaagaaagcaaacggggtggcatctgaatgtggttttgggcttcagaacgggaactatcacttgcattctctacagtcagagctcctaatgtcgaacgcaaagtatgattctagggtttttgctagcaatgaaatccaagagcctggtttgggagctggtaacttgatttcacaagagaggaacgtagcagcaggacattctgcatgtacaacccctgaaaatgtgactatggagaataaatcaagtgagcatgaggcttgtaaggggaagtgccgctctaattcatctgaatcaaagcttcaagaatcccatatgatccatgactttgaagttgatggttgtgatgatttcgagattgggacacagctcagtgagctcattaacttgtgtatgaaggattccatagagggacagttaaactttagtgcatctcccatggaacagaacacattggattctaagcgactcggttcagactatgaagtgaaatgccctctctgtggatcggatatatctgatttaagcgaggagctccggcagctgcatactaacaattgtcttgacgaaccagctaagaagctcaaaaatattgctgcttttgtgttgatcctctacttgatggaatctagtcccaaccataaaaaagagccctgtgctggacaaaatgttgaaactggacgtgttgtcgaatggttaagaaaccttgggttatccaagtatgaggaggtttttatcagagaagaagttgactgggaaaccttgcagtggctcactgaagaggatctgttgggtatcgggatcacctctcttggaccaagaaagaaaattatccatgctctaggagagttacggaagaaacatgacgatccctgtgaagtggaagatgtcgtgttaaattcagaaaatactaagaagactaaacttccgatgaatggtaataaattaattactgaatactttcaatgttcctcatttgatcaaagacaaagaagggtatgcaaagtcaacaagccatctaatctgaacgagaagaaaatttctagtgctaaaatacccactagaagaagtgctggtaaaggaaaggttaaagatacacctctttggtgttgcatcccagggaccccttttcgagtggatgcatttcgctacttgagaggcgattgttcccactggtttctcacacacttccatgtggatcattatcaaggcttgactagaagcttttgtcatgggaagatatactgttcgtcaattacagcaagtcttgtgcatcataagattggtatcccatgggatagattgcatgtattgaccctaaatgaaaagctcactattggtggagttagtttgacatgttttgatgccaatcattgccctggatcaatcattattctctttgagcctcccaacggtaaagctgttttgcacaccggagacttccggttttcttccgagatggccaacaatcctgttttgcagtcttctcatatccacactctaatacttgacacaacctattgcaatccacggtatgacttcccaagtcaagagattgtaatacagttcgttatcgaggccatccaagcagaagctttcaatccaaaaacattgtttttgattggtagctacacaattggaaaagaaagactgtttatggaggttgctcgtttgcttcagaagaaaatatatgttggagctgcaaagctgcaaatattgaaacatttagagcttcctcaggagattatgcactggtttacagccaatgaagcagaaagtcacatacatgttgtccccatgtggactctagcaagcttcaagcggatgaaatatttatcaaatcaatatgccggccagtttgacctcatagtggcgttttgtcctactggttgggcatttggcaaaggtaggaaaaagacaccaggcaaaaggtggcaacaaggatcaatcatcagatacgaagtgccctacagtgaacacagcagtttcacggaactgcaagaatttgtcaagttcatatcaccagagcacataatccctagtgtgaacaacgatggccctgagagtgcagatgctatgcttgcccagctgttaaacgagtag

SEQ ID NO: 16041 - protein, 963 aa, Sorghum bicolor
  misc_feature: Useful for making plants with modulated low light sensitivity
  misc_feature: Useful for making plants with modulated nitrogen use efficiency
  misc_feature: Functional homolog of the protein sequence given in SEQ ID NO 13505
  misc_feature: Ceres ANNOT ID no. 8654342
  misc_feature (848)..(946): Pfam ID: DRMBL Pfam Description: DNA repair metallo-beta-lactamase
  misc_feature (485)..(548): Pfam ID: SAM_1 Pfam Description: SAM domain (Sterile alpha motif)
MAASGKLSAKPSPSPTVAPASRPKFTAVTFLGDCDDDDDFQPPRPRPLKPCNGAAALRLRKKLKASSSSASSGKENSSAAGGAVAAVGIASTAAKDAGTLATCSRVSGGVPKSKKRKAGEICGLSRYGSDSTKLSCKPKIGLDRYGYGKGSSSSLPNSLESRVLALGAVCDLGVGRCEVAQVAGTLVLEEGHATEELAGSECDPPKTEKKLGSSGAVEGHYDSRLIEPGLIESDANRESVTACSYDSEVLDSGILGSLTDKQDTKKANGVASECGFGLQNGNYHLHSLQSELLMSNAKYDSRVFASNEIQEPGLGAGNLISQERNVAAGHSACTTPENVTMENKSSEHEACKGKCRSNSSESKLQESHMIHDFEVDGCDDFEIGTQLSELINLCMKDSIEGQLNFSASPMEQNTLDSKRLGSDYEVKCPLCGSDISDLSEELRQLHTNNCLDEPAKKLKNIAAFVLILYLMESSPNHKKEPCAGQNVETGRVVEWLRNLGLSKYEEVFIREEVDWETLQWLTEEDLLGIGITSLGPRKKIIHALGELRKKHDDPCEVEDVVLNSENTKKTKLPMNGNKLITEYFQCSSFDQRQRRVCKVNKPSNLNEKKISSAKIPTRRSAGKGKVKDTPLWCCIPGTPFRVDAFRYLRGDCSHWFLTHFHVDHYQGLTRSFCHGKIYCSSITASLVHHKIGIPWDRLHVLTLNEKLTIGGVSLTCFDANHCPGSIIILFEPPNGKAVLHTGDFRFSSEMANNPVLQSSHIHTLILDTTYCNPRYDFPSQEIVIQFVIEAIQAEAFNPKTLFLIGSYTIGKERLFMEVARLLQKKIYVGAAKLQILKHLELPQEIMHWFTANEAESHIHVVPMWTLASFKRMKYLSNQYAGQFDLIVAFCPTGWAFGKGRKKTPGKRWQQGSIIRYEVPYSEHSSFTELQEFVKFISPEHIIPSVNNDGPESADAMLAQLLNE

SEQ ID NO: 16042 - DNA, 1614 bp, Sorghum bicolor
  misc_feature: Ceres ANNOT ID no. 8654344
  misc_feature: Encodes the peptide sequence at SEQ ID NO 16043
atggctgatcgcctcgccgggcgccggcaccgggctacgcccgatcgcgcccatccgatgctggagaccgccgccgccgcctcctccccccgcgccgcggccgcggcagtcgccgctggggcggccgcggtcgtttcctccccgcggcggggcggaggcgccgcgcaccaccaccggcggtggggcccgtcctcgatcagggcttaccatctcctgctcgcgttctggctggtgggcttcgcgctcgtcgtcgtgtggcagaccacctccgcgggccgcgtgcggctctacacgcgcccgccgatgcccaagcgcgccgcggcgtctttgtctttggggcagtgggtggcctccccgcccgtctacgatctgagggagtttggggcagtcggggacgggcggacggttaacacagctgcgttcgagtctgccatcgcggccatcgctgagaggggcgggggcaggctcaccgttccagccgggcggtggctcacagcgccgttcaacctcaccagccacatgattctcttccttgccgctggtgctgagatcctagggattcaggatgaaagatattggccattaatgtctccattaccatcatacggctatggaagagagcacaagggacctcgatatgggagccttatacatggccaagacctgaaggatgtgactataacaggtcataatggtaccataaatggacaaggtcaaagttggtgggtaaaatttcggagaaaactccttaatcacacaaggggtcctctggtgcagctcatgcgatcaagtgacattatcatttctaatatcactcttcgtgattctcccttctggactcttcacacgtatgactgcaagaatgttactatatcagaaaccaccatcttggctccaattgctggagctccaaatactgatggaatagatccagattcttgtgaaaatgtggtgataaaaaattgttacatttctgttggtgatgatgggatagccataaagagtggttgggatcaatatggaattgcttatggtcgtccatctgctaacattgttattcagaatgtcgtaatccgctctatggtcagtgctggagtatcgattggaagcgagatgtctggtggtgtctcggatgttttggtagagaatgttcatgtctgggattcacggcgaggcgtgaggataaagactgcgcctggaagaggggcctatgtaaccaacatcgtgtaccggaacataaccttggaaaatgtacgtgtcggtatagtgataaagacagactacaacgagcacccagacgaaggcttcgacccaaaggctgtccccaccatcgggaatatttcttacacatcaatccatgggcatcgtgtgcgagtaccggtcaggatacagggaagcgcagagatccctgtgaagaatgttaccttccatgacatgtcaatcggtatagtagacaagaagcaccatgttttccagtgctccttcgtccaggggcaggtcattggctatgttttccctgtgccttgcaagaacctggacctgtatgacgagcggcgtgagctggttaaacaatcaacgttacagaatatctctgatatcgactacagtttttga

SEQ ID NO: 16043 - protein, 537 aa, Sorghum bicolor
  misc_feature: Useful for making plants with altered cell wall content and/or composition
  misc_feature: Functional homolog of the protein sequence given in SEQ ID NO 13906
  misc_feature: Useful for making plants with altered carbohydrate content
  misc_feature: Functional homolog of the protein sequence given in SEQ ID NO 13716
  misc_feature: Ceres ANNOT ID no. 8654344
  misc_feature (272)..(437): SWISSPROT Homolog: EC 3.2.1.15 Polygalacturonase
  misc_feature (149)..(509): Pfam ID: Glyco_hydro_28 Pfam Description: Glycosyl hydrolases family 28
MADRLAGRRHRATPDRAHPMLETAAAASSPRAAAAAVAAGAAAVVSSPRRGGGAAHHHRRWGPSSIRAYHLLLAFWLVGFALVVVWQTTSAGRVRLYTRPPMPKRAAASLSLGQWVASPPVYDLREFGAVGDGRTVNTAAFESAIAAIAERGGGRLTVPAGRWLTAPFNLTSHMILFLAAGAEILGIQDERYWPLMSPLPSYGYGREHKGPRYGSLIHGQDLKDVTITGHNGTINGQGQSWWVKFRRKLLNHTRGPLVQLMRSSDIIISNITLRDSPFWTLHTYDCKNVTISETTILAPIAGAPNTDGIDPDSCENVVIKNCYISVGDDGIAIKSGWDQYGIAYGRPSANIVIQNVVIRSMVSAGVSIGSEMSGGVSDVLVENVHVWDSRRGVRIKTAPGRGAYVTNIVYRNITLENVRVGIVIKTDYNEHPDEGFDPKAVPTIGNISYTSIHGHRVRVPVRIQGSAEIPVKNVTFHDMSIGIVDKKHHVFQCSFVQGQVIGYVFPVPCKNLDLYDERRELVKQSTLQNISDIDYSF

SEQ ID NO: 16044 - DNA, 2325 bp, Sorghum bicolor
  misc_feature: Ceres ANNOT ID no. 8654358
  misc_feature: Encodes the peptide sequence at SEQ ID NO 16045
atgctccccatgcagcaactgctcgtgctcctcctcctcttcatcggctccgccaagtatgcggccgtcgcctccggcgccgatgctggcgccggtgcggctacctacattgtctatctgaaccccgcgctcaagccgtccccctacgccacgcacctccactggcaccacgcgcacctcgactccctctccctggaccccgcgcgccacctcctctactcgtacaccaccgcggcgccgtccgcgttcgccgcccgcctcttcccgtcccacgtcgcggcgctccgcagccaccctgccgtggcgtcagtgcatgaggacgtgctcctaccgctccacaccacgcgctccccttcgttcctccacctcccgcagtacaacgcgcccgatgaggcgaacggcggtgggggtccggacgtcatcatcggagtgctcgacaccggcgtgtggcccgagagccccagcttcggagatgccggtctgggccccgtgcctgcacggtggcgcgggagctgcgagaccaatgccaccgacttcccgtcgtcgatgtgcaaccgcaggctcatcggcgcccgcgcctttttccgcggctactcgtcgggtggcatcggcagtggttctcgagtcaccgccgacctcatgtcgccgagggaccatgacgggcacggcacgcacaccgcaagcaccgcagccggggccgtcgtggcgaacgcaagcctccttgggtacgcgtcgggcacggcgcggggcatggcccccggggcgcgcgtcgcggcatacaaggtgtgctggaggcaaggctgcttcagctccgacattctggcgggcatggagaaggccatcgacgacggcgtcgacgtgctctcgctgtcgctgggcggcggcgcgttcccgctctcgcgcgatcccatcgcggtcggcgcgctcgcggccacccgccgcggtatcgtcgtctcgtgctccgctgggaacagcgggccgtcgccgtcgtctctggtgaacacggccccgtggataatcacggtaggcgccggaacgctcgaccggaacttcccggcttacgccgagctcggcaacggcgagacccacgccggcatgtccctctactccggcgatgggcttggtgatgacaagctccctctggtgtacaataagggcattcgtgccggcagcaactcgagcaagctctgcatggagggcacgctggacgccgcggaggtgaagggcaaggtggtcctgtgcgaccgaggcggcaactcgagggtggagaaggggctgattgtgaagcaggccggcggtgtgggaatggtgcttgcgaacaccgcccagagcggcgaggaggtcgtggcggacagccacctactcccggcggtggccgtcggcgctaagagcggggatgccataaggaggtacgtggagtcagacgccaacccggaggtggcgttaacctttgccggcaccgcgctcgacgtgcggccggcgccggtagtagccgcgttcagctcccgtggaccgaacagggtggtgccgcagctgctgaagccggacgtgatcggtccaggcgtgaacatcctcgccgggtggacggcgtccgtcggcccgaccgggctactcgccgacgagcggcggtcagagtttaacatcttgtcagggacatccatgtcgtgcccgcacatcagcggcctggcggcgttcgtgaaggcggcgcacccggactggagccccagcgccatcaagtccgcgctcatgacgactgcctacaccgtggacaacaccgagtcgccgctcctggacgccgcgaccaacgccacggccacgccgtgggccttcggcgcgggccacgtggaccccgtcagcgcgctctccccgggactcgtctacgacgcctccgtcgacgactacgtcgccttcctctgcgccgtcggcgtcgcgccgcggcagatccaggccatcacggcggcggggccgaacgtgacctgcacccggaagctgtccagcccaggggacctcaactacccgtccttctccgtcgtgttcggccggaggtcgtcgcggagcaccgtcaagtaccgccgcgagctgaccaacgttggcaacgccggggacacgtacactgtcaaggtcaccggccccagcgacatcagtgtgagcgtcaagccggcgaggctccagttcaggcgggccggggacaagctcaggtacaccgtcacgttcaggtccgcgaacgccaggggacccatggaccccgcggccttcgggtggctgacgtggagcagcgacgagcacgtcgtgcgaagcccgatatcgtatacttgggggatgtag

SEQ ID NO: 16045 - protein, 774 aa, Sorghum bicolor
  misc_feature: Useful for making plants with modulated flowering time
  misc_feature: Functional homolog of the protein sequence given in SEQ ID NO 14098
  misc_feature: Ceres ANNOT ID no. 8654358
  misc_feature (212)..(771): SWISSPROT Homolog: EC 3.4.21.25 Cucumisin
  misc_feature (372)..(472): Pfam ID: PA Pfam Description: PA domain
  misc_feature (34)..(113): Pfam ID: Subtilisin_N Pfam Description: Subtilisin N-terminal Region
MLPMQQLLVLLLLFIGSAKYAAVASGADAGAGAATYIVYLNPALKPSPYATHLHWHHAHLDSLSLDPARHLLYSYTTAAPSAFAARLFPSHVAALRSHPAVASVHEDVLLPLHTTRSPSFLHLPQYNAPDEANGGGGPDVIIGVLDTGVWPESPSFGDAGLGPVPARWRGSCETNATDFPSSMCNRRLIGARAFFRGYSSGGIGSGSRVTADLMSPRDHDGHGTHTASTAAGAVVANASLLGYASGTARGMAPGARVAAYKVCWRQGCFSSDILAGMEKAIDDGVDVLSLSLGGGAFPLSRDPIAVGALAATRRGIVVSCSAGNSGPSPSSLVNTAPWIITVGAGTLDRNFPAYAELGNGETHAGMSLYSGDGLGDDKLPLVYNKGIRAGSNSSKLCMEGTLDAAEVKGKVVLCDRGGNSRVEKGLIVKQAGGVGMVLANTAQSGEEVVADSHLLPAVAVGAKSGDAIRRYVESDANPEVALTFAGTALDVRPAPVVAAFSSRGPNRVVPQLLKPDVIGPGVNILAGWTASVGPTGLLADERRSEFNILSGTSMSCPHISGLAAFVKAAHPDWSPSAIKSALMTTAYTVDNTESPLLDAATNATATPWAFGAGHVDPVSALSPGLVYDASVDDYVAFLCAVGVAPRQIQAITAAGPNVTCTRKLSSPGDLNYPSFSVVFGRRSSRSTVKYRRELTNVGNAGDTYTVKVTGPSDISVSVKPARLQFRRAGDKLRYTVTFRSANARGPMDPAAFGWLTWSSDEHVVRSPISYTWGM

SEQ ID NO: 16046 - DNA, 1566 bp, Sorghum bicolor
  misc_feature: Ceres ANNOT ID no. 8654364
  misc_feature: Encodes the peptide sequence at SEQ ID NO 16047
atggagttatcagcatgggcgtccctttccgccgtggtgctcagcaccgtcctgttcctgatcggagctatccacgcacgcaggcgccggcgcccatccatatccaacagcctgccgggccccaagccgtggccggtcatcggcaacttcaacctcctcggcgcgctcccgcaccgctccctcgacgcgctgtccaagctccacggcccgctgatgcgcgtgcagttcggctccttccccgtcgtcatcgcgtcgtccgtcgacatggccaggttcttcctcaagacccacgactcggcgttcatcgaccggcccaagatggcggcgggcaagtacaccacctacaactactccaacatcgcctggagcccctacggcgcctactggcggcaggcgcgcaagatctgcgccgacgagctcttcagcgccaggcggctagagtccttggagcacgttcgccgggaggaggtgcacgcgctgctgcgggacctgcacgggacggcgccggggcaggtcgtgcagctcaaggagcgcctgtccacgatgagcctgaacatcatcgcccgcatggttctgggcaggaagtgcgtggagaatgaggtggtcaccagtggcgggggatccgtgacgacgtggagggagttcaggtggatgctcgacgagctgttcttgctcaacggcgtgctcaacgtcggcgactggatcccttgggtgtcgtggctggacctgcaggggtacgtcaggaggatgaagagggtgggcaggatgttcgatcgattcatggagaacgtggtggaggagcacaacgagcggcgtctgcgcgagggagacgagttcgtgccgcaggacatggtcgacaggctgcttcagctcgccgacgatcccagcctcgacgtcaagctcactcgagacagcgttaaagccttcactcaggacctcgtcgccggcggcacagagagcgccgcggtaatcgtcgagtggggcatctcagagctcatgaagaatcccgacgtcttcgccaaggccaccgaggagctggacggcgtcatcggccgcgaccgctgggtcacggagaaggacatgcctcgcctcccatacatggacgccatcgtcaaggagaccatgcgcttgcatatggtcgtgcccctgctgtcgccgcgcttgtctcgcgaggacacgtccgtgggcggaagatacgacatccccgcgggcacgcgcgtgctcatcaacgcgtggaccatcagccgcgacccggcgctgtgggacgcgcccgaggagttctggccggagcggttcgtcgggagcaagatcgacgtcaagggccaggacttcgagctgctcccattcggttccggccggcggatgtgccccggttacagcctcgggctgaaggtgatccaggtgaccctcgtcaacctgttgcacgggtttgcgtggaggctcccggatggcatgacgaaggaagagctgagcatggaggaagtcttcggcctgtccacgccgcgcaagttcccgctccaggccgtcgtcgagcccaagcttccggcccgcctgtacactgcttga

SEQ ID NO: 16047 - protein, 521 aa, Sorghum bicolor
  misc_feature: Useful for making plants with altered carbohydrate content
  misc_feature: Functional homolog of the protein sequence given in SEQ ID NO 14183
  misc_feature: Ceres ANNOT ID no. 8654364
  misc_feature (39)..(519): SWISSPROT Homolog: EC 1.14.13.21 Flavonoid 3'-monooxygenase
  misc_feature (38)..(510): Pfam ID: p450 Pfam Description: Cytochrome P450
MELSAWASLSAVVLSTVLFLIGAIHARRRRRPSISNSLPGPKPWPVIGNFNLLGALPHRSLDALSKLHGPLMRVQFGSFPVVIASSVDMARFFLKTHDSAFIDRPKMAAGKYTTYNYSNIAWSPYGAYWRQARKICADELFSARRLESLEHVRREEVHALLRDLHGTAPGQVVQLKERLSTMSLNIIARMVLGRKCVENEVVTSGGGSVTTWREFRWMLDELFLLNGVLNVGDWIPWVSWLDLQGYVRRMKRVGRMFDRFMENVVEEHNERRLREGDEFVPQDMVDRLLQLADDPSLDVKLTRDSVKAFTQDLVAGGTESAAVIVEWGISELMKNPDVFAKATEELDGVIGRDRWVTEKDMPRLPYMDAIVKETMRLHMVVPLLSPRLSREDTSVGGRYDIPAGTRVLINAWTISRDPALWDAPEEFWPERFVGSKIDVKGQDFELLPFGSGRRMCPGYSLGLKVIQVTLVNLLHGFAWRLPDGMTKEELSMEEVFGLSTPRKFPLQAVVEPKLPARLYTA

SEQ ID NO: 16048 - DNA, 1569 bp, Sorghum bicolor
  misc_feature: Ceres ANNOT ID no. 8654362
  misc_feature: Encodes the peptide sequence at SEQ ID NO 16049
atggaacaagcaacattggccgcgttcttcggcatcgtcctttgcgctgtgttcttcctcaggaccttccttttgcgcggccaccgccgagcctacaaccccccaccgggccccaagccatggccgatcatcggcaaccttaacctcataggcgagctgccccaccgctccatccacgagctctccaagcgctacggcccgctcatgcagctccggttcgggtcgttgcctgtcgtcgtcggcgcgtccgctgagatcgcgaagctcttcctcaaggtcaacgacgcggcgttctccgaccggccgaggttcgccgtcggcaagtacaccgcgtacgactgctccgacatcctgtggtctcccttcgggccgtacctgcgccaggcacgcaggatctgcgccaccgagctcttcagcgccaagcggctcgagtccttcgagcacatccgcgacgaggaagtgcgcgtgttgctgcggcagctgcgccaagcgtccgggcgcgccgtgcggctcagggactacctgcagatgctgacgctcggcgtgatctcgcgcatagttctgggcaagaagtacgtccaggaggcggcggccggcgacggcgagggggactcatcagcgccgacggtgataacggctgacgagttcagggagatggtgggcgagtacttcgagcttcatggcgtgttcaacgttggtgatttcatcccgtggttagattgcctggacctgcagggctacgttgctaggatgaagagaatgaacgcgaggtttgatcgattcctggaacatgtcctggacgtgcacaacgagcggcggcgacgcgagggagggagcttcgtgccaaaggatatgttggacgtgctgctgcagctcgccgatgacactgaccttgaggtccagctcagcagggacaatgttaaggctatcacacaggacctaatcgtcggagccacggatactacagcaaacaccgtggagtgggcaatctcggagctcctcaagaactctaagatcatagcaaaggccatggaggagctgaacaacgtcgtagggccggaccgcctggtgacggaaagcgacctccctcgcctcccctaccttgaggctctcctcaaggagaccatgcgcgtgcacccgcccgcgccgctgctggcgccccacgtggcccgcgaggacacgtccgtggacggctacgacgtgctcgccggcacggtcgtgttcgtcaacgtgtgggcaatcgggcacgaccctgcactgtgggacgcgccgggggagttccggccggagcggttcctcgagagcaagatcgacatgaggggccaggacttccagctggtgccgttcggctctggccggcggatgtgccccgggttcaacctcgcgctgaaggtggtggctttgggccttgccaatctgcttcacggctttcagtggaggcttccggacggcgagacggcggcggagctgagcatggaggaggtcttcgtgctcgcgatgccgcgtaagttcccgctcaaggccgtggtcgagcccaggttgccagcccgcctgtatatgggcgattga

SEQ ID NO: 16049 - protein, 522 aa, Sorghum bicolor
  misc_feature: Useful for making plants with altered carbohydrate content
  misc_feature: Functional homolog of the protein sequence given in SEQ ID NO 14183
  misc_feature: Ceres ANNOT ID no. 8654362
  misc_feature (46)..(521): SWISSPROT Homolog: EC 1.14.13.21 Flavonoid 3'-monooxygenase
  misc_feature (35)..(510): Pfam ID: p450 Pfam Description: Cytochrome P450
MEQATLAAFFGIVLCAVFFLRTFLLRGHRRAYNPPPGPKPWPIIGNLNLIGELPHRSIHELSKRYGPLMQLRFGSLPVVVGASAEIAKLFLKVNDAAFSDRPRFAVGKYTAYDCSDILWSPFGPYLRQARRICATELFSAKRLESFEHIRDEEVRVLLRQLRQASGRAVRLRDYLQMLTLGVISRIVLGKKYVQEAAAGDGEGDSSAPTVITADEFREMVGEYFELHGVFNVGDFIPWLDCLDLQGYVARMKRMNARFDRFLEHVLDVHNERRRREGGSFVPKDMLDVLLQLADDTDLEVQLSRDNVKAITQDLIVGATDTTANTVEWAISELLKNSKIIAKAMEELNNVVGPDRLVTESDLPRLPYLEALLKETMRVHPPAPLLAPHVAREDTSVDGYDVLAGTVVFVNVWAIGHDPALWDAPGEFRPERFLESKIDMRGQDFQLVPFGSGRRMCPGFNLALKVVALGLANLLHGFQWRLPDGETAAELSMEEVFVLAMPRKFPLKAVVEPRLPARLYMGD

SEQ ID NO: 16050 - DNA, 1557 bp, Sorghum bicolor
  misc_feature: Ceres ANNOT ID no. 8654366
  misc_feature: Encodes the peptide sequence at SEQ ID NO 16051
atggagcttccgccatgggcgtccttcctcggcgtggtgctcgccaccgtgatgcttctgaaggccatcatcggccgccgccgcagccgccgcgtgtacaacctcccgcccggccccaagccgtggccgatcatcggcaacctcaacctggttggcgcgctccctcaccgctccatccacgagctgtccaggaagtacggcccgctgatgcagctccggttcgggtcgttccccgtggtggtcggctcgtcggtggacatggccaagttcttcctcaagacccacgacgtggtgttcacggaccgcccaaagaccgccgccggcaagtacaccacctacaactaccgcgacatcacctggtccccctacggcgcctactggcgtcaggcgcgcaagatgtgcctcaccgagctcttcagcgtcaagcggctcgagtcgtacgagtacatccgcgccgccgaggtgcgcgcgctgctgcgcgacctgaactccgcctccggctccggccgcgccgtcatgctcaaggactacctgtccacggtgagcctgaacgtgatcacgcgcatggtgctcggcaagaagtacctggacagggaggaggcggccgccgggtcggtgaccaccccagaggagttcaagtggatgctggacgagctgttcctgctcaacggcgtgctcaacatcggcgactccatcccgtggctcgactggatggacctgcaggggtacatcaagcggatgaagaagctcggcaagatgttcgatcggttcctggagcacgtcgtggaggagcacaaccagcggcggctgcgcgagggcaagggcttcgtcgccaaggacatggtcgacgtgctgctgcagatcgccgacgaccctacgcttgaggttgagctcgacagggaaagtgtcaaggcttttacccaggacctcatcgccggtggcacggagagctcggcggtcacggtggagtgggccatctcggagctcctcaagaagcccgaggtgatcgccaaggccacggaggagctggaccgcgtcatcggccgcggccgctgggtgacagagaaggacatgcccagcctcccctacgtcgacgccgtcgtcaaggagaccatgcgtctgcacccggtggcgccgctgctggtgccccgccttgcgcgcgaggacacgaccgtggccggctacgacatccccgcgggcacgcgcgtgctcgtcagcgtgtggtccatcggccgcgaccccgcgctgtgggacgcgccggaggaattcatgccggagcggttcctcggcagcaagctcgacgtgaaggggcaggactacgagctgctgccgttcgggtccggccggcggatgtgccccgggtacagcctcggcctcaaggtcatccaggtgagcctcgctaacctgctgcacggcttcgcgtggagcctccccgacggcgtgaccaaggaggagctcagcatggaggagatcttcggcctgtccacgccgcgcaagttcccgctcgaggctgtcgtcgagcccaagctcccggcacacctctactcggaggcttga

SEQ ID NO: 16051 - protein, 518 aa, Sorghum bicolor
  misc_feature: Useful for making plants with altered carbohydrate content
  misc_feature: Functional homolog of the protein sequence given in SEQ ID NO 14183
  misc_feature: Ceres ANNOT ID no. 8654366
  misc_feature: Up-regulated in root tissues in response to salicylic acid treatment
  misc_feature (10)..(515): SWISSPROT Homolog: EC 1.14.13.21 Flavonoid 3'-monooxygenase
  misc_feature (36)..(504): Pfam ID: p450 Pfam Description: Cytochrome P450
MELPPWASFLGVVLATVMLLKAIIGRRRSRRVYNLPPGPKPWPIIGNLNLVGALPHRSIHELSRKYGPLMQLRFGSFPVVVGSSVDMAKFFLKTHDVVFTDRPKTAAGKYTTYNYRDITWSPYGAYWRQARKMCLTELFSVKRLESYEYIRAAEVRALLRDLNSASGSGRAVMLKDYLSTVSLNVITRMVLGKKYLDREEAAAGSVTTPEEFKWMLDELFLLNGVLNIGDSIPWLDWMDLQGYIKRMKKLGKMFDRFLEHVVEEHNQRRLREGKGFVAKDMVDVLLQIADDPTLEVELDRESVKAFTQDLIAGGTESSAVTVEWAISELLKKPEVIAKATEELDRVIGRGRWVTEKDMPSLPYVDAVVKETMRLHPVAPLLVPRLAREDTTVAGYDIPAGTRVLVSVWSIGRDPALWDAPEEFMPERFLGSKLDVKGQDYELLPFGSGRRMCPGYSLGLKVIQVSLANLLHGFAWSLPDGVTKEELSMEEIFGLSTPRKFPLEAVVEPKLPAHLYSEA

SEQ ID NO: 16052 - DNA, 1554 bp, Sorghum bicolor
  misc_feature: Ceres ANNOT ID no. 8654367
  misc_feature: Up-regulated in root tissues in response to salicylic acid treatment
  misc_feature: Encodes the peptide sequence at SEQ ID NO 16053
atggagcttccaacatgggcgtccttcctcggtgtggtgctcgccactgtgatgcttctgaaggccatcctcggccgccgcagccgccgcgtgtacaacctcccgcccggccccaagccgtggccgatcatcggcaacctcaacctgatgggcgcgctcccacaccgctccatccacgagctgtccaggaagtacggcccgctgatgcagctccagttcgggtcgttccccgtggtggtcggctcgtcggtggacatggccaagttcttcctcaagacccacgacgtggtgttcacggaccgcccaaagaccgccgccggcaagtacaccacctacaactaccgcgacatcacctggtccccctacggcgcctactggcggcaggcgcgcaagatgtgcctcaccgagctcttcagcgccaagcggctcgagtcgtacgagtacatccgcgccgccgaggtgcgcgcgctgctgcgggacctgcactcggcgtccggctccggccgcgccgtcatgctcaaggactacctgtccacggtgagcctgaacgtgatcacgcgcatggtgctcggcaagaagtacctggacaaggaggaggcggccgccgggtcggtgaccaccccagaggagttcaagtggatgctggacgagctgttcctgctcaacggcgtgctcaacatcggcgattccatcccgtggctcgactggatggacctgcaggggtacatcaagcggatgaagaagctcggcaagatgttcgatcggttcctggagcacgtcgtggaggagcacaaccagcggcggctgcgcgagggcaagggcttcgtcgccaaggacatggtcgacgtgctgctgcagatcgccgacgaccctacgcttgaggttgagctcaaccgggaaagcgtcaaagcttttactcaggacctcatcgccggtggcacagagagctcggcggtcacggtggagtgggccatctcggagctcctcaagaagcccgaggtgatcgccaaggccacggaggagctggaccgcgtcatcggccgcggccgctgggtgacagagaaggacatgcccagcctcccctacgtcgacgccgtcgtcaaggagaccatgcgtctgcacccggtggcgccgctgctggtgccccgcctgtcacgcgaggacacgaccgtggccggctacgatatccccgccggcacgcgcgtgctcgtcagcgtgtggtccatcggccgcgaccccgcgctgtgggacgcgccggaggaattcatgccggagcggttcctcggcagcaagctcgacgtgaaggggcaggactacgagctgctgccgttcgggtccggccggcggatgtgccccgggtacagcctcggcctcaaggtcatccaggtgagcctcgctaacctgctgcacggcttcgcgtggagcctccccgacggcgtgaccaaggaggagctcagcatggaggagatcttcggcctgtccacgccgcgcaagttcccgctcgaggccgtcgtcgagcctaagctgccggcgcacctctacgccgagccatga

SEQ ID NO: 16053 - protein, 517 aa, Sorghum bicolor
  misc_feature: Useful for making plants with altered carbohydrate content
  misc_feature: Functional homolog of the protein sequence given in SEQ ID NO 14183
  misc_feature: Ceres ANNOT ID no. 8654367
  misc_feature: Up-regulated in root tissues in response to salicylic acid treatment
  misc_feature (10)..(514): SWISSPROT Homolog: EC 1.14.13.21 Flavonoid 3'-monooxygenase
  misc_feature (35)..(503): Pfam ID: p450 Pfam Description: Cytochrome P450
MELPTWASFLGVVLATVMLLKAILGRRSRRVYNLPPGPKPWPIIGNLNLMGALPHRSIHELSRKYGPLMQLQFGSFPVVVGSSVDMAKFFLKTHDVVFTDRPKTAAGKYTTYNYRDITWSPYGAYWRQARKMCLTELFSAKRLESYEYIRAAEVRALLRDLHSASGSGRAVMLKDYLSTVSLNVITRMVLGKKYLDKEEAAAGSVTTPEEFKWMLDELFLLNGVLNIGDSIPWLDWMDLQGYIKRMKKLGKMFDRFLEHVVEEHNQRRLREGKGFVAKDMVDVLLQIADDPTLEVELNRESVKAFTQDLIAGGTESSAVTVEWAISELLKKPEVIAKATEELDRVIGRGRWVTEKDMPSLPYVDAVVKETMRLHPVAPLLVPRLSREDTTVAGYDIPAGTRVLVSVWSIGRDPALWDAPEEFMPERFLGSKLDVKGQDYELLPFGSGRRMCPGYSLGLKVIQVSLANLLHGFAWSLPDGVTKEELSMEEIFGLSTPRKFPLEAVVEPKLPAHLYAEP

SEQ ID NO: 16054 - DNA, 1401 bp, Sorghum bicolor
  misc_feature: Ceres ANNOT ID no. 8654380
  misc_feature: Up-regulated in root tissues in response to salicylic acid treatment
  misc_feature: Encodes the peptide sequence at SEQ ID NO 16055
atggccggccacgcccagtcgtggaggacgtacctgtgctgcggcgcgggcggcagcgcggcggtcgaggacgacagcgggtcgacgacgcggcggcggaggatcacacggcggaggggcaaggacagccctcgctcgtcgtcgtcgcggatgtcgttcacgagcctcagctcgtcggagatgctgtcccctgaggacctgtcgctcacgctgtccgggtccaacctgcacgccttcacctacgccgagctccgctccgccacggccggcttctcccgcgccaactacctcggctgcggcgggttcggcccggtctacaggggcgccgtcggcgaggcgctccgcccgggcctccgcgcgcaggacgtcgccgtcaagtacctcgacctggaaggcggcacgcaggggcacaaggagtggctggctgaggtgttcttccttgggcaactgaggcacaagaacctggtgaagctcatcggctactgctacgaggccaagcaccggatgctggtgtacgagttcatgagcttcgggagcctcgagaaccacctcttcaaaagtgttaacggcgccctcccatggatgacaaggatgaagatcgccgtcggcgcggccaagggcctcgccttcctccacaacgccgacccgccggtgatctaccgcgacttcaaggcctccaacatcctgctcgactcggactacaacaccaagctgtccgacttcggtctggccaaggacgggcctcagggggacgagacgcacgtgacgacgcgtgtgatggggacgcacgggtacgcggcgcccgagtacatcctgacgggccacctgaccgccaagagcgacgtgtacagcttcggcgtggtgctgctggagctgctcgccggccggcagtcggtggaccgctcgcggcggccgcgcgagcagaacctcgtggactgggccaggccgtacctgaagcaccccgacaggctgtaccgggtcatggacccggccctggagtgccagtactcgtgcaggggcgccgaggtggccgccgtcgtggcgtacaagtgcctgagccagaaccccaagtccaggcccacgatgagggaggtggtcagggccctggagcccgtgctcggcatggacgacttcttccccgccggcccgttcgtgttcaccatcagcgtggaggaggacaaggtggtgggcgtcaaggtggaggtggaggagaagctgccgcagcagcaccagagccaccaggacaggcaccggcagaagtaccccaactcgtcgatccacgccggcggcattgtgctgcacggccgggaagggatggtcggcggcgatgactacaccgccacgctccggcggcagcggagggcggcggcggcgagctaccacaaggagaggggggcttaa

SEQ ID NO: 16055 - protein, 466 aa, Sorghum bicolor
  misc_feature: Useful for making plants with modulated heat sensitivity
  misc_feature: Functional homolog of the protein sequence given in SEQ ID NO 14079
  misc_feature: Ceres ANNOT ID no. 8654380
  misc_feature (71)..(377): SWISSPROT Homolog: EC 2.7.11.1 Non-specific serine/threonine protein kinase
  misc_feature (91)..(369): Pfam ID: Pkinase Pfam Description: Protein kinase domain
MAGHAQSWRTYLCCGAGGSAAVEDDSGSTTRRRRITRRRGKDSPRSSSSRMSFTSLSSSEMLSPEDLSLTLSGSNLHAFTYAELRSATAGFSRANYLGCGGFGPVYRGAVGEALRPGLRAQDVAVKYLDLEGGTQGHKEWLAEVFFLGQLRHKNLVKLIGYCYEAKHRMLVYEFMSFGSLENHLFKSVNGALPWMTRMKIAVGAAKGLAFLHNADPPVIYRDFKASNILLDSDYNTKLSDFGLAKDGPQGDETHVTTRVMGTHGYAAPEYILTGHLTAKSDVYSFGVVLLELLAGRQSVDRSRRPREQNLVDWARPYLKHPDRLYRVMDPALECQYSCRGAEVAAVVAYKCLSQNPKSRPTMREVVRALEPVLGMDDFFPAGPFVFTISVEEDKVVGVKVEVEEKLPQQHQSHQDRHRQKYPNSSIHAGGIVLHGREGMVGGDDYTATLRRQRRAAAASYHKERGA

SEQ ID NO: 16056 - DNA, 1080 bp, Sorghum bicolor
  misc_feature: Ceres ANNOT ID no. 8654433
  misc_feature: Encodes the peptide sequence at SEQ ID NO 16057
atggcggatgccggcagggacctcgtgcttgggcttgggatgggcgtcgtcggagtgcggagggaggaggaagccgccgagagggggagtaggagggatagggacgcgaggagggagctggagttcgggacgacggggtggtgcggcgcccggtcctcgccggagccgccagccgtgcgactcacgctcctgcccggcctggtgccccgcctcggcggcctcccgtggccgccgccgccgccgccgccgccgccgtcgtccgagaccaaccggcatttggaggcgtcgacgacgcgtggcttcgacgttaaccgtgcgccgtcgctgtccgtggccggtgccgccgcggcggaggaggacgaggagcacgacgaggcgggcgcggcggcggcgtcgtcgtcgcccaacaacagcgcgggctccttcccgacggacttctccgcgcagggcggccaggtggcgcccggaggcgggggcgaccgcggcgcgtgctcccgcgccagcgacgacgacgacggcgggtcggcgcgcaagaagctgcgcctctccaaggagcagtccgcgttcctggaggagagcttcaaggagcacgccacgctgaacccgaagcagaagctggcgctggcgaagcagctcaacctccggccgcgccaggtggaggtgtggttccagaaccgcagagccaggacgaagctgaagcagacggaggtggactgcgagtacctgaagcgctgctgcgagacgctgacggaggagaaccggcggctgcagaaggagctagccgagctccgcgcgctcaagacggtgcaccctttctacatgcacctcccggccaccaccctctccatgtgcccctcctgcgagcgcgtcgcctccaactcctccgcccctgccgtcgcaccggtggcgccagcgtcgtcgccctcccctgctgctactggcattgcggcatcgtcggccccgtcggagcagcagaggccatcgtcgttcgcagctctgttctcgtccccccttaaccgcccgctggtggccgcccaggcgcaaccgcaaccgcgaccgcaggcgccggccagctcttga

SEQ ID NO: 16057 - protein, 359 aa, Sorghum bicolor
  misc_feature: The sequence is a functional homolog of SEQ ID NO 1674 in the 10/374,780 US patent application
  misc_feature: Ceres ANNOT ID no. 8654433
  misc_feature (233)..(277): Pfam ID: HALZ Pfam Description: Homeobox associated leucine zipper
  misc_feature (178)..(232): Pfam ID: Homeobox Pfam Description: Homeobox domain
MADAGRDLVLGLGMGVVGVRREEEAAERGSRRDRDARRELEFGTTGWCGARSSPEPPAVRLTLLPGLVPRLGGLPWPPPPPPPPPSSETNRHLEASTTRGFDVNRAPSLSVAGAAAAEEDEEHDEAGAAAASSSPNNSAGSFPTDFSAQGGQVAPGGGGDRGACSRASDDDDGGSARKKLRLSKEQSAFLEESFKEHATLNPKQKLALAKQLNLRPRQVEVWFQNRRARTKLKQTEVDCEYLKRCCETLTEENRRLQKELAELRALKTVHPFYMHLPATTLSMCPSCERVASNSSAPAVAPVAPASSPSPAATGIAASSAPSEQQRPSSFAALFSSPLNRPLVAAQAQPQPRPQAPASS

SEQ ID NO: 16058 - DNA, 582 bp, Sorghum bicolor
  misc_feature: Ceres ANNOT ID no. 8654489
  misc_feature: Encodes the peptide sequence at SEQ ID NO 16059
atggtgacaggggccggggcggtgtggctggagattgcgccgtcagggactaagtgtgtgtcggaggagatccaatccaacgttgtcgtcatcggcgactactccgtcctctacgagcaccaccacgcccaccctaccatcgccgtcaaggttacatccccttttggagacattgttcataagaaagaaaaggtttcaatggagcaatttgcatttaccacagcagaagcagggaactaccttgcctgcttctcgattgatggtgaggacagagggttagcggtgaaactaaatcttgattggaaagttgggatagctactagagactggaattctgttgctaaaaaggaaaagatcgagggagtcgaactggagttactcaagcttgaagttgctgtccaatcaatccaagacaacctgcttcttctaaaatccaaagaagctaacatgagggatgtcagtgaaaagacgaattctagagtcacgtggttgagcatgctttctcttagtgtttgcattgcagtctctgtttcacagttgtggcatctacaacagtacttccggaagaagaagctcatctaa

SEQ ID NO: 16059 - protein, 193 aa, Sorghum bicolor
  misc_feature: Useful for making plants with altered carbohydrate content
  misc_feature: Functional homolog of the protein sequence given in SEQ ID NO 13728
  misc_feature: Useful for making plants with altered cell wall content and/or composition
  misc_feature: Functional homolog of the protein sequence given in SEQ ID NO 13729
  misc_feature: Ceres ANNOT ID no. 8654489
  misc_feature (30)..(101): Pfam ID: EMP24_GP25L Pfam Description: emp24/gp25L/p24 family/GOLD
MVTGAGAVWLEIAPSGTKCVSEEIQSNVVVIGDYSVLYEHHHAHPTIAVKVTSPFGDIVHKKEKVSMEQFAFTTAEAGNYLACFSIDGEDRGLAVKLNLDWKVGIATRDWNSVAKKEKIEGVELELLKLEVAVQSIQDNLLLLKSKEANMRDVSEKTNSRVTWLSMLSLSVCIAVSVSQLWHLQQYFRKKKLI

SEQ ID NO: 16060 - DNA, 861 bp, Sorghum bicolor
  misc_feature: Ceres ANNOT ID no. 8654548
  misc_feature: Encodes the peptide sequence at SEQ ID NO 16061
atggccgggaagcaaggtttcaaggagcagcagttcaatgatcagaggagacagcaggcttcgattcaaggagacgacatcgccaagagcctggtggggttcggcggcggcggcggcaggctgatctcccatgagcaggaggacgccatcatcgtggcggcgctgcggcacgtggtgtccgggtacagcacgccgccgccggaggtcgtcacggtggcgggcggcgagccgtgcggggtctgcggcatcgacggatgcctcggctgcgacttcttcggggcggcgccggagctgacgcaacaggaagcagtgaacttcggcacagggcagatggtagcgacagctgcggcagcggcggccggaggggagcacgggcagaggacgcggcggcgtcggaagaagaacatgtaccgcggcgtgcggcagcggccgtgggggaagtgggcggcggagatccgcgacccgcggcgcgcggcgcgcgtgtggctgggcacgttcgacaccgcggaggaggccgccagggcctacgactgcgccgccatcgagttccgcggcgcgcgcgccaagctcaatttcccgggccacgaggcgttgctgccgttccagggccatggccatggcggcgacgcttgcgccaccgcggcggcgaacgccgagacgcagacgacaccgatgctgatgacgccgtcgccgtgcagtgcagacgccgcggcggcggcgccgggagactggcagctgggcggcggcgtggacggcggagagggagacgaggtgtgggaaggtctgctacaggacctgatgaagcaggacgaggcggacctctggttcttgccattttccggcgctgcatctagtttttga

SEQ ID NO: 16061 - protein, 286 aa, Sorghum bicolor
  misc_feature: The sequence is a functional homolog of SEQ ID NO 14 in the 10/903,236 US patent application
  misc_feature: The sequence is a functional homolog of SEQ ID NO 1737 in the 10/374,780 US patent application
  misc_feature: The sequence is a functional homolog of SEQ ID NO 2129 in the 10/666,642 US patent application
  misc_feature: The sequence is a functional homolog of SEQ ID NO 74 in the 10/714,887 US patent application
  misc_feature: The sequence is a functional homolog of SEQ ID NO 74 in the 11/435,388 US patent application
  misc_feature: Ceres ANNOT ID no. 8654548
  misc_feature (135)..(186): Pfam ID: AP2 Pfam Description: AP2 domain
MAGKQGFKEQQFNDQRRQQASIQGDDIAKSLVGFGGGGGRLISHEQEDAIIVAALRHVVSGYSTPPPEVVTVAGGEPCGVCGIDGCLGCDFFGAAPELTQQEAVNFGTGQMVATAAAAAAGGEHGQRTRRRRKKNMYRGVRQRPWGKWAAEIRDPRRAARVWLGTFDTAEEAARAYDCAAIEFRGARAKLNFPGHEALLPFQGHGHGGDACATAAANAETQTTPMLMTPSPCSADAAAAAPGDWQLGGGVDGGEGDEVWEGLLQDLMKQDEADLWFLPFSGAASSF

SEQ ID NO: 16062 - DNA, 1209 bp, Sorghum bicolor
  misc_feature: Ceres ANNOT ID no. 8654593
  misc_feature: Encodes the peptide sequence at SEQ ID NO 16063
atggagaaaggaaaacacatccagccaccgacttatggcaaccttgtaacgattctttctattgatggtggaggcattcgaggaatcattccggctgttgttctcacctttctggaatcagagttgcagaaacttgatggagaggaagccaggttagcagattacttcgatgtcgttgctgggaccagcacaggggggcttgtgacctcaatgctggttgcaccaaacaatacaaacaggccactctttgcagccaaggatattcaagcattttatatgaaccatgctcccaagattttcccacagcagaggggtccatttggtaagataatgaggatattccgatcgctgtcaggaccttcctatgatggtaagtaccttcatgatgttgtcagaaagaagttaggaatcaccaggctgcatgagactttaacagatgtggtaataccaactttcgacatcaagcggctacaacctattattttctcgtcctatgaggttaagaatgagaagtacaacacaatggatgctctactatcagatatttgtatcagcacatctgctgctccaacttatcttcctgcacactacttcaaaacagaagattgccatgggaacaccaaggagttccatcttattgatggaggagtagctgccaataatccggctttagttgccattggagaagtaaccaagcagatattcaaggaaaacccagatttcttcccaataaaacctatggattatggccggtttttggtcatttcactaggcacaggctccgcaaagtttgaagcaaactacaatgcacaaaaggctaaatcatggggagtgttgggttggttgcttggcagtggatccactcccttggtagatattttcacacaggcaagtgcagatatggtggatatccatatctctgctgttttcaaagccttgcattctgagcaaaactatctgaggattcaggatgatactctacaagggacactgtcctcggttgatgttgcaaccaaggaaaatatggagaaacttgccagagttggagatatgctactaaagaaacctgtgtcacatgtgaatttggaaactggccatatggtgcctgcctgtcataggacagagatgactaatgaagaagctctaaagagatttgcgaagctactgtctgatgaaaggcgaattcgcaaggcaagatcgccaaaatga

SEQ ID NO: 16063 - protein, 402 aa, Sorghum bicolor
  misc_feature: Useful for making plants with modulated heat sensitivity
  misc_feature: Functional homolog of the protein sequence given in SEQ ID NO 13256
  misc_feature: Ceres ANNOT ID no. 8654593
  misc_feature (10)..(229): SWISSPROT Homolog: EC 3.1.1.5 Lysophospholipase
  misc_feature (19)..(227): Pfam ID: Patatin Pfam Description: Patatin-like phospholipase
MEKGKHIQPPTYGNLVTILSIDGGGIRGIIPAVVLTFLESELQKLDGEEARLADYFDVVAGTSTGGLVTSMLVAPNNTNRPLFAAKDIQAFYMNHAPKIFPQQRGPFGKIMRIFRSLSGPSYDGKYLHDVVRKKLGITRLHETLTDVVIPTFDIKRLQPIIFSSYEVKNEKYNTMDALLSDICISTSAAPTYLPAHYFKTEDCHGNTKEFHLIDGGVAANNPALVAIGEVTKQIFKENPDFFPIKPMDYGRFLVISLGTGSAKFEANYNAQKAKSWGVLGWLLGSGSTPLVDIFTQASADMVDIHISAVFKALHSEQNYLRIQDDTLQGTLSSVDVATKENMEKLARVGDMLLKKPVSHVNLETGHMVPACHRTEMTNEEALKRFAKLLSDERRIRKARSPK

SEQ ID NO: 16064 - DNA, 909 bp, Sorghum bicolor
  misc_feature: Ceres ANNOT ID no. 8654646
  misc_feature: Encodes the peptide sequence at SEQ ID NO 16065
atggacttcgacgaccacgacgatggcgacgaggagatggcgccgatgccggtgagctccagctacgaggccccgcctctggcagtggcagctggcgggtttgctggcggcgtggcggcggcgcccaagccgcccgtcggtgagcccggcggcggccgcgccagcaaggccccgagcggcctcggccttggcggcctccacggcgccggcggcgggaggtaccgcgagtgcctcaagaaccacgcggtcggcatcgggggccacgccgtggacgggtgcggcgagttcatgcccgcgggcgaggaaggcacgctggacgcgctccgctgcgccgcgtgcaactgccaccgcaacttccaccgcaaggagtcccccgccgccgccgagggctcgcccatctcctccgccgcgctggtcgcctacggcggcacgccgcaccagcaccaccacttctccccgtactaccgcaccccggccggcgccggatacttccaccaccaccaccaccagcagccgccgccgctccatcacatggcgcacacgccacggccgctggcgctgccgtccacgtccccacacagcgggcgcgacgacggcgacgacctgtccgggatgcccatgtcggcgatggggccgctgacgctgagcggcatgtccctcggcggcagcggcggcgccgggccctccggcggctcgggcgggtccgggtctggcaagaagcggttccgcaccaagttcacccaggagcagaaggacaagatgctggcgttcgcggagcgcgtcgggtggcgcatccagaagcacgacgaggccgccgtgcagcagttctgcgacgaggtcggcgtcaagcgccacgtgctcaaggtgtggatgcacaacaacaagcacaccctcggcaagaagccgtag

SEQ ID NO: 16065 - protein, 302 aa, Sorghum bicolor
  misc_feature: The sequence is a functional homolog of SEQ ID NO 108 in the 10/714,887 US patent application
  misc_feature: The sequence is a functional homolog of SEQ ID NO 108 in the 11/435,388 US patent application
  misc_feature: The sequence is a functional homolog of SEQ ID NO 110 in the 10/714,887 US patent application
  misc_feature: The sequence is a functional homolog of SEQ ID NO 110 in the 11/435,388 US patent application
  misc_feature: Useful for biocontainment applications
  misc_feature: Useful for making plants with modulated biomass
  misc_feature: Useful for making plants with modulated flowering time
  misc_feature: Functional homolog of the protein sequence given in SEQ ID NO 13913
  misc_feature: Useful for making plants with modulated low light sensitivity
  misc_feature: Functional homolog of the protein sequence given in SEQ ID NO 13756
  misc_feature: Ceres ANNOT ID no. 8654646
  misc_feature (69)..(128): Pfam ID: ZF-HD_dimer Pfam Description: ZF-HD protein dimerisation region
MDFDDHDDGDEEMAPMPVSSSYEAPPLAVAAGGFAGGVAAAPKPPVGEPGGGRASKAPSGLGLGGLHGAGGGRYRECLKNHAVGIGGHAVDGCGEFMPAGEEGTLDALRCAACNCHRNFHRKESPAAAEGSPISSAALVAYGGTPHQHHHFSPYYRTPAGAGYFHHHHHQQPPPLHHMAHTPRPLALPSTSPHSGRDDGDDLSGMPMSAMGPLTLSGMSLGGSGGAGPSGGSGGSGSGKKRFRTKFTQEQKDKMLAFAERVGWRIQKHDEAAVQQFCDEVGVKRHVLKVWMHNNKHTLGKKP

SEQ ID NO: 16066 - DNA, 1044 bp, Sorghum bicolor
  misc_feature: Ceres ANNOT ID no. 8654635
  misc_feature: Encodes the peptide sequence at SEQ ID NO 16067
atgagtcaggagcgcctgtaccaagatcgcaaggacgtgccgcccgtccacttcaccacgccgccgccgccatcccaccaccaccagcagcagctggagtgcttctccgatgaggtggatagccgcgggagcgccgagcagaaggagcccgccagtggtggggcaggggccctggtggtgtcgggcggcggcggcgacgaggcgagcatggagctgtccaagaagcggaggggccggcccccggggtccaagaacaagccgaagccgcccgttgtgatcacgcgtgaggcggagccggccgccgcgatgcgcccgcacgtgatcgagatcccctgcggctgcgacgtggccgacgcgctcgcgcgcttcgcggcgcggcggaacctcgggatctgcgtgctcgcgggcacgggcgccgtcgccaacgtgtcgctccgccacccgatgtccggcggcgtcgcggtcggtggcggtggcggtggcgccccgacgaccgccatcgtgttccacgggcagtacgagatcctctccatctccgccacgttccttccccccgccatgtccgccgtggcgccgcaggccgccgccgccgccgcgtgcctctccatctcgctggcggggccgcacgggcaggtcgtcggcggcgccgtcgtgggcccgctgtacgccgcgtccgccgtcgtcctcgtcgcggccgccttcaccaaccccaccttccaccgcctcccgctcccaccggacgacgacgcggccgtgtccgtctccgtctcgctctccgccggcagcggcggcgaccatgcagcggacgagcaccaccgaggcgtcgcccaccagcaccagcaccccggggagcagccgccgccgcaagagcatcatcgtcctctcgccgtacgacgccaggccccgccgcaccttgcctcggcatcagcagcgcagcctgtggagccgtgcggcggcccaccggccgtgcccatctacaccgcttgccacccgcagccgcaagacgtgatttggccgccgccaccgccaccgccgccgtactga

SEQ ID NO: 16067 - protein, 347 aa, Sorghum bicolor
  misc_feature: The sequence is a functional homolog of SEQ ID NO 1407 in the 10/374,780 US patent application
  misc_feature: The sequence is a functional homolog of SEQ ID NO 20 in the 10/669,824 US patent application
  misc_feature: The sequence is a functional homolog of SEQ ID NO 20 in the 10/870,198 US patent application
  misc_feature: The sequence is a functional homolog of SEQ ID NO 356 in the 11/435,388 US patent application
  misc_feature: The sequence is a functional homolog of SEQ ID NO 358 in the 10/714,887 US patent application
  misc_feature: The sequence is a functional homolog of SEQ ID NO 1418 in the 10/374,780 US patent application
  misc_feature: Ceres ANNOT ID no. 8654635
MSQERLYQDRKDVPPVHFTTPPPPSHHHQQQLECFSDEVDSRGSAEQKEPASGGAGALVVSGGGGDEASMELSKKRRGRPPGSKNKPKPPVVITREAEPAAAMRPHVIEIPCGCDVADALARFAARRNLGICVLAGTGAVANVSLRHPMSGGVAVGGGGGGAPTTAIVFHGQYEILSISATFLPPAMSAVAPQAAAAAACLSISLAGPHGQVVGGAVVGPLYAASAVVLVAAAFTNPTFHRLPLPPDDDAAVSVSVSLSAGSGGDHAADEHHRGVAHQHQHPGEQPPPQEHHRPLAVRRQAPPHLASASAAQPVEPCGGPPAVPIYTACHPQPQDVIWPPPPPPPPY

SEQ ID NO: 16068 - DNA, 468 bp, Sorghum bicolor
  misc_feature: Ceres ANNOT ID no. 8654674
  misc_feature: Encodes the peptide sequence at SEQ ID NO 16069
atggccaacgccttgctgctcctcgtggcgctgctcgtcgccgggtgcgcggctctggcttcggccacgtcgtacaccgtcggcgacgggcagggctggacgaccaacgtcgactacagcacctgggccagcggcaagagcttcgccgtcggagacaaactagtgttcaactacatgagcaaggcgcactcggtgacggaggtgagcaagagcggctacgacacctgctccggcgccaacccgctgagcgacgacgagagcggctccaccgtcgtcccgctccagaccccgggaacgcactacttcatctgcaacgtccccggccactgcgcggaaggcatgaagctggccgtcgccgtctccgccacgccgtcttccgcggggggcgccctgctgcaggtcccggcgatggcctccgtcgtcgccgcggcggccgcaggcgctgcgatcaagctcgcgctcttctga

SEQ ID NO: 16069 - protein, 155 aa, Sorghum bicolor
  misc_feature: Useful for making plants with modulated nitrogen use efficiency
  misc_feature: Functional homolog of the protein sequence given in SEQ ID NO 14314
  misc_feature: Ceres ANNOT ID no. 8654674
  misc_feature (33)..(114): Pfam ID: Cu_bind_like Pfam Description: Plastocyanin-like domain
MANALLLLVALLVAGCAALASATSYTVGDGQGWTTNVDYSTWASGKSFAVGDKLVFNYMSKAHSVTEVSKSGYDTCSGANPLSDDESGSTVVPLQTPGTHYFICNVPGHCAEGMKLAVAVSATPSSAGGALLQVPAMASVVAAAAAGAAIKLALF

SEQ ID NO: 16070 - DNA, 1314 bp, Sorghum bicolor
  misc_feature: Ceres ANNOT ID no. 8654715
  misc_feature: Encodes the peptide sequence at SEQ ID NO 16071
atggacatgaacgagagcggcgagaaagggatggagggcaacgcgtcgtccggcgccgccggcatcccggtggagtggcagacccaattcagcgccgccgccttctcgtgcgcgccgccgcagcagcagcaggttccaatgatggactccgccttcgcgtccgccgccggcctgtgggcgtccacctcccaggccatggcgctctccgacgtcggcgccatgtcggccgcgcggggcggtggcggcttcttggcgccggtccccggtttcctccctcagggcctcggccatttccccgtcgactccggcttcatcgagcgcgccgcgcgggcgtcctgcttcggcggcggcggcggggtgatgggtgctaccgctggctacggcacagctgatcatcagaccatgaacaacgcgttcagtggctcctcagaggcgctgttggatcaccagaggaaggacggcaacgacaagggcgagccggagctcggccggaacggccacgacggggtgctgagctcggaggctgctgctggggactgctcgtccaaggggacctcggactccaagaagaggagaaggcctaacgaggtgatgggaggcgatcaggttcagtcggccaacctgcccgcggactcggcaaacgagagcgtgcacagcaaggacaaaggcgaggagagcagcccggcaacgaccaccggacccggaaagtcgaaagggaagggggcgaaagagacctccgagtctcagaaggaagactacattcatgtccgagctcggcgcggacaggcaaccaacagccacagcctagcagaaaggttgaggagggagaagattagcgagaggatgaagcttctgcaggaccttgttcctggctgcagcaaagtcactgggaaagcggtaatgcttgacgagatcatcaactatgttcagtccctgcaaagacaagttgagttcttatcgatgaagctcgcaacagtaaacccaaggcttgacctcaatatagaagggcttctatcgaaagatcttcttcgcttccctggtgttccttcttcttcccttggattttccccagaaatgatgcacccacaattacagctatcgcaaccaggcctgattcaggggggcgctgctggcatggccaatccggacgtattcaggagaatcatgcaggcacaattgagtgcaaaagacgggtctcagatgtcccacgcattgaatggagggtcattcagcgaggttgcgcagatggcgtacccgtcgctggggtcccaggacttgagcatcaggccgtcgcaggacgggtttcaaatgtga

SEQ ID NO: 16071 - protein, 437 aa, Sorghum bicolor
  misc_feature: The sequence is a functional homolog of SEQ ID NO 1930 in the 10/374,780 US patent application
  misc_feature: Ceres ANNOT ID no. 8654715
  misc_feature (263)..(313): Pfam ID: HLH Pfam Description: Helix-loop-helix DNA-binding domain
MDMNESGEKGMEGNASSGAAGIPVEWQTQFSAAAFSCAPPQQQQVPMMDSAFASAAGLWASTSQAMALSDVGAMSAARGGGGFLAPVPGFLPQGLGHFPVDSGFIERAARASCFGGGGGVMGATAGYGTADHQTMNNAFSGSSEALLDHQRKDGNDKGEPELGRNGHDGVLSSEAAAGDCSSKGTSDSKKRRRPNEVMGGDQVQSANLPADSANESVHSKDKGEESSPATTTGPGKSKGKGAKETSESQKEDYIHVRARRGQATNSHSLAERLRREKISERMKLLQDLVPGCSKVTGKAVMLDEIINYVQSLQRQVEFLSMKLATVNPRLDLNIEGLLSKDLLRFPGVPSSSLGFSPEMMHPQLQLSQPGLIQGGAAGMANPDVFRRIMQAQLSAKDGSQMSHALNGGSFSEVAQMAYPSLGSQDLSIRPSQDGFQM

SEQ ID NO: 16072 - DNA, 1911 bp, Sorghum bicolor
  misc_feature: Ceres ANNOT ID no. 8654719
  misc_feature: Encodes the peptide sequence at SEQ ID NO 16073
atggctgtggcagtcctggatcggagctttagcagtgaatatcctggaggtagcagaactgaggggaggcagctgagctggaagagagtctttgtccaaactgacaatggttctgtccttggcatcgagctggagagaggagaaaatgtgcaaactgtgaaaaagaagctgcagatagccctcaatatgcccactgatgagagctccttgacctttggtgacctggttctgaataatgatcttagcagcattcgcaatgactcaccattgcttctcaaaaggaatcagattcaccgaagcaattccacaccatgcctctcccctactggcaaggatgtttggcaaagagaccggagtgggcccattgaaatccttggctgttcaagcccttcctctcggatgaagcagcttgctaaagatgtcattaaagccataaagaatggtgttgatccagttgctgttaacagtgggatgggtggtgcctactacttcaagaacatttggggagagcgtgttgcaattgtcaagccaacagatgaggaaccatttgccccaaacaatccaaaaggttttgtggggaaggctctgggacagccaggcctaaaaagatctgtgcgtgtcggtgagacgggcttcagagaggttgctgcttacctcctcgactatgatcactttgcaaatgtccctcgcaccatgctggtcaagataacacacaccatcttcaatgtgaatgactgcgttggctgcaaaactaaagtattctgcaacaaatcagaggctgtgagcaagattgcatcactgcaggagttcattcctcatgattttgatgccagtgaccatgggacctcaagcttccctgtatctgcagtgcatagaattggcatacttgacattagaatcttcaacactgacaggcatgctggaaatcttctggtcaagaagcttggtcctggggctgacaattttggagagcagacagaacttatcccgattgaccatggcctttgtcttccagaatgcctagaagacccttactttgagtggatccactggccacaggcatctgttcccttctccgaggaggagcttgaatacattgcaaaacttgatcctgtaaaagatgcagaaatgctacgcacggagctaccgatgatacgagaggcatgtctcagggtgctggtgctgtcaacagtatttctcaaggaagctgctgtgtttggtctctgcctctccgagataggagacatgatgagcaggcagttcactgcaaaagaagaggaaccaagtcagcttgagcttctctgcatggaggcaaggaagtgggttgaggaaagagagttctttcttcctgacgaagccggagttgaagatgacgatgatgacttcacccagttccttcttgacagcgaggatgattcggatgcctttgaaccaccagctttctgcaagtttggtagcatgaaggcaagttccaggaatccactatccaagctagatgagtgtgatgaggaggatgaagatgagaccgaggacgacgaagatgatgacatcttgaccagtgcattgccccagaagattccttctatctccaagctgtcgtcgtccatgaaggggcttggcttcatcgggaaatctaaactctaccgtagaggagttccaaagggtaaagtgacaggtagaactaactacagtggcaaagctagtgagcatcagtccgggagcaggagcgccaacgagctgctcccgcccagcgccagttttgtgaagctgtcggacatgagccctaaagagtggagtgcattccttgagaagttccaggagctgctcccaggtgccttccacacccggaagcacactgctggtgttggccagcgtccgatgccgaggctgggcacgtcttgccagttttga

SEQ ID NO: 16073 - protein, 636 aa, Sorghum bicolor
  misc_feature: Useful for making plants with altered protein content
  misc_feature: Functional homolog of the protein sequence given in SEQ ID NO 13479
  misc_feature: Ceres ANNOT ID no. 8654719
  misc_feature (143)..(264): SWISSPROT Homolog: EC 2.7.1.67 1-phosphatidylinositol 4-kinase
  misc_feature (157)..(420): Pfam ID: PI3_PI4_kinase Pfam Description: Phosphatidylinositol 3- and 4-kinase
MAVAVLDRSFSSEYPGGSRTEGRQLSWKRVFVQTDNGSVLGIELERGENVQTVKKKLQIALNMPTDESSLTFGDLVLNNDLSSIRNDSPLLLKRNQIHRSNSTPCLSPTGKDVWQRDRSGPIEILGCSSPSSRMKQLAKDVIKAIKNGVDPVAVNSGMGGAYYFKNIWGERVAIVKPTDEEPFAPNNPKGFVGKALGQPGLKRSVRVGETGFREVAAYLLDYDHFANVPRTMLVKITHTIFNVNDCVGCKTKVFCNKSEAVSKIASLQEFIPHDFDASDHGTSSFPVSAVHRIGILDIRIFNTDRHAGNLLVKKLGPGADNFGEQTELIPIDHGLCLPECLEDPYFEWIHWPQASVPFSEEELEYIAKLDPVKDAEMLRTELPMIREACLRVLVLSTVFLKEAAVFGLCLSEIGDMMSRQFTAKEEEPSQLELLCMEARKWVEEREFFLPDEAGVEDDDDDFTQFLLDSEDDSDAFEPPAFCKFGSMKASSRNPLSKLDECDEEDEDETEDDEDDDILTSALPQKIPSISKLSSSMKGLGFIGKSKLYRRGVPKGKVTGRTNYSGKASEHQSGSRSANELLPPSASFVKLSDMSPKEWSAFLEKFQELLPGAFHTRKHTAGVGQRPMPRLGTSCQF

SEQ ID NO: 16074 - DNA, 843 bp, Sorghum bicolor
  misc_feature: Ceres ANNOT ID no. 8654733
  misc_feature: Encodes the peptide sequence at SEQ ID NO 16075
atgcgccgcctcagccgcgccgccgcgctccccctcctcctcctcctcgccctcgcagccgccaccaccaccacaacggtggcggcggcggcggcggcgaaggcgaaggctcccgcggcagcggcgccgccagcgcctccgaacgtgacggcggagatggccaagggcgggtgcaaggcgttcgcggacctgatcgcggcgtccccggacgcgtcgtcgacgtaccagtcggccgtggagggcggcctgacggtgttctgcccctccgacgacgccgtgcgtgcgttcctgccaaaatacaagaacctcagcgcggacgggaaggcggagctgctgctgttccacgccgtgccggtgcactactcgctggggagcctcaagtccaacaacgggcccatgaacacgctggccaccgacggcgccgcccggaacttcaacttcacggtgcagaaccagggcgacgtcgtcaccatccggacggccgccggcagcggcgcgcccgcaagggtcaagtccacggcggtcgacaaggacccgctcgctgtctacgtcatcaacgccgtggtggagcccgtggagctgttcaagcccgcgccgtcgccgacgccggcccccgcgcccgcgcccgccgccgcggcggacgcgcccaaggccgggaagaagggcgccgcgcgccacgcgccgcccgccgtggccgacgcgcccgggcccaacgcggacgacaacgcggctcctgtggaccagaaggacgccaacaagaagagcgcggccgccggcgcgccgtgcgaccggtggtggctcgccaccgtgctggcggcggccgtggcctcagcattggcttag

SEQ ID NO: 16075 - protein, 280 aa, Sorghum bicolor
  misc_feature: Useful for making plants with altered cell wall content and/or composition
  misc_feature: Functional homolog of the protein sequence given in SEQ ID NO 14315
  misc_feature: Ceres ANNOT ID no. 8654733
  misc_feature (57)..(191): Pfam ID: Fasciclin Pfam Description: Fasciclin domain
MRRLSRAAALPLLLLLALAAATTTTTVAAAAAAKAKAPAAAAPPAPPNVTAEMAKGGCKAFADLIAASPDASSTYQSAVEGGLTVFCPSDDAVRAFLPKYKNLSADGKAELLLFHAVPVHYSLGSLKSNNGPMNTLATDGAARNFNFTVQNQGDVVTIRTAAGSGAPARVKSTAVDKDPLAVYVINAVVEPVELFKPAPSPTPAPAPAPAAAADAPKAGKKGAARHAPPAVADAPGPNADDNAAPVDQKDANKKSAAAGAPCDRWWLATVLAAAVASALA

SEQ ID NO: 16076 - DNA, 609 bp, Sorghum bicolor
  misc_feature: Ceres ANNOT ID no. 8654805
  misc_feature: Encodes the peptide sequence at SEQ ID NO 16077
atggatcccagcaaatccagcacccctccgccgcctccagtcatgggcgcccccgttgcctaccctccggcggcgtaccctcccggcgcggccgccggcgcggccgcctacgcgccgcagctctacgcgccgcccgcagctgccgcggcccagcaggcggccgccgcgcagcagcagcagctgcagatgttctgggcggagcagtaccgcgagatcgaggccaccaccgacttcaagaaccacaacctcccgctcgcccgcatcaagaagatcatgaaggccgacgaggacgtccgcatgatcgccgccgaggcccccgtcgtgttcgcccgggcctgcgagatgttcatcctcgagctcacccaccgcggctgggcgcacgccgaggagaacaagcgccgcacgcttcagaagtccgacattgccgctgccatcgcccgcaccgaggtgttcgacttcctcgtggacatcgttccgcgcgacgacgcaaaggacgccgacgcggcggccgccgcagctgctgcggctgctgctgccgggatcccgcgtcctgccgcgggagtaccggccaccgaccccctcgcctactactatgtgcctcagcagtaa

SEQ ID NO: 16077 - protein, 202 aa, Sorghum bicolor
  misc_feature: The sequence is a functional homolog of SEQ ID NO 1109 in the 10/374,780 US patent application
  misc_feature: The sequence is a functional homolog of SEQ ID NO 1108 in the 10/374,780 US patent application
  misc_feature: The sequence is a functional homolog of SEQ ID NO 1188 in the 10/412,699 US patent application
  misc_feature: The sequence is a functional homolog of SEQ ID NO 835 in the 10/374,780 US patent application
  misc_feature: The sequence is a functional homolog of SEQ ID NO 1190 in the 10/412,699 US patent application
  misc_feature: The sequence is a functional homolog of SEQ ID NO 837 in the 10/374,780 US patent application
  misc_feature: The sequence is a functional homolog of SEQ ID NO 1908 in the 11/479,226 US patent application
  misc_feature: The sequence is a functional homolog of SEQ ID NO 2126 in the 10/374,780 US patent application
  misc_feature: The sequence is a functional homolog of SEQ ID NO 314 in the 10/374,780 US patent application
  misc_feature: The sequence is a functional homolog of SEQ ID NO 846 in the 10/225,066 US patent application
  misc_feature: The sequence is a functional homolog of SEQ ID NO 1107 in the 10/374,780 US patent application
  misc_feature: The sequence is a functional homolog of SEQ ID NO 712 in the 11/479,226 US patent application
  misc_feature: Useful for making plants with modulated cold sensitivity
  misc_feature: Functional homolog of the protein sequence given in SEQ ID NO 13649
  misc_feature: The sequence is a functional homolog of SEQ ID NO 1004 in the 10/225,066 US patent application
  misc_feature: The sequence is a functional homolog of SEQ ID NO 340 in the 10/374,780 US patent application
  misc_feature: The sequence is a functional homolog of SEQ ID NO 450 in the 11/435,388 US patent application
  misc_feature: Ceres ANNOT ID no. 8654805
  misc_feature (83)..(154): SWISSPROT Homolog: EC 2.7.7.7 DNA-directed DNA polymerase
  misc_feature (81)..(145): Pfam ID: CBFD_NFYB_HMF Pfam Description: Histone-like transcription factor (CBF/NF-Y) and archaeal histone
MDPSKSSTPPPPPVMGAPVAYPPAAYPPGAAAGAAAYAPQLYAPPAAAAAQQAAAAQQQQLQMFWAEQYREIEATTDFKNHNLPLARIKKIMKADEDVRMIAAEAPVVFARACEMFILELTHRGWAHAEENKRRTLQKSDIAAAIARTEVFDFLVDIVPRDDAKDADAAAAAAAAAAAAGIPRPAAGVPATDPLAYYYVPQQ

SEQ ID NO: 16078 - DNA, 429 bp, Sorghum bicolor
  misc_feature: Ceres ANNOT ID no. 8654813
  misc_feature: Encodes the peptide sequence at SEQ ID NO 16079
atggccacatcgaccgccgccgtgctgtccccgccgtccgtggccgggctccgcctggcgccgtccccccgccgggcggcgcgcgtggcgttccgcgcggcgccggcgcggcggtccgtggcggcgcgcgcggagctgagcgcgtcgctggtgatcagcctgagcacgggcgtgtcgctgttcctgggccgcttcgtcttcttcaacttccagcgggagaacgtggcgaagcaggtgcccgcgcagaacggcaagacgcacttcgacgccggcgacgagcgcgccaaggagttcgcggccctgctcaagtccaacgaccccgtgggcttcaacctcgtcgacgtcctcgcctggggctcgctcggccacatcgtcgcctactacatcctcgccacctccagcaacggatacgaccccaacttcttctga

SEQ ID NO: 16079 - protein, 142 aa, Sorghum bicolor
  misc_feature: Useful for making plants with modulated nitrogen use efficiency
  misc_feature: Functional homolog of the protein sequence given in SEQ ID NO 14316
  misc_feature: Useful for biocontainment applications
  misc_feature: Functional homolog of the protein sequence given in SEQ ID NO 14317
  misc_feature: Ceres ANNOT ID no. 8654813
  misc_feature (45)..(139): Pfam ID: PSI_PSAK Pfam Description: Photosystem I psaG / psaK
MATSTAAVLSPPSVAGLRLAPSPRRAARVAFRAAPARRSVAARAELSASLVISLSTGVSLFLGRFVFFNFQRENVAKQVPAQNGKTHFDAGDERAKEFAALLKSNDPVGFNLVDVLAWGSLGHIVAYYILATSSNGYDPNFF

SEQ ID NO: 16080 - DNA, 459 bp, Sorghum bicolor
  misc_feature: Ceres ANNOT ID no. 8654812
  misc_feature: Encodes the peptide sequence at SEQ ID NO 16081
atgacgcgctgctggatcgcgggcacgacaccaccggccggagcctgctgcaggccaagaaaggtgcccgcatttttcacctcttttctcggggattgcccggtgagcttcgagggcgccaactacacgatcatcacgagccggtgcaagggcccgctgtaccagccgacgctgtgctgcggcgcgctcaaggacttcgcgtgcccctacgccacctacatcaacgacgtcacgaccaactgcgccgccaccatgttcagctacatcaacctctacggcaagtacccgccgggcctcttcgccaacacctgccacgagggcgacaagggcctcgcgtgccccgaggacaccccgcaggtccagcccgggcagaaggcctccggcgcggccgccgtcgccgccgcgcccgccgcggccctggccgccgcgctggccgcctcgttgctcgtgtcctgctga

SEQ ID NO: 16081 - protein, 152 aa, Sorghum bicolor
  misc_feature: Useful for making plants with altered cell wall content and/or composition
  misc_feature: Functional homolog of the protein sequence given in SEQ ID NO 14318
  misc_feature: Useful for making plants with altered carbohydrate content
  misc_feature: Functional homolog of the protein sequence given in SEQ ID NO 14319
  misc_feature: Ceres ANNOT ID no. 8654812
MTRCWIAGTTPPAGACCRPRKVPAFFTSFLGDCPVSFEGANYTIITSRCKGPLYQPTLCCGALKDFACPYATYINDVTTNCAATMFSYINLYGKYPPGLFANTCHEGDKGLACPEDTPQVQPGQKASGAAAVAAAPAAALAAALAASLLVSC

SEQ ID NO: 16082 - DNA, 807 bp, Sorghum bicolor
  misc_feature: Ceres ANNOT ID no. 8654855
  misc_feature: Encodes the peptide sequence at SEQ ID NO 16083
atggggtccaaagctgcaatcttcgccacggcggctgtactggccgtcctcttctccgccccggcattggctcagaagagcagcccgcccgcgccggcgcccgtgtcactgccgccgaccccggcgccggcgccggcgccggcgccgcactacgtggacctggcggagctcctgagcgtggccgggccgttccacacgttcctcaactacctggagaagacggacgtgatcgagaccttccaggggcaggccaacaacaccaaggtgggcatcaccatcttcgtgcccaaggactcggcgttcgcggcgctcaagaagtccaccttcaccaacctcacctccgaccagctcaagacgctgctcctgtaccacgcgttccccaagttctactccctggccgagttcaagaacctgagctcgctcaacccggtgaacaccttcgccggtgcgccctacacgctcaacctcaccgacgacatgggcagcatctacgtgcagtccatgtggtccaggcccaagatcgccagcagcgtctacgccaccaagcccgtcgccatctacgcgctcaacaaggtgctcctgcccatgcagctcttcagcaaggacccgccgctcgcgccggcccccgcgcccgcgccggagtccggggcgtccgatgcgcccagcccggcggccggcaaagcaggcgggctggccggcggcaagggtgactcgacgagcgccgccgcgcacagcactggtgccgtcggcgtcgccagttccttgctgctcgctgccgcagggtgcttgatggttctccagtggtga

SEQ ID NO: 16083 - protein, 268 aa, Sorghum bicolor
  misc_feature: Useful for making plants with altered carbohydrate content
  misc_feature: Functional homolog of the protein sequence given in SEQ ID NO 14320
  misc_feature: Useful for making plants with altered cell wall content and/or composition
  misc_feature: Useful for making plants with altered lignin content
  misc_feature: Functional homolog of the protein sequence given in SEQ ID NO 14321
  misc_feature: Ceres ANNOT ID no. 8654855
  misc_feature (63)..(195): Pfam ID: Fasciclin Pfam Description: Fasciclin domain
MGSKAAIFATAAVLAVLFSAPALAQKSSPPAPAPVSLPPTPAPAPAPAPHYVDLAELLSVAGPFHTFLNYLEKTDVIETFQGQANNTKVGITIFVPKDSAFAALKKSTFTNLTSDQLKTLLLYHAFPKFYSLAEFKNLSSLNPVNTFAGAPYTLNLTDDMGSIYVQSMWSRPKIASSVYATKPVAIYALNKVLLPMQLFSKDPPLAPAPAPAPESGASDAPSPAAGKAGGLAGGKGDSTSAAAHSTGAVGVASSLLLAAAGCLMVLQW

SEQ ID NO: 16084 - DNA, 429 bp, Sorghum bicolor
  misc_feature: Ceres ANNOT ID no. 8654860
  misc_feature: Encodes the peptide sequence at SEQ ID NO 16085
atgcagatcttcgtcaagacgctgacggggaagacgatcacgctcgaggtcgagagcagcgacaccatcggccacgtcaaggccaagatccaggacaaggaaggcgtcccgccggaccagcagcgcctcatcttcgccggaaagcagctggaggatgaccgcaccctggccgactacaacatccagaaggagtccaccgttcacctggtgctccgcctccgcggcggtaccaagagcttcaaattcaacatcccaccaaacctcctcgtgctcgcgcgcaagtacaaggagaacaagctgatctgccgcaagtgctatgctcgccttcccctcaggtctaccaactgtcgcaagaagaagtgcggtcataacaatgagttgagggaaaagcacaagtttgtctccaagtatggtattgatcgtgaatag

SEQ ID NO: 16085 - protein, 142 aa, Sorghum bicolor
  misc_feature: Useful for making plants with modulated nitrogen use efficiency
  misc_feature: Functional homolog of the protein sequence given in SEQ ID NO 13585
  misc_feature: Useful for making plants with modulated cold sensitivity
  misc_feature: Useful for making plants with modulated flowering time
  misc_feature: Functional homolog of the protein sequence given in SEQ ID NO 14303
  misc_feature: Ceres ANNOT ID no. 8654860
  misc_feature (6)..(74): Pfam ID: ubiquitin Pfam Description: Ubiquitin family
  misc_feature (83)..(134): Pfam ID: Ribosomal_L40e Pfam Description: Ribosomal L40e family
MQIFVKTLTGKTITLEVESSDTIGHVKAKIQDKEGVPPDQQRLIFAGKQLEDDRTLADYNIQKESTVHLVLRLRGGTKSFKFNIPPNLLVLARKYKENKLICRKCYARLPLRSTNCRKKKCGHNNELREKHKFVSKYGIDRE

SEQ ID NO: 16086 - DNA, 603 bp, Sorghum bicolor
  misc_feature: Ceres ANNOT ID no. 8654866
  misc_feature: Encodes the peptide sequence at SEQ ID NO 16087
atggcgatgccccaaaaggcaacatccattgttctggctatggtgctagtccgccttgcgatgctgtccctggccgcggggacgactaccgcgactttctacaccccaagctacacaccgtcggcttgctacgggttccaggacaagggcacgatgatcgcggcggcgagcgaagccttctggaacggcggcaaggcctgcggcgaccggtacgaggtcacgtgcaagggcgccaccaacgacggcgtgccggaaccgtgcaccggccggagcgtcaccgtccggatcgtggacctctgccccgccgccggctgccggggcaccatcgacctctcgcaggaggccttcgccatcatcgccgacccgaacgccggcaaggtccagatcgagtatcgccgcacaccaccattacctagagcctggcgtccgagagccaaccagccaacaacaccggtttcccttgctgtgtttcgcatgccgattttcgaaaacagaaatgctaatggtcaaccggttgatttggagcttccaatcaaccggattcttggccgtttgatccgccgaggcaccgcccttgccaagcctgctgcccaccgatactaa

SEQ ID NO: 16087 - protein, 200 aa, Sorghum bicolor
  misc_feature: Useful for making plants with altered cell wall content and/or composition
  misc_feature: Functional homolog of the protein sequence given in SEQ ID NO 14322
  misc_feature: Ceres ANNOT ID no. 8654866
  misc_feature (53)..(131): Pfam ID: DPBB_1 Pfam Description: Rare lipoprotein A (RlpA)-like double-psi beta-barrel
MAMPQKATSIVLAMVLVRLAMLSLAAGTTTATFYTPSYTPSACYGFQDKGTMIAAASEAFWNGGKACGDRYEVTCKGATNDGVPEPCTGRSVTVRIVDLCPAAGCRGTIDLSQEAFAIIADPNAGKVQIEYRRTPPLPRAWRPRANQPTTPVSLAVFRMPIFENRNANGQPVDLELPINRILGRLIRRGTALAKPAAHRY

SEQ ID NO: 16088 - DNA, 1389 bp, Sorghum bicolor
  misc_feature: Ceres ANNOT ID no. 8654883
  misc_feature: Encodes the peptide sequence at SEQ ID NO 16089
atggcttctccgccgcttcagctcgccgccgcgcccttgctgctgctgctgctgctgctgctagtagtggtgccgggcacagggtccagccgcgtcttttcggtggccgactatggtgcggcgggcgatgggtcccattacgacacggcggcgattcaggccactgtagacgcctgcgcggcggcgggcgggggccgcgtccttctcccagcgccgggcgactacctgacagcgaccgtccacctccgctcgcgggtggtgctggatgtgccccccggcgcgcggcttctgggcgggaccaggcaggcggactacccgcccgagtcgcgccggtggtacgtcgtactggccgagaacaccacgggcgccggcgtcacggggggcggcgagatcaacggccagggcggggcgttcgtggtcacgcccagcgaggtgaagaacgtcatggtgagctggaacgccaccggcgactgcctgggcgatgagtgccggccgcggcttgttggcttcattgactccaaggatgttaagatccacgacatcacactcaacaaacccgcctactggtgtcttcaccttgtcagatgtgacaacactgtcatccacaatgtgtccatatttggagatttgaacagtcccaacaatgatggcattgacattgaggattctaacaacactgtcataactgattgccacatagacacgggagacgatgctatatgcccaaagtcgaccactggaccggtttacaacttgacggcaacaaactcttggatccggactaaatcttgtgcaatcaagtttggaagtgcaagcttctttgacttcaaaaggctggttttcgacaatattacaatagttgatgcacatcgaggacttgggatgcagatccgggatggagggaatgtgagtgatgtcatgttttcaaacattaaaatgagcaccaggtactaccatcctttatggtggggcagagccgagccaatctacatcacaacttgcccaaggcacccagattcaaaagaaggcaccatttcagacataagattcatcaacatctcatcggtatcagaaaatggtatttttctggctggatcgaagcacgggctgctccgcaacctgaaattcaagaacatagaccttacctataagcggtggacaaactacacaggggggctctatgattacaggcctgggtgccagaagatggtgaagcacaagactggtggcatgatgctggagcatatctccggcctggagattgacaacgtgaggatgagatgggcaagaggaagcctgaagggctggaacgttaaccctatcctcttccgtccgtcaaccattgacaaactgtcttttcatgactggcagtcagtggatgttcagtaa

SEQ ID NO: 16089 - protein, 462 aa, Sorghum bicolor
  misc_feature: Useful for making plants with altered cell wall content and/or composition
  misc_feature: Functional homolog of the protein sequence given in SEQ ID NO 14323
  misc_feature: Ceres ANNOT ID no. 8654883
  misc_feature (32)..(381): SWISSPROT Homolog: EC 3.2.1.15 Polygalacturonase
  misc_feature (59)..(402): Pfam ID: Glyco_hydro_28 Pfam Description: Glycosyl hydrolases family 28
MASPPLQLAAAPLLLLLLLLLVVVPGTGSSRVFSVADYGAAGDGSHYDTAAIQATVDACAAAGGGRVLLPAPGDYLTATVHLRSRVVLDVPPGARLLGGTRQADYPPESRRWYVVLAENTTGAGVTGGGEINGQGGAFVVTPSEVKNVMVSWNATGDCLGDECRPRLVGFIDSKDVKIHDITLNKPAYWCLHLVRCDNTVIHNVSIFGDLNSPNNDGIDIEDSNNTVITDCHIDTGDDAICPKSTTGPVYNLTATNSWIRTKSCAIKFGSASFFDFKRLVFDNITIVDAHRGLGMQIRDGGNVSDVMFSNIKMSTRYYHPLWWGRAEPIYITTCPRHPDSKEGTISDIRFINISSVSENGIFLAGSKHGLLRNLKFKNIDLTYKRWTNYTGGLYDYRPGCQKMVKHKTGGMMLEHISGLEIDNVRMRWARGSLKGWNVNPILFRPSTIDKLSFHDWQSVDVQ

SEQ ID NO: 16090 - DNA, 1308 bp, Sorghum bicolor
  misc_feature: Ceres ANNOT ID no. 8654885
  misc_feature: Encodes the peptide sequence at SEQ ID NO 16091
atgtacggcgcgccggtgcccaaggacctgaacctgccagcagcagccctgccgcagccgaccaccagggccggtgcgagaacgccaccgcaccagcagcagcagatgagctccccgggactgctgcggtacaggtcggcgccgagcacgctgctcggcgaggtcatgtgcggggatcaggacttccccgcggctgcggctgcggctggcggcgcaggggcagggcacggaccaccaccggaccacgccgccgccgcggacaacgtcctcgcgcgctttctcgccgggcaccaccactgctccgaggcccgggactgcaagcctccccgccccgccgcgtccgctcatcacttcatggacgaagccgccgccgccgccgcgtccatggccgcctcacagcagcagcagctcatgtaccagtcgtcgcagcagcagatggccgccatggaggggttgtaccgcaacgtcagctccggcggcacggagcacggtgcggccgttggcggcgccggtaacaacagcctgatccgccagagcagctcccccgccggcttcctcagccacctgaacatggacaacgggtacgggagcatgctccgggcgggcatggccggcggcgggttcaggacgaacggcgccgtcagcgacgcgcggctcaaggggcagctgagcttctcgtcccggcaggggtcggtgatgtcgcagatctcggaggtgggcagcgaggagctcgacggcggcagcagccccgagacggcggccggcagcaacggcagcggcgcgccgcgcggctacagcggcatcccagggtacacgatgggcgtctcgcccggcgcctggacggacgagccgtcgccgtcgccgacgtccggcgcgaagcgcccccgcgactttgctgggcccgtgccgcagaacgtgcatcagcagccgctggcgccgcagctcagtctgcccagcggcaacaacggcggcggcaagccggcggcggcctcggcggagatggcggcgatcgagaagttcctgcagttccaggacgccgtcccctgcaaaatccgcgccaagcgcgggtgcgccacccacccgcgcagcatcgccgagcgggtgaggaggacgaagatcagcgagcggatacggaagctgcaggaactcgtgcccaacatggaaaagcaaaccaacactgccgacatgctggatctggctgtggactacatcaaggatcttcagaagcaggtcaaggtgctgaacgacggccgcgccaactgcacctgctccgccggcaagctgctgcaggaccagttcaccagttag

SEQ ID NO: 16091 - protein, 435 aa, Sorghum bicolor
  misc_feature: The sequence is a functional homolog of SEQ ID NO 1258 in the 10/412,699 US patent application
  misc_feature: The sequence is a functional homolog of SEQ ID NO 172 in the 10/714,887 US patent application
  misc_feature: The sequence is a functional homolog of SEQ ID NO 172 in the 11/435,388 US patent application
  misc_feature: The sequence is a functional homolog of SEQ ID NO 178 in the 10/714,887 US patent application
  misc_feature: The sequence is a functional homolog of SEQ ID NO 178 in the 11/435,388 US patent application
  misc_feature: The sequence is a functional homolog of SEQ ID NO 174 in the 10/714,887 US patent application
  misc_feature: The sequence is a functional homolog of SEQ ID NO 174 in the 11/435,388 US patent application
  misc_feature: The sequence is a functional homolog of SEQ ID NO 188 in the 10/714,887 US patent application
  misc_feature: The sequence is a functional homolog of SEQ ID NO 188 in the 11/435,388 US patent application
  misc_feature: The sequence is a functional homolog of SEQ ID NO 186 in the 10/714,887 US patent application
  misc_feature: The sequence is a functional homolog of SEQ ID NO 186 in the 11/435,388 US patent application
  misc_feature: The sequence is a functional homolog of SEQ ID NO 194 in the 10/714,887 US patent application
  misc_feature: The sequence is a functional homolog of SEQ ID NO 194 in the 11/435,388 US patent application
  misc_feature: Ceres ANNOT ID no. 8654885
  misc_feature (360)..(408): Pfam ID: HLH Pfam Description: Helix-loop-helix DNA-binding domain
MYGAPVPKDLNLPAAALPQPTTRAGARTPPHQQQQMSSPGLLRYRSAPSTLLGEVMCGDQDFPAAAAAAGGAGAGHGPPPDHAAAADNVLARFLAGHHHCSEARDCKPPRPAASAHHFMDEAAAAAASMAASQQQQLMYQSSQQQMAAMEGLYRNVSSGGTEHGAAVGGAGNNSLIRQSSSPAGFLSHLNMDNGYGSMLRAGMAGGGFRTNGAVSDARLKGQLSFSSRQGSVMSQISEVGSEELDGGSSPETAAGSNGSGAPRGYSGIPGYTMGVSPGAWTDEPSPSPTSGAKRPRDFAGPVPQNVHQQPLAPQLSLPSGNNGGGKPAAASAEMAAIEKFLQFQDAVPCKIRAKRGCATHPRSIAERVRRTKISERIRKLQELVPNMEKQTNTADMLDLAVDYIKDLQKQVKVLNDGRANCTCSAGKLLQDQFTS

SEQ ID NO: 16092 - DNA, 1500 bp, Sorghum bicolor
  misc_feature: Ceres ANNOT ID no. 8654898
  misc_feature: Encodes the peptide sequence at SEQ ID NO 16093
atggcgaagctgcttcttccagctctgcttctggcagcaaccgcttgcatcggcgttcacgccaagttcagcaggtacagcttccccaaggacttcgtcttcggcacaggctccgcggcgtatcagtatgagggtgcctacaacgaaggaggcaaggggcctagcatatgggacaagttcactcacatcccaggtaagatcttgaacaacgataccggcgacgtagcagatgacatgtaccatcgatacaaggaggatgtgcaactcctcaaggacatgaacttggacgccttccggttctccattgcctggaccaggatcctgccaaacggttccctgagtggaggaatcaacaaagaaggcgtggccttctataacaacctcatcaacgaggtcatagccaaagggctgaagccatttgtcaccatcttccactgggacacgcccctggccctggaggacaagtatggaggattcctcagcgagaacatcatcaaggactacgtggacttcgccgaggtttgcttcaaagagttcggcgaccgcgtcaaggcctggaccacgttcaacgagccgtggacgtactcgtaccagggctacgccgtcggcaagtcggcgccgggccggtgctcgtcgtacgtcaacaagaactgcttccccggcgactcggcgcgcgagccctacaccgtgacgcacaacatcatcctcgcccacgcggaggcggtggcgctgtacaacgccaagtacaagccggcgcagcgcgggcagatcggcatcaccgtggtgtccaactggtacgtgcccaccaacgccagctccgccgccgacgtcaaggccgtgcagcgcagcctggacttcatgtacggctggttcctggaccccatcgtgcacggcgagtacccgggcaccatgctcggctacctgggcgaccggctgcccaggttcaccgcggcgcaggcgaagctcatcaagggctcctacgacttcatcggcgtcaactactacacggcctacttcgcctccgccaagccggcgcccaacgggatggagcagtcctacgacggcgacatccgcgccaacacctccgggtaccgcgacggcgtgcccatcggcacgccggagttcgtgcccatcttcttcgagtacccgcaggggctccgggagctgctgctctacaccagccgccgctacggcagcccggtgctctacgtcacggagaacggcatcgcggaggagaacaacaggacgattccgctggaggtggcgctcagggacgggcacaggatcaggttccacagccagcacctgcagttcgtgaaccacgccatcagggacggcgtgaatgtgaagggctacttcacctggaccttcatggactgcttcgagtggggggacggctacctggaccgcttcggcctcatcttcatcgaccgcctcaacggcctcaagcgctaccggaaggagtccagctactggatccagaacttcttgaagagatag

SEQ ID NO: 16093 - protein, 499 aa, Sorghum bicolor
  misc_feature: Useful for making plants with altered carbohydrate content
  misc_feature: Functional homolog of the protein sequence given in SEQ ID NO 14324
  misc_feature: Useful for making plants with altered cell wall content and/or composition
  misc_feature: Functional homolog of the protein sequence given in SEQ ID NO 14325
  misc_feature: Useful for making plants with modulated biomass
  misc_feature: Useful for making plants with modulated flowering time
  misc_feature: Functional homolog of the protein sequence given in SEQ ID NO 14326
  misc_feature: Useful for making plants with altered oil content
  misc_feature: Functional homolog of the protein sequence given in SEQ ID NO 14125
  misc_feature: Ceres ANNOT ID no. 8654898
  misc_feature: Down-regulated in root tissues in response to aminocyclopropane carboxylic treatment
  misc_feature: Up-regulated in shoot tissues in response to salicylic acid treatment
  misc_feature (24)..(477): SWISSPROT Homolog: EC 3.2.1.21 Beta-glucosidase
  misc_feature (24)..(498): Pfam ID: Glyco_hydro_1 Pfam Description: Glycosyl hydrolase family 1
MAKLLLPALLLAATACIGVHAKFSRYSFPKDFVFGTGSAAYQYEGAYNEGGKGPSIWDKFTHIPGKILNNDTGDVADDMYHRYKEDVQLLKDMNLDAFRFSIAWTRILPNGSLSGGINKEGVAFYNNLINEVIAKGLKPFVTIFHWDTPLALEDKYGGFLSENIIKDYVDFAEVCFKEFGDRVKAWTTFNEPWTYSYQGYAVGKSAPGRCSSYVNKNCFPGDSAREPYTVTHNIILAHAEAVALYNAKYKPAQRGQIGITVVSNWYVPTNASSAADVKAVQRSLDFMYGWFLDPIVHGEYPGTMLGYLGDRLPRFTAAQAKLIKGSYDFIGVNYYTAYFASAKPAPNGMEQSYDGDIRANTSGYRDGVPIGTPEFVPIFFEYPQGLRELLLYTSRRYGSPVLYVTENGIAEENNRTIPLEVALRDGHRIRFHSQHLQFVNHAIRDGVNVKGYFTWTFMDCFEWGDGYLDRFGLIFIDRLNGLKRYRKESSYWIQNFLKR

SEQ ID NO: 16094 - DNA, 960 bp, Sorghum bicolor
  misc_feature: Ceres ANNOT ID no. 8654924
  misc_feature: Down-regulated in root tissues in response to aminocyclopropane carboxylic treatment
  misc_feature: Up-regulated in shoot tissues in response to salicylic acid treatment
  misc_feature: Encodes the peptide sequence at SEQ ID NO 16095
atggccggaggtacaacggtgtgcgtgaccggcgccggcgggttcatcgcctcgtggctcgtgaagctcctgctctcccgcggctacaccgtgcacggcaccgtccgcgacctcagtgacgagaagacgaaccatctgaagcgcctggagaatgctgccggaaacctcaggattttcaaggctgatctgctggactacgacgccatggcagctgcggtcgtcgggtgccagggagttctccatgtggccactccagtgccttcagagaacctgactgacccagagctacaaatgttgggtcctgctgtcactggtacaactaatgtgctcaaggctgcctctgccgcgaatgtccagcgagtggtggttgtgtcatccatggttgccgttgagatcagcccaaagattggcctgaagagctggtacccggtcgccaagatcatctcagaagaggcggcgctcgcatacgggcggcaaaccgggcttgacgtggtgactatcaatccagggttggtgttcggccccctgctgcagccgacggtgaacgcaagcatccagttcctcatctacttcctcaaaggaggccccgacctggtgaggaacaagctctggcacgtcgtcgatgtccgtgacctcgccgacgcgctgctgctgctctacgaggtgcctgaagcagccggcaggcacatctgcgcgcctcatgttatcagtgcccgcgacctgctggacttgctgaagagcatgtaccctgacaaccctttcattgccaaggagagcatatgtgatagagatcacccagcaccgatgacttctgacaagctaaagaacctcgggtggagctgccggccgctggaagagacgatcctggacacagtcgagtgctgccagcgggctgggtttcttgacggtgtggctggggagactccctgtcgtttccctcctatcttcaacaaaatctag

SEQ ID NO: 16095 - protein, 319 aa, Sorghum bicolor
  misc_feature: Useful for making plants with altered carbohydrate content
  misc_feature: Functional homolog of the protein sequence given in SEQ ID NO 13705
  misc_feature: Useful for making plants with altered cell wall content and/or composition
  misc_feature: Functional homolog of the protein sequence given in SEQ ID NO 13694
  misc_feature: Ceres ANNOT ID no. 8654924
  misc_feature (135)..(301): SWISSPROT Homolog: EC 1.1.1.219 Dihydrokaempferol 4-reductase
  misc_feature (16)..(111): SWISSPROT Homolog: EC 1.3.1.77 Anthocyanidin reductase
  misc_feature (7)..(232): Pfam ID: Epimerase Pfam Description: NAD dependent epimerase/dehydratase family
MAGGTTVCVTGAGGFIASWLVKLLLSRGYTVHGTVRDLSDEKTNHLKRLENAAGNLRIFKADLLDYDAMAAAVVGCQGVLHVATPVPSENLTDPELQMLGPAVTGTTNVLKAASAANVQRVVVVSSMVAVEISPKIGLKSWYPVAKIISEEAALAYGRQTGLDVVTINPGLVFGPLLQPTVNASIQFLIYFLKGGPDLVRNKLWHVVDVRDLADALLLLYEVPEAAGRHICAPHVISARDLLDLLKSMYPDNPFIAKESICDRDHPAPMTSDKLKNLGWSCRPLEETILDTVECCQRAGFLDGVAGETPCRFPPIFNKI

SEQ ID NO: 16096 - DNA, 588 bp, Sorghum bicolor
  misc_feature: Ceres ANNOT ID no. 8654928
  misc_feature: Encodes the peptide sequence at SEQ ID NO 16097
atggcgtcgccgccgcggcgcccgcgcgtgtgcctaaccgggggcggtggttttgtcgcttcatggctcgtcaagctcctcctctcccgcggctacgccgtgcacaccactgtccgcgacccaagtgagcccgcacccctaacgccggagagcttgctcctgttcactgccgacatgctcgaccgtgacgctctggcggccgcggtcgccgggtgcgagggcgtctttcatgtcgcctcccctgttcccgcggataaggtccatgatcccgagtcagagggattggctcctgctgtcaaagacactttgaatgtccttgaggcttgctcggcgaataatgttcagaaaaaagctattgtggtttcctccacagctgctgttcgttttaatccaagttggccccaagatagaatcaaagatgagagttgctggtcagacaaaaaattgtgcattaagaatcagagacagcattggagtagactaactgttgtcacagtttgcccttgtctagttttaggtccactcctgccgcctctggtcaatacctcgagtgaattactcatctacgttataaaaggtcacctgtaa

SEQ ID NO: 16097 - protein, 195 aa, Sorghum bicolor
  misc_feature: Useful for making plants with altered carbohydrate content
  misc_feature: Functional homolog of the protein sequence given in SEQ ID NO 13693
  misc_feature: Ceres ANNOT ID no. 8654928
  misc_feature (3)..(158): SWISSPROT Homolog: EC 1.1.1.219 Dihydrokaempferol 4-reductase
  misc_feature (10)..(195): Pfam ID: Epimerase Pfam Description: NAD dependent epimerase/dehydratase family
MASPPRRPRVCLTGGGGFVASWLVKLLLSRGYAVHTTVRDPSEPAPLTPESLLLFTADMLDRDALAAAVAGCEGVFHVASPVPADKVHDPESEGLAPAVKDTLNVLEACSANNVQKKAIVVSSTAAVRFNPSWPQDRIKDESCWSDKKLCIKNQRQHWSRLTVVTVCPCLVLGPLLPPLVNTSSELLIYVIKGHL

SEQ ID NO: 16098 - DNA, 987 bp, Sorghum bicolor
  misc_feature: Ceres ANNOT ID no. 8654951
  misc_feature: Encodes the peptide sequence at SEQ ID NO 16099
atgaagcggaagacgcggaacaaggtcatcgtgtggacgctggccctggccgcggcggcgattctggtgggcggcacgatcgcgctggtgctcacggcggggacgtggaaggcccagataaagaagtcgcaggagaagatctgcaacaaggggtgggagtgctcgggcagcaagtactgctgcaacgacaccatcaccgacttcttcaaggtgtaccagttcgagaacctcttcgccaagcgcaacacccccgtcgcgcacgccgtcggcttctgggactaccaggccttcatcaccgccgcggcgctcttcgagccccaggggttctgcaccaccggcggcaagcagatgcagatgatggagctctgcgcgtttctcgggcacgtcggcgccaagacttcatgtgggtatggcgtggccaccggcgggccgacggcgtgggggctatgctacaaccacgagatgagccccgaccagacctactgtgacaagacctacacccagtggccctgcgttgagggcgccgagtactacggccgcggcgcgatacctgtctactggaactacaactatggcgccgcaggtgacgggatcaaggtggacctgctccaccacccagagtacctagagcagaatgcgacgttggcattcatggcggcaatgtggcggtggatgacaccgatcaagaagagccagccgtcagcgcacgaagcgtttgtgggcacctggaagcccacaaagaacgatacgctcagcaaacgcctgcctgggttcggcgccaccatgaacatactctatggagaatcgatctgtggcaagggattcgttgactccatgaatgttataatctctcactaccagtattaccttgacctcatgggcgttggccgtgagcactctggcgacaaccgtgattgtgctgagcagctcccgttcaacccctcaagcccaacggatgaccagaagcagcagcaatcaggaagctaa

SEQ ID NO: 16099 - protein, 328 aa, Sorghum bicolor
  misc_feature: Useful for making plants with modulated water use efficiency
  misc_feature: Functional homolog of the protein sequence given in SEQ ID NO 14327
  misc_feature: Useful for making plants with altered cell wall content and/or composition
  misc_feature: Functional homolog of the protein sequence given in SEQ ID NO 14328
  misc_feature: Ceres ANNOT ID no. 8654951
  misc_feature (53)..(319): SWISSPROT Homolog: EC 3.2.1.14 Chitinase
  misc_feature (68)..(306): Pfam ID: Glyco_hydro_19 Pfam Description: Chitinase class I
MKRKTRNKVIVWTLALAAAAILVGGTIALVLTAGTWKAQIKKSQEKICNKGWECSGSKYCCNDTITDFFKVYQFENLFAKRNTPVAHAVGFWDYQAFITAAALFEPQGFCTTGGKQMQMMELCAFLGHVGAKTSCGYGVATGGPTAWGLCYNHEMSPDQTYCDKTYTQWPCVEGAEYYGRGAIPVYWNYNYGAAGDGIKVDLLHHPEYLEQNATLAFMAAMWRWMTPIKKSQPSAHEAFVGTWKPTKNDTLSKRLPGFGATMNILYGESICGKGFVDSMNVIISHYQYYLDLMGVGREHSGDNRDCAEQLPFNPSSPTDDQKQQQSGS

SEQ ID NO: 16100 - DNA, 960 bp, Sorghum bicolor
  misc_feature: Ceres ANNOT ID no. 8654946
  misc_feature: Encodes the peptide sequence at SEQ ID NO 16101
atggcgactgttcccgtcgacgtggtggtggccgcggatggcagcggcgactactcgtccgtgagcgctgccatcgctgccgcgccactcaagagcaacaagaggcacgtcattcacatcaagaaaggtttgtacaaggagttcgtcatcctgggagaggacgcgtggaacgtgacgttgatcggcgacggcatggacgccaccgtgatctccggcagccgatgctgcgcggatggcttccacacgccgcagacggcagttctgactgttctcggcaggggcttcatagcccgtgatctccgcgtcgagaacacggccggcccgaggaaggagctggggcaagcggtggcgctcttgtccaattcggatcagtccgtggtgttccgctgcgccctccgcggctaccaggacacgctctacgccgagctcgggaggcagttctaccgcgagtgcaaaatctctggcacggtggacttcattttcggcgacgcggcggccgtgtttcagaactgcgacatcctcgcgcgcctgccgattcagggacagcagaacaccctcactgcggaggggcgagacaagcccgacagcaatgggggcttctgcttccagtcgtgcacggtggcggccgacgacgatctcgccaaggcaagcggcgtggaaacgtacctgggccgtccgtggaaggcgtactcccgcgtcatcttcatgaagtcgacgatttccaacgtgcggcacgccaaggggtggctgccatgggagcacgccgcccctcctgacacgatctactacgccgagtacgacaacgacgggccaggtgccgcggtgggtggccgggtcaagtggtccggtttccacacgattcaggacgccgccgaggccatcaacttcaccgtcgagaagttcatcaacggcaatgactggcttccgggcacgggcgtagactacaagcccggcctttga

SEQ ID NO: 16101 - protein, 319 aa, Sorghum bicolor
  misc_feature: Useful for making plants with altered carbohydrate content
  misc_feature: Functional homolog of the protein sequence given in SEQ ID NO 14329
  misc_feature: Useful for making plants with altered cell wall content and/or composition
  misc_feature: Functional homolog of the protein sequence given in SEQ ID NO 14330
  misc_feature: Ceres ANNOT ID no. 8654946
  misc_feature (14)..(315): SWISSPROT Homolog: EC 3.1.1.11 Pectinesterase
  misc_feature (7)..(305): Pfam ID: Pectinesterase Pfam Description: Pectinesterase
MATVPVDVVVAADGSGDYSSVSAAIAAAPLKSNKRHVIHIKKGLYKEFVILGEDAWNVTLIGDGMDATVISGSRCCADGFHTPQTAVLTVLGRGFIARDLRVENTAGPRKELGQAVALLSNSDQSVVFRCALRGYQDTLYAELGRQFYRECKISGTVDFIFGDAAAVFQNCDILARLPIQGQQNTLTAEGRDKPDSNGGFCFQSCTVAADDDLAKASGVETYLGRPWKAYSRVIFMKSTISNVRHAKGWLPWEHAAPPDTIYYAEYDNDGPGAAVGGRVKWSGFHTIQDAAEAINFTVEKFINGNDWLPGTGVDYKPGL

SEQ ID NO: 16102 - DNA, 2037 bp, Sorghum bicolor
  misc_feature: Ceres ANNOT ID no. 8654922
  misc_feature: Encodes the peptide sequence at SEQ ID NO 16103
atggccttcggagctctcgtcgcgtcgaggctggccaggtccggccgcaccctcgcatccgccgttgcccagggtcccgtggcccagcggacagcgcctcctctgctctccaggcttggagcagtagctcgtcttctcagcacaaagccggccgcggcagatgtcatcggtatcgatctaggcacaacgaattcctgcgtctccgtcatggaaggaaagacaccacgggtgattgaaaatgcggaaggcgcaaggacaactccctccattgttgctaagaatcagaatggtgacctgctgatcggtatcactgcgagccgacaggcggtaaccaatgcccagaacacaatccgtgggtcgaagcgtctgatcggtaggacttttaatgacccgcagacccagaaggagatgaagatggtgccttacaagattgtcaaggcaccgaatggtgatgcctgggtggagatgggtggccagcagtactcccctagccagattggtgcatttgttctcactaagatgaaggaaactgcagaggcttaccttggcaagacagtctctaaggctgttattactgtcccagcttatttcaatgatgctcaacgccaggctaccaaggatgctggtaggattgctggactggaggttatgaggattatcaatgagcctactgctgcagctttgtcatatggaatgaacaacaaggagggccttatcgctgtgtttgacctgggtggtggcacatttgatgtgtcaatccttgagatatcaaatggagtttttgaggtcaaggcaaccaatggtgatactttccttggtggtgaggactttgatggtgcactgcttgagtatctggttagcgagttcaagaagtcagacaacattgatctgagccaggacaagttagcactgcaaaggctcagggaagctgctgagaaggccaaggttgagctttcctccaccatgcagactgaaatcaatctcccatttatcactgctgatgcctctggtgcaaagcacttcaacattaccttgaccagatcgaagtttgagtctcttgtgagcaatctcattgagaggactcgcatcccttgtgtgaactgcctcaaggatgctggcatctctgctaaggagattgatgaggttctactggttggtggtatgactagagtaccaaaggtccaggaggttgtttctcagatattcaacaagccaccaagcaagggtgtcaatcctgatgaggctgttgccatgggagctgctattcagggaggcattttgaggggtgatgtgaaggagctcctcttgctggatgtcacacctctctcccttggtattgagactcttggtggcatcttcacaaggttaattaacaggaacaccacaattccaaccaagaagagccaggtcttctctactgctgcagataaccagacacaggttggagtcaaggtgcttcagggtgagagggagatggctacagataacaaactccttggcgaattccagcttgagggcattccaccagctccaaggggcatgccccagattgaggttacctttgacattgatgccaatggcattgtgaaggtgtcagctagggacaaagccacaggcaaagaacaagaaatcaccatcaagtcttctgggggtttgtcagagggtgaaattgagaagatggtgaaggaggctgaactgcatgctcagaaggatcaggaaaggaagtctctcattgatcttaagaactctgcagataccacgatttacaccattgagaagagtgtcagcgagtacaaggacaaggtacctgctgaagtcaccaaggagattgagtctgctgtctctgatctgagggcagctatggctgaggacgatctggagaagatcaagcagaagctggaagcagcaaacaaggctgtgtcaaagattggggagcacatgcaacaaggtggtggtggtggcagcgctggcagcagtagtggcggagaccagactccagaagccgagtaccaggacgccaaggaagccaagatgtag

SEQ ID NO: 16103 - protein, 678 aa, Sorghum bicolor
  misc_feature: Useful for making plants with modulated drought sensitivity
  misc_feature: Useful for making plants with modulated heat sensitivity
  misc_feature: Functional homolog of the protein sequence given in SEQ ID NO 14080
  misc_feature: Ceres ANNOT ID no. 8654922
  misc_feature: Up-regulated in shoot tissues in response to salicylic acid treatment
  misc_feature (55)..(649): Pfam ID: HSP70 Pfam Description: Hsp70 protein
MAFGALVASRLARSGRTLASAVAQGPVAQRTAPPLLSRLGAVARLLSTKPAAADVIGIDLGTTNSCVSVMEGKTPRVIENAEGARTTPSIVAKNQNGDLLIGITASRQAVTNAQNTIRGSKRLIGRTFNDPQTQKEMKMVPYKIVKAPNGDAWVEMGGQQYSPSQIGAFVLTKMKETAEAYLGKTVSKAVITVPAYFNDAQRQATKDAGRIAGLEVMRIINEPTAAALSYGMNNKEGLIAVFDLGGGTFDVSILEISNGVFEVKATNGDTFLGGEDFDGALLEYLVSEFKKSDNIDLSQDKLALQRLREAAEKAKVELSSTMQTEINLPFITADASGAKHFNITLTRSKFESLVSNLIERTRIPCVNCLKDAGISAKEIDEVLLVGGMTRVPKVQEVVSQIFNKPPSKGVNPDEAVAMGAAIQGGILRGDVKELLLLDVTPLSLGIETLGGIFTRLINRNTTIPTKKSQVFSTAADNQTQVGVKVLQGEREMATDNKLLGEFQLEGIPPAPRGMPQIEVTFDIDANGIVKVSARDKATGKEQEITIKSSGGLSEGEIEKMVKEAELHAQKDQERKSLIDLKNSADTTIYTIEKSVSEYKDKVPAEVTKEIESAVSDLRAAMAEDDLEKIKQKLEAANKAVSKIGEHMQQGGGGGSAGSSSGGDQTPEAEYQDAKEAKM

SEQ ID NO: 16104 - DNA, 798 bp, Sorghum bicolor
  misc_feature: Ceres ANNOT ID no. 8654955
  misc_feature: Up-regulated in shoot tissues in response to salicylic acid treatment
  misc_feature: Encodes the peptide sequence at SEQ ID NO 16105
atggagtggagggacagcttcttggacctggtgctcatcccgctcagcctgctcctccccatggcgtaccacgcctggctgtggcgcgaggtccgcctccgcccgctgcgcacggccgtcggcatcaacgccgccgcgcgccgcgtctgggccatcgccatgatgaaggacaacgccaagaacgcggtgacggtggtgcagtcggtgcggaacgtgatcatggggtcgacgctgatggcgacgacggcgatcctcttctgcacgggcgtggcggcggtgctgagcagcacctacaccatcaagaagccgctgagcgacgccgtgttcggcgcgcacggcgagtacatgatggcgctcaagtacgtggcgctcatgctgctcttcctcttcgccttcctctgccactccctcgccatctgcttcctcaaccaggccagcttcctcatcaacacctccggctgccacttcgccgccggcgccgacgactccgactccgacgcctcctcctcctccctccccgccgccggcggcctcccgctgccgcccaccagggactacatcggcgacgtcctggagcgcggcttcacgctcaacctcgtcggcaacaggctcttctacgccggcgtgcccctcctgctctggatcttcggcccgctcctcgccttcctgtcgtccatggtcatggtccccatactctacagcctcgacgtcgtcaatctcaggggccacagcggctgcgtcgtcgtcagcggcaaatctgccgagatgaacgggagcgactgcacgcatgtcgtctga

SEQ ID NO: 16105 - protein, 265 aa, Sorghum bicolor
  misc_feature: Useful for making plants with altered terpenoid content
  misc_feature: Functional homolog of the protein sequence given in SEQ ID NO 14331
  misc_feature: Ceres ANNOT ID no. 8654955
MEWRDSFLDLVLIPLSLLLPMAYHAWLWREVRLRPLRTAVGINAAARRVWAIAMMKDNAKNAVTVVQSVRNVIMGSTLMATTAILFCTGVAAVLSSTYTIKKPLSDAVFGAHGEYMMALKYVALMLLFLFAFLCHSLAICFLNQASFLINTSGCHFAAGADDSDSDASSSSLPAAGGLPLPPTRDYIGDVLERGFTLNLVGNRLFYAGVPLLLWIFGPLLAFLSSMVMVPILYSLDVVNLRGHSGCVVVSGKSAEMNGSDCTHVV

SEQ ID NO: 16106 - DNA, 1131 bp, Sorghum bicolor
  misc_feature: Ceres ANNOT ID no. 8654965
  misc_feature: Encodes the peptide sequence at SEQ ID NO 16107
atggaagcaggaggaggtggtggagggggagggggagagtcgaagaagaaggaggagagcttgccgccgggcttcaggttccacccaacggacgaggagctcatcacgtactacctgcggcagaagatcgccgacggcagcttcacggcgagggccatcgccgaggtcgacctcaacaagtgcgagccgtgggatctcccggagaaagcgaagctgggagaaaaagagtggtatttcttcagcctaagagaccgaaagtacccaacaggcgttcgaacaaaccgtgccactaacgccggatattggaagacaacggggaaagataaggaaatctacaccggtcagctaccggccacgccagagctagtagggatgaagaaaaccctggtgttctacaagggaagagctcctcggggcgagaagacaaactgggtcatgcatgagtatcgcctgcactccaaatcagtccccaaatctaacaaggatgagtgggtggtgtgccgggtgttcgccaagagcgccggcgccaagaagtacccgtccaacaacgcgcactcgcggtcgtcgcaccaccaccacccgtacgcgctggacatggtgccaccgctcctgcccacgctgctgcagcacgaccccttcgcgcgccaccacggccaccaccaccaccacccgtacatgaccccggccgacctggccgagctcgcgcgcttcgcccgcggcacgccggggctgcacccgcacatccagccgcaccccgggacgtcggcggcggcggcggcgtacatgaaccccgccgtggcagcagctgcgccaccgtcgttcacgctctctggcagtgggctcaacctgaacctcggcgcctcgccggccatgccatcgccgccgcaagcactccacgcgatgtcgatggcgatgggcggccagacgggtaaccatcatcaggtgatggcaggtgagcaccagcaccagcaccatcagcagcagatggcgacggcggcggggctcggcggctgcgtcatcgtgcccggagcggacggagggttcggcgcggacgcggccgggggccggtaccagagcttggacgtggagcagctggtggagaggtactggcctgccggctaccaggtctag

SEQ ID NO: 16107 - protein, 376 aa, Sorghum bicolor
  misc_feature: The sequence is a functional homolog of SEQ ID NO 2418 in the 10/374,780 US patent application
  misc_feature: The sequence is a functional homolog of SEQ ID NO 554 in the 10/225,066 US patent application
  misc_feature: The sequence is a functional homolog of SEQ ID NO 68 in the 10/286,264 US patent application
  misc_feature: Useful for making plants with altered terpenoid content
  misc_feature: Functional homolog of the protein sequence given in SEQ ID NO 13140
  misc_feature: The sequence is a functional homolog of SEQ ID NO 326 in the 10/412,699 US patent application
  misc_feature: The sequence is a functional homolog of SEQ ID NO 760 in the 11/479,226 US patent application
  misc_feature: The sequence is a functional homolog of SEQ ID NO 2346 in the 10/374,780 US patent application
  misc_feature: The sequence is a functional homolog of SEQ ID NO 238 in the 10/225,068 US patent application
  misc_feature: The sequence is a functional homolog of SEQ ID NO 338 in the 10/412,699 US patent application
  misc_feature: The sequence is a functional homolog of SEQ ID NO 774 in the 11/479,226 US patent application
  misc_feature: The sequence is a functional homolog of SEQ ID NO 476 in the 10/666,642 US patent application
  misc_feature: Useful for making plants with altered lignin content
  misc_feature: Functional homolog of the protein sequence given in SEQ ID NO 13250
  misc_feature: The sequence is a functional homolog of SEQ ID NO 1196 in the 10/412,699 US patent application
  misc_feature: The sequence is a functional homolog of SEQ ID NO 865 in the 10/374,780 US patent application
  misc_feature: The sequence is a functional homolog of SEQ ID NO 1036 in the 10/225,066 US patent application
  misc_feature: The sequence is a functional homolog of SEQ ID NO 216 in the 10/666,642 US patent application
  misc_feature: The sequence is a functional homolog of SEQ ID NO 2608 in the 10/374,780 US patent application
  misc_feature: The sequence is a functional homolog of SEQ ID NO 658 in the 11/435,388 US patent application
  misc_feature: The sequence is a functional homolog of SEQ ID NO 880 in the 10/412,699 US patent application
  misc_feature: Useful for making plants with modulated water use efficiency
  misc_feature: Useful for making plants with altered carbohydrate content
  misc_feature: Functional homolog of the protein sequence given in SEQ ID NO 13622
  misc_feature: The sequence is a functional homolog of SEQ ID NO 2470 in the 10/374,780 US patent application
  misc_feature: The sequence is a functional homolog of SEQ ID NO 798 in the 10/225,066 US patent application
  misc_feature: The sequence is a functional homolog of SEQ ID NO 2478 in the 10/374,780 US patent application
  misc_feature: The sequence is a functional homolog of SEQ ID NO 572 in the 10/225,066 US patent application
  misc_feature: The sequence is a functional homolog of SEQ ID NO 316 in the 10/412,699 US patent application
  misc_feature: The sequence is a functional homolog of SEQ ID NO 738 in the 11/479,226 US patent application
  misc_feature: Useful for biocontainment applications
  misc_feature: Functional homolog of the protein sequence given in SEQ ID NO 13623
  misc_feature: The sequence is a functional homolog of SEQ ID NO 1157 in the 11/479,226 US patent application
  misc_feature: The sequence is a functional homolog of SEQ ID NO 1416 in the 10/666,642 US patent application
  misc_feature: The sequence is a functional homolog of SEQ ID NO 30 in the 10/286,264 US patent application
  misc_feature: The sequence is a functional homolog of SEQ ID NO 430 in the 11/435,388 US patent application
  misc_feature: The sequence is a functional homolog of SEQ ID NO 518 in the 10/412,699 US patent application
  misc_feature: The sequence is a functional homolog of SEQ ID NO 890 in the 10/374,780 US patent application
  misc_feature: The sequence is a functional homolog of SEQ ID NO 102 in the 10/374,780 US patent application
  misc_feature: The sequence is a functional homolog of SEQ ID NO 886 in the 10/225,066 US patent application
  misc_feature: Useful for making plants with modulated light quality response
  misc_feature: Functional homolog of the protein sequence given in SEQ ID NO 13870
  misc_feature: The sequence is a functional homolog of SEQ ID NO 853 in the 10/374,780 US patent application
  misc_feature: The sequence is a functional homolog of SEQ ID NO 1197 in the 10/412,699 US patent application
  misc_feature: The sequence is a functional homolog of SEQ ID NO 866 in the 10/374,780 US patent application
  misc_feature: The sequence is a functional homolog of SEQ ID NO 2060 in the 10/374,780 US patent application
  misc_feature: The sequence is a functional homolog of SEQ ID NO 516 in the 10/412,699 US patent application
  misc_feature: The sequence is a functional homolog of SEQ ID NO 100 in the 10/374,780 US patent application
  misc_feature: The sequence is a functional homolog of SEQ ID NO 318 in the 10/412,699 US patent application
  misc_feature: The sequence is a functional homolog of SEQ ID NO 749 in the 11/479,226 US patent application
  misc_feature: The sequence is a functional homolog of SEQ ID NO 884 in the 10/225,066 US patent application
  misc_feature: The sequence is a functional homolog of SEQ ID NO 132 in the 10/225,066 US patent application
  misc_feature: The sequence is a functional homolog of SEQ ID NO 1508 in the 10/666,642 US patent application
  misc_feature: The sequence is a functional homolog of SEQ ID NO 1924 in the 10/412,699 US patent application
  misc_feature: The sequence is a functional homolog of SEQ ID NO 2186 in the 10/374,780 US patent application
  misc_feature: The sequence is a functional homolog of SEQ ID NO 564 in the 11/435,388 US patent application
  misc_feature: Useful for making plants with modulated oxidative stress sensitivity
  misc_feature: Functional homolog of the protein sequence given in SEQ ID NO 13621
  misc_feature: The sequence is a functional homolog of SEQ ID NO 808 in the 10/225,066 US patent application
  misc_feature: The sequence is a functional homolog of SEQ ID NO 926 in the 11/435,388 US patent application
  misc_feature: The sequence is a functional homolog of SEQ ID NO 98 in the 10/374,780 US patent application
  misc_feature: Useful for making plants with altered cell wall content and/or composition
  misc_feature: Functional homolog of the protein sequence given in SEQ ID NO 13620
  misc_feature: Useful for making plants with modulated nitrogen use efficiency
  misc_feature: Functional homolog of the protein sequence given in SEQ ID NO 13624
  misc_feature: The sequence is a functional homolog of SEQ ID NO 26 in the 10/286,264 US patent application
  misc_feature: The sequence is a functional homolog of SEQ ID NO 336 in the 10/412,699 US patent application
  misc_feature: The sequence is a functional homolog of SEQ ID NO 770 in the 11/479,226 US patent application
  misc_feature: Ceres ANNOT ID no. 8654965
  misc_feature (21)..(152): Pfam ID: NAM Pfam Description: No apical meristem (NAM) protein
MEAGGGGGGGGGESKKKEESLPPGFRFHPTDEELITYYLRQKIADGSFTARAIAEVDLNKCEPWDLPEKAKLGEKEWYFFSLRDRKYPTGVRTNRATNAGYWKTTGKDKEIYTGQLPATPELVGMKKTLVFYKGRAPRGEKTNWVMHEYRLHSKSVPKSNKDEWVVCRVFAKSAGAKKYPSNNAHSRSSHHHHPYALDMVPPLLPTLLQHDPFARHHGHHHHHPYMTPADLAELARFARGTPGLHPHIQPHPGTSAAAAAYMNPAVAAAAPPSFTLSGSGLNLNLGASPAMPSPPQALHAMSMAMGGQTGNHHQVMAGEHQHQHHQQQMATAAGLGGCVIVPGADGGFGADAAGGRYQSLDVEQLVERYWPAGYQV

SEQ ID NO: 16108 - DNA, 1455 bp, Sorghum bicolor
  misc_feature: Ceres ANNOT ID no. 8655019
  misc_feature: Encodes the peptide sequence at SEQ ID NO 16109
atggcggtatccatggccgctccaccgctcttgaccctccccttcctcttccttctcttcgccaccgtcgcctgccgcggggcgtatggggcaagcggcggctacgggctcggcgtcaactacggccgggtggcggacgacatcccctcgccgcggcggtccgtggagctgctccgcgcggcgggggccgggtcggtcaagatctacgacgccaacccgggcgtgctccgcgcgctggcggggacgcgctggcctgtctccatcatggtgcccaacgagatcatcccggacctcgccgcctcagtggccgcggcggaccggtgggtcgccaagaacctggtcccctactacccggcgacgcgggtcaagttccttctcgtggggaacgagatcctctccgaccactccatcgccaactccacctggccgcgcctggtcccggcgatggagaacatccaccggagcctccgcaagaggggcatcagcagcgttaagattggcaccacgctcgccatggacgcgctcgccgacggcgccttcccgcgcccaccgtcggccgccacgttccgcgccgacatcgccgaggcagtcgtgcgcccgctgctgcacttcctgaacgggacaaactcgtactacttcgtcgacgcgtacccctacttcgtctgggccgacaacaacctcaccgtctcgctcgactacgcgctcttccagggcggacgcctccgctacgtcgacccgggcaccagactcacatacaccaacctgctcgacgaaatgctcgacgcggtggtcatcgcgatggcgaagctcggttacgggcacgtgaagctggccatcgcggagaccgggtggcccaacggctgcgactacgaccagattggcggcaacgtccacaacgccgccatctacaacaggaacctcgcggcgcggatggtcaagaacccgggcacgccggtgaggccgggcgccaagatgccggtgttcgtgttctcgctctacaacgaggacctcaagccagggccgggcaccgagcgacattgggggttgtactatgccaacggcacggcggtctacgagatcgacctcaccggacggcggccactgtggtcgtacccgcctctgccggcgccggagaacaatacaccgtacaaggggccgatatggtgcttgctctcggccgccgccagcaacaagctgaacgagacggcagtggggaacgcgctgacgtacgcgtgcgggcagggaaacgggacctgcgacgccattcagcctgggaaaaactgctacatgccgaacacgacggtggcgcacgccagctacgctttcaattcttactggcagcagttcaggaagattggagcgacgtgctacttcaacaacctcgcagagcagactatcaaagacccaagtaagtgtttacactcatcctgcattctgaaattatggtccatttag

SEQ ID NO: 16109 - protein, 484 aa, Sorghum bicolor
  misc_feature: Useful for making plants with altered carbohydrate content
  misc_feature: Functional homolog of the protein sequence given in SEQ ID NO 14072
  misc_feature: Useful for making plants with altered cell wall content and/or composition
  misc_feature: Functional homolog of the protein sequence given in SEQ ID NO 14332
  misc_feature: Ceres ANNOT ID no. 8655019
  misc_feature (45)..(470): SWISSPROT Homolog: EC 3.2.1.39 Glucan endo-1,3-beta-D-glucosidase
  misc_feature (37)..(362): Pfam ID: Glyco_hydro_17 Pfam Description: Glycosyl hydrolases family 17
  misc_feature (387)..(479): Pfam ID: X8 Pfam Description: X8 domain
MAVSMAAPPLLTLPFLFLLFATVACRGAYGASGGYGLGVNYGRVADDIPSPRRSVELLRAAGAGSVKIYDANPGVLRALAGTRWPVSIMVPNEIIPDLAASVAAADRWVAKNLVPYYPATRVKFLLVGNEILSDHSIANSTWPRLVPAMENIHRSLRKRGISSVKIGTTLAMDALADGAFPRPPSAATFRADIAEAVVRPLLHFLNGTNSYYFVDAYPYFVWADNNLTVSLDYALFQGGRLRYVDPGTRLTYTNLLDEMLDAVVIAMAKLGYGHVKLAIAETGWPNGCDYDQIGGNVHNAAIYNRNLAARMVKNPGTPVRPGAKMPVFVFSLYNEDLKPGPGTERHWGLYYANGTAVYEIDLTGRRPLWSYPPLPAPENNTPYKGPIWCLLSAAASNKLNETAVGNALTYACGQGNGTCDAIQPGKNCYMPNTTVAHASYAFNSYWQQFRKIGATCYFNNLAEQTIKDPSKCLHSSCILKLWSI

SEQ ID NO: 16110 - DNA, 1230 bp, Sorghum bicolor
  misc_feature: Ceres ANNOT ID no. 8655015
  misc_feature: Encodes the peptide sequence at SEQ ID NO 16111
atgcatcccaccgcgccgagctacgcgacggacgcggcgcgcggcccacagacccaaccgcagcggcaacaaccgctctataaagcaatccccccacctaccggctccgcggcctcgctcgctgcgcttcgctttcccctcaaatccaccgcggactcgagctttgctcggaggagacgagacgacccaagacttgctcagctcccccctttgcttcctgcgcaatccctgcggcagcgccttttctttcattcaatggacagcgactacgttgccagcctgctcatgggctcatccgcccatgcgctcgacttcgccgcgctggacaccgggttcctcgacacgctctgcggcggcgccggcctctttggggtgcccggggtcgccgcggggactgggtgtggcagcggcggcggcggcgggtccccggaggggtcctcggtgtccgacccggcgtgggcgcgcgccagcgacggcggcaatgccaggaagcgcaaggcgccgcccacggggtccgccggcgggaaggagacctgcttgggcaaggctgcggaggccaaggttccggacgggaagaggtgcagagtgggcgctagcgacagtccggtgaagcccaaggtagaggaggcggcggcgagcgacgcctcggttgaagtcaaagggcagaagaagggcaaggggaagagcccgaagccggcagtcgaaccacccaaagactacgtccatgtccgggcacggcgaggtcaggcaactgacagccacagccttgcagagagggttagaagagagaagattagccagaggatgaagtttctacaggacctagtgccaggatgcaacaaggtggttggcaaggcactcatgctcgatgagatcataaactacgtgcaatcgctgcagcagcaagttgagttcctgtccatgaagcttgccactgtgaacccgcaacttaatttcagcaacctgtcgactctcctacacaaagatatgtaccaaccatgtggcccatcagctaattcggtctttccattggaaagtgccggtgcagcttttccattttgtgaccaaggggatcttttccagaactttggttcgggtgctaggaggatcagtcaaagggacttctgggaggatggcctacagaatgctttgcctaccggtagtgagcaaagacaggaggatgggcttttagtaccgaactttgatggtatgcgacttatgcttaaatga

SEQ ID NO: 16111 - protein, 409 aa, Sorghum bicolor
  misc_feature: Useful for making plants with altered lignin content
  misc_feature: Functional homolog of the protein sequence given in SEQ ID NO 13755
  misc_feature: The sequence is a functional homolog of SEQ ID NO 186 in the 10/714,887 US patent application
  misc_feature: The sequence is a functional homolog of SEQ ID NO 186 in the 11/435,388 US patent application
  misc_feature: Ceres ANNOT ID no. 8655015
  misc_feature (250)..(300): Pfam ID: HLH Pfam Description: Helix-loop-helix DNA-binding domain
MHPTAPSYATDAARGPQTQPQRQQPLYKAIPPPTGSAASLAALRFPLKSTADSSFARRRRDDPRLAQLPPLLPAQSLRQRLFFHSMDSDYVASLLMGSSAHALDFAALDTGFLDTLCGGAGLFGVPGVAAGTGCGSGGGGGSPEGSSVSDPAWARASDGGNARKRKAPPTGSAGGKETCLGKAAEAKVPDGKRCRVGASDSPVKPKVEEAAASDASVEVKGQKKGKGKSPKPAVEPPKDYVHVRARRGQATDSHSLAERVRREKISQRMKFLQDLVPGCNKVVGKALMLDEIINYVQSLQQQVEFLSMKLATVNPQLNFSNLSTLLHKDMYQPCGPSANSVFPLESAGAAFPFCDQGDLFQNFGSGARRISQRDFWEDGLQNALPTGSEQRQEDGLLVPNFDGMRLMLK

SEQ ID NO: 16112 - DNA, 1485 bp, Sorghum bicolor
  misc_feature: Ceres ANNOT ID no. 8655026
  misc_feature: Encodes the peptide sequence at SEQ ID NO 16113
atgccgttgtcggggatcaccgcggtggacgcggccggcaaggggatgaagctggagcggtacgccagcgggggcgcgctgctgctgcgccgggcgaccagcgccaagctcgtgtccgcgtcgtcgcacctgctcttccgcgccaccgtgctcgccacgctcgcgctcgtcttcctcttcacgctgcactacccgtccctcctctcgcggtccttccacctctccgccggcgccggcgacgactcagcaggcggcggagcgcactccacctccgcctcgcaccgcagcctgctcatgtcgtcctcggcgtcggcgtcgtacggcggcgccgcgtgggagaaggaggtacggcggagcgccaggccgagccgggacgggggcatctccgtgctggtcacgggcgccgcgggcttcgtgggcacgcactgctcgctcgcgctcaaggcccgcggcgacggcgtgctcggcctcgacaacttcaactcctactacgacccgtcgctgaagcgcgcccgccaggcgctcctggccagccgtggcgtcgtcgtgctcgacgccgacatcaacgacggcctgctgctggagaagctcttcgacgtcgcggcgttcacgcacgtgctgcacctggccgcgcaagccggggtgcggtacgcgatggaggcgccgcagacgtacgtggcgtccaacgtggccgggctcgtcagcgtcttcgaggtggcggccaagcacgccgacccgcagccggccatcgtctgggcctcctcctcctcggtgtacgggctcaacaccgacgcgcccttctccgaggaccaccgcaccgaccgcccggcgtcgctgtacgcggccaccaagaaggccggcgaggccatcgcgcacacctacaaccacatctacgggctctccatcaccggcctccgcttcttcaccgtctacggtccctggggccgccccgacatggcctacttcttctttgcccgcagcatcgtcgccggcgagcccatcacgctgttccgcgccgccgacggctccgacgcgcgccgcgacttcacctacattgacgacgtcgtcaagggctgcctcggcgcgctcgacaccgccggcaagagcaccggctccaggtccggcaagaagagcgggcccgcgccgctccgcgtctacaacctcggcaacacatcccccgtgcccgtcacccggatggtcgccatcctcgagaagctgctcggcaagaaggccaacaagcgcatcgtcaccatgcccagcaacggcgacgtgcccttcacccacgccaacgtcagccacgccgcccacgacttcggctaccgccccacaacctccctcgaggccggcctccggcacttcgtcgactggttcgtcaactactacaagctcgacaccaagatcgccaagggcgcccgcagcagcgccgccgccgacaagccggcgaagaagaagaaggccgcggcggccatgtcggcgtcctcgtga

SEQ ID NO: 16113 - protein, 494 aa, Sorghum bicolor
  misc_feature: Useful for making plants with altered carbohydrate content
  misc_feature: Functional homolog of the protein sequence given in SEQ ID NO 14333
  misc_feature: Useful for making plants with altered cell wall content and/or composition
  misc_feature: Functional homolog of the protein sequence given in SEQ ID NO 14334
  misc_feature: Ceres ANNOT ID no. 8655026
  misc_feature (1)..(469): SWISSPROT Homolog: EC 5.1.3.6 UDP-glucuronate 4-epimerase
  misc_feature (130)..(389): Pfam ID: Epimerase Pfam Description: NAD dependent epimerase/dehydratase family
MPLSGITAVDAAGKGMKLERYASGGALLLRRATSAKLVSASSHLLFRATVLATLALVFLFTLHYPSLLSRSFHLSAGAGDDSAGGGAHSTSASHRSLLMSSSASASYGGAAWEKEVRRSARPSRDGGISVLVTGAAGFVGTHCSLALKARGDGVLGLDNFNSYYDPSLKRARQALLASRGVVVLDADINDGLLLEKLFDVAAFTHVLHLAAQAGVRYAMEAPQTYVASNVAGLVSVFEVAAKHADPQPAIVWASSSSVYGLNTDAPFSEDHRTDRPASLYAATKKAGEAIAHTYNHIYGLSITGLRFFTVYGPWGRPDMAYFFFARSIVAGEPITLFRAADGSDARRDFTYIDDVVKGCLGALDTAGKSTGSRSGKKSGPAPLRVYNLGNTSPVPVTRMVAILEKLLGKKANKRIVTMPSNGDVPFTHANVSHAAHDFGYRPTTSLEAGLRHFVDWFVNYYKLDTKIAKGARSSAAADKPAKKKKAAAAMSASS

SEQ ID NO: 16114 - DNA, 444 bp, Sorghum bicolor
  misc_feature: Ceres ANNOT ID no. 8655061
  misc_feature: Encodes the peptide sequence at SEQ ID NO 16115
atggtccacgcatccttcgttgtcatcaaggccgagacgccgtggcattatacccaggatggcgtcgatcttgtggttaaagatcctagaggtgatcaaatccatgattgttgtgacaagactagtgacaagtttgaattcatagttcacaagagggcagtccatcacttttgcttcactaataagtcaccgtatcatgaaactgtggacttcgatgtgcatgttggccatttatcatattctgaccaacatgctaaagatgccctctataacattcaattcgaacaacattggcttgaggcccaaacagaccgcgaagcaatatgtaagaggatagttcacaaggcactctttgaatcagctggccttgttgcagccagcgttgtgcagatctacctcatgcgccgcctctttgagcgtaagcaggggagttgtagggtctaa

SEQ ID NO: 16115 - protein, 147 aa, Sorghum bicolor
  misc_feature: Useful for making plants with altered carbohydrate content
  misc_feature: Functional homolog of the protein sequence given in SEQ ID NO 14028
  misc_feature: Useful for making plants with altered cell wall content and/or composition
  misc_feature: Functional homolog of the protein sequence given in SEQ ID NO 14027
  misc_feature: Ceres ANNOT ID no. 8655061
  misc_feature (12)..(75): Pfam ID: EMP24_GP25L Pfam Description: emp24/gp25L/p24 family/GOLD
MVHASFVVIKAETPWHYTQDGVDLVVKDPRGDQIHDCCDKTSDKFEFIVHKRAVHHFCFTNKSPYHETVDFDVHVGHLSYSDQHAKDALYNIQFEQHWLEAQTDREAICKRIVHKALFESAGLVAASVVQIYLMRRLFERKQGSCRV

SEQ ID NO: 16116 - DNA, 1014 bp, Sorghum bicolor
  misc_feature: Ceres ANNOT ID no. 8655056
  misc_feature: Encodes the peptide sequence at SEQ ID NO 16117
atggagaaacgaagacgcaggcacttgctgcttgctgctgcagccgtggtgctggtggcagtggcagcaataccgctgccgtccgcggaggcgaagctgtccccagactactaccggtcgacgtgcccggacgtcgaggcgatcgtgcgggcagtggtggcgaagaaggtcaatgagaccttcgtcacggtcccggccacgctcaggctcttcttccacgactgcttcgtcgagggctgtgatgcgtcggtcatgatcgcgtcccgcgacaacgacgccgagaaggacgcgcccgacaacgtgtccctcgccggcgacggcttcgacaccgtggtgcgcgccaaggccgaggtcgagaagaagtgccccggcgtggtctcctgcgccgacatcctcgccatcgccgccagggacgtcgtcgccatgtcgtccggcccccactggaccgtccagcttgggcggcttgacgggctcgtctccaaggccggcaacgtcgcgggcaagttgccgggacccaacatgcgcgtcaaggacctcgccgccatgttcgccaagcacaacctcacgacgctggacatggtcgcgctctcgggcgcgcacaccgtcgggttcgcgcactgcacccgcttcacggaccgcctctaccgccacggcggcggcggcaatggcgcgtcggtggacccgtcgtacaaccctgcgtacgcgcggcagctcatgggcgcctgcccgccggacgtcggcgcggacatcgccgtcgatatggacccgatcacaccgaccgccttcgataacgcctactacgccaacctcgccggcggcctgggcctgttcgcctccgaccaggcgctgtacagcgacggcgcgtcgcggccggcggtgaggggcttcgctgggaaccagacgcgcttcttcgaggcgttcaaggacgccatggtgaagctgggcagtgttggggtgaagaccaccggcaggcacggggagatcagaagagactgcaccgcattcaacgagtag

SEQ ID NO: 16117 - protein, 337 aa, Sorghum bicolor
  misc_feature: Useful for making plants with altered carbohydrate content
  misc_feature: Functional homolog of the protein sequence given in SEQ ID NO 14029
  misc_feature: Useful for making plants with altered cell wall content and/or composition
  misc_feature: Functional homolog of the protein sequence given in SEQ ID NO 14335
  misc_feature: Ceres ANNOT ID no. 8655056
  misc_feature (29)..(336): SWISSPROT Homolog: EC 1.11.1.7 Peroxidase
  misc_feature (49)..(299): Pfam ID: peroxidase Pfam Description: Peroxidase
MEKRRRRHLLLAAAAVVLVAVAAIPLPSAEAKLSPDYYRSTCPDVEAIVRAVVAKKVNETFVTVPATLRLFFHDCFVEGCDASVMIASRDNDAEKDAPDNVSLAGDGFDTVVRAKAEVEKKCPGVVSCADILAIAARDVVAMSSGPHWTVQLGRLDGLVSKAGNVAGKLPGPNMRVKDLAAMFAKHNLTTLDMVALSGAHTVGFAHCTRFTDRLYRHGGGGNGASVDPSYNPAYARQLMGACPPDVGADIAVDMDPITPTAFDNAYYANLAGGLGLFASDQALYSDGASRPAVRGFAGNQTRFFEAFKDAMVKLGSVGVKTTGRHGEIRRDCTAFNE

SEQ ID NO: 16118 - DNA, 684 bp, Sorghum bicolor
  misc_feature: Ceres ANNOT ID no. 8655093
  misc_feature: Encodes the peptide sequence at SEQ ID NO 16119
atgcatggtcagagaggtgtcgtcggctctagaagtcctcctcggcacggccgagaggtgcccaaggtggaaccagcagcaggcctagggggccgcggctttctcggccacagctactccgccgcccgcgccgattacgacgtcgccgtcatggccgcggcgctcacgcacgtcgtctgcggcgccacagagccaccgcgcggcggcgagacggcggcggcggcggcgcttccgccggggccgcggcgccaagatgcaggaggaggaggaggagcgacgtcgacgacggagctgcaggcgcgggcgcaacagtacaggggcgtgaggcggcggccgtggggcaagtgggcggcggagatacgggacccggagaaggcggcgcgcgtgtggctcggcaccttcgcgacgcccgaggaggccgcccgcgcttacgacgacgccgcgcgcaggttcaagggcgccaaggccaagctcaacttcccaacgacgacgacgacggcgtcgtcgtcgtcgtctgcaacggagacggtggaggagttccccgacctcgggcagtacctgcacatactccagagcagcgacgacgtcgacgtgcgggccgtcgcggccgggctgccgctgatgaaccgcctgccgccgccaggggacggtcaaggtcaagaccacggcagcagcgggcgctag

SEQ ID NO: 16119 - protein, 227 aa, Sorghum bicolor
  misc_feature: The sequence is a functional homolog of SEQ ID NO 164 in the 10/714,887 US patent application
  misc_feature: The sequence is a functional homolog of SEQ ID NO 164 in the 11/435,388 US patent application
  misc_feature: The sequence is a functional homolog of SEQ ID NO 32 in the 10/903,236 US patent application
  misc_feature: Useful for making plants with altered lignin content
  misc_feature: Functional homolog of the protein sequence given in SEQ ID NO 13219
  misc_feature: Ceres ANNOT ID no. 8655093
  misc_feature (103)..(154): Pfam ID: AP2 Pfam Description: AP2 domain
MHGQRGVVGSRSPPRHGREVPKVEPAAGLGGRGFLGHSYSAARADYDVAVMAAALTHVVCGATEPPRGGETAAAAALPPGPRRQDAGGGGGATSTTELQARAQQYRGVRRRPWGKWAAEIRDPEKAARVWLGTFATPEEAARAYDDAARRFKGAKAKLNFPTTTTTASSSSSATETVEEFPDLGQYLHILQSSDDVDVRAVAAGLPLMNRLPPPGDGQGQDHGSSGR

SEQ ID NO: 16120 - DNA, 1443 bp, Sorghum bicolor
  misc_feature: Ceres ANNOT ID no. 8655103
  misc_feature: Encodes the peptide sequence at SEQ ID NO 16121
atggcggcgaagacgacgcattcctatgatgctgccctcctcttcctcctggccggtgtgctggcggcggcgccggcggcctcgataacccgtagtgacttcccagcggggtttgtcttcggcgcgggctcctccgcctaccaggttgaaggtgcatttgctgaggatggaagaaatgctagcatctgggacacattcacacatgaaggcgatgtaacagcagatcagtatcacaagtacaaggaagatgtaaagcttttgcatggattaggtgtcgatgcatacagaatgtcgattgcctggcctcgacttattcccgatggtcggggagctgtaaatccaaagggattggagtactacaacaatctgatagatgaacttctgagctatggaatacaacctcatgtaacgatatatcatttcgattttcctcaggcacttcaagatgaatacaatgggctgattagtcgtaaattcatagaggacttcactgcgtatgcagatgtatgctttaagaactttggcaacagggtgaagtactggaccactgttaatgagcctaacattgaaacggttggtggatacgatgaaggaattctgccgccacggcggtgttcatcgccattcggcttcccttgcaacggtggcaactccaccacagagccatacatagctgcccaccacctcttgcttgcacatgcctcagcagtgtcattgtatagagagaagtaccagtttgagcccgcaacacaaactccggatgatgcagcagcagctgaaaggatgaaggaattccacattggatggttcatgcatcctatagtctacggtgactaccctccagtgatgcagaagaatgtcgggccaaggctgccatctttcactgatgaagaaaggaaaaaagtaaagggctcattcgatttcgttggatttaaccactacattgtcgtccatgtgagagccgatcttaatcggctgaaacagaaactgagagattacatgggtgatgcagctgtgaaatttgatagcaatcagttcccgatcaggttgaacagtttgacgatcgatttcaagacatcgaaaccctgggctctgaagaaattgctgaggcatattcgagtgaaatacaagaacccaccagtcatgattcatgaaaatggtggaaacagctacgacgacgagttcaggtcgcagttcttgcaggattacatcgaagccactcttgaatccatcagggacggatcaaacgtgcgtggctacttcgtctggtcgttcctggacatgttcgagttcttgttcggttaccgcctccggttcggcctctacggtgttgacttcagctcgtcggcgagaactaggtaccagaggcattcagcgcggtggtactccagcttcctccacggtggagagctcaggccggtggctctgctggacagggcgtag

SEQ ID NO: 16121 - protein, 480 aa, Sorghum bicolor
  misc_feature: Useful for making plants with altered cell wall content and/or composition
  misc_feature: Functional homolog of the protein sequence given in SEQ ID NO 14336
  misc_feature: Ceres ANNOT ID no. 8655103
  misc_feature (29)..(246): SWISSPROT Homolog: EC 3.2.1.147 Thioglucosidase
  misc_feature (375)..(451): SWISSPROT Homolog: EC 3.2.1.23 Beta-galactosidase
  misc_feature (30)..(471): Pfam ID: Glyco_hydro_1 Pfam Description: Glycosyl hydrolase family 1
MAAKTTHSYDAALLFLLAGVLAAAPAASITRSDFPAGFVFGAGSSAYQVEGAFAEDGRNASIWDTFTHEGDVTADQYHKYKEDVKLLHGLGVDAYRMSIAWPRLIPDGRGAVNPKGLEYYNNLIDELLSYGIQPHVTIYHFDFPQALQDEYNGLISRKFIEDFTAYADVCFKNFGNRVKYWTTVNEPNIETVGGYDEGILPPRRCSSPFGFPCNGGNSTTEPYIAAHHLLLAHASAVSLYREKYQFEPATQTPDDAAAAERMKEFHIGWFMHPIVYGDYPPVMQKNVGPRLPSFTDEERKKVKGSFDFVGFNHYIVVHVRADLNRLKQKLRDYMGDAAVKFDSNQFPIRLNSLTIDFKTSKPWALKKLLRHIRVKYKNPPVMIHENGGNSYDDEFRSQFLQDYIEATLESIRDGSNVRGYFVWSFLDMFEFLFGYRLRFGLYGVDFSSSARTRYQRHSARWYSSFLHGGELRPVALLDRA

SEQ ID NO: 16122 - DNA, 1410 bp, Sorghum bicolor
  misc_feature: Ceres ANNOT ID no. 8655106
  misc_feature: Encodes the peptide sequence at SEQ ID NO 16123
atggggaaggcgctcgtcggctctgctgttttcctcctcctggccgcgctcggggcggcgggggcctctgccgcggacatcacccgggccgacttccccgcggggttcgtcttcggcgtcggctcgtcggcgtaccaggttgaaggtgcagttgcagaggatggaaggaagcctagcatctgggacacattcacacataaaggatattctattgacggtgcgacaggtgatgtaactgcggatcagtatcataagtacaaggaagatgtaaagcttttgcatgagctgggtgttgatgcctacaggatgtcgattgcctggcctcgacttattcctgatggccgaggagctgtcaatccgaaggggctggagtactacaacaatctgatagatgaactccttagctacggaatacaacctcatgtaacgatctatcatttcgattttcctcaggctcttcaagatgagtacaaggggctgcttagtcctagattcatagaggactacacagcatacgcagatgtgtgcttcaagaactttggcgacagagtgaagtactggagcactgtcaatgaacctaacatcgaaacgattggcggatttgaccaaggaatcctaccaccacagcgatgctcagcccccttcggcttcggttgtgatgaaggcaactccaccacagaaccgtacatagcagcacaccaccttgtacttgcgcatgcatctgcagtgtccctatatagagagaagtaccaggctgagcaaggaggacgaattggactaaccttgcttggttggtggtatgagcctgcaacggagactcccgatgatattgcagcagctgcaaggatgaatgatttccacgttggatggttcatgcatcctatggtgtatggagactaccctccagtgatgaggaagaatgttgggtccagactgccatccttcacgaatgaagaggcaaaaagggtaaagggatcttttgattttgtcggattcaaccactatgttgccgtctacgtgaaagctgatcttagccgactagatgagaaagtgagagattacatggctgatgcagctgtggcatatgacagagctgctggacagcctgatccatccggcgtgaacacctacgatgacgaattcaggtcacaatatctccaagattacatcgaagccacgcttcaatccatcaggaacggatcaaacgtgcaaggttacttcgtgtggtcattcctggacgtgttcgagtacctgttcggctaccgcctccggttcggtgtctgtggcgttgaattcaactcgacggcaaggacaaggtatcagaggcactcggccaagtggtactccagcttcctccgtggtggcgagctgaggccagtggctctacctgagggagcatattcacagtga

SEQ ID NO: 16123 - protein, 469 aa, Sorghum bicolor
  misc_feature: Useful for making plants with altered cell wall content and/or composition
  misc_feature: Functional homolog of the protein sequence given in SEQ ID NO 14337
  misc_feature: Ceres ANNOT ID no. 8655106
  misc_feature (26)..(340): SWISSPROT Homolog: EC 3.2.1.21 Beta-glucosidase
  misc_feature (28)..(457): Pfam ID: Glyco_hydro_1 Pfam Description: Glycosyl hydrolase family 1
MGKALVGSAVFLLLAALGAAGASAADITRADFPAGFVFGVGSSAYQVEGAVAEDGRKPSIWDTFTHKGYSIDGATGDVTADQYHKYKEDVKLLHELGVDAYRMSIAWPRLIPDGRGAVNPKGLEYYNNLIDELLSYGIQPHVTIYHFDFPQALQDEYKGLLSPRFIEDYTAYADVCFKNFGDRVKYWSTVNEPNIETIGGFDQGILPPQRCSAPFGFGCDEGNSTTEPYIAAHHLVLAHASAVSLYREKYQAEQGGRIGLTLLGWWYEPATETPDDIAAAARMNDFHVGWFMHPMVYGDYPPVMRKNVGSRLPSFTNEEAKRVKGSFDFVGFNHYVAVYVKADLSRLDEKVRDYMADAAVAYDRAAGQPDPSGVNTYDDEFRSQYLQDYIEATLQSIRNGSNVQGYFVWSFLDVFEYLFGYRLRFGVCGVEFNSTARTRYQRHSAKWYSSFLRGGELRPVALPEGAYSQ

SEQ ID NO: 16124 - DNA, 687 bp, Sorghum bicolor
  misc_feature: Ceres ANNOT ID no. 8655235
  misc_feature: Encodes the peptide sequence at SEQ ID NO 16125
atgaccggagagtcgagctccccctgcagctcagcctcgacctcttcggagcaccaccagacggtgtggacgtcgcgaccgaagcggcccgcggggcggaccaagttccgggagacgaggcacccggtgttccgcggcgtccggaggcggggcaacgccgggcggtgggtgtgcgaggtgcgcgtgccggggaggcgcggctgcaggctctggctcggcaccttcgacaccgcggacgccgcggcccgcgcgcacgacgccgccatgctcgccatcgccggcgcgggcgcctgcctcaacttcgccgactcggcctggctcctcgccgtgccggcctcgtacgccagcctcgccgaggtccgccacgccgtcgcggaggccgtggaggagttcctgctccgtgaggtggtccaagaggacgatgcgctttcggccacgtcctcgacgccgccgtcgtccccgtccagcagcgacgacggaagcacctctgatggcggggagtcctctgaatctgattcgtctccggccgccaccggggcctcgccgttcgaattggacgtgttcaatgacatgagctgggacctgtactacgcgagcttggcgcaggggatgctcgtggaaccaccgtccgcggtcaccgcgttcatggacgaaggcttcgccgatgtgccactatggagctactag

SEQ ID NO: 16125 - protein, 228 aa, Sorghum bicolor
  misc_feature: The sequence is a functional homolog of SEQ ID NO 2 in US patent 7253000
  misc_feature: The sequence is a functional homolog of SEQ ID NO 1246 in the 10/374,780 US patent application
  misc_feature: The sequence is a functional homolog of SEQ ID NO 748 in the 11/435,388 US patent application
  misc_feature: The sequence is a functional homolog of SEQ ID NO 1248 in the 10/374,780 US patent application
  misc_feature: Ceres ANNOT ID no. 8655235
  misc_feature (42)..(95): Pfam ID: AP2 Pfam Description: AP2 domain
MTGESSSPCSSASTSSEHHQTVWTSRPKRPAGRTKFRETRHPVFRGVRRRGNAGRWVCEVRVPGRRGCRLWLGTFDTADAAARAHDAAMLAIAGAGACLNFADSAWLLAVPASYASLAEVRHAVAEAVEEFLLREVVQEDDALSATSSTPPSSPSSSDDGSTSDGGESSESDSSPAATGASPFELDVFNDMSWDLYYASLAQGMLVEPPSAVTAFMDEGFADVPLWSY

SEQ ID NO: 16126 - DNA, 723 bp, Sorghum bicolor
  misc_feature: Ceres ANNOT ID no. 8655233
  misc_feature: Encodes the peptide sequence at SEQ ID NO 16127
atgtgtccgccgatcaagaaggagatgagcgccgagtcgtcggcctcagcctcggcctcgccctcggcctcgtcggagcaccagaccgtgtggacgtcgccgccgaagcggccggcggggcggaccaagttccgcgagacgcggcaccccgtgttccgcggcgtccggcgccggggcaacgccgggcggtgggtgtgcgaggtgcgcgtgccggggaggcgcggctgcaggctctggctcggcacattcgacaccgccgaggccgcggcgcgcgcgcacgacgccgccatgctcgccatcgccggcgcgggcgcgtgcctcaacttcgccgattcggcttggctcctcgcggtcccggcctcgtacgccagcctcgccgaggtccgccacgcggttgccgaggccgtagaggatttccagcgccgcgagggcgagggcgaggcggccgccggggaggacgacgcgcgctcggccacctcgtcgtcagtgccgtccacctcatcgggcaatgaggacgacgccgctgccactgacggcgaggagtcttcgccggccacggaggactcgtcgccgttcgagatggacgtgttcaatgacatgagctgggatctgtactacgcgagcatggcgcaggggatgctcatggagctgccgtccgcagttccggcgttcggggacgacggctacgccaatgtcgccgatgtgccactgtggagctactag

SEQ ID NO: 16127 - protein, 240 aa, Sorghum bicolor
  misc_feature: The sequence is a functional homolog of SEQ ID NO 1230 in the 10/374,780 US patent application
  misc_feature: The sequence is a functional homolog of SEQ ID NO 724 in the 11/435,388 US patent application
  misc_feature: The sequence is a functional homolog of SEQ ID NO 2 in US patent 7138277
  misc_feature: The sequence is a functional homolog of SEQ ID NO 1246 in the 10/374,780 US patent application
  misc_feature: The sequence is a functional homolog of SEQ ID NO 748 in the 11/435,388 US patent application
  misc_feature: The sequence is a functional homolog of SEQ ID NO 2 in US patent 7253000
  misc_feature: The sequence is a functional homolog of SEQ ID NO 1248 in the 10/374,780 US patent application
  misc_feature: Ceres ANNOT ID no. 8655233
  misc_feature (50)..(103): Pfam ID: AP2 Pfam Description: AP2 domain
MCPPIKKEMSAESSASASASPSASSEHQTVWTSPPKRPAGRTKFRETRHPVFRGVRRRGNAGRWVCEVRVPGRRGCRLWLGTFDTAEAAARAHDAAMLAIAGAGACLNFADSAWLLAVPASYASLAEVRHAVAEAVEDFQRREGEGEAAAGEDDARSATSSSVPSTSSGNEDDAAATDGEESSPATEDSSPFEMDVFNDMSWDLYYASMAQGMLMELPSAVPAFGDDGYANVADVPLWSY

SEQ ID NO: 16128 - DNA, 699 bp, Sorghum bicolor
  misc_feature: Ceres ANNOT ID no. 8655229
  misc_feature: Encodes the peptide sequence at SEQ ID NO 16129
atggacacaccctcgccgtcgccgacgtcgtccgcggggcacgacgagtacaggacggtgtggtcggcgccgcccaagaagccggcgggacggaccaagttccgggagacgcggcacccggtgtaccgcggcgtccggcgccgcggcacgctggggcggtgggtgtgcgaggtgcgcgtccccgggggccgcgggtcaaggctctggctcggcaccttcaccacgcccgagctggcggcgcgcgcgcacgacgccgccgccatcgcgctgtcgcgccgcggcgcctgcctcaacttcgccgactcggcgtggctgctcccgccgctgatgcccgccgcgctgtcggcgccagagctggctagcgcgcgggaggtcaaggacgccgtcgccgaggccgtcgaggcgttccggcggtgctcggtggccgaaccgacgctgtcgtcgccgccgaatgatactgccgacgacgaggaggaggaggacgacgacgacgatgctgtttcctcgccgggcgcggtgccttggaacgacgccgtgttcgagttcgaggacgtgttcaggttcggtggcatggttgatgccggatcgtactacgcgagcctggcgcaggggctgctcgtagacccgccggatgccgccggcgcctggcgggaggacgtcgtgcatgccaccgctgacactgtactgtggagctactag

SEQ ID NO: 16129 - protein, 232 aa, Sorghum bicolor
  misc_feature: The sequence is a functional homolog of SEQ ID NO 1227 in the 10/374,780 US patent application
  misc_feature: The sequence is a functional homolog of SEQ ID NO 706 in the 11/435,388 US patent application
  misc_feature: The sequence is a functional homolog of SEQ ID NO 1248 in the 10/374,780 US patent application
  misc_feature: Ceres ANNOT ID no. 8655229
  misc_feature (40)..(93): Pfam ID: AP2 Pfam Description: AP2 domain
MDTPSPSPTSSAGHDEYRTVWSAPPKKPAGRTKFRETRHPVYRGVRRRGTLGRWVCEVRVPGGRGSRLWLGTFTTPELAARAHDAAAIALSRRGACLNFADSAWLLPPLMPAALSAPELASAREVKDAVAEAVEAFRRCSVAEPTLSSPPNDTADDEEEEDDDDDAVSSPGAVPWNDAVFEFEDVFRFGGMVDAGSYYASLAQGLLVDPPDAAGAWREDVVHATADTVLWSY

SEQ ID NO: 16130 - DNA, 1488 bp, Sorghum bicolor
  misc_feature: Ceres ANNOT ID no. 8655243
  misc_feature: Encodes the peptide sequence at SEQ ID NO 16131
atgggttcgacggggcctgagggggtggagatgccaccgcacgtagtgtgcgtgccgtacccggcgcagggccacgtcactccgatgctgaagctggcgaagctgctccacgcccgtggcttccatgtcaccatggtgaacaccgagttcaaccaccgccgcctgctccactcgcgtggccccgaagcgctggacggcatcccgaggttccgctacgccgccattcccgacgggctcccgccctccgacgagaacgccacgcaggacgtccccgcgctctgctactccaccatgaccacctgcctcccgcacctcctgtccctcctccggaagctcaacgacgacgacgacgaccctactagcgtgccacccgtcacctgcctcgtcgtggacggcgtcatgtcgttcgcctacgacgcggcgaaacagctgggccttccctgcgccgcgctctggaccgccagcgcgtgcggcctcgcggggtaccgccactaccagcagctcgtccagtggggcctcgtccctttcagcgacgacgcgcagctcgcggacgacggcgcgtacctcgacaccgtggtccgcggcgcgcgcggcatgtgcgacggcgtgcgcctgcgcgacttccccagcttcatccgcaccacggaccgcggcgacgtcatgctcaacttcttcatccacgaggccgagcggctgtcgctcccggacgccgtcatgatcaacaccttcgacgacctcgaggcgccgacgctcgacgccctgcgcgcgacgctccctccgatgtacgccgtgggcccgctgctcctccacgcgcgccgcgccgtcgcggagggcagcgacctcgatggcctcggctccaacctctgggaggagcagggtggcctcctcgagtggctcgacggccaggcgccgggctccgtcgtgtacgtcaactacgggagcatcaccgtgatgtccaacgagcagctgctggagttcgcgtgggggctggctggcagcggctacccgttcatgtggaacatccggccggaccttgtcaagggtgacaccgccgtgctgccgccggagttctcgtcctccgtgaagggccgcgccatgctaacgacgtggtgcccgcaggaggctgtgctggcgcacgaggcggtggggctgttcctcacgcactccgggtggaactcgaccctagagagcatctccgcgggggtgccaatgctcagctggcccttcttcgcggagcagcagaccaactgccggtacaagcgtacagaatggggcgtcgggatggagatcggtggcaaggtgagacgcgcagagctggcagagatgatcagagaggccatgggcggggacaaggggagggagatgcaccggcgtgccgcggactggaaggagaaggccatccgagcgacaatgttaggcgggtctgcggaaaccaatctggacattgttgtcaatgaggtgctgctccgcaaccgcaagatacgttaa

SEQ ID NO: 16131 - protein, 495 aa, Sorghum bicolor
  misc_feature: Useful for making plants with altered carbohydrate content
  misc_feature: Functional homolog of the protein sequence given in SEQ ID NO 14338
  misc_feature: Ceres ANNOT ID no. 8655243
  misc_feature (120)..(487): SWISSPROT Homolog: EC 2.4.1.121 Indole-3-acetate beta-glucosyltransferase
  misc_feature (13)..(491): Pfam ID: UDPGT Pfam Description: UDP-glucoronosyl and UDP-glucosyl transferase
MGSTGPEGVEMPPHVVCVPYPAQGHVTPMLKLAKLLHARGFHVTMVNTEFNHRRLLHSRGPEALDGIPRFRYAAIPDGLPPSDENATQDVPALCYSTMTTCLPHLLSLLRKLNDDDDDPTSVPPVTCLVVDGVMSFAYDAAKQLGLPCAALWTASACGLAGYRHYQQLVQWGLVPFSDDAQLADDGAYLDTVVRGARGMCDGVRLRDFPSFIRTTDRGDVMLNFFIHEAERLSLPDAVMINTFDDLEAPTLDALRATLPPMYAVGPLLLHARRAVAEGSDLDGLGSNLWEEQGGLLEWLDGQAPGSVVYVNYGSITVMSNEQLLEFAWGLAGSGYPFMWNIRPDLVKGDTAVLPPEFSSSVKGRAMLTTWCPQEAVLAHEAVGLFLTHSGWNSTLESISAGVPMLSWPFFAEQQTNCRYKRTEWGVGMEIGGKVRRAELAEMIREAMGGDKGREMHRRAADWKEKAIRATMLGGSAETNLDIVVNEVLLRNRKIR

SEQ ID NO: 16132 - DNA, 1095 bp, Sorghum bicolor
  misc_feature: Ceres ANNOT ID no. 8655260
  misc_feature: Encodes the peptide sequence at SEQ ID NO 16133
atggcgatcggcgggtcggatgccggcggcggaggcgcggcggcgggcaggaggagcgtgctggtgacgggcggcgccgggttcatcggcacgcacacggtgctgcgcctcctggagcagggctacggcgtcaccgtcgtcgacaacttccacaactccgtccccgaggcgctcgaccgcgtccgcctcatcgccgggcccgcgctctccgcccgcctcgacttcatccgcggggacctgaggagcaccgaggacttggagaaggtgttctctgccaggaggtacgacgccgtcatccacttcgccgggctgaaggccgtcggggagagcgtcgcgcacccggagatgtactacgagaacaacctcgtcggcaccatcaacctctacaagaccatgaaggcgcacaactgcaagaagttggtgttctcgtcgtccgccaccgtgtacggctggccggaggagatcccatgcgtggaggactccaagctgcaggccgccaacccttacggcaggaccaagcttatcctggaggatatggcgcgtgactaccaccgcgcggacccggagtggagcatcgtcctgctgcgctacttcaaccccatcggcgcgcacagctccggcgagatcggagaggaccccaaggggatacccaacaacctgctgccctacatccagcaggtcgccgtcggcaggctccccgagctcaacgtctacggccacgattaccccacccgggacggcaccgcgatcagggattacatacacgtcgtcgacctggccgacgggcacatcgcagcgctcaacaagctcttcgacgctcccgatatcggttgtgtggcctacaatctgggcacggggcgcggcacatccgttctggagatggtggcggcgttcaagaaggcctccggcaaggagattcccaccaagttgtgccccaggagaccgggtgacgcgacggaggtttacgcgtccaccgagaaggctggaagggagcttggatggagagcccagtatggaatcgaggagatgtgcagggaccagtggaactgggccaagaagaacccgtatggctactgcggcagtgccgaaaaatag

SEQ ID NO: 16133 - protein, 364 aa, Sorghum bicolor
  misc_feature: Useful for making plants with altered carbohydrate content
  misc_feature: Functional homolog of the protein sequence given in SEQ ID NO 14339
  misc_feature: Useful for making plants with altered cell wall content and/or composition
  misc_feature: Functional homolog of the protein sequence given in SEQ ID NO 14340
  misc_feature: Ceres ANNOT ID no. 8655260
  misc_feature: Up-regulated in shoot tissues in response to salicylic acid treatment
  misc_feature (18)..(360): SWISSPROT Homolog: EC 5.1.3.2 UDP-glucose 4-epimerase
  misc_feature (20)..(284): Pfam ID: Epimerase Pfam Description: NAD dependent epimerase/dehydratase family
MAIGGSDAGGGGAAAGRRSVLVTGGAGFIGTHTVLRLLEQGYGVTVVDNFHNSVPEALDRVRLIAGPALSARLDFIRGDLRSTEDLEKVFSARRYDAVIHFAGLKAVGESVAHPEMYYENNLVGTINLYKTMKAHNCKKLVFSSSATVYGWPEEIPCVEDSKLQAANPYGRTKLILEDMARDYHRADPEWSIVLLRYFNPIGAHSSGEIGEDPKGIPNNLLPYIQQVAVGRLPELNVYGHDYPTRDGTAIRDYIHVVDLADGHIAALNKLFDAPDIGCVAYNLGTGRGTSVLEMVAAFKKASGKEIPTKLCPRRPGDATEVYASTEKAGRELGWRAQYGIEEMCRDQWNWAKKNPYGYCGSAEK

SEQ ID NO: 16134 - DNA, 978 bp, Sorghum bicolor
  misc_feature: Ceres ANNOT ID no. 8655255
  misc_feature: Up-regulated in shoot tissues in response to salicylic acid treatment
  misc_feature: Encodes the peptide sequence at SEQ ID NO 16135
atggcgagcgacggcgacgggaagggccgcgtcgcgacggcgccggggggagggtacgggtacgggtacgggtacggcggctacgaggggttcgaggaccggaagtggtggccgtggctcgtgcccaccgtgatcgtcgcctgcatcgccgtgttcgtcgtcgagatgtacgagaacaactgccccaagaacaggagccagctcggcggctgcgtcgccgggttcctccgccgcttctccttccagccgctccgcgagaacccgctgctcgggccgtcatcctccactttggagaaaatgggagctcttgactggaataaaattgttcatcaaaaccaagggtggcgccttattagctgcatttggctccatgctggcctaatccatttggttgtgaacatgctaagtttgctgtttattggaatccgccttgagcagcaatttggatttgtccgcattggtgccatatacctactgtctggttttggtggcagcgtgttgtctgcactcttcctacggaacaattacatctctgttggtgcttctggagctttatttggcctgcttgggtccatgctttctgagctactcatgaactggactatatactccaacaaggccacagctataataacactcctgtttattgttgcactcaacttagctattgggatattacctcacgctgacaactttgctcacattggtggcttcgcgacgggtttcctcttgggttttgttctgttggcaaggcctcaatttagctggatggagcgccatgagttgccacagactaaccaacctcccaagtacaaagcgtaccagtatattttgtgggttgtggcactcgtcttgctgttagttgggtttgtggtttcactggtgatgcttttcaaagggaagaatgggaacgatggctgccactggtgccactacctgaactgcgtgccaacatctaagtggaagtgcaacacctag

SEQ ID NO: 16135 - protein, 325 aa, Sorghum bicolor
  misc_feature: Useful for making plants with altered cell wall content and/or composition
  misc_feature: Functional homolog of the protein sequence given in SEQ ID NO 14341
  misc_feature: Ceres ANNOT ID no. 8655255
  misc_feature (84)..(262): SWISSPROT Homolog: EC 3.4.21.105 Rhomboid protease
  misc_feature (108)..(253): Pfam ID: Rhomboid Pfam Description: Rhomboid family
MASDGDGKGRVATAPGGGYGYGYGYGGYEGFEDRKWWPWLVPTVIVACIAVFVVEMYENNCPKNRSQLGGCVAGFLRRFSFQPLRENPLLGPSSSTLEKMGALDWNKIVHQNQGWRLISCIWLHAGLIHLVVNMLSLLFIGIRLEQQFGFVRIGAIYLLSGFGGSVLSALFLRNNYISVGASGALFGLLGSMLSELLMNWTIYSNKATAIITLLFIVALNLAIGILPHADNFAHIGGFATGFLLGFVLLARPQFSWMERHELPQTNQPPKYKAYQYILWVVALVLLLVGFVVSLVMLFKGKNGNDGCHWCHYLNCVPTSKWKCNT

SEQ ID NO: 16136 - DNA, 771 bp, Sorghum bicolor
  misc_feature: Ceres ANNOT ID no. 8655266
  misc_feature: Encodes the peptide sequence at SEQ ID NO 16137
atggtggcgctcgggcagggggggaacaggacgaaggaggcggaggaggaggcggcggcgcggtgggagagcgagaaggaggcggagatcgactacgtgttcaaggtggtggtggtgggcgactcggcggtgggcaagacgcagctgctggcgcgcttcacccgggacgagttcgcgctcgactccaagtccaccatcggcgtcgagttccagacgcgcaccctcacgctccaccgcaagcgcgtcaaggcgcagatctgggacaccgccgggcaggagaggtacagggcggtgacgagcgcctactaccggggcgcgctgggcgccatggtggtgtacgacgtgacccggcgcgccacgttcgagcacgtggcgcggtgggtggaggagctccgcgcgcacgccgacggctcctccaccgtcgtggcgctcatcgggaacaaggccgacatgcccgcggggaggcgcgaggtggccgccgacgaggccgcgcgcctcgccgaggagcaggggctcttcttctccgaggcgtccgcgctcacgggcgacaacgtggagcgcgccttcctcacgctcctcgaggaggtcttcgccgtcgtgtcgcgcagggcgctggagctcgacgaggcacgccggatgcgcggcgaccagggccagggcgatggcggccgaggcggcgaggtgctgtcgctcaaggggaccgccgtggatgtgggctccatcatggagaccagcgccatgaagaggagctcgcagtgcgcttgctcatga

SEQ ID NO: 16137 - protein, 256 aa, Sorghum bicolor
  misc_feature: Useful for making plants with altered lignin content
  misc_feature: Functional homolog of the protein sequence given in SEQ ID NO 13076
  misc_feature: Useful for making plants with altered alkaloid content
  misc_feature: Functional homolog of the protein sequence given in SEQ ID NO 13220
  misc_feature: Useful for making plants with altered terpenoid content
  misc_feature: Functional homolog of the protein sequence given in SEQ ID NO 13157
  misc_feature: Ceres ANNOT ID no. 8655266
  misc_feature (35)..(151): SWISSPROT Homolog: EC 2.7.11.1 Non-specific serine/threonine protein kinase
  misc_feature (35)..(198): Pfam ID: Ras Pfam Description: Ras family
  misc_feature (35)..(150): Pfam ID: Miro Pfam Description: Miro-like protein
MVALGQGGNRTKEAEEEAAARWESEKEAEIDYVFKVVVVGDSAVGKTQLLARFTRDEFALDSKSTIGVEFQTRTLTLHRKRVKAQIWDTAGQERYRAVTSAYYRGALGAMVVYDVTRRATFEHVARWVEELRAHADGSSTVVALIGNKADMPAGRREVAADEAARLAEEQGLFFSEASALTGDNVERAFLTLLEEVFAVVSRRALELDEARRMRGDQGQGDGGRGGEVLSLKGTAVDVGSIMETSAMKRSSQCACS

SEQ ID NO: 16138 - DNA, 795 bp, Sorghum bicolor
  misc_feature: Ceres ANNOT ID no. 8655275
  misc_feature: Encodes the peptide sequence at SEQ ID NO 16139
atgggcctaaaggtgtttcattggctgaattggaggatgcatcctaatactgagtactgcaccatccatggtaacaaggccatggaggatagggaggactctgtgcctcatagtgtggttgagaaagacactgaagcccttttgctccgtgatgtgcttcttaatggtatacttgcaattggcacacttggacatcacgtagactcattttgtcctgaggcttgcattgaagaagaagatctcctcgtcatgggtgatgagagagtaattgaggaagatatagatgatgaggaacccaggaatgatcaggtgaaagaagacgttgcattggaaacagagccatgtgaaccagtattgcctattgttgagcctgctaagatgcattcattgtcaatgaaagaagacaactttacatgctttgtaacagaagaaatcctgatgcgtgaggtggaagatgggggagctgttaatatccaggagcgaccacttctgatggtagagaaggtggagaaagtaagaactacacttgctgatttatttgcagcagaagtattctcatcaagtgctccaggggagaatagttgccaggatatcatccatgttgctggggcatccacttcaaagcatacatcatgcatggacaagatgcatcaaaagaaaccaaggaagccaccaccaaaaccactgaaagccacaagaaaattaagtcgggtcatgaggaagatgttggggaagaagatccacccagagcagctcaatgggcgtagcaatgcagaggggccccttactgcatga

SEQ ID NO: 16139 - protein, 264 aa, Sorghum bicolor
  misc_feature: Useful for making plants with modulated light quality sensitivity
  misc_feature: Functional homolog of the protein sequence given in SEQ ID NO 14342
  misc_feature: Ceres ANNOT ID no. 8655275
  misc_feature: Down-regulated in shoot tissues in response to salicylic acid treatment
MGLKVFHWLNWRMHPNTEYCTIHGNKAMEDREDSVPHSVVEKDTEALLLRDVLLNGILAIGTLGHHVDSFCPEACIEEEDLLVMGDERVIEEDIDDEEPRNDQVKEDVALETEPCEPVLPIVEPAKMHSLSMKEDNFTCFVTEEILMREVEDGGAVNIQERPLLMVEKVEKVRTTLADLFAAEVFSSSAPGENSCQDIIHVAGASTSKHTSCMDKMHQKKPRKPPPKPLKATRKLSRVMRKMLGKKIHPEQLNGRSNAEGPLTA

SEQ ID NO: 16140 - DNA, 984 bp, Sorghum bicolor
  misc_feature: Ceres ANNOT ID no. 8655277
  misc_feature: Down-regulated in shoot tissues in response to salicylic acid treatment
  misc_feature: Encodes the peptide sequence at SEQ ID NO 16141
atgtacacctccgtctccgccgccgccgttgcagctgccgctgccgctgccgccctcgtcccacgcctcaccggccgccgatcggcgccggcatctcgcataccggagatctgccgcagaagaatccgatccaaaccccgtaccttttcttcctccccctccttccccattgtccccgccgctgccatggccaccgacggcgccgcctctgatgctgggtccaagaagaagctgctcatcttcgactccgaggaggatctcgcggtttctctggcgaagtacactgcggagctgtcggagaagttcgcggccgagaggggcgccttcaccgccgtgctctctggcggatccctcatccaggcgctcaggaagctgacggagccgccgtacctggattcggttgactggagcaagtggcacgtcttctgggtggatgagagggtcgtgcgcaaggaccatgtggatagcaactacaagctcgcctttgatgggtttctctccaaggtgccgattcctcctggacaagtttatgctataaatgatgccttgtcagctgagggagcagcagatgactatgaagcgtgcttgaagcagcttgttaagaatggtgtgatttccatgtcagcagcgactggatttcccaggtttgatctccagcttctgggaatgggacctgatggccacattgcatctctcttccctggtcaccctcttgttaatgagaaagagaggtgggtcacatacattaaggattctccaaaaccaccaccagagagaatcacatttacatttccagtaatcaactcatctgcatatgttgcaatggtggtaactggagttggaaaggctggagcagtgcagaaagcactttcagacaagcaaacatcatcggatctgctgcctgttgagatggctgtactgcaagatggagaattcacttggttctctgacaagccagcagtgtccatgctgcagaacaattaa

SEQ ID NO: 16141 - protein, 327 aa, Sorghum bicolor
  misc_feature: Useful for biocontainment applications
  misc_feature: Useful for making plants with modulated flowering time
  misc_feature: Functional homolog of the protein sequence given in SEQ ID NO 13189
  misc_feature: Ceres ANNOT ID no. 8655277
  misc_feature (80)..(324): SWISSPROT Homolog: EC 3.1.1.31 6-phosphogluconolactonase
  misc_feature (91)..(327): Pfam ID: Glucosamine_iso Pfam Description: Glucosamine-6-phosphate isomerases/6-phosphogluconolactonase
MYTSVSAAAVAAAAAAAALVPRLTGRRSAPASRIPEICRRRIRSKPRTFSSSPSFPIVPAAAMATDGAASDAGSKKKLLIFDSEEDLAVSLAKYTAELSEKFAAERGAFTAVLSGGSLIQALRKLTEPPYLDSVDWSKWHVFWVDERVVRKDHVDSNYKLAFDGFLSKVPIPPGQVYAINDALSAEGAADDYEACLKQLVKNGVISMSAATGFPRFDLQLLGMGPDGHIASLFPGHPLVNEKERWVTYIKDSPKPPPERITFTFPVINSSAYVAMVVTGVGKAGAVQKALSDKQTSSDLLPVEMAVLQDGEFTWFSDKPAVSMLQNN

SEQ ID NO: 16142 - DNA, 1656 bp, Sorghum bicolor
  misc_feature: Ceres ANNOT ID no. 8655281
  misc_feature: Encodes the peptide sequence at SEQ ID NO 16143
atggcggtggcggcgacccccgatgactgcggcagctggttgctgtacctgtccctagccgccaaatgcgccggcggcgaccagcctcaccgcctggccggtttcctggcggtctgcgccgtggccttcgtcgtcacttgcctcctccactggtgcttccctggaggtccggcgtggggaaggtggtggtggacgacgcaggcgcggcgggtcgcggcggccgccgttccggggccgaggggcctgcccgtggtcgggagcatgtggctcatgacgggcctggcgcaccgcaagctggcggcggcggcggacagcctccgcgccaggcgcctgatggcgttctccctcggcggcacgcgggtggtggtggccgcgcacccggacgtggcgcgggagatcctcaacagcccggcgttcgcggaccgtcccatcaaggagtccgcgtacgggctcctgttccaccgcgccatcggcttcgcgccctacggcgcctactggcgcgcgctccgccgcgtggcgtccacgcacctcttctccccgtggcaggtcgccgcctccgccgcgcagcgcgccgtcatcgcgcgccagatggtcgccgccatgaagcaggagctgtcgtcgtcgtcgtcggcctcggccggcttcgaggtccgccgcgtcctgcgccgcgggtccctgcacaacgtgatgtggtcggtgttcggccggcggtacgacctggagctggacccggccaaggagagccccgagacgcgggagctgaggagcctcgtggacgaaggctacgacctgctgggccagctcaactggtccgaccacctcccctggctcgcgcgcttcgacctgcagagcaccaggtccaggtgcgaccgcctcgtcccgctcgtgaaccgcttcgtcggcggcatcatcgacgcgcaccgcgcccggaacgacctccgctccgctccaccacacgccgtcatggacttcaccgacgtgctcctctcgctgccggccgacgacaggctcaccgactctgacatgatcgccgtcctctgggaaatggtgttccgtggaactgacaccgttgccgtgctgatcgagtgggtgctggcgaggctcgtgctgcaccctgacgtgcaggcccgtgtccacgacgagctggaccgcgtggtcgggcgtgaccgggccgtgaccgagtccgactcggggtcactggtctacctgcacgccgtgatcaaggaggtgctcaggatgcacccgccgggcccactgctgtcgtgggcgcgcctggccacgtcggacgtgcaggtggacgggcacctcatccccgccggcaccaccgccatggtgaacatgtgggccataacgcacgacccggacgtgtgggcggagccggcggagttccagccggagaggttcatgggatccaccaccggcggcgagttcccgataatggggtcggacctgaggctcgcgccgttcggggcgggccggcgcagctgccccgggaagagcctcgccatggccaccgtggctctctggctcgcgacgctgctgcacgagttcgagctgctcccggcgcgcggcgtctacctgtcggaggtgctcaagctgtcgtgcgagatggccgtcccgctggccgtgacggcgaggccccggcaagcggtgtga

SEQ ID NO: 16143 - protein, 551 aa, Sorghum bicolor
  misc_feature: Useful for biocontainment applications
  misc_feature: Useful for making plants with modulated flowering time
  misc_feature: Useful for making plants with modulated nitrogen use efficiency
  misc_feature: Functional homolog of the protein sequence given in SEQ ID NO 14250
  misc_feature: Ceres ANNOT ID no. 8655281
  misc_feature (116)..(550): SWISSPROT Homolog: EC 1.14.13.21 Flavonoid 3'-monooxygenase
  misc_feature (76)..(545): Pfam ID: p450 Pfam Description: Cytochrome P450
MAVAATPDDCGSWLLYLSLAAKCAGGDQPHRLAGFLAVCAVAFVVTCLLHWCFPGGPAWGRWWWTTQARRVAAAAVPGPRGLPVVGSMWLMTGLAHRKLAAAADSLRARRLMAFSLGGTRVVVAAHPDVAREILNSPAFADRPIKESAYGLLFHRAIGFAPYGAYWRALRRVASTHLFSPWQVAASAAQRAVIARQMVAAMKQELSSSSSASAGFEVRRVLRRGSLHNVMWSVFGRRYDLELDPAKESPETRELRSLVDEGYDLLGQLNWSDHLPWLARFDLQSTRSRCDRLVPLVNRFVGGIIDAHRARNDLRSAPPHAVMDFTDVLLSLPADDRLTDSDMIAVLWEMVFRGTDTVAVLIEWVLARLVLHPDVQARVHDELDRVVGRDRAVTESDSGSLVYLHAVIKEVLRMHPPGPLLSWARLATSDVQVDGHLIPAGTTAMVNMWAITHDPDVWAEPAEFQPERFMGSTTGGEFPIMGSDLRLAPFGAGRRSCPGKSLAMATVALWLATLLHEFELLPARGVYLSEVLKLSCEMAVPLAVTARPRQAV

SEQ ID NO: 16144 - DNA, 417 bp, Sorghum bicolor
  misc_feature: Ceres ANNOT ID no. 8655298
  misc_feature: Encodes the peptide sequence at SEQ ID NO 16145
atggcgggctacggcggcggcgacgacggcgtggacctcaccgagctgacgctggggctacccggcgtcaatgcgcgcaaggcgagacgagcgaggaagaacggccagcagccgccgtcgtcgatgcaagcgttcgtgaaggtgagcatggacgggacgccgtacctgaggaaggtggacgtggcggcgtacgacgactacggcgagctcgtggaggcgctcaatgagctcttctgctgctgctccatcgggctgatggatgggtacggcgactgggagcacgccgtggtgtacgaggacggcgacggcgactggatgctcgtcggcgacgtgccgtgggagatgttcgtgtcctcgtgcaagaggatgagagtgatgcgatcgtgcgaggcgagagggttgagctccaacgcctga

SEQ ID NO: 16145 - protein, 138 aa, Sorghum bicolor
  misc_feature: The sequence is a functional homolog of SEQ ID NO 648 in the 11/479,226 US patent application
  misc_feature: The sequence is a functional homolog of SEQ ID NO 636 in the 11/479,226 US patent application
  misc_feature: The sequence is a functional homolog of SEQ ID NO 739 in the 10/374,780 US patent application
  misc_feature: The sequence is a functional homolog of SEQ ID NO 290 in the 10/412,699 US patent application
  misc_feature: The sequence is a functional homolog of SEQ ID NO 674 in the 11/479,226 US patent application
  misc_feature: The sequence is a functional homolog of SEQ ID NO 656 in the 11/479,226 US patent application
  misc_feature: Useful for making plants with altered alkaloid content
  misc_feature: Functional homolog of the protein sequence given in SEQ ID NO 13611
  misc_feature: The sequence is a functional homolog of SEQ ID NO 667 in the 11/479,226 US patent application
  misc_feature: Useful for making plants with modulated nitrogen use efficiency
  misc_feature: Functional homolog of the protein sequence given in SEQ ID NO 13612
  misc_feature: The sequence is a functional homolog of SEQ ID NO 2004 in the 10/374,780 US patent application
  misc_feature: The sequence is a functional homolog of SEQ ID NO 660 in the 11/479,226 US patent application
  misc_feature: The sequence is a functional homolog of SEQ ID NO 652 in the 11/479,226 US patent application
  misc_feature: The sequence is a functional homolog of SEQ ID NO 598 in the 10/666,642 US patent application
  misc_feature: The sequence is a functional homolog of SEQ ID NO 904 in the 11/435,388 US patent application
  misc_feature: Useful for making plants with altered terpenoid content
  misc_feature: Functional homolog of the protein sequence given in SEQ ID NO 13610
  misc_feature: The sequence is a functional homolog of SEQ ID NO 736 in the 10/374,780 US patent application
  misc_feature: The sequence is a functional homolog of SEQ ID NO 737 in the 10/374,780 US patent application
  misc_feature: Ceres ANNOT ID no. 8655298
  misc_feature (10)..(138): Pfam ID: AUX_IAA Pfam Description: AUX/IAA family
MAGYGGGDDGVDLTELTLGLPGVNARKARRARKNGQQPPSSMQAFVKVSMDGTPYLRKVDVAAYDDYGELVEALNELFCCCSIGLMDGYGDWEHAVVYEDGDGDWMLVGDVPWEMFVSSCKRMRVMRSCEARGLSSNA

SEQ ID NO: 16146 - DNA, 2118 bp, Sorghum bicolor
  misc_feature: Ceres ANNOT ID no. 8655324
  misc_feature: Encodes the peptide sequence at SEQ ID NO 16147
atgccgactccgaagcagcggctcccctactccacctccggcgggggcggaggaggagggaggcgcgccgcctcgagctccgccgcgctgcctcccgtggtggtcctcgtgttcctcttcgtggtcgcgccttcgctcttcttcgtcgcgcgcaatggcggtcgcggccacgtccacgtagcctccgatcccaagggcaagaatgtcgatcaggaagcagcagcaatgaagaacctcaaatctattttgcctaaggaggtgtttgatgctataactgctagtcaacaagaatcaggcactttgagtcttgattttttcaggaatcatgcatctccctcttggaaaactgatgatctagtcaccgagaagagcatggatgttgatgacaaggctaaagctgaaaacagtttgccagaacatgatctaccaacaaatagatcacccaaagatccagacgaacatcaagttgataaagcagcaaaagtagctcgaagggtaacagtactatccttgtatacaaattaccttgttttggtctctgttggtgttggtacacatttcaaacttagggagaaaaggcgtgagaagagaactatggatttggttcataaagatgatgaagcacgtgctaagctggagaatgccgctattgagcgatcaaaagctgtcgattctgctgtgcttggaaaatacagcatatggcgaaaagagaatgagaacgagaattcagactctacagttaggctgatgagggaccaagttattatggctcgtgtctattctgtgcttgctaaatcaaagaacaagaacgatctatatcaaaaactgcagacccgaatcaaggaaagccagcgggctgttggagaggcatctgctgatgctgacctgcatcacagcgcacctgagaaaatcagagcaatgggtcaagttttatcaaaggcgagagaagaactttatgattgtatggcaatcactcagagactaagggctatgcttcagtcagcagatgaacaggtcaggagcttgaagaagcagagtacatttcttagccagttggctgcaaagacaattccaaacagcattcactgcttgtctatgcgtctgacaattgattactatctcctcccccttgaggaatggaaattcccaaggagtgaaaatttagaaaacccaaatctctatcactatgcacttttctcagataatgtcttggcagcctctgttgttgtgaactcgaccatcatgaatgctaaggaaccagagaaacatgttttccatcttgtgactgacaagttaaactttggagccatgaacatgtggtttctgctgaacccacctggcaaggccaccatccatgttgagaatgtggacgaatttaagtggttgaactcatcatactgtcctgtgctgcggcaacttgagtctgctgccatgaaagagtactatttcaaagctgatcgtcccaccacactgtcagcaggttcttcgaacctaaagtatcggaaccccaagtacctctctatgctgaaccacttgaggttctatctcccagaggtctatccaaagttggataaaatactcttcctcgacgatgacatagttgtgcagaaagatttgacagggttgtgggatgttgatcttaatggaaaggtcaatggtgctgtggaaacctgtggggagagtttccaccgttttgacaagtatcttaatttttcaaatccacacattgctcggaactttgatccaaatgcatgtggctgggcttatgggatgaacatctttgatttgagggagtggaagaagaaagatattactgggatctaccacaaatggcaaaatctgaatgaagacagagctctttggaagcttgggacacttccgcctggcctcttgaccttctacaagttgacgcacccactggacaagtcatggcatgttcttggattaggatacaacccaagcatagaccgttcagagatagacagtgctgctgtggttcattacaatgggaacatgaagccatggttggagctagcaatgaccaagtaccgaccatattggaccaagtatatcaagtatgatcacccttacatccgtgggtgcaacttgagtgagtag

SEQ ID NO: 16147 - protein, 705 aa, Sorghum bicolor
  misc_feature: Useful for making plants with altered cell wall content and/or composition
  misc_feature: Functional homolog of the protein sequence given in SEQ ID NO 13838
  misc_feature: Useful for making plants with altered carbohydrate content
  misc_feature: Functional homolog of the protein sequence given in SEQ ID NO 13787
  misc_feature: Ceres ANNOT ID no. 8655324
  misc_feature (363)..(679): Pfam ID: Glyco_transf_8 Pfam Description: Glycosyl transferase family 8
MPTPKQRLPYSTSGGGGGGGRRAASSSAALPPVVVLVFLFVVAPSLFFVARNGGRGHVHVASDPKGKNVDQEAAAMKNLKSILPKEVFDAITASQQESGTLSLDFFRNHASPSWKTDDLVTEKSMDVDDKAKAENSLPEHDLPTNRSPKDPDEHQVDKAAKVARRVTVLSLYTNYLVLVSVGVGTHFKLREKRREKRTMDLVHKDDEARAKLENAAIERSKAVDSAVLGKYSIWRKENENENSDSTVRLMRDQVIMARVYSVLAKSKNKNDLYQKLQTRIKESQRAVGEASADADLHHSAPEKIRAMGQVLSKAREELYDCMAITQRLRAMLQSADEQVRSLKKQSTFLSQLAAKTIPNSIHCLSMRLTIDYYLLPLEEWKFPRSENLENPNLYHYALFSDNVLAASVVVNSTIMNAKEPEKHVFHLVTDKLNFGAMNMWFLLNPPGKATIHVENVDEFKWLNSSYCPVLRQLESAAMKEYYFKADRPTTLSAGSSNLKYRNPKYLSMLNHLRFYLPEVYPKLDKILFLDDDIVVQKDLTGLWDVDLNGKVNGAVETCGESFHRFDKYLNFSNPHIARNFDPNACGWAYGMNIFDLREWKKKDITGIYHKWQNLNEDRALWKLGTLPPGLLTFYKLTHPLDKSWHVLGLGYNPSIDRSEIDSAAVVHYNGNMKPWLELAMTKYRPYWTKYIKYDHPYIRGCNLSE

SEQ ID NO: 16148 - DNA, 915 bp, Sorghum bicolor
  misc_feature: Ceres ANNOT ID no. 8655354
  misc_feature: Encodes the peptide sequence at SEQ ID NO 16149
atggccgcggcgccgtcgtccctcgcgtcctcccacctctcccgcctcgccgacctccgccgcgccgcggcggtggccactcccgccgtcccacagcagcttcgcatcggctgctcgcgccgccgcgcccagcgcgtcgtcgccatggctggatccggcaagttcttcgtcggaggcaactggaagtgcaatggaacaaaggactccattagcaagcttgtttctgaattgaatgctgctaccctcgaaactgatgtagatgttgtggtggcacctccattcatctatatcgatcaggtcaagaattcactaactggtcgcattgaggtttctgctcagaatgtgtggattggaaaaggaggagcctacaccggagagatcagtgcagaacaattggtggacattggtgttcagtgggttattcttggacactctgagcgtaggcatattattggtgaagatgatgagtttattgggaagaaggctgcatatgcattgagccaaaatgttaagcttattgcctgcataggagagctcctggaagagagggaagcagggaaaacttttgatgtatgttttacgcagatgaaggcttttgcagatagtatttcaaactgggccgatgttgtaattgcatatgagcctgtttgggctattggaactggaaaagttgctactcctgagcaggcccaggaagttcatgccgctgtacgcgattggttgaagaccaacgtatcacctgaagttgcctctagcactcgaataatctatggaggttctgtgaatgcagccaattgtgcagagctagcaaagaaagaagatattgatggttttcttgttggcggtgcctccttgaaggcaccggatttcgccaccattgtcaactcagtgactgccaagaaagttactgcgtga

SEQ ID NO: 16149 - protein, 304 aa, Sorghum bicolor
  misc_feature: Useful for making plants with modulated biomass
  misc_feature: Functional homolog of the protein sequence given in SEQ ID NO 14343
  misc_feature: Ceres ANNOT ID no. 8655354
  misc_feature (43)..(304): SWISSPROT Homolog: EC 5.3.1.1 Triose-phosphate isomerase
  misc_feature (55)..(294): Pfam ID: TIM Pfam Description: Triosephosphate isomerase
MAAAPSSLASSHLSRLADLRRAAAVATPAVPQQLRIGCSRRRAQRVVAMAGSGKFFVGGNWKCNGTKDSISKLVSELNAATLETDVDVVVAPPFIYIDQVKNSLTGRIEVSAQNVWIGKGGAYTGEISAEQLVDIGVQWVILGHSERRHIIGEDDEFIGKKAAYALSQNVKLIACIGELLEEREAGKTFDVCFTQMKAFADSISNWADVVIAYEPVWAIGTGKVATPEQAQEVHAAVRDWLKTNVSPEVASSTRIIYGGSVNAANCAELAKKEDIDGFLVGGASLKAPDFATIVNSVTAKKVTA

SEQ ID NO: 16150 - DNA, 1269 bp, Sorghum bicolor
  misc_feature: Ceres ANNOT ID no. 8655345
  misc_feature: Encodes the peptide sequence at SEQ ID NO 16151
atgagctgcctgggctggttcaagcggcggaggtccaggagcggggggtcgtcgacgtcgacgtcggggaagcgaggggcgtcggcgtcggcgccggtgtcggtgtctggccccgcgaccacgatgaccaccacgacgatggcgtcggcggtgagcacgagccggtccgacgactccggcgcggtgcggccggtgagcaagtcggcgggctcgtcgtcgcaggcgtcgcagcggagcatctcgtcgctgtacgaggagcggggccacggccagctccgggtgttcgactacgaggagctccagggcgccaccgccgagttcagccgcgcgcagaagctcggcgagggcggcttcggcagcgtctacaagggcttcatccgcgccgccgacggcaagggcgaccgcgtccccgtcgccgtcaagaagctcaaccagcgcagcatgcagggacataagcaatggttggcagaagtacagttccttggtgttctggagcacccaaatcttgtaaagctacttggatattgtgctgttgatagcgaaagagggccacaaagattattggtctacgagtttatgcccaataagagcttggaagaccacttgttcaggcgagctaatcctcctctatcgtggaacaaaaggcttcaggttatcttgggagctgctgaaggattggcttacctgcatgaaggggtagaagttcaggtgatctaccgggacttcaaaacgtccaacattttactggacaaggacttcagagcaaagctatcggacttcggcctagccagggagggtccaactggagaaaacactcacgtctcgactgcggtcgtcgggacgcacgggtacgccgcgccggagtacatggaatcggggcacctgacggcgaagagcgacgtgtggagcttcggcgtggtgctgtacgagatcctgacggggcggcggtcgctggaccggaacaagccggcggcggagcagaagctgctggagtgggtggtccagttcccgccggacagccgcaacttccggatgatcatggaccccaggctccgcggggagtactcggtgaaggccgcccgggagatcgccaagctggccgacagctgcctgctcaagaacgccaaggagcggcccaccatgagcgaggtggtcgaggtcctcaggcgggccgtgcaggcgcacgccgagcctgacagccggactcccggcggccccggcgccaaggggaagaaatcatccgacgctgccacaccgtccaggcggtga

SEQ ID NO: 16151 - protein, 422 aa, Sorghum bicolor
  misc_feature: Useful for making plants with modulated drought sensitivity
  misc_feature: Functional homolog of the protein sequence given in SEQ ID NO 14078
  misc_feature: Useful for making plants with modulated heat sensitivity
  misc_feature: Functional homolog of the protein sequence given in SEQ ID NO 14079
  misc_feature: Ceres ANNOT ID no. 8655345
  misc_feature (92)..(401): SWISSPROT Homolog: EC 2.7.11.1 Non-specific serine/threonine protein kinase
  misc_feature (107)..(388): Pfam ID: Pkinase Pfam Description: Protein kinase domain
MSCLGWFKRRRSRSGGSSTSTSGKRGASASAPVSVSGPATTMTTTTMASAVSTSRSDDSGAVRPVSKSAGSSSQASQRSISSLYEERGHGQLRVFDYEELQGATAEFSRAQKLGEGGFGSVYKGFIRAADGKGDRVPVAVKKLNQRSMQGHKQWLAEVQFLGVLEHPNLVKLLGYCAVDSERGPQRLLVYEFMPNKSLEDHLFRRANPPLSWNKRLQVILGAAEGLAYLHEGVEVQVIYRDFKTSNILLDKDFRAKLSDFGLAREGPTGENTHVSTAVVGTHGYAAPEYMESGHLTAKSDVWSFGVVLYEILTGRRSLDRNKPAAEQKLLEWVVQFPPDSRNFRMIMDPRLRGEYSVKAAREIAKLADSCLLKNAKERPTMSEVVEVLRRAVQAHAEPDSRTPGGPGAKGKKSSDAATPSRR

SEQ ID NO: 16152 - DNA, 888 bp, Sorghum bicolor
  misc_feature: Ceres ANNOT ID no. 8655325
  misc_feature: Encodes the peptide sequence at SEQ ID NO 16153
atggccgcagccactgccgccgccgcttctaccatgtccctgctcccgatctcccagctcaggcagcagcagcacggcgcgggcgccgtggtcgtgttccggcggcgggcccgggacgcgcggcggaggcgatacgtcgtgccgacggcgaggctgttcgggccggcgatcttcgaggcgtccaagctgaaggtgctgttcctgggcgtggacgaggagagcaacaacaagcacgggcacccgacgacgccgtcgccgacttccccgccgctgccgctactgccgcggacgtacacgctgacgcacagcgacgtgacggccagcctgacgctggccgtgtcccacaccatcaaccgcgcgcagctgcaagggtggtacaaccgcctgcagcgggacgaggtggtggcggagtggaagaaggtgcgcgggcggatgtcgctgcacgtgcactgccacatctccggcggccacttcctgctcgacctcatcgccggcctccgctactacatcttccgcaaggagctccccgtggtgctcaaggctttcgtgcacggcgacggcgacctgttcagccggcacccggagctggaggatgccccggtgtgggtctacttccactccaacctgacccgcttcaaccgcgtcgagtgctggggtccgctgcgcgacgccgccgcgccgccggccgaggacgactccaccgcgccggccgccgcctccaacaaggatgggcagatgccgcccgtgggcgagtggccgtaccggtgtccccagcagtgcgactgctgcttcccgccgcacagcctcatcccctggccgaacgagcgcgacatggcggccgccgccgccgatgcctcctccgccgccggccaggcccaacagcagtag

SEQ ID NO: 16153 - protein, 295 aa, Sorghum bicolor
  misc_feature: Useful for making plants with modulated time to senescence
  misc_feature: Functional homolog of the protein sequence given in SEQ ID NO 14344
  misc_feature: Useful for making plants with modulated abscission
  misc_feature: Functional homolog of the protein sequence given in SEQ ID NO 14345
  misc_feature: Ceres ANNOT ID no. 8655325
MAAATAAAASTMSLLPISQLRQQQHGAGAVVVFRRRARDARRRRYVVPTARLFGPAIFEASKLKVLFLGVDEESNNKHGHPTTPSPTSPPLPLLPRTYTLTHSDVTASLTLAVSHTINRAQLQGWYNRLQRDEVVAEWKKVRGRMSLHVHCHISGGHFLLDLIAGLRYYIFRKELPVVLKAFVHGDGDLFSRHPELEDAPVWVYFHSNLTRFNRVECWGPLRDAAAPPAEDDSTAPAAASNKDGQMPPVGEWPYRCPQQCDCCFPPHSLIPWPNERDMAAAAADASSAAGQAQQQ

SEQ ID NO: 16154 - DNA, 1467 bp, Sorghum bicolor
  misc_feature: Ceres ANNOT ID no. 8655384
  misc_feature: Encodes the peptide sequence at SEQ ID NO 16155
atgatgcagcagatgcagcaggagccgtggaacgccgccgccgtggggctcctccggccgaccaagtcggcgccctgctcgccaatcaagccggcggcggcggcggccatgctgcgaacccactccgactccttccacgtcgcgcacaaggtgcccgtcggcgacacgccgtacgtgcgagccaagcgcgtccagctggtggacaaggatccggagaaggcgatcgcgctgttctggagtgcgatcaatgccggcgaccgcgtcgacagcgcgctcaaggacatggccatcgtgatgaagcagcagaaccgcgccgaggaggccatcgaggccatcaagtcgctgcgcagccggtgctccgaccaggcgcaggagtccctcgacaacatcctcctcgatctctacaagagatgcgggcggctggacgaccagatctcgctgctcaagcacaagctgcagctgatccaccagggccacgccttcaacggcaagcggaccaaaacggctcgctctcagggccgcaagttccaggtcaccctcgagcaagaagccaccaggctccttggtaacctgggatgggcgctgatgcagaaggagaactacacggaggcggagggggcgtaccgtcgggcgctgcttatcgggccggacaacaacaagatgtgcaatctgggcatctgcctcatgaagcagggccgcgtgctcgaggccaaggatgtgctcaagcaggtacgccccgcggcggtcgacggtctgcgcggcgccgactcccacctcaaggcctacgagcgcgcgcaagagatgctgcgggacctcgagaccaagctcgtcggccgcccgcgcgctgaccagctcgacacgaactggctcttcgatgcactgctgctgggatcgtcctcgagcatctggcagccgcagccgtgcatcgaccacttgctgccacctccggctccggctccggcttcggctccagcaccagccccggcgccgcgcgaccgcttcgccgatgaaaacgccagtgtcagcaagaagctggcggcgctccaggcgaacatgcttaatgtggacgcgcagcccttctactctctgcgacagcagcagcagaagccagctcctgcccatgatcccttgggcaacctgaagaggacacggtccggcaattgcatggacaaggcaggagcagtggtggacaaggagcaggagcagagcatcgacgagaacagcggcaggaggaagtcgctctctgctgaggacagatggccagagctgcccgaccacagcgcgttcgacgaggccatcgtcgcggctgtcctgggcccagtgctcgacgacgaaccagcagctgctgaagggaacggccatggcaagctgccgacgagctgcgacacgagcccagcggtgaaggaaaagatcggcaagaggctgaggatcttccaggacatcacacagacagtgaacaatttctga

SEQ ID NO: 16155 - protein, 488 aa, Sorghum bicolor
  misc_feature: Useful for making plants with altered terpenoid content
  misc_feature: Functional homolog of the protein sequence given in SEQ ID NO 13067
  misc_feature: Ceres ANNOT ID no. 8655384
  misc_feature: Down-regulated in shoot tissues in response to salicylic acid treatment
  misc_feature (185)..(218): Pfam ID: TPR_2 Pfam Description: Tetratricopeptide repeat
MMQQMQQEPWNAAAVGLLRPTKSAPCSPIKPAAAAAMLRTHSDSFHVAHKVPVGDTPYVRAKRVQLVDKDPEKAIALFWSAINAGDRVDSALKDMAIVMKQQNRAEEAIEAIKSLRSRCSDQAQESLDNILLDLYKRCGRLDDQISLLKHKLQLIHQGHAFNGKRTKTARSQGRKFQVTLEQEATRLLGNLGWALMQKENYTEAEGAYRRALLIGPDNNKMCNLGICLMKQGRVLEAKDVLKQVRPAAVDGLRGADSHLKAYERAQEMLRDLETKLVGRPRADQLDTNWLFDALLLGSSSSIWQPQPCIDHLLPPPAPAPASAPAPAPAPRDRFADENASVSKKLAALQANMLNVDAQPFYSLRQQQQKPAPAHDPLGNLKRTRSGNCMDKAGAVVDKEQEQSIDENSGRRKSLSAEDRWPELPDHSAFDEAIVAAVLGPVLDDEPAAAEGNGHGKLPTSCDTSPAVKEKIGKRLRIFQDITQTVNNF

SEQ ID NO: 16156 - DNA, 2412 bp, Sorghum bicolor
  misc_feature: Ceres ANNOT ID no. 8655391
  misc_feature: Down-regulated in shoot tissues in response to salicylic acid treatment
  misc_feature: Encodes the peptide sequence at SEQ ID NO 16157
atgaccgtccgggccgcggccgtgctggtggccgccgccgcgctcgcgctcctcctcccgggatgggcggcggcggagtggaccctcacgaagaagggcagcgtcgtcacctacgatgcgcgctctctcttgatcgacggcaagcgggacctcttcttctccggcgccatccactaccccaggagcccgcctgaggtgtggccgaagctgctcgaccgggccaaggagggcggcctcaacacgatcgagacgtacatattctggaatgcacacgagcctgagcctggcaagtacaattttgaaggcaggctcgatttggtcaagttcctcaagatgatccaggagcatggcatgtatgcaattgtgcgcatcgggccctttatccaggcagaatggaaccatggtggcctgccttattggcttagagagatcgaccacataatattccgggcaaacaatgatccgtacaagaaagaaatggagaaatggacgagatttgtagtacagaagttgaaggatgctgagttatttgcatctcaaggaggacccgtcattttaacacagatcgagaatgagtatgggaacataaaaaaagatcataaaatagaaggtgacaagtacctcgaatgggcagctcaaatggccctcagcacacaaacaggagttccatggataatgtgcaaacagtcttcagctcctggtgaagtgatccctacttgcaatggaaggcattgtggagacacatggacactgcgtgacaaaaataagcctatgctttggactgagaattggactcaacaattcagagcatatggcgatcaattagcaatgcgttcagctgaggacattgcatatgccgtgttacgattttttgcaaagggtgggtcaatggttaactactacatgtatcacggaggaacaaattttggaaggactagcgcttcttatgtgctgactggatactatgatgaagctcccttggatgaatatggtatgtacaaggaacccaaatttgggcatctcagggacttgcacaatgtaataaggtcatatcagaaagcattcctctcggggaagcattcgtctgagatattgggtcatgggtatgaggcacaaatctttgagttgcctgaagaaaacctgtgcctctctttcctttccaacaataacacgggggaagatggaacagtgatcttccgaggggttaagcactatgtgcctagccgttccgtctccattcttgcagggtgcaaggatgtggtttacaataccaagagagtgtttgtacaacacagtgaaaggtcataccatacctcagaggtaacaagcaagaataaccagtgggagatgtactcagaaatggtcccaaagtataaagatactaaaatcaggacaaaggaacccctggagcaatataaccagaccaaggacgctagtgactacttatggtacaccacaagctttcgcttggagtcagacgatttgccctttagaggtgacatccggcctgtgcttcaggtcaaaagcagtgcacactcaatgattggatttgccaatgatgctttcgtaggaagtgcgcgtggaaacaagcaggtgaagggtttcatgtttgaaaaacccgttgatctgaaagcaggtgtgaaccatgtcgtattgctgtcgtcaactatgggaatgaaggacagtggtggtgaacttgctgaagtaaagggcggcattcaggagtgcctaatccaaggtctcaacactgggacgttggatttacaagtcaatggctggggccataagagatactttgatgagcctgatggagatgatcccattgtacttgacatgagctcaatgagcaagggaatgatttttgtgaatggtgaaggcatcggtagatactgggtctcattccgaactcttgctggaactccttctcaagcagtataccatattccgcgtcctttcttgaaacccaaggacaacctcttggttgtcttcgaggaggaaatgggcaagccggatggcatcctcgtgcagaccgtgacgagagacgacatatgcctgctgatatcggagcacaacccgggacagataaagacgtgggacacggatggggtcaaaatcaagctcattgcagaggatcacagcgtgcggggcactttgatgtgcccccctgagaagataatccaggaagtcgtctttgccagctttggcaacccggatggcatgtgcggcaacttcactgtaggcacttgccacacgcccaatgcgaagcagatcgttgagaaggaatgccttggcaagccatcctgcatgctgccggtggatcacacagtgtacggcgcggacatcaactgccaatcaacaactggaacactgggggtgcaggtgagatgcagagggggcaagaagggtgcctga

SEQ ID NO: 16157 - protein, 803 aa, Sorghum bicolor
  misc_feature: Useful for making plants with altered cell wall content and/or composition
  misc_feature: Functional homolog of the protein sequence given in SEQ ID NO 14346
  misc_feature: Ceres ANNOT ID no. 8655391
  misc_feature (27)..(595): SWISSPROT Homolog: EC 3.2.1.23 Beta-galactosidase
  misc_feature (42)..(348): Pfam ID: Glyco_hydro_35 Pfam Description: Glycosyl hydrolases family 35
  misc_feature (718)..(796): Pfam ID: Gal_Lectin Pfam Description: Galactose binding lectin domain
MTVRAAAVLVAAAALALLLPGWAAAEWTLTKKGSVVTYDARSLLIDGKRDLFFSGAIHYPRSPPEVWPKLLDRAKEGGLNTIETYIFWNAHEPEPGKYNFEGRLDLVKFLKMIQEHGMYAIVRIGPFIQAEWNHGGLPYWLREIDHIIFRANNDPYKKEMEKWTRFVVQKLKDAELFASQGGPVILTQIENEYGNIKKDHKIEGDKYLEWAAQMALSTQTGVPWIMCKQSSAPGEVIPTCNGRHCGDTWTLRDKNKPMLWTENWTQQFRAYGDQLAMRSAEDIAYAVLRFFAKGGSMVNYYMYHGGTNFGRTSASYVLTGYYDEAPLDEYGMYKEPKFGHLRDLHNVIRSYQKAFLSGKHSSEILGHGYEAQIFELPEENLCLSFLSNNNTGEDGTVIFRGVKHYVPSRSVSILAGCKDVVYNTKRVFVQHSERSYHTSEVTSKNNQWEMYSEMVPKYKDTKIRTKEPLEQYNQTKDASDYLWYTTSFRLESDDLPFRGDIRPVLQVKSSAHSMIGFANDAFVGSARGNKQVKGFMFEKPVDLKAGVNHVVLLSSTMGMKDSGGELAEVKGGIQECLIQGLNTGTLDLQVNGWGHKRYFDEPDGDDPIVLDMSSMSKGMIFVNGEGIGRYWVSFRTLAGTPSQAVYHIPRPFLKPKDNLLVVFEEEMGKPDGILVQTVTRDDICLLISEHNPGQIKTWDTDGVKIKLIAEDHSVRGTLMCPPEKIIQEVVFASFGNPDGMCGNFTVGTCHTPNAKQIVEKECLGKPSCMLPVDHTVYGADINCQSTTGTLGVQVRCRGGKKGA

SEQ ID NO: 16158 - DNA, 870 bp, Sorghum bicolor
  misc_feature: Ceres ANNOT ID no. 8655414
  misc_feature: Encodes the peptide sequence at SEQ ID NO 16159
atgtcgaaggatgacgtgacggcggaggcggaggccgcggcgaaggcgccgtactgggatccgccgccggcgccgctgctggacacgagcgagctgaagaagtggtccctgtaccgcgcgctcatcgccgagttcatggccaccctcatcttcctctacgtgagcatcgccaccgtcatcgggtacaagaaccagtccaaggccgaatcgtgcaccggcgtcggcgccctcggcatcgcctggtccttcggcgccaccatcttcatcctcgtctactgcaccggcggcatctcaggcgggcacatcaacccggcggtgacgttcggtctgttcgtggggcggaagctgtcgctggtgcgcacgctgctgtacatcgtggcgcagtgcctgggcgccatctgcggcgtgggcatcgtcaaggggatcatgaaggtgccctacaactccctcggcggcggcgccaacgcggtggccacgggcccctccgacggggtgctcacgggttactccgtcggcagcgccctggccgccgagatcgtcggcaccttcatcctcgtgtacaccgtcttctccgccaccgaccccaagcgcacggcgcgcgactccttcatccccgtgctcgtgccgctgccgattgggttcgcggtgttcgtggttcacctggcgaccattcccatcaccggcaccggcatcaacccggccaggagcctcggcgccgccgtcgtgcacgcagcatggaaagaccattggatcttctgggttgggccgctgatcggggcgacggtggcggcgttgtaccacaagctcgtgctgcgcggggaggccgtcaaggcgctcggctccttcaggagcaccagcgccacggtgtga

SEQ ID NO: 16159 - protein, 289 aa, Sorghum bicolor
  misc_feature: Useful for making plants with modulated drought sensitivity
  misc_feature: Functional homolog of the protein sequence given in SEQ ID NO 14287
  misc_feature: Useful for making plants with modulated cold sensitivity
  misc_feature: Functional homolog of the protein sequence given in SEQ ID NO 14288
  misc_feature: Useful for making plants with modulated water use efficiency
  misc_feature: Functional homolog of the protein sequence given in SEQ ID NO 14289
  misc_feature: Ceres ANNOT ID no. 8655414
  misc_feature (31)..(267): Pfam ID: MIP Pfam Description: Major intrinsic protein
MSKDDVTAEAEAAAKAPYWDPPPAPLLDTSELKKWSLYRALIAEFMATLIFLYVSIATVIGYKNQSKAESCTGVGALGIAWSFGATIFILVYCTGGISGGHINPAVTFGLFVGRKLSLVRTLLYIVAQCLGAICGVGIVKGIMKVPYNSLGGGANAVATGPSDGVLTGYSVGSALAAEIVGTFILVYTVFSATDPKRTARDSFIPVLVPLPIGFAVFVVHLATIPITGTGINPARSLGAAVVHAAWKDHWIFWVGPLIGATVAALYHKLVLRGEAVKALGSFRSTSATV

SEQ ID NO: 16160 - DNA, 711 bp, Sorghum bicolor
  misc_feature: Ceres ANNOT ID no. 8655425
  misc_feature: Encodes the peptide sequence at SEQ ID NO 16161
atggacacggacacgacgtccaccgactcccagttccggcaccctgctcctgccatctccgcggccggagcgcgcgccgtcgtatgctcattggccgctcggggcgccgagagcctcgcccgcggcctcgtcacctgcgtcttcgcgacagtgggcacggtcctcggcgcgatcaccggcgggctgatcgggctggccacggagacgggcgtgctgcgcggcacgggcgtcggcggcatcacgggcgcgctggtgtccatggaggtcgtcgagtcgtccctcgccttgtggcgctccgacgagccggccatctggagcgtcgtctacgtgctcgatgtgatctggagcttgctgaccggccgtctcgtgcgcgagaaggtggaccccgccgtgctcaacgccgtcgagagccagatgagcgcagcggaggcaacggtcttgcatggagaccacgccgacatcttcggcatgggtggcaccaacggcatggcgagggtcgccatcgatgcgctccccgtggtgaggttcaccgagcgcagcagcgtcgacgccagcggcgacctcatcgcctgctcggtttgcctccaggaattccaagccggcgacagcgcgaggagcctgccggtgtgccgccacacgttccacctgccgtgcatcgacggctggctgctccggcacgcctcctgcccattgtgccggcgatcggtctag

SEQ ID NO: 16161 - protein, 236 aa, Sorghum bicolor
  misc_feature: Useful for making plants with modulated nitrogen use efficiency
  misc_feature: Functional homolog of the protein sequence given in SEQ ID NO 12909
  misc_feature: The sequence is a functional homolog of SEQ ID NO 216 in the 10/225,068 US patent application
  misc_feature: The sequence is a functional homolog of SEQ ID NO 2322 in the 10/374,780 US patent application
  misc_feature: The sequence is a functional homolog of SEQ ID NO 242 in the 10/412,699 US patent application
  misc_feature: The sequence is a functional homolog of SEQ ID NO 515 in the 11/479,226 US patent application
  misc_feature: Ceres ANNOT ID no. 8655425
  misc_feature (191)..(236): SWISSPROT Homolog: EC 6.3.2.19 Ubiquitin--protein ligase
  misc_feature (191)..(232): Pfam ID: zf-C3HC4 Pfam Description: Zinc finger, C3HC4 type (RING finger)
MDTDTTSTDSQFRHPAPAISAAGARAVVCSLAARGAESLARGLVTCVFATVGTVLGAITGGLIGLATETGVLRGTGVGGITGALVSMEVVESSLALWRSDEPAIWSVVYVLDVIWSLLTGRLVREKVDPAVLNAVESQMSAAEATVLHGDHADIFGMGGTNGMARVAIDALPVVRFTERSSVDASGDLIACSVCLQEFQAGDSARSLPVCRHTFHLPCIDGWLLRHASCPLCRRSV

SEQ ID NO: 16162 - DNA, 1725 bp, Sorghum bicolor
  misc_feature: Ceres ANNOT ID no. 8655484
  misc_feature: Encodes the peptide sequence at SEQ ID NO 16163
atgggccagccgcggcggcgcggctacccgcacgggcacggccgccaccaccggtgcccgcgccgcattgcgctgccggcggccgggctgggcctgctctttctcgccgtctcgctcctctccgtctcactcctctccgcgccgccgctcacaaacggctccggcggcgaactagagggctccgagagcggggatgcgttcagtgttacgacacatggatggactgggcaggatgatctttggcgatcgaagcttgctagcaatttccacagatgcagcaactctagcaataaatttcttgattctggtgttaccactcaaccagatcgatacttgattgttgttacaagtggaggtcttaatcagcagagaacggggatagtcgatgctgtagttgctgcacgtattttgaacgctacacttgttgttcccagactggatcaaacatctttctggaaagattcaagtaatttttcagaaatctttgatatggactggttcatctcatatcttgaaaaggatgtcagaattatcaaagagcctccagaaaaaggaggtaaagcaatgaaaccttataaaatgcgtgtcccccgaaaatgtactccacggtgttacttgaaccgcgtcttaccagcacttttgaaaaaacatgttattcgaatgactaaatatgattataggctctcaaataagttggacactgacctgcaaaaactacgttgcagagtcaactatcatgctttgagatttactgacccgatacaagaattggctgaaaagctaatacagcgaatgcgagaaaagagcagatattttattgctcttcacctgagatttgaacctgatatgctcgccttttctgggtgctattatggtggtggagaaaaggagaggagagaattagcttcaattcgcaaacgatggagaaccttgcatatacgtgacccggagaaaggaagaaggcaaggtaggtgtccactaactcctgaggaggtagggttgatgttgagggcattaggctacagaagtgatgtgtacatttatgttgcttctggtgagatatacggaggggaagatactttagcacccctcaaagcgctctttcctaatttccatacaaaagaaacactgtcaagccaagaggagcttgctccattcctaaagttctcatctcgcatggctgcaatcgatttcattgtctgtgatgaaagtgatgcttttgtggctaacaacattggtaacatggccaaaattctggctgggcaaaggaggtattttggccacaagagaacaatccggccaaatgctaaacagctctatcccttattcatgaagaggggaaatatgtcatgggatgcatttgcctcacaggtgcgaactatccagaaaggatatatgggagagcctatggaaatcacaccaggaagaggcgaatttcatgccaaccctgccgcctgtatatgtgaaaagagcggccgaaactcagtaatagtcaagtccatttctggaagtacccaggaacctgtaactgacaccagaataaggaaagccattgacattggtagaccaccataccctgtttatactgacgaagaggcagatggatctgatacagaagaagatccagatagcagcgggagaggagaggtgattgacactgaacctgacgatgattctgtggtcagacaggaggatcctgagctagaggagatcctgtcagattag

SEQ ID NO: 16163 - protein, 574 aa, Sorghum bicolor
  misc_feature: Useful for making plants with modulated nitrogen use efficiency
  misc_feature: Functional homolog of the protein sequence given in SEQ ID NO 14347
  misc_feature: Ceres ANNOT ID no. 8655484
MGQPRRRGYPHGHGRHHRCPRRIALPAAGLGLLFLAVSLLSVSLLSAPPLTNGSGGELEGSESGDAFSVTTHGWTGQDDLWRSKLASNFHRCSNSSNKFLDSGVTTQPDRYLIVVTSGGLNQQRTGIVDAVVAARILNATLVVPRLDQTSFWKDSSNFSEIFDMDWFISYLEKDVRIIKEPPEKGGKAMKPYKMRVPRKCTPRCYLNRVLPALLKKHVIRMTKYDYRLSNKLDTDLQKLRCRVNYHALRFTDPIQELAEKLIQRMREKSRYFIALHLRFEPDMLAFSGCYYGGGEKERRELASIRKRWRTLHIRDPEKGRRQGRCPLTPEEVGLMLRALGYRSDVYIYVASGEIYGGEDTLAPLKALFPNFHTKETLSSQEELAPFLKFSSRMAAIDFIVCDESDAFVANNIGNMAKILAGQRRYFGHKRTIRPNAKQLYPLFMKRGNMSWDAFASQVRTIQKGYMGEPMEITPGRGEFHANPAACICEKSGRNSVIVKSISGSTQEPVTDTRIRKAIDIGRPPYPVYTDEEADGSDTEEDPDSSGRGEVIDTEPDDDSVVRQEDPELEEILSD

SEQ ID NO: 16164 - DNA, 2574 bp, Sorghum bicolor
  misc_feature: Ceres ANNOT ID no. 8655493
  misc_feature: Encodes the peptide sequence at SEQ ID NO 16165
atggaagagggaggagacccgcagccgcagcttccgagcatctccgtggcacgcaccacgtccgaaggcgcgggggccgccgtcgacttggatctccttgagcagctactgtccggcgacaacggctggctcgaggtggtctcgcgctcgcccaattcggtagcgttttctccaccctcggccttcttctcggctgacgcgacagccaccacagtgacgacgaccacggcggcgccgaccgcgaacgccagctggtggattcagacgggcggcgcaagcccctcctccgtgcgggagcggttcagccaggccctgtcctacatccgggacacgcagagcgacggcgacgtcctcgtgcagctctgggtgccggtcaaccgcgacgacgggaagctggtgctcaccaccagcggtcagccgttcacgctcgaccaccgctccgacagcctcatccggttcagggatgtgtccaccaagtaccagttctcggccgacgtcaattcaggggacacgccagggctgccagggagggtcttcatcggcaggctccccgagtggtcgccggacatcaggtacttcaccagctacgagtatcccagggtaagggatgcacagtacctcgatgtccacggcaccatggggctgccagtgttcgagaaaggaagctacaattgcctgggcgtcatcgagctgatcatgacaaggcagaagctcaacttcacctctgagctcaacaccatctgcagtgctctccaggcagttaatctcagaagtacagaagtttcgagcattccacgcataaagttcagcactgcttcctacaaagatgctttgccagagatactggaggtcctgagagcagcctgcctgacccacaagctgccattagctcagacatgggtcacatgcgctcaacaagggaaaagaggcagccgacattctgacgagaactacaggtactgcatttccaccattgacgaagcatgctttgtgaatgaagccgagatgcggggcttccatgaggcctgctcagagcaccacctgctgcgtggggagggggtggcagggaaggccttcacaacaaaccagccatgcttcttgccggacattggatcctcaaccaaattggaataccccttgtctcaccatgctaagatcttcaagttaaaaggtgcagtggcaatccgactgcggtgcacacgcactgggacagcagacttcgtgctggaattctttctgccaacagattgtgaagcactggaggagcagaagacagtgctggactccttgtcaagcaccatgcgtggtgtttgccagaccctacgtgtggtcacagatagagagatggaagacgaagcggtgctggaaatgaacgagttgaactcatttactcctcaggggaaggacaaagttgaggagttgtcctttggaggcaaatcagcagatcgtagaggagaggcctcttggacaagtctggcaggaacttcacagcaagaatccgagctagctgcattgcggatgcatggaatgttctcacctggggggcagggtccatctctatctggtgttcaggcaactgctgaaggcagcaaggcaaaaaggcgtacaaaggccgagaagaccgttagtttgcaggttcttcgacagtacttcgctggtagcctgaaagatgcagcaaggagccttggagtgtgccctacgaccctcaaaagaatatgcaggcagcatggtataacccgctggccatcgcgaaagatcaagaaggtagaccactctctaagaaagcttcaacagatcattgattcggttcatggagcagagacagctttccagctaaacaccctgtacaaggatctcacaaacacctcaatatcgtctgacaacaatttgtcaggaagtgtcatggttcctccaactaaccagagcaatctcactgacttcaacaagcaccaaccccacaagtcaagtagcaatgtgccatcaacttcacactcacactcttcttgcagccacagttctaagtcaagcccctcatgtagcggtggtgcaacaaaacatgcacaacagggtataattgatctgattaagtcaaaaaatcctgtgaaagacagctctattcagactctgcaaacagaaaacccttcattatatgagcatttctcagttcatgaggctccaattgatcttctacaggatgttactgaaaaggctaatggtggacatcattcttctccaagcccgtcatcccacaatcctaagcagaacacagacgcaaatatgagagtaaaggcaacatttggctcagaaaaggtgagattcagactgaatccagagtgcaattttcaagaactgaagcatgagatagcaaaacgtttgagtatagtagacacaaaccccttggttttaaagtacttggatgatgattcagaatgggtcttgatgacatgtgatgcagatctacaggagtgccttcatgtatacaaactagcagatatccaaacaatcaaaatttcagttcatttagctattagtccagctacaagggtcacaactggtcacactggtttgtcatga

SEQ ID NO: 16165 - protein, 857 aa, Sorghum bicolor
  misc_feature: The sequence is a functional homolog of SEQ ID NO 372 in the 10/666,642 US patent application
  misc_feature: The sequence is a functional homolog of SEQ ID NO 1498 in the 10/666,642 US patent application
  misc_feature: Ceres ANNOT ID no. 8655493
  misc_feature (538)..(589): Pfam ID: RWP-RK Pfam Description: RWP-RK domain
  misc_feature (759)..(842): Pfam ID: PB1 Pfam Description: PB1 domain
MEEGGDPQPQLPSISVARTTSEGAGAAVDLDLLEQLLSGDNGWLEVVSRSPNSVAFSPPSAFFSADATATTVTTTTAAPTANASWWIQTGGASPSSVRERFSQALSYIRDTQSDGDVLVQLWVPVNRDDGKLVLTTSGQPFTLDHRSDSLIRFRDVSTKYQFSADVNSGDTPGLPGRVFIGRLPEWSPDIRYFTSYEYPRVRDAQYLDVHGTMGLPVFEKGSYNCLGVIELIMTRQKLNFTSELNTICSALQAVNLRSTEVSSIPRIKFSTASYKDALPEILEVLRAACLTHKLPLAQTWVTCAQQGKRGSRHSDENYRYCISTIDEACFVNEAEMRGFHEACSEHHLLRGEGVAGKAFTTNQPCFLPDIGSSTKLEYPLSHHAKIFKLKGAVAIRLRCTRTGTADFVLEFFLPTDCEALEEQKTVLDSLSSTMRGVCQTLRVVTDREMEDEAVLEMNELNSFTPQGKDKVEELSFGGKSADRRGEASWTSLAGTSQQESELAALRMHGMFSPGGQGPSLSGVQATAEGSKAKRRTKAEKTVSLQVLRQYFAGSLKDAARSLGVCPTTLKRICRQHGITRWPSRKIKKVDHSLRKLQQIIDSVHGAETAFQLNTLYKDLTNTSISSDNNLSGSVMVPPTNQSNLTDFNKHQPHKSSSNVPSTSHSHSSCSHSSKSSPSCSGGATKHAQQGIIDLIKSKNPVKDSSIQTLQTENPSLYEHFSVHEAPIDLLQDVTEKANGGHHSSPSPSSHNPKQNTDANMRVKATFGSEKVRFRLNPECNFQELKHEIAKRLSIVDTNPLVLKYLDDDSEWVLMTCDADLQECLHVYKLADIQTIKISVHLAISPATRVTTGHTGLS

SEQ ID NO: 16166 - DNA, 1602 bp, Sorghum bicolor
  misc_feature: Ceres ANNOT ID no. 8655573
  misc_feature: Encodes the peptide sequence at SEQ ID NO 16167
atggcggccgcctcgtccgcgcccttctttgggctcgccgacacgcagatgcagccacaggccggttcctcctctctgcagcaaaactccactgccgctcccgatgtcgcggcgccgccgcccaagaagaagaggaaccagccaggcaacccaaatcctgacgcggaggtgatcgcgctgtcgccgcggacgctgctggcgacgaaccggttcgtgtgcgaggtgtgcaacaaggggttccagcgggagcagaacctgcagctgcaccggcggggccacaacctgccgtggaagctgaagcagaagaaccccaaggacgtgcggcggcgggtgtacctgtgcccggagccgacgtgcgtgcaccacgacccgtcccgggcgctgggcgacctcacggggatcaagaagcactactgccgcaagcacggcgagaagaagtggaagtgcgacaagtgcaacaagcgctacgccgtgcagtccgactggaaggcgcactccaagacctgcggcacccgcgagtaccgctgcgactgcggcaccctcttctccaggagggacagcttcatcacccaccgcgccttctgcgacgcgctggctcgtgagagcgcgcagatgccgcccctgggcgccggcctctacgccggccccggcagcatgagcctcgggctctccggcaccgtcgcccagatgcatggctttgcagaccaagccggccagtcctcttcagctgcagccgcgcagtttgaccacatcatgccatcgtcctcgggctccagctccatgttccgctctcaggcgtcggcctcctcgccatcctacttcctcggcggcggcgctcctcctgccgcccaggatttctccgaggacggctcccaaggcagccagggccctctgctgcacggcaaggcgcccttccatggcctaatgcaacttcccgagcagcaccaccagccggggccgggcagcagcaacgccgccgtcgccaacggtaacaacagcctcctgaaccttgggttcttctcagctggcaacaatggtggcacgtccggcagccaggacgcgcgccttgtcatccaagaccagttcaacgtcaccggcggcggcggtggaagcgcagagcatggcaacaacttgatggcgtccctcggaagccacctcggcggaggcttcccttccctgtacaacaactcatcgccatcggccgggctggcccagaactcggccacggcgctcctgatgaaggcggctcagatgggctcgacgtcgagcaccgcccacaacaacggcactactagcacgctgttccgtgctgtaagcttcagcgccgccgccgccgccgccgcaagtggacaggggacaagcagggccgcaggagaagggacgacgacgtctcacgaggcacacttccatgagctcatcatgaactctctggctggcggcggcggcgccgccggcaccggcggcttctccggcgctactgcagggttcgggggcgtggacgacggcaagctgagcacaagagacttcctcggcgtcggcaggggcgccatggcgccgcccgggctccacatcggcgccctggacccggctcagatgaagtga

SEQ ID NO: 16167 - protein, 533 aa, Sorghum bicolor
  misc_feature: Useful for making plants with altered lignin content
  misc_feature: Functional homolog of the protein sequence given in SEQ ID NO 13275
  misc_feature: The sequence is a functional homolog of SEQ ID NO 1087 in the 10/666,642 US patent application
  misc_feature: Ceres ANNOT ID no. 8655573
  misc_feature (71)..(93): Pfam ID: zf-C2H2 Pfam Description: Zinc finger, C2H2 type
MAAASSAPFFGLADTQMQPQAGSSSLQQNSTAAPDVAAPPPKKKRNQPGNPNPDAEVIALSPRTLLATNRFVCEVCNKGFQREQNLQLHRRGHNLPWKLKQKNPKDVRRRVYLCPEPTCVHHDPSRALGDLTGIKKHYCRKHGEKKWKCDKCNKRYAVQSDWKAHSKTCGTREYRCDCGTLFSRRDSFITHRAFCDALARESAQMPPLGAGLYAGPGSMSLGLSGTVAQMHGFADQAGQSSSAAAAQFDHIMPSSSGSSSMFRSQASASSPSYFLGGGAPPAAQDFSEDGSQGSQGPLLHGKAPFHGLMQLPEQHHQPGPGSSNAAVANGNNSLLNLGFFSAGNNGGTSGSQDARLVIQDQFNVTGGGGGSAEHGNNLMASLGSHLGGGFPSLYNNSSPSAGLAQNSATALLMKAAQMGSTSSTAHNNGTTSTLFRAVSFSAAAAAAASGQGTSRAAGEGTTTSHEAHFHELIMNSLAGGGGAAGTGGFSGATAGFGGVDDGKLSTRDFLGVGRGAMAPPGLHIGALDPAQMK

SEQ ID NO: 16168 - DNA, 432 bp, Sorghum bicolor
  misc_feature: Ceres ANNOT ID no. 8655568
  misc_feature: Encodes the peptide sequence at SEQ ID NO 16169
atgcagatcttcgtgaagacgctgacggggaagacgatcacgctggaggtggagagcagcgacaccatcgacaacgtgaaggcgaagatccaggacaaggaaggcatcccgccggaccagcagcggctcatcttcgccgggaagcagctggacgacggccgcaccctggccgactacaacatccagaaggagtcgacgctgcacctggtgctgcgcctccgcggcggcagcaggggcggctaccccacgaccatctcgcccagcctccgcgagctcgcgcagaagtacaacgagaacaagatggtctgccgcaagtgctatgcacggcttccgcccagggcaaccaactgccgcaagaagaagtgtggccacaccaacgcgctgaggtcaaagaagaggttcatgtctaagattggtggaacaaataaatga

SEQ ID NO: 16169 - protein, 143 aa, Sorghum bicolor
  misc_feature: Useful for making plants with modulated cold sensitivity
  misc_feature: Useful for making plants with modulated flowering time
  misc_feature: Functional homolog of the protein sequence given in SEQ ID NO 14303
  misc_feature: Useful for making plants with modulated nitrogen use efficiency
  misc_feature: Functional homolog of the protein sequence given in SEQ ID NO 14348
  misc_feature: Ceres ANNOT ID no. 8655568
  misc_feature (6)..(74): Pfam ID: ubiquitin Pfam Description: Ubiquitin family
  misc_feature (84)..(135): Pfam ID: Ribosomal_L40e Pfam Description: Ribosomal L40e family
MQIFVKTLTGKTITLEVESSDTIDNVKAKIQDKEGIPPDQQRLIFAGKQLDDGRTLADYNIQKESTLHLVLRLRGGSRGGYPTTISPSLRELAQKYNENKMVCRKCYARLPPRATNCRKKKCGHTNALRSKKRFMSKIGGTNK

SEQ ID NO: 16170 - DNA, 1023 bp, Sorghum bicolor
  misc_feature: Ceres ANNOT ID no. 8655548
  misc_feature: Encodes the peptide sequence at SEQ ID NO 16171
atggccgccacaggtaaaggcatcgatccgcagcagtgcccaaagaggaacggcgcaagcaaggtgtctttggcctcgctcacacccggccggccccgtgggcgatcgcgcgagctcgctgatcgccggccggcggtgcactcctcgctcggcgcgcgcgccacgcccacgccagctcgctcggccggcgcccggcgcggcatcagtacttcactcatcatctcatcaccgccgcgccggagggagagatatagagagatacacacacatatacacatcgtcaccatggcgcccgtggggctcccgccgggcttccggttccacccgacggacgaggagctggtgaactactacctgaagcgcaagatccacgggctgaagatcgagctggacatcatccccgaggtcgacctctacaagtgcgagccatgggagctcgcagacaagtcgttcctgccgagccgtgacccggagtggtacttcttcgggccgcgggaccgcaagtaccccaacgggttccgcaccaaccgcgcgacgcgggccggctactggaagtccacgggcaaggaccgccgcgtgctgcaccacgccggccgccccatcggcatgaagaagacgctcgtctactaccgcggccgcgcgccgcagggggtccgcaccgactgggtcatgcacgagtaccgactcgacgacaaggacgccgaggacacgctgcccatccaggacacctacgcactatgccgggtcttcaagaagaacgccatctgcaccgaggtggacggcctgcaagcgcagtgcagcatggcgctgctggagggcgcctgccagcagctgctcaccagcgccagccaggagtaccagaccccgtcgccggacgtgcccgtcgggtccacatccggtggagctgacgatgacgcggacaaggatgagtcctggatgcagttcatttccgacgacgcatggtgctccagcacggcggacggtgccgaggagagcacctcctgtgtggccctggccagctga

SEQ ID NO: 16171 - protein, 340 aa, Sorghum bicolor
  misc_feature: The sequence is a functional homolog of SEQ ID NO 2478 in the 10/374,780 US patent application
  misc_feature: The sequence is a functional homolog of SEQ ID NO 572 in the 10/225,066 US patent application
  misc_feature: The sequence is a functional homolog of SEQ ID NO 344 in the 10/666,642 US patent application
  misc_feature: The sequence is a functional homolog of SEQ ID NO 1365 in the 11/479,226 US patent application
  misc_feature: The sequence is a functional homolog of SEQ ID NO 2474 in the 10/374,780 US patent application
  misc_feature: The sequence is a functional homolog of SEQ ID NO 744 in the 10/225,066 US patent application
  misc_feature: Useful for making plants with altered carbohydrate content
  misc_feature: Functional homolog of the protein sequence given in SEQ ID NO 13622
  misc_feature: The sequence is a functional homolog of SEQ ID NO 2346 in the 10/374,780 US patent application
  misc_feature: The sequence is a functional homolog of SEQ ID NO 238 in the 10/225,068 US patent application
  misc_feature: The sequence is a functional homolog of SEQ ID NO 338 in the 10/412,699 US patent application
  misc_feature: The sequence is a functional homolog of SEQ ID NO 774 in the 11/479,226 US patent application
  misc_feature: Useful for biocontainment applications
  misc_feature: Functional homolog of the protein sequence given in SEQ ID NO 13623
  misc_feature: Useful for making plants with altered terpenoid content
  misc_feature: Functional homolog of the protein sequence given in SEQ ID NO 13966
  misc_feature: Useful for making plants with altered cell wall content and/or composition
  misc_feature: Useful for making plants with altered lignin content
  misc_feature: Functional homolog of the protein sequence given in SEQ ID NO 13620
  misc_feature: The sequence is a functional homolog of SEQ ID NO 853 in the 10/374,780 US patent application
  misc_feature: The sequence is a functional homolog of SEQ ID NO 891 in the 10/374,780 US patent application
  misc_feature: The sequence is a functional homolog of SEQ ID NO 2012 in the 10/374,780 US patent application
  misc_feature: The sequence is a functional homolog of SEQ ID NO 312 in the 10/412,699 US patent application
  misc_feature: The sequence is a functional homolog of SEQ ID NO 731 in the 11/479,226 US patent application
  misc_feature: Useful for making plants with modulated nitrogen use efficiency
  misc_feature: Functional homolog of the protein sequence given in SEQ ID NO 13624
  misc_feature: The sequence is a functional homolog of SEQ ID NO 100 in the 10/374,780 US patent application
  misc_feature: The sequence is a functional homolog of SEQ ID NO 318 in the 10/412,699 US patent application
  misc_feature: The sequence is a functional homolog of SEQ ID NO 749 in the 11/479,226 US patent application
  misc_feature: The sequence is a functional homolog of SEQ ID NO 884 in the 10/225,066 US patent application
  misc_feature: The sequence is a functional homolog of SEQ ID NO 26 in the 10/286,264 US patent application
  misc_feature: The sequence is a functional homolog of SEQ ID NO 336 in the 10/412,699 US patent application
  misc_feature: The sequence is a functional homolog of SEQ ID NO 770 in the 11/479,226 US patent application
  misc_feature: The sequence is a functional homolog of SEQ ID NO 1197 in the 10/412,699 US patent application
  misc_feature: The sequence is a functional homolog of SEQ ID NO 866 in the 10/374,780 US patent application
  misc_feature: Ceres ANNOT ID no. 8655548
  misc_feature (101)..(230): Pfam ID: NAM Pfam Description: No apical meristem (NAM) protein
MAATGKGIDPQQCPKRNGASKVSLASLTPGRPRGRSRELADRRPAVHSSLGARATPTPARSAGARRGISTSLIISSPPRRRERYREIHTHIHIVTMAPVGLPPGFRFHPTDEELVNYYLKRKIHGLKIELDIIPEVDLYKCEPWELADKSFLPSRDPEWYFFGPRDRKYPNGFRTNRATRAGYWKSTGKDRRVLHHAGRPIGMKKTLVYYRGRAPQGVRTDWVMHEYRLDDKDAEDTLPIQDTYALCRVFKKNAICTEVDGLQAQCSMALLEGACQQLLTSASQEYQTPSPDVPVGSTSGGADDDADKDESWMQFISDDAWCSSTADGAEESTSCVALAS

SEQ ID NO: 16172 - DNA, 1221 bp, Sorghum bicolor
  misc_feature: Ceres ANNOT ID no. 8655625
  misc_feature: Encodes the peptide sequence at SEQ ID NO 16173
atggagtatgagtatacatggtatgcggagaccacctggattccatcgatcggtcccgtcctgcaaagccgaaaacttgaagatgccaccgccgtcgttgattggatctgctcgaggcccacacctcttcgggagaacgaagtcgatgccatcggagtggccgccgccgccgccatgggaagccaccgctatcacacgagatccaacttggggaggccgtcacatccaccaccatgcctggggaaggatgtcaccgcagtggccgtgtgggctagaacaaggactgaccatccatttacacagcagcagcttccagcatgccattttatacttaaacctccgactgcgattgctgcaattgcgttggtgggcataatttttattccgataggtcttgcctgcatggcagcctcaaacaaggttgttgaagtggtggatcagtatgaaaccgcatgcataccggaaaagatgcgcgacaacaaagttgcttatatccagaatccttcgacagacaagtcctgcccaagattgctgaaggttcatgcgcatatgaaggcgccaatttacgtatactacaaactcgacaaattcgaccagaaccataggaggtatgcaaggagccgcagcatcagccagcttgggtccccgaagatggccaaggacacgaagacctgcagccctgaagccaccgcgaagggaggaggccccatcgtcccctgcggtctcgtcgcgtggagcctgttcaacgacacctacggcttcgcccgtcgcaacgagacgctggcggtgaacaggcagggcatctcgtggaggagtgacagaggccacctgttcggcgaccgtgtctacccaagaaacttccaggccggcgctctggtcggcggcgggacgcttgatccgaacaaatccctgagtgagcaggaggatctgatggtgtggatgcgaacggcggcgctgccggcgttccggaagctgtacgggaggatcgaggtggacctgcacgccggcgacgaggtagcggtgacggtgcagaacaactacaacacgtacagcttcggcgggaagaaggcgctggtgctgtccaccgccggcgtgctgggcggcaagagcagcttcctcggccgcgcgtacctggccggcggcatagcatgcctcgccctggcgctgcttctcacgctgctctttctcctcccggtgccagcgcacgcgtcgtcgtcgtag

SEQ ID NO: 16173 - protein, 406 aa, Sorghum bicolor
  misc_feature: Useful for making plants with modulated nitrogen use efficiency
  misc_feature: Functional homolog of the protein sequence given in SEQ ID NO 13263
  misc_feature: Ceres ANNOT ID no. 8655625
  misc_feature (134)..(406): Pfam ID: CDC50 Pfam Description: LEM3 (ligand-effect modulator 3) family / CDC50 family
MEYEYTWYAETTWIPSIGPVLQSRKLEDATAVVDWICSRPTPLRENEVDAIGVAAAAAMGSHRYHTRSNLGRPSHPPPCLGKDVTAVAVWARTRTDHPFTQQQLPACHFILKPPTAIAAIALVGIIFIPIGLACMAASNKVVEVVDQYETACIPEKMRDNKVAYIQNPSTDKSCPRLLKVHAHMKAPIYVYYKLDKFDQNHRRYARSRSISQLGSPKMAKDTKTCSPEATAKGGGPIVPCGLVAWSLFNDTYGFARRNETLAVNRQGISWRSDRGHLFGDRVYPRNFQAGALVGGGTLDPNKSLSEQEDLMVWMRTAALPAFRKLYGRIEVDLHAGDEVAVTVQNNYNTYSFGGKKALVLSTAGVLGGKSSFLGRAYLAGGIACLALALLLTLLFLLPVPAHASSS

SEQ ID NO: 16174 - DNA, 351 bp, Sorghum bicolor
  misc_feature: Ceres ANNOT ID no. 8655676
  misc_feature: Encodes the peptide sequence at SEQ ID NO 16175
atgggctcactgaagctgacggagatcgtctccaagaagtggggcgtcggcggcggcagcaaggtcgcctccccgagcgcggcggcgtgcccgcgaggccacttcgcggcctacaccagggagggccgccggttcttcatccccatcgcctacctcgccagcgacaccttccaggagctgctcagcatggccgaggaggagttcggcgagcccggcgaccgccccatcgtgctgccctgctccgccgaccgcctcgagcagatcctcgacgccttccgcagcggcggcggccccaagaagaagagcgccggcgccggcgccggcagcggcaggatcagcaagatctggtag

SEQ ID NO: 16175 - protein, 116 aa, Sorghum bicolor
  misc_feature: Useful for making plants with modulated cold sensitivity
  misc_feature: Functional homolog of the protein sequence given in SEQ ID NO 13492
  misc_feature: Ceres ANNOT ID no. 8655676
  misc_feature (1)..(93): Pfam ID: Auxin_inducible Pfam Description: Auxin responsive protein
MGSLKLTEIVSKKWGVGGGSKVASPSAAACPRGHFAAYTREGRRFFIPIAYLASDTFQELLSMAEEEFGEPGDRPIVLPCSADRLEQILDAFRSGGGPKKKSAGAGAGSGRISKIW

SEQ ID NO: 16176 - DNA, 1011 bp, Sorghum bicolor
  misc_feature: Ceres ANNOT ID no. 8655675
  misc_feature: Encodes the peptide sequence at SEQ ID NO 16177
atggacgtcctcctctgctgctgcttgctgctgctcctggcctccgccgcgtccgccggcagcgagcgctgcgtgcggcaggggaaggcggcctactcaccctcttcgctctccccggtccctcacggtagcagcggggcgtgcgggtacggcgccatggccgccgagatcaatgggggattcctcgccgccggcgggcccaggcagcaccgcggtggcctcggctgcggccgctgcttccaggtactgcatccagctgtttccttcccaaatcgctctccgattcccctgcttcgtctgtcctttgcttgcttcggttggcaagaagccactttcttgactgcacccgcaagaatcttcggtactatacctcggattgcgatgtgcggttgcgagttttgtcctcaaacaatctcccgggatggtacgatgagatgccgagacgcaaagctgtgcagcgccggcggagtgcgggtggtgctcaccgacttccacaggagcaaccgcaccgacttcctgctcgccgggcccgccttcgcggtccttgccaagcccgggatggcccagcagctcaacaggctagacgccctctccgtagagtacaaaaggattccgtgcgagtacaaggagaagaacctgtcgatccgggtggaagaagggagcgacaagaaccgaggcaacctggtggtgaagctgctgtaccagggcggccagaccgacatcctggcggtggacgtggcccccgtgggctcgtcggcggagtggcggttcatgacgcgggtgtacgggcccgtgtggagcacgccgcgggcgcccgcgggaccgctgcagttccgggcggtggtcacgggcggctacgacggcaagtgggtgtgggcagagcaggaggtgctcccggcggactggcgccccggacaggtctacgacaccggcgtccgcatcgccgacgtcgccagggacggctgccggggatgcgccgccgccgacgccgcgatggacgactggaagtga

SEQ ID NO: 16177 - protein, 336 aa, Sorghum bicolor
  misc_feature: Useful for making plants with altered carbohydrate content
  misc_feature: Functional homolog of the protein sequence given in SEQ ID NO 14167
  misc_feature: Ceres ANNOT ID no. 8655675
  misc_feature (62)..(201): Pfam ID: DPBB_1 Pfam Description: Rare lipoprotein A (RlpA)-like double-psi beta-barrel
  misc_feature (213)..(299): Pfam ID: Pollen_allerg_1 Pfam Description: Pollen allergen
MDVLLCCCLLLLLASAASAGSERCVRQGKAAYSPSSLSPVPHGSSGACGYGAMAAEINGGFLAAGGPRQHRGGLGCGRCFQVLHPAVSFPNRSPIPLLRLSFACFGWQEATFLTAPARIFGTIPRIAMCGCEFCPQTISRDGTMRCRDAKLCSAGGVRVVLTDFHRSNRTDFLLAGPAFAVLAKPGMAQQLNRLDALSVEYKRIPCEYKEKNLSIRVEEGSDKNRGNLVVKLLYQGGQTDILAVDVAPVGSSAEWRFMTRVYGPVWSTPRAPAGPLQFRAVVTGGYDGKWVWAEQEVLPADWRPGQVYDTGVRIADVARDGCRGCAAADAAMDDWK

SEQ ID NO: 16178 - DNA, 993 bp, Sorghum bicolor
  misc_feature: Ceres ANNOT ID no. 8655743
  misc_feature: Encodes the peptide sequence at SEQ ID NO 16179
atgggttcctatgctaatggcagcacccgtgcagatgatgatcctccatcagtggagaagctgaaagaaccggctattcctcttaaaacaatgccactgcatgcaaatgcctggttgaatgacatgaagatatcctcgcctactgctatccgagtgaacattggtaacaatgttgcttttgatcccatctaccgagcttggactaagaagtatccttcagctctgaacgcatttgaaaaaattgttgcctacggcaaaggcaagaagatagcgctgttcttggattatgatggaaccctctcgccaattgttgatgaacctgaccatgctgtcatgtctgatcagatgcgggaggtggtgaggagtgctgcactgcatcttcccactgcgattatcagtggaaggtcttgtgataagtgggaaaaactggttctatcactgaccatagaagcaacactaactccaaacaaggagatgaagatctttcaggctgctagcgaattcttaccaatgattgacgaggtctttagattgctcgttgacaaggtcaggggaattgatggtgcgaaagttgaaaacaacaaattctgcgtgtcggtgcactaccgcaatgtcaatgagaaggactggccactcgttgcacggtgcacagacgacgtcctgaaagcctaccctcgcctccgactgtgccatggacgaaaggttttagaagttcgtccagtgatagactggaacaaggggaaggctgtggagttcttgctggactccctagggctagctgactctgacaaggtgctccctatctacatcggagatgaccgaacagatgaggacgcgttcaaggttttacgggaagataaacggggctttggaatcttggtgtcatctgtaccaaaggaatctcatgccttgtactccctggtggatccacctgaggtgatggacttcctgaagagactagtgaaatggaaggaggaagaagaagaaacataa

SEQ ID NO: 16179 - protein, 330 aa, Sorghum bicolor
  misc_feature: Useful for making plants with modulated drought sensitivity
  misc_feature: Useful for making plants with modulated flowering time
  misc_feature: Useful for making plants with modulated water use efficiency
  misc_feature: Functional homolog of the protein sequence given in SEQ ID NO 13348
  misc_feature: The sequence is a functional homolog of SEQ ID NO 16 in US patent 7214858
  misc_feature: Useful for making plants with modulated low light sensitivity
  misc_feature: Functional homolog of the protein sequence given in SEQ ID NO 13725
  misc_feature: Ceres ANNOT ID no. 8655743
  misc_feature (91)..(329): SWISSPROT Homolog: EC 3.1.3.12 Trehalose-phosphatase
  misc_feature (93)..(311): Pfam ID: Trehalose_PPase Pfam Description: Trehalose-phosphatase
MGSYANGSTRADDDPPSVEKLKEPAIPLKTMPLHANAWLNDMKISSPTAIRVNIGNNVAFDPIYRAWTKKYPSALNAFEKIVAYGKGKKIALFLDYDGTLSPIVDEPDHAVMSDQMREVVRSAALHLPTAIISGRSCDKWEKLVLSLTIEATLTPNKEMKIFQAASEFLPMIDEVFRLLVDKVRGIDGAKVENNKFCVSVHYRNVNEKDWPLVARCTDDVLKAYPRLRLCHGRKVLEVRPVIDWNKGKAVEFLLDSLGLADSDKVLPIYIGDDRTDEDAFKVLREDKRGFGILVSSVPKESHALYSLVDPPEVMDFLKRLVKWKEEEEET

SEQ ID NO: 16180 - DNA, 1488 bp, Sorghum bicolor
  misc_feature: Ceres ANNOT ID no. 8655761
  misc_feature: Encodes the peptide sequence at SEQ ID NO 16181
atggcgaaggcggaagcggcggcggcggcgcacgtgctggtgttcccggccccggcacagggccacctcaacagcttcctccacttgtccacggggctcctccgcgcgggcctccacgtcactttcctccacaccgaccacaacctccgccgcctcggcgccgctgtcgccgaggccacggccgcctcgccgcgcctccgcttcctgtccgtgcccgacggcctccccgacgacgacccgcgcgccgtcgacggcctcccgcgactcgtggaggccctgtgtaccaaggccagcgcgtcgtaccgcgccctgatgctcgcctccctgtcgccgcgcgcggacgggggcggaggcgccgccgacggcttcccgcccgtgacgtgcgtcgtcggcgacggcatactgccgttcgtggtcgacgtcgcggaggagctcggcgtcccggcgatctcctaccgcacggtgagcgcgtgcgccgtgctggcgtacctgtccgtgcccaggctcctcgacctcggcgagctcccattccccgaaggtggcgacgacgtcctcgacgagcccgtccgcggcgtcccggggatggagagcttcctgcgacggcgagacctcccgatccagttccgccaactcaccagcacgcacgaggagccgctgatcaaggcggtggtggaggccaccctgcacagccgcaaggccagagctctcatggtcaacacgaccacgtccctggagcggcggtccctcgaccacctcgccaaggagatgcgcggcgtgttcgccgtcgggcctctgcacgccatgtcccccgcgccggcggcggccacgagcctgtggcgccacgacgacgggtgcatggcgtggctcgacagccaggcggaggcggcggcgcggtccgtggtgtacatcagcctggggagcctcgccgtcatctcccacgagcagttcaccgagttcctgcacgggctcgtcgcctccggctacccgttcctgtgggtgctccggccggacatgctcggggcaagccaggacgccgcgctccaggaagccgtcgccgcggtcgggagtggcagggcgcgcgtcgtgccgtgggcgccgcagcgagacgtgctgcggcaccgcgccgtggggtgcttcctgacgcacagcgggtggaactcgacgctggagggcatcgtggagggcgtgcccatggtgtgctggcccttcttcgcggaccagcagatcaacagccgcttcgtgggcgccgtgtggaggaacgggctggacatgaaggacgtgtgcgacagaggcgtggtggagaggacggtgagggaagccatggagtccgccgagatcaggaggtcggcgcatgcgctggcggagcaggtgaagcgagacgtggccgacggcggggcatcggcgttggagttcgagcgcctggtcagcttcgtcagggagctcagcacgtcagcagcacagacccccatctccaatgtcttgaaatga

SEQ ID NO: 16181 - protein, 495 aa, Sorghum bicolor
  misc_feature: Useful for making plants with altered carbohydrate content
  misc_feature: Functional homolog of the protein sequence given in SEQ ID NO 14349
  misc_feature: Ceres ANNOT ID no. 8655761
  misc_feature (126)..(478): SWISSPROT Homolog: EC 2.4.1.115 Anthocyanidin 3-O-glucosyltransferase
  misc_feature (10)..(482): Pfam ID: UDPGT Pfam Description: UDP-glucoronosyl and UDP-glucosyl transferase
MAKAEAAAAAHVLVFPAPAQGHLNSFLHLSTGLLRAGLHVTFLHTDHNLRRLGAAVAEATAASPRLRFLSVPDGLPDDDPRAVDGLPRLVEALCTKASASYRALMLASLSPRADGGGGAADGFPPVTCVVGDGILPFVVDVAEELGVPAISYRTVSACAVLAYLSVPRLLDLGELPFPEGGDDVLDEPVRGVPGMESFLRRRDLPIQFRQLTSTHEEPLIKAVVEATLHSRKARALMVNTTTSLERRSLDHLAKEMRGVFAVGPLHAMSPAPAAATSLWRHDDGCMAWLDSQAEAAARSVVYISLGSLAVISHEQFTEFLHGLVASGYPFLWVLRPDMLGASQDAALQEAVAAVGSGRARVVPWAPQRDVLRHRAVGCFLTHSGWNSTLEGIVEGVPMVCWPFFADQQINSRFVGAVWRNGLDMKDVCDRGVVERTVREAMESAEIRRSAHALAEQVKRDVADGGASALEFERLVSFVRELSTSAAQTPISNVLK

SEQ ID NO: 16182 - DNA, 567 bp, Sorghum bicolor
  misc_feature: Ceres ANNOT ID no. 8655773
  misc_feature: Encodes the peptide sequence at SEQ ID NO 16183
atggttgtttccacctccggcgccgcgtgctcgaggccgtcgtcgtccccctggttctcgcactggctctgcggcttcacggcggactccgtcgtcgtgccgcgcccagatcgccagcagccgtctgcggcggcggcgtcctcctcctcggcagccgggctagcctccgccgcgtctcagctgaggcagttgccgttgctctgcggcgcactcctgtctcctcctcctgtcagtagccgctgccgccgaccctacaagtggtgtggacacgccgccgcgggcatgttcgcctggatcctccggggctgccgcgacgagagctccgcctccgaccagctcaagcaggctcgtgatgtgttcaaggccaaagaggcggtgttgcaaaagaagatctctcaagagatggaacgggccaaggagttcacaaagtcgggaaacaaacaggcggcaatgcaatgcttgaagaggaaaaagtactatgagagtcaaatgaaccaggttggaagcgttcagctacgcattaataccaaggagagaatgatcgctgatcacatgggcaacaagtaa

SEQ ID NO: 16183 - protein, 188 aa, Sorghum bicolor
  misc_feature: Useful for making plants with modulated nitrogen use efficiency
  misc_feature: Functional homolog of the protein sequence given in SEQ ID NO 14350
  misc_feature: Ceres ANNOT ID no. 8655773
MVVSTSGAACSRPSSSPWFSHWLCGFTADSVVVPRPDRQQPSAAAASSSSAAGLASAASQLRQLPLLCGALLSPPPVSSRCRRPYKWCGHAAAGMFAWILRGCRDESSASDQLKQARDVFKAKEAVLQKKISQEMERAKEFTKSGNKQAAMQCLKRKKYYESQMNQVGSVQLRINTKERMIADHMGNK

SEQ ID NO: 16184 - DNA, 804 bp, Sorghum bicolor
  misc_feature: Ceres ANNOT ID no. 8655774
  misc_feature: Encodes the peptide sequence at SEQ ID NO 16185
atggcgatggacgcggagcggcggcaggcggagctgatcgcgcagttctccgctcaggcggcggcgctgtcgtccgcgccgcagctcgccgcgctggtgcttgaggccacctcccacccggccctcttcgccttctccgagctcctcaccctcccggccctctccaagctcgctggcacgcagtacgcgtcgtcactggacttgctccggctcttcgcctacggcaccttgaaggactacaagagtaattctggatcccttccagcattgttgcctgaccaggtccggaagctaaagcaactcagtgtgctaactctggcagagtcaactaagatactaccgtatgatcagctcatgcaagagttggacgtttccaacgtaagagaactcgaagatttcctaatcaatgagtgcatgtactcgggtatcgttagaggcaaactggatcagctgagaaggtgctttgaggtacaatttgcagctggaagagatcttacacctgatcagctaaacaacatgatagagaccttgtctgactggttgggaacatcagatagcctgttgcatcaaattcaggagaaaatcaagtgggctgatacaatgagtgaggtgaacaagaagcaccagaaagaatttgaagacagagtggaagaggccaaaaaatcaatcaagcaggcagacatcgacttacgggggcatgacgactttctctctgaatctggaggaataatggattttgaagaggaccgcgtccgaccaaaaaggtgcataggaatagctatgtacctagaaaagccggaatga

SEQ ID NO: 16185 - protein, 267 aa, Sorghum bicolor
  misc_feature: Useful for making plants with modulated low light sensitivity
  misc_feature: Functional homolog of the protein sequence given in SEQ ID NO 13380
  misc_feature: Useful for making plants with modulated light quality sensitivity
  misc_feature: Functional homolog of the protein sequence given in SEQ ID NO 13844
  misc_feature: Ceres ANNOT ID no. 8655774
  misc_feature (63)..(159): Pfam ID: PCI Pfam Description: PCI domain
MAMDAERRQAELIAQFSAQAAALSSAPQLAALVLEATSHPALFAFSELLTLPALSKLAGTQYASSLDLLRLFAYGTLKDYKSNSGSLPALLPDQVRKLKQLSVLTLAESTKILPYDQLMQELDVSNVRELEDFLINECMYSGIVRGKLDQLRRCFEVQFAAGRDLTPDQLNNMIETLSDWLGTSDSLLHQIQEKIKWADTMSEVNKKHQKEFEDRVEEAKKSIKQADIDLRGHDDFLSESGGIMDFEEDRVRPKRCIGIAMYLEKPE

SEQ ID NO: 16186 - DNA, 1464 bp, Sorghum bicolor
  misc_feature: Ceres ANNOT ID no. 8655760
  misc_feature: Encodes the peptide sequence at SEQ ID NO 16187
atggcgccggcgcacgtcctcgtgttcccgtggccgatgcagggccacatcaactgcatgctccacttcgccacgggcctcgccggcgccggcctccacgtctctttcctccacaccgaacacaacctccgcctgctcggcctggcctccgcggccgccgcgccgcgcctccgcttcctgtccgtcccagatggcctcccggacgaccacccacgctcagtcggtgaccttatcgagctcgccaggtccctgaagacggagggctccgtcgcataccgtgctctgcttaccacgttgctgccagtgccaccggcggagagcccgggcggcccttcctccgacgccggcgtcgatcccggcttcccgccggtgacatgcgtcgtcgccgacgggctgctgccttgggccatcgacaccgccgaggagctcggtgtgccggcgctcgccttccgcacggccagcgcctgcagcttcttggcctacctgtccgtgcccaagctcttcgaccttggcgaggtccccttccctgccggcggcagccttgacgagccggtgcgcggcgtcccgaggatggagagctacctacgccggcgtgatctcccacgccagtgccgccgcctgagcgagaccgtcgacgtcgatcccatgctgcacttgctcgccacaggcaccgcgcacaacgtcaacgcacgggcactgatactgaacacagccgcctccctggaaggctcggccgtcacgaacatcgcacggcgcacgcgggacgtattcgccatcgggcctttacacgcggcgtcgccggcggcgccggcggtggcctccagcctgtggcgcgaggacgacgggtgcacggcgtggctcgacggccacgccgacaggtccgtcgtgttcgtgagcttggggagcctcgcggtgatctcgcacgagcagttcacggagttcctgtgtggtctcgtcgccgcggggtaccctttcctctgggtgctccggccggacatggtcgacgcaggaggacaggacgccgcgctcctccgagaagccatccgcgccgtcggaggcaagagcgccgcgcgcgtcgtgccgtgggcgccgcagcgagacgtgcttcggcaccgcgccgtggggtgcttcctgacgcacgccgggtggaactcgacgctggagggcatcgtggagggcgtgcccatggtgtgctggccattcttcgccgaccagcagaccaacagccgcttcgtgggcgccgtgtgggggaacgggctggacatgaaggacgtgtgcgacagggccgtcgtgcagaggacgctgaaggaggcgatggagtccgatgtgatcaagggcgcggcgcaagcgttggcgcagcaggtgaggcgggatgtcgacggtgggggctcgtcggcggtggaacttcagcggctcgtcgcattcatagaggagctctcagcacagccgagccattaccgatga

SEQ ID NO: 16187 - protein, 487 aa, Sorghum bicolor
  misc_feature: Useful for making plants with altered carbohydrate content
  misc_feature: Functional homolog of the protein sequence given in SEQ ID NO 14349
  misc_feature: Ceres ANNOT ID no. 8655760
  misc_feature (125)..(476): SWISSPROT Homolog: EC 2.4.1.121 Indole-3-acetate beta-glucosyltransferase
  misc_feature (4)..(480): Pfam ID: UDPGT Pfam Description: UDP-glucoronosyl and UDP-glucosyl transferase
MAPAHVLVFPWPMQGHINCMLHFATGLAGAGLHVSFLHTEHNLRLLGLASAAAAPRLRFLSVPDGLPDDHPRSVGDLIELARSLKTEGSVAYRALLTTLLPVPPAESPGGPSSDAGVDPGFPPVTCVVADGLLPWAIDTAEELGVPALAFRTASACSFLAYLSVPKLFDLGEVPFPAGGSLDEPVRGVPRMESYLRRRDLPRQCRRLSETVDVDPMLHLLATGTAHNVNARALILNTAASLEGSAVTNIARRTRDVFAIGPLHAASPAAPAVASSLWREDDGCTAWLDGHADRSVVFVSLGSLAVISHEQFTEFLCGLVAAGYPFLWVLRPDMVDAGGQDAALLREAIRAVGGKSAARVVPWAPQRDVLRHRAVGCFLTHAGWNSTLEGIVEGVPMVCWPFFADQQTNSRFVGAVWGNGLDMKDVCDRAVVQRTLKEAMESDVIKGAAQALAQQVRRDVDGGGSSAVELQRLVAFIEELSAQPSHYR

SEQ ID NO: 16188 - DNA, 627 bp, Sorghum bicolor
  misc_feature: Ceres ANNOT ID no. 8655808
  misc_feature: Encodes the peptide sequence at SEQ ID NO 16189
atgcagatcttcgtgaagacgctgacggggaagaccatcacgctggaggtcgagagcagcgacaccgtcgagaacgtcaaggccaagatccaggacaaggaaggcatcccgccggaccagcagcggctcatcttcgccgggaagcagctggacgacggccgcacccttgccgactacaacatccagaaggagtccacgctgcacctgatcttcgtgaagacgctgacggggaagaccgtcacgctggaggtcgagagcagcgacactatcgccaacgtcaaggccaagatccaggacaaggaaggcatcccgccggaccagcagcggctcatcttcgccgggaagcagctggatgacgaccgcaccctggccgactacaacatccagaaggagtccacgctgcacctggtgctccgcctccgcggcggcggcaggggcggctaccccatcatgagcgtcccgtgggacctcatcaaccttgcccgcaagcacaatgagaccaagatgatctgccgccagtgctatgcgcgccttccccccaggtccaaaaactgccgcaagaagaagtgtggccgcagcaacgagctgaggtcaaagaagaagttcatctccaagtttaacatctga

SEQ ID NO: 16189 - protein, 208 aa, Sorghum bicolor
  misc_feature: Useful for making plants with modulated nitrogen use efficiency
  misc_feature: Functional homolog of the protein sequence given in SEQ ID NO 13585
  misc_feature: Useful for making plants with modulated cold sensitivity
  misc_feature: Useful for making plants with modulated flowering time
  misc_feature: Functional homolog of the protein sequence given in SEQ ID NO 14303
  misc_feature: Ceres ANNOT ID no. 8655808
  misc_feature (73)..(141): Pfam ID: ubiquitin Pfam Description: Ubiquitin family
  misc_feature (6)..(72): Pfam ID: ubiquitin Pfam Description: Ubiquitin family
  misc_feature (152)..(203): Pfam ID: Ribosomal_L40e Pfam Description: Ribosomal L40e family
MQIFVKTLTGKTITLEVESSDTVENVKAKIQDKEGIPPDQQRLIFAGKQLDDGRTLADYNIQKESTLHLIFVKTLTGKTVTLEVESSDTIANVKAKIQDKEGIPPDQQRLIFAGKQLDDDRTLADYNIQKESTLHLVLRLRGGGRGGYPIMSVPWDLINLARKHNETKMICRQCYARLPPRSKNCRKKKCGRSNELRSKKKFISKFNI

SEQ ID NO: 16190 - DNA, 1029 bp, Sorghum bicolor
  misc_feature: Ceres ANNOT ID no. 8655809
  misc_feature: Encodes the peptide sequence at SEQ ID NO 16191
atggggaggctgctccctcgccacccttcccccctcctcctcctcgccgccgccgctgccgcggcgatctgcatctccagcagcagcatcgctgccgtccggggcgcgccagtgtaccgcgcggactacctggtggacgggaaccagctggtggacatgcagtaccacatgggccccgtcgtgtccgggtcgccgaccaacctctacctcatctggtacgggcggtgggagcccacggcgcaggccgtgctccgggacttcctcgcctcgctctctgcgccggcgccgttcccggccgtctccgactggtgggcgcgcacgccgcggatgtacgcggaccagacgggcgccaacgtgacgggaaccttcgccgtcgccggggagcactccgacgcgggctactcccacggcgcgtcgctccggcgcatcgacgtgcagtccgtgatccggtcggcggtgtacgcgtacccggacccgctgccgctggacccctacagcggcgcgtacctggtgctgacgtccccggacgtgaaggtggacgagttctgccgcgccgtctgcggcttccactacttcaccttcgcgtccgtggtcggggtcacggtgccctacgcctgggtcgggaacagcggcacgcagtgcccgggcaagtgcgcgtacccgttcgccgccgccgccgagtacggcgggggcgggggagcccaggcggtgctgcggccccccaacggcgacgccggggtggacgggatggtgatcgtgctggggcacgagctggcggagatgtctacgaacccactggtgaacgcgtggtacgccggggacacgcccacggcgccgaccgagatcgcggacctgtgcctcggcgtctacggcgacggcggcggcccgggcggcctggtcgggaacgtgtcccgcgcgcccgatggcagcgcctacaacgtcaacggcgtcaacggccggcggttcctcgtgcagtggctctggaaccccgtccgcggcgcctgctacggccccaactccagcaactga

SEQ ID NO: 16191 - protein, 342 aa, Sorghum bicolor
  misc_feature: Useful for biocontainment applications
  misc_feature: Functional homolog of the protein sequence given in SEQ ID NO 14166
  misc_feature: Ceres ANNOT ID no. 8655809
  misc_feature (53)..(339): Pfam ID: Phi_1 Pfam Description: Phosphate-induced protein 1 conserved region
MGRLLPRHPSPLLLLAAAAAAAICISSSSIAAVRGAPVYRADYLVDGNQLVDMQYHMGPVVSGSPTNLYLIWYGRWEPTAQAVLRDFLASLSAPAPFPAVSDWWARTPRMYADQTGANVTGTFAVAGEHSDAGYSHGASLRRIDVQSVIRSAVYAYPDPLPLDPYSGAYLVLTSPDVKVDEFCRAVCGFHYFTFASVVGVTVPYAWVGNSGTQCPGKCAYPFAAAAEYGGGGGAQAVLRPPNGDAGVDGMVIVLGHELAEMSTNPLVNAWYAGDTPTAPTEIADLCLGVYGDGGGPGGLVGNVSRAPDGSAYNVNGVNGRRFLVQWLWNPVRGACYGPNSSN

SEQ ID NO: 16192 - DNA, 828 bp, Sorghum bicolor
  misc_feature: Ceres ANNOT ID no. 8655818
  misc_feature: Encodes the peptide sequence at SEQ ID NO 16193
atgtataagcaggggggagcggggggaggggctgggctggaccggaagcggatcagcgacgcgctagacaagcacctcgagaaggcggtcgcgtcgccgtccacgtcgagggggtcggcgggcggcggcggcgggcgcgaccaccaccgcctcgttgtgccgtcctccgtctcgaccatcctcaagggccactgctccgaaggggagtctgattctgatagtgaagcatcagatgttagcggctctgacggagaagacacctcatggatttcatggtactgcaaccttagggggaatgagttcttctgtgaagtcgacgatgattatattcaagacgacttcaacctttgtggcctcagcagccaagttccttattatgattatgctctcgatctcattttagatatcgagtcatctcatggtgatatgttcaccgaggaacagaatgagcttgtagaatcagctgcagagatgctttatgggctgatccatgcacgatacattcttaccagtaaaggactggctgcaatgctggagaagtataagaactatgactttgggcggtgcccacgtgtttactgctgcggtcaaccatgcctgccagttggacaatcagatatccatcgatctagtaccgtgaagatatactgccccaagtgtgaagacatctactacccacggtccaagtaccaaggcaacatcgacggcgcatactttgggacaacgttccctcatctgttcctgatgacatacgagcacctcaagccacagaagccctcgcagcgctatgttcctcgtgtctttggcttcaagctccacaagccatga

SEQ ID NO: 16193 - protein, 275 aa, Sorghum bicolor
  misc_feature: Useful for making plants with modulated flowering time
  misc_feature: Functional homolog of the protein sequence given in SEQ ID NO 13452
  misc_feature: Ceres ANNOT ID no. 8655818
  misc_feature (89)..(263): Pfam ID: CK_II_beta Pfam Description: Casein kinase II regulatory subunit
MYKQGGAGGGAGLDRKRISDALDKHLEKAVASPSTSRGSAGGGGGRDHHRLVVPSSVSTILKGHCSEGESDSDSEASDVSGSDGEDTSWISWYCNLRGNEFFCEVDDDYIQDDFNLCGLSSQVPYYDYALDLILDIESSHGDMFTEEQNELVESAAEMLYGLIHARYILTSKGLAAMLEKYKNYDFGRCPRVYCCGQPCLPVGQSDIHRSSTVKIYCPKCEDIYYPRSKYQGNIDGAYFGTTFPHLFLMTYEHLKPQKPSQRYVPRVFGFKLHKP

SEQ ID NO: 16194 - DNA, 1203 bp, Sorghum bicolor
  misc_feature: Ceres ANNOT ID no. 8655824
  misc_feature: Encodes the peptide sequence at SEQ ID NO 16195
atgggcagcgctcccgccaccatcggcgatatgaggcgtgcccagcgcgcggatggcccggctgccgtgctaggcatcggcacggcgaacccgccgacgtgcttggcccaggacgagtaccccgactactacttccgcgtcacaaagagcgagcacctcaccgacctcaagggcaagctcaccaggatctgtaacaagtccggcatcaagcagcgcttcatccacctggacgagcagctcctcgccgcgaacccggacttcaccgaccgcacgctgccctccctggacgcccgcgtggagatcgcctccgccgccgtcccggagctggccgcgtccgccgcggccaaggccatcgctgactggggccgcccagccaccgacatcacccacctcatcttcagcacctactccggcgcgcgcgcgccgagcgccgaccgccgcctcgcgtccctgctgggcctcagccccacggtgtcccgcaccatactcaacctccacggctgctacggcgggggcaggtcgctccagctcgccaaggagctcgcggagaacaaccgcggcgcgcgcgtcctcgtggcgtgctccgagatcacgctcatcgccttctacgggccggaaggcggctgccccgacaacatcctgggacaggctctgttcggcgacggcgccggtgccgtcatcgtcggcgccgaccctgtcagccccgtggagcgcccgctgttcgagatggccttcgcctcgcagaccaccataccggaaaccgaggatgccatctccatgcagatcaacaagggtggcatggagtatcacatctccaaccaggttccccggttgctgggatgcaacgtggaacgctgcctcgtcgacgcgtttggcgcgcttggcatcaacaataacgattggaacgacctcttctgggcgatccatcctggtggtcgtgctattctggaccacatcgagggagtgctcggcctagacgatggcaaattggccgccagtcgccacgtgctcagtgagttcggtaacatgagcggcacaacggtgatcttcgtgctcgacgagctgcgccgccgtcggggtctggcagtcaagcaggaggaaggcaaagcaccggagtggggagtcatgatggcgttcggaccgggaatcacaatagagaccatggtgctgcgtgcccctgccgccaatctggagggaaattag

SEQ ID NO: 16195 - protein, 400 aa, Sorghum bicolor
  misc_feature: The sequence is a functional homolog of SEQ ID NO 2 in US patent 7202397
  misc_feature: Ceres ANNOT ID no. 8655824
  misc_feature (4)..(398): SWISSPROT Homolog: EC 2.3.1.74 Naringenin-chalcone synthase
  misc_feature (6)..(232): Pfam ID: Chal_sti_synt_N Pfam Description: Chalcone and stilbene synthases, N-terminal domain
  misc_feature (242)..(394): Pfam ID: Chal_sti_synt_C Pfam Description: Chalcone and stilbene synthases, C-terminal domain
MGSAPATIGDMRRAQRADGPAAVLGIGTANPPTCLAQDEYPDYYFRVTKSEHLTDLKGKLTRICNKSGIKQRFIHLDEQLLAANPDFTDRTLPSLDARVEIASAAVPELAASAAAKAIADWGRPATDITHLIFSTYSGARAPSADRRLASLLGLSPTVSRTILNLHGCYGGGRSLQLAKELAENNRGARVLVACSEITLIAFYGPEGGCPDNILGQALFGDGAGAVIVGADPVSPVERPLFEMAFASQTTIPETEDAISMQINKGGMEYHISNQVPRLLGCNVERCLVDAFGALGINNNDWNDLFWAIHPGGRAILDHIEGVLGLDDGKLAASRHVLSEFGNMSGTTVIFVLDELRRRRGLAVKQEEGKAPEWGVMMAFGPGITIETMVLRAPAANLEGN

SEQ ID NO: 16196 - DNA, 1215 bp, Sorghum bicolor
  misc_feature: Ceres ANNOT ID no. 8655827
  misc_feature: Encodes the peptide sequence at SEQ ID NO 16197
atgggaagtagtgctgctccggccaacgtccgcgagatctgccgcgcacagcgtgccgacggccctgcagccgtgctcgccatcggcacggccaacccggcgaactgcgtgccccaggacgagttcccggacttctacttccgcgccaccaagagcgaccatctcactggcctcaaggaaaagttcaagagagtttgccagaagctgggcgtgcagaagcgctacctgcaccacaccgaggagctgctgagcgcgcacccggagttcctcgaccactcctcgccgtccctcgacgcgcggctggacatcgtcaagaccgccgtgccggagctcgccgcgcaggccagcaggaaggccatcgccgagtggggccgcccggccgccgacatcacgcacctcgtcgtcaccaccaactccggcgcgcacatcccgggcgtcgacttccgtctggtcccgctcctgggcctccgcccgaccgtgcgccgcaccatgctctacctcaacggctgcttcgcgggcgccgccgcgctgcgcctcgccagggacctggccgagaacaacagcggcgcgcgcgtgctcgtcgtctgcgccgagatcaccgtcctgctcttcaacgggcccgaggaggggtgcttccagacgctcgtcaaccagggcctgttcggcgacggcgctggggccgtcatcgtcggtgccgacccactggcggccgagcgcccgctgttcgagatcgtgtccgccgcgcaggccatcataccggagtccgaggacgtcatcaccatgcacctcaccaggggcggctacggcggcaacatctccaccaggcaggtccccgtcctcatcggcgacaacatcgagcgctgtctcaccgacgctttcgcgccgctcggcggcgttattggcgccgaatggaacgacctgttctgggacgtgcacccgggctcgtcggcgatcctggaccaggtcgacgccgtgctcaagctcaagcctgagaagctggcggcgagcaggcgtgtcctgagcgagtacgggaacatgttcggcgtcacggtgatcttcgtgctcgacgagctgcgccgccggatggagaagggggaagaggagggggcgccagagtggggggtcatggtggcgttcggacccgggctcaccgttgagacgatggtgctccaccgatcaggcaccccagctgagaagaaactggcggaggcatga

SEQ ID NO: 16197 - protein, 404 aa, Sorghum bicolor
  misc_feature: The sequence is a functional homolog of SEQ ID NO 2 in US patent 7202397
  misc_feature: Ceres ANNOT ID no. 8655827
  misc_feature (8)..(398): SWISSPROT Homolog: EC 2.3.1.74 Naringenin-chalcone synthase
  misc_feature (8)..(234): Pfam ID: Chal_sti_synt_N Pfam Description: Chalcone and stilbene synthases, N-terminal domain
  misc_feature (243)..(394): Pfam ID: Chal_sti_synt_C Pfam Description: Chalcone and stilbene synthases, C-terminal domain
MGSSAAPANVREICRAQRADGPAAVLAIGTANPANCVPQDEFPDFYFRATKSDHLTGLKEKFKRVCQKLGVQKRYLHHTEELLSAHPEFLDHSSPSLDARLDIVKTAVPELAAQASRKAIAEWGRPAADITHLVVTTNSGAHIPGVDFRLVPLLGLRPTVRRTMLYLNGCFAGAAALRLARDLAENNSGARVLVVCAEITVLLFNGPEEGCFQTLVNQGLFGDGAGAVIVGADPLAAERPLFEIVSAAQAIIPESEDVITMHLTRGGYGGNISTRQVPVLIGDNIERCLTDAFAPLGGVIGAEWNDLFWDVHPGSSAILDQVDAVLKLKPEKLAASRRVLSEYGNMFGVTVIFVLDELRRRMEKGEEEGAPEWGVMVAFGPGLTVETMVLHRSGTPAEKKLAEA

SEQ ID NO: 16198 - DNA, 1464 bp, Sorghum bicolor
  misc_feature: Ceres ANNOT ID no. 8655841
  misc_feature: Encodes the peptide sequence at SEQ ID NO 16199
atggcggcgcccgcgctggtgctcctgccggagtggggcaccggccacctcatgtccatgctcgagtcctgcaagcgcgtcctcctcagcggcggcggcggcaaggccttcaccatcaccctgctcgtcatgcgcccgcccaccgccgaggccacctccgaggtggaggctcacgtgcgccgcgaggccgcgtccgggctggacatccgcttccaccgcctccccgccgtggaggcgccctcggacgccgcgggggtcgaggagttcatcgcgcggtacatcgccctccacgcgccgcacgtcagggacgccgtggccgccatgtcgtgccccgtcgccgcgctcgtgctcgacatcttcgccgcgcccctggtcgacgtggcgcggggcctcggggtgccgtcctacgtcttcatgtcgtccacggccgccctgctcgcgctcatgctgcacctgcccgtgctccacgagtccgtccccgtggagttcgacgaggtggaaggggaggtgcaggtgcccggcctgccgccggtgccgccggagtccatgccgtgccccgtggtggacaagaagagccccaactacgcctggttcgtgcgcctcggcgatcgcttcatggacgccacggggatcatcgccaacaccgcggacgagctcgagccggggccgctagcggccgtcgccggggggcggtgcgtgcccggtcgccccgcgccgccggtgtacccgatcggccccgtgctgtcgctcggcgaccgctcgccgtctcacgaatgcgtcgcgtggctggatgcgcagccgccggggtcagtggtgttcctctgcttcgggagcctgggctggttcgatccgtcgcaggtggtggagatcacggccgcgctcgagcggtgcggacaccggttcctgtgggtcttgcggggcccaccttcggacgcgtccggctccggcgccggcgccccagacggggcggagcacccgacggacgcgaacctcgacgagctcctgccggaggggttcttggagaggaccaagggcaagggcctggtgtggccgacgtgggcgccgcagaaggacatcctggcgcaccccgccgtgggcggcttcgtgacgcacggcggatggaactcggtgctggagagcctgtggcacggcgtgccggtggtgccgtggccgctgtacgcggagcagcacctgaacgcgctggagctggtggccgatatgggcgtggccgtgccgctcaaggtggacaggaagcgggacaacttcgtggaggccgcggagctcgagcgcgcggtgcggtccctgatggacgccgacggcgagcaggggaggagggcgagggagaagaccgcggatatgaaggccgtgtgccggaaggccgtggaggagggcgggtcgtcgcacgcagcgctgcagaggctcgccgaggcgctccaccacggcgcggtgatcgccaagaagtga

SEQ ID NO: 16199 - protein, 487 aa, Sorghum bicolor
  misc_feature: Useful for making plants with altered carbohydrate content
  misc_feature: Functional homolog of the protein sequence given in SEQ ID NO 14351
  misc_feature: Ceres ANNOT ID no. 8655841
  misc_feature (15)..(474): SWISSPROT Homolog: EC 2.4.1.115 Anthocyanidin 3-O-glucosyltransferase
  misc_feature (5)..(482): Pfam ID: UDPGT Pfam Description: UDP-glucoronosyl and UDP-glucosyl transferase
MAAPALVLLPEWGTGHLMSMLESCKRVLLSGGGGKAFTITLLVMRPPTAEATSEVEAHVRREAASGLDIRFHRLPAVEAPSDAAGVEEFIARYIALHAPHVRDAVAAMSCPVAALVLDIFAAPLVDVARGLGVPSYVFMSSTAALLALMLHLPVLHESVPVEFDEVEGEVQVPGLPPVPPESMPCPVVDKKSPNYAWFVRLGDRFMDATGIIANTADELEPGPLAAVAGGRCVPGRPAPPVYPIGPVLSLGDRSPSHECVAWLDAQPPGSVVFLCFGSLGWFDPSQVVEITAALERCGHRFLWVLRGPPSDASGSGAGAPDGAEHPTDANLDELLPEGFLERTKGKGLVWPTWAPQKDILAHPAVGGFVTHGGWNSVLESLWHGVPVVPWPLYAEQHLNALELVADMGVAVPLKVDRKRDNFVEAAELERAVRSLMDADGEQGRRAREKTADMKAVCRKAVEEGGSSHAALQRLAEALHHGAVIAKK

SEQ ID NO: 16200 - DNA, 1428 bp, Sorghum bicolor
  misc_feature: Ceres ANNOT ID no. 8655844
  misc_feature: Encodes the peptide sequence at SEQ ID NO 16201
atggcagcccctaccgtggtcttactgccggtgtggggtgccggccacctcatgcccatgctcgaggccggcaagcgcctgctcacccacagcggccgcgcgctctcactcaccgttctcctcatgccagcgcccacggaggaggtcgcggccgagctcgacggccacgtacgcagggaggaggcctccggcctcgacatccgtttcgtccgcctccccgcagtggagccgccgatggactcccgcggcatcgaggagttcgtctccaggctggtccagctgcacgcgcctcacgtcagggcggcgatgtccagcctgtcgtccccggtggccgcgttcgtcatcgacttcttctgcacgacgctgctcgacgtgtcccgcgagctggccgtgcccgcgtacgtctacttcaccgccagcgccgggatgctcgcgctcttcctgcgcctcccgtcgctccacgaggaggtgacggtccagttcgaggagatggagggcgcggtggacgtgcctgggcttccgccggtgccgccgtcgtccctccccgacccattgatggacaagaatcaccccaactgcacgtggttcgcgtaccacggcaggcgcttcgtcgaggccgacggcatcatcgtcaacacggctgccgagatcgagcagagcgtgcttgctgccatcgccgacgggcggtgcacgcgcggtgcccgtgccccgacgctttatccaattggcccggtgatctcgttcatcccgcccactgagcgtcggccggacgagtgcgtgcagtggctcgacacgcagcccccggcctccgtggtgctcctctgcttcgggagcggagggttcttcactgcgccacaggcgcacgagatcgcgcacggcctggagcgcagcggccaccgcttcctctgggtgctgcgcggcccacctgcacccggcgagcggctaccgtcggacgcgaacgtcgccgagctgctccccgacggcttcctcgagaggaccaatggcagaggcttggtgtggccgacgaaggcgccacaaaaagagatactagcccacgccgccatgggtggtttcgtgacacacggcggctggaactcggtcctcgagagcctgtggtttggcgtgccgatggcaccgtggccgctgtacgccgagcagcacctgaacgcgttcacgctggtggcctacatgggcgtcgccgtggcgatgaaggtggacaggaagaggaacaatttcgtggatgccgcggagctggagcgagcggtgaaggagctgatgggcggtggcgaggaggggaggaaggcgagggagaaggccatggagatgaaggccgccttcaggaacgccgtggaggagggtggctcatcctacgctgcgctgtggaggctatcagaggagatcatgtgcaaagtcgacacgaaccactaa

SEQ ID NO: 16201 - protein, 475 aa, Sorghum bicolor
  misc_feature: Useful for making plants with altered carbohydrate content
  misc_feature: Functional homolog of the protein sequence given in SEQ ID NO 14351
  misc_feature: Ceres ANNOT ID no. 8655844
  misc_feature (15)..(468): SWISSPROT Homolog: EC 2.4.1.115 Anthocyanidin 3-O-glucosyltransferase
  misc_feature (5)..(472): Pfam ID: UDPGT Pfam Description: UDP-glucoronosyl and UDP-glucosyl transferase
MAAPTVVLLPVWGAGHLMPMLEAGKRLLTHSGRALSLTVLLMPAPTEEVAAELDGHVRREEASGLDIRFVRLPAVEPPMDSRGIEEFVSRLVQLHAPHVRAAMSSLSSPVAAFVIDFFCTTLLDVSRELAVPAYVYFTASAGMLALFLRLPSLHEEVTVQFEEMEGAVDVPGLPPVPPSSLPDPLMDKNHPNCTWFAYHGRRFVEADGIIVNTAAEIEQSVLAAIADGRCTRGARAPTLYPIGPVISFIPPTERRPDECVQWLDTQPPASVVLLCFGSGGFFTAPQAHEIAHGLERSGHRFLWVLRGPPAPGERLPSDANVAELLPDGFLERTNGRGLVWPTKAPQKEILAHAAMGGFVTHGGWNSVLESLWFGVPMAPWPLYAEQHLNAFTLVAYMGVAVAMKVDRKRNNFVDAAELERAVKELMGGGEEGRKAREKAMEMKAAFRNAVEEGGSSYAALWRLSEEIMCKVDTNH

SEQ ID NO: 16202 - DNA, 1476 bp, Sorghum bicolor
  misc_feature: Ceres ANNOT ID no. 8655840
  misc_feature: Encodes the peptide sequence at SEQ ID NO 16203
atggcgagcctcaacgtgctgctcctccctgagcccggctccggccacctcatgtcgctcatcgaagctgggaagcgcctgctcggccactgcgccggcgccggagacgacgagttcacggtgaccgtcctcgtcgtgcagccgccgacgccagagtcggcgtccgaggtgggcgcgcacgtgcggcgcgtcgcggcgtccggcattggcgtccggttccatcacctcccggccgtggaaccccccgcggactgcgcgggcgacctgcaggagttcaagtcgcgctacatggagctctacaagccacacgtggaggccgcggcgcgggagctcggcgccgcggcgctcgtggtcgacttcttcgccaccaccgtgctcgacgtggcgcgcgagctcgccgtgccgacgtacgtctacttcacctccaccgccgcgctgctcgcgctcatgctgaggctgccggccctcgacaagacggtcgccgtcgacttcgagacgtttaagggcacggtggacgtcccgggcttgcctcccgtgcccgcggggaacatccccgggttcctgggacgcaaggactgccccaacttcacgtggttcgtgtaccacggcagacgtttcatggacgccgacggcatcatcgtcaacacggtgacccagctcgagccggggcttctcgccgccatcgcggaaggacggtgcgtcccgggacgaccggcgccgccgctgtacccgatcggcccggtgctgaacctcggcgtggaaaatgccgcgtccgacgacgaggcgtgcgtccggtggctcgacgcgcagccgcgggcgtcggtggtgttcctctgcttcgggagccttggctggttcgacgccgccaaggcgcgggaggtcgccacggggctggagcggagcgggcaccggttcctgtgggcgctgcgcgggcctcccgcggcggccgggtcgcggcacccgtcggacgccgacctagacgagctcctccccgcggggttcctggagcggaccaaggacaggggcctcgtgtggcctcggtgggcgccgcagaaggcggtgctctcgcacggggccgtgggcggcttcgtgacccactgcgggtggaactcgacgatggagagcctgtggcacggcgtgccgctggcgccgtggccgctgtacgcggagcagcgcctgaacgcgttcgagctcgtgtccgtcatgggcgtggccgtggcgatggaggtggaggtggacaggagccgtgacaacttcgtcgaggccgaggagctggagcgcgcggtgagggccctcatgggcggcggcgaggaggggcggaaggcgcgggagaaggccgcggagatgaaggccgcgtgccgcagggccgtggaggagggcgggtcgtcgtacgtggcgctggagaggctgcgtgatgcgattcgcaaggctgcaaatgcgacaactgctcatttggtgaaggcgccgctcatttga

SEQ ID NO: 16203 - protein, 491 aa, Sorghum bicolor
  misc_feature: Useful for making plants with altered carbohydrate content
  misc_feature: Functional homolog of the protein sequence given in SEQ ID NO 14351
  misc_feature: Ceres ANNOT ID no. 8655840
  misc_feature (119)..(398): SWISSPROT Homolog: EC 2.4.1.218 Hydroquinone glucosyltransferase
  misc_feature (5)..(478): Pfam ID: UDPGT Pfam Description: UDP-glucoronosyl and UDP-glucosyl transferase
MASLNVLLLPEPGSGHLMSLIEAGKRLLGHCAGAGDDEFTVTVLVVQPPTPESASEVGAHVRRVAASGIGVRFHHLPAVEPPADCAGDLQEFKSRYMELYKPHVEAAARELGAAALVVDFFATTVLDVARELAVPTYVYFTSTAALLALMLRLPALDKTVAVDFETFKGTVDVPGLPPVPAGNIPGFLGRKDCPNFTWFVYHGRRFMDADGIIVNTVTQLEPGLLAAIAEGRCVPGRPAPPLYPIGPVLNLGVENAASDDEACVRWLDAQPRASVVFLCFGSLGWFDAAKAREVATGLERSGHRFLWALRGPPAAAGSRHPSDADLDELLPAGFLERTKDRGLVWPRWAPQKAVLSHGAVGGFVTHCGWNSTMESLWHGVPLAPWPLYAEQRLNAFELVSVMGVAVAMEVEVDRSRDNFVEAEELERAVRALMGGGEEGRKAREKAAEMKAACRRAVEEGGSSYVALERLRDAIRKAANATTAHLVKAPLI

SEQ ID NO: 16204 - DNA, 1449 bp, Sorghum bicolor
  misc_feature: Ceres ANNOT ID no. 8655851
  misc_feature: Encodes the peptide sequence at SEQ ID NO 16205
atggctgccgcaaccatggtcttccttccgtgctggggatccggtcacttcatgtccatgatcacggccggcaagcggatgctcgacgccagcggcggtgccctctctttgaccgtgctggtcatgcaggccccgacgccagccaaggcgtccgaggtcgaggaccacgtgcgccgtgagtcatcgtccggccatgacatccgcgtcatcaatctccccgccgtcgagccgccgacgaccgactgcgtggcccccgaggagttcaccttcaggtacatccagctccaggcttcccatgtcgaggaggccatagccgggctatcgtccccggtgaccgccatcgtcttcgatctcttctgtacgcccctgctcgacgtggccggcgacctcgccgtgccgcggtatgcgtacttcgcctccacgggcgcgttcctcgcgctcacgctgcgccttacgctggcgggaatccgcgaggacctcatcgtcaggctcaagcagacggaaggcacggtggacgtgccggggctgccgccggtgcctgtgtcctacatgccggcgtgcctgtcgggcagtaagatcggcaactgcgagtggttcgagtactgcgggcgccgcctcatggacaccagcggcatcatcatcaactcctcggtcgagctggagccgggggttctcaccgctatcgcggacggccgctgcgtgccgggccgcccggctccgaccgtctacgccatcggcccggtgatctggttcgccgccgcgcctgagcatcagcagccgcacgcgtgcgtccagtggctcgacacgcagccgtcgggctcagtcgtgttcctctgcttcggaagcaacggggtcctggacgcagcgcaggtcagggaagtcgccgctggcctggagcgcggcggtcaccgcttcctttgggtgctgcggggcgcgccggccggcggctcgcgccacccgacggacgccgacctggacacggcgctccccacggggttcctgacgaggacccgggggcgcgggctcgtgtggcctgcctgggcgccgcagaaggagatcctggcccacccggccgtcggcggcttcgtgacccactgcggttggaactccatcctggagagcctgtggttcggtgtgccgatgctgccgtggccgctctacggagagcagcacctgaacgcgttcgagctcgtgagggagatgggcgtcgccgtccacctcaagaatatggacgtcaccgaggcggacatggtcgtggaggcagccgaggtggaggcggcggtgcggggcctgatgggcgggacagaaggaggcaggaaggccaaggagaaggccgcggacatgaaggacgcgtgccggaacgccgtggtggagggcgggtcctcgtacgttgcgcttcgggagctcatgcgcggtctctgccccggcggggtggcaccatcgccgtga

SEQ ID NO: 16205 - protein, 482 aa, Sorghum bicolor
  misc_feature: Useful for making plants with altered carbohydrate content
  misc_feature: Functional homolog of the protein sequence given in SEQ ID NO 14351
  misc_feature: Ceres ANNOT ID no. 8655851
  misc_feature (15)..(473): SWISSPROT Homolog: EC 2.4.1.115 Anthocyanidin 3-O-glucosyltransferase
  misc_feature (4)..(477): Pfam ID: UDPGT Pfam Description: UDP-glucoronosyl and UDP-glucosyl transferase
MAAATMVFLPCWGSGHFMSMITAGKRMLDASGGALSLTVLVMQAPTPAKASEVEDHVRRESSSGHDIRVINLPAVEPPTTDCVAPEEFTFRYIQLQASHVEEAIAGLSSPVTAIVFDLFCTPLLDVAGDLAVPRYAYFASTGAFLALTLRLTLAGIREDLIVRLKQTEGTVDVPGLPPVPVSYMPACLSGSKIGNCEWFEYCGRRLMDTSGIIINSSVELEPGVLTAIADGRCVPGRPAPTVYAIGPVIWFAAAPEHQQPHACVQWLDTQPSGSVVFLCFGSNGVLDAAQVREVAAGLERGGHRFLWVLRGAPAGGSRHPTDADLDTALPTGFLTRTRGRGLVWPAWAPQKEILAHPAVGGFVTHCGWNSILESLWFGVPMLPWPLYGEQHLNAFELVREMGVAVHLKNMDVTEADMVVEAAEVEAAVRGLMGGTEGGRKAKEKAADMKDACRNAVVEGGSSYVALRELMRGLCPGGVAPSP

SEQ ID NO: 16206 - DNA, 648 bp, Sorghum bicolor
  misc_feature: Ceres ANNOT ID no. 8655855
  misc_feature: Encodes the peptide sequence at SEQ ID NO 16207
atggaccgcaagagcaagtccaccaagggctccgcggcgagctcggcagcggcgtccatggccgcgctcgctgccgccgcggcggccggcgacagcagcgcggaccccggggcggaggacaacgtgcctgcgaagatggcagccgtgggagacgtctccagctcctccccggtggcggcgaggaggagcgtggcggccgcgggcggtgccgcctccagctcctccccggtgccggcggcggcgaggaggggcgcggcggcggcggcggcggcgtctgtcgcggcaggaggaggaggcggcggcgggccgaggtgccaggcggagcggtgcaacgccaatctgatgaccgacgagaagccgtacaaccggaggcacaaggtgtgcgaggcgcactccaaggctcccgtcgtgctcgtcgccggcctccgccagcgcttctgccagcaatgcagccggttccacgagctgtcggagttcgacgacatcaagcgcagctgccgcctgcgtctggccgggcacaacgagcggcgccggaagagctcggccgacgcgcacggtggtggcggcgccggcgccggcgccggcaatggattccgccaacacgccgatcagaacggcccggccgggaaccacttccagatcagataa

SEQ ID NO: 16207 - protein, 215 aa, Sorghum bicolor
  misc_feature: Useful for making plants with altered terpenoid content
  misc_feature: Useful for making plants with modulated flowering time
  misc_feature: Functional homolog of the protein sequence given in SEQ ID NO 13706
  misc_feature: Ceres ANNOT ID no. 8655855
  misc_feature (104)..(183): Pfam ID: SBP Pfam Description: SBP domain
MDRKSKSTKGSAASSAAASMAALAAAAAAGDSSADPGAEDNVPAKMAAVGDVSSSSPVAARRSVAAAGGAASSSSPVPAAARRGAAAAAAASVAAGGGGGGGPRCQAERCNANLMTDEKPYNRRHKVCEAHSKAPVVLVAGLRQRFCQQCSRFHELSEFDDIKRSCRLRLAGHNERRRKSSADAHGGGGAGAGAGNGFRQHADQNGPAGNHFQIR

SEQ ID NO: 16208 - DNA, 1419 bp, Sorghum bicolor
  misc_feature: Ceres ANNOT ID no. 8655853
  misc_feature: Encodes the peptide sequence at SEQ ID NO 16209
atggcggcaccaacggtggtgctcatcccgttctgcgtcaccggccacctgacgtccatgctccaagccggcaagcggatgctgagcagcggcggcgacgaccgcgccatgtcgctcaccgtgctcctcgcgccgctgccgatggccaggttcgcgcacatcgtagagcgggaggccacctcgggctctgggttcgacatccgcttccaccgcctcccttacgtggagctccccgccttcaccagcccggaggacatgatctccagcttcattcagctgcacgcatccaacgctaaggcggccatcgccggcctgggatgccccgtcgccgccgtcgtcatggactacttctgcaccacgctgttcgacgtcacccacgagctagcactgccggtgtacgtgtacttcacgtccccggcctccatgctcgcgctcatgctgcggctgccggcgctggaccaggaagtggcgggggattttggggaggcgggagcggcgttcgacgtgcctggtatgccgccggtgccagcggctttcctgccgaatgccgtgatgaagagggattcggcctacaggtggagcatgtaccacgccaaccggttcatggaggccgccggcatcatcgtcaacacggtggcggaggtcgagccggaatccctcgcggccatcgctggcggccggtgcatgcccggcgggcgccgcgtcccgaccatctacccgatcggtcccgtgatcgccttcgatccgcctgccgagcagccgcacgacgagtgcctgcgctggctggacgcgcagccgcgttcgtccgtggtcctgctctgcttcgggagcatgggcaacctgaccctgccgcaggtgcaggagatagcggagggcctgcaacgcagcgagcaccggttcctgtgggtgctccgtggcccgccgccagccgggtcgccgtacccgacggacgccaacgtggaggagctcgtcccgggaggcttcttggagaggaccaaggagaggggcctcgtgtggccgagatgggcgccgcagaaggagatcctgtcgcacccgtccatcgggggcttcgtgtcgcacggcgggtggaactcgacgctggagagcctgtggcacggcgtgccgctggtgacttggccgctgtacgcggagcagcacatgaacgcgttcgtgcttgtggcggccctgggcgtcgccgtggcgatggaggtggacaggaagcggggcaacttcgtggaggccgcggagctggagcgcgcggtgcggacgctgatgggagggtcggaggaggggagggaggcgagagccaaggccgcggaggccaaggccgcgtgccggaacgcggtagaggagggcgggtcgtcgtgtgccgcgttgcagaggctgatgcgtgagatttcgggacacggaggggcgtga

SEQ ID NO: 16209 - protein, 472 aa, Sorghum bicolor
  misc_feature: Useful for making plants with altered carbohydrate content
  misc_feature: Functional homolog of the protein sequence given in SEQ ID NO 14351
  misc_feature: Ceres ANNOT ID no. 8655853
  misc_feature (4)..(462): SWISSPROT Homolog: EC 2.4.1.218 Hydroquinone glucosyltransferase
  misc_feature (5)..(471): Pfam ID: UDPGT Pfam Description: UDP-glucoronosyl and UDP-glucosyl transferase
MAAPTVVLIPFCVTGHLTSMLQAGKRMLSSGGDDRAMSLTVLLAPLPMARFAHIVEREATSGSGFDIRFHRLPYVELPAFTSPEDMISSFIQLHASNAKAAIAGLGCPVAAVVMDYFCTTLFDVTHELALPVYVYFTSPASMLALMLRLPALDQEVAGDFGEAGAAFDVPGMPPVPAAFLPNAVMKRDSAYRWSMYHANRFMEAAGIIVNTVAEVEPESLAAIAGGRCMPGGRRVPTIYPIGPVIAFDPPAEQPHDECLRWLDAQPRSSVVLLCFGSMGNLTLPQVQEIAEGLQRSEHRFLWVLRGPPPAGSPYPTDANVEELVPGGFLERTKERGLVWPRWAPQKEILSHPSIGGFVSHGGWNSTLESLWHGVPLVTWPLYAEQHMNAFVLVAALGVAVAMEVDRKRGNFVEAAELERAVRTLMGGSEEGREARAKAAEAKAACRNAVEEGGSSCAALQRLMREISGHGGA

SEQ ID NO: 16210 - DNA, 1446 bp, Sorghum bicolor
  misc_feature: Ceres ANNOT ID no. 8655854
  misc_feature: Encodes the peptide sequence at SEQ ID NO 16211
atgccgagcccaaccatcgtgctcctcccgatgtgggctcccggccatttctcgtcgatgctcgaagccggcaagaggctgctgttctgcagcaccggcggcactgcagcatccagcctcactgttctcgtcacgcccccgccgatggccgcgtcgtccgacgccgccggcctgcacgtacacggtgagatggcctccggcgacggcatcgttttccaccacctccccgccatcgagcacggcaccgatctcgtccacccgtccgagtacatccgactctacgcgccgcatgtcaaggagaccatcgtgggcttggcgaccccggtggcagcggtcgtcgtcgacttcttcgggaccccgctcctcgacgtcgcccacgacctcgccgtgccagcctacgtctacttcgcgtccaccggcgccacgcttgcgctcatgctgcgtttaccggccatgcaggaggagctggcttccaggttgcgggaggagggaggggccgtcgacgtgccagggatgcctccggtgccggtggcctctatgccgtcgccggaaattaacgactacgcgtggttcgcgtactacggccgccgcttcctggaagccagaggcatcgtcgttaacacggcagccgagctggagcctggcgttcttgcgtccatcgccgacggccggtgcacgcccggtggccgtgctcccatggtctacccaatcggcccggtgctctcgccgaagccgcgcgccgatgctcggtcgccgccgtctgcgcaggagtgcatccggtggctcgacgcgcagccgccggcgtccgtcgtgttcctctgcttcgggagcatggggtggatgcacgcggagcaggcgcgcgaggtggccgccggcctcgagcgcagcgagcacaggttcctgtgggtgctgcgcggcccaccgccggccggcggcagctcgcagaacccgacggacgtcgcgaacctcggtgacctgcttccccacgggttcctggagaggacgaaggcgaagggggttgtgtggcggagctgggcaccgcagctggagatcctcgcccacgccgccgtgggtggcttcgttacccactgtggctggaactcggtgctggagagcctgtggcacggcgtgcccatggcgccgtggccgatgtacgccgagcagccgcttaacgcgttcgagctcgtcgcgtgcatgggtgtcgccgttgagcttagggtctgcacgggaagggacgacaacttcgtggaggcagcggaactggagcgagcgatacggagcttgatgggcggatcatcagaggaggggaggaaggcgagggagaaggccaggaagatgaaggcggcatgccggaaggctgtggagaaaggcggatcggcgtacgctgccatgcaggcactggtgcaggatatgctagaaagccacgtacccggcacccgtgtataa

SEQ ID NO: 16211 - protein, 481 aa, Sorghum bicolor
  misc_feature: Useful for making plants with altered carbohydrate content
  misc_feature: Functional homolog of the protein sequence given in SEQ ID NO 14351
  misc_feature: Ceres ANNOT ID no. 8655854
  misc_feature (15)..(473): SWISSPROT Homolog: EC 2.4.1.115 Anthocyanidin 3-O-glucosyltransferase
  misc_feature (5)..(475): Pfam ID: UDPGT Pfam Description: UDP-glucoronosyl and UDP-glucosyl transferase
MPSPTIVLLPMWAPGHFSSMLEAGKRLLFCSTGGTAASSLTVLVTPPPMAASSDAAGLHVHGEMASGDGIVFHHLPAIEHGTDLVHPSEYIRLYAPHVKETIVGLATPVAAVVVDFFGTPLLDVAHDLAVPAYVYFASTGATLALMLRLPAMQEELASRLREEGGAVDVPGMPPVPVASMPSPEINDYAWFAYYGRRFLEARGIVVNTAAELEPGVLASIADGRCTPGGRAPMVYPIGPVLSPKPRADARSPPSAQECIRWLDAQPPASVVFLCFGSMGWMHAEQAREVAAGLERSEHRFLWVLRGPPPAGGSSQNPTDVANLGDLLPHGFLERTKAKGVVWRSWAPQLEILAHAAVGGFVTHCGWNSVLESLWHGVPMAPWPMYAEQPLNAFELVACMGVAVELRVCTGRDDNFVEAAELERAIRSLMGGSSEEGRKAREKARKMKAACRKAVEKGGSAYAAMQALVQDMLESHVPGTRV

SEQ ID NO: 16212 - DNA, 1794 bp, Sorghum bicolor
  misc_feature: Ceres ANNOT ID no. 8655846
  misc_feature: Encodes the peptide sequence at SEQ ID NO 16213
atggctactccgaccgtcgtcctggtgcccgtctggggcattggccacttcgtgccaatgctcgaggtcggcaagcggctgctcgcacgcagcgcacgggccctcacgatcaccgtgctcgttatgccggagcccgatgcgacgcgggcgtccgagatcaccgagcacatacgccaggagcaagccactggcctcgccatccgcttccaccatctgccattagtggcacccccaaccgacacctcgggcatcgaggagtacgtctcccgctacgtgcagctgtactcgccccacgtcaaggcggccgtcgccggcctgacgtgcccggtggccggcgtcgtcgtcgacatcttctgcacgacgctgttcgacgcggcgcacgagctgggcgtgccggcctacgtgtacctcatcgccagcgccgcgatgtgcgcgctcctgctgcgctccccggcgctccacgaggaggtcgccggcgacgtcgagttcgaagacgtggaaggcggcggcgtcgacgtgcccgggctgccgccggtgccggcgtcctgcctgccgacggggctggagaacaggaagatcacgacctacagatggttcctgtacaacggcaggcgctacatggaagccggaggtatcgtcctcaacaccgttgccgaggcggagccgcgcgtcctcgcggccatcgccgacgggcggtgcacgcgcggtgtcccggcacctccggtgtactccatcgggccggtgatccccttcaccccgcccgccgccgccggcgagcaggcgcgccacgagtgcgtgcgttggctcgactcgcagccgccgggcagtgtggtgttcctctgcttcggaggcaaaggctgcttcacggcgccgcaagcgcacgagatagcgcacggcctggaccgcagcgggcgtcgattcctgtgggtgctgcgcgggctgccggagcccggcacgaagatgcccgcggacgggaacctcgcggagctgcttccggcggggttcttggagaggacaaaggacagagggctcgtgtggcccaccaaggcgccgcagaaggagatactcgcccacgccgccgtgggaggtttcgtcacgcacggtggctggaactcaatcctcgagagcctctggcatggcgtgccgatggttccgtggccgctcggcgccgagcagcactacaacgcgttcacgctggtggccgacatgggcgtcgccgtggcgatgggcgtggaaaggaagaggagcaacttcgtggcggcggccgagctggagcgagcggtcaaagctctcatgggcgacggcgagacggtgaggaaggttagggacaaggtcacggagatgaaagccgcgtgccggaaggcagtggaggagggaggatcatccaacgtgtcgctgcagaggctctgtgatgcgctcgtcaagggcgcgatctcgagtcttcgcgtgggcgccgtggggctgggcgccagcggccgcgcgcgcgtcccgatctcttcgtgtgggtgtcgtggggctgggcgcccgcgccgcgtcccgatctctggtcttcgcgtgggcgccgtggggctaggctccagcggccgcgtctccgccgacgccgcgggggagtccgcgctgcgcgccgtagccgtctcccctccttctgatccccttctccgccgccgccacgggggagtccgcgctgcgcgccgtcgccgtatgccctgcggccactgccgccagttcctccaggagatccgcaccgcggcgggcatccagccataccagtggcggaggaaggatttaaattga

SEQ ID NO: 16213 - protein, 597 aa, Sorghum bicolor
  misc_feature: Useful for making plants with altered carbohydrate content
  misc_feature: Functional homolog of the protein sequence given in SEQ ID NO 14352
  misc_feature: Ceres ANNOT ID no. 8655846
  misc_feature (14)..(475): SWISSPROT Homolog: EC 2.4.1.115 Anthocyanidin 3-O-glucosyltransferase
  misc_feature (5)..(477): Pfam ID: UDPGT Pfam Description: UDP-glucoronosyl and UDP-glucosyl transferase
MATPTVVLVPVWGIGHFVPMLEVGKRLLARSARALTITVLVMPEPDATRASEITEHIRQEQATGLAIRFHHLPLVAPPTDTSGIEEYVSRYVQLYSPHVKAAVAGLTCPVAGVVVDIFCTTLFDAAHELGVPAYVYLIASAAMCALLLRSPALHEEVAGDVEFEDVEGGGVDVPGLPPVPASCLPTGLENRKITTYRWFLYNGRRYMEAGGIVLNTVAEAEPRVLAAIADGRCTRGVPAPPVYSIGPVIPFTPPAAAGEQARHECVRWLDSQPPGSVVFLCFGGKGCFTAPQAHEIAHGLDRSGRRFLWVLRGLPEPGTKMPADGNLAELLPAGFLERTKDRGLVWPTKAPQKEILAHAAVGGFVTHGGWNSILESLWHGVPMVPWPLGAEQHYNAFTLVADMGVAVAMGVERKRSNFVAAAELERAVKALMGDGETVRKVRDKVTEMKAACRKAVEEGGSSNVSLQRLCDALVKGAISSLRVGAVGLGASGRARVPISSCGCRGAGRPRRVPISGLRVGAVGLGSSGRVSADAAGESALRAVAVSPPSDPLLRRRHGGVRAARRRRMPCGHCRQFLQEIRTAAGIQPYQWRRKDLN

SEQ ID NO: 16214 - DNA, 1425 bp, Sorghum bicolor
  misc_feature: Ceres ANNOT ID no. 8655842
  misc_feature: Encodes the peptide sequence at SEQ ID NO 16215
atggcagcccctaccgtcgtcttactgccggtgtggggtgccggccacctcatgcccatgctcgaggccggcaagcgcctgctcacccgcggcggccgcgcgctctcgctcaccgtgctcctcatgccagcgcccacggaggaggtcgcggccgagctcgacggccacgtacgcagggaggaggcctccggcctcgacatccgtttcgtccgcctccccgcagtggagccgccgatggactcccgcggcatcgaggagttcgtctccaggctggtccagctgcacgcgcctcacgtcagggcggcgatgtccagcctggcgtccccggtggccgcgttcgtcatcgacttcttctgcaccacgctgctcgacgtgtcccgcgagctcgccgtgcccgcgtacgtctacttcaccgccagcgccgggatgctcgcgctcaagctgcgcctcccgtcgctccacgaggaggtgacggtccagttcgaggagatggagggcgcggtggacgtgcctgggcttccgccggtgccgccgtcgtcgctccccaacccagtgatggacaagaatcaccccaactacacgtggttcgcgtaccacggcagacggttcgccgaggccgacggcatcatcgtcaacacggctgccgagctcgagcagagcgtgctttctgccatcgccgacgggcggtgcacgcccggtgtccgtgccccgacggtctatccaattggcccggtgatctcgttcaccccgcccgctgaggagccacacgagtgcgtgcggtggctcgacacgcagccggtggcctccgtggtgctcctctgcttcgggagcgtgggattcttcaccgcgccacaggcgcacgagctcgcgcacggcctggagcgcagcggccatcgcttcctctgggtgctgcgcggcccaccggcacccggggagcggcacccgtcggacgcgaacctcgacgagctgctccccgacggcttcctcgagaggaccaagggcagaggcctggtgtggccgacgaaggcgccgcagaaagaggtacttgcgcacgccgccatgggtggtttcgtgacacacggcggctggaactcggtcctcgagagcctgtggttcggcgtgccaatggcaccgtggccgctgtacgccgagcagcacctgaacgcgttcacgctggtggcctacatgggcgtcgccgtggcgatgaaggtggacaggaagaggaacaatttcgttgaggccgcggagctggagcgagcggtgaaggagctgatgggcggtggcgaggaggggaggaaggcgagggagaaggccatggagatgaaggccgccttcaggaacgccgtggaggagggtggctcatcctacgctgcgctgcggaggctatcagaggagatcatgtgcaaagtcgacacgaaccaatga

SEQ ID NO: 16215 - protein, 474 aa, Sorghum bicolor
  misc_feature: Useful for making plants with altered carbohydrate content
  misc_feature: Functional homolog of the protein sequence given in SEQ ID NO 14351
  misc_feature: Ceres ANNOT ID no. 8655842
  misc_feature (15)..(467): SWISSPROT Homolog: EC 2.4.1.115 Anthocyanidin 3-O-glucosyltransferase
  misc_feature (5)..(471): Pfam ID: UDPGT Pfam Description: UDP-glucoronosyl and UDP-glucosyl transferase
MAAPTVVLLPVWGAGHLMPMLEAGKRLLTRGGRALSLTVLLMPAPTEEVAAELDGHVRREEASGLDIRFVRLPAVEPPMDSRGIEEFVSRLVQLHAPHVRAAMSSLASPVAAFVIDFFCTTLLDVSRELAVPAYVYFTASAGMLALKLRLPSLHEEVTVQFEEMEGAVDVPGLPPVPPSSLPNPVMDKNHPNYTWFAYHGRRFAEADGIIVNTAAELEQSVLSAIADGRCTPGVRAPTVYPIGPVISFTPPAEEPHECVRWLDTQPVASVVLLCFGSVGFFTAPQAHELAHGLERSGHRFLWVLRGPPAPGERHPSDANLDELLPDGFLERTKGRGLVWPTKAPQKEVLAHAAMGGFVTHGGWNSVLESLWFGVPMAPWPLYAEQHLNAFTLVAYMGVAVAMKVDRKRNNFVEAAELERAVKELMGGGEEGRKAREKAMEMKAAFRNAVEEGGSSYAALRRLSEEIMCKVDTNQ

SEQ ID NO: 16216 - DNA, 627 bp, Sorghum bicolor
  misc_feature: Ceres ANNOT ID no. 8655857
  misc_feature: Encodes the peptide sequence at SEQ ID NO 16217
atggccccctcgagctcggcagcggcgtccatggccgcgctcgcggccgccgcggcgtctggcgacggctcggacgactccggggcggccaaaaacggtggcgcgcctccgacgcacggggtggaggcgggcaacaatcccgcggagctggcggcggccgtgggtggcgcctccagcagctcctcccgggcggcggcgaggagcagggtcgcggcggctgctggcgcctccggctcctccccggtggcggcggcgaggagcaggggcgccggcgccgtggccgcggcggcgggcggcggcggtggcgtcgggccgagctgccaggtggagcggtgcaacgccgacatgggcgtggagaagcggtacaaccggaggcacaaggtgtgcgacgcgcaccgcaaggcgtccgtcgtcctcctcgccggcctccgccagcgcttctgccagcaatgcagccggttccacgagctgtcgcacttcgacgacaccaagcggagctgccgcctgcgcctggcggggcacaacgagcggcgccggaggaacccggcggaggcgcacgaccagaacggcggccggggcgacccggggaaccaccacctccacatcagatcagataaacctatctaa

SEQ ID NO: 16217 - protein, 208 aa, Sorghum bicolor
  misc_feature: Useful for making plants with altered terpenoid content
  misc_feature: Useful for making plants with modulated flowering time
  misc_feature: Functional homolog of the protein sequence given in SEQ ID NO 13706
  misc_feature: Ceres ANNOT ID no. 8655857
  misc_feature (106)..(184): Pfam ID: SBP Pfam Description: SBP domain
MAPSSSAAASMAALAAAAASGDGSDDSGAAKNGGAPPTHGVEAGNNPAELAAAVGGASSSSSRAAARSRVAAAAGASGSSPVAAARSRGAGAVAAAAGGGGGVGPSCQVERCNADMGVEKRYNRRHKVCDAHRKASVVLLAGLRQRFCQQCSRFHELSHFDDTKRSCRLRLAGHNERRRRNPAEAHDQNGGRGDPGNHHLHIRSDKPI

SEQ ID NO: 16218 - DNA, 1569 bp, Sorghum bicolor
  misc_feature: Ceres ANNOT ID no. 8655890
  misc_feature: Encodes the peptide sequence at SEQ ID NO 16219
atggggagcaggaccagaggagggagtggcagccgcagccgcttgctcttcttccctttcatcctcttgctccacctcctctctcttcactcagcaggcccgtcggtggtggtgtcggcggcggggtccggcgagccgtacgtgggcgtgacgatcggcacgcaggtgacgaacctgctctcgccgtcggacctggcgtcgttcctgcgcgcgcagcgcatcacccgcgtgcgcctctacgacgcggacccgcggctgctgtcggcgctggccgcctcgggggtgcgcgccatcgtgggtgtccccaacgacgagctcctggcgctgggctcctccccggcgacggccgcgtcctgggtctcccgccgcgtgctccccttcgcgggcgtcaactccagcaccccgaacgtcatctccgccatcgccgtcggggacgaggtgccgaccgcgctcccctcggcgctgcccgtgctgctcccggccatcaactccctcgccgccgcgctggccgccgccaacctttcctccatcccggtgtcgacgccgctgcccttctccgtggtgctggacccgttcccgccgtcgcaggccttcttcaaccagtccctggccaagtcgttcgtggcgccgctgctcgcccacctcgccaacacctcggcgccgctgatgctgaacctgtacccgtactactcgctgatgcagagcaagggcgtgatcccgctggacaacgcgctgttccggccgctgccgccgtcgcaggagatggtggaccccaacacgctgctccactacaccaacgtgctcgacgcgatgctggacgcggtgcgcgtggccgtccggaacctcaacgccacgggcggcgcgagcgtgccgatcctggtgacggagaccgggtggccgtcgtacggggaccggcgcgcggagccgtacgcgaccagggacaacgcggacgcgtacaactccaacctcatcaagcacgtgctggaggacaagcccggcacgcccatggcgcccggcgccggcgcgcagtccagcgcctacatctacgagctcttcaacgaggacctccgcccgggccccgtgtcggaggcgaactggggcctgttctacgggaacggcaccccggtgtacctcctccacgtgtccggcgccgacgggttcctggggaacgacacgacggaccggaccttctgcgtagccgccgacgacgcggacttgaaggcggtgcaggcggccatggactgggcgtgcggccccgggcgcgccgactgcacggcgatacagcccgggcaggcgtgctaccagcccgacgacgtgcgcagccacgcgtcgttcgcgttcgacgcctactaccagtcccagggccgcgccgccggctcgtgctacttccagggcgccggaatggtcaccaccgtggatccgagtgagtacactctcgcttctttttctggctgcctcgtcaccatccgtgtttattaccactggagttacataattaatagtcgcgcttcttttaatgcccgcctgacaaagacaaatggaacgaaactgcgcagtagcttctcgtga

SEQ ID NO: 16219 - protein, 522 aa, Sorghum bicolor
  misc_feature: Useful for making plants with altered carbohydrate content
  misc_feature: Functional homolog of the protein sequence given in SEQ ID NO 14353
  misc_feature: Useful for making plants with altered cell wall content and/or composition
  misc_feature: Functional homolog of the protein sequence given in SEQ ID NO 14354
  misc_feature: Ceres ANNOT ID no. 8655890
  misc_feature (36)..(475): SWISSPROT Homolog: EC 3.2.1.39 Glucan endo-1,3-beta-D-glucosidase
  misc_feature (48)..(381): Pfam ID: Glyco_hydro_17 Pfam Description: Glycosyl hydrolases family 17
  misc_feature (396)..(487): Pfam ID: X8 Pfam Description: X8 domain
MGSRTRGGSGSRSRLLFFPFILLLHLLSLHSAGPSVVVSAAGSGEPYVGVTIGTQVTNLLSPSDLASFLRAQRITRVRLYDADPRLLSALAASGVRAIVGVPNDELLALGSSPATAASWVSRRVLPFAGVNSSTPNVISAIAVGDEVPTALPSALPVLLPAINSLAAALAAANLSSIPVSTPLPFSVVLDPFPPSQAFFNQSLAKSFVAPLLAHLANTSAPLMLNLYPYYSLMQSKGVIPLDNALFRPLPPSQEMVDPNTLLHYTNVLDAMLDAVRVAVRNLNATGGASVPILVTETGWPSYGDRRAEPYATRDNADAYNSNLIKHVLEDKPGTPMAPGAGAQSSAYIYELFNEDLRPGPVSEANWGLFYGNGTPVYLLHVSGADGFLGNDTTDRTFCVAADDADLKAVQAAMDWACGPGRADCTAIQPGQACYQPDDVRSHASFAFDAYYQSQGRAAGSCYFQGAGMVTTVDPSEYTLASFSGCLVTIRVYYHWSYIINSRASFNARLTKTNGTKLRSSFS

SEQ ID NO: 16220 - DNA, 231 bp, Sorghum bicolor
  misc_feature: Ceres ANNOT ID no. 8655891
  misc_feature: Encodes the peptide sequence at SEQ ID NO 16221
atggatatcttttgctatgcaggtcatgacagctgtttatttcctggaagtaagctgctgagcaacagcactggatctggcagcacgaacacatcgacgcccacaagtgatgcggagggatctgcaatatggagattaagaactggaagggacaaagggttcttcctcttccttcggttggtacttagcattgcggtggttatcgtggtggattcgaacttttggacatga

SEQ ID NO: 16221 - protein, 76 aa, Sorghum bicolor
  misc_feature: Useful for making plants with altered carbohydrate content
  misc_feature: Functional homolog of the protein sequence given in SEQ ID NO 14353
  misc_feature: Ceres ANNOT ID no. 8655891
MDIFCYAGHDSCLFPGSKLLSNSTGSGSTNTSTPTSDAEGSAIWRLRTGRDKGFFLFLRLVLSIAVVIVVDSNFWT

SEQ ID NO: 16222 - DNA, 1383 bp, Sorghum bicolor
  misc_feature: Ceres ANNOT ID no. 8655886
  misc_feature: Encodes the peptide sequence at SEQ ID NO 16223
atggcttccgctaccacctccatctcatcgcaccctgccgccctccgcgatgtcgtccaagctgcgaggattggcgcgctgaggcagcaggtgggcgtggccccggcggcggcgcgcggccagcgcgctcgcgcggtgcgcccgctgcgcgcggcggagcccgcgaggcagccggtggcggcctccgcggccgcggcggcgccggccgcgcccatggccgacgaggctgcggcggccctcgcggcggtggactacgaggccctggcgcgtgagctggatggcgcgtcgccgctggagatcatggatcgggcgctggccatgttcggctccgaaatcgccatcgccttcagcggtgctgaggacgtggcgctgatcgagtacgccaagctgacggggcgtccgttccgggtgttcagcctggacacgggtcgtctcaacccggagacgtaccagttcttcgaccaggtggagaagcactacggcatccgcatcgagtacatgttcccggacgcgagcgaggtgcaggagctggtgcgcaccaagggcctcttctccttctacgacgacggccaccaggagtgctgccgggtgcgcaaggtgcggcccctgcgcagggcgctcaaggggctcagggcatggatcaccggccagaggaaggaccagtcccccggcaccagggccagcatccccctggtccaggtcgacccttccttcgaaggcctggatggcggagctggtagcttgatcaagtggaaccctgtggccaacgtcgacggcaaggacatctggacgttcctaaggaccatggacgtccctgtcaacaccctgcatgctcagggctacgtgtccatcgggtgcgagccgtgcaccaggcctgtcctgccggggcagcacgagcgggaaggccggtggtggtgggaggacgccaaggccaaggagtgcggcctccacaagggaaacatcgagaaggacggccaggcggcggcccccaggtccgccaacggcaacggctcggcgggcgccccggacatcttcgagagccccgccgtggtgtccctcacccgcgccgggatcgagaacctgctgcgcctggagaaccgcgccgagccgtggctcgtggtgctgtacgcgccctggtgccccttctgccaggccatggaggcctcctacgtggagctggccgagaagctggcgggctccggcgtcaaggtggccaagttccgcgccgacggcgagcagaagccgttcgcgcaggccgagctgcagctgcagagcttccccaccgtgctcctgttcccgagccgcacccccaggcccatcaagtacccgtcggagaagagggacgtcgactcgctcctcgccttcgtcaacagcctccggtga

SEQ ID NO: 16223 - protein, 460 aa, Sorghum bicolor
  misc_feature: Useful for making plants with modulated nitrogen use efficiency
  misc_feature: Functional homolog of the protein sequence given in SEQ ID NO 14355
  misc_feature: Ceres ANNOT ID no. 8655886
  misc_feature (90)..(460): SWISSPROT Homolog: EC 1.8.4.9 Adenylyl-sulfate reductase (glutathione)
  misc_feature (111)..(292): Pfam ID: PAPS_reduct Pfam Description: Phosphoadenosine phosphosulfate reductase family
  misc_feature (349)..(459): Pfam ID: Thioredoxin Pfam Description: Thioredoxin
MASATTSISSHPAALRDVVQAARIGALRQQVGVAPAAARGQRARAVRPLRAAEPARQPVAASAAAAAPAAPMADEAAAALAAVDYEALARELDGASPLEIMDRALAMFGSEIAIAFSGAEDVALIEYAKLTGRPFRVFSLDTGRLNPETYQFFDQVEKHYGIRIEYMFPDASEVQELVRTKGLFSFYDDGHQECCRVRKVRPLRRALKGLRAWITGQRKDQSPGTRASIPLVQVDPSFEGLDGGAGSLIKWNPVANVDGKDIWTFLRTMDVPVNTLHAQGYVSIGCEPCTRPVLPGQHEREGRWWWEDAKAKECGLHKGNIEKDGQAAAPRSANGNGSAGAPDIFESPAVVSLTRAGIENLLRLENRAEPWLVVLYAPWCPFCQAMEASYVELAEKLAGSGVKVAKFRADGEQKPFAQAELQLQSFPTVLLFPSRTPRPIKYPSEKRDVDSLLAFVNSLR

SEQ ID NO: 16224 - DNA, 1596 bp, Sorghum bicolor
  misc_feature: Ceres ANNOT ID no. 8655924
  misc_feature: Encodes the peptide sequence at SEQ ID NO 16225
atggggcagtgttgcagcagagcgacggccccggactctggacggggaggcaccaatggttatggctactctaaccaggcaaagccagcgcaagcacctccgagttacaaccttcctcagcaggcggccgaggtgaggtacacgccgccggcgatgaacgcaccggtagtcccacctgtgactgtgccaccgaagccaacggcggacacgattcttggcaagcagtacgaggacgtgcgctctgtctactccctcgggaaggagcttggccggggccagtttggggtgacatacctctgtacagagattgccactggtaggcagtacgcctgcaagtccatctccaagcgcaagctcaccagcaaggcagacagggaggacattcgaagggagatccagatcatgcagcatctgtctggacagccaaacattgtcgagttccggggagcatacgaggacaagagcaatgtccatgtggtgatggagctctgtgcaggcggggagctcttcgatcgcatcattgcaaaggggcactacacagaacgtgcagctgcgacaatctgcagagcagttgtgaatgttgtcaacatttgccacttcatgggtgtgatgcatcgtgatctgaaacctgaaaacttcttgcttgcgaccaaggaggagaatgcaatgctcaaggccactgattttgggctttctgtcttcattgaagaaggaaagatgtacagggacattgttgggagtgcttattatgttgctcctgaagtccttaggcgcagctatggaaaagagatagatgtttggagtgcaggtgttattttgtacattcttctcagtggcgtgcctccattttgggctgaaactgaaaaggggatatttgatgctattctgcgtgaggagattgactttgaaagtcaaccttggccatcaatttctgagagtgctaaagacttggttagaaagatgttgacacgagatccaaagaaaagactgacttcagctcaagttcttcaacatccatggctcagagaaggtggggacgcatctgataagcctatcgacagtgctgttctttctagaatgaaacagttcagagcaatgaataagctgaaaaaaatggccctaaaggttattgcttcaaaccttaacgaggaagagatcaaggggttaaagcaaatgttcatgaacatggacacagacaatagtggcacaatcacatatgaagaactcaaagtaggattagccaaacttggatcaaagctgtcagaagctgaagtaaaacagttgatggaggctgctgatgttgatgggaatggatccattgactatgttgagttcatcactgccacaatgcatagacacaagctcgaaagagacgagcatttgtttaaggcattccagtacttcgataaagacaacagtggcttcatcacaagagatgaactggaatctgctttgatcgagcatgagatgggcgacacgagtacaataaaggagatcatatcagaagttgacacggacaatgatgggaggattaactatgaggagttttgcgcaatgatgagaggagggatgcagcagccaatgaggctcaagtag

SEQ ID NO: 16225 - protein, 531 aa, Sorghum bicolor
  misc_feature: The sequence is a functional homolog of SEQ ID NO 2 in US patent 7084323
  misc_feature: Ceres ANNOT ID no. 8655924
  misc_feature (1)..(531): SWISSPROT Homolog: EC 2.7.11.1 Non-specific serine/threonine protein kinase
  misc_feature (83)..(341): Pfam ID: Pkinase Pfam Description: Protein kinase domain
  misc_feature (495)..(523): Pfam ID: efhand Pfam Description: EF hand
  misc_feature (388)..(416): Pfam ID: efhand Pfam Description: EF hand
  misc_feature (460)..(488): Pfam ID: efhand Pfam Description: EF hand
  misc_feature (424)..(452): Pfam ID: efhand Pfam Description: EF hand
MGQCCSRATAPDSGRGGTNGYGYSNQAKPAQAPPSYNLPQQAAEVRYTPPAMNAPVVPPVTVPPKPTADTILGKQYEDVRSVYSLGKELGRGQFGVTYLCTEIATGRQYACKSISKRKLTSKADREDIRREIQIMQHLSGQPNIVEFRGAYEDKSNVHVVMELCAGGELFDRIIAKGHYTERAAATICRAVVNVVNICHFMGVMHRDLKPENFLLATKEENAMLKATDFGLSVFIEEGKMYRDIVGSAYYVAPEVLRRSYGKEIDVWSAGVILYILLSGVPPFWAETEKGIFDAILREEIDFESQPWPSISESAKDLVRKMLTRDPKKRLTSAQVLQHPWLREGGDASDKPIDSAVLSRMKQFRAMNKLKKMALKVIASNLNEEEIKGLKQMFMNMDTDNSGTITYEELKVGLAKLGSKLSEAEVKQLMEAADVDGNGSIDYVEFITATMHRHKLERDEHLFKAFQYFDKDNSGFITRDELESALIEHEMGDTSTIKEIISEVDTDNDGRINYEEFCAMMRGGMQQPMRLK

SEQ ID NO: 16226 - DNA, 2016 bp, Sorghum bicolor
  misc_feature: Ceres ANNOT ID no. 8655998
  misc_feature: Encodes the peptide sequence at SEQ ID NO 16227
atggcagcgccagtgccgctccggcggcggcgggcgctcctggcggtggcgacgttgctcgccgtggtcaccgccgcggtggcgcaggactataacgatggcggcgacgacgaggaagacgagaagaagaagaagccgcagttcaaggcgcaggaggcgtgcaacggcgtgttcctgtcgtacacgttcatggagcgcaccaaggagtacccgcacctgaagaacgcgacggcgcagccgtacgcgttcaaggcgacggcgtcggtgctcaacaccatgaccgaggacctcaaggcgtggcagatgttcgtgggcttccagcacaaggagatcctcgtgtccgtcggcggcgccgtgctcctggacggctccgacctccccgccaacgtgtccggcggcgtcaccttcgcggggtacccgatggccgacctcctcaactccatcgagacggccggcgagccgtccctgatcgagagcaagattgagatcaccggcacccagttcggcgtgaagccccccggcaagcccatgcccaagaccatcaagctgaccaaccccgagggcttccggtgccccgcaccaaaccacaaaggcagcgtgatgtacgtttgctgcgtcaaggaccgcaagttcaaggcgaagaaggccaacagcacgcggtaccaggcacggcggaaggcggacctgacgttcgcctacgacgtgctgcaggcgacagccaacaactaccaggtgcaggtgacgatcgacaactggagccccatcagccggctggacaactggaacctcacctgggagtggaagcgcggcgagttcatctacaacatgaagggcgcctacacgctgctcaaggaaggccccgcctgcatctacagccccgccgctggctactacaaggacttggacttcaccccggtgtacaactgcgagaagcgtcccgtcatcgtggacctcccgccggagcgggagaaggacaacgccatcgggaacatccccttctgctgcaagaacggcaccctgctgccgcccaccatggacccgtccaagtcgcgtgccatgttccagatgcaggtgttcaagctgccgccggacctcaaccgcacggcgctgtacccgccgcagaactggaagatctccggcaagctcaacccgcagtacaggtgcgggcagcccatccgcgtgaagccccaggagttcccggacgcgacggggctcatgtccgccaccccggccgtggcgtcgtggcaggtggcgtgcaacatcacccggcccaagaagcgcgcctccaagtgctgcgtctccttctccgcctactacaacgactccgtggtgccgtgcaacacctgcgcctgcggctgcggcaacgacacgtccacgtgcgacccggacaggcacgccatgctgctgccgccggaggcgctgctcgtcccgttcgacaaccggtcggccaaggcccgggcgtgggccaagatcaagcactggcgggtgcccaaccccatgccctgcagcgacaactgcggcgtcagcatcaactggcacgtcatgaacaactacaagtccggctggtcggcgcgcatgaccatcttcaactggcaggactacaccttcaaggactggttcgccgccgtcaccatgggcagccacttcagcggctacgagaacgtctactccttcaacggcaccaggatgggcgcccccttcaacaacaccatcttcatgcagggggtgccgggactcgcgtacctcgaccccatcaccgacgggaacacgccggcggaaccaaggcttcccggaaagcagcagtcggtcctctccttctccaggaaagacgcgcccaacatcgacattcccaaaggggaagggttccccaagagggtctacttcgacggcgaggagtgcgcgctgccggataggatacccaaggtgtcgagcgcgcgccggcgggcagggacggcgagcctcgggcagcttgccatggcggcggcgctcgtgatgattgtggcgctagtggattaa

SEQ ID NO: 16227 - protein, 671 aa, Sorghum bicolor
  misc_feature: Useful for making plants with altered cell wall content and/or composition
  misc_feature: Functional homolog of the protein sequence given in SEQ ID NO 14356
  misc_feature: Useful for making plants with altered carbohydrate content
  misc_feature: Functional homolog of the protein sequence given in SEQ ID NO 13790
  misc_feature: Ceres ANNOT ID no. 8655998
  misc_feature (243)..(423): Pfam ID: Phytochel_synth Pfam Description: Phytochelatin synthetase-like conserved region
MAAPVPLRRRRALLAVATLLAVVTAAVAQDYNDGGDDEEDEKKKKPQFKAQEACNGVFLSYTFMERTKEYPHLKNATAQPYAFKATASVLNTMTEDLKAWQMFVGFQHKEILVSVGGAVLLDGSDLPANVSGGVTFAGYPMADLLNSIETAGEPSLIESKIEITGTQFGVKPPGKPMPKTIKLTNPEGFRCPAPNHKGSVMYVCCVKDRKFKAKKANSTRYQARRKADLTFAYDVLQATANNYQVQVTIDNWSPISRLDNWNLTWEWKRGEFIYNMKGAYTLLKEGPACIYSPAAGYYKDLDFTPVYNCEKRPVIVDLPPEREKDNAIGNIPFCCKNGTLLPPTMDPSKSRAMFQMQVFKLPPDLNRTALYPPQNWKISGKLNPQYRCGQPIRVKPQEFPDATGLMSATPAVASWQVACNITRPKKRASKCCVSFSAYYNDSVVPCNTCACGCGNDTSTCDPDRHAMLLPPEALLVPFDNRSAKARAWAKIKHWRVPNPMPCSDNCGVSINWHVMNNYKSGWSARMTIFNWQDYTFKDWFAAVTMGSHFSGYENVYSFNGTRMGAPFNNTIFMQGVPGLAYLDPITDGNTPAEPRLPGKQQSVLSFSRKDAPNIDIPKGEGFPKRVYFDGEECALPDRIPKVSSARRRAGTASLGQLAMAAALVMIVALVD

SEQ ID NO: 16228 - DNA, 348 bp, Sorghum bicolor
  misc_feature: Ceres ANNOT ID no. 8656012
  misc_feature: Encodes the peptide sequence at SEQ ID NO 16229
atgtctgatctcgacgttcagatcccaactgccttcgatccctttgctgaggccaatgctggggactctggtgcggcagcaggatcaaaggactacgttcatgtacgcatccagcagcgtaatggtcgcaagagtctgactactgtccagggattgaagaaggagttcagctacagcaagatcctcaaagatctcaagaaagagttttgctgcaatggtacagtggtccaggacccagaacttggacaggtcattcaactccagggtgatcagaggaagaacgtctctaatttccttgtccaggccggcattgtgaagaaggaacacatcaagattcatggtttctga

SEQ ID NO: 16229 - protein, 115 aa, Sorghum bicolor
  misc_feature: Useful for making plants with modulated biomass
  misc_feature: Useful for making plants with modulated flowering time
  misc_feature: Functional homolog of the protein sequence given in SEQ ID NO 13160
  misc_feature: Ceres ANNOT ID no. 8656012
  misc_feature: Up-regulated in shoot tissues in response to methyl jasmonate treatment
  misc_feature: Up-regulated in root tissues in response to salicylic acid treatment
  misc_feature: Up-regulated in shoot tissues in response to salicylic acid treatment
  misc_feature (27)..(108): Pfam ID: SUI1 Pfam Description: Translation initiation factor SUI1
MSDLDVQIPTAFDPFAEANAGDSGAAAGSKDYVHVRIQQRNGRKSLTTVQGLKKEFSYSKILKDLKKEFCCNGTVVQDPELGQVIQLQGDQRKNVSNFLVQAGIVKKEHIKIHGF

SEQ ID NO: 16230 - DNA, 957 bp, Sorghum bicolor
  misc_feature: Ceres ANNOT ID no. 8656011
  misc_feature: Up-regulated in shoot tissues in response to methyl jasmonate treatment
  misc_feature: Up-regulated in root tissues in response to salicylic acid treatment
  misc_feature: Up-regulated in shoot tissues in response to salicylic acid treatment
  misc_feature: Encodes the peptide sequence at SEQ ID NO 16231
atgacgggagggccgccgcggcgtccgtgcgcgggcgcgcttcttcttcccctcgcggcggccgtcgcggtggtgctgtcgtcctgctgctgccacggcgcgtccgcggcagcgtcgttcggcgacaacttcgagatcacgggcgccgaggaccacgtcaagacctccgccgacgggcagacctggtacctgtacctcgacaacaagacaggcgtcgggttccagacgaagcagcgctacctcttcggctggttcagcatgaagctcaagctggtgggcaacgactccgcgggcgtcgtcaccgcctactacatgtgctcggacgtggacgcggcgccgttgcgcgacgagctggacttcgagttcctgggcaaccgcagcggggagccctacatcatccagaccaacgtgtaccacaacggcgtcggcggccgggagatgcgccactcgctctggttcgaccccaccgccgacttccacacctacgccatcctctggaaccccaagcacatcgtgttcttcgtggacaaggtggcgatccgggtgtacccgaacgacgcgtccaagccgggcggcggcggcggcagcggcttcttcccgatcagcaagcccatgtacatcttctcgagcatctggaacgcggacgactgggcgacgcgcggcgggctggagaagacggactggtccagggcgcccttcgtgtcgtcctaccgcgacttcgccgccgacgcctgcgcgtggccggctgcaggcggaccgccggcgtgcgcggcggcgacgggggacagctggtgggaccagccccccgcgtgggcgctggacgccgggcagcgcctggacaacgcctgggtggccaggaacctcctcatctacgactactgcgacgaccgcaagcgcttcccgacgccgcccgaggagtgcgcgctccgggacgccgccgccaccaccgcctcgtga

SEQ ID NO: 16231 - protein, 318 aa, Sorghum bicolor
  misc_feature: Useful for making plants with altered cell wall content and/or composition
  misc_feature: Functional homolog of the protein sequence given in SEQ ID NO 14357
  misc_feature: Useful for making plants with altered carbohydrate content
  misc_feature: Functional homolog of the protein sequence given in SEQ ID NO 13783
  misc_feature: Ceres ANNOT ID no. 8656011
  misc_feature (40)..(311): SWISSPROT Homolog: EC 2.4.1.207 Xyloglucan:xyloglucosyl transferase
  misc_feature (40)..(230): Pfam ID: Glyco_hydro_16 Pfam Description: Glycosyl hydrolases family 16
  misc_feature (256)..(307): Pfam ID: XET_C Pfam Description: Xyloglucan endo-transglycosylase (XET) C-terminus
MTGGPPRRPCAGALLLPLAAAVAVVLSSCCCHGASAAASFGDNFEITGAEDHVKTSADGQTWYLYLDNKTGVGFQTKQRYLFGWFSMKLKLVGNDSAGVVTAYYMCSDVDAAPLRDELDFEFLGNRSGEPYIIQTNVYHNGVGGREMRHSLWFDPTADFHTYAILWNPKHIVFFVDKVAIRVYPNDASKPGGGGGSGFFPISKPMYIFSSIWNADDWATRGGLEKTDWSRAPFVSSYRDFAADACAWPAAGGPPACAAATGDSWWDQPPAWALDAGQRLDNAWVARNLLIYDYCDDRKRFPTPPEECALRDAAATTAS

SEQ ID NO: 16232 - DNA, 2574 bp, Sorghum bicolor
  misc_feature: Ceres ANNOT ID no. 8656019
  misc_feature: Encodes the peptide sequence at SEQ ID NO 16233
atggggtcgacggcggaggacgtggcggcggtgccggacgaggaggcgtgcatgtacgcgatgcagctggcgtcgtcgtcgatcctccccatgacgctgaagaacgcgctggagctgggcctgctggaggtgctgcataaggacgccggcaaggcgctggcggcagaggaggtggtggcgcggctgcccgtggcgccgaccaaccccggcgcggcggacatggtggaccggatgctccgcctcctcgcctcctacgacgtcgtcaagtgccagatggaggacgggcggagcgccaggtcgggaggttgggtgctgtggatgcggcgccccggccgcggccacggccacagggaactcggggagtgtggagaggcggcggagaccgagcccaagccggcacaggacggcggcgaacggagaggcggcggaggccgagcccaagccggcacaggacggcggcgaacggagaggcggcggaggccgagcccaagccggcacaggacggcggcggacagatgcgggagcgctccagatgcggcgtcatgtcggggaggtaaaaagctccctaaaggccctaaacaaggcctaatttcgaacggatgggctgctcagcccatagtccctgcattggaatctggggatgaccatggcgacgaggcccgcgtggaggagctattggcccgagaaaacgatggccactcgcgaacggacggcggagtggcggtaaacgtccagctgggagcggcgacgactggagcagaggcgccactgccgtcgccgcggcagagggaggcagcaagcggcctcctcggcgtgacgcgcagcgggagcacggcgctccacctggtcgccagccgcgggcacgcggggctcgcgaggcgcgtctgcgagctggcgccctcgctcgtcgccacgcgcgacgggggcctcgacacgccgctgcaccgcgcggcaatggccgggcaccgcgaggtggcggcctgcctcctgtcggcgatgcgcgcgggcggagcaagcgccgacgcgttgcgggcgaggaacgggctgggcgccacggcgctgtacgaggccgtccggaacggccacgcggagacagtggtcctgctggcgacggaggctcccgagctggccgcgatgacgacggacggcggcgtctcgccgctgtatctggcggcgatgaccggctccgtggagatggtccgcgcgctgcttcgtccggcgcctgacgggacaccgtcgctggcatcgtttgccggaccagagggacggactgctttgcctgccgcggcgtccaaaagcaaagaaatcgttcaagaaatcctggaatcagaacagggtctggcattgctgcccagagctgatttatcggggaaaactcctctccactatgcgctgctgtcgcacaggcaacacggcgtcgtctcgctgctcctaagtgcagaagcttcactagcgcgtgtctccgacaacgaaggtttgtttccagtgcatgtcgccgccatgatggggaacgttaggaacatcgttgagcttgtagagagatgccctgactttgcagaatttgtagatcgccggcgaaggaatttcttgcactgtgcaattgagcataatcaggaaggtgtggttcgattcatttgccgagatggcatgtttgctatcctgctgaatgccatggattacgaaggaaacaccccgctccatttggccgtcaagtatgggcatccaaggatggtcagttttctgctgcagaccatgagcgtggaggtaggcattaccaacgtggatggtctaacgcctgcagatcttgcttacagtcatttggagcctggtttacactatttcctgaatcctcgagccgtagtgaagaactgtttgtactggacaagagcaccggtcacaggagaggatcatgtccgtctgcacagcaggatgagtacgaccacaacgccggctatggacgaggaccccaaggacatcgacggcatcacggcgaccgcaacgatcgcgtccgtgctgatcgccaccgtcacgttcgcggccgcgttcaccgtgccggggggctacgtcgcggacgaccacccgcgtgcgggcacggccgtgctggccaggcggttggcgttccgggcgttcgtggcgtcggacaccatggcgttcctctgctccatcgtcgccacatgcttcctcgtctacggcggcgcggggcagtcggcgtcggggctcctgccgcccggcgcgcagctcatggtcgccgcgttcgcgttcgggatccacgtcgttctcggcgaggacaaccggtggctggtaaccctggtgtacgtgctcgcgctggccgcggtgctcctctgcttcccgggcatctgggcgcccttctacctcgggaaagccatctggcgacgagccggatggagagggctcatcaatgtgcaccggcgtcccgcgagcttggaagagttcttctggcttttcatcacgagctttctcttcaaaaatctgatgcgccctttgtttgcggtgctcatcacggtcacatttgctgtgtccatcgccctcaacatcgctttgccggactactga

SEQ ID NO: 16233 - protein, 857 aa, Sorghum bicolor
  misc_feature: Useful for making plants with altered carbohydrate content
  misc_feature: Functional homolog of the protein sequence given in SEQ ID NO 14135
  misc_feature: Ceres ANNOT ID no. 8656019
  misc_feature (1)..(94): SWISSPROT Homolog: EC 2.1.1.68 Caffeate O-methyltransferase
  misc_feature (209)..(464): SWISSPROT Homolog: EC 2.7.11.1 Non-specific serine/threonine protein kinase
  misc_feature (489)..(582): SWISSPROT Homolog: EC 3.1.1.4 Phospholipase A(2)
  misc_feature (561)..(594): Pfam ID: Ank Pfam Description: Ankyrin repeat
  misc_feature (456)..(489): Pfam ID: Ank Pfam Description: Ankyrin repeat
  misc_feature (31)..(83): Pfam ID: Dimerisation Pfam Description: Dimerisation domain
MGSTAEDVAAVPDEEACMYAMQLASSSILPMTLKNALELGLLEVLHKDAGKALAAEEVVARLPVAPTNPGAADMVDRMLRLLASYDVVKCQMEDGRSARSGGWVLWMRRPGRGHGHRELGECGEAAETEPKPAQDGGERRGGGGRAQAGTGRRRTERRRRPSPSRHRTAADRCGSAPDAASCRGGKKLPKGPKQGLISNGWAAQPIVPALESGDDHGDEARVEELLARENDGHSRTDGGVAVNVQLGAATTGAEAPLPSPRQREAASGLLGVTRSGSTALHLVASRGHAGLARRVCELAPSLVATRDGGLDTPLHRAAMAGHREVAACLLSAMRAGGASADALRARNGLGATALYEAVRNGHAETVVLLATEAPELAAMTTDGGVSPLYLAAMTGSVEMVRALLRPAPDGTPSLASFAGPEGRTALPAAASKSKEIVQEILESEQGLALLPRADLSGKTPLHYALLSHRQHGVVSLLLSAEASLARVSDNEGLFPVHVAAMMGNVRNIVELVERCPDFAEFVDRRRRNFLHCAIEHNQEGVVRFICRDGMFAILLNAMDYEGNTPLHLAVKYGHPRMVSFLLQTMSVEVGITNVDGLTPADLAYSHLEPGLHYFLNPRAVVKNCLYWTRAPVTGEDHVRLHSRMSTTTTPAMDEDPKDIDGITATATIASVLIATVTFAAAFTVPGGYVADDHPRAGTAVLARRLAFRAFVASDTMAFLCSIVATCFLVYGGAGQSASGLLPPGAQLMVAAFAFGIHVVLGEDNRWLVTLVYVLALAAVLLCFPGIWAPFYLGKAIWRRAGWRGLINVHRRPASLEEFFWLFITSFLFKNLMRPLFAVLITVTFAVSIALNIALPDY

SEQ ID NO: 16234 - DNA, 1662 bp, Sorghum bicolor
  misc_feature: Ceres ANNOT ID no. 8656059
  misc_feature: Encodes the peptide sequence at SEQ ID NO 16235
atggcgttcactcgcctcctcgttgtcctcctcggcgctgcatttccgctgctcttattattctcccctgcagtggcgagtgaattgggcgtgagctacgggagggtggcgaacgacctgccggacccgtcgtcggtggtgaagctgctcggagacaacggcatcaccatggtgaggatctacgacgccaactccaacgtgcttagttcgctggccaacacgggcatcaaggtgatggtgatgctgcccaacgagaacctggcggacgccgcctccagctcagacaaagcgctccagtgggtgcagaacaacgtggccgcatactacccggccaccaacatccatggcgtggcggtgggcaacgaggtgttcaacagcaagcccgaccagaacttgaacctcgtcccggccatgaccaacatccagaaggcgctggcgcagctgaacctggccgacgccataaaggtgaccacgcccatcgcgttcaacgcggtggccgtgtcctggccgccgtcgtcgggcgcgttcggcgacgacatcgcgcagctggtgatgaagcccatgctccagttcctgcagcagacgggctcctacctctccgtcaattactacccttacttgacttacatggcccagccagacactttcaacctcgactacgtcctggggaacaaccccaaccccggcgcggtagaccccgacacccagttcaagtacaacagcctcctggacgcccagcgcgacgccacgtactacgccatggacaagctgggggcatcgtactccaatatggccgtgcaccacacggagcacggcgcgccttcagggggcagcctcagaggcggcggcggcggccacaggaggcttttacaggccggaggagtggccaccatagctaacgctcagacctacatcaacaacctcatgaaccgcgtgctgtccggaaacaccggcacgccgcaccgcccgaacgccgacatgaacgtgtacatcttcgcgctgttcaacgaggaccagaagggcaccggcgctggtgacgtcgaacagcacttcggcctcttctaccccaacatgcagaaggtgtacgagttcgacttccgcggcggcggcgttccgccggcgccgggggcggagagctggtgcgtggcaaacgcgtcggtcggggaatcgtggctgcaggcggcactcgagtacgcgtgcggccacggcgccgactgcagcgccatccagcccggcgcggcgtgcttcgagccggacaccgtggtcgcccacgcctcgtacgcgttcaacagctactaccagcggaacggccggagcaacgggacgtgcgacttcaacggcgccggttacatcgtctaccaagaaccagctggcacctgcgacccgaacgcgagctggtgcgtggcgaacgcggaggtcggggacgcgcggcttcagaatgccctggactacgcatgcggcaacggcgcggactgcagcgccatccagcccggcgggcagtgcttccaacccgacaccaagccctcgcacgcctcgtacgcgttcaacagctactaccagcacaagggacgggctagcggaacttgcgacttctctggtgccgcctccgttgtataccagcaacccaaagtcggaaactgtgtgctcccatcgagtggttga

SEQ ID NO: 16235 - protein, 553 aa, Sorghum bicolor
  misc_feature: Useful for making plants with altered carbohydrate content
  misc_feature: Functional homolog of the protein sequence given in SEQ ID NO 14358
  misc_feature: Useful for making plants with modulated drought sensitivity
  misc_feature: Useful for making plants with modulated water use efficiency
  misc_feature: Functional homolog of the protein sequence given in SEQ ID NO 13472
  misc_feature: Ceres ANNOT ID no. 8656059
  misc_feature (29)..(460): SWISSPROT Homolog: EC 3.2.1.39 Glucan endo-1,3-beta-D-glucosidase
  misc_feature (29)..(366): Pfam ID: Glyco_hydro_17 Pfam Description: Glycosyl hydrolases family 17
  misc_feature (465)..(549): Pfam ID: X8 Pfam Description: X8 domain
  misc_feature (379)..(462): Pfam ID: X8 Pfam Description: X8 domain
MAFTRLLVVLLGAAFPLLLLFSPAVASELGVSYGRVANDLPDPSSVVKLLGDNGITMVRIYDANSNVLSSLANTGIKVMVMLPNENLADAASSSDKALQWVQNNVAAYYPATNIHGVAVGNEVFNSKPDQNLNLVPAMTNIQKALAQLNLADAIKVTTPIAFNAVAVSWPPSSGAFGDDIAQLVMKPMLQFLQQTGSYLSVNYYPYLTYMAQPDTFNLDYVLGNNPNPGAVDPDTQFKYNSLLDAQRDATYYAMDKLGASYSNMAVHHTEHGAPSGGSLRGGGGGHRRLLQAGGVATIANAQTYINNLMNRVLSGNTGTPHRPNADMNVYIFALFNEDQKGTGAGDVEQHFGLFYPNMQKVYEFDFRGGGVPPAPGAESWCVANASVGESWLQAALEYACGHGADCSAIQPGAACFEPDTVVAHASYAFNSYYQRNGRSNGTCDFNGAGYIVYQEPAGTCDPNASWCVANAEVGDARLQNALDYACGNGADCSAIQPGGQCFQPDTKPSHASYAFNSYYQHKGRASGTCDFSGAASVVYQQPKVGNCVLPSSG

SEQ ID NO: 16236 - DNA, 1965 bp, Sorghum bicolor
  misc_feature: Ceres ANNOT ID no. 8656057
  misc_feature: Encodes the peptide sequence at SEQ ID NO 16237
atggctcaccacctcctgcccttgcttgccgttctcgccgccgccgccgcactgctcgtggcgccgcccgtcgcagcttacccgtggccagtgtgcggccagagcaactacttcaagcctaacggcacataccaggctcatctcgacttcgtcgcggccacgctgcccaagaacgcctccgcgtcccggtccctcttcgccaccaccgtcgtcggcaccatcccggagcagctctgggccatggcgctctgccgcggcgacgtcaacgccacggactgcttcacctgcctgactcaagccttcagagaccttccgaacgactgctcctacgacatggacggcaccatctactacgaccagtgcatcctccattactccgacgtgctcaccttccccggcgccggcaccggcccgacgaccgacacgtacgccgtcaacttcaacacaaatgtcacgtcggacccggcccagttcacgagcctcctggccgccctcatcaacgccaccgtcgcgtacgccgccgacaactccacgcggctgttcgcgacaggggaggctgacttcaaccaggagttccccaaggtgtacagcctggcgcagtgcacgccggatcagacgccggcgcactgtcggaactgcctcgccaaggccgtagcgaagtaccaggggtcgttctatgactacatcggaggcagggtgcttggcatcaactgcagctaccggtacgagatcgtgtccttcttcaatggaccggcgatggttcggctggcatcaccgagctctggagctccggcatcagcaccggcaccggcaccagcgccggcttcagctctgcaaccaactgttgggacgccgccggcagcagggaaagttctactaccaagtattgcagccttgaaccttgttgcctggctctgttactggaagcgtcagcgaccaattgaacaggcgaaacagaaatctggagctgaggacacggagacggtggactcaatgatgatggacgtgtccaccctgcgggccgcgacaggggatttcgacgagaccaacaagcttggcgaaggtggcttcggagcggtgtacaagggtgttctccccgatggcgatgagatagcggtgaagcgattgtcaaagagctcgacgcagggagtggaggagctgaagaacgagctcgcgctggtggccaagctgaagcacaagaatctcgtcaggctcatcggcgtctgcctggagcagcaggagcggctgctggtctacgagttcgtccccaatcgaagcctggacctcattctcttcgacactgagaatcacaaacgtgagcagctggactggggtcagaggtacacgatcataaacggcatcgctcgaggcctgcagtacctgcatgaagactctcagctcaaagtagtccaccgtgatctcaaggccagcaacatcctgctcgacgcaaatatgagccccaaaatctcagactttggcctcgcgaggatcttcagccgagaccagacacaggccgtcaccaaccgcgttgtcggaacctatgggtacatggcaccagaatacatgatgcgcgggaactactctgtcaagtctgatgcgttcagcttcggcgtcatggtgctggagatcgtcacggggaggaagaacaacagtaacaacgacggcacccagcagtctggagaccttttgaccactgtatgggagcactgggagaccgggacggtggtggagttggtagacccgaacatgggcggcggcagcatcccggaggacgatgtgctgaggtgcatccacatagggctgctgtgcgtccagggagaccccgcggctcggccggtgatgtcgtccgtcgtggtgatgcttggcagcaatacggtcaccctccaagcgccgtccaagccggcattctgcgccaggaacaactctaacacggccgtgtcgtcgacggcaccgctgcagggctag

SEQ ID NO: 16237 - protein, 654 aa, Sorghum bicolor
  misc_feature: Useful for making plants with modulated biomass
  misc_feature: Functional homolog of the protein sequence given in SEQ ID NO 14141
  misc_feature: Useful for making plants with altered cell wall content and/or composition
  misc_feature: Functional homolog of the protein sequence given in SEQ ID NO 14359
  misc_feature: Ceres ANNOT ID no. 8656057
  misc_feature (287)..(621): SWISSPROT Homolog: EC 2.7.11.1 Non-specific serine/threonine protein kinase
  misc_feature (346)..(621): Pfam ID: Pkinase Pfam Description: Protein kinase domain
MAHHLLPLLAVLAAAAALLVAPPVAAYPWPVCGQSNYFKPNGTYQAHLDFVAATLPKNASASRSLFATTVVGTIPEQLWAMALCRGDVNATDCFTCLTQAFRDLPNDCSYDMDGTIYYDQCILHYSDVLTFPGAGTGPTTDTYAVNFNTNVTSDPAQFTSLLAALINATVAYAADNSTRLFATGEADFNQEFPKVYSLAQCTPDQTPAHCRNCLAKAVAKYQGSFYDYIGGRVLGINCSYRYEIVSFFNGPAMVRLASPSSGAPASAPAPAPAPASALQPTVGTPPAAGKVLLPSIAALNLVAWLCYWKRQRPIEQAKQKSGAEDTETVDSMMMDVSTLRAATGDFDETNKLGEGGFGAVYKGVLPDGDEIAVKRLSKSSTQGVEELKNELALVAKLKHKNLVRLIGVCLEQQERLLVYEFVPNRSLDLILFDTENHKREQLDWGQRYTIINGIARGLQYLHEDSQLKVVHRDLKASNILLDANMSPKISDFGLARIFSRDQTQAVTNRVVGTYGYMAPEYMMRGNYSVKSDAFSFGVMVLEIVTGRKNNSNNDGTQQSGDLLTTVWEHWETGTVVELVDPNMGGGSIPEDDVLRCIHIGLLCVQGDPAARPVMSSVVVMLGSNTVTLQAPSKPAFCARNNSNTAVSSTAPLQG

SEQ ID NO: 16238 - DNA, 1503 bp, Sorghum bicolor
  misc_feature: Ceres ANNOT ID no. 8656066
  misc_feature: Encodes the peptide sequence at SEQ ID NO 16239
atggccctgagtaacctcgtcgtcgtcctcctcggtaccgcatcggttctgctccccttctcccctgcagatgccggcgtggtgggcgtgagctacggccggctggggaaccacctgccggacacggcttcgacggtaaagcttctgcagaagagcggcatcacctcggtgaggctctacgacgccaactccaaggtgctcaaggccctggccaacaccgggatcacggtgatggtaatgctacccaacgacaacctcgccgcggcggccgcggacccgtcgagcgcgcggcggtgggtgcggagaaacgtggcggcgtactaccccgccacgcggatccacggcgtggccgtggggaacgaggtgttcgaggaggccaataagaacctgacggcgcagctcgtcccggccatggccaacgtgcacgacgcgctggtgaagctgggcctggacgaggccgtgaaggtgtcgacgccgatcgcgttcaccgcgctccaggcgtcgtggccgccgtcggcgggcaggttccgggacgacgtcgcggcgtcggtgatgaagcccatgctcgatttcctggagcggacggggtcgtacctcaccgtcaacgcctacccgttcttcgcgtacgtcgaggagccagacaagatctccctcgactacgccctggggaactccaacgccgccggcgtgcgcgaccccgtgacggggctcgtgtaccacagcctcctggacgcccagctcgacgccacgtacttcgcgatggagaagctggggacgtccagttccagtgcgcaggagccaaatttcatggcgcgaaagggtccgcgcgcgtatgtttcggagagcgggtggccttccgccggcaggcccaaacccggcggcaggccacgcccacgcggcggcgggagcgggaggcgatgtttggaggaggaggaggctggggacgaagcggcttcggtagcaaacgcgcgagcgtacaacaactacctcatcaaccgcgtgctgtccggcgacacgggcaccccgtaccgccccggcgccgacatggacgtgtacgtcttcgccctcttcaacgagaaccagaagggcgacggagcggacgacatcgagcagcacttcggcctgttctacccgaaccagacgaaggtgtacgagttcgacttccggggcggcgcgctgccgagctggtgcgtggcgaacgcgtccgtcggggacgcgcggctgcaggcggcgctggagtacgcgtgcggccacggcgccgactgcggcgccatccagcccggcggagcgtgcttcgagccggacaccgtggtcgcccacgcctcgtacgcgttcaacagctactaccagcggaacggccggggcagcgggacgtgcgacttcgccggcgccgcctccgtcgtccaccacgcaccgaaggttggtcactgcgtcctcccgtcgaacggttgggttcaagaaacaacagcaacagcgaagtctgaaggctacactgccatctga

SEQ ID NO: 16239 - protein, 500 aa, Sorghum bicolor
  misc_feature: Useful for making plants with altered carbohydrate content
  misc_feature: Functional homolog of the protein sequence given in SEQ ID NO 14358
  misc_feature: Ceres ANNOT ID no. 8656066
  misc_feature (6)..(258): SWISSPROT Homolog: EC 3.2.1.39 Glucan endo-1,3-beta-D-glucosidase
  misc_feature (28)..(388): Pfam ID: Glyco_hydro_17 Pfam Description: Glycosyl hydrolases family 17
  misc_feature (395)..(479): Pfam ID: X8 Pfam Description: X8 domain
MALSNLVVVLLGTASVLLPFSPADAGVVGVSYGRLGNHLPDTASTVKLLQKSGITSVRLYDANSKVLKALANTGITVMVMLPNDNLAAAAADPSSARRWVRRNVAAYYPATRIHGVAVGNEVFEEANKNLTAQLVPAMANVHDALVKLGLDEAVKVSTPIAFTALQASWPPSAGRFRDDVAASVMKPMLDFLERTGSYLTVNAYPFFAYVEEPDKISLDYALGNSNAAGVRDPVTGLVYHSLLDAQLDATYFAMEKLGTSSSSAQEPNFMARKGPRAYVSESGWPSAGRPKPGGRPRPRGGGSGRRCLEEEEAGDEAASVANARAYNNYLINRVLSGDTGTPYRPGADMDVYVFALFNENQKGDGADDIEQHFGLFYPNQTKVYEFDFRGGALPSWCVANASVGDARLQAALEYACGHGADCGAIQPGGACFEPDTVVAHASYAFNSYYQRNGRGSGTCDFAGAASVVHHAPKVGHCVLPSNGWVQETTATAKSEGYTAI

SEQ ID NO: 16240 - DNA, 2076 bp, Sorghum bicolor
  misc_feature: Ceres ANNOT ID no. 8656051
  misc_feature: Encodes the peptide sequence at SEQ ID NO 16241
atggctgcgcaccatcaccacctgcgcccctacctcgccactgccaccgcgctcttcctcgcattcacctccgcgcctctcgacgccggggacccgctgggccagttctgcggtaccggcttcaactacacgctcaacagcacctaccagggcaacatccagcgcctcgccgccacgctgccccggaacacctccgcctccccgacgctcttcgccaaggacaccgtcggcgcggtcccggacatcgtctatgcgctcgcgctctgccgcggggacaccaacgcctccgcctgcagcgactgcgtcgccaccgcgttccaggacgcgcagcagctgtgcgcctacaacaaggacgccaccgtcttctacgacccctgcctcctccgcttctccaaccagaacttcatcgcctcgccctccaacagcgacgacaaggtgctcatcctcatgaacacgcagaacgtcaccgcgccgttcaaggtgttcgacgccgccgtcgccgtgctcctcaacgccaccgccgcctacgcggccgccaattcgtccaagaggttcggcaccggggtggagcggttccagaccttcgacagcaagaacccgaccatttacggtctggcgcagtgcacgccggacatgtcgccggccgactgccggaggtgcctctcgggtattattcagatggcccccaagtatttcaacggcaagccgggtggcaggattcttggtctgcggtgcaattacaggtatgagcagtactcgttcttcacaagcaccccgctgcttcagctgccggagcctaccgtgggggcgccggcgcccgcgcccgcggtggtgaacggaacgccaacggtgccgacgaacggaggagcacgaggaacaacaggaaaaaaaactggtagagttttagccattgcactgcctatagttgctgctgcaatactagctactatagtactttgttcatgcctctggaggaggaagaggaaaccagggaagtcaacactaccagatacaactaacccagaggacatacaaagtattgattctctcattattgatatatcaactttgcgagctgcaacagaaaactttgatgaagccaataagctcggtgaaggaggttttggttcagtatataagggaatcctccctgatgaccaggaaatagcagtgaaaaggctctcacagacttctagacaagggatggaggagctcaaaaatgagcttgtattggttgctaagctgcaacacaagaatttagtgaggcttgttggggtttgcttggaggaccatgaaaaattgcttgtctatgaatacatgcccaacaaaagccttgacactattctattcaatcatgagagatgtggtgagctagattgggggaagaggtttaagatagttaatgggattgcccgtggcttgcagtatcttcatgaagattctcaagtgaagataatccaccgggatcttaaagcgagcaatgttttattagactatgacttcaatcctaagatctcagattttggcttagcaaggttatttggaagtgaccaatcacaagatgtcaccaatcgcgtcgtcggaacctatggatacatggcccctgagtacgccatgcgtgggcattactctatcaagtcggacgtgttcagcttcggtgttttgatcctagaaatcgtcaccggaagaagaaatggtggctcctatagctctgatgaatatgctgatctccttagtttggtgtgggagcactggacgacaggaacattgatagacatcatggattcatccttgagcagccttgctccgcgagaccagatgttgaagtgtatccacatcgggctcctttgtgttcaagatgaccccgcagataggccgatgatgtcaacagtgaatgtcatgcttagtagtagtacggtgaccctccaagctccatctagaccggcgttttgcatcccaaagagtggcttctcagagatgaactcagaagggtacccgccaggagcttcacagtccgcgagcagatcgcctatgtcgctgaatgacgtttcaatcactgagcttgagcccagatga

SEQ ID NO: 16241 - protein, 691 aa, Sorghum bicolor
  misc_feature: Useful for making plants with altered carbohydrate content
  misc_feature: Functional homolog of the protein sequence given in SEQ ID NO 14360
  misc_feature: Useful for making plants with modulated biomass
  misc_feature: Functional homolog of the protein sequence given in SEQ ID NO 14141
  misc_feature: Ceres ANNOT ID no. 8656051
  misc_feature (360)..(631): SWISSPROT Homolog: EC 2.7.11.1 Non-specific serine/threonine protein kinase
  misc_feature (364)..(631): Pfam ID: Pkinase Pfam Description: Protein kinase domain
MAAHHHHLRPYLATATALFLAFTSAPLDAGDPLGQFCGTGFNYTLNSTYQGNIQRLAATLPRNTSASPTLFAKDTVGAVPDIVYALALCRGDTNASACSDCVATAFQDAQQLCAYNKDATVFYDPCLLRFSNQNFIASPSNSDDKVLILMNTQNVTAPFKVFDAAVAVLLNATAAYAAANSSKRFGTGVERFQTFDSKNPTIYGLAQCTPDMSPADCRRCLSGIIQMAPKYFNGKPGGRILGLRCNYRYEQYSFFTSTPLLQLPEPTVGAPAPAPAVVNGTPTVPTNGGARGTTGKKTGRVLAIALPIVAAAILATIVLCSCLWRRKRKPGKSTLPDTTNPEDIQSIDSLIIDISTLRAATENFDEANKLGEGGFGSVYKGILPDDQEIAVKRLSQTSRQGMEELKNELVLVAKLQHKNLVRLVGVCLEDHEKLLVYEYMPNKSLDTILFNHERCGELDWGKRFKIVNGIARGLQYLHEDSQVKIIHRDLKASNVLLDYDFNPKISDFGLARLFGSDQSQDVTNRVVGTYGYMAPEYAMRGHYSIKSDVFSFGVLILEIVTGRRNGGSYSSDEYADLLSLVWEHWTTGTLIDIMDSSLSSLAPRDQMLKCIHIGLLCVQDDPADRPMMSTVNVMLSSSTVTLQAPSRPAFCIPKSGFSEMNSEGYPPGASQSASRSPMSLNDVSITELEPR

SEQ ID NO: 16242 - DNA, 2064 bp, Sorghum bicolor
  misc_feature: Ceres ANNOT ID no. 8656071
  misc_feature: Encodes the peptide sequence at SEQ ID NO 16243
atggccgcgcccacgggccacctcctcttcctcgccgtcgcctccctcctcctcctcttcctcctcctctcgccgcgggccgctgcgcagccgtggcaggtctgcgggaacaccggcaactacacggcccagagcacctaccagtccaacctcgcgagcctcgccaaggcgctccccgcgaacgcgtcccgctcggcggggaacctcttcgcggagggcagcgtcggcgccgtcccggacgtcgtctacgcgctcgcgctctgccgcggggacacggccaacgccacggcctgcggctcctgcgtcgccacggggttccaggacgcgcagcagctctgcccctacgacaaggacgcggccgtggtctacgacgcctgctacctccgcttctccaacaaggacttcatcgccagcaccaccgacaacggcgataatctcatcatcctcgccaacacgcagagcgtgagctcgccggtgcgggcgttcgacgccgccgtcgccgcgctcctcaacgccaccggcgactacgcgtccgcgaactcgtcgcggtttgccacgggggaagagggtttcgacgccagcaaccccaccatctacgggctcacgcagtgcacgccggacatgtcgtccgccgactgccggagctgccttgggagcataatctcggcgataccacagtctctcagcggaagtaagggcgggaggattataggtatgcggtgcaatttcaggtacgaggtgtattctttcttctccggatcgccctcgctacgtctgccagcggcgtcgccaccggcggcatctcctactacaccatttaacgggacgccgacggcaaccccaccaccaccaggaagaaccagaaacaaaacaggaattgctttagcaattgtgttgcctataattgctgcggtgctagctatcagtactgtttgtctctgtttcttctggaggaggagaaaacaagcgagggagcagacaccatcttattcaactaatgctggagacatggaaagcattgagtcacttcttcttgatatatcaactttacgcgctgcgactggtaactttgctgagagcaataggcttggtgaaggaggttttggtgctgtctataagggcgtccttcctgatggtcaagaaattgcagtgaagaggctctcacagagttcagggcaaggaatacaagagctgaaaaatgagcttgttttggttgccaagcttcaacacaagaatcttgttaggcttcttggtgtttgcttgcaagaacatgagaaactgcttgtgtatgaatacatgcccaatagaagcatcgacaccctccttttcgatgctgagaaaaacaaggagctagattgggcaaacagagtcaagataatagatggaattgctagaggattacagtatcttcatgaagattctcagttgaagattattcaccgggaccttaaagcgagcaatgtccttttagactctgattatactcctaagatttctgactttggcctggctaggctatttggaggggatcaatcgcgggaggtcacaagtcgcgtcgttggaacatatgggtatatggcacccgagtacgccatgcgtggccactattctataaagtccgatgtttttagctttggcatcttgattcttgaaatcttaaccggaagaaaaagcagtggttcctttaacatcgaggagtctgttgatctcttaagtcttgtttgggagcactggaccatgggaacaattgttgaggttatggatccatctctgagaggcaaagctcctgcgcaacaaatgctgaaatatgtccatatcggcctactatgtgttcaggataacccggtcgacagaccgatgatgtcaacagtaaacgtcatgctcagcggcagcactttctccctccaggctccactaaagccagtatttttcattcccaagagtggttactactcaactgtttattcagaatcatatcctacagcttcccaatccaccgataacgttatgtcaggggcgttatcacctaatgaagtgtcaattacagaattggaaccaagatga

SEQ ID NO: 16243 - protein, 687 aa, Sorghum bicolor
  misc_feature: Useful for making plants with altered carbohydrate content
  misc_feature: Functional homolog of the protein sequence given in SEQ ID NO 14360
  misc_feature: Useful for making plants with modulated biomass
  misc_feature: Functional homolog of the protein sequence given in SEQ ID NO 14141
  misc_feature: Ceres ANNOT ID no. 8656071
  misc_feature (350)..(629): SWISSPROT Homolog: EC 2.7.11.1 Non-specific serine/threonine protein kinase
  misc_feature (357)..(624): Pfam ID: Pkinase Pfam Description: Protein kinase domain
MAAPTGHLLFLAVASLLLLFLLLSPRAAAQPWQVCGNTGNYTAQSTYQSNLASLAKALPANASRSAGNLFAEGSVGAVPDVVYALALCRGDTANATACGSCVATGFQDAQQLCPYDKDAAVVYDACYLRFSNKDFIASTTDNGDNLIILANTQSVSSPVRAFDAAVAALLNATGDYASANSSRFATGEEGFDASNPTIYGLTQCTPDMSSADCRSCLGSIISAIPQSLSGSKGGRIIGMRCNFRYEVYSFFSGSPSLRLPAASPPAASPTTPFNGTPTATPPPPGRTRNKTGIALAIVLPIIAAVLAISTVCLCFFWRRRKQAREQTPSYSTNAGDMESIESLLLDISTLRAATGNFAESNRLGEGGFGAVYKGVLPDGQEIAVKRLSQSSGQGIQELKNELVLVAKLQHKNLVRLLGVCLQEHEKLLVYEYMPNRSIDTLLFDAEKNKELDWANRVKIIDGIARGLQYLHEDSQLKIIHRDLKASNVLLDSDYTPKISDFGLARLFGGDQSREVTSRVVGTYGYMAPEYAMRGHYSIKSDVFSFGILILEILTGRKSSGSFNIEESVDLLSLVWEHWTMGTIVEVMDPSLRGKAPAQQMLKYVHIGLLCVQDNPVDRPMMSTVNVMLSGSTFSLQAPLKPVFFIPKSGYYSTVYSESYPTASQSTDNVMSGALSPNEVSITELEPR

SEQ ID NO: 16244 - DNA, 1965 bp, Sorghum bicolor; identical to SEQ ID NO: 16236
  misc_feature: Ceres ANNOT ID no. 8656060
  misc_feature: Encodes the peptide sequence at SEQ ID NO 16245

SEQ ID NO: 16245 - protein, 654 aa, Sorghum bicolor; identical to SEQ ID NO: 16237
  misc_feature: Useful for making plants with modulated biomass
  misc_feature: Functional homolog of the protein sequence given in SEQ ID NO 14141
  misc_feature: Useful for making plants with altered cell wall content and/or composition
  misc_feature: Functional homolog of the protein sequence given in SEQ ID NO 14359
  misc_feature: Ceres ANNOT ID no. 8656060
  misc_feature (287)..(621): SWISSPROT Homolog: EC 2.7.11.1 Non-specific serine/threonine protein kinase
  misc_feature (346)..(621): Pfam ID: Pkinase Pfam Description: Protein kinase domain

SEQ ID NO: 16246 - DNA, 1797 bp, Sorghum bicolor
  misc_feature: Ceres ANNOT ID no. 8656069
  misc_feature: Encodes the peptide sequence at SEQ ID NO 16247
atggcgctcactcgcctcctcgttctcctcctcggcgccgccgcattgcctgtgctcttgttccgcactgcaggtaatcacatagatgtgcagctgtctggaaatggtggagatccagttgcagaggcgcgcgaggtgggcgtgaactacggcagggtggcgaacgacctgccggacccggcggcggtggtgcagctgctcagggacaacggcatcaccatggtgcggatctacgacaccgacgacgcggtgctgaggtcgttcgccaacaccggcatcaagctcatggtgatgctgcccaacgagaacctggccgacgccgcgcggagcccgtcgtacgcggccgactgggcgcggcgccgcgtggctgcctacctcccggccacgcggatccacgccgtctccgtgggcaacgaggtgttcgactcgaggccggacctgacgccgctgctcgtccccgccatgaccaacgtgcacgccgcgctggcgcagctgggcctcgccgacgccatcaaggtgtccacgccgctgtccttcgccgcggtggccgtgtcgtggccgccgtccgcgggcaggttccgggacgacatcgcgcagccggtgatgaggcccatgctcgagttcctgcagcggaccggctcctacctcaccatcaacctctacccttacttcgcctacgccgctcagccggacaagatctcccgcgactacttcctcgggaaccccaaccccggcgtgcgcgacccggacaccggcctcatgtattacagcgtcctggacgcgcagcgcgacgccacgttctctgccatggataagcttgggttcaccagtcttcaagcaattccaggggagaccgggtcagcgtctgccggccgaccgaaacctggtcctcgacacaacaaaccactacaccagccttcttgggagctggccgtcggggacgacggggatggagttagagtagacccgccggcggcctcaaaggccaacgcgcaggcgtacaacaacaacgtcatcaaccgcgtgctggccggcaggacgggcaccccgctccgccccgacgccgacatggacgtgtacatcttcgccctgttcaacgagaaccagaagggttccgggccggacgacatcgaggccaacttcggcctcttctaccccaacatggagaaggtgtacgagttcgacttccgcggcggcggcgttccgccggcgccgggggcggagagctggtgcgtggcgaacgcgtcggtcggggagtcgtggctgcaggcggcactggagtacgcgtgcggccacggcgccgactgcagcgccatccagcccggcgcgacgtgcttcgagccggacaccgtggtcgcgcacgcctcgtacgcgttcaacagctactaccagcggaacggccggagcaacgggacgtgcgacttcaacggcgccggttacatcgtctaccaagaaccagctggcacctgcgacccgaacgcgagctggtgcgtggcgaacgcggcggtcggggacgcgcggctgctggatgggttgaactatgcgtgtgccaacggcgcggactgcagcaccatccagccgggcgcgccgtgcttcgagcccaacaccatggtcgcgcacgcctcacacgcgttcaacagctactaccagcgcaaccgtcgggcaagcgggacgtgcgacttcgccggcgccgcctccgtcgtctaccgggcaccaaagtacggaaactgcgtgctcccatcaaaggcttcgattgaagaaacgatagcaaagtcggaaggcgaagctgccatttga

SEQ ID NO: 16247 - protein, 598 aa, Sorghum bicolor
  misc_feature: Useful for making plants with altered carbohydrate content
  misc_feature: Functional homolog of the protein sequence given in SEQ ID NO 14358
  misc_feature: Ceres ANNOT ID no. 8656069
  misc_feature (36)..(293): SWISSPROT Homolog: EC 3.2.1.39 Glucan endo-1,3-beta-D-glucosidase
  misc_feature (46)..(396): Pfam ID: Glyco_hydro_17 Pfam Description: Glycosyl hydrolases family 17
  misc_feature (409)..(492): Pfam ID: X8 Pfam Description: X8 domain
  misc_feature (495)..(579): Pfam ID: X8 Pfam Description: X8 domain
MALTRLLVLLLGAAALPVLLFRTAGNHIDVQLSGNGGDPVAEAREVGVNYGRVANDLPDPAAVVQLLRDNGITMVRIYDTDDAVLRSFANTGIKLMVMLPNENLADAARSPSYAADWARRRVAAYLPATRIHAVSVGNEVFDSRPDLTPLLVPAMTNVHAALAQLGLADAIKVSTPLSFAAVAVSWPPSAGRFRDDIAQPVMRPMLEFLQRTGSYLTINLYPYFAYAAQPDKISRDYFLGNPNPGVRDPDTGLMYYSVLDAQRDATFSAMDKLGFTSLQAIPGETGSASAGRPKPGPRHNKPLHQPSWELAVGDDGDGVRVDPPAASKANAQAYNNNVINRVLAGRTGTPLRPDADMDVYIFALFNENQKGSGPDDIEANFGLFYPNMEKVYEFDFRGGGVPPAPGAESWCVANASVGESWLQAALEYACGHGADCSAIQPGATCFEPDTVVAHASYAFNSYYQRNGRSNGTCDFNGAGYIVYQEPAGTCDPNASWCVANAAVGDARLLDGLNYACANGADCSTIQPGAPCFEPNTMVAHASHAFNSYYQRNRRASGTCDFAGAASVVYRAPKYGNCVLPSKASIEETIAKSEGEAAI

SEQ ID NO: 16248 - DNA, 1983 bp, Sorghum bicolor
  misc_feature: Ceres ANNOT ID no. 8656070
  misc_feature: Encodes the peptide sequence at SEQ ID NO 16249
atggctccccacctcctggccgtggccgtggccgtgtccgccatcatcgccgccgtatcgctgctcgcgcccggcgccgctggctacccgtggccattttgtggcacgagcaacgacttcaagcccaacagcacataccaggccaacctcaacctcctcgccgccacgctgcccaagaacgtctcggcgtccccgaccctctacgccaccgccgtcgtcggcgccgtcccggagcaggtctgggccatggggctctgccgcggcgacaccaacgccagcagctgcctcgcctgcctcacccaggcgttccaggacctgcccaacgactgctcctacaacaaggacgccaccatctactacgacccctgcatcctccactactccgacgtccacaccctccccgacgacgacaccggcccgacgacactgtcctacaccgtcaacaacaacgccaacgtcacctccgacccggcccggttcgagcgcctcctcgccgccctcgtcaacgccaccgccgagcacgccgcgtacaactccacgcggcggttcgccacgggggaggccgacttcgaccaggagttccccaaggtgtacaccctggcgcagtgcacgccggaccagacgccggcgctgtgccgcaagtgcctcgccgggctcatatcgcagtcgctagacgggttccagagcaatatcggaggcagggtgctctgggtcaactgcacctggcgatacgagaccgcgcccttcttcaatggaccggccatggtgcggctggcaacgtcgagccctccagcgccagcgccggctgggacgacgacggcagcggcaggaggaggggagaggaagtacagtgtgttcattgtggttcttgcagttgtgctgcctactcttgctgccctaaaccttgtgttttgcttctgtttctggaggcggcggcgacaagtagcacaagcaaagcagtcacaggccatgtattccactgaagcagaggacatggagacggtggactccatgatgatcgacatctccaccctacgagccgcaacagggaatttcgacgaaacaaacaagctcggtgaaggcggatttggcgcggtgtacaagggcgttctcccggacggcgacgagatagcggtgaagcggctgtcgaagagctcgacacagggagtggaggagctgaagaacgagctcgcgttggtcgccaagctgaagcacaggaacctcgtcagactcgtcggcgtgtgcctggagcagcaagaacgactgctcgtgtacgagttcgtccccaaccggagtctcgacctgatactcttcggtactactgataaacgtgagcagcagcttagctgggagcagaggtacaagatcataaacggcatcgctcgaggcttgcagtacctccatgaggactcccagctcaaagtagtccaccgtgatctcaaggccagcaacatcctgctagacgtggagatgaaccccaagatctcagattttggcctcgcgaggatcttcagtcgagaccaaacacaggccatcaccagccgcgttgttggaacctatgggtacatggcgccagaatacctaatgcgcgggaactactcggtgaaatcggacgcgttcagcttcggcgtcatggtgctggagatcgtcaccgggaggaagaaccacgacagcttccaccacaactcccagaagtctggagacctcttgaccaccgtatgggagcactgggaggccgggacagtggcggagctggtggatccatccctgggcggaagcttcccggagggcgacgtgctgaggtgcatccacatcggcctgctctgcgtccagggagaccccgcggcccggccggtgatgtcgtccgtcgtcatgatgcttggaaccgacacagtcaccctccaggctccatccaagccgggattcttcgccagaaagagtggcactaacacgaccgtgtccgctgatgtgtcgtcgatttag

SEQ ID NO: 16249 - protein, 660 aa, Sorghum bicolor
  misc_feature: Useful for making plants with modulated biomass
  misc_feature: Functional homolog of the protein sequence given in SEQ ID NO 14141
  misc_feature: Useful for making plants with altered cell wall content and/or composition
  misc_feature: Functional homolog of the protein sequence given in SEQ ID NO 14359
  misc_feature: Useful for making plants with altered carbohydrate content
  misc_feature: Functional homolog of the protein sequence given in SEQ ID NO 14360
  misc_feature: Ceres ANNOT ID no. 8656070
  misc_feature: Up-regulated in shoot tissues in response to methyl jasmonate treatment
  misc_feature: Up-regulated in root tissues in response to methyl jasmonate treatment
  misc_feature (308)..(630): SWISSPROT Homolog: EC 2.7.11.1 Non-specific serine/threonine protein kinase
  misc_feature (352)..(625): Pfam ID: Pkinase Pfam Description: Protein kinase domain
MAPHLLAVAVAVSAIIAAVSLLAPGAAGYPWPFCGTSNDFKPNSTYQANLNLLAATLPKNVSASPTLYATAVVGAVPEQVWAMGLCRGDTNASSCLACLTQAFQDLPNDCSYNKDATIYYDPCILHYSDVHTLPDDDTGPTTLSYTVNNNANVTSDPARFERLLAALVNATAEHAAYNSTRRFATGEADFDQEFPKVYTLAQCTPDQTPALCRKCLAGLISQSLDGFQSNIGGRVLWVNCTWRYETAPFFNGPAMVRLATSSPPAPAPAGTTTAAAGGGERKYSVFIVVLAVVLPTLAALNLVFCFCFWRRRRQVAQAKQSQAMYSTEAEDMETVDSMMIDISTLRAATGNFDETNKLGEGGFGAVYKGVLPDGDEIAVKRLSKSSTQGVEELKNELALVAKLKHRNLVRLVGVCLEQQERLLVYEFVPNRSLDLILFGTTDKREQQLSWEQRYKIINGIARGLQYLHEDSQLKVVHRDLKASNILLDVEMNPKISDFGLARIFSRDQTQAITSRVVGTYGYMAPEYLMRGNYSVKSDAFSFGVMVLEIVTGRKNHDSFHHNSQKSGDLLTTVWEHWEAGTVAELVDPSLGGSFPEGDVLRCIHIGLLCVQGDPAARPVMSSVVMMLGTDTVTLQAPSKPGFFARKSGTNTTVSADVSSI

SEQ ID NO: 16250 - DNA, 2241 bp, Sorghum bicolor
  misc_feature: Ceres ANNOT ID no. 8656072
  misc_feature: Up-regulated in shoot tissues in response to methyl jasmonate treatment
  misc_feature: Up-regulated in root tissues in response to methyl jasmonate treatment
  misc_feature: Encodes the peptide sequence at SEQ ID NO 16251
atggcgctggctcacttcctcggggcggcattgccgctactcctcctccgtgcagcagaggccgccggcgaggtgggcgtgaactacggtagggtggcgtacgacctgccggacccggcgtcggtggtgcagctgctcaagcagaacggcatcaccatggtgaggctgtacgacgccaaccccaaggtgctggcgtcgctggccaacacgggcatcaaggtgctggtgatgctgcccaacgaggagctcgccgccgcggcctccgacccgtcctacgcgctccggtgggcgcggagcaacgtggcggcgttctacccggccacgcgcatccacggcgtctccgtgggcaacgaggtgttcgactccaggccggacctgaacgcggacctcgtcgccgccatgaccaacgtgcacgacgcgctggcgcagctcggcctcgccgacgccgtcaaggtgtccacccccgtcgccttctcggcggtcacggactcgtacccgccgtcgtcgggcaggttccgggacgacatcgcgcagagcgtgatgaagcccatgctagggttcctggagaggacgggctcctacctcaccatcaacatctacccctacttggcgtacgccgagcatcccgaccaaatctccctcgactacgccctggggaactcgaaccccggcgtgcgtgtcgacgacgacgacgacgatacggccggcctcacgctcgacgacgacgacgacaacgacggcggcggcgtcacgtactacagcctcctggacgcccagctcgacgccacgtactatgccatggatgacctggggttcaccagtctgaaagcacatgttggggagactgggcatccgtcggccggaaaacccaaaactgggcggcggccgccacgcggaggacggaggcatttgatggccggggacgacgacggcgacgggtaccccgttgcgtcggtagccaatgcccatgcgtacgtcaacaacgtcatcaaccgcgtgctgtccggcaaaacgggcaccccgcaccggcccgacgcggacatggacgtctacatcttcgcgcttttcaatgagaaccagaaaggcgacgggccggacgacatcgagcagaacttcgggctgttctacccgaacgagcagaaggtgtacgaattcgacttccacggcggcggcggcggtggtggcgcgaaggcgagctggtgcgtggcgaacgcggccgtcggggactcacggctgcagacggcgctggactatgcgtgcggccacggcgcggactgcagcgccatccagcccggcgcggcgtgctacgaacccaacaccaagcttgcccatgcctcctatgcattcaacgattactaccagaagaacggccgggccagcgggacttgtgacttcgccggtgccgccaacgtcgtctaccaggcgccagccgacacctgcaacgcggcaaaggcgatgagctggtgtgtggcgaacacggcagtcggtgacgcgcggctgcaggcggctctggactacgcatgcggacacggcgcggactgcggcgccatccagcccggcgcgacgtgcttcgcgccggacaccaaggccgcccacgcctcgtacgcgttcaacgactactaccagcgcaagggccgggcaagcgggacgtgcgacttcgccggcgctgcttccgttgtctaccagcaaccagccggcgcctgcgacgccaagtcgagctggtgcgtggcgaacgcggccgtcggggacgcgcggctgcaggcggcactggactacgcgtgcggccacggcgcggactgcagcgccatccagcccggtgccacgtgcttccagccggacaccaaggccgcgcacgcctcgcatgccttcaacagctactaccagcgcaatggccgggccagcggcacctgcgacttcgccggcgctgcctccgtcgtctaccaggcgccaatgcacaagctgacaagcaaacgcgccacctctaagtcgccggcgtgcgtgatgaagctgctcgagattaatggcaggctttttgtcgccggcatcgcccctggcaccagtgacgccgacatcggccgccacttctgccgctacggagaggtgtccgacgtctgccaacccaaggaccgattcaccggctgcccccgtggcttcgtgttcgtgcaattcccccgccccattgacgccggccgcgccctcgccgacccacaccacgtcatcaacggccagcatgatagataa

SEQ ID NO: 16251 - protein, 746 aa, Sorghum bicolor
  misc_feature: Useful for making plants with altered carbohydrate content
  misc_feature: Functional homolog of the protein sequence given in SEQ ID NO 14358
  misc_feature: Ceres ANNOT ID no. 8656072
  misc_feature (26)..(227): SWISSPROT Homolog: EC 3.2.1.39 Glucan endo-1,3-beta-D-glucosidase
  misc_feature (399)..(482): Pfam ID: X8 Pfam Description: X8 domain
  misc_feature (487)..(570): Pfam ID: X8 Pfam Description: X8 domain
  misc_feature (573)..(668): Pfam ID: X8 Pfam Description: X8 domain
  misc_feature (25)..(387): Pfam ID: Glyco_hydro_17 Pfam Description: Glycosyl hydrolases family 17
  misc_feature (677)..(746): Pfam ID: RRM_1 Pfam Description: RNA recognition motif. (a.k.a. RRM, RBD, or RNP domain)
MALAHFLGAALPLLLLRAAEAAGEVGVNYGRVAYDLPDPASVVQLLKQNGITMVRLYDANPKVLASLANTGIKVLVMLPNEELAAAASDPSYALRWARSNVAAFYPATRIHGVSVGNEVFDSRPDLNADLVAAMTNVHDALAQLGLADAVKVSTPVAFSAVTDSYPPSSGRFRDDIAQSVMKPMLGFLERTGSYLTINIYPYLAYAEHPDQISLDYALGNSNPGVRVDDDDDDTAGLTLDDDDDNDGGGVTYYSLLDAQLDATYYAMDDLGFTSLKAHVGETGHPSAGKPKTGRRPPRGGRRHLMAGDDDGDGYPVASVANAHAYVNNVINRVLSGKTGTPHRPDADMDVYIFALFNENQKGDGPDDIEQNFGLFYPNEQKVYEFDFHGGGGGGGAKASWCVANAAVGDSRLQTALDYACGHGADCSAIQPGAACYEPNTKLAHASYAFNDYYQKNGRASGTCDFAGAANVVYQAPADTCNAAKAMSWCVANTAVGDARLQAALDYACGHGADCGAIQPGATCFAPDTKAAHASYAFNDYYQRKGRASGTCDFAGAASVVYQQPAGACDAKSSWCVANAAVGDARLQAALDYACGHGADCSAIQPGATCFQPDTKAAHASHAFNSYYQRNGRASGTCDFAGAASVVYQAPMHKLTSKRATSKSPACVMKLLEINGRLFVAGIAPGTSDADIGRHFCRYGEVSDVCQPKDRFTGCPRGFVFVQFPRPIDAGRALADPHHVINGQHDR

SEQ ID NO: 16252 - DNA, 1662 bp, Sorghum bicolor; identical to SEQ ID NO: 16234
  misc_feature: Ceres ANNOT ID no. 8656062
  misc_feature: Encodes the peptide sequence at SEQ ID NO 16253

SEQ ID NO: 16253 - protein, 553 aa, Sorghum bicolor; identical to SEQ ID NO: 16235
  misc_feature: Useful for making plants with altered carbohydrate content
  misc_feature: Functional homolog of the protein sequence given in SEQ ID NO 14358
  misc_feature: Useful for making plants with modulated drought sensitivity
  misc_feature: Useful for making plants with modulated water use efficiency
  misc_feature: Functional homolog of the protein sequence given in SEQ ID NO 13472
  misc_feature: Ceres ANNOT ID no. 8656062
  misc_feature (29)..(460): SWISSPROT Homolog: EC 3.2.1.39 Glucan endo-1,3-beta-D-glucosidase
  misc_feature (29)..(366): Pfam ID: Glyco_hydro_17 Pfam Description: Glycosyl hydrolases family 17
  misc_feature (465)..(549): Pfam ID: X8 Pfam Description: X8 domain
  misc_feature (379)..(462): Pfam ID: X8 Pfam Description: X8 domain

SEQ ID NO: 16254 - DNA, 900 bp, Sorghum bicolor
  misc_feature: Ceres ANNOT ID no. 8656079
  misc_feature: Encodes the peptide sequence at SEQ ID NO 16255
atggcctcccccgagggaaccacgtgggtcttcgactgtcccctcatggacgacctcgcggtggccgccgacttcgcggcagcccccgcggggggatttttctgggcagcgccgccgtcgctacagccgcaggaatcgtgtatgcacaacagaacaagtggaagaactagttacacgggccctctctgtttccaatttactatatcagcgtggccctgtggaagcgcggaaggtgtgggctctgtgttggttctactagtagtgctgtgtgagaggactgaggaaatggttcacactggatgggtcagtggacctttacttgtggaaatcagtagctctgtggactgtggtcagggaaaagaacagccaacaaataaacgtcctaggtcagaaagtaccgcagaaccaagcacaaaagcatccagggagaaaattagaagggataagctgaacgagagattcctggaattgggtgccattttggagccagggaaaactcctaaaatggacaagtcagctatattaaatgatgctattcgtgtagtaggtgaattgcgtagcgaagcaaaagagctcaaggattcaaatgagagcctacaagagaagattaaagagctaaaggctgagaagaatgagctgcgagacgagaagcaaaggctgaaggccgagaaggagagcctggagcagcagatcaagttcctgaatgcccgcccaagtctggtaccacaccacccagtgatctcagcctctgccttcactgctccccaggggccggcagtcgccgggcacaagctgatgatgcctgtgcttggctaccctggattcccgatgtggcagttcatgccgccttctgatgttgacacctctgatgaccccaagtcttgcccacctgtggcgtaa

SEQ ID NO: 16255 - protein, 299 aa, Sorghum bicolor
  misc_feature: The sequence is a functional homolog of SEQ ID NO 1203 in the 11/479,226 US patent application
  misc_feature: The sequence is a functional homolog of SEQ ID NO 2422 in the 10/374,780 US patent application
  misc_feature: The sequence is a functional homolog of SEQ ID NO 542 in the 10/412,699 US patent application
  misc_feature: The sequence is a functional homolog of SEQ ID NO 814 in the 10/225,066 US patent application
  misc_feature: Useful for making plants with altered lignin content
  misc_feature: Functional homolog of the protein sequence given in SEQ ID NO 12959
  misc_feature: Ceres ANNOT ID no. 8656079
  misc_feature (135)..(186): Pfam ID: HLH Pfam Description: Helix-loop-helix DNA-binding domain
MASPEGTTWVFDCPLMDDLAVAADFAAAPAGGFFWAAPPSLQPQESCMHNRTSGRTSYTGPLCFQFTISAWPCGSAEGVGSVLVLLVVLCERTEEMVHTGWVSGPLLVEISSSVDCGQGKEQPTNKRPRSESTAEPSTKASREKIRRDKLNERFLELGAILEPGKTPKMDKSAILNDAIRVVGELRSEAKELKDSNESLQEKIKELKAEKNELRDEKQRLKAEKESLEQQIKFLNARPSLVPHHPVISASAFTAPQGPAVAGHKLMMPVLGYPGFPMWQFMPPSDVDTSDDPKSCPPVA

SEQ ID NO: 16256 - DNA, 2049 bp, Sorghum bicolor
  misc_feature: Ceres ANNOT ID no. 8656076
  misc_feature: Encodes the peptide sequence at SEQ ID NO 16257
atgcacagcgggcgcgcccttcgcgcccccgcccagcttgcagcggcagcagcgctgctggcggcggccgtgacgctcacgcttgtctcctccgcggcggcgcaggcgtgggtgggtccgtggccgacgtgcgacgacaccacgggcaactactcggccggcagcgcctacgccaacaacaccaagcagctcatcctcaacctccagaagaacgcgtccaacacgcccgcgctgttcgcgacgggctccgtcggcgtgggcggcgcggacgacgccgtctacgggctcatactctgccgcggcgacctcagcgccaccgactgcttcgactgcggcaccaacgctggccaggacgtgtaccgcgtctgcaacggcagccgggacgccgcgctcgtctacaaccaatgctacgtccgcatcgcccccacggacttcctcgcctccaccgacaacaccggcttcaagggcctcatcggctaccgcgtccccgctggcgtcgacgacgtcgcggcctacgacggcgccgtcaccaggctgctcaacgccaccgtgcaatacgcggtggacagcggctccgcccagtcgtcgtctccgaggaaatacttcgccacggggcagatggtggggctcgacccacagctgcagctcccgacgggcatctggtccatggcgcagtgcgcgggggacatatcgccggcgcagtgccggagctgcctggacgacctgttggcgcagtggtgggacgtccagtttgaccgccggcaggtgggcgccaggctcgccggttcgcgctgcaacctgaggatcgaaggggaaaacttctacaccggcagcccgatgctgaagctgcagatgaacggagcgccggcgccttcaactgatgttgtaccgggcaccaccggaggtaaaaggaattcagctggcaaacttctcagaattatattgccaatagcatttatcgttgcagtagctgtcgtagccctttgcatatggattgtttgtaagaagagaacatctcaaggaacaaatctttcccaccaaacttatatggttgaggacatcgaaagcatcaagtcgatattgttatcattgtcatcactacaagtagcaacaaataactttgatgaaagcaataaactaggtgaaggggggtttggtgcagtttacaagggagatctttttggacgagaagtggccgtgaagaggctgccaaagggttcagatctggggctagaagaactaaaaaatgagctagttttggtgtccaaacttcatcacaaaaaccttgttcgattggagggtttctgcttagaagagggagagaggttgctcgtctatgagtacatgcccaacaaaagtctcgacaatattctttttgatcatgaggagaaaagacaactagattggaggaaacgattcaagataatagaaggagttgcacgtggattgcaatatcttcatgaagactctcagaagaagatagttcaccgtgacttgaaagcgagcaacattttattagattcagatatgaaccctaagattggtgactttggactagccaggctctttgggcaagaccagactcgaggcatcacaaaccacatcattggaacatttggctacatgtctcccgagtatgtgatgcgtggacaatactccacaaaatcagatgtatttagttttggcatacttgttatagagattgtaacaggacaaaaaaacactgggcattacgtcgatgagcaaaatgaggatattataagcattgtatggaagcactggtctgagggaacacttgcagagattatagatgattctctatggagaaactactcagagaatgaggtactaaaatgtgttaacattggcctatggtgccttcagcagagtccaatggatcgacccacgatgtcagatgttacggtgatgctcaacgatgatgatactactagttctctacctcctgctgcaagaccaacttttttcttggatgcaagctcaggttactcttacacttcgggtactatttcgcatccttctgcgaggtag

SEQ ID NO: 16257 - protein, 682 aa, Sorghum bicolor
  misc_feature: Useful for making plants with altered carbohydrate content
  misc_feature: Functional homolog of the protein sequence given in SEQ ID NO 14360
  misc_feature: Ceres ANNOT ID no. 8656076
  misc_feature (368)..(647): SWISSPROT Homolog: EC 2.7.11.1 Non-specific serine/threonine protein kinase
  misc_feature (374)..(644): Pfam ID: Pkinase Pfam Description: Protein kinase domain
MHSGRALRAPAQLAAAAALLAAAVTLTLVSSAAAQAWVGPWPTCDDTTGNYSAGSAYANNTKQLILNLQKNASNTPALFATGSVGVGGADDAVYGLILCRGDLSATDCFDCGTNAGQDVYRVCNGSRDAALVYNQCYVRIAPTDFLASTDNTGFKGLIGYRVPAGVDDVAAYDGAVTRLLNATVQYAVDSGSAQSSSPRKYFATGQMVGLDPQLQLPTGIWSMAQCAGDISPAQCRSCLDDLLAQWWDVQFDRRQVGARLAGSRCNLRIEGENFYTGSPMLKLQMNGAPAPSTDVVPGTTGGKRNSAGKLLRIILPIAFIVAVAVVALCIWIVCKKRTSQGTNLSHQTYMVEDIESIKSILLSLSSLQVATNNFDESNKLGEGGFGAVYKGDLFGREVAVKRLPKGSDLGLEELKNELVLVSKLHHKNLVRLEGFCLEEGERLLVYEYMPNKSLDNILFDHEEKRQLDWRKRFKIIEGVARGLQYLHEDSQKKIVHRDLKASNILLDSDMNPKIGDFGLARLFGQDQTRGITNHIIGTFGYMSPEYVMRGQYSTKSDVFSFGILVIEIVTGQKNTGHYVDEQNEDIISIVWKHWSEGTLAEIIDDSLWRNYSENEVLKCVNIGLWCLQQSPMDRPTMSDVTVMLNDDDTTSSLPPAARPTFFLDASSGYSYTSGTISHPSAR

SEQ ID NO: 16258 - DNA, 666 bp, Sorghum bicolor
  misc_feature: Ceres ANNOT ID no. 8656126
  misc_feature: Encodes the peptide sequence at SEQ ID NO 16259
atgccgcgccggcagagggcgcgcagtagcgaggagctcaaggcggaggacttcgtcgactcggtcctcaacttcggcggcggcggcgtgggcgacgaggatgacgaggagaaggaggccggcggggactcccagccgccggcggagttcaagtccaagaacctggaggccgagcgcaagaggcgcggcaagctcaaccgcaacatcctcgagctcaggtccgtcgtgcccaacatcaccaagatgagcaaggagtccaccctgtcggatgctattgatcacatcaagaagctccagaaccaggtcctcgagctgcagcgccagctcgcagactcacctggagaggcctgggagaagcagggcagcgcgtcgtgctctgaatcattcactgccactgaaaacatgccgtatcagggtcaaatcgagctggttcctctggggccatacaagtaccaccttaggatcttctgcaagaagaccggcgtcttcaccaaggtgctggaagcgctctgcagctacaatgcgcaggtcaccagcctgaacacgataacgttctatggctatgctgagagcgtcttcaccattgaggtgaaaggtgagcaggatgttgtgatggtggatctaaggagccttttatccaacattgtggaggtcccgagcaactga

SEQ ID NO: 16259 - protein, 221 aa, Sorghum bicolor
  misc_feature: Useful for biocontainment applications
  misc_feature: Functional homolog of the protein sequence given in SEQ ID NO 14361
  misc_feature: Ceres ANNOT ID no. 8656126
  misc_feature (52)..(99): Pfam ID: HLH Pfam Description: Helix-loop-helix DNA-binding domain
MPRRQRARSSEELKAEDFVDSVLNFGGGGVGDEDDEEKEAGGDSQPPAEFKSKNLEAERKRRGKLNRNILELRSVVPNITKMSKESTLSDAIDHIKKLQNQVLELQRQLADSPGEAWEKQGSASCSESFTATENMPYQGQIELVPLGPYKYHLRIFCKKTGVFTKVLEALCSYNAQVTSLNTITFYGYAESVFTIEVKGEQDVVMVDLRSLLSNIVEVPSN

SEQ ID NO: 16260 - DNA, 2676 bp, Sorghum bicolor
  misc_feature: Ceres ANNOT ID no. 8656135
  misc_feature: Encodes the peptide sequence at SEQ ID NO 16261
atggcccacgccgccgtggcagcgctcgccctgctcgtcttcttcagcgcgcaagcgcggcgggacggcgccggcgtatacgtcgtggacgcggcggcggcgctgtcgcaggggcactcgctgggcgccggcgacaagctggtgtcgtcagacggcaccttcgagctagccttcttcacgccgaccggggccgccgacccgtcgcggcggtacctgggcgtcatgtacgcgcagtccaacgagcagaccgtgccctgggtggccaaccgcgacgcgcccgtgagcgccggctcgtcgtactcggccaccgtcacggacgccggcgagctgcaggtgcttgagggcgaacgcgtggtctggcgcaccaactccgcgacgacggcctcctcctcctcctcctcgccggcgaacgtgacgctcaccctcctcgacaccgggaacctccagctgaccgcgggcgcaacggtgctctggcagagcttcgaccaccccgcggacaccttcctccccgggatgagcatcacgctcgaccggaccaacaggtccgccgtccgccggacgctgttcacgtcgtggcggagccccggggatcccggcaccggggacttcacgctggggcaggacccgctcggctccgcgcagctctacatctggcggaccggcggcgagaacaccaacagcacctactggcggtccgggcagtgggccaacaccaacttcgtgggcgtgccatggcggtcgctctacgtgtacggcttcaagctcaacggcgacccgtacaacgactccggtgtcatgtcctacgtcttcaacacgtacaacagctccgagtaccggttcatgctccactccaacggcaccgagacgtgctacatgctgctcgacaccggcgactgggagaccgtctggtcgcagccgaccatcccgtgccaggcctacaacatgtgcggcgccaacgcccggtgcgccggcggcggcggcggcgacgacggccagcaggccgtctgcacctgcttgacaggcttcgagccgaggaatgtgtcggagtacggcaacgggaactggacgcagggatgcgtcaggagctccccgctggcctgcagcagcgacgcgaacgtgagtggcggcggcggcggcgatggcttcgccgacctccccggcgtgaagctgcccaacttcgcggcgtggggatccacggtgggcgacgcggacgcgtgcaagcagtcgtgcctggccaactgctcgtgcggcgcgtacagctacagcggtggcaccggctgcctcacctggggacaggacctgctggacatctaccagttcccggatggagaaggatacgatctgcagatcaaggtccctgcatacttactagacagcagaccattggttttggatgttggcttaaagattacgtactttgacaatggcagatcagacgggctccagaagaaggcgatggacgacagttgccgttgctgtagttatcgtcgtggttgtattggcaggatgcggccttctcctgtggaaatgcaggagaagaatcaaagggagaagacaaagacgacaacgcagccgtctctgcttcctttgagggaagcacggcaggatttctcagggccgaaacaggttgatcaagaggaagcagagggcggcaagaagtgcgagctgcctctcttctccttggagatggttgcagcggccaccggcgacttcagcgccgacaacaagcttggagagggaggctttggccatgtctacaagggaagacttcccggtggcgaagaggttgcggtgaagaggctgtcccggggctcagggcaggggctggaggagttcaagaacgaggtgatcctgatcgccaagctgcagcaccgcaaccttgtgaagttgctaggttgctgcatccagggggaggagaagatcctggtctacgagtacatgcccaacaagagcctcgacgccttcctcttcgatccggcgcggcgagggctgctggactggaagacgaggttccacatcatcgagggcatcgcccgtggcctcctgtacctccaccgtgactcgcggctccgggtggtgcaccgggacctcaaggccagcaacatcctgctggaccgcgacatgaaccccaagatctccgacttcggcatggcgcggatcttcggcggcgaccagaaccaggtgaacacgaaccgcgtggtgggcacgctgggctacatgtcgcccgagtacgccatggagggcctcttctccgtgcgctccgacgtctacagcttcggcatcctcatcctggagatcgtctccgggcagaagaacagcagcttccaccgcatggagggctccctcaacatcgtcggccacgcgtggcagctctggaacgccgacagaggggagcagctcatcgacccggccatcctgccggcgtgccccgtgcgggaggcgctccgctgcgtgcacatggcgctgctgtgcgtgcaggaccacgcgtgcgaccgcccggacatctcctacgtcgtcatggcgctcggcagcgacagctccgtgctgccgatgcctaagccgccgacgttcacgctgcagtgcacgtcgtcggacagggacgggatcttcccggagagagtcgatgagtcctactccgcctgtgacctcaccgtcacaatgctgcatgggaggtag

SEQ ID NO: 16261 - protein, 891 aa, Sorghum bicolor
  misc_feature: Useful for making plants with altered cell wall content and/or composition
  misc_feature: Functional homolog of the protein sequence given in SEQ ID NO 14140
  misc_feature: Ceres ANNOT ID no. 8656135
  misc_feature (506)..(842): SWISSPROT Homolog: EC 2.7.11.1 Non-specific serine/threonine protein kinase
  misc_feature (571)..(842): Pfam ID: Pkinase_Tyr Pfam Description: Protein tyrosine kinase
  misc_feature (367)..(437): Pfam ID: PAN_2 Pfam Description: PAN-like domain
  misc_feature (81)..(199): Pfam ID: B_lectin Pfam Description: D-mannose binding lectin
  misc_feature (213)..(350): Pfam ID: S_locus_glycop Pfam Description: S-locus glycoprotein family
MAHAAVAALALLVFFSAQARRDGAGVYVVDAAAALSQGHSLGAGDKLVSSDGTFELAFFTPTGAADPSRRYLGVMYAQSNEQTVPWVANRDAPVSAGSSYSATVTDAGELQVLEGERVVWRTNSATTASSSSSSPANVTLTLLDTGNLQLTAGATVLWQSFDHPADTFLPGMSITLDRTNRSAVRRTLFTSWRSPGDPGTGDFTLGQDPLGSAQLYIWRTGGENTNSTYWRSGQWANTNFVGVPWRSLYVYGFKLNGDPYNDSGVMSYVFNTYNSSEYRFMLHSNGTETCYMLLDTGDWETVWSQPTIPCQAYNMCGANARCAGGGGGDDGQQAVCTCLTGFEPRNVSEYGNGNWTQGCVRSSPLACSSDANVSGGGGGDGFADLPGVKLPNFAAWGSTVGDADACKQSCLANCSCGAYSYSGGTGCLTWGQDLLDIYQFPDGEGYDLQIKVPAYLLDSRPLVLDVGLKITYFDNGRSDGLQKKAMDDSCRCCSYRRGCIGRMRPSPVEMQEKNQREKTKTTTQPSLLPLREARQDFSGPKQVDQEEAEGGKKCELPLFSLEMVAAATGDFSADNKLGEGGFGHVYKGRLPGGEEVAVKRLSRGSGQGLEEFKNEVILIAKLQHRNLVKLLGCCIQGEEKILVYEYMPNKSLDAFLFDPARRGLLDWKTRFHIIEGIARGLLYLHRDSRLRVVHRDLKASNILLDRDMNPKISDFGMARIFGGDQNQVNTNRVVGTLGYMSPEYAMEGLFSVRSDVYSFGILILEIVSGQKNSSFHRMEGSLNIVGHAWQLWNADRGEQLIDPAILPACPVREALRCVHMALLCVQDHACDRPDISYVVMALGSDSSVLPMPKPPTFTLQCTSSDRDGIFPERVDESYSACDLTVTMLHGR

SEQ ID NO: 16262 - DNA, 1533 bp, Sorghum bicolor
  misc_feature: Ceres ANNOT ID no. 8656188
  misc_feature: Encodes the peptide sequence at SEQ ID NO 16263
atgaagaggacgatcgttctgtaccccggcctcttcgtcagccatttcgtccccatgatgcagctcgccgacgccctcctggaggcgggctacgccgttgcggtggcgctcatcgacctcaccatggaccaggacgtcgccctggcagccgccgtcgaccgcgtcgcctccgccaagccgtcgccatcgccgtcggtcaccatccacaggctccctcggatccaaaatcctcccgcgatcacggactgcggcggcgacgcagtcctctggtacttcaagaccgtgagacgctacaacgtccgcctccgtgagttcctctgctccctgcagcagcagcagcctccccgaagcgtcgtccacgcggtgatcgtggacgggccctccgccgacgcgctcgacgtcaccaaggagcttggcgtcccggcctacaccttctacgccaccaacgcctccgccgtcgcggtgttcctgcagcttccgtggacccacgcggaaggccagggccagccaagcttcaaggagctcggagacacccgtctcagcgtcaccggcgtcccacccatgccggcgtcgtacctcatgccgtcgatgctccacgacccggccagtgagtcgtacaagacgatgatgcgcgtgatgcgccggaacccggagcccgatggcatcttggtgaacacgttcgcgtcgctggaggcccgggtgctgagagctctcagggacccactgttcctccccatcggcgacggcgacagcgacagcgacggcgggtgcatgaggacacctccggtgtactgcgtggggccgttgatcgttgcagccggcgacggcgagacgaaagaaaagcacgagtgcctcgcgtggctggacgagcaaccggagcgcagcgtcgtgttcctctgcttcggaagcttaggctccgccacccactcggcggagcagctcagggagatagccgtcggcctggagaggtccgggcaccggttcctgtgggtggtgcgggcgcctctccccaccggcggcgtggacacggggcctctgttcgacccgcgcgccgactcggacctccaagcgctcctgccgcccgggttcttggagaggaccagagctcgcggcctcgtcgtgaagctgtgggcgccgcaggtggacgtgctcaaccacagggccacaggtgccttcgtcacgcactgcgggtggaactcggtgatggaggcgatcacggccggagtgccgatgctttgctggcctatgtacgcggagcagaagatgaactcggtggtcatggtggaggaggtcggaatcggcgtggatttggttggatggcagcgggggctggtcaaggccgaggaggtggagggcaaggtgaggatggtgatggagtccgaggaaggggaggagctcagagcacgtgtggcggcgcacagggatgccgccgccgtggcctggaaggacggcggctcatcgcgcgcggcatttggccagttcttgtcggacgtcgacagccatgtacatgtacgaggcaaagatatggagtag

SEQ ID NO: 16263 - protein, 510 aa, Sorghum bicolor
  misc_feature: Useful for making plants with altered carbohydrate content
  misc_feature: Functional homolog of the protein sequence given in SEQ ID NO 14362
  misc_feature: Ceres ANNOT ID no. 8656188
  misc_feature (261)..(493): SWISSPROT Homolog: EC 2.4.1.218 Hydroquinone glucosyltransferase
  misc_feature (4)..(502): Pfam ID: UDPGT Pfam Description: UDP-glucoronosyl and UDP-glucosyl transferase
MKRTIVLYPGLFVSHFVPMMQLADALLEAGYAVAVALIDLTMDQDVALAAAVDRVASAKPSPSPSVTIHRLPRIQNPPAITDCGGDAVLWYFKTVRRYNVRLREFLCSLQQQQPPRSVVHAVIVDGPSADALDVTKELGVPAYTFYATNASAVAVFLQLPWTHAEGQGQPSFKELGDTRLSVTGVPPMPASYLMPSMLHDPASESYKTMMRVMRRNPEPDGILVNTFASLEARVLRALRDPLFLPIGDGDSDSDGGCMRTPPVYCVGPLIVAAGDGETKEKHECLAWLDEQPERSVVFLCFGSLGSATHSAEQLREIAVGLERSGHRFLWVVRAPLPTGGVDTGPLFDPRADSDLQALLPPGFLERTRARGLVVKLWAPQVDVLNHRATGAFVTHCGWNSVMEAITAGVPMLCWPMYAEQKMNSVVMVEEVGIGVDLVGWQRGLVKAEEVEGKVRMVMESEEGEELRARVAAHRDAAAVAWKDGGSSRAAFGQFLSDVDSHVHVRGKDME

SEQ ID NO: 16264 - DNA, 867 bp, Sorghum bicolor
  misc_feature: Ceres ANNOT ID no. 8656198
  misc_feature: Encodes the peptide sequence at SEQ ID NO 16265
atggcttcgtcagtggccgccgcggcgagcacattcctgggcacccgcctgtcggacccggcgccgcagaacgggcgcatcgtggcccggttcggcttcggaaagccgaaaaaggctgctgcccccaagaaggtgtccaagatctcctctgaccggccgctgtggttccccggcgccgtggcgcccgactacctcgacggcacgctggtcggcgactacggcttcgaccccttcgggctcgggaagcccgtggagtacctgcagttcgatttggactcgctggaccagaacctggccaagaatgagcccggcgtcgtcatcggcacccgcttcgagtcctccgacgtcaaatccaccccgttgcagccctacagcgaggtgttcggcctccagcggttccgcgagtgcgagctcatccacggccgctgggccatgctcgccaccctcggcgccctctccgtcgagtggctcaccggcgtcacctggcaggacgccggcaaggtggagctggtggacgggtcctcgtacctgggccagccgctgccgttctccatctcgacgctcatctggatcgaggtgctggtgatcggctacatcgagttccagcgcaacgccgagctcgacccggagaagaggctgtaccccggcggctcctacttcgacccgctcggcctggcggccgacccggagaagaaggagcggctgcagctggcggagatcaagcacgcgcgcctcgccatggtcgccttcctcggattcgccgtgcaggccgccgccaccggcaaggggccgctcaacaactgggccacccacctgagcgacccgctccacaccaccatcttcgacacgttcggagcatcctcttaa

SEQ ID NO: 16265 - protein, 288 aa, Sorghum bicolor
  misc_feature: Useful for making plants with modulated water use efficiency
  misc_feature: Functional homolog of the protein sequence given in SEQ ID NO 13861
  misc_feature: Useful for making plants with modulated biomass
  misc_feature: Useful for making plants with modulated drought sensitivity
  misc_feature: Useful for making plants with modulated phosphate use efficiency
  misc_feature: Functional homolog of the protein sequence given in SEQ ID NO 13527
  misc_feature: Ceres ANNOT ID no. 8656198
  misc_feature (60)..(258): Pfam ID: Chloroa_b-bind Pfam Description: Chlorophyll A-B binding protein
MASSVAAAASTFLGTRLSDPAPQNGRIVARFGFGKPKKAAAPKKVSKISSDRPLWFPGAVAPDYLDGTLVGDYGFDPFGLGKPVEYLQFDLDSLDQNLAKNEPGVVIGTRFESSDVKSTPLQPYSEVFGLQRFRECELIHGRWAMLATLGALSVEWLTGVTWQDAGKVELVDGSSYLGQPLPFSISTLIWIEVLVIGYIEFQRNAELDPEKRLYPGGSYFDPLGLAADPEKKERLQLAEIKHARLAMVAFLGFAVQAAATGKGPLNNWATHLSDPLHTTIFDTFGASS

SEQ ID NO: 16266 - DNA, 918 bp, Sorghum bicolor
  misc_feature: Ceres ANNOT ID no. 8656234
  misc_feature: Encodes the peptide sequence at SEQ ID NO 16267
atggcggggcgctacgacagcaaccccttcgaggaggaggacgtgaaccctttctcggaacaagcacgcggcaaggctggtgggcagtccaacttcggtggtggcgcgttttacatgcctaacccaagaaacgtgcctcctgcatccaattcacgcctttcaccacttcctcctgaaccggcagacttcagtgctacagtggatataccccttgactcgtcaaaagacctgaagagaagagagaaggagctgcaagctagggaagctgaattgaacaagagggagaaggagctaaaacggagagaggaggctgcagcaagagctggcattgtcattgaggagaaaaactggcctccttttctgccactcatccatcatgatatcaccaatgagataccgagtcaccttcaaagaatgcaatatgttgcatttgcgtcctttcttggattgatttgctgcctcttctggaatgtcatagcagttactacagcttggatcaagggggaaggtgttaagatctggttattggcaataatctacttcatatctggtgttcctggtgcatatgttttgtggtatcgtcctctgtataatgcaatgaggactgatagtgcattgaagtttggattgttcttcttgctttacttgttccacattcttttctgcgtattttctgctgtggctcctcctgttgtatttgagggaaaatcattagcgggaattttgccagcgattgatcttatcagcgtgaatgctttggttgggatattctactttgttggatttggattgttctgtctggaatcgttgctcagcatctgggtcatccagcaagtgtacatgtacttccgtggaagtggaaaggctgcagagatgaagcgtgatgcgacaaggggtgcaatgagagccgcattttaa

SEQ ID NO: 16267 - protein, 305 aa, Sorghum bicolor
  misc_feature: Useful for biocontainment applications
  misc_feature: Functional homolog of the protein sequence given in SEQ ID NO 13043
  misc_feature: Ceres ANNOT ID no. 8656234
  misc_feature (113)..(287): Pfam ID: SCAMP Pfam Description: SCAMP family
MAGRYDSNPFEEEDVNPFSEQARGKAGGQSNFGGGAFYMPNPRNVPPASNSRLSPLPPEPADFSATVDIPLDSSKDLKRREKELQAREAELNKREKELKRREEAAARAGIVIEEKNWPPFLPLIHHDITNEIPSHLQRMQYVAFASFLGLICCLFWNVIAVTTAWIKGEGVKIWLLAIIYFISGVPGAYVLWYRPLYNAMRTDSALKFGLFFLLYLFHILFCVFSAVAPPVVFEGKSLAGILPAIDLISVNALVGIFYFVGFGLFCLESLLSIWVIQQVYMYFRGSGKAAEMKRDATRGAMRAAF

SEQ ID NO: 16268 - DNA, 1383 bp, Sorghum bicolor
  misc_feature: Ceres ANNOT ID no. 8656258
  misc_feature: Encodes the peptide sequence at SEQ ID NO 16269
atgctccagggggtgctgtcccgcgcgcccgccaccgacgcggcggcagcggcagcgatgaaggccaagaggtcggccgcgtcccccggcgaagaggaggaaggggacggccgttctgcgcgcggtgggaagcggcaacagctgcttgcgcttggccccgccaccgctttggcgtcggcggtggcggcggaggaagggccggagacgcgaggcctgcggctgctcagcctgttgctgcggtgcgcggaggcggtggccatggaccagctgacggaggcgcgggagctgctcccggagatcgccgagctggcgtcgccgttcgggtcgtccccggagcgcgtggcggcctacttcggggacgcgctgtgcgcgcgcgtgctcagctcgtacctgggcgcctactcgccgctcgcgctccgccagctggcggccgcgcagagccgccgcgtggcggtggcgttccaggcgtacaacgcgctgtcgccgctcgtcaagttctcgcacttcacggccaaccaggccatcctgcaggcgctcgacggcgaggactgcctccacgtgatcgacctggacatcatgcagggcctgcagtggccggggctcttccacatcctcgcctcccgcccgcgcaagccgcgctcgctccggatcaccgggctcggcgcgtcgctcgacgtcctcgaggccacgggccgccgcctggccgacttcgcggcatccctcggactgccgttcgagttccaccccattgaggggaagatcgggcacgtcgccgacgccgcggcgctcctcggctcgcgccagcaccagaaccagcagcgggacgacgaggccaccgtggtgcactggatgcaccactgcctctacgacgtgacggggtcggacgtgggcacggtgcggctgctccggagcctgcgcccgaagctgatcaccatcgtggagcaggacctgggccacagcggcgacttcctgggccggttcgtggaggcgctgcactactactcggcactgttcgacgcgctgggagacggcgccggcgcggccgaggaggagtcggccgagcggtacgcggtggagcggcagctcctgggcgcggagatacggaacatcgtggccgtagggggacccaagcggaccggggaggtgcgcgtggagcggtggggcgacgagctgcggcgcgctgggttccggccagtgtccctggcggggagccctgccacgcaggccaggctgctcctcggcatgtacccgtggaaggggtacacgctggtggaggaggacgcgtgccttaggctcgggtggaaggacctctccctgctcaccgcgtcggcgtgggagccggcggacgacgcagccgcttctgcgcccaccaccaccagttaa

SEQ ID NO: 16269 - protein, 460 aa, Sorghum bicolor
  misc_feature: The sequence is a functional homolog of SEQ ID NO 438 in the 11/435,388 US patent application
  misc_feature: The sequence is a functional homolog of SEQ ID NO 431 in the 11/479,226 US patent application
  misc_feature: Ceres ANNOT ID no. 8656258
  misc_feature (48)..(353): Pfam ID: GRAS Pfam Description: GRAS family transcription factor
MLQGVLSRAPATDAAAAAAMKAKRSAASPGEEEEGDGRSARGGKRQQLLALGPATALASAVAAEEGPETRGLRLLSLLLRCAEAVAMDQLTEARELLPEIAELASPFGSSPERVAAYFGDALCARVLSSYLGAYSPLALRQLAAAQSRRVAVAFQAYNALSPLVKFSHFTANQAILQALDGEDCLHVIDLDIMQGLQWPGLFHILASRPRKPRSLRITGLGASLDVLEATGRRLADFAASLGLPFEFHPIEGKIGHVADAAALLGSRQHQNQQRDDEATVVHWMHHCLYDVTGSDVGTVRLLRSLRPKLITIVEQDLGHSGDFLGRFVEALHYYSALFDALGDGAGAAEEESAERYAVERQLLGAEIRNIVAVGGPKRTGEVRVERWGDELRRAGFRPVSLAGSPATQARLLLGMYPWKGYTLVEEDACLRLGWKDLSLLTASAWEPADDAAASAPTTTS

SEQ ID NO: 16270 - DNA, 1593 bp, Sorghum bicolor
  misc_feature: Ceres ANNOT ID no. 8656250
  misc_feature: Encodes the peptide sequence at SEQ ID NO 16271
atgtccagggggcgacggggcgagggcttgacggaatcgcggccggggcgcgcgcgcgcgggtgctgggcgcggccggtggcgagctgacacgcggtacgggcggcggcggggtacgtgtcgaggggcgacgggcccggggctctggggttcggtgcaacggagccatatttctcggggcaatgccttcggcacctcccactcttcccctgcccgcccgcctgcgcctccgtctccggccggctctcctccatcgctacgattcccccagggcgaaaccaccaaaaatcccagcgcagatcactcgccgggagggatccatcccgcggggccggtgatgaggtccatggagagcacggactcgtcgtccggcgagttgccaccaccgcagaagcagccgagctcggcgccggatctcccgccggggttccggttccatccgacggacgaggagctggtcgtccactacctcaagaagaaggctgcgtccgtgcctctacccgtcgccatcatcgccgaggtcgacctttacaagttcgatccgtgggagctacctgataaggcgaccttcggggagcaggagtggtacttcttcagcccgagggaccgcaagtaccccaacggagcgcggccgaacagggcggcgacgtccggctactggaaggcgactggcacagacaagcccatcatggcgtccggcggcaaccgcgagaaggtcggcgtcaagaaggcgctcgtgttctaccgcgggaagccgccaaagggcctcaagaccaactggatcatgcacgagtaccgcctcgcggatgcggcgagctcaaccaccagccggccgccgccgccatgcaacgtcggaggaggcaaggccacatctctcaggctcgacgactgggtgttatgccgcatctacaagaagatcaacaagcttggagccggcgagaggagcatggactgcgaggactccgtggaggacgcagtggcagcctacccgactcatgccgcggctgccatggccgccgccgtcgcaggcggaggaagggcggctcatcataacggcaatagttacacatcgctgatccaccaccatcacgaggacaacttcctggatggattcatgacagcagaggacacaggcctctcagcgggcgccagctccctgagccagctagccgcggcggcgagggcagctgctccagctgacaccaagcagctcctcgtcccgtcgtcctccaccaccccattcaactggctcgacgcgtccgcactcgcaattcttccaccctcaaagaggttccatgggtacaacagtggaggcacgtccactgacggcggcggcacgtccctgtcgtcgccgtccgagaggaataatctggcggctgccggtgccgtcgatagtggcgcctgcagcggtggcgctaatgccatcgttcctacattcctcaacccgctcggcgtgcaaggtgcgacaacctatcaccaccacgccattttcggcacaccagtaacgccggaagctgccgcggccgccgccaccaccgccacatgcggtttccagcatccctaccagctctccggcgtgaactggaacccgtga

SEQ ID NO: 16271 - protein, 530 aa, Sorghum bicolor
  misc_feature: The sequence is a functional homolog of SEQ ID NO 854 in the 10/374,780 US patent application
  misc_feature: Useful for making plants with altered cell wall content and/or composition
  misc_feature: Useful for making plants with altered lignin content
  misc_feature: Functional homolog of the protein sequence given in SEQ ID NO 13620
  misc_feature: Useful for making plants with modulated oxidative stress sensitivity
  misc_feature: Functional homolog of the protein sequence given in SEQ ID NO 13621
  misc_feature: The sequence is a functional homolog of SEQ ID NO 808 in the 10/225,066 US patent application
  misc_feature: The sequence is a functional homolog of SEQ ID NO 926 in the 11/435,388 US patent application
  misc_feature: The sequence is a functional homolog of SEQ ID NO 98 in the 10/374,780 US patent application
  misc_feature: Useful for making plants with altered alkaloid content
  misc_feature: Functional homolog of the protein sequence given in SEQ ID NO 14171
  misc_feature: The sequence is a functional homolog of SEQ ID NO 316 in the 10/412,699 US patent application
  misc_feature: The sequence is a functional homolog of SEQ ID NO 738 in the 11/479,226 US patent application
  misc_feature: The sequence is a functional homolog of SEQ ID NO 2060 in the 10/374,780 US patent application
  misc_feature: The sequence is a functional homolog of SEQ ID NO 516 in the 10/412,699 US patent application
  misc_feature: Useful for making plants with altered terpenoid content
  misc_feature: Functional homolog of the protein sequence given in SEQ ID NO 13966
  misc_feature: The sequence is a functional homolog of SEQ ID NO 891 in the 10/374,780 US patent application
  misc_feature: The sequence is a functional homolog of SEQ ID NO 102 in the 10/374,780 US patent application
  misc_feature: The sequence is a functional homolog of SEQ ID NO 886 in the 10/225,066 US patent application
  misc_feature: The sequence is a functional homolog of SEQ ID NO 2012 in the 10/374,780 US patent application
  misc_feature: The sequence is a functional homolog of SEQ ID NO 312 in the 10/412,699 US patent application
  misc_feature: The sequence is a functional homolog of SEQ ID NO 731 in the 11/479,226 US patent application
  misc_feature: The sequence is a functional homolog of SEQ ID NO 852 in the 10/374,780 US patent application
  misc_feature: The sequence is a functional homolog of SEQ ID NO 320 in the 10/374,780 US patent application
  misc_feature: The sequence is a functional homolog of SEQ ID NO 850 in the 10/225,066 US patent application
  misc_feature: Useful for making plants with modulated light quality sensitivity
  misc_feature: Functional homolog of the protein sequence given in SEQ ID NO 13618
  misc_feature: The sequence is a functional homolog of SEQ ID NO 2346 in the 10/374,780 US patent application
  misc_feature: The sequence is a functional homolog of SEQ ID NO 238 in the 10/225,068 US patent application
  misc_feature: The sequence is a functional homolog of SEQ ID NO 338 in the 10/412,699 US patent application
  misc_feature: The sequence is a functional homolog of SEQ ID NO 774 in the 11/479,226 US patent application
  misc_feature: Useful for making plants with modulated nitrogen use efficiency
  misc_feature: Functional homolog of the protein sequence given in SEQ ID NO 13624
  misc_feature: The sequence is a functional homolog of SEQ ID NO 1196 in the 10/412,699 US patent application
  misc_feature: The sequence is a functional homolog of SEQ ID NO 865 in the 10/374,780 US patent application
  misc_feature: Useful for making plants with altered carbohydrate content
  misc_feature: Functional homolog of the protein sequence given in SEQ ID NO 13622
  misc_feature: The sequence is a functional homolog of SEQ ID NO 328 in the 10/374,780 US patent application
  misc_feature: The sequence is a functional homolog of SEQ ID NO 852 in the 10/225,066 US patent application
  misc_feature: The sequence is a functional homolog of SEQ ID NO 2470 in the 10/374,780 US patent application
  misc_feature: The sequence is a functional homolog of SEQ ID NO 798 in the 10/225,066 US patent application
  misc_feature: The sequence is a functional homolog of SEQ ID NO 344 in the 10/666,642 US patent application
  misc_feature: Ceres ANNOT ID no. 8656250
  misc_feature: Up-regulated in root tissues in response to methyl jasmonate treatment
  misc_feature: Down-regulated in shoot tissues in response to methyl jasmonate treatment
  misc_feature: Up-regulated in root tissues in response to salicylic acid treatment
  misc_feature (139)..(268): Pfam ID: NAM Pfam Description: No apical meristem (NAM) protein
MSRGRRGEGLTESRPGRARAGAGRGRWRADTRYGRRRGTCRGATGPGLWGSVQRSHISRGNAFGTSHSSPARPPAPPSPAGSPPSLRFPQGETTKNPSADHSPGGIHPAGPVMRSMESTDSSSGELPPPQKQPSSAPDLPPGFRFHPTDEELVVHYLKKKAASVPLPVAIIAEVDLYKFDPWELPDKATFGEQEWYFFSPRDRKYPNGARPNRAATSGYWKATGTDKPIMASGGNREKVGVKKALVFYRGKPPKGLKTNWIMHEYRLADAASSTTSRPPPPCNVGGGKATSLRLDDWVLCRIYKKINKLGAGERSMDCEDSVEDAVAAYPTHAAAAMAAAVAGGGRAAHHNGNSYTSLIHHHHEDNFLDGFMTAEDTGLSAGASSLSQLAAAARAAAPADTKQLLVPSSSTTPFNWLDASALAILPPSKRFHGYNSGGTSTDGGGTSLSSPSERNNLAAAGAVDSGACSGGANAIVPTFLNPLGVQGATTYHHHAIFGTPVTPEAAAAAATTATCGFQHPYQLSGVNWNP

SEQ ID NO: 16272 - DNA, 1632 bp, Sorghum bicolor
  misc_feature: Ceres ANNOT ID no. 8656267
  misc_feature: Up-regulated in root tissues in response to methyl jasmonate treatment
  misc_feature: Down-regulated in shoot tissues in response to methyl jasmonate treatment
  misc_feature: Up-regulated in root tissues in response to salicylic acid treatment
  misc_feature: Encodes the peptide sequence at SEQ ID NO 16273
atgggcaactgctgcgtgacgccgaaaggagccgccgacgccggcggcggcaagaagaagtccaaggagcccaaggagccgaagcagaagaagggcaagaagcccaaccccttctcgatcgagtacaaccgcgcggcgccggcgagcgcgcccaggctggtggtgctgcgggagcccacggggcgggacatcgcggcgcggtacgagctcggcgccgagctcgggcgcggcgagttcggtgtcacctacctctgcaccgaccgcgcctcgggggaggcgctggcctgcaagtccatctccaagaagaagctccgcacccccgtcgacatcgaggacgtgcgccgggaggtggagatcatgcgccacctccccaagcaccccaacgtcgtcacgctcagggacacctacgaggatgacaatgccgtgcacctcgtcatggagctctgcgagggcggggagctcttcgaccgcatcgtggcgcggggacactacactgagcgcgctgccgccttggtcacacgcactatcgtcgaggtcgtgcagatgtgccataagcatggagtgatgcacagggatctcaaaccagaaaatttcttgtttgcgaacaagaaagaatcagcggcccttaaggccattgattttggcctgtctgtatttttcactccaggcgaacggtttactgagattgttggaagtccttattacatggctccagaggtgctaaagagaaactatggcccagaggttgatgtttggagtgcaggagtgattctgtacattcttctttgtggtgtccccccattctgggcagaaacggaacagggtgttgctcaggcaattatccgatctgccattgatttcaagagggatccatggccaagggtgtctgataatgccaaagaccttgtcagaggaatgctcaatccggatccaaaacgacgattgacagctcagcaagtgcttgatcacccatggttgcagaacattaagaaggctccaaatgtcaatctgggtgaaactgttaaggctagacttcaacaattctctgtgatgaacaagttcaagaagcatgcacttagggtcatagctgagcatctttcagtagaagaggctgctgacataaaggatatgtttgagaagatggatcttaacaaggatcaaatgcttagtttcgatgagctgaagcttggtctgcataagtttggtcaccaaatgcctgatgcagatgttcaaatactaatggaagctgcggatgctgatggaaatgggtccttggattatggagaatttgttacattatctgttcatctaagaaagattggaaatgatgagcatctgcataaggcatttgcatactttgaccggaacaagagtggttatattgaaatcgatgaactccgtgagtcattagctgatgaccttggacaaaatcatgaagaggttatcaatgccattatccgtgatgtagacactgataaggatggcaagataagctatgatgagtttgcggcgatgatgaaggccggaacagactggaggaaagcatcgagacagtattcgagagagcggttcaccaacctgagccttaagctgcaaaaggatggatcgttgcagatgacgagtacgcggtag

SEQ ID NO: 16273 - protein, 543 aa, Sorghum bicolor
  misc_feature: The sequence is a functional homolog of SEQ ID NO 2 in US patent 7084323
  misc_feature: Ceres ANNOT ID no. 8656267
  misc_feature: Down-regulated in shoot tissues in response to salicylic acid treatment
  misc_feature (38)..(539): SWISSPROT Homolog: EC 2.7.11.1 Non-specific serine/threonine protein kinase
  misc_feature (68)..(326): Pfam ID: Pkinase Pfam Description: Protein kinase domain
  misc_feature (481)..(509): Pfam ID: efhand Pfam Description: EF hand
  misc_feature (445)..(473): Pfam ID: efhand Pfam Description: EF hand
  misc_feature (373)..(401): Pfam ID: efhand Pfam Description: EF hand
MGNCCVTPKGAADAGGGKKKSKEPKEPKQKKGKKPNPFSIEYNRAAPASAPRLVVLREPTGRDIAARYELGAELGRGEFGVTYLCTDRASGEALACKSISKKKLRTPVDIEDVRREVEIMRHLPKHPNVVTLRDTYEDDNAVHLVMELCEGGELFDRIVARGHYTERAAALVTRTIVEVVQMCHKHGVMHRDLKPENFLFANKKESAALKAIDFGLSVFFTPGERFTEIVGSPYYMAPEVLKRNYGPEVDVWSAGVILYILLCGVPPFWAETEQGVAQAIIRSAIDFKRDPWPRVSDNAKDLVRGMLNPDPKRRLTAQQVLDHPWLQNIKKAPNVNLGETVKARLQQFSVMNKFKKHALRVIAEHLSVEEAADIKDMFEKMDLNKDQMLSFDELKLGLHKFGHQMPDADVQILMEAADADGNGSLDYGEFVTLSVHLRKIGNDEHLHKAFAYFDRNKSGYIEIDELRESLADDLGQNHEEVINAIIRDVDTDKDGKISYDEFAAMMKAGTDWRKASRQYSRERFTNLSLKLQKDGSLQMTSTR

SEQ ID NO: 16274 - DNA, 825 bp, Sorghum bicolor
  misc_feature: Ceres ANNOT ID no. 8656317
  misc_feature: Down-regulated in shoot tissues in response to salicylic acid treatment
  misc_feature: Encodes the peptide sequence at SEQ ID NO 16275
atggtctcgctccgcttccccaccgctgccatcccccgcctcccgccaacccaggcccccaacggcgtcgccgtcgccgccacggtcgccgctgcggccgcggccgcagctgcagcagcggccagtttgaccctcacggccaagtccgcaggccggccagccccgcaccccgcccctctctgggcctccctctccctggccgacggggcggcccccggctccgtcgaaccccggaccggcgtgacattccccactgaggccgccactgggcgccgcctactcggcgtaggcctccgcaagactagcgtactcgggctcaagtccatcgacgtctacgcattcggcgtgtatgcggatggcaacgatttgaaacagcagctgaaggagaagtacaataagttctcggcctcggaactgaaggcaaatgctgagctgatcaacgatacgctagagcgtgacatacagatgacggtcaggctgcagattgtttatgggaggctgagtattggctcggttcgcagcgcatttgagaagagtgtgggaagtaggcttcagaagttcggtggaaaagacaccaaagagttacttcagagctttgttgcacttttcaaggatgaatacaaattacccaaggggtctgtgattgagctttccagggaatcaaatcatgtgcttaaaatttgtattggaggcgaggaagtggggagcattcagagcgagctcttgtgccagtctctcttagatctttatattggagatgacccctttgacaaaaatgcaaaagatgacatccatgaaaatatagctagcattcttaaaagttaa

SEQ ID NO: 16275 - protein, 274 aa, Sorghum bicolor
  misc_feature: Useful for making plants with modulated heat sensitivity
  misc_feature: Functional homolog of the protein sequence given in SEQ ID NO 14363
  misc_feature: Ceres ANNOT ID no. 8656317
  misc_feature (57)..(272): SWISSPROT Homolog: EC 5.5.1.6 Chalcone isomerase
MVSLRFPTAAIPRLPPTQAPNGVAVAATVAAAAAAAAAAAASLTLTAKSAGRPAPHPAPLWASLSLADGAAPGSVEPRTGVTFPTEAATGRRLLGVGLRKTSVLGLKSIDVYAFGVYADGNDLKQQLKEKYNKFSASELKANAELINDTLERDIQMTVRLQIVYGRLSIGSVRSAFEKSVGSRLQKFGGKDTKELLQSFVALFKDEYKLPKGSVIELSRESNHVLKICIGGEEVGSIQSELLCQSLLDLYIGDDPFDKNAKDDIHENIASILKS

SEQ ID NO: 16276 - DNA, 825 bp, Sorghum bicolor; identical to SEQ ID NO: 16274
  misc_feature: Ceres ANNOT ID no. 8656321
  misc_feature: Encodes the peptide sequence at SEQ ID NO 16277

SEQ ID NO: 16277 - protein, 274 aa, Sorghum bicolor; identical to SEQ ID NO: 16275
  misc_feature: Useful for making plants with modulated heat sensitivity
  misc_feature: Functional homolog of the protein sequence given in SEQ ID NO 14363
  misc_feature: Ceres ANNOT ID no. 8656321
  misc_feature (57)..(272): SWISSPROT Homolog: EC 5.5.1.6 Chalcone isomerase

SEQ ID NO: 16278 - DNA, 1293 bp, Sorghum bicolor
  misc_feature: Ceres ANNOT ID no. 8656351
  misc_feature: Encodes the peptide sequence at SEQ ID NO 16279
atggcggcgtcggcgagggcgtgcttggttgcgctggcgctggtggccgcgctcatcctcgacggaccagcggcagcggcggcggaggaggggaatgccggaggccgcgggtcgctgacgctgaggcagcgccgccggcagctgctacggcagcggcaggtgcgcagccacctcaagcgcctcaacaaggcgccgctcgctaccattcagagtccagatggagacatcatagactgcgtgcatatctccaagcagcctgccttggatcaccccttccttaagaaccacaccatccagatgcggcctgcataccacccggaaggtctgtatgatgagtccaaggttgcatcgcagcagaacgcccaaacaatcacccaaatgtggcatcagaatggcaggtgccccgagaacacgataccgatcaggaggaccaaggaggaggacgtcctgagggccagctccgtcaggaggtatggcaagaagaagggcaagactaccgcgaaccccatgtcggttgaccctgacatgctcaacgagagcggccaccagcatgccatagcatatgtggagggcgataagtactatggcgccaaggctaccatcaatgtgtggcaaccgaagatcgagcaggctaatgagttcagcctgtcccagctctggatcttggggggctccttcggacaggacctcaacagcatcgaagcaggatggcaggttagcccagacctgtatggagacaacaacactaggctcttcacctactggactagcgatgcgtatcaagcaacaggatgctacaacctgctgtgctcggggttcatccagataagcaatcagatcgccatgggcgccagcatcttccctatctccaactatggtggttcccaatatgacatcaacattttggtctggaaggacccaaaggagggcaactggtggttgcagttcgggaacgactatgttctgggctactggccgtccttcctcttctcctacctggccgacagcgcctccatgatcgagtggggcggcgaggtggtgaactcagagcccgacggcagtcacaccaccacacagatgggcagcggacactttccggaggaagggttcggcaaggccagctacttcagaaacatccaagtggtggactcgaccaacaacctcaaggcgccaaagggcgtgggaaccttcaccgagcaatccaattgctacgacgtgcagaacggcaacaatggtgactggggcacctacttctactatggcggccccgggaagaactctaactgtccatag

SEQ ID NO: 16279 - protein, 430 aa, Sorghum bicolor
  misc_feature: Useful for biocontainment applications
  misc_feature: Functional homolog of the protein sequence given in SEQ ID NO 14085
  misc_feature: Ceres ANNOT ID no. 8656351
  misc_feature: Down-regulated in root tissues in response to methyl jasmonate treatment
  misc_feature: Down-regulated in shoot tissues in response to salicylic acid treatment
MAASARACLVALALVAALILDGPAAAAAEEGNAGGRGSLTLRQRRRQLLRQRQVRSHLKRLNKAPLATIQSPDGDIIDCVHISKQPALDHPFLKNHTIQMRPAYHPEGLYDESKVASQQNAQTITQMWHQNGRCPENTIPIRRTKEEDVLRASSVRRYGKKKGKTTANPMSVDPDMLNESGHQHAIAYVEGDKYYGAKATINVWQPKIEQANEFSLSQLWILGGSFGQDLNSIEAGWQVSPDLYGDNNTRLFTYWTSDAYQATGCYNLLCSGFIQISNQIAMGASIFPISNYGGSQYDINILVWKDPKEGNWWLQFGNDYVLGYWPSFLFSYLADSASMIEWGGEVVNSEPDGSHTTTQMGSGHFPEEGFGKASYFRNIQVVDSTNNLKAPKGVGTFTEQSNCYDVQNGNNGDWGTYFYYGGPGKNSNCP

SEQ ID NO: 16280 - DNA, 1011 bp, Sorghum bicolor
  misc_feature: Ceres ANNOT ID no. 8656347
  misc_feature: Down-regulated in root tissues in response to methyl jasmonate treatment
  misc_feature: Down-regulated in shoot tissues in response to salicylic acid treatment
  misc_feature: Encodes the peptide sequence at SEQ ID NO 16281
atggtggacgcacgcctcgcggcgcgcccaccccgcccgcgtgcccctgtccgcctcccgtttgccgcctccaccgcaacgcggcgcgcggggtggcggtgccctcgcgatcctcgtgtcgattccagcggcgggggtacctttccctttccctcccctggccgttgcccgcgcctcgcggtcgcgcaccggaaccggagccccgcggcgaatctaggtttgcctccgccccgccctctcctcccgacactcccggcggctggaattaggacgagggtaacaggggacggaggctgcgagggacgccccctcgtcgaatgcaccggcgaccgatctgttgaggagcagccggagcacgcaggagttgaggggaaagcattgaaaatgtcatctactgtgccgaagtcatcaaatatcttctggcatgattgtccagttggcaagactgatcgccagaagctactcaagcagaaaggctgtgttgtgtggattaccggccttagtggttcaggtaaaagtacgttggcatgtacattaggtcgggagctccacacaagagggaagcttgcatatgtccttgatggtgataacttaagacatggtctgaacaaggatcttggctttaacgctgaagatcgtgctgaaaatataaggagagttggtgaagtagcaaagttattttcagatgcgggccttgtatgtattgcaagtttgatatctccatataggagggaccgtgaatcttgccgtgcaatgttgtctgatggtagctttattgaagttttcttgaacatgtccttggaattgtgtgaagcaagggatccaaagggcctctataagcttgctcgtgcaggaaaaataaagggttttacaggaatagatgacccttatgaagcaccactgaattgcgagattgagatcaaagaagctgatggtgtatgcccttcgccttctgacatggcagggcaagtggttacttaccttgaggagaaaggcttcctgcacgagtag

SEQ ID NO: 16281 - protein, 336 aa, Sorghum bicolor
  misc_feature: Useful for making plants with modulated biomass
  misc_feature: Useful for making plants with modulated heat sensitivity
  misc_feature: Functional homolog of the protein sequence given in SEQ ID NO 13501
  misc_feature: Ceres ANNOT ID no. 8656347
  misc_feature (121)..(334): SWISSPROT Homolog: EC 2.7.1.25 Adenylyl-sulfate kinase
  misc_feature (158)..(313): Pfam ID: APS_kinase Pfam Description: Adenylylsulphate kinase
MVDARLAARPPRPRAPVRLPFAASTATRRAGWRCPRDPRVDSSGGGTFPFPSPGRCPRLAVAHRNRSPAANLGLPPPRPLLPTLPAAGIRTRVTGDGGCEGRPLVECTGDRSVEEQPEHAGVEGKALKMSSTVPKSSNIFWHDCPVGKTDRQKLLKQKGCVVWITGLSGSGKSTLACTLGRELHTRGKLAYVLDGDNLRHGLNKDLGFNAEDRAENIRRVGEVAKLFSDAGLVCIASLISPYRRDRESCRAMLSDGSFIEVFLNMSLELCEARDPKGLYKLARAGKIKGFTGIDDPYEAPLNCEIEIKEADGVCPSPSDMAGQVVTYLEEKGFLHE

SEQ ID NO: 16282 - DNA, 1353 bp, Sorghum bicolor
  misc_feature: Ceres ANNOT ID no. 8656368
  misc_feature: Encodes the peptide sequence at SEQ ID NO 16283
atgagagagatcatcagcatccacatcggccaggccgggatccaggtcggcaacgcctgctgggagctctactgcctcgagcacggcatcgagcccgatggcaccatgcccagtgatacctcggttggcgtcgcacatgatgccttcaacacgttcttcagtgagaccggttccggcaagcatgtgccgagggctattttcgtcgaccttgagcccactgtcattgacgaggttcgcactggctcgtaccgccagctcttccacccagagcagctcatctcggggaaggaggatgcagctaacaactttgcccgtggccactacactgttgggaaggagattgtcgatctatgcctggaccgcgtgcgcaagcttgcagacaactgcactgggctgcagggattcttggtgttcaatgctgttggtggtggtactggctctggacttggttcactgctactggagcgcctttcagttgattatggcaagaagtctaagctcggtttcaccatttatccttccccacaggtgtcaacagctgttgtagagccatacaacagtgtcctctcgacccactccttgcttgagcacactgatgttgcagtcctcctggacaacgaggctatctatgacatatgcaggaggtcccttgacatcgaaaggccaacctacaccaacttgaacaggttgatctcacagatcatatcatcacttaccacctccctgaggtttgatggtgctatcaacgtggatgttactgagttccagaccaaccttgtgccgtacccacgtatccatttcatgctttcctcatatgcccctgtaatctctgctgagaaggcctaccatgagcagctctctgtgcctgaaatcaccaatgctgtttttgagccctcaagcatgatggccaagtgtgacccaaggcacgggaagtacatggcttgctgcttgatgtaccgtggtgatgttgttcccaaggatgtcaacgctgctgttgcaaccatcaagaccaagagaactgtccagtttgtggactggtgccccactggattcaagtgtggcatcaactatcagccaccctctgttgtccctggaggtgacctggcaaaggtccagcgtgccgtgtgcatgatcagcaacaacactgccgttgccgaggtgttctcacgcattgaccacaaatttgaccttatgtacgccaagcgcgcattcgttcactggtacgtcggtgagggtatggaagagggtgagttctcagaggcccgtgaggacttggctgctcttgagaaggactatgaggaagtcggcgcagagggtgcagatgacgagggtgacgagggcgatgactattga

SEQ ID NO: 16283 - protein, 450 aa, Sorghum bicolor
  misc_feature: Useful for making plants with altered cell wall content and/or composition
  misc_feature: Functional homolog of the protein sequence given in SEQ ID NO 14092
  misc_feature: Ceres ANNOT ID no. 8656368
  misc_feature (49)..(246): Pfam ID: Tubulin Pfam Description: Tubulin/FtsZ family, GTPase domain
  misc_feature (248)..(393): Pfam ID: Tubulin_C Pfam Description: Tubulin/FtsZ family, C-terminal domain
MREIISIHIGQAGIQVGNACWELYCLEHGIEPDGTMPSDTSVGVAHDAFNTFFSETGSGKHVPRAIFVDLEPTVIDEVRTGSYRQLFHPEQLISGKEDAANNFARGHYTVGKEIVDLCLDRVRKLADNCTGLQGFLVFNAVGGGTGSGLGSLLLERLSVDYGKKSKLGFTIYPSPQVSTAVVEPYNSVLSTHSLLEHTDVAVLLDNEAIYDICRRSLDIERPTYTNLNRLISQIISSLTTSLRFDGAINVDVTEFQTNLVPYPRIHFMLSSYAPVISAEKAYHEQLSVPEITNAVFEPSSMMAKCDPRHGKYMACCLMYRGDVVPKDVNAAVATIKTKRTVQFVDWCPTGFKCGINYQPPSVVPGGDLAKVQRAVCMISNNTAVAEVFSRIDHKFDLMYAKRAFVHWYVGEGMEEGEFSEAREDLAALEKDYEEVGAEGADDEGDEGDDY

SEQ ID NO: 16284 - DNA, 1620 bp, Sorghum bicolor
  misc_feature: Ceres ANNOT ID no. 8656384
  misc_feature: Encodes the peptide sequence at SEQ ID NO 16285
atgaacaagaaagacctcagcctgatttacgagaggaaaaaaccttccttttctttagaagagatgatgcttttcctgagagcttctgagaagtgtccctggctcacagctaatcagatccttgggcacaaggatatgtcgtcgaagagactacatggcgtgtttacccttcttatgctcatggttttcaatgtttcaggggcgtttgttggtatcactattggcaatgacatgtcgaacatgccaccagcaacagatatagtgtctatcctcaaagcaaagaagactcagcatgttcgcctgcttgattcagaccatcagatgttgactgcccttgcaaatactggaatagaagtgatggttggggttccaaatgatcagctacttcgtgtgggccaatctcgttccacagctgctgattggattaataagaatgtcgctgcttacactccggcaactaacataacatatattgctgtgggcaatgaggtccttactaccattcccaatgcagcacttgttctcgtacctgcactgcaattcctccagtcagcacttttggctgcaaacctcaatactcaagtgaaaatttcgagtcctcattcaatggatgtgatctcgaaggcgtttcctccctctgctgccactttcaattcgacatggagctcaataatgtctcagtatcttgagtttctcaagaatacgggatcttcgtttatgctgaatgcccaaccatactatggctatgtcggagggcaaggcgtattccccttggagtatgcactattccgctcacttaatccgaacagtcaaatttcagatcctaacaccaatctcttttataccaatatgtttgatgctataattgatgctacctacaactcaattcaagcaatgaatttcacggggattcctgttttagtcacagcttctggttggccatggcgtggtgggccaagtgagaaggctgctactgttgataatgctttggcctacaatacaaacctcatacatcatgtactgaacaattctggtactcccagccaaccaaataatcagtcaagcacctacatctttgagctgttcaacgaggataatcggtcagggcctgtatcagagcaaaattgggggattatgtttcccaatgcaaccactatatactctctatcatttgaggacgtggccacaactattcctgaatcgccagctttgcgtggggtgttttgtgtggcaaattcaagtgcaccccatagtgcactgaagcatagtttggattgggcatgtggccctggttctgcaaactgcagtgcaattcaacctgggcaaccatgctatgcatcagatgatattgtagctgtttcttcttatgctttcaacgattattaccacagaacacagtctagtggtggtacatgcaacttcaatggcaccgcaatgataacatcaactgatccaagccatggttcatgcattttcgctggaagcactggcgccagtggcagcaaaggtggaacggcctccgggcctgcaagcccggacagttttgcttcaaaatcccaatcatgctggttgattcacctagtagccacattgctgcccattctatttgtagtgatgtaa

SEQ ID NO: 16285 - protein, 539 aa, Sorghum bicolor
  misc_feature: Useful for making plants with altered carbohydrate content
  misc_feature: Functional homolog of the protein sequence given in SEQ ID NO 14364
  misc_feature: Useful for making plants with altered cell wall content and/or composition
  misc_feature: Functional homolog of the protein sequence given in SEQ ID NO 14017
  misc_feature: Ceres ANNOT ID no. 8656384
  misc_feature: Down-regulated in shoot tissues in response to salicylic acid treatment
  misc_feature (57)..(490): SWISSPROT Homolog: EC 3.2.1.39 Glucan endo-1,3-beta-D-glucosidase
  misc_feature (70)..(391): Pfam ID: Glyco_hydro_17 Pfam Description: Glycosyl hydrolases family 17
  misc_feature (407)..(492): Pfam ID: X8 Pfam Description: X8 domain
MNKKDLSLIYERKKPSFSLEEMMLFLRASEKCPWLTANQILGHKDMSSKRLHGVFTLLMLMVFNVSGAFVGITIGNDMSNMPPATDIVSILKAKKTQHVRLLDSDHQMLTALANTGIEVMVGVPNDQLLRVGQSRSTAADWINKNVAAYTPATNITYIAVGNEVLTTIPNAALVLVPALQFLQSALLAANLNTQVKISSPHSMDVISKAFPPSAATFNSTWSSIMSQYLEFLKNTGSSFMLNAQPYYGYVGGQGVFPLEYALFRSLNPNSQISDPNTNLFYTNMFDAIIDATYNSIQAMNFTGIPVLVTASGWPWRGGPSEKAATVDNALAYNTNLIHHVLNNSGTPSQPNNQSSTYIFELFNEDNRSGPVSEQNWGIMFPNATTIYSLSFEDVATTIPESPALRGVFCVANSSAPHSALKHSLDWACGPGSANCSAIQPGQPCYASDDIVAVSSYAFNDYYHRTQSSGGTCNFNGTAMITSTDPSHGSCIFAGSTGASGSKGGTASGPASPDSFASKSQSCWLIHLVATLLPILFVVM

SEQ ID NO: 16286 - DNA, 678 bp, Sorghum bicolor
  misc_feature: Ceres ANNOT ID no. 8656386
  misc_feature: Down-regulated in shoot tissues in response to salicylic acid treatment
  misc_feature: Encodes the peptide sequence at SEQ ID NO 16287
atggcgtcccggcggaggctctcctcgacggcttccaggatccaaggaggcgtgaagtcccgcggtgatttgccattgccagagtggtcaccgaatctgtgccccgcggcggctatgtcctcgtcctccttccccaactcccgcttccccttcggcgccggcgccagggcccccggcggaagcggcggcggaggcgggagcagcgtgcggccgtgggggtcgagcggcgggacgtcggtgtcttcgtctgggaaacggatacagaaggagctgctggacctcaacgcctccgattgctccgcggggcccaagggcgacaatctctaccactggctatccaccatcatcggaccccaaggatcgccatatgaaggaggggtatttttccttgacatcgtgtttcctcctgattatcccttcaaacctcccatggtaactttcaaaacaaggatttaccactgcaatattgattccactggtaaagtgcatttggacattctgaaggatggctggagtccagctttcactatttcaaaggtgttattggccatcaaagacatcatcagcaatccagatccatacaccccgcttgtgatgaacatttcacgtcagtatctgactgatagagctaaacacgatgaaatagcagctgagtggacaatgagatttgcaagatag

SEQ ID NO: 16287 - protein, 225 aa, Sorghum bicolor
  misc_feature: Useful for making plants with modulated low light sensitivity
  misc_feature: Functional homolog of the protein sequence given in SEQ ID NO 14365
  misc_feature: Useful for making plants with modulated light quality sensitivity
  misc_feature: Functional homolog of the protein sequence given in SEQ ID NO 14366
  misc_feature: Useful for biocontainment applications
  misc_feature: Functional homolog of the protein sequence given in SEQ ID NO 13996
  misc_feature: Ceres ANNOT ID no. 8656386
  misc_feature (85)..(224): SWISSPROT Homolog: EC 6.3.2.19 Ubiquitin--protein ligase
  misc_feature (86)..(220): Pfam ID: UQ_con Pfam Description: Ubiquitin-conjugating enzyme
MASRRRLSSTASRIQGGVKSRGDLPLPEWSPNLCPAAAMSSSSFPNSRFPFGAGARAPGGSGGGGGSSVRPWGSSGGTSVSSSGKRIQKELLDLNASDCSAGPKGDNLYHWLSTIIGPQGSPYEGGVFFLDIVFPPDYPFKPPMVTFKTRIYHCNIDSTGKVHLDILKDGWSPAFTISKVLLAIKDIISNPDPYTPLVMNISRQYLTDRAKHDEIAAEWTMRFAR

SEQ ID NO: 16288 - DNA, 1110 bp, Sorghum bicolor
  misc_feature: Ceres ANNOT ID no. 8656408
  misc_feature: Encodes the peptide sequence at SEQ ID NO 16289
atggccttccacttccacccgctggccgccacgcgcgtccacctctccccactcccgttcgccgccgccgccgccgcgggggcgccctccccctcgtcctcctccgtcgccatcgcggcgccccaccaccaccacggccgccgccgcttctccgccgtcgtggccacggcggccgcctccgcggcggccaccacggagttcgacttcaaggcgtacatgggggagcgcgcggtcgcggtgaaccgtgcgctggacgcggccatccccgccggggaaccccccgccgcgctgcacgacgcgatgcggtacgcgctgctggcgggcgggaagcgcgtgcgcccggcgctgtgcctggccgcgtgcgccgtggtgggtgggcccgaggcctgggcgatgcccgccgccgcggccgtcgagatggtgcacaccatgtcgctcgtccacgacgacctcccctgcatggacgacgacgacctccgccgcggcaagcccacctgccacgtcgtctacggcgagcccatcgcggtcctcgccggggacgcgctgctctcgctctccttccaccacatggccagcgtcgggtcctaccctccggacgtagacccggagaagcatcccgcccgcgtcgtccgagccattggcgagctcgcgcgctgcatcggatcggagggactcgtcgccggccaggttgtcgatcttgagatgacgggcacatctgaacctgtgccccttgaacgccttgagtacatccatctccacaagactgccgcattgcttgaggcctcagtggtgattggggcaatcattggaggcggcacggatgagcaaattgagcggctgcgaaaatatgcgaggtcaatcgggctgctgttccaggtggtcgatgacattcttgatgtcaccaagtcgtcagaggagctcggcaagacggcagggaaggacttggcaagtgacaagacgacgtacccaaagctattggggttagaaaagtcacgcgagtttgcagaaaagttgctttctgatgcaatagagcagcttgattgtttcgacaaggagaaggcagcacctctgttgcatttggccaactatatcgcccataggcagaactga

SEQ ID NO: 16289 - protein, 369 aa, Sorghum bicolor
  misc_feature: Useful for making plants with altered protein content
  misc_feature: Useful for making plants with altered terpenoid content
  misc_feature: Useful for making plants with modulated nitrogen use efficiency
  misc_feature: Functional homolog of the protein sequence given in SEQ ID NO 14367
  misc_feature: Useful for making plants with modulated water use efficiency
  misc_feature: Functional homolog of the protein sequence given in SEQ ID NO 14368
  misc_feature: Ceres ANNOT ID no. 8656408
  misc_feature (67)..(369): SWISSPROT Homolog: EC 2.5.1.29 Farnesyltranstransferase
  misc_feature (97)..(365): Pfam ID: polyprenyl_synt Pfam Description: Polyprenyl synthetase
MAFHFHPLAATRVHLSPLPFAAAAAAGAPSPSSSSVAIAAPHHHHGRRRFSAVVATAAASAAATTEFDFKAYMGERAVAVNRALDAAIPAGEPPAALHDAMRYALLAGGKRVRPALCLAACAVVGGPEAWAMPAAAAVEMVHTMSLVHDDLPCMDDDDLRRGKPTCHVVYGEPIAVLAGDALLSLSFHHMASVGSYPPDVDPEKHPARVVRAIGELARCIGSEGLVAGQVVDLEMTGTSEPVPLERLEYIHLHKTAALLEASVVIGAIIGGGTDEQIERLRKYARSIGLLFQVVDDILDVTKSSEELGKTAGKDLASDKTTYPKLLGLEKSREFAEKLLSDAIEQLDCFDKEKAAPLLHLANYIAHRQN

SEQ ID NO: 16290 - DNA, 1017 bp, Sorghum bicolor
  misc_feature: Ceres ANNOT ID no. 8656409
  misc_feature: Encodes the peptide sequence at SEQ ID NO 16291
atggaggcggagaagaagacgccggcggtgtccgatgtgggcgcgtgggcgatgaacgtcgtcagctccgtcagtctcatcatggccaacaagcagctcatgtcctcctccggctacgccttcgccttcgccaccacgctgaccgggttccacttcacggtcacggcgctcgtcgggtggatctccaacgccaccggctactccgtctccaagcacgtcccgctctgggagctcgtctggttctcgctcgtcgccaacacctccatcaccgggatgaacctcagcctcatgctcaactccgtcggcttctaccagatctccaaattgagcatgattccggtcgtctgcctgatggaatgggtgctgaacagcaagcactacaccactaaggtcatatcggcagtgattgtcgtggccgccggtgtcgggatttgcacggtcacggatgtcgaggtcaatgccaagggattcatctgcgcttgcgtggcagtgttctgcacgtcgcttcaacagattaagaagtacaacattggatcatttgagctgctgagcaaaactgcaccaattcaggcactttcgcttgttatactgggcccctttgtggactactatctaaatggacggtcattgttgaactaccctttttcaggaggggcaactttcttcatactgctttcctgctccctggctgtcttttgcaacatgagccaatacctctgcatcggtcggttctcagcgacctcattccaggtcctgggccacatgaagaccgtgtgcgtgctgatcctcggctggatcctgtttgactcggccctcaccgtgaagaacatcctcgggatgctgcttgccgtgatgggcatggtggtctacagctgggccgtggaagcggagaagaaggcggcagccccgatcccccggaacaagagcgacatgctcgatggcgaggacgtacccctcaaggccagggtgagtggcgtgcccacgggcgacctcgaggacggcgagatgaagagctag

SEQ ID NO: 16291 - protein, 338 aa, Sorghum bicolor
  misc_feature: Useful for making plants with altered cell wall content and/or composition
  misc_feature: Functional homolog of the protein sequence given in SEQ ID NO 13788
  misc_feature: Ceres ANNOT ID no. 8656409
  misc_feature (156)..(292): Pfam ID: TPT Pfam Description: Triose-phosphate Transporter family
MEAEKKTPAVSDVGAWAMNVVSSVSLIMANKQLMSSSGYAFAFATTLTGFHFTVTALVGWISNATGYSVSKHVPLWELVWFSLVANTSITGMNLSLMLNSVGFYQISKLSMIPVVCLMEWVLNSKHYTTKVISAVIVVAAGVGICTVTDVEVNAKGFICACVAVFCTSLQQIKKYNIGSFELLSKTAPIQALSLVILGPFVDYYLNGRSLLNYPFSGGATFFILLSCSLAVFCNMSQYLCIGRFSATSFQVLGHMKTVCVLILGWILFDSALTVKNILGMLLAVMGMVVYSWAVEAEKKAAAPIPRNKSDMLDGEDVPLKARVSGVPTGDLEDGEMKS

SEQ ID NO: 16292 - DNA, 1320 bp, Sorghum bicolor
  misc_feature: Ceres ANNOT ID no. 8656414
  misc_feature: Encodes the peptide sequence at SEQ ID NO 16293
atgcagccgccgcacccggaggcggggcccgagcaggaggcggtgccggctccagtcaagaagaagcggaacctccccgggacgccagatccggacgccgaggtgatcgcgctctcgccggggacgctgctggccacgaatcgcttcgtgtgcgaggtctgcggcaagggcttccagcgggaccagaacctgcagctgcaccgccgcggccacaacctaccctggcggctgcggcagcgcgggccgggcgccgctccgccgcgccgccgggtttacgtgtgccccgagccaggctgcgtgcaccacgccccgacgcgagccctcggtgacctcaccgggatcaagaagcacttctgccgaaagcacggggagaagcgctgggcgtgcccgcgctgcggcaagcgctacgccgtccaggccgacctcaaggcgcacgccaagacctgcggcacccgcgagtaccgctgcgactgcggcacgctcttcaccagacgggacagcttcgtgacgcatcgcgccttctgcggcgctctcggggaggagaccggcagggtgctggcgccgccggagccaccgacccatccgtctccacctccattgccacaggagccaccgcgccaccagtctccacctccattgccgcaggagccaccacgccggctgtccccacccccgttgccaaaggagccaccgcgccggctgtccccacctccgttgccaaaggagccacggtgccgtccaactccacctccattgccaaaggaaccacagcggcttccgtttccactggagcagcagccagttgtggcattggtgccaaatctggatgatcccacattcctttgccttgcaattggagcgccctctatgttcccgcagacaagcgcaagcaattcaggcaccttcgccccgcctccggcgccacacatgtccgcgacagcgctcctgcagaaggcgacagaggctggagccacacaatcaagctcatcattcttgaaggagtttgggcttgcctcttcctctttgtcatcggcgatgctatctggcggtctcggccttggccttgcatacgaaagtggaaactcaggcttgccggacctggtgatgggaccatcaccactgttcggtcctaagcctgctgcaacgctggacttccttgggcttggcatcggagggaccatgggcggctccacggttgccaaccgtggcctcccggcattgatgattggaggagagctggacatggggtcttcggcacaggtgcctgcgccatgggaggacgccaagaggaagaccaacaacggccgcacgatcctgtga

SEQ ID NO: 16293 - protein, 439 aa, Sorghum bicolor
  misc_feature: Useful for making plants with altered lignin content
  misc_feature: Functional homolog of the protein sequence given in SEQ ID NO 13275
  misc_feature: The sequence is a functional homolog of SEQ ID NO 1087 in the 10/666,642 US patent application
  misc_feature: Ceres ANNOT ID no. 8656414
  misc_feature (49)..(71): Pfam ID: zf-C2H2 Pfam Description: Zinc finger, C2H2 type
  misc_feature (127)..(149): Pfam ID: zf-C2H2 Pfam Description: Zinc finger, C2H2 type
MQPPHPEAGPEQEAVPAPVKKKRNLPGTPDPDAEVIALSPGTLLATNRFVCEVCGKGFQRDQNLQLHRRGHNLPWRLRQRGPGAAPPRRRVYVCPEPGCVHHAPTRALGDLTGIKKHFCRKHGEKRWACPRCGKRYAVQADLKAHAKTCGTREYRCDCGTLFTRRDSFVTHRAFCGALGEETGRVLAPPEPPTHPSPPPLPQEPPRHQSPPPLPQEPPRRLSPPPLPKEPPRRLSPPPLPKEPRCRPTPPPLPKEPQRLPFPLEQQPVVALVPNLDDPTFLCLAIGAPSMFPQTSASNSGTFAPPPAPHMSATALLQKATEAGATQSSSSFLKEFGLASSSLSSAMLSGGLGLGLAYESGNSGLPDLVMGPSPLFGPKPAATLDFLGLGIGGTMGGSTVANRGLPALMIGGELDMGSSAQVPAPWEDAKRKTNNGRTIL

SEQ ID NO: 16294 - DNA, 696 bp, Sorghum bicolor
  misc_feature: Ceres ANNOT ID no. 8656416
  misc_feature: Encodes the peptide sequence at SEQ ID NO 16295
atggaggaatacgacgggctctttccttccgcctacgtggactcctcctcatccctcctggtgcccaacggcacggcgcagggggagaggccgagagcgcggcgcaggaggcgtcgagcaccgaggtgcggcggcggcggcgacctggacgggggaggggaccccaagaagcggcggctgagcgacgagcaggtagagatgctggaactgagcttccgggaggagcggaagctggagaccggccggaaggtgcacctggccgccgagctcggcctcgaccccaagcaggtcgccgtctggttccagaaccgccgcgcccgccacaagagcaagctgctcgaggaggagttcgccaagctcaagcaggcacacgacgccgccatcctccacaaatgccaccttgagaacgaggtgatgaggctgaaggagaggctggtgctcgccgaggaggagctgacgcgtttcagatccgcggggagccacgccgtctccggtgacggcggagacatcatgggccgtgccgtctgcagcgggagcccgagctcatcgttctcgacaggcacctgccaccagccgggcgtcgacgtcggcggcggcgatcacctgggggacgacgaccagctgctctacgttcctgactatgcctacgctgacaacagcgtggtcgagtggtttagcctgtatggactgatgtaa

SEQ ID NO: 16295 - protein, 231 aa, Sorghum bicolor
  misc_feature: The sequence is a functional homolog of SEQ ID NO 1857 in the 11/479,226 US patent application
  misc_feature: The sequence is a functional homolog of SEQ ID NO 246 in the 10/666,642 US patent application
  misc_feature: Ceres ANNOT ID no. 8656416
  misc_feature (56)..(110): Pfam ID: Homeobox Pfam Description: Homeobox domain
MEEYDGLFPSAYVDSSSSLLVPNGTAQGERPRARRRRRRAPRCGGGGDLDGGGDPKKRRLSDEQVEMLELSFREERKLETGRKVHLAAELGLDPKQVAVWFQNRRARHKSKLLEEEFAKLKQAHDAAILHKCHLENEVMRLKERLVLAEEELTRFRSAGSHAVSGDGGDIMGRAVCSGSPSSSFSTGTCHQPGVDVGGGDHLGDDDQLLYVPDYAYADNSVVEWFSLYGLM

SEQ ID NO: 16296 - DNA, 978 bp, Sorghum bicolor
  misc_feature: Ceres ANNOT ID no. 8656466
  misc_feature: Encodes the peptide sequence at SEQ ID NO 16297
atggctgctgcacgcagcagccatcgctttcgccactccaagctctcagtactgatcctggcactggccacggtggtggccgccgcacgggctcagctttcgccgacgttctacgcctcgtcgtgccctgccgcgctcgtcaccatcaagaccgccgtgcgggctgctctggtgctggaccggcgcatgggcgcctccctgctccggcttcacttccacgactgcttcgtgcagggctgcgacgcgtccgttctgctggacgacacgggcaacttcaccggggagaagagcgcgggcccgaacgcggggtcgctcagggggttcggcgtcatcgacaccatcaaggccctgctggaggcgctgtgcccgcggaccgtgtcgtgcgccgacatcctcgccgtcgccgcccgtgactctgtcgtcgcgctaggagggccatcgtggacggtgcagctcggcaggagggactccaccacggcgagcctctccaccgcgaacaccgacctcccctcgccggcgtccagcctgagcaccctgctcgccgcattcgccaggaaaggcctgagcagcaccgacatggtcgctctgtctggagcccacacggcggggcaggcgcagtgccagaactaccaggccaggatctacaacgacgccaacatcaacgcggccttcgcggcgtcgctgagggccggctgcccggccggcggcgggggcggcgcgaacgcgccgctggacgcgtccacgccgaacgcgttcgacaacgcgtactacggcgacctggtcgcgcagcaggggttgctgcactccgatcaagagctcttcaacggcggctccacggacggactggtcaggagctacgcagccagctcggcgcggttcagtagcgacttcgccgctgccatggtcaagatgggcggcattggtgtcataaccgggagcagcggagaggtccggcgcaactgccggagggtgaactag

SEQ ID NO: 16297 - protein, 325 aa, Sorghum bicolor
  misc_feature: Useful for making plants with altered cell wall content and/or composition
  misc_feature: Functional homolog of the protein sequence given in SEQ ID NO 13605
  misc_feature: Useful for making plants with altered carbohydrate content
  misc_feature: Functional homolog of the protein sequence given in SEQ ID NO 13662
  misc_feature: Ceres ANNOT ID no. 8656466
  misc_feature (34)..(325): SWISSPROT Homolog: EC 1.11.1.7 Peroxidase
  misc_feature (49)..(289): Pfam ID: peroxidase Pfam Description: Peroxidase
MAAARSSHRFRHSKLSVLILALATVVAAARAQLSPTFYASSCPAALVTIKTAVRAALVLDRRMGASLLRLHFHDCFVQGCDASVLLDDTGNFTGEKSAGPNAGSLRGFGVIDTIKALLEALCPRTVSCADILAVAARDSVVALGGPSWTVQLGRRDSTTASLSTANTDLPSPASSLSTLLAAFARKGLSSTDMVALSGAHTAGQAQCQNYQARIYNDANINAAFAASLRAGCPAGGGGGANAPLDASTPNAFDNAYYGDLVAQQGLLHSDQELFNGGSTDGLVRSYAASSARFSSDFAAAMVKMGGIGVITGSSGEVRRNCRRVN

SEQ ID NO: 16298 - DNA, 834 bp, Sorghum bicolor
  misc_feature: Ceres ANNOT ID no. 8656505
  misc_feature: Encodes the peptide sequence at SEQ ID NO 16299
atggctcagtttcttggaactgatgatcactgcttcacctatgagtatgagcatgtggatgagtccatggaagcaatagcagctctgttcttgcctaaccttgacactgactccaactcctctagctgtctcaactttgatgtccctccacaatgctggcctcagccagaccatagttctagtgttacaagtttgcttgatccaacagagaactttgagagctttgagtttccagttattgatccgttccccgcaagcggcttcgattcgcattgtgagaccccctaccttactgagtatccgatctccctacatggcaaacattcatcagtcatagaggaagaagcagccaacgttacgcctgctgctaaaaagaggaaggctagtgctaccaccaagggatcaaagaaatccaggaaggtgagcaaaaaggattatatcggcgacgatgatggcggcgatgcctatgttgacacgcaaagctccagtagctgcacctccgaggacggaaattttgaaggaaatacgaattcaagcacgaagaaggcctacactagggccagccgtggagcagcaactgatcctcagagtctctatgcaaggaagaggagagagaggatcaatgaaaggttgagaatcttgcagaaattggttcccaatggaacaaaagttgacattagtacgatgctcgaggaagcagcacagtatgtcaaatttttacagcttcaaattaagctgttgagctctgacgatacgtggatgtatgcgccaatcgcgtacaatgggattaacatcagcaatgttgatctgaacatcccttctctgcaaaagtaa

SEQ ID NO: 16299 - protein, 277 aa, Sorghum bicolor
  misc_feature: The sequence is a functional homolog of SEQ ID NO 2832 in the 10/374,780 US patent application
  misc_feature: The sequence is a functional homolog of SEQ ID NO 680 in the 11/435,388 US patent application
  misc_feature: The sequence is a functional homolog of SEQ ID NO 932 in the 10/225,066 US patent application
  misc_feature: Ceres ANNOT ID no. 8656505
  misc_feature (194)..(241): Pfam ID: HLH Pfam Description: Helix-loop-helix DNA-binding domain
MAQFLGTDDHCFTYEYEHVDESMEAIAALFLPNLDTDSNSSSCLNFDVPPQCWPQPDHSSSVTSLLDPTENFESFEFPVIDPFPASGFDSHCETPYLTEYPISLHGKHSSVIEEEAANVTPAAKKRKASATTKGSKKSRKVSKKDYIGDDDGGDAYVDTQSSSSCTSEDGNFEGNTNSSTKKAYTRASRGAATDPQSLYARKRRERINERLRILQKLVPNGTKVDISTMLEEAAQYVKFLQLQIKLLSSDDTWMYAPIAYNGINISNVDLNIPSLQK

SEQ ID NO: 16300 - DNA, 1365 bp, Sorghum bicolor
  misc_feature: Ceres ANNOT ID no. 8656515
  misc_feature: Encodes the peptide sequence at SEQ ID NO 16301
atgcagttcacgcatactgcgccaccgccgccgcctcatgctgctggaggtctagggctagggctcttccttgacgtcggcgcgccgagggcggcacgcggcccgtggcccggcagcttcccgacgccggcgtccaagatctcgctcggcaacctcaacagcaccagctgcatggagcagctgctggtgcactgcgccaacgccatcgaggccaacgacgccacgctgacgcagcagatcctctgggtgctcaacaacatcgcgccgcccgacggggactccaaccagcgcctcacggcggccttcctctgcgcgctcgtcgcgcgcgcgtccaggaccggcgcctgcaaggccgtcaccgccgccgtcgccgccgccgtcgagtcggccgcgctccacgtgcaccgcttcacggccgtcgagctcgccagcttcgtcgacctcacgccatggcaccgcttcggctacacggccgccaacgccgccatcctcgaggccgtcgagggcttccccgtcgtgcacgtcgtcgagctcggcaccacgcactgcatgcagatccccacgctcatcgacatgctcgccagccgcgccgaggggccaccgatcctccggctcacggtcgccgacgtcgcgcccagcgcgccgccgccagcgctcgacatgtcctacgaggagctcggcgcgaagctggtcaacttcgcgcgatcgcgcaacatgtccatggacttccgggtggtgcccacctcgccggccgacgccctcacgtccctggtggaccagctcagggtgcagcagctggtcctggacgggacggaggcgctcgtcgtcaactgccacatgctgctgcacacggtgccggacgagacggcggggtctgtgagcctgacgcagccggtgtcgctgcggaccatgctcctcaagtccctccggacgctggaccccaacctggtggtggtggtggaggaggacgcggacttcacggcgggcgacgtggtggggaggctccgcgcggcgttcaacttcctctggatcccgtacgacgccgtggacacgttcctgcccaaggggagcgagcagcggcggtggtacgaggcggagatcgggtggaaggtggagaacgtgctggcgcaggagggcgtggagcgggtggagcggcaggaggacagggggaggtgggggcagagaatgcgcagcgcggggttccgggcggtggcgttcggcgaggaggccgccggggaggtgaaggcgatgctgaacgagcacgcggcggggtgggggatgaagcgggaggacgacgacctggtgctcacgtggaagggccacaacgtcgtgttcgcgtcggcgtgggcgccctcgccgtcgtga

SEQ ID NO: 16301 - protein, 454 aa, Sorghum bicolor
  misc_feature: The sequence is a functional homolog of SEQ ID NO 502 in the 10/666,642 US patent application
  misc_feature: The sequence is a functional homolog of SEQ ID NO 70 in the 10/666,642 US patent application
  misc_feature: Ceres ANNOT ID no. 8656515
  misc_feature (33)..(361): Pfam ID: GRAS Pfam Description: GRAS family transcription factor
MQFTHTAPPPPPHAAGGLGLGLFLDVGAPRAARGPWPGSFPTPASKISLGNLNSTSCMEQLLVHCANAIEANDATLTQQILWVLNNIAPPDGDSNQRLTAAFLCALVARASRTGACKAVTAAVAAAVESAALHVHRFTAVELASFVDLTPWHRFGYTAANAAILEAVEGFPVVHVVELGTTHCMQIPTLIDMLASRAEGPPILRLTVADVAPSAPPPALDMSYEELGAKLVNFARSRNMSMDFRVVPTSPADALTSLVDQLRVQQLVLDGTEALVVNCHMLLHTVPDETAGSVSLTQPVSLRTMLLKSLRTLDPNLVVVVEEDADFTAGDVVGRLRAAFNFLWIPYDAVDTFLPKGSEQRRWYEAEIGWKVENVLAQEGVERVERQEDRGRWGQRMRSAGFRAVAFGEEAAGEVKAMLNEHAAGWGMKREDDDLVLTWKGHNVVFASAWAPSPS

SEQ ID NO: 16302 - DNA, 1860 bp, Sorghum bicolor
  misc_feature: Ceres ANNOT ID no. 8656536
  misc_feature: Encodes the peptide sequence at SEQ ID NO 16303
atggcggtgatggccgaagtagtgtcgaccaccggcgcggcgctccggagcccggcctcgcagccgccgccgccgccggcggcggccgcggtgaaggacgctgacgctgagaagctccagttcatcgaggagatgacctccaacgtggacgccgtgcaggagcgcgtgctgggtgagatcctcgcccgcaacgccgacaccgagtacctcgccaagtacggcatcaccggcgcttcggaccgcgccaccttccgcgccaaggtgccgatggcgacgtacgaggacctgcagccgtacatccggcgcattgccgacggcgaccgctcgcccatcctgtcggggcacccggtctccgagttcctcaccagctccggcacgtccgccggcgagcgcaagctcatgcccaccattgaggatgagctcaaccgccgccagctgctgtacagcctccagatgcccgtcatgaacctgtatgtgcctgggatggacaagggcaaggctctccatttcctcttcgtcaagtcggagacgaagacgccgggcggcctcgcggcgaggcccgtcctgacgagctactacaagagcaaccacttcaagaaccggccgttcgacgcctacaacaactacacgagccccacggcggccatcctctgcgcggacgcgttccagagcatgtacgcgcagatggtgtgcgggctgtgccagcgccaggacgtgctgcgcgtcggcgccgtgttcgcgtcgggcctcctccgcgccattcgcttcctccagctcaactgggagcagctcgcggacgacatcgagtccggctcgctcaccccgcgcatcaccgacccgtcggtgcgcgaggcggtcgccggcatcctccgccctgaccccgagctcgcctcgctggtccgctccgaatgctccaagggcgactgggcgggcatcatcacccgcatttggcccaacaccaagtacctggacgtcatcgtcaccggcgccatggcgcagtacatcccgaccctcaagtactacagcggcgggctcccgatggcgtgcaccatgtacgcgtcgtcggagtgctacttcgggctgaacctccgccccatgtgcgacccgtcggaggtgtcctacaccctgatgcccaacatgtgctacttcgagttcctgcccatggacgccgcggcgtccggcggcggcgacgcgagccagctggtggacctcgcccgcgtggaggtcgggcgcgagtacgagctggtgatcaccacgtacgcggggctgaaccggtaccgcgtcggcgacgtgctccaggtcacgggcttccacaacaccgcgccgcagttccggttcgtgcgccgcaagaacgtgctgctgtccatcgagtccgacaagacggacgaggcggagctgcagcgcgccgtggagcgcgcgtccgcgctgctccgcccgcacggcgccgccgtggtggagtacaccagccaggcctacaccaagagcatccccggccactacgtcatctactgggagctcctgaccaagggccccgcggccggcgccggcgccgcggtggacagggagacgctggacaggtgctgcctcgagatggaggaggcgctgaacacggtgtacaggcagagccgcgtggcggacggctccatcggcccgctggagatccgggtggttcggccgggcaccttcgaggagctcatggactacgccatctcccgcggcgcgtccatcaaccagtacaaggtgccccggtgcgtgacgttcccgcccatcatcgagctcctggactcccgtgtcgtgtccacccacttcagccccgcgctgccgcactggacccccggccagcgctcccactccgactaa

SEQ ID NO: 16303 - protein, 619 aa, Sorghum bicolor
  misc_feature: Useful for making plants with modulated biomass
  misc_feature: Useful for making plants with modulated light quality response
  misc_feature: Useful for making plants with modulated low light sensitivity
  misc_feature: Functional homolog of the protein sequence given in SEQ ID NO 14293
  misc_feature: Ceres ANNOT ID no. 8656536
  misc_feature: Down-regulated in root tissues in response to methyl jasmonate treatment
  misc_feature: Down-regulated in shoot tissues in response to methyl jasmonate treatment
  misc_feature: Down-regulated in shoot tissues in response to salicylic acid treatment
  misc_feature (37)..(593): Pfam ID: GH3 Pfam Description: GH3 auxin-responsive promoter
MAVMAEVVSTTGAALRSPASQPPPPPAAAAVKDADAEKLQFIEEMTSNVDAVQERVLGEILARNADTEYLAKYGITGASDRATFRAKVPMATYEDLQPYIRRIADGDRSPILSGHPVSEFLTSSGTSAGERKLMPTIEDELNRRQLLYSLQMPVMNLYVPGMDKGKALHFLFVKSETKTPGGLAARPVLTSYYKSNHFKNRPFDAYNNYTSPTAAILCADAFQSMYAQMVCGLCQRQDVLRVGAVFASGLLRAIRFLQLNWEQLADDIESGSLTPRITDPSVREAVAGILRPDPELASLVRSECSKGDWAGIITRIWPNTKYLDVIVTGAMAQYIPTLKYYSGGLPMACTMYASSECYFGLNLRPMCDPSEVSYTLMPNMCYFEFLPMDAAASGGGDASQLVDLARVEVGREYELVITTYAGLNRYRVGDVLQVTGFHNTAPQFRFVRRKNVLLSIESDKTDEAELQRAVERASALLRPHGAAVVEYTSQAYTKSIPGHYVIYWELLTKGPAAGAGAAVDRETLDRCCLEMEEALNTVYRQSRVADGSIGPLEIRVVRPGTFEELMDYAISRGASINQYKVPRCVTFPPIIELLDSRVVSTHFSPALPHWTPGQRSHSD

SEQ ID NO: 16304 - DNA, 1338 bp, Sorghum bicolor
  misc_feature: Ceres ANNOT ID no. 8656571
  misc_feature: Down-regulated in root tissues in response to methyl jasmonate treatment
  misc_feature: Down-regulated in shoot tissues in response to methyl jasmonate treatment
  misc_feature: Down-regulated in shoot tissues in response to salicylic acid treatment
  misc_feature: Encodes the peptide sequence at SEQ ID NO 16305
atggatgtcgtggagcttgctgcggcggcgaggcatggatgcaaggtctgcgggaaaagcttcctgtgcggccggtcgcttggaggacacatgagatcgcacatctcgctcggcgaggcggcgctggaggttcacgccgacgacgagctgaggcgtgcttcgccgaatggtggccggaactgcaatggagtggtcgggtacgggctgagggagaatcccaggaagacccggcggctatccgacttcgccaacgaggaggatggcggccatggcgttggcgatggcgatggcgatggtgagcagcacaaggcgtgccgggagtgcgggaagctgttctcgtcgtggaagtctctgttcgggcacatgcggagccatgcgtccggcggcaggtatcacgacgacgaggatgacgtggacgtggaagaggaggaattcgtcccagtcccagaggaggcggaagcagagatggtgacgccgatggaggcgcctgtggcggcggcgccggcagctctgacggtgctgtccgcgccgcctaggcggcggcgccgatcgatgcgcgtggctgctccgctcccggcaccgccaccgccggtgctgagcgggttcgagaaggagacggaagacgtcgcgctctgcctcctgatgctctcgcgcgacaccggcatgtggagctcgccggccaaagaggagcctttcgagagcgcggagaagcaggcgggcctcccaagaagcggttacaattccgacgacgactcagctctgcaccagcacggcgacgccaagatcaagggccgcgtcgccaagagcagcaagcgaggctccccgaagcagcgacgcgaacgcgatcccgtggcgcctaagcggacccggtacgagtgcccggggtgcggcaaagttttcagctcgtaccaggcgctcggcggccaccgcgcgagccacaagcggatcaacgccagctgcagctcccccaaggtcacccccgtcgcgtcccccgcgccggagccaagcaccgagacgtacgcttcgttcaacacactgtccccctccgcgtcgccggactcggtggccatcggcttcggcaagcccaaggacgacgaggcggtggccgacgcggccgtggagaagttcgagtgcgcggtctgcttcagggtgttcgcgtcggggcaggctctcggctggcacaagcggtcgcattcgcatctgatgccctccgagtccgacgacgtcgagctctactacgccggcggcgccggcgcggatcaccaggagcagcattcagcagccgtggacgggttccttgatctcaacttcccaccggctgcaccggaggaggcttga

SEQ ID NO: 16305 - protein, 445 aa, Sorghum bicolor
  misc_feature: The sequence is a functional homolog of SEQ ID NO 1093 in the 10/666,642 US patent application
  misc_feature: Ceres ANNOT ID no. 8656571
  misc_feature (291)..(313): Pfam ID: zf-C2H2 Pfam Description: Zinc finger, C2H2 type
  misc_feature (103)..(125): Pfam ID: zf-C2H2 Pfam Description: Zinc finger, C2H2 type
MDVVELAAAARHGCKVCGKSFLCGRSLGGHMRSHISLGEAALEVHADDELRRASPNGGRNCNGVVGYGLRENPRKTRRLSDFANEEDGGHGVGDGDGDGEQHKACRECGKLFSSWKSLFGHMRSHASGGRYHDDEDDVDVEEEEFVPVPEEAEAEMVTPMEAPVAAAPAALTVLSAPPRRRRRSMRVAAPLPAPPPPVLSGFEKETEDVALCLLMLSRDTGMWSSPAKEEPFESAEKQAGLPRSGYNSDDDSALHQHGDAKIKGRVAKSSKRGSPKQRRERDPVAPKRTRYECPGCGKVFSSYQALGGHRASHKRINASCSSPKVTPVASPAPEPSTETYASFNTLSPSASPDSVAIGFGKPKDDEAVADAAVEKFECAVCFRVFASGQALGWHKRSHSHLMPSESDDVELYYAGGAGADHQEQHSAAVDGFLDLNFPPAAPEEA

SEQ ID NO: 16306 - DNA, 585 bp, Sorghum bicolor
  misc_feature: Ceres ANNOT ID no. 8656587
  misc_feature: Encodes the peptide sequence at SEQ ID NO 16307
atgaaggcgctggtggtgacagtgcttctcctgctctcctccaccctcgccgtgtcacagtggtgcgtgtgcaggcaggacgcgacgcaggcggcgctgcagaagaccatagactacgcctgcggctccggggcggactgcaactccatccatgagaacggggcgtgctacaaccccaacaccgtcccggcgcactgctcctgggcggccaacagctactaccagaacaacaaggccaagggcgccacctgcgacttcaccggcaccgccaccctcaccaccagcgacccaagttcttctggctgctcttaccctaccagtgcaagcgccgctggaacgatgaccccgaccactggaggcacaatgggaggaaccccagggaccttcacgcccgggacaggcacaggcacaactggcactggcatggggacaggcactgccaccggaaccaccgggttcggcggcctaggaccaggcacaaacgctggcatggacacagcggcagcagcgggcttgctcctcccaacggctgggctggccactgccctcgctgcgctcctcttctcagccatcgtgctcgcatga

SEQ ID NO: 16307 - protein, 194 aa, Sorghum bicolor
  misc_feature: Useful for making plants with altered carbohydrate content
  misc_feature: Functional homolog of the protein sequence given in SEQ ID NO 14369
  misc_feature: Ceres ANNOT ID no. 8656587
  misc_feature (20)..(104): SWISSPROT Homolog: EC 3.2.1.39 Glucan endo-1,3-beta-D-glucosidase
  misc_feature (20)..(104): Pfam ID: X8 Pfam Description: X8 domain
MKALVVTVLLLLSSTLAVSQWCVCRQDATQAALQKTIDYACGSGADCNSIHENGACYNPNTVPAHCSWAANSYYQNNKAKGATCDFTGTATLTTSDPSSSGCSYPTSASAAGTMTPTTGGTMGGTPGTFTPGTGTGTTGTGMGTGTATGTTGFGGLGPGTNAGMDTAAAAGLLLPTAGLATALAALLFSAIVLA

SEQ ID NO: 16308 - DNA, 1524 bp, Sorghum bicolor
  misc_feature: Ceres ANNOT ID no. 8656592
  misc_feature: Encodes the peptide sequence at SEQ ID NO 16309
atggcttccaatgatgagcagcagccgccaatacatattctcttcttcccgtatattgcgcctggccacctcataccggtggcggccatggccgccctctttgcttcacgtggtggcgtcaagtgcaccatactcaccactcccgtaaacgccaccgtcatccgctcggccgtcgacaaggccaacaactccttccgcgggacctccgccctggcgatccacatctccaccatccccttccctgatgtcggactcccgccgggcgtcgagagcgttgtcggcatctcctcagagtccgacctccacaagttgctggaaggggtccagcgcctccgcgagcccttggatcggttcctggccgatcaccgccacccccgccccgacgccgtcgtggtcgacagcttctacctgtgggccgccgacgtcgccgccgagcacggcatcccacggctgtctttcctcgggagcagcctgttcgcccgggcctgtaacgagtccttgctgcgccacaacccgttcgcgctcgctccggatgaccccgacgccgtcgtgtccctgccggagctgccgcaccgcgtcgcgatgaggcgcagacaggtgatggacccaagaaaggaccagctggagtgggaatacaaccagctcgtgcacgccgcggaccggaggagctacggcgaggtgttcaacagcttcgccgagctggagccggactacgtcgagcactaccgcacgacgctcggccgccgtgtgtggctggttggcccggtcgcccacgccaacgccttcgccttcgccggcgaggacgaggacgaggacatggcgcccggcgcggacaggtgcctgcggtggctcgacgagaagccacgcggctcagttgtgtacctcgcattcggcacactagcccatttctcggcggcggagctgcgggaggtggcgcgcggcctgcagctgtccggcaagaatttcctgtgggtcatgaagggtggaggagcggacacggcggaggacgcatcggaatggatgcccgaaggcttcgccgagctgctgattgacgtcggagcacgcggcctcatcttccagggttgggctccgcagaggcttatcctcgagcactccgccgtcggtgggttcgtgacgcactgtggatggaactcggtgctggaggccgtcagcgctggggtgccgctggtgacgttgccacggtacgccgaccagttctataacgagaagctcgtcgtcgagttgctcaagatgggggtcgatgtcgatgccggcgactatgtctccccgtttgaggtccgccgcgaggtgatcagcggtgagaagatcgcggaagggattgacagagtgatgggtgggaaccaagaggccgaggcgataaggaaaaacgctatggagctccgtcggaaggctaggagcgcaactgacaagggcggcacttcgtatgacgatgtcggcaagctcatccacgagttgatggcttgccggagatctctccaaaatagccatttacatgcgaattag

SEQ ID NO: 16309 - protein, 507 aa, Sorghum bicolor
  misc_feature: Useful for making plants with altered carbohydrate content
  misc_feature: Functional homolog of the protein sequence given in SEQ ID NO 14370
  misc_feature: Ceres ANNOT ID no. 8656592
  misc_feature (11)..(492): SWISSPROT Homolog: EC 2.4.1.238 Anthocyanin 3'-O-beta-glucosyltransferase
  misc_feature (22)..(498): Pfam ID: UDPGT Pfam Description: UDP-glucoronosyl and UDP-glucosyl transferase
MASNDEQQPPIHILFFPYIAPGHLIPVAAMAALFASRGGVKCTILTTPVNATVIRSAVDKANNSFRGTSALAIHISTIPFPDVGLPPGVESVVGISSESDLHKLLEGVQRLREPLDRFLADHRHPRPDAVVVDSFYLWAADVAAEHGIPRLSFLGSSLFARACNESLLRHNPFALAPDDPDAVVSLPELPHRVAMRRRQVMDPRKDQLEWEYNQLVHAADRRSYGEVFNSFAELEPDYVEHYRTTLGRRVWLVGPVAHANAFAFAGEDEDEDMAPGADRCLRWLDEKPRGSVVYLAFGTLAHFSAAELREVARGLQLSGKNFLWVMKGGGADTAEDASEWMPEGFAELLIDVGARGLIFQGWAPQRLILEHSAVGGFVTHCGWNSVLEAVSAGVPLVTLPRYADQFYNEKLVVELLKMGVDVDAGDYVSPFEVRREVISGEKIAEGIDRVMGGNQEAEAIRKNAMELRRKARSATDKGGTSYDDVGKLIHELMACRRSLQNSHLHAN

SEQ ID NO: 16310 - DNA, 1542 bp, Sorghum bicolor
  misc_feature: Ceres ANNOT ID no. 8656613
  misc_feature: Encodes the peptide sequence at SEQ ID NO 16311
atggccaccggccaagaggactccctcctcctgctcctcctccccaccacctccccactcccgcccctcatggccgtgttcatcctagccgccgtcctcctgtggctctcccccggtggtcctgcgtgggcgctctcccgctgccgccgcccgccgtccggcccaacgggcgtggtcaccgcgctctcaagccccgtggcgcaccgcaccctggcggcgctgtcccacgccgtagacggcggcaaagcactgatggccttctcggtcgggctcacccgcctcgtcgtgtcgagccagcccgacacggcgcgagagatcctcgtcaaccccgcgttcagcgaccgccccatcaaggacgcggctcgccacctgctcttccaccgcgccatgggcttcgcgccctccggagacgcgcactggcgcgggctccgccgcctcgccgccaaccacctgttcggcccgcgccgcgtggcggcggccgcgcaccaccgcgtctccatcggcgaggccatggtcgccgacgtcgccgctgccatggcccgccacggcgaggtctccctgaagcgcgtgctgcatatcgcgtctctcaaccacatcatggccaccgtcttcggcaagcactacgacatggacagccaagagggcgtccttctggaagagatggtcaccgagggctacgacctcctgggcacgttcaactgggctgaccacctgccgttgatcaagcatctcgacctccagggcgtgcgccgccggtgcaacaggttagtccaaaaggttgaagtgttcgttggaaagatcatccaggagcacagggcgaggcgcgcgaatggaggagtcgacgatgagtacatgggtgacttcgtcgacgtccttcttgacctcgagggagaggagaagctgtccgaatccgacatgatcgctgttctttgggagatgatcttcagaggcgccgacactgtggcgatcttgatggagtggatcatggcgaggatggcgctgcaccctgaaatccagtccaaggcccaggcggagctggacggcgtcgtcgtgggcggcgtggcggacgccgacgtgggcaacctcccctacatccagtgcatcgtgaaggagacgctgcggatgcaccctccgggcccgctcctgtcgtgggcgcgcctcgccatccacgacgcgcacgtcggcggccacctggtccccgccggcaccacggccatggtgaacatgtggtccatcgcgcatgaccccgccatctgggcagagccggagaagttccgccccgagcgcttccaggaggaggacgtgagcgtcctcgggagcgacctccgcctggccccgttcggcgccggacgccgcgtctgccccggcaagatgctggccctcgccaccacacacctctggatcgcccagctgctgcacgagttcgagtgggcacccgcggccgccaacggcggcgtcgacctgtccgagcgcctcaacatgtcgctggagatggccacgccgctggtgtgcaaggccgtccccagggcccagctggcctaa

SEQ ID NO: 16311 - protein, 513 aa, Sorghum bicolor
  misc_feature: Useful for biocontainment applications
  misc_feature: Functional homolog of the protein sequence given in SEQ ID NO 14371
  misc_feature: Useful for making plants with modulated time to senescence
  misc_feature: Functional homolog of the protein sequence given in SEQ ID NO 14372
  misc_feature: Ceres ANNOT ID no. 8656613
  misc_feature (49)..(509): SWISSPROT Homolog: EC 1.14.13.21 Flavonoid 3'-monooxygenase
  misc_feature (52)..(506): Pfam ID: p450 Pfam Description: Cytochrome P450
MATGQEDSLLLLLLPTTSPLPPLMAVFILAAVLLWLSPGGPAWALSRCRRPPSGPTGVVTALSSPVAHRTLAALSHAVDGGKALMAFSVGLTRLVVSSQPDTAREILVNPAFSDRPIKDAARHLLFHRAMGFAPSGDAHWRGLRRLAANHLFGPRRVAAAAHHRVSIGEAMVADVAAAMARHGEVSLKRVLHIASLNHIMATVFGKHYDMDSQEGVLLEEMVTEGYDLLGTFNWADHLPLIKHLDLQGVRRRCNRLVQKVEVFVGKIIQEHRARRANGGVDDEYMGDFVDVLLDLEGEEKLSESDMIAVLWEMIFRGADTVAILMEWIMARMALHPEIQSKAQAELDGVVVGGVADADVGNLPYIQCIVKETLRMHPPGPLLSWARLAIHDAHVGGHLVPAGTTAMVNMWSIAHDPAIWAEPEKFRPERFQEEDVSVLGSDLRLAPFGAGRRVCPGKMLALATTHLWIAQLLHEFEWAPAAANGGVDLSERLNMSLEMATPLVCKAVPRAQLA

SEQ ID NO: 16312 - DNA, 1719 bp, Sorghum bicolor
  misc_feature: Ceres ANNOT ID no. 8656615
  misc_feature: Encodes the peptide sequence at SEQ ID NO 16313
atggaggagggaggcgagcacacgagtcttctggtcaaggatgatgcatcatgtcatggcgaggaaacacaaagtatattggaagcaaatctagggccacagctgaaaagtaaatgctctgactggagagcaccggcactcatcctgggattggaatgcttggagagcatggcttttaatggcattgccacaaacctagtcgtgtatctccgttcggtcctccatggtggtattgcttccagtgcatcaacagtatctctttggtacgggacaagcttctttgtgccaatgcttggagccgccatagcagatacttgcttgggaaattataagaccatcctgatctcccttatcatgtacctaattggaatggtactgattacagttgcaacatttctgccttctacttcaatcttatgcgacgccagctcatgcttgtcatcaaatggaactcaaaccgtgattttctttgctggtttgtatctcactgctgttggatgtggaggcgtaagatctgcattgcttccatttggtgcgagccagttcaacaacgagaacaatttagtagacataaaaaggagaagaaatttcttcagttcattctatatatgtgtcatctttggtgtgattacttctgggacaattatagtttgggttcaggaaaatgtgagctgggctataggatatggagttgccactacatgcataggtcttgctttgataggatttctggtggggacaccaatattccaacaagatgagccttgtggttctccagtgaagagtattttccaggttattgttgcctcttttaggaacatgagcttggaagtacctgctgatagctctcttctgtatgaggtcaggagcaaccacgtacaaaggacaatacttgctcactccgatgattttaggttcttagataaggcagcagttatttctgatccaagcttggtgtatggagggtgtcgaagctcatggagtttatgtacggttactgaagttgaggaactgaaaatacttatccgcttactcccaatatgggtgactggaatattctttgctgctgcgatctctcaaatgcacaccactttcattcagcagggagctgtgatgaacaccaagattggttccctgtccattccaccagcatccttgtactcatttgaagtgatatgtgtcacgctctgggtactttctgtgaacaaagtgcttgtgccggcaaccagaacgtattttgcaaatggagcagagctcacacagttacagaggattggaattggtcgtttcttgatgatctttgccatggcaatggccgcacttctagaaaccaagaggctgcagagtgttcaggagggggaactgctaaacattgtatggcagcttccacagtacttcgtcattgctggggctgagtgcttcgctgtcatcactcagctagagtttttccatggccaagcgccagactccatgaagagcatattaacggcattcgcgttgctcaccactgcccttgggaattacttgagctcagctatcatcaccctcattgcaggggtgaccagggtatggcatagtcctggatggataccggatgatctgaacaagggacaccttgattactactactggtgtcttacagccctctcgttggtgaattttgttgtgtatctgtattttgctagtaaatacaaattgaagaaagttgttatctgctaa

SEQ ID NO: 16313 - protein, 572 aa, Sorghum bicolor
  misc_feature: Useful for making plants with modulated nitrogen use efficiency
  misc_feature: Functional homolog of the protein sequence given in SEQ ID NO 14373
  misc_feature: Ceres ANNOT ID no. 8656615
  misc_feature (110)..(503): Pfam ID: PTR2 Pfam Description: POT family
MEEGGEHTSLLVKDDASCHGEETQSILEANLGPQLKSKCSDWRAPALILGLECLESMAFNGIATNLVVYLRSVLHGGIASSASTVSLWYGTSFFVPMLGAAIADTCLGNYKTILISLIMYLIGMVLITVATFLPSTSILCDASSCLSSNGTQTVIFFAGLYLTAVGCGGVRSALLPFGASQFNNENNLVDIKRRRNFFSSFYICVIFGVITSGTIIVWVQENVSWAIGYGVATTCIGLALIGFLVGTPIFQQDEPCGSPVKSIFQVIVASFRNMSLEVPADSSLLYEVRSNHVQRTILAHSDDFRFLDKAAVISDPSLVYGGCRSSWSLCTVTEVEELKILIRLLPIWVTGIFFAAAISQMHTTFIQQGAVMNTKIGSLSIPPASLYSFEVICVTLWVLSVNKVLVPATRTYFANGAELTQLQRIGIGRFLMIFAMAMAALLETKRLQSVQEGELLNIVWQLPQYFVIAGAECFAVITQLEFFHGQAPDSMKSILTAFALLTTALGNYLSSAIITLIAGVTRVWHSPGWIPDDLNKGHLDYYYWCLTALSLVNFVVYLYFASKYKLKKVVIC

SEQ ID NO: 16314 - DNA, 1353 bp, Sorghum bicolor
  misc_feature: Ceres ANNOT ID no. 8656644
  misc_feature: Encodes the peptide sequence at SEQ ID NO 16315
atggggtcaccgcacgtcgccgtggtgccttttcccttcagctcccacgcccccaagctgctcatggtcgcgcgcgccctagccaccgcggcgccgtccgcgaccttctccttcatctccaccgccgactccctggcgcggcttggtgtcgcggcggtcccggggaacctgcgctttgtggaggtgccgtctggaggaggcgacgatcagggaaccccgccgtggcgccggatggagctgtttgtcgaggccgcggaggctggtggcctcagacacgcattggaaatggcacgcgccgcggctgggggcgccagggtgagctgcgtcgtcggggacgccttcatgtccatggctgcagaggccggggtgccctgggtcgcagtctggacgggcggcccgtgcgcgctcctggcgcacctcatcggcgacgcgatccgcgaggacatcggcgagcacgccgcgaacagggccgacgagcttctgacctcccacccaggcctcgggagctaccgcgtccgcgacctccccttcggcggcatcggcgccagcggcgacatgcaccgtgtcatgagcctcctcttctgccgcatggcgcagcgcctgccccgcgccgccaccgccgtcgcgctcaacgccttcccgggcctcttcccgcaggacgtgtccgccgccctcgccgacgcgctccccaactccctccccatcggcccctaccacctcctcccgggcgccgccgcgccagccgacgacccccacgcctgccttgcctggctcgctcaccgccccgcgggcaccgtggcgtacgtcagcttcggcacggtcgcggcgctgccaccggacgagctccgtgagctggcctccgggctcgaggccagcggcgcgccctacctgtggtcgcttcgggaggacgcgtggccgctgctcccggcggggttcgtggaccgcgccaaggccaatggctccgggctcctggtgccgtggacgccgcaggccgcggtgctgcggcacccggcggtgggcgcgttcgtcacgcactccggctggggggccgtcgtcgaggggatgtccggcggcgtgcccatggcgtgccgccccttcttcggggaccagcagatgaatgcgcgtgctgtggcgcgcctgtggtgcttcggcacagcgttcggcgacgacacgccgatgacgagccgtggcgtggcggaggtggtgacgtcgctgctgacaggggcggaaggggcccggatgagggctagggcgcgcgatctgcaaggcagggtcgtcgaggcgttcgaacccgacggcggatccatgaacaacttccacaaatttgtcgaggttgtttgtgcccgtgtgtga

SEQ ID NO: 16315 - protein, 450 aa, Sorghum bicolor
  misc_feature: Useful for making plants with altered carbohydrate content
  misc_feature: Functional homolog of the protein sequence given in SEQ ID NO 14374
  misc_feature: Useful for making plants with modulated flowering time
  misc_feature: Functional homolog of the protein sequence given in SEQ ID NO 14375
  misc_feature: Ceres ANNOT ID no. 8656644
  misc_feature (4)..(447): SWISSPROT Homolog: EC 2.4.1.115 Anthocyanidin 3-O-glucosyltransferase
  misc_feature (18)..(450): Pfam ID: UDPGT Pfam Description: UDP-glucoronosyl and UDP-glucosyl transferase
MGSPHVAVVPFPFSSHAPKLLMVARALATAAPSATFSFISTADSLARLGVAAVPGNLRFVEVPSGGGDDQGTPPWRRMELFVEAAEAGGLRHALEMARAAAGGARVSCVVGDAFMSMAAEAGVPWVAVWTGGPCALLAHLIGDAIREDIGEHAANRADELLTSHPGLGSYRVRDLPFGGIGASGDMHRVMSLLFCRMAQRLPRAATAVALNAFPGLFPQDVSAALADALPNSLPIGPYHLLPGAAAPADDPHACLAWLAHRPAGTVAYVSFGTVAALPPDELRELASGLEASGAPYLWSLREDAWPLLPAGFVDRAKANGSGLLVPWTPQAAVLRHPAVGAFVTHSGWGAVVEGMSGGVPMACRPFFGDQQMNARAVARLWCFGTAFGDDTPMTSRGVAEVVTSLLTGAEGARMRARARDLQGRVVEAFEPDGGSMNNFHKFVEVVCARV

SEQ ID NO: 16316 - DNA, 717 bp, Sorghum bicolor
  misc_feature: Ceres ANNOT ID no. 8656632
  misc_feature: Encodes the peptide sequence at SEQ ID NO 16317
atggggcgcggaccggtgcagctgcgccggatcgagaacaagatcaaccgccaggtgaccttctccaagcgccggaacgggctgctgaagaaggcccacgagatctccgttctctgcgatgcggaggtcgcgctcatcgtcttctccactaaggggaagctctacgagtactctagccattccagcatggaaggcattcttgagcgttaccagcgttactcatttgaagaaagagcagtacttgacccaactattgaagaccaggcaaattggggagatgaatatgtccggttaaaatccaaacttgatgcacttcagaagagtcaaaggcaactgttaggagaacaattggattcactaaccataaaagaactccagcaactggagcaacaattggacagttctttgaagcatattaggtcaagaaagaatcagctcatgttcgattcaatttccgagcttcagaaaaaggagaaagcacttacagaccaaaatggtgtcctgcaaaagctcatggaggcagagaaggagaaaaacaatgctttaatgaacgcacacctccgggagcagccaaatggagcatcaacaagctccccatcactgccatgtcaacctagaggagcaggaaaatctgagcctggtccgtctcctgctcctgcacaagcaaacagcggcaacctgccaccatggatgctccgcactgtcagtaacaggtga

SEQ ID NO: 16317 - protein, 238 aa, Sorghum bicolor
  misc_feature: Useful for making plants with altered alkaloid content
  misc_feature: Useful for making plants with modulated flowering time
  misc_feature: Functional homolog of the protein sequence given in SEQ ID NO 13525
  misc_feature: The sequence is a functional homolog of SEQ ID NO 730 in the 10/666,642 US patent application
  misc_feature: The sequence is a functional homolog of SEQ ID NO 6 in US patent 7279615
  misc_feature: The sequence is a functional homolog of SEQ ID NO 2 in US patent 7273968
  misc_feature: Useful for making plants with modulated biomass
  misc_feature: Useful for making plants with modulated phosphate use efficiency
  misc_feature: Functional homolog of the protein sequence given in SEQ ID NO 13166
  misc_feature: The sequence is a functional homolog of SEQ ID NO 46 in the 10/666,642 US patent application
  misc_feature: The sequence is a functional homolog of SEQ ID NO 1360 in the 10/666,642 US patent application
  misc_feature: The sequence is a functional homolog of SEQ ID NO 22 in the 10/666,642 US patent application
  misc_feature: The sequence is a functional homolog of SEQ ID NO 36 in the 10/666,642 US patent application
  misc_feature: The sequence is a functional homolog of SEQ ID NO 60 in the 10/412,699 US patent application
  misc_feature: The sequence is a functional homolog of SEQ ID NO 30 in the 10/666,642 US patent application
  misc_feature: Useful for making plants with altered terpenoid content
  misc_feature: Functional homolog of the protein sequence given in SEQ ID NO 13021
  misc_feature: The sequence is a functional homolog of SEQ ID NO 731 in the 10/666,642 US patent application
  misc_feature: The sequence is a functional homolog of SEQ ID NO 1701 in the 10/412,699 US patent application
  misc_feature: Useful for making plants with altered lignin content
  misc_feature: Functional homolog of the protein sequence given in SEQ ID NO 12944
  misc_feature: The sequence is a functional homolog of SEQ ID NO 1949 in the 10/412,699 US patent application
  misc_feature: The sequence is a functional homolog of SEQ ID NO 1965 in the 10/412,699 US patent application
  misc_feature: The sequence is a functional homolog of SEQ ID NO 1967 in the 10/412,699 US patent application
  misc_feature: The sequence is a functional homolog of SEQ ID NO 1963 in the 10/412,699 US patent application
  misc_feature: The sequence is a functional homolog of SEQ ID NO 1957 in the 10/412,699 US patent application
  misc_feature: The sequence is a functional homolog of SEQ ID NO 1959 in the 10/412,699 US patent application
  misc_feature: Ceres ANNOT ID no. 8656632
  misc_feature (75)..(174): Pfam ID: K-box Pfam Description: K-box region
  misc_feature (9)..(59): Pfam ID: SRF-TF Pfam Description: SRF-type transcription factor (DNA-binding and dimerisation domain)
MGRGPVQLRRIENKINRQVTFSKRRNGLLKKAHEISVLCDAEVALIVFSTKGKLYEYSSHSSMEGILERYQRYSFEERAVLDPTIEDQANWGDEYVRLKSKLDALQKSQRQLLGEQLDSLTIKELQQLEQQLDSSLKHIRSRKNQLMFDSISELQKKEKALTDQNGVLQKLMEAEKEKNNALMNAHLREQPNGASTSSPSLPCQPRGAGKSEPGPSPAPAQANSGNLPPWMLRTVSNR

SEQ ID NO: 16318 - DNA, 1149 bp, Sorghum bicolor
  misc_feature: Ceres ANNOT ID no. 8656654
  misc_feature: Encodes the peptide sequence at SEQ ID NO 16319
atggtcgccgccgccgccgggtgcagcaggcggcgccgctgcatctgctgcgcggccgccatgtacatcctcctgctcctgcccgtcgtcgtcctcgcgtcgtccgcgtcatccgcggcgacggctgacgggtcgttcataacgtgggacgaccttagcatcccgaccgccgccgccgtgcaggcaggcggcgtgggaggaggcggcgtgaaggcggccgctaggggcggatcccacgacctggacacgatcgtggtgtcgcaggacgggacggggcactcgcgcacagtgcagggcgccgtcgacatggtgcccgccggcaaccgccgccgcgtcaagatcctcgttaggcccggcgtgtacagggagaaggtgacggtgccgatcacgaagccgttcgtgtcgctcatcggcatgggcagcgggcgcacggtgatcacgtggaacgccagggcatcggacatcgaccaccgctccggccaccaggtcggcaccttctactccgcctccgtcgccgtcgaggccgactacttctgcgccagccacatcaccttcgagaactccgcgccggcggcgccgccgggggccgtggggcagcaggcggtggcgctgcggctgtccggcgacaagacgatgctgtacaggtgcaggatcctggggacgcaggacacgctgttcgacaacatcggccgccacttcctctacaactgcgagatacagggctccatcgacttcattttcgggaacgcgaggtccctgtaccaggggtgcacgctgcacgcggtggcgacgagctacggcgcgatcgcggcgtcgcagcggagctcgccggcggaggactccgggttctcgttcgtggggtgcaggctcaccggctccggcatgctgtacctgggcagggcgtggggccgctacgcccgggtggtctactcctactgcgacctcagcggcatcgtcgtgccccagggctggagcgactggggcgaccgctccagaaccaagacggtgctgttcggggagtacaactgcaagggcccaggggcgagcacgaggcagcgggtgccttggtcccgctcgctcacctacgacgaggcgcggccgttcctcggccggagcttcatcaacggcgagcagtggctcaggctgtag

SEQ ID NO: 16319 - protein, 382 aa, Sorghum bicolor
  misc_feature: Useful for making plants with altered cell wall content and/or composition
  misc_feature: Functional homolog of the protein sequence given in SEQ ID NO 14376
  misc_feature: Ceres ANNOT ID no. 8656654
  misc_feature (86)..(380): SWISSPROT Homolog: EC 3.1.1.11 Pectinesterase
  misc_feature (83)..(377): Pfam ID: Pectinesterase Pfam Description: Pectinesterase
MVAAAAGCSRRRRCICCAAAMYILLLLPVVVLASSASSAATADGSFITWDDLSIPTAAAVQAGGVGGGGVKAAARGGSHDLDTIVVSQDGTGHSRTVQGAVDMVPAGNRRRVKILVRPGVYREKVTVPITKPFVSLIGMGSGRTVITWNARASDIDHRSGHQVGTFYSASVAVEADYFCASHITFENSAPAAPPGAVGQQAVALRLSGDKTMLYRCRILGTQDTLFDNIGRHFLYNCEIQGSIDFIFGNARSLYQGCTLHAVATSYGAIAASQRSSPAEDSGFSFVGCRLTGSGMLYLGRAWGRYARVVYSYCDLSGIVVPQGWSDWGDRSRTKTVLFGEYNCKGPGASTRQRVPWSRSLTYDEARPFLGRSFINGEQWLRL

SEQ ID NO: 16320 - DNA, 1677 bp, Sorghum bicolor
  misc_feature: Ceres ANNOT ID no. 8656623
  misc_feature: Encodes the peptide sequence at SEQ ID NO 16321
atggcgacaccgcggccggcgctcctgctgcccgccgtgcgcttcgcctccaccaccatcgcgctcctcctcctcgtcgccttctcctctctaatgcgttcgtcagatgcatacgatccactcgatccgaatgggaacataacaattaagtgggacgtaatacagtggacttcagatggctatgtgaagtggacaggattattctacaagacttttcgagtagtacttcagttatcgtcagtattgagtcttgttggcgtattctgctttctctgtcattcttttgcgtcaggaaaccatgtcctctgttatattgccattctgccggtcgttgcccgttgggcactgcagtactttcttgatatgcttacaatggtcgtaactgaatatcaatcaaggctgcagcctgcagctgaaggatgtcatgacgaacatagtgccacaggacttctttttgaaaccatagaactggcaagcatagaactagctgttgtttctctatacaattaccagcaataccgccacattcaggcgccaggctggaaactaggctgggtatgggcaaagaaggaggtaatctgggcgatgaccggtggccaggccactgaacaaggcgactgctccaaattcaaaaccaacatcccccattgctgcagaaaggaccctgaggttgtggacttgctgcctgggactccctacaacatgcagattgccaactgctgcaagggaggagtcctcacatcatgggcacaggaccctagcaatgccgtggcatcgttccaagtcagcgttggacaggctgggactaccaacagaaccgtcaaagtgcccaagaatttcactctgaaggcaccaggtcccgggtacacctgtggaactgccaaactagtgacacctaccaagttcatatctccggatgggaggagatcaactcaagcacacatgacatggaatgtgacatgtacgtactcgcagtttcttgctcaaagatctccatcctgctgtgtctcgctctcatcattttacaacgacactattgttaactgcccaacatgctcctgtggctgccagaataacagcactgcgccaggaagctgtgtagagggtaattcgccttacctggcttctgtcgtgaacgatcctaataagaacagcttggcgcctctagtccaatgcacttcacacatgtgcccaataagagtgcattggcatgtcaaggttaactacaaggagtactggagggtaaagatcacggtgacaaacttcaattaccggatgaactactcgcaatggaacctggttgcgcaacaccccaacttcgacaatctgaccaccattttcagcttcaactacaaacctctgaacccctatggagtgataaacgacacggcgatgctatggggcatcaagtactacaacgatctgctcatgacggccgggccagacgggaatgtgcagtctgagcttctgttccggaaggagccctccacgttcaccttccagaaaggctgggccttcccgagacgagtctacttcaatggcgacaactgcgtgatgccgccgccggacgcctacccgtggctgcccaacgcctctccgcggctgtcggcttcacttctcctcccgttcgttgcagcttggacagcatttgcaatcctcttgatgacccatccgtag

SEQ ID NO: 16321 - protein, 558 aa, Sorghum bicolor
  misc_feature: Useful for making plants with altered carbohydrate content
  misc_feature: Functional homolog of the protein sequence given in SEQ ID NO 13944
  misc_feature: Useful for making plants with altered cell wall content and/or composition
  misc_feature: Useful for making plants with altered lignin content
  misc_feature: Functional homolog of the protein sequence given in SEQ ID NO 13349
  misc_feature: The sequence is a functional homolog of SEQ ID NO 4 in US patent 7109001
  misc_feature: Ceres ANNOT ID no. 8656623
  misc_feature (162)..(325): Pfam ID: Phytochel_synth Pfam Description: Phytochelatin synthetase-like conserved region
MATPRPALLLPAVRFASTTIALLLLVAFSSLMRSSDAYDPLDPNGNITIKWDVIQWTSDGYVKWTGLFYKTFRVVLQLSSVLSLVGVFCFLCHSFASGNHVLCYIAILPVVARWALQYFLDMLTMVVTEYQSRLQPAAEGCHDEHSATGLLFETIELASIELAVVSLYNYQQYRHIQAPGWKLGWVWAKKEVIWAMTGGQATEQGDCSKFKTNIPHCCRKDPEVVDLLPGTPYNMQIANCCKGGVLTSWAQDPSNAVASFQVSVGQAGTTNRTVKVPKNFTLKAPGPGYTCGTAKLVTPTKFISPDGRRSTQAHMTWNVTCTYSQFLAQRSPSCCVSLSSFYNDTIVNCPTCSCGCQNNSTAPGSCVEGNSPYLASVVNDPNKNSLAPLVQCTSHMCPIRVHWHVKVNYKEYWRVKITVTNFNYRMNYSQWNLVAQHPNFDNLTTIFSFNYKPLNPYGVINDTAMLWGIKYYNDLLMTAGPDGNVQSELLFRKEPSTFTFQKGWAFPRRVYFNGDNCVMPPPDAYPWLPNASPRLSASLLLPFVAAWTAFAILLMTHP

SEQ ID NO: 16322 - DNA, 657 bp, Sorghum bicolor
  misc_feature: Ceres ANNOT ID no. 8656646
  misc_feature: Encodes the peptide sequence at SEQ ID NO 16323
atgccggactccgacaacgagtccggcgggccgagcaacgcggacttctcgtcgccgagggagcaggaccggttcctgccgatcgcgaacgtgagccggatcatgaagaaggcgctcccggccaacgccaagatctccaaggacgccaaggagacggtgcaggagtgcgtgtccgagttcatctccttcatcaccggcgaggcctccgacaagtgccagcgcgagaagcgcaagactatcaacggcgacgatctgctctgggccatgaccacgctcggctttgaggactacatcgagccgctcaagctctacctccacaagttccgcgagctcgagggcgagaaggccgccacgggcgtcgcgggctcctcctccggcgtctcgcagccgcacagggagtcgacgccgtcgtcagcgcacaatggcgcgggcgggcccgtcggcggctatggcatgtacggcggcgccggcggaggcgggagcggcatgatcatgatgatgggacagcccatgtacggcggctccccaccggctgcgtcagggtacccgcagccaccgcaccaccagatggtcatgggtgggaaaggtggcgcgtatggccacggcggaggctcgtcgtcgtcgccgtcaggtctcggcaggcaggacaggttgtga

SEQ ID NO: 16323 - protein, 218 aa, Sorghum bicolor
  misc_feature: The sequence is a functional homolog of SEQ ID NO 2153 in the 10/666,642 US patent application
  misc_feature: The sequence is a functional homolog of SEQ ID NO 366 in the 11/435,388 US patent application
  misc_feature: The sequence is a functional homolog of SEQ ID NO 368 in the 10/714,887 US patent application
  misc_feature: The sequence is a functional homolog of SEQ ID NO 50 in the 10/675,852 US patent application
  misc_feature: The sequence is a functional homolog of SEQ ID NO 805 in the 10/374,780 US patent application
  misc_feature: The sequence is a functional homolog of SEQ ID NO 1164 in the 10/412,699 US patent application
  misc_feature: The sequence is a functional homolog of SEQ ID NO 29 in the 10/675,852 US patent application
  misc_feature: The sequence is a functional homolog of SEQ ID NO 780 in the 10/374,780 US patent application
  misc_feature: The sequence is a functional homolog of SEQ ID NO 807 in the 10/666,642 US patent application
  misc_feature: The sequence is a functional homolog of SEQ ID NO 2143 in the 10/666,642 US patent application
  misc_feature: The sequence is a functional homolog of SEQ ID NO 338 in the 11/435,388 US patent application
  misc_feature: The sequence is a functional homolog of SEQ ID NO 340 in the 10/714,887 US patent application
  misc_feature: The sequence is a functional homolog of SEQ ID NO 76 in the 10/675,852 US patent application
  misc_feature: The sequence is a functional homolog of SEQ ID NO 796 in the 10/374,780 US patent application
  misc_feature: The sequence is a functional homolog of SEQ ID NO 2151 in the 10/666,642 US patent application
  misc_feature: The sequence is a functional homolog of SEQ ID NO 364 in the 11/435,388 US patent application
  misc_feature: The sequence is a functional homolog of SEQ ID NO 366 in the 10/714,887 US patent application
  misc_feature: The sequence is a functional homolog of SEQ ID NO 48 in the 10/675,852 US patent application
  misc_feature: The sequence is a functional homolog of SEQ ID NO 804 in the 10/374,780 US patent application
  misc_feature: The sequence is a functional homolog of SEQ ID NO 2141 in the 10/666,642 US patent application
  misc_feature: The sequence is a functional homolog of SEQ ID NO 336 in the 11/435,388 US patent application
  misc_feature: The sequence is a functional homolog of SEQ ID NO 338 in the 10/714,887 US patent application
  misc_feature: The sequence is a functional homolog of SEQ ID NO 794 in the 10/374,780 US patent application
  misc_feature: The sequence is a functional homolog of SEQ ID NO 92 in the 10/675,852 US patent application
  misc_feature: The sequence is a functional homolog of SEQ ID NO 62 in the 10/675,852 US patent application
  misc_feature: The sequence is a functional homolog of SEQ ID NO 106 in the 10/666,642 US patent application
  misc_feature: The sequence is a functional homolog of SEQ ID NO 1784 in the 10/412,699 US patent application
  misc_feature: The sequence is a functional homolog of SEQ ID NO 2010 in the 10/374,780 US patent application
  misc_feature: The sequence is a functional homolog of SEQ ID NO 292 in the 11/435,388 US patent application
  misc_feature: The sequence is a functional homolog of SEQ ID NO 294 in the 10/714,887 US patent application
  misc_feature: The sequence is a functional homolog of SEQ ID NO 6 in the 10/675,852 US patent application
  misc_feature: The sequence is a functional homolog of SEQ ID NO 719 in the 11/479,226 US patent application
  misc_feature: The sequence is a functional homolog of SEQ ID NO 20 in the 10/675,852 US patent application
  misc_feature: The sequence is a functional homolog of SEQ ID NO 2181 in the 10/666,642 US patent application
  misc_feature: The sequence is a functional homolog of SEQ ID NO 404 in the 11/435,388 US patent application
  misc_feature: The sequence is a functional homolog of SEQ ID NO 406 in the 10/714,887 US patent application
  misc_feature: The sequence is a functional homolog of SEQ ID NO 800 in the 10/374,780 US patent application
  misc_feature: The sequence is a functional homolog of SEQ ID NO 18 in the 10/675,852 US patent application
  misc_feature: The sequence is a functional homolog of SEQ ID NO 2183 in the 10/666,642 US patent application
  misc_feature: The sequence is a functional homolog of SEQ ID NO 406 in the 11/435,388 US patent application
  misc_feature: The sequence is a functional homolog of SEQ ID NO 408 in the 10/714,887 US patent application
  misc_feature: The sequence is a functional homolog of SEQ ID NO 798 in the 10/374,780 US patent application
  misc_feature: The sequence is a functional homolog of SEQ ID NO 2187 in the 10/666,642 US patent application
  misc_feature: The sequence is a functional homolog of SEQ ID NO 410 in the 11/435,388 US patent application
  misc_feature: The sequence is a functional homolog of SEQ ID NO 412 in the 10/714,887 US patent application
  misc_feature: The sequence is a functional homolog of SEQ ID NO 86 in the 10/675,852 US patent application
  misc_feature: The sequence is a functional homolog of SEQ ID NO 22 in the 10/675,852 US patent application
  misc_feature: The sequence is a functional homolog of SEQ ID NO 2175 in the 10/666,642 US patent application
  misc_feature: The sequence is a functional homolog of SEQ ID NO 398 in the 11/435,388 US patent application
  misc_feature: The sequence is a functional homolog of SEQ ID NO 400 in the 10/714,887 US patent application
  misc_feature: The sequence is a functional homolog of SEQ ID NO 80 in the 10/675,852 US patent application
  misc_feature: The sequence is a functional homolog of SEQ ID NO 801 in the 10/374,780 US patent application
  misc_feature: The sequence is a functional homolog of SEQ ID NO 16 in the 10/675,852 US patent application
  misc_feature: The sequence is a functional homolog of SEQ ID NO 2179 in the 10/666,642 US patent application
  misc_feature: The sequence is a functional homolog of SEQ ID NO 402 in the 11/435,388 US patent application
  misc_feature: The sequence is a functional homolog of SEQ ID NO 404 in the 10/714,887 US patent application
  misc_feature: The sequence is a functional homolog of SEQ ID NO 797 in the 10/374,780 US patent application
  misc_feature: The sequence is a functional homolog of SEQ ID NO 82 in the 10/675,852 US patent application
  misc_feature: The sequence is a functional homolog of SEQ ID NO 66 in the 10/675,852 US patent application
  misc_feature: The sequence is a functional homolog of SEQ ID NO 134 in the 10/225,068 US patent application
  misc_feature: The sequence is a functional homolog of SEQ ID NO 1398 in the 10/666,642 US patent application
  misc_feature: The sequence is a functional homolog of SEQ ID NO 14 in the 10/286,264 US patent application
  misc_feature: The sequence is a functional homolog of SEQ ID NO 290 in the 11/435,388 US patent application
  misc_feature: The sequence is a functional homolog of SEQ ID NO 292 in the 10/714,887 US patent application
  misc_feature: The sequence is a functional homolog of SEQ ID NO 306 in the 10/412,699 US patent application
  misc_feature: The sequence is a functional homolog of SEQ ID NO 4 in the 10/675,852 US patent application
  misc_feature: The sequence is a functional homolog of SEQ ID NO 708 in the 11/479,226 US patent application
  misc_feature: The sequence is a functional homolog of SEQ ID NO 90 in the 10/374,780 US patent application
  misc_feature: The sequence is a functional homolog of SEQ ID NO 2177 in the 10/666,642 US patent application
  misc_feature: The sequence is a functional homolog of SEQ ID NO 400 in the 11/435,388 US patent application
  misc_feature: The sequence is a functional homolog of SEQ ID NO 402 in the 10/714,887 US patent application
  misc_feature: The sequence is a functional homolog of SEQ ID NO 52 in the 10/675,852 US patent application
  misc_feature: The sequence is a functional homolog of SEQ ID NO 799 in the 10/374,780 US patent application
  misc_feature: The sequence is a functional homolog of SEQ ID NO 38 in the 10/675,852 US patent application
  misc_feature: The sequence is a functional homolog of SEQ ID NO 46 in the 10/675,852 US patent application
  misc_feature: The sequence is a functional homolog of SEQ ID NO 56 in the 10/675,852 US patent application
  misc_feature: The sequence is a functional homolog of SEQ ID NO 785 in the 10/374,780 US patent application
  misc_feature: The sequence is a functional homolog of SEQ ID NO 786 in the 10/374,780 US patent application
  misc_feature: The sequence is a functional homolog of SEQ ID NO 64 in the 10/675,852 US patent application
  misc_feature: The sequence is a functional homolog of SEQ ID NO 60 in the 10/675,852 US patent application
  misc_feature: Useful for making plants with modulated biomass
  misc_feature: Functional homolog of the protein sequence given in SEQ ID NO 13228
  misc_feature: The sequence is a functional homolog of SEQ ID NO 44 in the 10/675,852 US patent application
  misc_feature: Useful for making plants with modulated drought sensitivity
  misc_feature: Functional homolog of the protein sequence given in SEQ ID NO 13743
  misc_feature: The sequence is a functional homolog of SEQ ID NO 12 in the 10/675,852 US patent application
  misc_feature: Useful for making plants with altered alkaloid content
  misc_feature: Useful for making plants with altered terpenoid content
  misc_feature: Functional homolog of the protein sequence given in SEQ ID NO 13247
  misc_feature: The sequence is a functional homolog of SEQ ID NO 34 in the 10/675,852 US patent application
  misc_feature: The sequence is a functional homolog of SEQ ID NO 807 in the 10/374,780 US patent application
  misc_feature: The sequence is a functional homolog of SEQ ID NO 310 in the 11/435,388 US patent application
  misc_feature: The sequence is a functional homolog of SEQ ID NO 312 in the 10/714,887 US patent application
  misc_feature: The sequence is a functional homolog of SEQ ID NO 72 in the 10/675,852 US patent application
  misc_feature: The sequence is a functional homolog of SEQ ID NO 2135 in the 10/666,642 US patent application
  misc_feature: The sequence is a functional homolog of SEQ ID NO 28 in the 10/675,852 US patent application
  misc_feature: The sequence is a functional homolog of SEQ ID NO 330 in the 11/435,388 US patent application
  misc_feature: The sequence is a functional homolog of SEQ ID NO 332 in the 10/714,887 US patent application
  misc_feature: The sequence is a functional homolog of SEQ ID NO 792 in the 10/374,780 US patent application
  misc_feature: The sequence is a functional homolog of SEQ ID NO 88 in the 10/675,852 US patent application
  misc_feature: The sequence is a functional homolog of SEQ ID NO 308 in the 11/435,388 US patent application
  misc_feature: The sequence is a functional homolog of SEQ ID NO 310 in the 10/714,887 US patent application
  misc_feature: The sequence is a functional homolog of SEQ ID NO 2137 in the 10/666,642 US patent application
  misc_feature: The sequence is a functional homolog of SEQ ID NO 332 in the 11/435,388 US patent application
  misc_feature: The sequence is a functional homolog of SEQ ID NO 334 in the 10/714,887 US patent application
  misc_feature: The sequence is a functional homolog of SEQ ID NO 54 in the 10/675,852 US patent application
  misc_feature: The sequence is a functional homolog of SEQ ID NO 74 in the 10/675,852 US patent application
  misc_feature: The sequence is a functional homolog of SEQ ID NO 790 in the 10/374,780 US patent application
  misc_feature: The sequence is a functional homolog of SEQ ID NO 42 in the 10/675,852 US patent application
  misc_feature: The sequence is a functional homolog of SEQ ID NO 787 in the 10/374,780 US patent application
  misc_feature: The sequence is a functional homolog of SEQ ID NO 1168 in the 10/412,699 US patent application
  misc_feature: The sequence is a functional homolog of SEQ ID NO 32 in the 10/675,852 US patent application
  misc_feature: The sequence is a functional homolog of SEQ ID NO 784 in the 10/374,780 US patent application
  misc_feature: The sequence is a functional homolog of SEQ ID NO 811 in the 10/666,642 US patent application
  misc_feature: The sequence is a functional homolog of SEQ ID NO 14 in the 10/675,852 US patent application
  misc_feature: The sequence is a functional homolog of SEQ ID NO 2171 in the 10/666,642 US patent application
  misc_feature: The sequence is a functional homolog of SEQ ID NO 2173 in the 10/666,642 US patent application
  misc_feature: The sequence is a functional homolog of SEQ ID NO 2185 in the 10/666,642 US patent application
  misc_feature: The sequence is a functional homolog of SEQ ID NO 24 in the 10/675,852 US patent application
  misc_feature: The sequence is a functional homolog of SEQ ID NO 394 in the 11/435,388 US patent application
  misc_feature: The sequence is a functional homolog of SEQ ID NO 396 in the 10/714,887 US patent application
  misc_feature: The sequence is a functional homolog of SEQ ID NO 396 in the 11/435,388 US patent application
  misc_feature: The sequence is a functional homolog of SEQ ID NO 398 in the 10/714,887 US patent application
  misc_feature: The sequence is a functional homolog of SEQ ID NO 408 in the 11/435,388 US patent application
  misc_feature: The sequence is a functional homolog of SEQ ID NO 410 in the 10/714,887 US patent application
  misc_feature: The sequence is a functional homolog of SEQ ID NO 84 in the 10/675,852 US patent application
  misc_feature: The sequence is a functional homolog of SEQ ID NO 36 in the 10/675,852 US patent application
  misc_feature: The sequence is a functional homolog of SEQ ID NO 2149 in the 10/666,642 US patent application
  misc_feature: The sequence is a functional homolog of SEQ ID NO 362 in the 11/435,388 US patent application
  misc_feature: The sequence is a functional homolog of SEQ ID NO 364 in the 10/714,887 US patent application
  misc_feature: The sequence is a functional homolog of SEQ ID NO 40 in the 10/675,852 US patent application
  misc_feature: The sequence is a functional homolog of SEQ ID NO 58 in the 10/675,852 US patent application
  misc_feature: The sequence is a functional homolog of SEQ ID NO 78 in the 10/675,852 US patent application
  misc_feature: The sequence is a functional homolog of SEQ ID NO 806 in the 10/374,780 US patent application
  misc_feature: The sequence is a functional homolog of SEQ ID NO 26 in the 10/675,852 US patent application
  misc_feature: The sequence is a functional homolog of SEQ ID NO 802 in the 10/374,780 US patent application
  misc_feature: The sequence is a functional homolog of SEQ ID NO 1440 in the 10/666,642 US patent application
  misc_feature: The sequence is a functional homolog of SEQ ID NO 1856 in the 10/412,699 US patent application
  misc_feature: The sequence is a functional homolog of SEQ ID NO 2102 in the 10/374,780 US patent application
  misc_feature: The sequence is a functional homolog of SEQ ID NO 290 in the 10/225,066 US patent application
  misc_feature: The sequence is a functional homolog of SEQ ID NO 8 in the 10/675,852 US patent application
  misc_feature: The sequence is a functional homolog of SEQ ID NO 418 in the 11/435,388 US patent application
  misc_feature: The sequence is a functional homolog of SEQ ID NO 420 in the 10/714,887 US patent application
  misc_feature: The sequence is a functional homolog of SEQ ID NO 803 in the 10/374,780 US patent application
  misc_feature: The sequence is a functional homolog of SEQ ID NO 2139 in the 10/666,642 US patent application
  misc_feature: The sequence is a functional homolog of SEQ ID NO 334 in the 11/435,388 US patent application
  misc_feature: The sequence is a functional homolog of SEQ ID NO 336 in the 10/714,887 US patent application
  misc_feature: The sequence is a functional homolog of SEQ ID NO 90 in the 10/675,852 US patent application
  misc_feature: The sequence is a functional homolog of SEQ ID NO 416 in the 11/435,388 US patent application
  misc_feature: The sequence is a functional homolog of SEQ ID NO 418 in the 10/714,887 US patent application
  misc_feature: The sequence is a functional homolog of SEQ ID NO 789 in the 10/374,780 US patent application
  misc_feature: The sequence is a functional homolog of SEQ ID NO 306 in the 11/435,388 US patent application
  misc_feature: The sequence is a functional homolog of SEQ ID NO 308 in the 10/714,887 US patent application
  misc_feature: The sequence is a functional homolog of SEQ ID NO 70 in the 10/675,852 US patent application
  misc_feature: The sequence is a functional homolog of SEQ ID NO 795 in the 10/374,780 US patent application
  misc_feature: The sequence is a functional homolog of SEQ ID NO 134 in US patent 7294759
  misc_feature: The sequence is a functional homolog of SEQ ID NO 2 in US patent 7220894
  misc_feature: The sequence is a functional homolog of SEQ ID NO 793 in the 10/374,780 US patent application
  misc_feature: The sequence is a functional homolog of SEQ ID NO 1167 in the 10/412,699 US patent application
  misc_feature: The sequence is a functional homolog of SEQ ID NO 783 in the 10/374,780 US patent application
  misc_feature: The sequence is a functional homolog of SEQ ID NO 810 in the 10/666,642 US patent application
  misc_feature: The sequence is a functional homolog of SEQ ID NO 22 in US patent 7166765
  misc_feature: The sequence is a functional homolog of SEQ ID NO 294 in the 11/435,388 US patent application
  misc_feature: The sequence is a functional homolog of SEQ ID NO 296 in the 10/714,887 US patent application
  misc_feature: The sequence is a functional homolog of SEQ ID NO 308 in the 10/412,699 US patent application
  misc_feature: The sequence is a functional homolog of SEQ ID NO 723 in the 11/479,226 US patent application
  misc_feature: The sequence is a functional homolog of SEQ ID NO 788 in the 10/374,780 US patent application
  misc_feature: The sequence is a functional homolog of SEQ ID NO 414 in the 11/435,388 US patent application
  misc_feature: The sequence is a functional homolog of SEQ ID NO 416 in the 10/714,887 US patent application
  misc_feature: Ceres ANNOT ID no. 8656646
  misc_feature (20)..(115): SWISSPROT Homolog: EC 2.7.7.7 DNA-directed DNA polymerase
  misc_feature (24)..(89): Pfam ID: CBFD_NFYB_HMF Pfam Description: Histone-like transcription factor (CBF/NF-Y) and archaeal histone
MPDSDNESGGPSNADFSSPREQDRFLPIANVSRIMKKALPANAKISKDAKETVQECVSEFISFITGEASDKCQREKRKTINGDDLLWAMTTLGFEDYIEPLKLYLHKFRELEGEKAATGVAGSSSGVSQPHRESTPSSAHNGAGGPVGGYGMYGGAGGGGSGMIMMMGQPMYGGSPPAASGYPQPPHHQMVMGGKGGAYGHGGGSSSSPSGLGRQDRL

SEQ ID NO: 16324 - DNA, 1164 bp, Sorghum bicolor
  misc_feature: Ceres ANNOT ID no. 8656664
  misc_feature: Encodes the peptide sequence at SEQ ID NO 16325
atgcgagcaggcgcccccgccggcgatgcgggccccagctccggggccggcgccgggagcagtacgcccgctcggccacggaggttccccggggcggcgcagccggagatcatgcgggcggcggagaaggacgacagctacgcagcccacgtcacagaggcatgccgcgacgcgtttcggcacctcttcggtaccagggttgctgttgcttaccagaacgagataaaattgcttggtcagtccctttactacttgctaacaactggttcaggccagcaaacacttggcgaggaatattgtgatataactcaggttgctaccttgcatggacttccacctactcctgcaaggcggatcctattcattttgtaccaaactactgtgccctatcttgctgaacggatcagctccagaattgttgcccgtagtattgcactcaatgaatctcagtttgatgatcatcctgaaagtgataattctagtagtgacattgcacaatccgtcacaaataatggcattccttcaacaagcttaagtgtttctgctctgtcaaggttaagaggccgagttcatgctttgtggcaatgggttcttcagaaatggccttcaatgctgccatatgctcaagatgttatacagttggctattcggacaaatctaatgttcttctattttgaaggattgtattatcatttgccaaagcgagcagctggtattcgctatgtattcattggcaagccaatgaatcaaaggtaccagatcttgggtatttttctgttgattcagttgtgtattctcggagctgaaagactccgaagaagtaatatatcgtcaatagctagttccattaatcaaatatcatctggaagctatccatcgtctacaggtcggggcatccctgttctaaatgaagatggaaatatcatcagcgacatccgcagtggtaaagctgcagatatagcttctcattcagaggcttccagtggcaagagcaaatgcaccctctgtctcagcacccggcaaaatcctactgccacaacctgtggacatgttttctgctggaattgcataatggagtggtgcaatgagaagcctgagtgccccctatgcagaactccaattacccattcgagtttgatttgtatatatcattcagatttctag

SEQ ID NO: 16325 - protein, 387 aa, Sorghum bicolor
  misc_feature: The sequence is a functional homolog of SEQ ID NO 1844 in the 11/479,226 US patent application
  misc_feature: The sequence is a functional homolog of SEQ ID NO 298 in the 10/374,780 US patent application
  misc_feature: The sequence is a functional homolog of SEQ ID NO 46 in the 10/225,066 US patent application
  misc_feature: Ceres ANNOT ID no. 8656664
  misc_feature (44)..(275): Pfam ID: Pex2_Pex12 Pfam Description: Pex2 / Pex12 amino terminal region
  misc_feature (333)..(370): Pfam ID: zf-C3HC4 Pfam Description: Zinc finger, C3HC4 type (RING finger)
MRAGAPAGDAGPSSGAGAGSSTPARPRRFPGAAQPEIMRAAEKDDSYAAHVTEACRDAFRHLFGTRVAVAYQNEIKLLGQSLYYLLTTGSGQQTLGEEYCDITQVATLHGLPPTPARRILFILYQTTVPYLAERISSRIVARSIALNESQFDDHPESDNSSSDIAQSVTNNGIPSTSLSVSALSRLRGRVHALWQWVLQKWPSMLPYAQDVIQLAIRTNLMFFYFEGLYYHLPKRAAGIRYVFIGKPMNQRYQILGIFLLIQLCILGAERLRRSNISSIASSINQISSGSYPSSTGRGIPVLNEDGNIISDIRSGKAADIASHSEASSGKSKCTLCLSTRQNPTATTCGHVFCWNCIMEWCNEKPECPLCRTPITHSSLICIYHSDF

SEQ ID NO: 16326 - DNA, 1320 bp, Sorghum bicolor
  misc_feature: Ceres ANNOT ID no. 8656685
  misc_feature: Encodes the peptide sequence at SEQ ID NO 16327
atgaggaccaggaagtcgaagacgacgtcggcgtggaggtcgttcctgggcggctgcctcggcttcggcggcggaggaaggggaagggcggcgggagacaggcagcggaaggtgcggcctggcggcggcggaggcgggcggctgtcgttcacggacctgagcggcgcggcggaccaggacctgtcggtgtcgctggtgggttccaacctgcacgtgttcagcgtggcggagctgcgcgaggccacgcgcggcttcgtctccggcaacttcctcggcgagggcggcttcggccccgtctacaagggcttcgtcgacgatggagtcaagaaggggctcaagccgcaggccatcgccgtcaagctctgggaccccgagggcgcccagggacacaaggagtggctggcggaggtgatcttcctggggcagctgcggcaccccaacctggtgaagctggtgggctactgctgcgaggacgagaaccggctgctcgtctacgagtacatggagcacggcagcctggagaaccacctcttcaaacagattcctgccgtgctgccctggtcgacccgactaaacattgcagtaggcgcggcgaagggtttggcgttcctccacaacgctgagaagccggtcatctaccgtgacttcaaggcctccaacatcttgctcgactcggactacaaggccaagctgtcagacttcgggctggccaaggacggaccagagggcgacgacacccacgtgtcgacgcgcgtgatggggacgcacggctacgcggcgccggagtacatcatgacgggccacctgacggcgaagagcgacgtgtacagcttcggcgtggtgctgctggagatcctgacggggcggcggtccgtggacaagacccggccgagccgggagcagaacctggtggactacgcgcggccgtgcctcaaggacccgctcaggctggcccggatcatggacccggccatggagggccagtactcggcgcgggcggcccagagcgcggcgctggtcgcgtaccggtgcctcagcagcagccccaagaaccggccggacatgtccgccgtcgtccaggcgctggagccgctgctggacctcaacgacgacgtgcccgtcggccccgttggccccgtggtgctgttcgtggcggcggcggaggcggaggagaagaaggagcgggcgccgaggaaggacgtccgccggcgcaggcctatgtcgtcgccgaaggcctcggcgagccccaggaagcgacccggcgccggcccgaaggaggagttctgggtgtggcatctgccggccgagcagaaggcgtga

SEQ ID NO: 16327 - protein, 439 aa, Sorghum bicolor
  misc_feature: Useful for making plants with modulated drought sensitivity
  misc_feature: Functional homolog of the protein sequence given in SEQ ID NO 14078
  misc_feature: Useful for making plants with modulated heat sensitivity
  misc_feature: Functional homolog of the protein sequence given in SEQ ID NO 14079
  misc_feature: Ceres ANNOT ID no. 8656685
  misc_feature (65)..(363): SWISSPROT Homolog: EC 2.7.11.1 Non-specific serine/threonine protein kinase
  misc_feature (85)..(362): Pfam ID: Pkinase_Tyr Pfam Description: Protein tyrosine kinase
MRTRKSKTTSAWRSFLGGCLGFGGGGRGRAAGDRQRKVRPGGGGGGRLSFTDLSGAADQDLSVSLVGSNLHVFSVAELREATRGFVSGNFLGEGGFGPVYKGFVDDGVKKGLKPQAIAVKLWDPEGAQGHKEWLAEVIFLGQLRHPNLVKLVGYCCEDENRLLVYEYMEHGSLENHLFKQIPAVLPWSTRLNIAVGAAKGLAFLHNAEKPVIYRDFKASNILLDSDYKAKLSDFGLAKDGPEGDDTHVSTRVMGTHGYAAPEYIMTGHLTAKSDVYSFGVVLLEILTGRRSVDKTRPSREQNLVDYARPCLKDPLRLARIMDPAMEGQYSARAAQSAALVAYRCLSSSPKNRPDMSAVVQALEPLLDLNDDVPVGPVGPVVLFVAAAEAEEKKERAPRKDVRRRRPMSSPKASASPRKRPGAGPKEEFWVWHLPAEQKA

SEQ ID NO: 16328 - DNA, 2139 bp, Sorghum bicolor
  misc_feature: Ceres ANNOT ID no. 8656723
  misc_feature: Encodes the peptide sequence at SEQ ID NO 16329
atgaggaggagcagacgccaacgcaatggacgaggaggagggagtggccagcgcggtgtaagggtggcctttgccttcgccgtgctgctgggctgtgtcatgcccctcgtcggcggcgccgccgcgcagggcccccggctcccctccgactacaaaaccctcagcggcgccgctccacttgtggtcgccaaaggtggattttcgggagtgtttccagattccagccaaggtgcctattcttttgcgatgatcgccagcgcaccggacacagccatgtggtgtgacgttcaactaacaaaggatggtgttggagtttgccttcgggatataaatatgaaaaattgcaccactgtcgaccaagcgtaccctgcgagaacgcggacctatgtcatcgatggtgtgcagaaatctggatggtttgtttcagacttcaccattgctgagcttcagtctgtttctctaacacaagcaatttggtctcgcactgagagattcgatggtatctatcctatcgtcagtgttactgactttcggtcccttgtcatgccatctcctgtttggttgaatgtccagcatgacatcttctacaaacaacatggtttggacatgaggaactacatattttcaatcaaaaagcgtgtatccatggattatatctcatcacctgaactgggcttcctcaaaaatatatctggaagagttggtcgcaaaacaaagcttgtgtttagatttcttgataaagccctcttagatcattctataaaccaaacatatggttcactgtcgagtaacctaacgtttattaagtctattgcatctggcataatagtccctaagagttacatttggccggtgacaaaggataactatctactgccatccacatcaattgtcacagaagcccacaatgcagggctggaaatatatgcctctgattttgccaatgatagaattattccctataactacagctatgatccgttggcagaatacctcaactttgtcaatgatggtggcttctctgttgatggtgtattgtcagagcacccaattactgcatcagaggcaattggttgttttactaaactgaattcaaataagactgatcatggagaacccttagttatctcacataatggtgctagtggagactacccggactgtacagacctggcctaccatagtgcaattgataatggtgcagatatcattgattgtcctgttcaagtgacaagtgatggagttcttatgtgcatgagttccggtaacctgcttgacaccacgaataagtcaaatgttatcttaataaatggaattcttccttcattgatcaatctatcttttgtactacagaatgctgcatttttaataaattcattgggaatcgacattgttgattctgtaaccactgccttaagtgctgctggcttcaataatcatcctaccaaggaagttctgatccagtcaaaagatagtgctgttcttgtcaaattgaagcaaaagaaaacaaaatccaagcttgtttacactctaccctcaggcatcggggatgcttctaattcctcactgaaagacattaagaagtttgctgaagctgtggttgtggacagcaaatctgtttttactctaagttctgactttatcataagacagaacagtcttgtgcaagatctgcagtcagcagggctagctttgtatgcagaggtgttccggaatgagtttgtagcacaaccgttggatttcttcggagatgaaactgtagaaatcaattactatgttcaatcatttaatttatcaggcatcataactgatttcccgaagacagtcagaagatacaaaaaaaacacttgtacagttctgggaaatgatatgcccaactacatgcagcctcctcaggctggctcccttgcacagtttctccaaaccttcaaaacccagccaccatctctgccacctatgccgacactgagttcttcaagcgtggaggagccacctcttcctactgttgcctcaagaagtgtatctgatggtagttcatcagggggcaccagaactcctggcacaccttctgatgctcacacggctactatgagtgctggcatgctacttgtgatggttttcacagctctgctgatctga

SEQ ID NO: 16329 - protein, 712 aa, Sorghum bicolor
  misc_feature: Useful for making plants with altered cell wall content and/or composition
  misc_feature: Functional homolog of the protein sequence given in SEQ ID NO 13867
  misc_feature: Ceres ANNOT ID no. 8656723
  misc_feature (60)..(170): SWISSPROT Homolog: EC 3.1.4.46 Glycerophosphodiester phosphodiesterase
  misc_feature (378)..(608): Pfam ID: GDPD Pfam Description: Glycerophosphoryl diester phosphodiesterase family
MRRSRRQRNGRGGGSGQRGVRVAFAFAVLLGCVMPLVGGAAAQGPRLPSDYKTLSGAAPLVVAKGGFSGVFPDSSQGAYSFAMIASAPDTAMWCDVQLTKDGVGVCLRDINMKNCTTVDQAYPARTRTYVIDGVQKSGWFVSDFTIAELQSVSLTQAIWSRTERFDGIYPIVSVTDFRSLVMPSPVWLNVQHDIFYKQHGLDMRNYIFSIKKRVSMDYISSPELGFLKNISGRVGRKTKLVFRFLDKALLDHSINQTYGSLSSNLTFIKSIASGIIVPKSYIWPVTKDNYLLPSTSIVTEAHNAGLEIYASDFANDRIIPYNYSYDPLAEYLNFVNDGGFSVDGVLSEHPITASEAIGCFTKLNSNKTDHGEPLVISHNGASGDYPDCTDLAYHSAIDNGADIIDCPVQVTSDGVLMCMSSGNLLDTTNKSNVILINGILPSLINLSFVLQNAAFLINSLGIDIVDSVTTALSAAGFNNHPTKEVLIQSKDSAVLVKLKQKKTKSKLVYTLPSGIGDASNSSLKDIKKFAEAVVVDSKSVFTLSSDFIIRQNSLVQDLQSAGLALYAEVFRNEFVAQPLDFFGDETVEINYYVQSFNLSGIITDFPKTVRRYKKNTCTVLGNDMPNYMQPPQAGSLAQFLQTFKTQPPSLPPMPTLSSSSVEEPPLPTVASRSVSDGSSSGGTRTPGTPSDAHTATMSAGMLLVMVFTALLI

SEQ ID NO: 16330 - DNA, 1473 bp, Sorghum bicolor
  misc_feature: Ceres ANNOT ID no. 8656722
  misc_feature: Encodes the peptide sequence at SEQ ID NO 16331
atggcggccgccatggcgagggccatgtccacggcggccgtcggcgcgccgccagtgtcactcaacaccatcaaccccaaggtcttgaagtgtgaatatgcagttcggggagagattgttacacatgctcagaacttacaacaagaattgcagaaaaatccagaatcacttcctttcgacgagatactctactgtaatattggaaatccccaatcacttggacaacaaccagttacctatttcagagaagttctctctttatgtgatcatccagctctgctggataaaagcgaaactcatgctttgtacagttcagatgctatagagagagcatggcaaattctagagaagataccaggtagagcgacaggagcatatagccatagtcagggtgtaaaaggtttacgtgatgaaattgctgctggaattgctgcacgtgatgggtttcacgcaagcggagataacatcttcctaacagatggagcaagcccagcattgctgataagttctgagaaggatggcattctctgccctattccacagtacccactgtactctgcatcgattgctcttcacggtggttcccttgttccttattaccttgatgaagagacagggtggggactcgaggttgatgaactgaagaaacaactggaggaggctcgatctaagggcatcactgtgagggcgcttgttgtcataaatccagggaatccaacaggacaggttcttgctgaggaaaaccaaaagaaaattgtcgaattctgcaagaatgaaggacttgttcttcttgcggatgaggtttaccaagaaaatgtatatgttgaagataagaaattccactcattcaaaaaaattgcacggtcactgggatacactgatgatgatcttcctttggtatcattccagtcggtttctaaaggcttctacggagaatgtggaaaacgaggtggttatatggagataactggattcagtcctgaagtacgggaacaaatttacaaggtggcatcagtaaatctatgctccaatgtttcagggcaaattcttgctagccttgtaatgaacccaccaaaggctggggatgaatcctttgaatccttcatgttagagagggatggtatcctttcatcattggctcggcgtgcaaaggctttggaagaagcattcaatagtttagaaggtattacatgcaataaagccgaaggtgcaatgtatctgttcccacgccttcatttaccccagaaggcaattggagctgcccaagcagctggcactgccccagatgcatactatgctaaacgcctactagaagccactgggattgttgttgtccctggctctggttttggacaggtccctggaacatggcacttcagatgcacgatactgccgcaggaggacaaaataccagcaataatatctaggttcaaggagtttcacgagaagttcatggatgaattccgtgattga

SEQ ID NO: 16331 - protein, 490 aa, Sorghum bicolor
  misc_feature: Useful for making plants with modulated nitrogen use efficiency
  misc_feature: Functional homolog of the protein sequence given in SEQ ID NO 13731
  misc_feature: Ceres ANNOT ID no. 8656722
  misc_feature: Up-regulated in shoot tissues in response to salicylic acid treatment
  misc_feature (19)..(490): SWISSPROT Homolog: EC 2.6.1.2 Alanine transaminase
  misc_feature (89)..(477): Pfam ID: Aminotran_1_2 Pfam Description: Aminotransferase class I and II
MAAAMARAMSTAAVGAPPVSLNTINPKVLKCEYAVRGEIVTHAQNLQQELQKNPESLPFDEILYCNIGNPQSLGQQPVTYFREVLSLCDHPALLDKSETHALYSSDAIERAWQILEKIPGRATGAYSHSQGVKGLRDEIAAGIAARDGFHASGDNIFLTDGASPALLISSEKDGILCPIPQYPLYSASIALHGGSLVPYYLDEETGWGLEVDELKKQLEEARSKGITVRALVVINPGNPTGQVLAEENQKKIVEFCKNEGLVLLADEVYQENVYVEDKKFHSFKKIARSLGYTDDDLPLVSFQSVSKGFYGECGKRGGYMEITGFSPEVREQIYKVASVNLCSNVSGQILASLVMNPPKAGDESFESFMLERDGILSSLARRAKALEEAFNSLEGITCNKAEGAMYLFPRLHLPQKAIGAAQAAGTAPDAYYAKRLLEATGIVVVPGSGFGQVPGTWHFRCTILPQEDKIPAIISRFKEFHEKFMDEFRD

SEQ ID NO: 16332 - DNA, 876 bp, Sorghum bicolor
  misc_feature: Ceres ANNOT ID no. 8656729
  misc_feature: Up-regulated in shoot tissues in response to salicylic acid treatment
  misc_feature: Encodes the peptide sequence at SEQ ID NO 16333
atggagacgccgccgcctttccaggagtccgcccactgcgacgtctgccgctgcaccttcggcaccttccgtcgccgtcatcactgccgcagctgcggacggacgctgtgtcacgagcattcttcgtaccacatggctctcccgcagtatgggatatatactgacgtcagagtctgctacgattgcttcaacaaatcttcgagccaaggacgcgttggtaattcagtgtcggctggtagcatttccggagcagctgactctttttcagggctgagtttgggtaaagaggatgcttcggcgcctatgaaaaactcaacagttcagagcgcgacaccccttattgagtgcaaatgtgggatgcctttgtgtatttgtgaagcaccaaaaccagaacctgcacctacacctgtaaagaatatcagcaccgttccctcaaccacacagtcgaatccaaagccaaagaagcctgctaacacccaacagaaggcttcagctacttccagtaacaactcaagctcgttcttaaatattggattgatgagcaacgatagcaatgataagggtctttctgactatgaagttagtggggagggactcagagaagcaattaaaggcggggatgttaagggtgtaaagaaacttcttacacagggagtggattgcaactactgtgacaaacaaggatttactttgctgcatttggctgcattgtttaaccagacggagattgctcttattctcatggaccatggcgcaaatgttgagagcaaaaatgggcaaggggaaactcctttggactgcgctccaacaatgctgcagtacaagatgcgacaacggatggaagaacttgcggcttcaaggagaccactagagtga

SEQ ID NO: 16333 - protein, 291 aa, Sorghum bicolor
  misc_feature: Useful for making plants with altered oil content
  misc_feature: Functional homolog of the protein sequence given in SEQ ID NO 14377
  misc_feature: Ceres ANNOT ID no. 8656729
  misc_feature (4)..(68): Pfam ID: FYVE Pfam Description: FYVE zinc finger
  misc_feature (227)..(259): Pfam ID: Ank Pfam Description: Ankyrin repeat
METPPPFQESAHCDVCRCTFGTFRRRHHCRSCGRTLCHEHSSYHMALPQYGIYTDVRVCYDCFNKSSSQGRVGNSVSAGSISGAADSFSGLSLGKEDASAPMKNSTVQSATPLIECKCGMPLCICEAPKPEPAPTPVKNISTVPSTTQSNPKPKKPANTQQKASATSSNNSSSFLNIGLMSNDSNDKGLSDYEVSGEGLREAIKGGDVKGVKKLLTQGVDCNYCDKQGFTLLHLAALFNQTEIALILMDHGANVESKNGQGETPLDCAPTMLQYKMRQRMEELAASRRPLE

SEQ ID NO: 16334 - DNA, 1104 bp, Sorghum bicolor
  misc_feature: Ceres ANNOT ID no. 8656743
  misc_feature: Encodes the peptide sequence at SEQ ID NO 16335
atggctactcttgcttctcggaaggtgacggtgctgaccatcgacggtggcggcatcagaggcctcatcccgggcacaatcctcaccttcctcgagaaaaagcttcaggagctggacgggcccaacgcacggctggccgactacttcgactacatcgccggaaccagcaccggtggccttatcacggcgatgctcgccgccccgaataaggataagcgcccgctcttcaccgccgagggcatcaacaaattttacctggagaacgggccaaaaatctttcctcaaaggccagactttgcaaacacgttgctggagctcaaggggccgaaatacgacggcgagttcctgcactccaagattcagggcctccttggcgctactagggtgaacgagactctcaccaacgtcgtcatccccgccttcgacgtcaagaacctccagcccaccatcttctccaccttcgataccaaggacgacgccggcaacacccgcgatttcaacctcatcgacggcggcgtcgccgccaacaacccaacaatggtgacgatcaaccagataacccggaagatgatcgtggacaagcaggagatcttcccgggaggcccgacggactacgacaagttcctggtgatctccatcgggaccggctcgggcaagggcgcggcgacgtacacggccaaggacgccgccgggtggggcatcctgtcgtggctgcacaccaaggaagggtacaccccgatcgtcgacatgttcagctactccagcgccgcgctcgtcgactacaacgtctccatcctcttccaggcgctccgcagcgagaagaactacctccgcattcaggatgattctctcaaaggcacggaggcgacggtggacgtggcgacggaggagaacatgaagaagctgatcgagatcggggagaggatgctggccaccacggtgagcagggtggacatggagacggggaagcccgtggcggtgccggaggaagggaccaacgccgaggcgctcacccgcttcgcgaaaatgctctccgatgaaaggaaggcgaggacatcatcatctagccccgaggcaattaagccagcaggcagcgcgttgtga

SEQ ID NO: 16335 - protein, 367 aa, Sorghum bicolor
  misc_feature: Useful for making plants with modulated heat sensitivity
  misc_feature: Functional homolog of the protein sequence given in SEQ ID NO 13256
  misc_feature: Ceres ANNOT ID no. 8656743
  misc_feature (7)..(139): SWISSPROT Homolog: EC 3.1.1.5 Lysophospholipase
  misc_feature (12)..(183): Pfam ID: Patatin Pfam Description: Patatin-like phospholipase
MATLASRKVTVLTIDGGGIRGLIPGTILTFLEKKLQELDGPNARLADYFDYIAGTSTGGLITAMLAAPNKDKRPLFTAEGINKFYLENGPKIFPQRPDFANTLLELKGPKYDGEFLHSKIQGLLGATRVNETLTNVVIPAFDVKNLQPTIFSTFDTKDDAGNTRDFNLIDGGVAANNPTMVTINQITRKMIVDKQEIFPGGPTDYDKFLVISIGTGSGKGAATYTAKDAAGWGILSWLHTKEGYTPIVDMFSYSSAALVDYNVSILFQALRSEKNYLRIQDDSLKGTEATVDVATEENMKKLIEIGERMLATTVSRVDMETGKPVAVPEEGTNAEALTRFAKMLSDERKARTSSSSPEAIKPAGSAL

SEQ ID NO: 16336 - DNA, 1020 bp, Sorghum bicolor
  misc_feature: Ceres ANNOT ID no. 8656767
  misc_feature: Encodes the peptide sequence at SEQ ID NO 16337
atggagaggtacgaggtgatcaaggacataggatcgggtaacttcggggtggccaagctggtccgggacgtcaggaccaaggagctcttcgccgtcaagttcatcgagcgggggatgaagattgatgagaatgtccaaagagagatcatgaaccacaggtcgctgaggcatccaaacatagttaaatttaaggaggttgtgctaactcccacacatttggccatagttatggaatatgctgctggcggtgagctatttgaaaggatctgcaaagctggaagatttagtgaggatgaggcaagattcttcttccaacaactgatttcaggagttagctattgtcattcaatgcaaatatgtcatagagatttgaaactagaaaacactctcctggatggtagtatagcacctcggctaaagatatgtgattttggttactccaagtcctctgtgttgcactctcaaccaaaatcaactgtcgggacaccagcttacattgctccagaggtccttgctagaaaggaatatgatggaaaggtcgccgatgtttggtcatgtggagttactctgtatgtgatgcttgttggtgcttatccatttgaggaccccgacgaaccgaagaatttccgcaagacgcttactcggattctcagtgtccaatatgcggttcctgattttgtccgagtttcaatggagtgcagacatctgctgtctcggatctttgtggcgatccctgagcaacggataaccatcccagagatcaagaaccacccgtggttcttgaagaacctgcccatcgagatgaccgacgagtaccagatgaacctacagctggttgacatgaatggcccctcgcaaagtctggaggagatcatgaccatcatacaagaggcccggaagcccggtgacgggctgaagcattcgggacagctccctggcctggggagcatggagctggatgacattgatgtcgacgacatagatgttgaggacagcggtgactttgtatgtgccttgtga

SEQ ID NO: 16337 - protein, 339 aa, Sorghum bicolor
  misc_feature: Useful for making plants with modulated water use efficiency
  misc_feature: Functional homolog of the protein sequence given in SEQ ID NO 14094
  misc_feature: Useful for making plants with modulated biomass
  misc_feature: Functional homolog of the protein sequence given in SEQ ID NO 14178
  misc_feature: Useful for biocontainment applications
  misc_feature: Useful for making plants with modulated time to senescence
  misc_feature: Functional homolog of the protein sequence given in SEQ ID NO 14093
  misc_feature: Ceres ANNOT ID no. 8656767
  misc_feature (1)..(339): SWISSPROT Homolog: EC 2.7.11.1 Non-specific serine/threonine protein kinase
  misc_feature (4)..(260): Pfam ID: Pkinase Pfam Description: Protein kinase domain
MERYEVIKDIGSGNFGVAKLVRDVRTKELFAVKFIERGMKIDENVQREIMNHRSLRHPNIVKFKEVVLTPTHLAIVMEYAAGGELFERICKAGRFSEDEARFFFQQLISGVSYCHSMQICHRDLKLENTLLDGSIAPRLKICDFGYSKSSVLHSQPKSTVGTPAYIAPEVLARKEYDGKVADVWSCGVTLYVMLVGAYPFEDPDEPKNFRKTLTRILSVQYAVPDFVRVSMECRHLLSRIFVAIPEQRITIPEIKNHPWFLKNLPIEMTDEYQMNLQLVDMNGPSQSLEEIMTIIQEARKPGDGLKHSGQLPGLGSMELDDIDVDDIDVEDSGDFVCAL

SEQ ID NO: 16338 - DNA, 5649 bp, Sorghum bicolor
  misc_feature: Ceres ANNOT ID no. 8656775
  misc_feature: Encodes the peptide sequence at SEQ ID NO 16339
atggcggagattcgcaagtacgccatgtccaaccagcccccagatattcctcagatactactggaagctcagaataggtggttgcggcccaccgaaatctgccaaatattgtcaaactacaagaagttttccattgcgcctgagccgccgaacagacctcaaagtggttccctgtttctgtttgatcggaaaatattgagatacttcaggaaggatggacacaactggagaaagaaaaaggatggaaagacagttaaagaagctcatgagaagcttaaagttggcagtgttgatgtacttcattgctattatgcccatggcgaggagaatgagaacttccaaagacgaacatattggctgcttgaagagagtttcatgaatattgttcttgttcactaccttgaaatcaagggtgtcaaacaaagtttcaatcgtgctaaagaagctgaagagaatgcaggattatctcatgctgatagtcctgcatgttcaaactctttcgctagtcagagccaggtagcctcccaatctatggatgctgaaagcccaattagtggacagatttcggaatatgaagatgctgaaacagataattctcgagcaagctccagataccaccctttcactgagatgcagcagcctgtggatggtatcatgatgggttatcttggtgaaatgcaacctacgggagctaacttaaccaatcatttttccactcgcaatgacgtagctagtgtgttcaatgaaactggctctgagttaggaggtggtcccaaagcttcaattgattcagtgctgttgggtgaaccatttcaagaatatccaggcggcttcatggattcgacactctattcttctgttgcaacgttgggtaatagtctggatgatggtttgcagacatttatgtctgaggcgctctacaccaacaatctcacacaaaaggaggttgatgcacttagtgcagcaggcataacatcctcaaaggcagagaatgatggttatacagatcaaagtgtcaggtatccacttttaaagcagtcatcatcagatctctttaagatggagccagatggtttgaagaaatttgacagcttttcaaggtggatgaacaatgagcttccagaggttgctgatttggatatcaagtccagttctgatgctttctggagtactactgaaaccgtgaatgttgctgatggatctagtatacctattaatgagcagttggatgcatttgtagtcagcccctcactttctgaagagcagcttttcagtattattgatgtgtctccaagctgggcatacaatggcaaaaaaaccaaggtcttaattactggtacatttttggcaaaaaaagaagatgtggaaaatcgcaggtggtcttgtatgtttggagatgctgaagtctctgctgaagttttagtggatggctccttgcgttgctatacaccagtacatcgttctggacgagttccattttatgtgacatgttcaaatagagtagcttgtagtgaagtgcgagaatttgagttccgcgattctgagacacattatatggatacttcagatcagcatactactggcataaatgaaatgcatttacatatccgccttgataagttactttccttggaacaagaagactatgaaatgtatgtcttgagtaatggaaataagtctgagttgatcgacactatcaattcattgatgcttgacgataatttgtctaatctggcattgccatttgatgagaaggaattgtccactgtacgggatcagaatcttgagaaacaggtgaaagaaaagctgtattattggctcatccataagatacatgatgatggaaaaggtccaaatgtcctaggcaaggaaggacaaggtgccattcatttagtagctgcacttggctatgattgggctatcaaaccaatagttgctgcaggagtaaatataaacttcagggatattcgtggatggactgcacttcactgggctgcatcttgtggaagggagcggacagtaggtgccctaatagcaaacggagctgcatcaggtcctttaacagatccaacacagcagtatccatctggaagaactcctgctgatctagcatcagaaaatggtcacaaaggcattgctggttttcttgcagagtctgctttgacaagtcacctctcagctcttacactaaaggagtcacagggtggcaatgtggaagaaatatgtggagtaacagcaccagcagctgaagattttgcagaaccaagttcttctcagcttgcttgtgttaattctcaggaagagtccttaaaagattcacttggtgcagttcgtaaatcaactcaagccgcagccagaatatttcaagcttttagggtggaatcattccacagaaagaaggttatcgaatatggagatgatgattgtggactgtctgatgaacgcacactttcacttatttccctaagaaatccgaaacctggacatggtgatttgcattctgctgctgttcgtatccaaaacaagtttagaggatggaaaggaagaaaagagtttatgattatccggcagaaaattgtgaagatacaggcccatgtacgtggacatcaggtaaggaaaaactatcggaaggtagtctggtctgttggcattgtggagaaagtcatactgaggtggaggagaaagagaaggggtcttcgaggtttccaacccgagaaacaacttgaaggtccatcatggcagatccaacctgcaaaggctgaggctgaggatgaatatgatttcttgaaggatggcaggaaacaggctgaaggcaggttgcaaagagcactggctcgtgtgcattcaatgaatcagtatcctgaagcaagagaccagtaccgcaggctgcaagcctgtgttaacagcctacaagagtcccaggcgatgcaggacaggatgctggctgattcagctggcaccgatggggcctcattcgacctgctgcttcgcgcacttgccaacgcaggcaaactcgatggcgccctccaggtgttcgacgaaatgcggacgctcgggtgccgccctagcatgcggtcctgtaacagtatgctcaacaggcttgcacagactggggacctgggcgccgcagtggcagtgtttgagcagatgcagcgtgcagagattctgccagacgagtttacggtagcgattatggcaaaggcttactgcagggttaagggggtgggacatgcattggagttcgtggaggagatgagaaagatgggtgtggaggtgaacctagtggcgtatcatgcagtgatgaatggctattgtgaggtggggcagaccaacgatgcaaggaggatgttggattcgctgcctgggagaggtttgtcaccaaatatagttacatatacattgcttgtgaaagggtattgtaatgagaagaacatggaggaggctgagggggttgttcgggagattaggaagaataagcagcttgtggttgatgaggctgtttatggtgcagtgatcaatggctattgccaaatgggaagaatggaggacgcaactcgattactcaatgagatgatggatgctaacctccaggttaatttgtttgtgtataacacaatgattaatggatattgcaagttggggagaatggtggaagcacataacattttgcatgaaatggaaggtgttggtgtgaggccagatacatacagttacaatagcctagttgatgggtattgcagaaagggtttgatgaacaatgcttttgaaacatatgatacaatgttaaggaatggattcacagtgactacattaacatataatgcactcctaaaaggtttttgctcgcttggcttaattgacgatgcacttagactgtggttcttcatgttgaagaaaggtgttgcacctaacgaaatcagttgtagcaccttgcttgatggtttcttcaaggcaggtaaaactgagaaggccttaaacctttggaaagaaaccttagcaaggggactagcaaaaaatataaccacatttaacacagttatcaatgggttgtgtaagattgagaggatgtccgaagcagaagagcttgttgacaggatgaaggaatggagatgtcctcctgatattataacttacagaacattagttagtggttattgtaagataggtgacatggatagagctactcacattatgaatgaaatggaaaatttaggttttgctcctacagttgaattgttcaattctttgataactggacacttcatagctaagcaacatggaaagttgaatggtatactctttgaaatgagtactaggggactttctccaaacacagtcacatatggagctctgattgctggatggtgtaaagaaggagatttgcatacagcctataacttatattttgaaatggttgagaaaggtctgacaccaaatctttttatttgcagtgctttagtgagttgtttctacaggaagggaaaggttgatgaggcaaattcagtgttgcaaaatcttgttggtactgacatgattccagatatcagtgcgcccagacttgagatagggaaagtagcaaatttcattgatactgttgctgatggaaatcatcattctgcaaaaatcatgtggaacattgttatttttggtctatgcaaattgggaagaattgaagatgctaaaaacttgtttgcagatctaaaaagcaaggggtttgttgctgacaatttcacttattctagcctcatccatggttgttctgcttcaggatttgttgatgtagcttttgatctgagggatacaatgttgagtgtcggtctcactccaaatatagtaacctacaattctcttatatatggtctctgcaagtctggggagttatccagagctgttaatctttttaagaagttgcggacaaagggtatatgccctaatgctatcacctataatacattaattgataagcattgcaaggatggttacataaccgaggcctttaagctaaaacaaaggatgatagaggaaggtattcagcctaccgtgttcacctattctatactgattaatggtctctgtactcaaggttatatggaagaagcaatcaaacttcttgatcaaatgattgagaataatgtagatccaaattatgtcacatactggacgctgattcaaggttatgttagatgcggtaatatgatagagatttcaaagatttatgataagatgcatatccgtggacttctgtccaccaataacatgatagtaaaaggtacaccaattaagttcacctctcccagcggccaagagaaaataaaaccagagaaggaactacagcgtgccaggaaacaaataataaacaataaaattatcttttgcgaagggacatgcaaaagggcatatcatgagaaatgtttggaacctcccttagacaaaagtggtcaaccaaagcggcatcttttgagtacagctgctcatgttgcttcggcaaatagctggtttacaattttctacaacacaagggcaaacccttcagagtttgtcatatcgcttgcaaaatatgtcgaggctctgtaccatacccgtatatatgtggggatgcatttcaggatgctttttttgagacagcagacagaagagtctagcatatga

SEQ ID NO: 16339 - protein, 1882 aa, Sorghum bicolor
  misc_feature: The sequence is a functional homolog of SEQ ID NO 1309 in the 10/666,642 US patent application
  misc_feature: The sequence is a functional homolog of SEQ ID NO 1308 in the 10/666,642 US patent application
  misc_feature: Ceres ANNOT ID no. 8656775
  misc_feature (1201)..(1235): Pfam ID: PPR Pfam Description: PPR repeat
  misc_feature (1612)..(1646): Pfam ID: PPR Pfam Description: PPR repeat
  misc_feature (1341)..(1375): Pfam ID: PPR Pfam Description: PPR repeat
  misc_feature (1647)..(1681): Pfam ID: PPR Pfam Description: PPR repeat
  misc_feature (1682)..(1716): Pfam ID: PPR Pfam Description: PPR repeat
  misc_feature (1446)..(1480): Pfam ID: PPR Pfam Description: PPR repeat
  misc_feature (1271)..(1305): Pfam ID: PPR Pfam Description: PPR repeat
  misc_feature (1236)..(1270): Pfam ID: PPR Pfam Description: PPR repeat
  misc_feature (1376)..(1410): Pfam ID: PPR Pfam Description: PPR repeat
  misc_feature (1542)..(1576): Pfam ID: PPR Pfam Description: PPR repeat
  misc_feature (1166)..(1200): Pfam ID: PPR Pfam Description: PPR repeat
  misc_feature (1577)..(1611): Pfam ID: PPR Pfam Description: PPR repeat
  misc_feature (990)..(1024): Pfam ID: PPR Pfam Description: PPR repeat
  misc_feature (1095)..(1129): Pfam ID: PPR Pfam Description: PPR repeat
  misc_feature (1025)..(1059): Pfam ID: PPR Pfam Description: PPR repeat
  misc_feature (1306)..(1340): Pfam ID: PPR Pfam Description: PPR repeat
  misc_feature (1717)..(1751): Pfam ID: PPR Pfam Description: PPR repeat
  misc_feature (1130)..(1164): Pfam ID: PPR Pfam Description: PPR repeat
  misc_feature (1060)..(1094): Pfam ID: PPR Pfam Description: PPR repeat
  misc_feature (19)..(137): Pfam ID: CG-1 Pfam Description: CG-1 domain
  misc_feature (856)..(876): Pfam ID: IQ Pfam Description: IQ calmodulin-binding motif
  misc_feature (657)..(689): Pfam ID: Ank Pfam Description: Ankyrin repeat
  misc_feature (1823)..(1882): Pfam ID: Auxin_resp Pfam Description: Auxin response factor
MAEIRKYAMSNQPPDIPQILLEAQNRWLRPTEICQILSNYKKFSIAPEPPNRPQSGSLFLFDRKILRYFRKDGHNWRKKKDGKTVKEAHEKLKVGSVDVLHCYYAHGEENENFQRRTYWLLEESFMNIVLVHYLEIKGVKQSFNRAKEAEENAGLSHADSPACSNSFASQSQVASQSMDAESPISGQISEYEDAETDNSRASSRYHPFTEMQQPVDGIMMGYLGEMQPTGANLTNHFSTRNDVASVFNETGSELGGGPKASIDSVLLGEPFQEYPGGFMDSTLYSSVATLGNSLDDGLQTFMSEALYTNNLTQKEVDALSAAGITSSKAENDGYTDQSVRYPLLKQSSSDLFKMEPDGLKKFDSFSRWMNNELPEVADLDIKSSSDAFWSTTETVNVADGSSIPINEQLDAFVVSPSLSEEQLFSIIDVSPSWAYNGKKTKVLITGTFLAKKEDVENRRWSCMFGDAEVSAEVLVDGSLRCYTPVHRSGRVPFYVTCSNRVACSEVREFEFRDSETHYMDTSDQHTTGINEMHLHIRLDKLLSLEQEDYEMYVLSNGNKSELIDTINSLMLDDNLSNLALPFDEKELSTVRDQNLEKQVKEKLYYWLIHKIHDDGKGPNVLGKEGQGAIHLVAALGYDWAIKPIVAAGVNINFRDIRGWTALHWAASCGRERTVGALIANGAASGPLTDPTQQYPSGRTPADLASENGHKGIAGFLAESALTSHLSALTLKESQGGNVEEICGVTAPAAEDFAEPSSSQLACVNSQEESLKDSLGAVRKSTQAAARIFQAFRVESFHRKKVIEYGDDDCGLSDERTLSLISLRNPKPGHGDLHSAAVRIQNKFRGWKGRKEFMIIRQKIVKIQAHVRGHQVRKNYRKVVWSVGIVEKVILRWRRKRRGLRGFQPEKQLEGPSWQIQPAKAEAEDEYDFLKDGRKQAEGRLQRALARVHSMNQYPEARDQYRRLQACVNSLQESQAMQDRMLADSAGTDGASFDLLLRALANAGKLDGALQVFDEMRTLGCRPSMRSCNSMLNRLAQTGDLGAAVAVFEQMQRAEILPDEFTVAIMAKAYCRVKGVGHALEFVEEMRKMGVEVNLVAYHAVMNGYCEVGQTNDARRMLDSLPGRGLSPNIVTYTLLVKGYCNEKNMEEAEGVVREIRKNKQLVVDEAVYGAVINGYCQMGRMEDATRLLNEMMDANLQVNLFVYNTMINGYCKLGRMVEAHNILHEMEGVGVRPDTYSYNSLVDGYCRKGLMNNAFETYDTMLRNGFTVTTLTYNALLKGFCSLGLIDDALRLWFFMLKKGVAPNEISCSTLLDGFFKAGKTEKALNLWKETLARGLAKNITTFNTVINGLCKIERMSEAEELVDRMKEWRCPPDIITYRTLVSGYCKIGDMDRATHIMNEMENLGFAPTVELFNSLITGHFIAKQHGKLNGILFEMSTRGLSPNTVTYGALIAGWCKEGDLHTAYNLYFEMVEKGLTPNLFICSALVSCFYRKGKVDEANSVLQNLVGTDMIPDISAPRLEIGKVANFIDTVADGNHHSAKIMWNIVIFGLCKLGRIEDAKNLFADLKSKGFVADNFTYSSLIHGCSASGFVDVAFDLRDTMLSVGLTPNIVTYNSLIYGLCKSGELSRAVNLFKKLRTKGICPNAITYNTLIDKHCKDGYITEAFKLKQRMIEEGIQPTVFTYSILINGLCTQGYMEEAIKLLDQMIENNVDPNYVTYWTLIQGYVRCGNMIEISKIYDKMHIRGLLSTNNMIVKGTPIKFTSPSGQEKIKPEKELQRARKQIINNKIIFCEGTCKRAYHEKCLEPPLDKSGQPKRHLLSTAAHVASANSWFTIFYNTRANPSEFVISLAKYVEALYHTRIYVGMHFRMLFLRQQTEESSI

SEQ ID NO: 16340 - DNA, 1068 bp, Sorghum bicolor
  misc_feature: Ceres ANNOT ID no. 8656795
  misc_feature: Encodes the peptide sequence at SEQ ID NO 16341
atgacgaagcacaccgccttcgccgcggacgacgcgatcaccgccgccgccgtcacgtcgcagcccggccgccggttcacgtcgtacccgccgccgacgagggcgcgcggcggatgcagggtggccgcggcggcggcggcggcgcgccaggccacggaccccggcgccgtggtcgtggccgtggggtccttgccggaactcgtgccgcgccacgccgacctcgacttcgagaactggatggagaagcacccgtcggcattggccgagttcgagtcggtgctggccgccgccaaggggaagcagatcgtgatgttccttgactacgacggcaccctgtcgccgatcgttaaggaccccgacagcgccgtcatgtccgaggagatgcgagacgcggtgagaggcgtggccgagcacttcccgacggcgatcgtgagcgggaggtgtagagacaaggtgttcaacttcgtgaagctggcggagctgtactacgccgggagccacggcatggacatcaaggggcccacggcacagtccaagcacaccaaggcaaaggccgaagctgttctgtgccaaccagcgagcgcgttcctgccggtcattgacgaggtgtaccgcacgctgacggcgaggacagcgccgatccccggagcgacggtggagaacaacaagttctgcctctccgtccatttccgctgcgtccacgaggagaaatggcgcgctctggaggagcaggtccggtcggtgctcaaggagtacccggacctccggctcaccaagggcaggaaggtcttggagatccggccgtccatcgagtgggacaagggcaacgccctacagttcttgcttgagtccctcggtttcgctgacagtaacaatgtgttcccgatatatatcggagacgatcgcacggatgaggacgcgttcaaggtgctgcgcagcatgggccaagggatcggaatccttgtgagcaagattccaaaggagaccagtgcatcctactccttgcgtgaaccttctgaggtgaaggagttcctgcgcaagttggtgaggtccaagcagcgggactag

SEQ ID NO: 16341 - protein, 355 aa, Sorghum bicolor
  misc_feature: Useful for making plants with modulated drought sensitivity
  misc_feature: Functional homolog of the protein sequence given in SEQ ID NO 13424
  misc_feature: Useful for making plants with modulated flowering time
  misc_feature: Useful for making plants with modulated low light sensitivity
  misc_feature: Functional homolog of the protein sequence given in SEQ ID NO 13725
  misc_feature: The sequence is a functional homolog of SEQ ID NO 16 in US patent 7214858
  misc_feature: Useful for making plants with modulated water use efficiency
  misc_feature: Functional homolog of the protein sequence given in SEQ ID NO 13348
  misc_feature: Ceres ANNOT ID no. 8656795
  misc_feature (81)..(348): SWISSPROT Homolog: EC 3.1.3.12 Trehalose-phosphatase
  misc_feature (105)..(339): Pfam ID: Trehalose_PPase Pfam Description: Trehalose-phosphatase
MTKHTAFAADDAITAAAVTSQPGRRFTSYPPPTRARGGCRVAAAAAAARQATDPGAVVVAVGSLPELVPRHADLDFENWMEKHPSALAEFESVLAAAKGKQIVMFLDYDGTLSPIVKDPDSAVMSEEMRDAVRGVAEHFPTAIVSGRCRDKVFNFVKLAELYYAGSHGMDIKGPTAQSKHTKAKAEAVLCQPASAFLPVIDEVYRTLTARTAPIPGATVENNKFCLSVHFRCVHEEKWRALEEQVRSVLKEYPDLRLTKGRKVLEIRPSIEWDKGNALQFLLESLGFADSNNVFPIYIGDDRTDEDAFKVLRSMGQGIGILVSKIPKETSASYSLREPSEVKEFLRKLVRSKQRD

SEQ ID NO: 16342 - DNA, 1092 bp, Sorghum bicolor
  misc_feature: Ceres ANNOT ID no. 8656803
  misc_feature: Encodes the peptide sequence at SEQ ID NO 16343
atgacgaagcacgccgcctaccccagcgaggacgtggtcgccgttgtggcggcgccagtgccggtgagccggcatttcacatcgttcccgccgctaaaggatgcccctctcgactgcaagaagcatgttgtcgtggacctctccgcttctagggatgccatcatgggcggctcctggttcgagtccatgaaggcttcatcgccgcggcacgccgatgacgccgagcaccacggcgattggatggagaagcacccatcagcattggcgcagtttgaggcgctgctggccgccgccaaggggaagcagatcgtgttgttcctagactacgatggcaccctgtcaccaatcgtcgaggaccccgaccgcgccgtcatgtcagaagagatgagagaagccgtgcggcgtgtcgcggagcacttccccaccgcaattgtgagcggaagatgcagggacaaggtgttcaacttcgtgaagctgacggagctgtactacgccggaagccatggcatggacatccagggtcccgccaatcaccacctccaggcaaatgctgaagttgtccattaccaagctggaactgagtttctgcccgtcatcgaagaggtgtttggcacgctgacggcgaagatggaggcgatcgccggcgccaaggtggagaacaacaagtactgcctgtccgtccacttccgctgcgtcagggaggaggaatggaatgccgtgaacgaggaggtcaggtcggtgctcaaggactaccccaacctcaagctcactcacggcagaaaggtcctggagattcgcccgtccataaagtgggacaagggcaaggcccttgagttcttgctcaagtctcttggctatgctgggcgcaacgacgtcttcccgatttacatcggagatgatcgcactgacgaggacgctttcaagatgcttcgcaacatgggacagggcatcggaatcctggtgtcgaggctccctaaggagacggtggcatcctactcgctgagtgaccctaccgaggtcaaggagttcctctgcaagctggagaagtcggccaaggaggacgcgccagacctagctagtagtggattgtag

SEQ ID NO: 16343 - protein, 363 aa, Sorghum bicolor
  misc_feature: Useful for making plants with modulated drought sensitivity
  misc_feature: Functional homolog of the protein sequence given in SEQ ID NO 13424
  misc_feature: Useful for making plants with modulated flowering time
  misc_feature: Useful for making plants with modulated low light sensitivity
  misc_feature: Functional homolog of the protein sequence given in SEQ ID NO 13725
  misc_feature: Useful for making plants with modulated water use efficiency
  misc_feature: Functional homolog of the protein sequence given in SEQ ID NO 13348
  misc_feature: Ceres ANNOT ID no. 8656803
  misc_feature (106)..(353): SWISSPROT Homolog: EC 3.1.3.12 Trehalose-phosphatase
  misc_feature (106)..(338): Pfam ID: Trehalose_PPase Pfam Description: Trehalose-phosphatase
MTKHAAYPSEDVVAVVAAPVPVSRHFTSFPPLKDAPLDCKKHVVVDLSASRDAIMGGSWFESMKASSPRHADDAEHHGDWMEKHPSALAQFEALLAAAKGKQIVLFLDYDGTLSPIVEDPDRAVMSEEMREAVRRVAEHFPTAIVSGRCRDKVFNFVKLTELYYAGSHGMDIQGPANHHLQANAEVVHYQAGTEFLPVIEEVFGTLTAKMEAIAGAKVENNKYCLSVHFRCVREEEWNAVNEEVRSVLKDYPNLKLTHGRKVLEIRPSIKWDKGKALEFLLKSLGYAGRNDVFPIYIGDDRTDEDAFKMLRNMGQGIGILVSRLPKETVASYSLSDPTEVKEFLCKLEKSAKEDAPDLASSGL

SEQ ID NO: 16344 - DNA, 1722 bp, Sorghum bicolor
  misc_feature: Ceres ANNOT ID no. 8656864
  misc_feature: Encodes the peptide sequence at SEQ ID NO 16345
atggaggctggggaaatcggaggggccctcctcttcgtcctcgccgccgccgccgccgtcgcggtcgccgtgtccgtcggcgcggtcgacttcagccgcccgctcaccgcaggctcgccgctcgacttccagggggcggtgtcctggctcatcggcatcctcgatggcacgtcctccgcggcggcggacgtgtacggggcgtgggtggcggtgcgggccgggctgatcgcgccggtgctgcaggtggcggtgtgggcgtgcatggtgatgtcggtgatgctggtggtggaggccgtgtacaacagcgtcgtcagcctcggcgtcaaggccattgggtggcggcctgagtggaggttcaagtggaagcccctcgacggcgccgacgaggagaaggggagcgcccacttccctatggtcctagtccagatacccatgtacaatgagctggaggtgtacaagctgtcaatagcggcagcatgtgggctgcagtggccaaaggacaggataatggttcaagtgctggacgattccactgacccctttatcaagaatttggtggagcttgaatgtgagcactgggcgaacaaaggcgtcaatattaagtatgccacaagaaccagccgcaaggggttcaaggcaggggctctgaagaaaggaatggaatgtgactatgcaaggcaaagcgaatacattgccatatttgatgctgatttccagcctgaaccagattttctgctccgaactgtcccattccttctgcacaatcccgaagttgcacttgttcaagctcggtggtcctttgtgaatggcaccacaagcctgctgacaagggtacagaagatgttttacgactaccacttcaaagttgaacaagaagcgggatcagcaacctttgccttcttcagtttcaatggaactgctggagtgtggcgtaccatagccataagagatgcaggaggttggaaggaccgaactacagttgaagacatggacttggcagttcgagcaaccctaaagggctggaaatttgtatatgttggggacattagggtcaagagtgaactgccgtccacttacaaggcctactgtcggcagcaattccggtggtctagtggtggtgcaaacttattccgtaagatggcaaaggatgttttgtttgccaaggacatatcactcgtcaagaaaatccatatgctctatagcttcttctttgtgaggagagttgtagcgccaacggctgcctgtattctcttcaatgtcataatccccatctcagtcacagtcccggagctctacttaccagtgtggggtgttgcctatattcccatggtgcttaccatagtcacagttataagacatccaaaaaatctacacataatgcctttttggattttgtttgagagtgtgatgacattgcatcgcatgagagctgcagtgactggactgctggaattagaagggttcaaccagtggactgtgaccaagaaggtggggaatgatctcgaggacactgaagttcctttgcttcagaaaacccggaaaaggctaagggacagagtcaatttccttgagattggattttcggtgtttctcttcctctgtgcgtcatacaacctggtgttccatgggacaagaagctactacttgtatatgtaccttcagggattagcatttctgttactagggcttaacttcactggcacttgttcttgttgccaatga

SEQ ID NO: 16345 - protein, 573 aa, Sorghum bicolor
  misc_feature: Useful for making plants with altered carbohydrate content
  misc_feature: Functional homolog of the protein sequence given in SEQ ID NO 13964
  misc_feature: Useful for making plants with altered cell wall content and/or composition
  misc_feature: Functional homolog of the protein sequence given in SEQ ID NO 14018
  misc_feature: Ceres ANNOT ID no. 8656864
  misc_feature (131)..(498): SWISSPROT Homolog: EC 2.4.1.12 Cellulose synthase (UDP-forming)
  misc_feature (140)..(318): Pfam ID: Glycos_transf_2 Pfam Description: Glycosyl transferase family 2
MEAGEIGGALLFVLAAAAAVAVAVSVGAVDFSRPLTAGSPLDFQGAVSWLIGILDGTSSAAADVYGAWVAVRAGLIAPVLQVAVWACMVMSVMLVVEAVYNSVVSLGVKAIGWRPEWRFKWKPLDGADEEKGSAHFPMVLVQIPMYNELEVYKLSIAAACGLQWPKDRIMVQVLDDSTDPFIKNLVELECEHWANKGVNIKYATRTSRKGFKAGALKKGMECDYARQSEYIAIFDADFQPEPDFLLRTVPFLLHNPEVALVQARWSFVNGTTSLLTRVQKMFYDYHFKVEQEAGSATFAFFSFNGTAGVWRTIAIRDAGGWKDRTTVEDMDLAVRATLKGWKFVYVGDIRVKSELPSTYKAYCRQQFRWSSGGANLFRKMAKDVLFAKDISLVKKIHMLYSFFFVRRVVAPTAACILFNVIIPISVTVPELYLPVWGVAYIPMVLTIVTVIRHPKNLHIMPFWILFESVMTLHRMRAAVTGLLELEGFNQWTVTKKVGNDLEDTEVPLLQKTRKRLRDRVNFLEIGFSVFLFLCASYNLVFHGTRSYYLYMYLQGLAFLLLGLNFTGTCSCCQ

SEQ ID NO: 16346 - DNA, 690 bp, Sorghum bicolor
  misc_feature: Ceres ANNOT ID no. 8656883
  misc_feature: Encodes the peptide sequence at SEQ ID NO 16347
atggccgcgcggcgtctcggatccaccgcctccaggtggctgcgcccgtccgcgctgcttctcctggtcgcctccgctctcctcttggccccgtcgccggccagggccctccggttcgacctcgagtccggccacaccaagtgcatctccgacgagatcaaggtcaacgccatggccgtcggcaagtaccacatcgtcgggcccgaccccaacttccccgacgcccagctccccgaatcgcaccgcatctccctcagggtgacgtcgccgtacgggaacagcatgcactacgcggagaacgtgcagtcgggccacttcgccttcaccgcggcggaggccggcgactacctggcctgcttctgggcgcccgaccacaagcctccggtcaccatcgggttcgagttcgactggaggagcggcgtctccgccaaggactatcccagcgtcgccaagaagggcaaggtcgatatgatggaattggagctgaagaagctagaggaaactattagaaatatacatgaagagatgttttatctgcgtgaaagggaagaggaaatgcaggacctgaacaggcgaacaaactcaaggatggcttggttagggttcctctcccttggcatctgcttatcagtggcaggtttgcagctgtggcacctgaagaccttctttgagaggaagaagttgctgtag

SEQ ID NO: 16347 - protein, 229 aa, Sorghum bicolor
  misc_feature: Useful for making plants with altered carbohydrate content
  misc_feature: Functional homolog of the protein sequence given in SEQ ID NO 14181
  misc_feature: Useful for making plants with altered cell wall content and/or composition
  misc_feature: Functional homolog of the protein sequence given in SEQ ID NO 14182
  misc_feature: Ceres ANNOT ID no. 8656883
  misc_feature (76)..(137): Pfam ID: EMP24_GP25L Pfam Description: emp24/gp25L/p24 family/GOLD
MAARRLGSTASRWLRPSALLLLVASALLLAPSPARALRFDLESGHTKCISDEIKVNAMAVGKYHIVGPDPNFPDAQLPESHRISLRVTSPYGNSMHYAENVQSGHFAFTAAEAGDYLACFWAPDHKPPVTIGFEFDWRSGVSAKDYPSVAKKGKVDMMELELKKLEETIRNIHEEMFYLREREEEMQDLNRRTNSRMAWLGFLSLGICLSVAGLQLWHLKTFFERKKLL

SEQ ID NO: 16348 - DNA, 1245 bp, Sorghum bicolor
  misc_feature: Ceres ANNOT ID no. 8656907
  misc_feature: Encodes the peptide sequence at SEQ ID NO 16349
atggcctcctccacttgcgctcttgccctggttcttgcgctgtcggtcggtgcaagcgtggcgcgtggctccgagccctggtggaacgagacgcaggtgtacaccaccaccgccaactccggtggcagcaacggcgtcttcgtcggcctcaccctcatccagtcggcggcggccaagggagcggtgtgcttggatggaagcttaccaggttaccacctgcacagagggtttggatcaggagcgaacagttggcttgtcaatctcgagggtggaggctggtgcaatgatgtcagcagctgtgtgttccgcaagggtagtcgtcgtggatcatcaaatcacatggagcggcaactccagtttacagggataatgagtaacagacctgatgagaatcctgatttctacaactggaatagagtgaaggtccggtactgtgacggtggatccttcactggtgatggctctgatgcggctgcaggcctttatttccgaggtcagcgtatttggcaggccgctatggatgacctaatggcccaaggaatgcgttatgctaatcaggcccttctttctggatgctctgccggtggtgtttctaccatacttcactgtgatgaattccgtggattgtttccatcaaataccagagtcaaatgcctggctgatgctggaatgtttcttgacactgttgatgtttctggccgtcgggaaatgagatcttttttcaatggcattgtgagattgcagggttctggaagaagcttgcctaggtcttgcaccgcacgcatggacaaaacctcgtgctttttcccgcagaacgtgttaccaaacattcaaaccccaacttttgttttgaacactgcctatgacgtgtggcagcttcaacaaagtgtggcccccagaacagctgatccccaaggtctttggtcaaagtgtaggacgaaccacgctttctgtaatagcaaccagcttcagtttttgcaagggtttaggaaccaaatgcttgatgccgtgaagggtttttctgcgtcaaggcgaaatggtttgttcatcaactcatgttttgctcattgccagagcgagagacaggatacttggtatgcgaacaactcgccacgtcttggtaacaagaaaatcgctgacgctgtcggtgattggttctttgagaggggagacgccaagtacacagactgcccatacccttgcgatggcacttgccatcatcttgtgttcaggggagaccattaa

SEQ ID NO: 16349 - protein, 414 aa, Sorghum bicolor
  misc_feature: Useful for making plants with altered carbohydrate content
  misc_feature: Functional homolog of the protein sequence given in SEQ ID NO 13670
  misc_feature: Useful for making plants with altered cell wall content and/or composition
  misc_feature: Functional homolog of the protein sequence given in SEQ ID NO 14015
  misc_feature: Ceres ANNOT ID no. 8656907
  misc_feature (32)..(395): Pfam ID: PAE Pfam Description: Pectinacetylesterase
MASSTCALALVLALSVGASVARGSEPWWNETQVYTTTANSGGSNGVFVGLTLIQSAAAKGAVCLDGSLPGYHLHRGFGSGANSWLVNLEGGGWCNDVSSCVFRKGSRRGSSNHMERQLQFTGIMSNRPDENPDFYNWNRVKVRYCDGGSFTGDGSDAAAGLYFRGQRIWQAAMDDLMAQGMRYANQALLSGCSAGGVSTILHCDEFRGLFPSNTRVKCLADAGMFLDTVDVSGRREMRSFFNGIVRLQGSGRSLPRSCTARMDKTSCFFPQNVLPNIQTPTFVLNTAYDVWQLQQSVAPRTADPQGLWSKCRTNHAFCNSNQLQFLQGFRNQMLDAVKGFSASRRNGLFINSCFAHCQSERQDTWYANNSPRLGNKKIADAVGDWFFERGDAKYTDCPYPCDGTCHHLVFRGDH

SEQ ID NO: 16350 - DNA, 591 bp, Sorghum bicolor
  misc_feature: Ceres ANNOT ID no. 8656890
  misc_feature: Encodes the peptide sequence at SEQ ID NO 16351
atgtttggcaaaagattgcacggattcctgctcctgctcgtcttccttctggcaaacgtagcaggcagccatgctgaaaccaccgtcgatccagattcagtggacggcagcaagaggaggtcgctggccaccagcttgttctgtgtggcgaaacagggcgcggacccgacggctctgcagatgggactgaactgggcgtgcgggccggggcaagcgaactgtgcgcccattcagcccggcgggtcgtgctacaagcaggacaacctggaggcgctagcgtcctacgcctacaacgactactaccagaagaactttgccaccggcgcctcttgcaacttcaacggcacggccgcgaccaccacctctgatcccagctcggggcagtgtgtcttcacaggaagctccatggcaggaggcagcacgccggctgcgagcgcccccagcggcctctccccgccgtcaacgttcacgccgggcatcgggagcccttccaacaccctgatccctctggacggcgcggagagcctagtgtccagcgcccggtgggcgatctgcgccctgctgctggcgttgccgctcttcttcctctga

SEQ ID NO: 16351 - protein, 196 aa, Sorghum bicolor
  misc_feature: Useful for making plants with altered carbohydrate content
  misc_feature: Functional homolog of the protein sequence given in SEQ ID NO 14016
  misc_feature: Useful for making plants with altered cell wall content and/or composition
  misc_feature: Functional homolog of the protein sequence given in SEQ ID NO 14017
  misc_feature: Ceres ANNOT ID no. 8656890
  misc_feature (47)..(131): SWISSPROT Homolog: EC 3.2.1.39 Glucan endo-1,3-beta-D-glucosidase
  misc_feature (46)..(131): Pfam ID: X8 Pfam Description: X8 domain
MFGKRLHGFLLLLVFLLANVAGSHAETTVDPDSVDGSKRRSLATSLFCVAKQGADPTALQMGLNWACGPGQANCAPIQPGGSCYKQDNLEALASYAYNDYYQKNFATGASCNFNGTAATTTSDPSSGQCVFTGSSMAGGSTPAASAPSGLSPPSTFTPGIGSPSNTLIPLDGAESLVSSARWAICALLLALPLFFL

SEQ ID NO: 16352 - DNA, 1110 bp, Sorghum bicolor
  misc_feature: Ceres ANNOT ID no. 8656940
  misc_feature: Encodes the peptide sequence at SEQ ID NO 16353
atggtgagccctaataagctcgccgtcctcactgtcttcgccctgctcggctccgtgtcttgccaggacggaggctactaccctcctcctccggctccggccaccccgccaccaccagcatgccctccacctcctccaagcccaagcccacccccagctacgccggcacccccaccacccccagggacgcaactcatggtcggatactacaagaacaagtgcggcgcttacgtggacgttgaggccatcgtcaagaagcacgtcaatgccactgatgctggcatgcaggccgggcttgtccgtatgttcttccacgactgcttcatccgtggatgcgacgcctccgtcctcctggactcgttcagcaacgacacgagcctgaccccggagaagttcagcgtgcccaacttccccagcctacgcgggtacgaggtgatcgacgcggccaaggcggagatcgaggcggcatgccccagcgtcgtctcgtgcgcggacatcgtcgcgttcgccgcccgcgacgcgtcctacttcctcagcggcggcggcatcaacttcgccatgcccgccggccgctacgacggcaacgtgtccctcgccagcgaggccctgccgaaccttcccccgccgttcgccggcttcgacctgctcgtccagatgttcgccgccaaggggctggactacgtcgacatgatcacgctctccggcgcgcacagcatcggccgctcccactgctcctccttcagcagggaccgcctgccgcccagcaacacctccgacatggacccggcgttcgccgccacgctgcaggctgcctgcgcgtcgcccaacggcaccgacaacacggtggtgcaggacttccagacccccgacgtcctggacaaccagtactacaaggacgtgctggcacacaaggtgctcttcacgtcggacgccgcgctcaccaccaacatcacatccaacaacctggtgcgcgcctacgcggacttcgttcccttcctgtggcagaataagttcggcaaggccatggtgaagatgggcggcatagagatcaagaccgccgccaacggggagatcaggaccaactgccgcaaagtcaacggcaggccgtga

SEQ ID NO: 16353 - protein, 369 aa, Sorghum bicolor
  misc_feature: Useful for making plants with altered carbohydrate content
  misc_feature: Functional homolog of the protein sequence given in SEQ ID NO 13714
  misc_feature: Ceres ANNOT ID no. 8656940
  misc_feature (64)..(366): SWISSPROT Homolog: EC 1.11.1.7 Peroxidase
  misc_feature (80)..(329): Pfam ID: peroxidase Pfam Description: Peroxidase
MVSPNKLAVLTVFALLGSVSCQDGGYYPPPPAPATPPPPACPPPPPSPSPPPATPAPPPPPGTQLMVGYYKNKCGAYVDVEAIVKKHVNATDAGMQAGLVRMFFHDCFIRGCDASVLLDSFSNDTSLTPEKFSVPNFPSLRGYEVIDAAKAEIEAACPSVVSCADIVAFAARDASYFLSGGGINFAMPAGRYDGNVSLASEALPNLPPPFAGFDLLVQMFAAKGLDYVDMITLSGAHSIGRSHCSSFSRDRLPPSNTSDMDPAFAATLQAACASPNGTDNTVVQDFQTPDVLDNQYYKDVLAHKVLFTSDAALTTNITSNNLVRAYADFVPFLWQNKFGKAMVKMGGIEIKTAANGEIRTNCRKVNGRP

SEQ ID NO: 16354 - DNA, 1758 bp, Sorghum bicolor
  misc_feature: Ceres ANNOT ID no. 8656896
  misc_feature: Encodes the peptide sequence at SEQ ID NO 16355
atgtcctcctccgacacggacgacgtccccgacggtggcgaggactcgcccctcttccgccgcagcggggggccctcctcgggcagctccgtcggcgacgttcccgtctcgcagtcgctcatcaaggcggcgagcaacgtgtgcttctccctcttcgtgctcgccgtcctcgtcgtcaccgtcgtcgccgtcacctaccagccgccggacccctggttccagtcctccgccgccatcaccacctcgctctcccgtgtcctccccaactccaccttcctcgtccccgacgactcgctcctacccaccggcgaggacttcaactcctcctcctccgcccccgccgtcccggcaccggcgcgggacgacaacgacgacgcggccgcggccgtcagcgccgcctccgccgccgccgcgggcaacaggacctgcgacccggacgcgccgctcaactgctccgacccgcgcgtcctcgccgccgtcaaggcgttcaatgccagggccttcttccgcaagtccatcgtgtttctcagctacgagacgccggtgcccgggcccaagcccggccagtgcgacgtcgcctggaggttcaggaaccgccgggagaagtcgtggcgccgctacagggattaccgccggttcagcctcgcctcgggcgatggctgcgctcttgacatcgtcagcgtcggcaagttccggtcggggacgaatgcagctcgccggccgtatcctaagggcccgaagaggccccgtgtgtcgccgccgcctgtggatgcggagatcaatgacacaatccccgtcgtcggatcagaggcagagttcaagaagggaaagtatttgtactatatgagaggtggtgaccattgcaagagcatgaaccagttcatttggagcttcctgtgtgggctcggtgaagccaagttcctcaaccggacgttcgtgatggatctgaatatttgtttgtctggggcacacacggtggatgggaaggatgtggatgggaaagatttccggtactattttgattttgagcacttgaaggagagtgtgccggtggtggaggaaggggacttcttgaaggattggaagcggtgggataagaagaagaagaagggtccaggacggatcacagtgcggaaggttccatcgtacaagataacaccgatgcaactgaagaaggacaagagcaacatcatctggaggcaatttaatggccaggagcccgagaattactggtaccgagtttgcgaagggcgagctgccaaagtcattcaaaggccttggtatgctatttggaagtcgaagaggctgatgaacattgtgactgagattgcaggtaggatggattgggattatgatggcttgcatgttgtccgagggtggaaggcgcagaacaagcaaatgtatccaaacctggattctgacacatcgcctgatgcacttgttgataaggtgaccaagcttgttaagccatggagaaatctatacatcgcaactaatgagccgttctataactacttcgacaagctaaggtcacacttccatatccatttgcttgatgattacaaggagctctggtcaaacactagtgaatggtacaatgagacaacaacgcttagtcagggtaagccagtgccattcgacgcatacatgagggtgattgtggacactgaggtattttacagatcgaaggcacaagttgagacattcaacaacttgacaagggattgcaaagatggaattaatacgtgcaacttgtga

SEQ ID NO: 16355 - protein, 585 aa, Sorghum bicolor
  misc_feature: Useful for making plants with modulated light quality sensitivity
  misc_feature: Functional homolog of the protein sequence given in SEQ ID NO 14148
  misc_feature: Ceres ANNOT ID no. 8656896
MSSSDTDDVPDGGEDSPLFRRSGGPSSGSSVGDVPVSQSLIKAASNVCFSLFVLAVLVVTVVAVTYQPPDPWFQSSAAITTSLSRVLPNSTFLVPDDSLLPTGEDFNSSSSAPAVPAPARDDNDDAAAAVSAASAAAAGNRTCDPDAPLNCSDPRVLAAVKAFNARAFFRKSIVFLSYETPVPGPKPGQCDVAWRFRNRREKSWRRYRDYRRFSLASGDGCALDIVSVGKFRSGTNAARRPYPKGPKRPRVSPPPVDAEINDTIPVVGSEAEFKKGKYLYYMRGGDHCKSMNQFIWSFLCGLGEAKFLNRTFVMDLNICLSGAHTVDGKDVDGKDFRYYFDFEHLKESVPVVEEGDFLKDWKRWDKKKKKGPGRITVRKVPSYKITPMQLKKDKSNIIWRQFNGQEPENYWYRVCEGRAAKVIQRPWYAIWKSKRLMNIVTEIAGRMDWDYDGLHVVRGWKAQNKQMYPNLDSDTSPDALVDKVTKLVKPWRNLYIATNEPFYNYFDKLRSHFHIHLLDDYKELWSNTSEWYNETTTLSQGKPVPFDAYMRVIVDTEVFYRSKAQVETFNNLTRDCKDGINTCNL

SEQ ID NO: 16356 - DNA, 1086 bp, Sorghum bicolor
  misc_feature: Ceres ANNOT ID no. 8656953
  misc_feature: Encodes the peptide sequence at SEQ ID NO 16357
atggccggacttgccgtcctcgtcttggttgcgttgctcgccgccgccactgctcaagcccaagggtcctacggctatggcaaatctcctgctcctgcagcaagcccgccggagagcgcccccatgccgccgccgagctcaagcccaccaacccagactcctccacctccggcttctcctcggacaaggctgaggttcgacttctacaagcggtcgtgcccttacgccgaggaaatcgtcagggaggccgtcaggaacgccatcaacgtcaaccccggcctcggcgccggcctcatccgcatggccttccacgactgcttcgtccagggctgcgacggctcagtgctgctcgacccgacgccggcgaacccacggccggagaagctcagcccggcaaacttccccagcctgcgtggcttcgacgtggtggacgcggccaaggcggcgctcgagaaggcctgcccaggcgtcgtctcctgcgccgacgtcgtccagttcgccgcccgcgacgccgccttcttcctcagcggctccaagatccactacagcctccctgggggacgcttggacggccgcgtgtccgtggagaacgagacgttcgccttcctgccggggccgtccttcaacctctcccggctcatccagagcttcaaggtcaaaggcctgagcgtcgacgacctcgtcgtgctctccggcgcccacaccatcggcctctcccactgctcctccttcctcaccgtctccacgccgccgtccgacatgaaccctggcctcgccgccgtactcaagaagcagtgcccggccaaccccaacttcaccaacgaccccacggtggtgcaggacgtcgtcacccccgacaagctcgacaaccagtactactggaacgtgctgcgtcacaaggtgctgttcaaatccgacgcggcgctgatggcgtcgacgcagacggcgaggatggtgctcgagaacgctggcatccgaggaaggtttgagaggaagttcgcccgggcgatgctcaagatgtcgttcatcgaggtcaagaacgctgccaacggcgagatcaggaagagctgccatgtcgccaactag

SEQ ID NO: 16357 - protein, 361 aa, Sorghum bicolor
  misc_feature: Useful for making plants with altered carbohydrate content
  misc_feature: Functional homolog of the protein sequence given in SEQ ID NO 13714
  misc_feature: Ceres ANNOT ID no. 8656953
  misc_feature (64)..(361): SWISSPROT Homolog: EC 1.11.1.7 Peroxidase
  misc_feature (80)..(325): Pfam ID: peroxidase Pfam Description: Peroxidase
MAGLAVLVLVALLAAATAQAQGSYGYGKSPAPAASPPESAPMPPPSSSPPTQTPPPPASPRTRLRFDFYKRSCPYAEEIVREAVRNAINVNPGLGAGLIRMAFHDCFVQGCDGSVLLDPTPANPRPEKLSPANFPSLRGFDVVDAAKAALEKACPGVVSCADVVQFAARDAAFFLSGSKIHYSLPGGRLDGRVSVENETFAFLPGPSFNLSRLIQSFKVKGLSVDDLVVLSGAHTIGLSHCSSFLTVSTPPSDMNPGLAAVLKKQCPANPNFTNDPTVVQDVVTPDKLDNQYYWNVLRHKVLFKSDAALMASTQTARMVLENAGIRGRFERKFARAMLKMSFIEVKNAANGEIRKSCHVAN

SEQ ID NO: 16358 - DNA, 1083 bp, Sorghum bicolor
  misc_feature: Ceres ANNOT ID no. 8656952
  misc_feature: Encodes the peptide sequence at SEQ ID NO 16359
atggctaggcttggcgtcatcgtcttggttgccctgctcgccgccgccgccgctcaagcgcaagggtcctacggcagtggctatgctgttcctgcattaagcttggagagcgcccccgtgccgccgccgatctcaagcccaccaccagcccagactccaccaccaccggcttcagctcggccaaagctgaggttcgacttctacaagcggtcgtgcccttacgccgaggaaatcgtcagggaggccgtgaggaacgccaccaatgtcaaccccggcctcggcgccggcctcatccgcatggccttccatgactgcttcgtccagggctgcgacggctcagttctgctcgacccgacgccggcgaacccgcggccggagaagctcagcccggcaaacttccccagcctgcgcggcttcgacgtggtggacgcggccaaggcggcgctcgagaaggcctgcccgggcgtcgtctcctgcgccgacgtcgtccagttcgccgcccgcgacgccgccttcttccttagcggctccaaggtctactacagcctccccgggggacgcttcgacggccgcgtgtccttcgagaacgagacgttcaccttcctgccaccgccgtccttcaacctctccgagctcatccagaacttcaaggtcaagggcctgaacgtcgacgacctcgtcgtgctctccggcgcccacaccatcggcctctcccactgctcgtccttcctcagcatctccacgccgccgtccgacatgaaccctggcctcgccaccgtactcaagaagcagtgcccggccaagcccaatttcaccaacgaccccacggtggtgcaggacgtcgtcacccccgacaagctggacaaccagtactaccggaacgtgctacatcacaaggtgctgttcaagtccgatgcggcccttctcaactcgacggagacggcgaagaaggtggccgagaacgccttgatccgtgggaggtgggagaggaagttcgccaaggcgatgctgaagatgtcgctcctcgacatcaagactgccgccaacggagagatccggaagaagtgccacgtcgtcaactag

SEQ ID NO: 16359 - protein, 360 aa, Sorghum bicolor
  misc_feature: Useful for making plants with altered carbohydrate content
  misc_feature: Functional homolog of the protein sequence given in SEQ ID NO 13714
  misc_feature: Ceres ANNOT ID no. 8656952
  misc_feature (63)..(360): SWISSPROT Homolog: EC 1.11.1.7 Peroxidase
  misc_feature (79)..(324): Pfam ID: peroxidase Pfam Description: Peroxidase
MARLGVIVLVALLAAAAAQAQGSYGSGYAVPALSLESAPVPPPISSPPPAQTPPPPASARPKLRFDFYKRSCPYAEEIVREAVRNATNVNPGLGAGLIRMAFHDCFVQGCDGSVLLDPTPANPRPEKLSPANFPSLRGFDVVDAAKAALEKACPGVVSCADVVQFAARDAAFFLSGSKVYYSLPGGRFDGRVSFENETFTFLPPPSFNLSELIQNFKVKGLNVDDLVVLSGAHTIGLSHCSSFLSISTPPSDMNPGLATVLKKQCPAKPNFTNDPTVVQDVVTPDKLDNQYYRNVLHHKVLFKSDAALLNSTETAKKVAENALIRGRWERKFAKAMLKMSLLDIKTAANGEIRKKCHVVN

SEQ ID NO: 16360 - DNA, 1098 bp, Sorghum bicolor
  misc_feature: Ceres ANNOT ID no. 8656941
  misc_feature: Encodes the peptide sequence at SEQ ID NO 16361
atgatgagccctaataagctcgccgtcctcactgtcatcttcgccgtgctcggctccgtgacttgccagggcggaggctactactcatccccgcctccgcctccgactacaccatcaccacccgtttaccactacccatccccgcaaccaccaccaagccctcctactgcagggtcccaactcatagtcgggtattacaagaacaaatgtggcgcttacgtggatgtggaggccattgtcaagaagcacgtcaaggccactgatgctggcatgcaggcaggccttgtccgtatgttcttccacgactgcttcatccgtggatgcgacgcctccgtcctcctggacacgttcagcaacgacaccagcctaaccccggagaagttcgccgtgcccaacttccccagcctacggggctacgaggtgatcgacgcggccaaggaggagatcgaggcggcatgccctggcaaggtctcgtgcgcggacatcatcgcgttcgccgcccgcgacgcgtcctacttcctcagcggcggcggcatcaacttcgccatgcccgccggccgctatgacggcaacgtgtccctcgccagcgaggccctgtcgaacctgcccccgccgttcggcggcttcgaccagctcgtcaagatgttcgccgccaagggcctcgacgccttcgacatggtcacgctctccggcgcgcacagtatcggccgctcccactgctcctccttcaccagggaccgcctcccgcccagcaacacctccgacatggacccggcgttcgccgccacgctgcaggctgactgcgcgtcggccgacggcaccgacaacacggtgatgcaggacttccagacccccgacgtcctggacaaccagtactataagaacgtgctggcgcacaaggttctcttcacatcggacgcggcgctcaccaccgacttcatggccaaaaacctggtgcgcgcttacgcggatttcgtcccctatttgtggcagaataagttcggcaaagccatggtgaagatgggcggcattgaggtcaagaccgccgccaacggggagatcaggaagacgtgccgtaaaatcaacagcaggtcgtga

SEQ ID NO: 16361 - protein, 365 aa, Sorghum bicolor
  misc_feature: Useful for making plants with altered carbohydrate content
  misc_feature: Functional homolog of the protein sequence given in SEQ ID NO 13714
  misc_feature: Ceres ANNOT ID no. 8656941
  misc_feature (59)..(362): SWISSPROT Homolog: EC 1.11.1.7 Peroxidase
  misc_feature (80)..(325): Pfam ID: peroxidase Pfam Description: Peroxidase
MMSPNKLAVLTVIFAVLGSVTCQGGGYYSSPPPPPTTPSPPVYHYPSPQPPPSPPTAGSQLIVGYYKNKCGAYVDVEAIVKKHVKATDAGMQAGLVRMFFHDCFIRGCDASVLLDTFSNDTSLTPEKFAVPNFPSLRGYEVIDAAKEEIEAACPGKVSCADIIAFAARDASYFLSGGGINFAMPAGRYDGNVSLASEALSNLPPPFGGFDQLVKMFAAKGLDAFDMVTLSGAHSIGRSHCSSFTRDRLPPSNTSDMDPAFAATLQADCASADGTDNTVMQDFQTPDVLDNQYYKNVLAHKVLFTSDAALTTDFMAKNLVRAYADFVPYLWQNKFGKAMVKMGGIEVKTAANGEIRKTCRKINSRS

SEQ ID NO: 16362 - DNA, 777 bp, Sorghum bicolor
  misc_feature: Ceres ANNOT ID no. 8656943
  misc_feature: Encodes the peptide sequence at SEQ ID NO 16363
atggcgtttacaacaaggacagattacattggttggatctcaacaaacctacttggttgcgatgcctccgttctgctcgacccgaccagcaccaaccagcagccggagaagctcggcatacccaacttccctagcctgcgcggctacgaggtgatcgacgcggccaaggacgagctcgagaaggcatgccccggcaaggtctcgtgcgcggacatcgtcgccttcgccgcccgcgacgcgtcctacttcctcagcggcggacgcatcagcttcgacatgcccgccggccgctacgacgggaatgtgtccctcgccagcgagaccctgccgaacctgcccccgccgttcgccggcttcgaccagctcgagaagatgttcgccgacaaggggctcgacgctttcgatatggtcactctctccggcgcgcacagcatcggccgctcccactgctcgtccttcagcagggaccgcctcccgcccagcagcacctcggacatggacacggcgttcgccgccaagctgcaggcgagctgcgcgactacaagacccccgacgacctaccagaacgtgctggatcgcaaggttctcttcacgtcggacgctgcgctcacctcggacgacatggcgaacaacctggtgcgtgtctacgcgatctttccatggttgtgggaggacaagttcgcggaagccatggtgaagatgggccgcatcgagatcaagacggacaccgccggggaaatcaggaagaggtgccgcgtggtcaacagcaaaccatga

SEQ ID NO: 16363 - protein, 258 aa, Sorghum bicolor
  misc_feature: Useful for making plants with altered cell wall content and/or composition
  misc_feature: Functional homolog of the protein sequence given in SEQ ID NO 14378
  misc_feature: Useful for making plants with altered carbohydrate content
  misc_feature: Functional homolog of the protein sequence given in SEQ ID NO 14379
  misc_feature: Ceres ANNOT ID no. 8656943
  misc_feature (19)..(189): SWISSPROT Homolog: EC 1.11.1.7 Peroxidase
  misc_feature (10)..(219): Pfam ID: peroxidase Pfam Description: Peroxidase
MAFTTRTDYIGWISTNLLGCDASVLLDPTSTNQQPEKLGIPNFPSLRGYEVIDAAKDELEKACPGKVSCADIVAFAARDASYFLSGGRISFDMPAGRYDGNVSLASETLPNLPPPFAGFDQLEKMFADKGLDAFDMVTLSGAHSIGRSHCSSFSRDRLPPSSTSDMDTAFAAKLQASCATTRPPTTYQNVLDRKVLFTSDAALTSDDMANNLVRVYAIFPWLWEDKFAEAMVKMGRIEIKTDTAGEIRKRCRVVNSKP

SEQ ID NO: 16364 - DNA, 1050 bp, Sorghum bicolor
  misc_feature: Ceres ANNOT ID no. 8656957
  misc_feature: Encodes the peptide sequence at SEQ ID NO 16365
atggccaccaccaccaggcttgctgctgctctgacttcacttgctgcgctgctgtgttcggtcatgacttcctgccatgctgacggctacggttactaccccagcccgaccccgacgccgacgccgacgccgaccccgagcggcgccggcctggccgttggcttctacagctactcgtgccccaacgccgaagccatcgtgaggggcgtcgtgacgaaggccgtgcagcagaaccctggcgtcggcgcaggactcatccgaatgctcttccacgactgcttcgtccagggttgcgacggctccgtgctcctcgacccaaccacggcgaacccgcagccggagaagctatcgccggccaacttcccgagcctgcgtggtttcgaggtcatcgacgacgccaagtccgcgctcgaggccgcgtgcccgggcaccgtctcctgcgccgacgtcgtcgccttcgccggccgcgacgccagcgccgtcctcagcggtggcagggccaacttcgcgatgcccgcggggcgccgcgacggccgggtgtccctgtccagcgagacgctccagttcctgccacctccgtccttcaacctctcccagctcgccgccagcttcgccgacaaggggctcggcgtcgacgacctcgtcgtgctctccggcgcgcacaccgtcggccgctcccactgctcgtccttcgtcagagacggccgcctcaacgcgtccacgtccgacatgaaccccgcgctggccgcgtcgctgcggcagcagtgcccggccaacgccgccactgacaacaccgtggtgcaggacgtcgtgacgccggacgcgctggacaaccagtactacaagaacgtgatggcccggaacgtgctcttcacgtcggacgcggcgctcctccagtcctcgaagaccgcggcgtccgtggcgctcaacgccattgtgccggggctgtgggagcagaagttcaaggtggccatggtcaagatggccagcatcggggtgaagaccggcaccaacggcgagatcaggaccaactgccgggtcgtcaactag

SEQ ID NO: 16365 - protein, 349 aa, Sorghum bicolor
  misc_feature: Useful for making plants with modulated oxidative stress sensitivity
  misc_feature: Functional homolog of the protein sequence given in SEQ ID NO 13607
  misc_feature: Useful for making plants with altered cell wall content and/or composition
  misc_feature: Functional homolog of the protein sequence given in SEQ ID NO 13958
  misc_feature: Ceres ANNOT ID no. 8656957
  misc_feature (49)..(349): SWISSPROT Homolog: EC 1.11.1.7 Peroxidase
  misc_feature (67)..(313): Pfam ID: peroxidase Pfam Description: Peroxidase
MATTTRLAAALTSLAALLCSVMTSCHADGYGYYPSPTPTPTPTPTPSGAGLAVGFYSYSCPNAEAIVRGVVTKAVQQNPGVGAGLIRMLFHDCFVQGCDGSVLLDPTTANPQPEKLSPANFPSLRGFEVIDDAKSALEAACPGTVSCADVVAFAGRDASAVLSGGRANFAMPAGRRDGRVSLSSETLQFLPPPSFNLSQLAASFADKGLGVDDLVVLSGAHTVGRSHCSSFVRDGRLNASTSDMNPALAASLRQQCPANAATDNTVVQDVVTPDALDNQYYKNVMARNVLFTSDAALLQSSKTAASVALNAIVPGLWEQKFKVAMVKMASIGVKTGTNGEIRTNCRVVN

SEQ ID NO: 16366 - DNA, 1050 bp, Sorghum bicolor; identical to SEQ ID NO: 16364
  misc_feature: Ceres ANNOT ID no. 8656961
  misc_feature: Encodes the peptide sequence at SEQ ID NO 16367

SEQ ID NO: 16367 - protein, 349 aa, Sorghum bicolor; identical to SEQ ID NO: 16365
  misc_feature: Useful for making plants with modulated oxidative stress sensitivity
  misc_feature: Functional homolog of the protein sequence given in SEQ ID NO 13607
  misc_feature: Useful for making plants with altered cell wall content and/or composition
  misc_feature: Functional homolog of the protein sequence given in SEQ ID NO 13958
  misc_feature: Ceres ANNOT ID no. 8656961
  misc_feature (49)..(349): SWISSPROT Homolog: EC 1.11.1.7 Peroxidase
  misc_feature (67)..(313): Pfam ID: peroxidase Pfam Description: Peroxidase

SEQ ID NO: 16368 - DNA, 1782 bp, Sorghum bicolor
  misc_feature: Ceres ANNOT ID no. 8656977
  misc_feature: Encodes the peptide sequence at SEQ ID NO 16369
atggggctctgccatggcaagccgacgcaaatcccggaggccgaggcggaggaggatccccacgtagcctccggcgcgggcgacggcggggacggggcgacctcgccgtcggcggcgacggcgcccgcggccaagccgggcacgccgaagcagcccaagttcccgttctacctgcccagcccgctcccgccgtccagctacaagggctcgccggcgaactcgagcgtcgcgtccacgccggcgcgcggcgggttcaagcgcccgttcccaccgccgtcgcccgccaagcacatccgcgctctcctcgcgcggcggcatggctccgtcaagcccaacgaggcgtccatccccgagggcggcgagccggagctcggcctcgacaagagcttcggcttctccaagcacttcttcgccaggtacgacctcggcgaggaggtcggccgcggccacttcggctacacgtgctccgccaaggccaagaagggcgagcacaagggccaggacgtcgccgtcaaggtcatccccaaggccaagatgacaacagctattgccattgaagatgtgagaagagaagtgagaatattgagttctctgacaggccacagtaacctagtgcagttctacgatgctttcgaggatgaagataacgtgtatatagttatggaattatgtaaaggaggtgaactgctggataggatattggctagaggtggaaagtactctgaagaggatgcgaaggttgttatggtacaaattttgagtgttgtatcattttgccatcttcaaggtgttgttcatcgtgatctgaaaccagagaatttccttttctcttcaaaggaagaaaactctcccttgaaggtcatagattttggcttgtctgactttgtgaagccagatgaaagactaaacgacattgttggaagtgcatactatgttgctccagaggtgctccacagatcttatggcactgaggcagatatgtggagcattggagtaattgcctacatcttactatgtgggagtcggccattctgggcgcgcacggagtcaggaatctttcgagctgtcttgaaggcggaaccaagttttgatgaggccccatggcccactctcacagctgaagctaaagattttgtaaaaaggcttcttaataaggattatcgcaagagaatgacggccgcacaagccctcagtcatccatggatccgtaatgctcaacaagtgaaagttcctttggatatgataatctataagctaatgagagcttacatcagttcgtcttcactgcggaagtctgctttgagggccctagccaagacgctgacaacgaaccaactcttttatgtaagggagcagtttgaattgctgggcccaaacaagaatggttatatctcattgcaaaatctgaaatcggctctagtgaagaactccacagatgcaatgaaggactctagggtggttgactttgttaacactgtgtgcactcttcagtacagaaaattggatttcgaagagtttgctgcttctgccatcagtgtttaccagatggaagccttggagacctgggaacagcatgcgaggcgcgcatatgatctgtttgataaggaaggaaaccggcctattgtgatcgaagaacttgcatcggaactcggacttggcccatcagtgcctcttcacgttgtcctccaagactggatcagacacgccgatgggaagctgagcttcctgggattcatcaagcttctgcacggggtttcgtcgcgctctattccaaaggcctag

SEQ ID NO: 16369 - protein, 593 aa, Sorghum bicolor
  misc_feature: The sequence is a functional homolog of SEQ ID NO 2 in US patent 7084323
  misc_feature: Ceres ANNOT ID no. 8656977
  misc_feature (72)..(593): SWISSPROT Homolog: EC 2.7.11.1 Non-specific serine/threonine protein kinase
  misc_feature (140)..(402): Pfam ID: Pkinase Pfam Description: Protein kinase domain
MGLCHGKPTQIPEAEAEEDPHVASGAGDGGDGATSPSAATAPAAKPGTPKQPKFPFYLPSPLPPSSYKGSPANSSVASTPARGGFKRPFPPPSPAKHIRALLARRHGSVKPNEASIPEGGEPELGLDKSFGFSKHFFARYDLGEEVGRGHFGYTCSAKAKKGEHKGQDVAVKVIPKAKMTTAIAIEDVRREVRILSSLTGHSNLVQFYDAFEDEDNVYIVMELCKGGELLDRILARGGKYSEEDAKVVMVQILSVVSFCHLQGVVHRDLKPENFLFSSKEENSPLKVIDFGLSDFVKPDERLNDIVGSAYYVAPEVLHRSYGTEADMWSIGVIAYILLCGSRPFWARTESGIFRAVLKAEPSFDEAPWPTLTAEAKDFVKRLLNKDYRKRMTAAQALSHPWIRNAQQVKVPLDMIIYKLMRAYISSSSLRKSALRALAKTLTTNQLFYVREQFELLGPNKNGYISLQNLKSALVKNSTDAMKDSRVVDFVNTVCTLQYRKLDFEEFAASAISVYQMEALETWEQHARRAYDLFDKEGNRPIVIEELASELGLGPSVPLHVVLQDWIRHADGKLSFLGFIKLLHGVSSRSIPKA

SEQ ID NO: 16370 - DNA, 1500 bp, Sorghum bicolor
  misc_feature: Ceres ANNOT ID no. 8657003
  misc_feature: Encodes the peptide sequence at SEQ ID NO 16371
atgactcgatcttcgactatcgattttggtcggaggaagcagagcgagctcttcgggtcagggccactgcgtccagcaaacatcatcaggaataagttccctacctacaagaatggttcaaacgggattgttatcaaattggtggatgccccagaaatgccatctcttaaggaggctgttgccaaggagacaactgatttgcttgataggtgtcagcgcctttcagtccgtgagctcaccatgaaattcgagaagggctttaacacagctaccttgttgtctaatgaggctaaatggagacatgcggctttattggagcgagacatccttctaaagaatcttaaaagcgtattggaatcattgagaggtcgagtagggggcaaaaataaagatgaaattgaggagtctctatctatggtggatattttagcagttgagctatccaaaagagaagatgagttgcttcagcaaaaaacagagatcaccaaaattgcagccacattgaaactggcttctaaagatgccaagagaattgttgatgaagaaagagctaatgctcggttggagatagaaagtgctaaagctgctgtacataaaattcaattagcacttaaagagcaggaaaatttttatcaaagaactgggaagcaggatgttgatgaactgaaggaagaagttcaagaagcacggagagtgaaaatgctgcattgcccaagcaaggcaatggacatcgagaacgagatccaagttctacgtgaccaactgtctgaaaaatcttcaacttctcttcaccttttgaaagagttggagctgcatcgaagttacgaggaaaatgccatgcccttgtgtgaattaaagggtctagaaaccttaggttcaatgttacgcatagttgttcaagattgtgcacatgtagatttttcaaattgttcaatccagtggtttcgcatacaacctgaaggaagcaatcaagaaattatttcaggtgccacaaagccagtatatgctccagaaccacatgacgtggggcgttacatccaagctgaaatcaaattcggtggtcaaatctcaatcgcaaagactgctggtccaatagatcctgctccaggattggttgattatgtagaggctcttgtgaggaatcctgaaactgattataatgtagttattcttcaagtgaatggaattgctcaggctgcagattctttacatgttctttgtattgggagattgcggatgaggcttgctaaagaaaaggcagtcgttgcgaaggagttctattcgtcgtcaatgcagttgtgtggcgttagaggaggtggagacgctgctccccaagcgatcttctggcaaccaagaaaggatctcagctttgtgctggcctttgaaacaaccagagagcgcaactcggcactcatgctggcccggagattcgcgatcgattgcaattgtaggactcgttacatttgtactcgctattccacaacgccaacggtcgagtag

SEQ ID NO: 16371 - protein, 499 aa, Sorghum bicolor
  misc_feature: Useful for making plants with altered alkaloid content
  misc_feature: Useful for making plants with altered terpenoid content
  misc_feature: Functional homolog of the protein sequence given in SEQ ID NO 13203
  misc_feature: Ceres ANNOT ID no. 8657003
  misc_feature (52)..(424): SWISSPROT Homolog: EC 2.7.11.1 Non-specific serine/threonine protein kinase
MTRSSTIDFGRRKQSELFGSGPLRPANIIRNKFPTYKNGSNGIVIKLVDAPEMPSLKEAVAKETTDLLDRCQRLSVRELTMKFEKGFNTATLLSNEAKWRHAALLERDILLKNLKSVLESLRGRVGGKNKDEIEESLSMVDILAVELSKREDELLQQKTEITKIAATLKLASKDAKRIVDEERANARLEIESAKAAVHKIQLALKEQENFYQRTGKQDVDELKEEVQEARRVKMLHCPSKAMDIENEIQVLRDQLSEKSSTSLHLLKELELHRSYEENAMPLCELKGLETLGSMLRIVVQDCAHVDFSNCSIQWFRIQPEGSNQEIISGATKPVYAPEPHDVGRYIQAEIKFGGQISIAKTAGPIDPAPGLVDYVEALVRNPETDYNVVILQVNGIAQAADSLHVLCIGRLRMRLAKEKAVVAKEFYSSSMQLCGVRGGGDAAPQAIFWQPRKDLSFVLAFETTRERNSALMLARRFAIDCNCRTRYICTRYSTTPTVE

SEQ ID NO: 16372 - DNA, 1074 bp, Sorghum bicolor
  misc_feature: Ceres ANNOT ID no. 8657055
  misc_feature: Encodes the peptide sequence at SEQ ID NO 16373
atggcgagggcctgcaggatggcccccctcctgctcctgctcgtggccgtcgccgcgtcgggcatccgggtggacgtgatccggctcccgtcgtcgtcgtccgcgcctccgccgctgccgccgtcgtccccggcgttccgcgaggcgcccgcgttccgcaacggggacgagtgcccgccccgtggctcccccgacggccgcgtcgacgtcgccatgacgctggacgccaactacctgcgcggcaccatggcggccgtcttctccatcctgcagcacacggcgtgcccggagaacgtggcgttccacttcctggccgccgccggcgattaccagcacgactcggacccgctggcggcgatccgcgccacgttcccgtaccttgacccgagcgtgcaccggttcgacccgtcccgtgtccgcggccgcatctcccgctccgtgcgccacgcgctggaccagccgctcaactacgcgcgcatctacctcgccgacacgctcccggccaccgtgcgccgggtcatctacctcgactccgacgtggtggtggtggacgacgtgcgcaagctctggtccgtcgacctgggcgatcgccacgtggtggcggcgcccgagtactgccacgccaacttcaccaagtacttcaccgacgccttctggtcggacgaggagctcagcgccgcgttccggggccgccgcccttgctacttcaacacgggcgtcatggtcatggacgtggcgcggtggcgacgcggcgggtacacgcggcgggtggaggagtggatggcggtgcagaagcggaagcggatctaccacctggggtcgctgccgccgttcctgctggtgctcgccggggacatcaggcccgtcgaccaccgctggaaccagcacgggctcggcggcgacaacgtggagggcaggtgccggagcctccacccgggccccatcagcctgctgcactggagcggcaagggcaagccgtggctgcgactcgacgcacggaagccctgcaccgtcgactacctctgggcgccctacgacctctacaaggcagcggccaccgcgctggaggagtag

SEQ ID NO: 16373 - protein, 357 aa, Sorghum bicolor
  misc_feature: Useful for making plants with altered cell wall content and/or composition
  misc_feature: Functional homolog of the protein sequence given in SEQ ID NO 14184
  misc_feature: Useful for making plants with altered carbohydrate content
  misc_feature: Functional homolog of the protein sequence given in SEQ ID NO 14010
  misc_feature: Ceres ANNOT ID no. 8657055
  misc_feature (67)..(327): SWISSPROT Homolog: EC 2.4.1.44 Lipopolysaccharide 3-alpha-galactosyltransferase
  misc_feature (69)..(331): Pfam ID: Glyco_transf_8 Pfam Description: Glycosyl transferase family 8
MARACRMAPLLLLLVAVAASGIRVDVIRLPSSSSAPPPLPPSSPAFREAPAFRNGDECPPRGSPDGRVDVAMTLDANYLRGTMAAVFSILQHTACPENVAFHFLAAAGDYQHDSDPLAAIRATFPYLDPSVHRFDPSRVRGRISRSVRHALDQPLNYARIYLADTLPATVRRVIYLDSDVVVVDDVRKLWSVDLGDRHVVAAPEYCHANFTKYFTDAFWSDEELSAAFRGRRPCYFNTGVMVMDVARWRRGGYTRRVEEWMAVQKRKRIYHLGSLPPFLLVLAGDIRPVDHRWNQHGLGGDNVEGRCRSLHPGPISLLHWSGKGKPWLRLDARKPCTVDYLWAPYDLYKAAATALEE

SEQ ID NO: 16374 - DNA, 2211 bp, Sorghum bicolor
  misc_feature: Ceres ANNOT ID no. 8657084
  misc_feature: Encodes the peptide sequence at SEQ ID NO 16375
atgccaccgaacgccttgcccactacctccagacccgcatctaggcgcgtcgtctacgtcctcctcgcggcgcttgccacggcgccgttcctgctgctcctcctctacggcggcgcctccccctccgcgctctgccccgccgcctaccgcgcgccccgccgcctcccgtacccgtccgtgctctggtccaaggtgcccccgctccccgtcctcctctcctcgccgcacccggacctccgcggctctcgctggatcgtcttcatcgcgtcgccgcatgccccgcggcaccgcccgctgcgcgcggtccccgggtggcagctcctcgcggtcgccgacgaggcgacccccgcggattggtcccacccaggcgccgtcctgctcacgctcgccgaccaggatcacctcggattccgctccgtcgctttccttccagcccggggcccggcgcgcaaggccgcggcgtacctcttcgccgtgcagcgcggggcgcgggtcatctacgacgccgacgtgcgcaacgccgtcctgggcggcaacctcaccagtcacttcgatgtcgatctggaccagcgccagggaggcgccgtgctgctgcagtacagccatgccgatcctaaccggacggtcgtgaacccgttcgtgcactttgggcagccgtcggtctggccacgggggctgccgctggagaaggcaggggaactggatgctgaggagttctacactgagatattcagtggtggccaattcatgcagcaaggaatgtgtaatggccttccagatgttgactcagtgttctacttcacccggaagtcattggagatggaggcatttgatttccggtttgacgcggatgcacccaaggttgcgctaccacagggcacgatgacgccagtcaactctgttaacacattgttccactcgccggcgttctgggggcttgcattgccagtgtcagtgagtccaatggcatcggatgtcatacgcggatactgggcgcagaggatactatgggagattggagggtacctagttgtctacccaccaactgtgcaccgcatagataatgtgcgtgctcacacatttgatgaagagaaggatctccatgtcaatgtagggaagctgataaagttcctaatggagtggcgatccagtaagaggacactattcgagcggattcttgatctaagctatgcgatgacagaggagggattctggggtgaaaaggatttgcatttcatgacttcttggctccaagatcttgttgctatcgggtaccggcagccacggttgatgtcattggagattgaccggcctagggcaaccattggacatggggacaagaaggagtttgcaccaaagaagctgccttcagtgcatcttggggttgaagagattggggaagtaagcactgagattggcaatctaattaaatggaggaagcattttggtgatattgtgctcatagtgcattgcaccgaacttgtggaccgaactgcactagagtggaggctgctttacggtcggatatttcgagcagttgttattctttcagagcaaagcaattctgatcttgctgtggaattcagcaacttggcacaagcctacaagtacttgccgaaggtgtttgctcggtttggaggtgctcaaggatttttgttccttcaagatcacatggtcttcaattactggaacctcttgaatgctgataaagataagctctggataaccaaccaggtgaaggaatcttggtcggatgtgcctctccatggtaacaacatcgagtggtttgtgaaccaaggggatatggttaaaaagggagtcagcaattttccatctcagtatgaagctaactacaggagaaatgtaggtgaaaataatctaattcgttgcagcagtgagatattttacatacctcaacggtacatcggtgacttttcaaatcttgttaaagctattggaagcttagacattcatcacagttttgcagtccccatgttattccttgcaatggattcaccgagcaactttgaatccaaagctttgacaaaacttgtctatagggcagatctgccatcaaataccacactctcaacaatttatactgctgaagcccatgcagtgtacccggtgaaggttcagaatgagatggactttgtaaaactaatcagggttatgtcttcaggagatccatttcttatggaattggtctga

SEQ ID NO: 16375 - protein, 736 aa, Sorghum bicolor; identical to SEQ ID NO: 8172
  misc_feature: Useful for making plants with altered cell wall content and/or composition
  misc_feature: Functional homolog of the protein sequence given in SEQ ID NO 14014
  misc_feature: Ceres ANNOT ID no. 8657084

SEQ ID NO: 16376 - DNA, 1404 bp, Sorghum bicolor
  misc_feature: Ceres ANNOT ID no. 8657082
  misc_feature: Encodes the peptide sequence at SEQ ID NO 16377
atgcagagtaccgtgaagctcgcggtgctcgctctactgctagcggcagcagctcaccacggtctgctgccgctgccgacggcgctatgctactggctcaacccagagatctacgacgccggcgggctgagccgccgcgcgttcccggagggcttcgtcttcgggacggccgcgtcggcgtaccaggtcgaggggatggccaagcacgggggccggggccccagcatctgggacgccttcatagaggtacccgatggaactggcaaggtgaaccaggaaggagtggattactataacaggctcatagattacatgcttcagcaaggtatcacgccgtatgcaaatctctaccattatgacctcccattggcactccatgaacagtacttgggctggcttagcccaaagattgtggaggcgtttgcagactacgccgagttctgcttccagacgttcggagacagggtgaagaactggtttaccttcaacgagccgaggtgcgtcgctgctcttggctacgacaatggcttacacgcaccgggaaggtgttccgagtgcgctgccggaggcaactccacgacggagccgtaccttgctgcacaccatctcatcctttctcatgcagctgcggtgaggcgataccgcgacaagtatcagctttaccaaaaggggaggattggaattctcttggatttcgtgtggtatgaacctttcagcgacagcaatgctgaccaggctgcagcacagcgagccagggacttccacctaggctggttccttgatcccataataaatggacggtatccgtactcgatgcaagagattgttaaagataggctgccgttgttcagtgatgaagaatccaggatggtgaaaggctctatagactacgttggcatcaaccactacacttctttctacatgaaggaccctgggacatggaacctgacgccagtcagctaccaggatgattggcatgttggtttcgtctatgagcgaaacagcattcctattggcgctcatgcaaactcctattggctgtacattgtgccgtggggaatcaacaaggctgtcaactatgtcaaggaaacttatgaaaatcctacaatgatccttgctgaaaatggaatggaccaacctggtgatatcagtattactcagggtgtgcatgacacaataaggatccgttactacagagactacataactgagctgaagaaggcaatagacgatggtgccagagtcatcggttactttgcgtggtcgctgctcgacaacttcgagtggaggcttgggtacacttcgcggtttggcttggtctacgtggactacaagactttgaagaggtaccccaaggactctgctttctggttcaagcatatgctctcaaagaagaggagctag

SEQ ID NO: 16377 - protein, 467 aa, Sorghum bicolor
  misc_feature: Useful for making plants with altered cell wall content and/or composition
  misc_feature: Functional homolog of the protein sequence given in SEQ ID NO 14123
  misc_feature: Useful for making plants with altered oil content
  misc_feature: Functional homolog of the protein sequence given in SEQ ID NO 14125
  misc_feature: Ceres ANNOT ID no. 8657082
  misc_feature (83)..(443): SWISSPROT Homolog: EC 3.2.1.21 Beta-glucosidase
  misc_feature (44)..(467): Pfam ID: Glyco_hydro_1 Pfam Description: Glycosyl hydrolase family 1
MQSTVKLAVLALLLAAAAHHGLLPLPTALCYWLNPEIYDAGGLSRRAFPEGFVFGTAASAYQVEGMAKHGGRGPSIWDAFIEVPDGTGKVNQEGVDYYNRLIDYMLQQGITPYANLYHYDLPLALHEQYLGWLSPKIVEAFADYAEFCFQTFGDRVKNWFTFNEPRCVAALGYDNGLHAPGRCSECAAGGNSTTEPYLAAHHLILSHAAAVRRYRDKYQLYQKGRIGILLDFVWYEPFSDSNADQAAAQRARDFHLGWFLDPIINGRYPYSMQEIVKDRLPLFSDEESRMVKGSIDYVGINHYTSFYMKDPGTWNLTPVSYQDDWHVGFVYERNSIPIGAHANSYWLYIVPWGINKAVNYVKETYENPTMILAENGMDQPGDISITQGVHDTIRIRYYRDYITELKKAIDDGARVIGYFAWSLLDNFEWRLGYTSRFGLVYVDYKTLKRYPKDSAFWFKHMLSKKRS

SEQ ID NO: 16378 - DNA, 1665 bp, Sorghum bicolor
  misc_feature: Ceres ANNOT ID no. 8657096
  misc_feature: Encodes the peptide sequence at SEQ ID NO 16379
atggtgcagcagcaacagcagcacagaatctacatcttgcagttcaggaagggcgagccggagcaggaggtggcatgcaaggtgtcgcagcccaagggcgccgggcggcgggtcatgtactactaccaggactacggcagcggtgggggcaagagcggcaagcaggtgcaacccagggctctcggcctgcggcgcttcttggccatgctcctgctctccttcctctgcgtggggacgctgttcgtggcgcccgtgtccttcctctctttcgtgcatagcgacgaaggcggcgcggcggcgggagcggggacgggggcggtggcgacggccgcggccgcgcgtggcgcggtgtccggaccgtgctcgtccgtggggaacgacagcttctgctgcgaccgcacgtcggagcgcgcggacatctgcttcgccaagggggacctgcgcatgcactcggcgagcgcgtcgttccagctcgtgtccgccggcaactcgacggcggcggcggaggaggaggaggagcggatacggccgtacacgcgcaagtgggaggcgaacgtgatggcgacgatcgacgaggtgcggctgcggcgcgtggtccccggcgacgccgcgcggtgcgacgtgcggcacgacgtgccggccgtgctcttctccaccggcgggtacacgggcaacgtgtaccacgagttcaacgacggcatcctgccgctgttcgtgacggcgcaccacctccggcggcgcgtggtgctggtgatcctcgagtaccacgactggtggatgaccaagtacggcgacgtggtgtcccagctgtcggcgttcccgccgatcgacttcaccgccgaccgccgcgtgcactgcttccccgaggtgatcgccgggcttcgcatccacggcgagctgagcgtggacccggcgaggacgcccgaggggaagagcatcggcgacttccgcaggctcctggacgacgcgtaccgcggccgcatcgagttcctggagcgcctggagcggcgcacggctcggaagcgcctgcgcctgcaccgccaccgccgcggcgccgtggtgccccgcgcgccgccaggtccgagtcacgcagacgacgaccgccggcccaggcccaggctggtgatcgtgtcgcggacggggtcccgcgtgatcgagaacgaggccgacctggcggcactggcggcggacgtcgggttcgacgtgcgcgtgatccgtcccgaccgcaccacggagctgtgcaagatataccgggagctgaacgccagcgacgccatgatcggggtgcacggcgccgccatgacgcacttcctgttcatgcggcccgggaaggtgttcatccaggtggttccgctgggcacggactgggccgccggcgcctactacggcgagcccgcggcgcggatgggcctgcggtacgtcgggtacaagatcagccccgaggagagctcgctgtcccgcgagtaccccacgggcgaccccgtgctgacggaccccgccggcgtggcgcagcgcggctgggacgtgaccaagaaggtgtacctggaccggcagaacgtgcggctggacctggcgcgcttccgggaggagctcgtcggggcgcaccggtacctgatggccggcggcgacggcggcggacggcggcggccgagagcgcccgagtga

SEQ ID NO: 16379 - protein, 554 aa, Sorghum bicolor
  misc_feature: Useful for making plants with altered carbohydrate content
  misc_feature: Functional homolog of the protein sequence given in SEQ ID NO 14380
  misc_feature: Ceres ANNOT ID no. 8657096
MVQQQQQHRIYILQFRKGEPEQEVACKVSQPKGAGRRVMYYYQDYGSGGGKSGKQVQPRALGLRRFLAMLLLSFLCVGTLFVAPVSFLSFVHSDEGGAAAGAGTGAVATAAAARGAVSGPCSSVGNDSFCCDRTSERADICFAKGDLRMHSASASFQLVSAGNSTAAAEEEEERIRPYTRKWEANVMATIDEVRLRRVVPGDAARCDVRHDVPAVLFSTGGYTGNVYHEFNDGILPLFVTAHHLRRRVVLVILEYHDWWMTKYGDVVSQLSAFPPIDFTADRRVHCFPEVIAGLRIHGELSVDPARTPEGKSIGDFRRLLDDAYRGRIEFLERLERRTARKRLRLHRHRRGAVVPRAPPGPSHADDDRRPRPRLVIVSRTGSRVIENEADLAALAADVGFDVRVIRPDRTTELCKIYRELNASDAMIGVHGAAMTHFLFMRPGKVFIQVVPLGTDWAAGAYYGEPAARMGLRYVGYKISPEESSLSREYPTGDPVLTDPAGVAQRGWDVTKKVYLDRQNVRLDLARFREELVGAHRYLMAGGDGGGRRRPRAPE

SEQ ID NO: 16380 - DNA, 1281 bp, Sorghum bicolor
  misc_feature: Ceres ANNOT ID no. 8657075
  misc_feature: Encodes the peptide sequence at SEQ ID NO 16381
atgggcgccggccgtgtctgccgcggcggcccctcctccgcccaccccgccgccggcgcaggcgcggggcggccgttcccgccgctcgccgcgtcctcctccgccttcccttcctcggccccctccgagacggcgtccacgtcggtcaccaagacggtgaacggctcccaccacttcaagatcgcgggttactccctctccaaggggatcggggtggggaagttcatcgcctccgagtccttcaacgtggggggattcgactgggcgatctacttctaccccgacgggaagagcggcgaggatggcgctgcctacgtctcgctcttcatagccctcgccagcgagggcaccgatgtgcgcgcgctgttcgagctcacgctcgtcgaccagagcggcaagggccaggacaaggtgcatacccactttgggaggtccctcgagagcggcccatacaccctcaagtaccgcggcagcatgtggggctacaagcgtttcttcaaacgaactgccctggaaacatcagactatcttaaagatgattgccttttagtgaactgcactgttggcgttgttcagtcacataccgaaggaccaaagatatacacgattccagtaccgcggtcgaacatggctctacatattggtcagctattgacaagtggcaagaggacagatattgctttcgaagttgatggagagatgtttcctgcccacaaagtgattctttcagcccggtctcctgtttttagggcccaactttttggtccaatgaaggataaaaacatgaagtgtataaagattgaagacatggaggctccagtattcaaggccttgctccatttcatgtactgggatgagttgccggatattgaagaacttactggtgtaaatacaacttgggtatccaccttgatggctcaacatttacttgctgctgctgaccgttatgcattggagagattaaagttgctctgtgaacttaagctgtgtgaagatgttgcaataaacacagtagcaaatactttggcactggctgaacagcaccactgttatcagctaaaaactgtttgcttgaaatttgtggctctgcctgagaatttgaaagctgtcatgcagaccgatgggtttgattatttgcagcaaagctgcccatccctcctgactgagcttctcgagtatgtggccaaggtaggagatcactccgtgagcccctgcttgtattcaactgaagttcttgatggtggcgatgccaatggacgacgtgtgaaaccgaggatctaa

SEQ ID NO: 16381 - protein, 426 aa, Sorghum bicolor
  misc_feature: Useful for making plants with modulated biomass
  misc_feature: Functional homolog of the protein sequence given in SEQ ID NO 12898
  misc_feature: Ceres ANNOT ID no. 8657075
  misc_feature: Up-regulated in shoot tissues in response to salicylic acid treatment
  misc_feature (214)..(333): Pfam ID: BTB Pfam Description: BTB/POZ domain
MGAGRVCRGGPSSAHPAAGAGAGRPFPPLAASSSAFPSSAPSETASTSVTKTVNGSHHFKIAGYSLSKGIGVGKFIASESFNVGGFDWAIYFYPDGKSGEDGAAYVSLFIALASEGTDVRALFELTLVDQSGKGQDKVHTHFGRSLESGPYTLKYRGSMWGYKRFFKRTALETSDYLKDDCLLVNCTVGVVQSHTEGPKIYTIPVPRSNMALHIGQLLTSGKRTDIAFEVDGEMFPAHKVILSARSPVFRAQLFGPMKDKNMKCIKIEDMEAPVFKALLHFMYWDELPDIEELTGVNTTWVSTLMAQHLLAAADRYALERLKLLCELKLCEDVAINTVANTLALAEQHHCYQLKTVCLKFVALPENLKAVMQTDGFDYLQQSCPSLLTELLEYVAKVGDHSVSPCLYSTEVLDGGDANGRRVKPRI

SEQ ID NO: 16382 - DNA, 456 bp, Sorghum bicolor
  misc_feature: Ceres ANNOT ID no. 8657123
  misc_feature: Up-regulated in shoot tissues in response to salicylic acid treatment
  misc_feature: Encodes the peptide sequence at SEQ ID NO 16383
atggcgcccaaggcggagaagaagccggcagcgaagaagcccgtggaggaggaatccgcggccccggcggagaagccccccgcggggaagaagcccaaggcggagaagcgtctcccggcgggcaagtccgccagcaaggagggcggcgagaagaggggtcggaagaagggcaagaagagcgtggagacgtacaagatctacatcttcaaggtgctgaagcaggtgcacccggacatcggcatctcctccaaggccatgtccatcatgaactcgttcatcaacgacatcttcgagaagctcgccggcgaggccgccaagctcgcccgctacaacaagaagcccaccatcacttctcgggagatccagacctccgtccgcctcgtcctccccggggagctcgccaagcacgccgtctctgagggcaccaaggccgtcaccaagttcacctcgtcttag

SEQ ID NO: 16383 - protein, 151 aa, Sorghum bicolor
  misc_feature: Useful for biocontainment applications
  misc_feature: Useful for making plants with modulated flowering time
  misc_feature: Functional homolog of the protein sequence given in SEQ ID NO 13102
  misc_feature: Ceres ANNOT ID no. 8657123
  misc_feature (58)..(128): Pfam ID: Histone Pfam Description: Core histone H2A/H2B/H3/H4
MAPKAEKKPAAKKPVEEESAAPAEKPPAGKKPKAEKRLPAGKSASKEGGEKRGRKKGKKSVETYKIYIFKVLKQVHPDIGISSKAMSIMNSFINDIFEKLAGEAAKLARYNKKPTITSREIQTSVRLVLPGELAKHAVSEGTKAVTKFTSS

SEQ ID NO: 16384 - DNA, 1128 bp, Sorghum bicolor
  misc_feature: Ceres ANNOT ID no. 8657159
  misc_feature: Encodes the peptide sequence at SEQ ID NO 16385
atgcccagccagcgaccccacaccgcaccttccagaaacgtacgtggcacacctccgcgaccccaccatcaccttacgcaccgtcaccggcatgtgggcccttctcgcccgtcccacgcgtcagtgtcgctggcggcgttactgtgcccctgcccccgcgcgggctccctcccgtgcacgcaaggcacccccgggacgaaagcgagaggggccagagctttaaatggccgcgccgctaaccaccgccactcgagccgccccgcccgtgccgtttaccggagtgcgacccgacccccgcggcgtcgagtggattgggggaggagggggactggaggaggccggggcttggatggtcgcggtgccggaggtggaggtggagcgctcccggaggtggtgttcatggggaggtcgttcagggactcgctcaaggtgctcgaggccgacatccagcacgccaactcgattgcttctgaatttcggagggaatatgatggcgcctgccttcagatgaggatggcatactgccctgctgcccactttttcctttttcttgtgcagtggacagactgcaatcttgctggtgcacttgggctgttgaggattctaatttataaggtttacgctgatgggacaaccaccatgtgtactcatgaaagaaaagcaagcatcagggaattttatgctgtcatatttccctctttgatgcaattacatgaaggaatcaatgaagttgaggataaaaaacagaaagcaatatgtctagagaggtatagaagacgagatgaggatcagaaaacagtaatatcagagattgatgataatatagaggaggaatgtggcatatgcatggaaataaacagcaaagttgttcttccaacttgtagccatgctatgtgcatcaaatgctaccgtgactggaggtcaagatcccagtcctgtccgttctgccgcgacagcctcaagagggtaaactctgctgacctgtggatatacacagataacaaggacatcatcgacgtggcgacagtccgaagagagaacctgaggcgactcttcatgtacatagacaagttgcccactgtcatcccagaatctgtgtttgacgtctacgactcccatgtaaagtga

SEQ ID NO: 16385 - protein, 375 aa, Sorghum bicolor
  misc_feature: Useful for making plants with altered lignin content
  misc_feature: Functional homolog of the protein sequence given in SEQ ID NO 13283
  misc_feature: Ceres ANNOT ID no. 8657159
  misc_feature (279)..(316): Pfam ID: zf-C3HC4 Pfam Description: Zinc finger, C3HC4 type (RING finger)
MPSQRPHTAPSRNVRGTPPRPHHHLTHRHRHVGPSRPSHASVSLAALLCPCPRAGSLPCTQGTPGTKARGARALNGRAANHRHSSRPARAVYRSATRPPRRRVDWGRRGTGGGRGLDGRGAGGGGGALPEVVFMGRSFRDSLKVLEADIQHANSIASEFRREYDGACLQMRMAYCPAAHFFLFLVQWTDCNLAGALGLLRILIYKVYADGTTTMCTHERKASIREFYAVIFPSLMQLHEGINEVEDKKQKAICLERYRRRDEDQKTVISEIDDNIEEECGICMEINSKVVLPTCSHAMCIKCYRDWRSRSQSCPFCRDSLKRVNSADLWIYTDNKDIIDVATVRRENLRRLFMYIDKLPTVIPESVFDVYDSHVK

SEQ ID NO: 16386 - DNA, 1590 bp, Sorghum bicolor
  misc_feature: Ceres ANNOT ID no. 8657186
  misc_feature: Encodes the peptide sequence at SEQ ID NO 16387
atggggctcggcgtggtggcggaactggtgcggctgggcgtgctgagctcgacctcggaccactcgtcggtggtgtccatcaacctgttcgtcgcgctgctctgcgcctgcatcgtcctcggccatctcctggaggagaaccgctgggtcaacgagtccatcaccgcgctcatcatcgggttgtgcaccggcgtggtgatcctgctgaccaccaaggggaagagctcgcacatcctcgtcttcagcgaggacttcttcttcatctacctcctccctcccatcatcttcaatgccgggttccaggtgaagaagaaacaattcttccggaatttcatgacaatcacattatttggtgctgtagggacaatgatatccttcttcacaatctctctcggtgcaatagcgatattcagcagaatgaacattggaacgttagatgtcggggattttctcgctattggagctatcttttctgcaacagattctgtctgcacactgcaggtcctccatcaggacgagacgccccttttgtacagtcttgtgttcggtgaaggagttgtgaacgatgccacgtccgttgtgctcttcaacgcactccagaactttgatcttaaccacatcgatgtaaccgttgtgctgaacttcttgggaaacttctgttatttattcttgtcaagcaccttacttggagtgttttctggattgctcagtgcctacataattaagaagttatatataggaaggcattccactgaccgtgaggttgcacttatgatgctcatggcttacctctcatatatgttggccgagttgctagatctgagtggtattcttactgtattcttctgcggtattgtgatgtcccactacacttggcataatgtgacagagagctcaagagttacaaccaagcatgcctttgcaactttgtccttcattgctgagacttttctcttcctttatgttgggatggatgccctcgatattgagaacccgggcaaatccattggcataagctcgattttgttaggattggttctggtcgggagagctgcatttgttttcccattgtcgtttttgtccaacttgacaaagaagtctccattggagaaaataacattgagacaacaagttgtaatatggtgggctggactgatgagaggcgccgtgtccatcgctcttgcttacaacaagttcacaagatctggacacactcagctgcacggcaatgcgataatgatcaccagcacaatcactgtagtcctgtttagcactatggtgtttgggatgatgacgaagccattgatccacctactgctccctgcctcgagcaacacggcccactccgagccgtcgtcacccaagtccctgcactcccctctcctgacgagcatgcagggctccgacctcgaggtgccgtctgcgcagattgtcaggccgtccagcctccggatgctcctcagcaagccgacccacacggtgcactactactggcgcaagttcgatgacgcgctgatgcggcccatgtttggcggccgtgggttcgtgcccttctcccccggatcgcccactgatcatgccggacggtga

SEQ ID NO: 16387 - protein, 529 aa, Sorghum bicolor
  misc_feature: The sequence is a functional homolog of SEQ ID NO 2 in US patent 7250560
  misc_feature: Useful for making plants with modulated water use efficiency
  misc_feature: Functional homolog of the protein sequence given in SEQ ID NO 13934
  misc_feature: The sequence is a functional homolog of SEQ ID NO 2 in US patent 7041875
  misc_feature: Useful for making plants with modulated drought sensitivity
  misc_feature: The sequence is a functional homolog of SEQ ID NO 4 in US patent 7250560
  misc_feature: Ceres ANNOT ID no. 8657186
  misc_feature (26)..(438): Pfam ID: Na_H_Exchanger Pfam Description: Sodium/hydrogen exchanger family
MGLGVVAELVRLGVLSSTSDHSSVVSINLFVALLCACIVLGHLLEENRWVNESITALIIGLCTGVVILLTTKGKSSHILVFSEDFFFIYLLPPIIFNAGFQVKKKQFFRNFMTITLFGAVGTMISFFTISLGAIAIFSRMNIGTLDVGDFLAIGAIFSATDSVCTLQVLHQDETPLLYSLVFGEGVVNDATSVVLFNALQNFDLNHIDVTVVLNFLGNFCYLFLSSTLLGVFSGLLSAYIIKKLYIGRHSTDREVALMMLMAYLSYMLAELLDLSGILTVFFCGIVMSHYTWHNVTESSRVTTKHAFATLSFIAETFLFLYVGMDALDIENPGKSIGISSILLGLVLVGRAAFVFPLSFLSNLTKKSPLEKITLRQQVVIWWAGLMRGAVSIALAYNKFTRSGHTQLHGNAIMITSTITVVLFSTMVFGMMTKPLIHLLLPASSNTAHSEPSSPKSLHSPLLTSMQGSDLEVPSAQIVRPSSLRMLLSKPTHTVHYYWRKFDDALMRPMFGGRGFVPFSPGSPTDHAGR

SEQ ID NO: 16388 - DNA, 1485 bp, Sorghum bicolor
  misc_feature: Ceres ANNOT ID no. 8657203
  misc_feature: Encodes the peptide sequence at SEQ ID NO 16389
atgagctgcttaccgtgctccggttcgtcggggaaggaggccaagagcttggcggcgctctcgccgacgccccggcctgcggcgaaggcagcaccagttcgatcaaattcacgtgcttcgggctccaagaaggaagattctgtacctgttcgcagaggaggaaacattccacatggcccggcacagattttcactttccgggagttggctatcgctaccaagaatttcaggaaagattgcctattgggagaaggtggctttggtcgtgtgtataaaggacgcatggaaaatggacaggtcattgctgtgaaacaacttgatagaaacggttttcaaggaaatcgtgaatttcttgtggaggttctcatgctaagcctcttgcaccatcctaatctggttagattaattggctattgtgcagatggtgaccagcgcctcctagtttacgaatatatgttgttgggatcactagaaaatcatctgtttggcccaccagacaaggaacctcttgactggaatacaaggatgaagattgctgccggtgcagcgaagggtctggagtatcttcatgataaggcaaatccaccagtcatatacagagatttcaaatcatcaaacattctgctcggtgaagactactacccgaagctgtctgattttgggcttgcaaaacttggtccagttggtgacaaaactcatgtatcaacacgagttatgggaacatatggatattgcgctcctgaatatgccatgacaggacagttgacattaaaatctgatgtttacagctttggtgttgtgttccttgaacttattacaggccgcaaagcaatcgatcacacccagccttcaggggagcaaaatcttgttgcatgggctcgtccacttttcagagaccgaaggaagttctgccaactcgctgatccatcgctgcaaggtcggtaccccaaaaggggtttgtaccaggctttagctgttgcagctatgtgtttgcaggagcaagcagcatctcggccactgataggagatgtcgtcactgcactatcttatctagctgcacatccctatgatccaaatgtgccttccacaaaggattcgaggacctgcccatctaccccaagggcaaaaacacaccgaagaaccaccagtgttcctgatgctcaacatgctgctgagtcgcttatgttgaacttcccagacttgaggaaggagactgtcagaggagggaaatttgagaaggatggtactgaaggttctggcagcagcagtagctctggaaggaatgatggccttgatgttccgcaacttctggccggcaaagcttgcagtgaaggtgataacgttcagaagcttgtttctgcggacccagatagcctcatgctccacggttgggttttagttgcctccatggagctgttttacaaatcttccaggttatacatgaagacacaggctgatgaatggaagaagtatttttgttgctga

SEQ ID NO: 16389 - protein, 494 aa, Sorghum bicolor
  misc_feature: Useful for making plants with modulated drought sensitivity
  misc_feature: Functional homolog of the protein sequence given in SEQ ID NO 14078
  misc_feature: Ceres ANNOT ID no. 8657203
  misc_feature (35)..(367): SWISSPROT Homolog: EC 2.7.11.1 Non-specific serine/threonine protein kinase
  misc_feature (76)..(348): Pfam ID: Pkinase Pfam Description: Protein kinase domain
MSCLPCSGSSGKEAKSLAALSPTPRPAAKAAPVRSNSRASGSKKEDSVPVRRGGNIPHGPAQIFTFRELAIATKNFRKDCLLGEGGFGRVYKGRMENGQVIAVKQLDRNGFQGNREFLVEVLMLSLLHHPNLVRLIGYCADGDQRLLVYEYMLLGSLENHLFGPPDKEPLDWNTRMKIAAGAAKGLEYLHDKANPPVIYRDFKSSNILLGEDYYPKLSDFGLAKLGPVGDKTHVSTRVMGTYGYCAPEYAMTGQLTLKSDVYSFGVVFLELITGRKAIDHTQPSGEQNLVAWARPLFRDRRKFCQLADPSLQGRYPKRGLYQALAVAAMCLQEQAASRPLIGDVVTALSYLAAHPYDPNVPSTKDSRTCPSTPRAKTHRRTTSVPDAQHAAESLMLNFPDLRKETVRGGKFEKDGTEGSGSSSSSGRNDGLDVPQLLAGKACSEGDNVQKLVSADPDSLMLHGWVLVASMELFYKSSRLYMKTQADEWKKYFCC

SEQ ID NO: 16390 - DNA, 138 bp, Sorghum bicolor
  misc_feature: Ceres ANNOT ID no. 8657236
  misc_feature: Encodes the peptide sequence at SEQ ID NO 16391
atggccgacgtcccgctcgggttcggcgtcgctgcgaggtccgcgcaggactgcaggaaggccgataccaatgccgtcgtcgtgctgcaccaggtggacgccggggagtacctccgcaagggggaggagctcatgtga

SEQ ID NO: 16391 - protein, 45 aa, Sorghum bicolor
  misc_feature: Useful for biocontainment applications
  misc_feature: Useful for making plants with modulated biomass
  misc_feature: Functional homolog of the protein sequence given in SEQ ID NO 13252
  misc_feature: Ceres ANNOT ID no. 8657236
MADVPLGFGVAARSAQDCRKADTNAVVVLHQVDAGEYLRKGEELM

SEQ ID NO: 16392 - DNA, 729 bp, Sorghum bicolor
  misc_feature: Ceres ANNOT ID no. 8657244
  misc_feature: Encodes the peptide sequence at SEQ ID NO 16393
atggcacaatatatccccatgcttgaattctacagcgatggtaggattcccttggtctgcaccatgtatgcttcctcagaaagctactttggcgtcaatctgaggctgctgtgcagcccaaaagacgtgtcttacaccatccttccgagcatggcctactttgaattcgtaccattcgatgatggcctcaagtcagtggaggatgatgaggtggtggagaatgacaagcttgtcagcctggtggatgtcaaggttggatgctactatgagttcgtggttaccacatttgttggtatttgcaggtacaaccgtgcaccacaattcaaattcatctgccggagaaatgtgatcctcagcattgattcagataagaccaacaaggaggatctccacagtagcgtgtcccgggccaagaaaatcttggagaaccaaaaccacctcctcctggagtactctagctgcaccgacacctccacggtcccgggccactacgttctgttctgggagatcaactgctgcattgctgtggaggagtcacttgactacgtctacaggcgctgcagaggcagagcccatgacaagtctgtagggccactggagatacggctggcgcctttgatctccattaaccagtacaaaaccccaaggtgcatcgagtcaggccctgcgctgaaactgctcaattctaaggccatcgcttcgctctttagcccccgggatcctgaatga

SEQ ID NO: 16393 - protein, 242 aa, Sorghum bicolor
  misc_feature: Useful for making plants with modulated biomass
  misc_feature: Useful for making plants with modulated light quality response
  misc_feature: Useful for making plants with modulated low light sensitivity
  misc_feature: Functional homolog of the protein sequence given in SEQ ID NO 14293
  misc_feature: Ceres ANNOT ID no. 8657244
  misc_feature (1)..(226): Pfam ID: GH3 Pfam Description: GH3 auxin-responsive promoter
MAQYIPMLEFYSDGRIPLVCTMYASSESYFGVNLRLLCSPKDVSYTILPSMAYFEFVPFDDGLKSVEDDEVVENDKLVSLVDVKVGCYYEFVVTTFVGICRYNRAPQFKFICRRNVILSIDSDKTNKEDLHSSVSRAKKILENQNHLLLEYSSCTDTSTVPGHYVLFWEINCCIAVEESLDYVYRRCRGRAHDKSVGPLEIRLAPLISINQYKTPRCIESGPALKLLNSKAIASLFSPRDPE

SEQ ID NO: 16394 - DNA, 1521 bp, Sorghum bicolor
  misc_feature: Ceres ANNOT ID no. 8657255
  misc_feature: Encodes the peptide sequence at SEQ ID NO 16395
atgaacagcgctgcagccaacagctgccgcaagcgccgctttgccgatgcccacgagggcggctcctcacctcgccgccgccgcctcaccctcgtccccaacttgttccaggtcgttcggtccttcgcaatccgcacgctcgccaccgccccccacaagcgccgccacgacgacgccacctcctcgtctcgcctctgccgtcgccgtagccgccaccgccacctcagccccgtcccgttccccgccctccgaccgcgtagcccccgcgtcgcgctagtcaccaccccgcgccgccaccgcaagcttcacgtcgacgacgcccgccacgccctcttcactccctgtcgccaccgcagccgtagcagtctgcttcccagggtcaggcacttcccagtccttggtccattcgcactccatttcctcctcaagaccggcacattagcccctcgccgtcgccggaagcctgcggaggtagatatgggcaacctcttctcacagctactggggaagagcagcagcgacggtgtatcagaggcgcacacgaagcggctcgatgggtcgccggaagtggtggatctcacagtggagccagagcttgaaaatatcgatgtcgtggggaggcgaattggcgactggagcgtccctgcactggggtcatcaaggtcgctggagaagaagccgatggtccgcaaggcacttcagtggacgaagaagcgcgttggaagattacaggagtcaggaatcgagaagctcagacttgctgagctgcctggtcctctggacactacacccaaggaggatctatctgaactatttacacctctaagtgacaaagaagaaagagaagttaatactctgttgtataataggaatcacagtgataaagtcgtagtgatacatgagccttctaacattgagattactaacgataaacttcaatgtttgaggcctcgtgggtggttgaatgatgaggtcattaatttgtacattgaactgttaaaggagagggaacaaagggaacacaacaggtttttgaaatgccatttcttcaatacattcttctacaagaagcttacttgtggaatagctggttatgattatcagtctgttagaagatggacaatgttcaagaggttgggctatgaactcgtcgagtgtgagaaaatctttgttccagtgcatagaaatgtacattggtgtttggtagttataaacatgaaggataaaacattgcagtaccttgattctcttggaggtttgggccatgatgtactgaaagtactgactagatacatcgtggatgaattgaaggacaagagtaacttagaggtagaccctagttcatgggtggtagtgtcagagtctctccccttgcagcagaatgggtgggactgtggcatgtttatgcttaaatacattgatttccatagcagaggtatcaaaccatgtttcagtcaggaacacatgatgtattttaggaaccgaacagcaaaagagatcatgacattaagagctgactga

SEQ ID NO: 16395 - protein, 506 aa, Sorghum bicolor
  misc_feature: Useful for making plants with modulated flowering time
  misc_feature: Functional homolog of the protein sequence given in SEQ ID NO 13393
  misc_feature: Ceres ANNOT ID no. 8657255
  misc_feature (319)..(505): Pfam ID: Peptidase_C48 Pfam Description: Ulp1 protease family, C-terminal catalytic domain
MNSAAANSCRKRRFADAHEGGSSPRRRRLTLVPNLFQVVRSFAIRTLATAPHKRRHDDATSSSRLCRRRSRHRHLSPVPFPALRPRSPRVALVTTPRRHRKLHVDDARHALFTPCRHRSRSSLLPRVRHFPVLGPFALHFLLKTGTLAPRRRRKPAEVDMGNLFSQLLGKSSSDGVSEAHTKRLDGSPEVVDLTVEPELENIDVVGRRIGDWSVPALGSSRSLEKKPMVRKALQWTKKRVGRLQESGIEKLRLAELPGPLDTTPKEDLSELFTPLSDKEEREVNTLLYNRNHSDKVVVIHEPSNIEITNDKLQCLRPRGWLNDEVINLYIELLKEREQREHNRFLKCHFFNTFFYKKLTCGIAGYDYQSVRRWTMFKRLGYELVECEKIFVPVHRNVHWCLVVINMKDKTLQYLDSLGGLGHDVLKVLTRYIVDELKDKSNLEVDPSSWVVVSESLPLQQNGWDCGMFMLKYIDFHSRGIKPCFSQEHMMYFRNRTAKEIMTLRAD

SEQ ID NO: 16396 - DNA, 294 bp, Sorghum bicolor
  misc_feature: Ceres ANNOT ID no. 8657266
  misc_feature: Encodes the peptide sequence at SEQ ID NO 16397
atgttgaatcttaacttctgttgttttgtgaattcactaggatttcataaagttgatccagatagaatggaatgggccaatgaaggttctatcatcaagagaaagaagaaatcctctcaggatgcacatagtgatctgcagccggcctctggcaaaactgcacctggactgtcagatggaatcacaacagaactggaaaagtcctcaatgtggaccgtactaattgacgtatgcttacctcatccagttctcttttttacacagcatacatatgtaattttattttgttgttga

SEQ ID NO: 16397 - protein, 97 aa, Sorghum bicolor
  misc_feature: The sequence is a functional homolog of SEQ ID NO 1805 in the 10/374,780 US patent application
  misc_feature: Ceres ANNOT ID no. 8657266
MLNLNFCCFVNSLGFHKVDPDRMEWANEGSIIKRKKKSSQDAHSDLQPASGKTAPGLSDGITTELEKSSMWTVLIDVCLPHPVLFFTQHTYVILFCC

SEQ ID NO: 16398 - DNA, 1800 bp, Sorghum bicolor
  misc_feature: Ceres ANNOT ID no. 8657293
  misc_feature: Encodes the peptide sequence at SEQ ID NO 16399
atgccgaggccacccaagcgagcagcggcggcggcggccaagctccccctcacggccaccttcctctccctctccctctcccttctcctcctgccgctcggcttcgtcgccacccacagggcattctccggtggcgtcgccgccgcgtccacgccgaccgcgaagcgtgttcttctcgaggacgacggtcatgccaatgccgccgccgccgagcacgcggccgccgtggagcggcactgcgcggggacgctgcaccgcgacgtgtgcgcgtcgacgctgtccgccatcccggacctggcgcagaagccggtgcgcgacgtgatctcggcggtggtggcgcgcgcggcggccgcggtgcgcgcgtcggcgtccaactgctcggcgtacctccgccggccggcgggggcgggtgcgctgcgggtgcgcgaccgcctggcgctgtccgactgcgtggagctcctgcagcacacgctggcgcagctgggcacggcggaggcggagctgtcggcggcgaacagcagcaccagcaccagcaccagcaccgatgaggagtccgtggccggggtgcagaccgtgctgtcggccgccctgaccaaccagtacacctgcctggacggcttcgcggggccgtcggcgtcggaggacggccgcgtccggccctacatccagggccgcatctaccacgtggcccaccttgtgtccaactccctcgcgatgctgcgccgcctcccgcagcgccgccggcggcggggtagagaggcgctggagctggaagggtacgggcgcgtgcggcgcgggttcccgtcgtgggtgtcggcggcggaccggaggcggctgcagcagcagcaggtggtcccggacctggtggtggccaaggacgggagcggcaacttcacgacggtaggggaggcggtggcggcggcgcccaacaacagcgagtcgcggttcgtgatctacatcaaggcgggtgggtacttcgagaacgtggaggtcgggagcgagaagaccaacctgatgttcgtcggcgacggcatgtggaagacggtgatcaaggccagccgcaacgtcgtggacaactccaccacattccgctccgccacgctagcggtggttggcacggggttcctggcgcgtgacctgacggtggagaacgcggcgggtccaagcaagcaccaggccgtggcgctgcgcgtgaacgccgacctggccgccttctaccgctgcagcttcgcgggttaccaggacaccctctacgcgcactccctccgccagttctaccgcgactgcgacgtctacggcaccgtcgacttcgtcttcggcgacgccgccgccgtgctgcagggctgcagcctctacgcgcgccgcccgggccccgggcagaagaacgtcgtcacggcgcagggccgggaggaccccaaccagaacacgggcatcgtcgtgcagggcggcaaggtcgccgccgccgccgacctcgtccccgtcctcggcaacgtctcctcctacctcggcaggccgtggaagctctactcgcgcaccgtgttcgtgcagaccaagatggaggcgctcgtccacccgcgaggatggctcgagtggaacggcaccttcgcgctcgacacgctatactacgccgagtacatgaaccgcgggcctggagccgacacttccgcaagggtggcgtggtcggggtaccacgtgctcaccaacgccaccgacgccgccaacttcaccgtgctcgacttcatccagggagacctctggctcaactccacatccttcccctacacattgggcttcacctag

SEQ ID NO: 16399 - protein, 599 aa, Sorghum bicolor
  misc_feature: Useful for making plants with altered carbohydrate content
  misc_feature: Functional homolog of the protein sequence given in SEQ ID NO 14381
  misc_feature: Useful for making plants with altered cell wall content and/or composition
  misc_feature: Functional homolog of the protein sequence given in SEQ ID NO 14382
  misc_feature: Ceres ANNOT ID no. 8657293
  misc_feature (80)..(597): SWISSPROT Homolog: EC 3.1.1.11 Pectinesterase
  misc_feature (287)..(584): Pfam ID: Pectinesterase Pfam Description: Pectinesterase
  misc_feature (70)..(239): Pfam ID: PMEI Pfam Description: Plant invertase/pectin methylesterase inhibitor
MPRPPKRAAAAAAKLPLTATFLSLSLSLLLLPLGFVATHRAFSGGVAAASTPTAKRVLLEDDGHANAAAAEHAAAVERHCAGTLHRDVCASTLSAIPDLAQKPVRDVISAVVARAAAAVRASASNCSAYLRRPAGAGALRVRDRLALSDCVELLQHTLAQLGTAEAELSAANSSTSTSTSTDEESVAGVQTVLSAALTNQYTCLDGFAGPSASEDGRVRPYIQGRIYHVAHLVSNSLAMLRRLPQRRRRRGREALELEGYGRVRRGFPSWVSAADRRRLQQQQVVPDLVVAKDGSGNFTTVGEAVAAAPNNSESRFVIYIKAGGYFENVEVGSEKTNLMFVGDGMWKTVIKASRNVVDNSTTFRSATLAVVGTGFLARDLTVENAAGPSKHQAVALRVNADLAAFYRCSFAGYQDTLYAHSLRQFYRDCDVYGTVDFVFGDAAAVLQGCSLYARRPGPGQKNVVTAQGREDPNQNTGIVVQGGKVAAAADLVPVLGNVSSYLGRPWKLYSRTVFVQTKMEALVHPRGWLEWNGTFALDTLYYAEYMNRGPGADTSARVAWSGYHVLTNATDAANFTVLDFIQGDLWLNSTSFPYTLGFT

SEQ ID NO: 16400 - DNA, 411 bp, Sorghum bicolor
  misc_feature: Ceres ANNOT ID no. 8657308
  misc_feature: Encodes the peptide sequence at SEQ ID NO 16401
atggaactggatgacacccgtcatgctcctacatctagcctccaacaacttttgtctgcgtataacaagaagaacctcaacccgaccgacatggttgctctctcaggagcccacacgaaatcgggcatgcaggcgcagtgctccaacttcaatgaccacatctacaacgacaccaacatcaactccgccatcgcgacgtcgctcagggccaactgccccagggcaggcagcacgaggcaggagctcttcaacaacggctgcaccgacagcacggttaggaacttcgcgtccagcgcatcggccttcaacagcgccttggcgacggggatggtgaagatggggaaccttagccctcagatcggaacccaggggcagatcaggctcagctgctggaaggtgaactcgtcgtaa

SEQ ID NO: 16401 - protein, 136 aa, Sorghum bicolor
  misc_feature: Useful for making plants with altered carbohydrate content
  misc_feature: Functional homolog of the protein sequence given in SEQ ID NO 13662
  misc_feature: Useful for making plants with altered cell wall content and/or composition
  misc_feature: Functional homolog of the protein sequence given in SEQ ID NO 13605
  misc_feature: Ceres ANNOT ID no. 8657308
  misc_feature (12)..(84): SWISSPROT Homolog: EC 1.11.1.7 Peroxidase
MELDDTRHAPTSSLQQLLSAYNKKNLNPTDMVALSGAHTKSGMQAQCSNFNDHIYNDTNINSAIATSLRANCPRAGSTRQELFNNGCTDSTVRNFASSASAFNSALATGMVKMGNLSPQIGTQGQIRLSCWKVNSS

SEQ ID NO: 16402 - DNA, 975 bp, Sorghum bicolor
  misc_feature: Ceres ANNOT ID no. 8657311
  misc_feature: Encodes the peptide sequence at SEQ ID NO 16403
atggcagcttcgtcgcgaatgggcgcgctactagttgtctacctcactctcatggcggcggctctcggggtcagggcggagctcaccgcggactactacagcgagacgtgcccgctcgcgctgagcaccatcaaggtcctcgtcggcaccgccatcgtgggggagcccaggatgggggcgtcgctggtccgcctacacttccacgactgcttcgtcaatggctgcgacggctccatcctgctggacgacaccgacgacatggtcggcgagaagacggccaagcccaacaacaactccgtgagaggctacgaggtcatcgacaccatcaagtcggcggtgaacacggtatgcttggggaacgtcgtctcctgcgccgatatcttggctgtggccgctcgcgattccattgtcgctctgggaggaacctcgtacgacgtggtcctcgggcggcgcgacgcgacgacggcgagcatggacgacgcgaacaacgtgatcccgaacccgttcatggacctgccggcgctgcaggcgagcttcgagtccctgggcctgtccctgcacgacctggtggtgctctccggcggccacacgctgggctacgcccgctgcctcttcttccggggccgcctgtacaacgagacggcgacgctggacccgacctacgcggcgtcgctggacgagcggtgcccgctgtcgggcgacgacgacgcgctgtcggcgctggacgacaccccgaccaccgtcgacacggactactaccagggcctcattcagggccgcgcgctgctgcacacggaccagcagctgtaccagggcggcggcgacgccggcgacctggtcaagtactacgccgacaaccccaccaagttctgggaggacttcggcgcggccatggtgaagctgggcaacctaagcccgctcaccggcgaccaaggagaggtcagggagaactgccgggtcgtcaaccaggcgtga

SEQ ID NO: 16403 - protein, 324 aa, Sorghum bicolor
  misc_feature: Useful for making plants with altered carbohydrate content
  misc_feature: Functional homolog of the protein sequence given in SEQ ID NO 13606
  misc_feature: Useful for making plants with altered cell wall content and/or composition
  misc_feature: Functional homolog of the protein sequence given in SEQ ID NO 13958
  misc_feature: Useful for making plants with modulated oxidative stress sensitivity
  misc_feature: Functional homolog of the protein sequence given in SEQ ID NO 13607
  misc_feature: Ceres ANNOT ID no. 8657311
  misc_feature (12)..(322): SWISSPROT Homolog: EC 1.11.1.7 Peroxidase
  misc_feature (44)..(286): Pfam ID: peroxidase Pfam Description: Peroxidase
MAASSRMGALLVVYLTLMAAALGVRAELTADYYSETCPLALSTIKVLVGTAIVGEPRMGASLVRLHFHDCFVNGCDGSILLDDTDDMVGEKTAKPNNNSVRGYEVIDTIKSAVNTVCLGNVVSCADILAVAARDSIVALGGTSYDVVLGRRDATTASMDDANNVIPNPFMDLPALQASFESLGLSLHDLVVLSGGHTLGYARCLFFRGRLYNETATLDPTYAASLDERCPLSGDDDALSALDDTPTTVDTDYYQGLIQGRALLHTDQQLYQGGGDAGDLVKYYADNPTKFWEDFGAAMVKLGNLSPLTGDQGEVRENCRVVNQA

SEQ ID NO: 16404 - DNA, 942 bp, Sorghum bicolor
  misc_feature: Ceres ANNOT ID no. 8657309
  misc_feature: Encodes the peptide sequence at SEQ ID NO 16405
atggctgcctctgcttcttgcctcgcctttttggtggcggcggcggtggcctcggtggcgtcggcgcagctgtcgtcgacgttctacgacacgtcgtgcccgaacgcgctgtccaccatcaagagcggcgtggacgcggcggtgatgcaggaggcgcgcaccggggcgtcgctgctccggatgcacttccacgactgctttgtgcatggctgcgatgggtccgttctactgaacgacacgtctggggagcagagctcacctccaaacaagggatcgctgaggcgcttcgatgtcatcgacagcatcaaggcgcaggtggaggccgtctgccctggggtcgtctcctgcgccgacatcctcgccgtcgccgcccgagactccgtcgtcgcgctcggcgggccttcgtggaccgttctactggggagaagggattccaccgcttcattcccgagcgagacaaccgacctcccagctccaacatctagcctccaacagctgttatctctgttcagcaacaagaacctcgacgcaacagacatggttgctctctcaggggctcacactatcggacaggcgcagtgctccaacttcaatgaccatatctacaacgacaccaacatcgacgccgccttcgcgacatcgctgcaggccaactgccctgcatcaggcagcaccagcctagcgccgctggacaccatgacccccaccacattcgacaacgactattacaccaacttgatgtcgcagaaggggctcctgcactcggaccaggagctcttcaacaatggcagcaccgacagcacggtcagcaacttcgcgtccagcgcatcggccttcaccagcgccttcacggcggcgatggtgaagatgggaaacctcagcccactcaccggaactgatggggagatcaggctcgcctgcgggatcgtcaactcctcctaa

SEQ ID NO: 16405 - protein, 313 aa, Sorghum bicolor
  misc_feature: Useful for making plants with altered carbohydrate content
  misc_feature: Functional homolog of the protein sequence given in SEQ ID NO 13662
  misc_feature: Useful for making plants with altered cell wall content and/or composition
  misc_feature: Functional homolog of the protein sequence given in SEQ ID NO 13605
  misc_feature: Ceres ANNOT ID no. 8657309
  misc_feature (27)..(311): SWISSPROT Homolog: EC 1.11.1.7 Peroxidase
  misc_feature (40)..(275): Pfam ID: peroxidase Pfam Description: Peroxidase
MAASASCLAFLVAAAVASVASAQLSSTFYDTSCPNALSTIKSGVDAAVMQEARTGASLLRMHFHDCFVHGCDGSVLLNDTSGEQSSPPNKGSLRRFDVIDSIKAQVEAVCPGVVSCADILAVAARDSVVALGGPSWTVLLGRRDSTASFPSETTDLPAPTSSLQQLLSLFSNKNLDATDMVALSGAHTIGQAQCSNFNDHIYNDTNIDAAFATSLQANCPASGSTSLAPLDTMTPTTFDNDYYTNLMSQKGLLHSDQELFNNGSTDSTVSNFASSASAFTSAFTAAMVKMGNLSPLTGTDGEIRLACGIVNSS

SEQ ID NO: 16406 - DNA, 1125 bp, Sorghum bicolor
  misc_feature: Ceres ANNOT ID no. 8657332
  misc_feature: Encodes the peptide sequence at SEQ ID NO 16407
atggcgatgccgccgaagcccggcgacccgccgcagcgctcgccggggcggagccccaacctcaacctgccctgcccgctgccgccggtcccgggcggggcgcctgcgccgccgccgcagcaccagccgggcgccgggctgcccccgccgcgcgtgggccaccaccgccgtgccagatctgaggtggccttccgcttcccggacgacctggccggcgccggggccggcggcttcgatgagatcggctccgaggacgacctcttctccaccttcatggacatggacaagatcgccggtgccgaccgcgaccgcgccgccgagacctcctcgccgccgcgcccagccaagcaccgccacagcgcctccttcgacggcttcgggatgggggccggcgccggcggcccgggcgggcagcaggacggcggcggaggcgtgttcggagaggtcatggaggccaagaaggccatgtcatccgagcagctcgctgagctcgctgctatcgaccccaagcgcgccaaaagaattattgcaaatagacaatctgcagcacggtcaaaggaaagaaaagctcgatatataacagaattggagcggaaggttcaaactcttcagacagaggctactactctttcagcgcagctaacactgttccagagagacacaactggactttcggcggaaaatgctgagctcaagataaggttgcaggccatggagcagcaggctcaactgcgtgatgctctaaatgatgcactgaagcaggaagtggagaggcttaagatagcaacaggtgagatgtcgaagtccaatgaacaatttaatatgggaatgcagcacatctcgtacagcccttcattcttccagctctcagagcaacacacagttcagcagcatggaaatattcagctgccacatcatttccaacagccgccaccgaatgtcccgagtcaccagatgctatcccaccccaattccctctcggatatgatgcagcaagactcgcttgggcggctccaggggctggacatcggaaaaggttcgatggctgtgaagtcagaggcagaggtcgtggtgaagtcggagggtagctctatatctgcaggtgaaagcaataccaccttctag

SEQ ID NO: 16407 - protein, 374 aa, Sorghum bicolor
  misc_feature: The sequence is a functional homolog of SEQ ID NO 1046 in the 10/225,066 US patent application
  misc_feature: The sequence is a functional homolog of SEQ ID NO 2388 in the 10/374,780 US patent application
  misc_feature: The sequence is a functional homolog of SEQ ID NO 412 in the 10/412,699 US patent application
  misc_feature: Ceres ANNOT ID no. 8657332
  misc_feature (166)..(229): Pfam ID: bZIP_1 Pfam Description: bZIP transcription factor
MAMPPKPGDPPQRSPGRSPNLNLPCPLPPVPGGAPAPPPQHQPGAGLPPPRVGHHRRARSEVAFRFPDDLAGAGAGGFDEIGSEDDLFSTFMDMDKIAGADRDRAAETSSPPRPAKHRHSASFDGFGMGAGAGGPGGQQDGGGGVFGEVMEAKKAMSSEQLAELAAIDPKRAKRIIANRQSAARSKERKARYITELERKVQTLQTEATTLSAQLTLFQRDTTGLSAENAELKIRLQAMEQQAQLRDALNDALKQEVERLKIATGEMSKSNEQFNMGMQHISYSPSFFQLSEQHTVQQHGNIQLPHHFQQPPPNVPSHQMLSHPNSLSDMMQQDSLGRLQGLDIGKGSMAVKSEAEVVVKSEGSSISAGESNTTF

SEQ ID NO: 16408 - DNA, 1131 bp, Sorghum bicolor
  misc_feature: Ceres ANNOT ID no. 8657364
  misc_feature: Encodes the peptide sequence at SEQ ID NO 16409
atgtcggcggcgtctcagctgccgccggggttccggttccacccgacggacgacgagctcatcctgcactacctccgcaaccgcgccgcgtccgcgccgtgccccgtgcccatcatcgccgacgtcgacatctacaagttcaacccatgggacctccccgccaaggcgctgtacggcgacggcgagtactacttcttcagcccgcgggaccgcaagtaccccaacggcatccgccccaaccgcgccgccgggtccggctactggaaggccaccggcaccgacaagcccatccacgacgccgccaccggcgatgccgtcggcgtcaagaaggcgctcgtcttctacaagggccgcccgcccagaggctccaagaccaactggatcatgcacgagtaccgcctcgccgccgccaacggctccaccagccccctcgccgccgcctaccgcccgccgtccaagttcaggaacgtctccatgaggctggacgactgggtgctgtgccggatctacaagaagtccagccaggcgtcgccgatggtgccgccgctcgccgactacgagcacctggaccacgacgagccttctcccggcggcacctccttcgacgacttctgcaccagcttctacgccgcgccggccgtcggcgacatcggtgctgctgctgctagtagtactacgactactactactactacgcccgtcatgcacccccaccaccaccaccagccggcggcggcggcgctgccgaggctccccaagataccctccatctccgacctgttgttggacgagtacacgatcgcgcagatcttggacgccccgaccgatatagccgaccaccacgccccgctcgccgtccacccctccctcaaccagctcctggccgtcggcggcgccgacgcctccgacctcacgatctactcgacgccgcccccggccgccgcggctggcgggaagcgcaaggcgatgatgatgagcccggacgagtacgccgccgggatgatgatcaccacagctgctggcctccaccatcactcgccgccgcccaagaggctcaacggcggcttgccggccacgacgtcgcccgtgctcggcggcggcctcaaccatcacatgcttcctcagttctag

SEQ ID NO: 16409 - protein, 376 aa, Sorghum bicolor
  misc_feature: The sequence is a functional homolog of SEQ ID NO 851 in the 10/374,780 US patent application
  misc_feature: Useful for making plants with modulated oxidative stress sensitivity
  misc_feature: Functional homolog of the protein sequence given in SEQ ID NO 13621
  misc_feature: The sequence is a functional homolog of SEQ ID NO 808 in the 10/225,066 US patent application
  misc_feature: The sequence is a functional homolog of SEQ ID NO 926 in the 11/435,388 US patent application
  misc_feature: The sequence is a functional homolog of SEQ ID NO 98 in the 10/374,780 US patent application
  misc_feature: Useful for making plants with altered alkaloid content
  misc_feature: Functional homolog of the protein sequence given in SEQ ID NO 14171
  misc_feature: Useful for making plants with altered cell wall content and/or composition
  misc_feature: Useful for making plants with altered lignin content
  misc_feature: Functional homolog of the protein sequence given in SEQ ID NO 13620
  misc_feature: The sequence is a functional homolog of SEQ ID NO 316 in the 10/412,699 US patent application
  misc_feature: The sequence is a functional homolog of SEQ ID NO 738 in the 11/479,226 US patent application
  misc_feature: The sequence is a functional homolog of SEQ ID NO 104 in the 10/225,068 US patent application
  misc_feature: The sequence is a functional homolog of SEQ ID NO 2014 in the 10/374,780 US patent application
  misc_feature: The sequence is a functional homolog of SEQ ID NO 22 in the 10/286,264 US patent application
  misc_feature: The sequence is a functional homolog of SEQ ID NO 314 in the 10/412,699 US patent application
  misc_feature: The sequence is a functional homolog of SEQ ID NO 734 in the 11/479,226 US patent application
  misc_feature: The sequence is a functional homolog of SEQ ID NO 890 in the 10/374,780 US patent application
  misc_feature: The sequence is a functional homolog of SEQ ID NO 853 in the 10/374,780 US patent application
  misc_feature: The sequence is a functional homolog of SEQ ID NO 891 in the 10/374,780 US patent application
  misc_feature: The sequence is a functional homolog of SEQ ID NO 2060 in the 10/374,780 US patent application
  misc_feature: The sequence is a functional homolog of SEQ ID NO 516 in the 10/412,699 US patent application
  misc_feature: The sequence is a functional homolog of SEQ ID NO 102 in the 10/374,780 US patent application
  misc_feature: The sequence is a functional homolog of SEQ ID NO 886 in the 10/225,066 US patent application
  misc_feature: The sequence is a functional homolog of SEQ ID NO 852 in the 10/374,780 US patent application
  misc_feature: The sequence is a functional homolog of SEQ ID NO 2012 in the 10/374,780 US patent application
  misc_feature: The sequence is a functional homolog of SEQ ID NO 312 in the 10/412,699 US patent application
  misc_feature: The sequence is a functional homolog of SEQ ID NO 731 in the 11/479,226 US patent application
  misc_feature: Useful for making plants with altered terpenoid content
  misc_feature: Functional homolog of the protein sequence given in SEQ ID NO 13966
  misc_feature: Ceres ANNOT ID no. 8657364
  misc_feature (7)..(135): Pfam ID: NAM Pfam Description: No apical meristem (NAM) protein
MSAASQLPPGFRFHPTDDELILHYLRNRAASAPCPVPIIADVDIYKFNPWDLPAKALYGDGEYYFFSPRDRKYPNGIRPNRAAGSGYWKATGTDKPIHDAATGDAVGVKKALVFYKGRPPRGSKTNWIMHEYRLAAANGSTSPLAAAYRPPSKFRNVSMRLDDWVLCRIYKKSSQASPMVPPLADYEHLDHDEPSPGGTSFDDFCTSFYAAPAVGDIGAAAASSTTTTTTTTPVMHPHHHHQPAAAALPRLPKIPSISDLLLDEYTIAQILDAPTDIADHHAPLAVHPSLNQLLAVGGADASDLTIYSTPPPAAAAGGKRKAMMMSPDEYAAGMMITTAAGLHHHSPPPKRLNGGLPATTSPVLGGGLNHHMLPQF

SEQ ID NO: 16410 - DNA, 1002 bp, Sorghum bicolor
  misc_feature: Ceres ANNOT ID no. 8657374
  misc_feature: Encodes the peptide sequence at SEQ ID NO 16411
atggcgtcggaggtgtcgtcggagatcaaccagaaccagggcggcgaggaggagacgcggctggacctcccgccgggcttccgtttccaccccaccgacgaggaggtagtgtcgcactacctcacccacaaggcgctcaacagcagcttctcctgcctcgtcatcgccgacgtcgacctcaacaagatcgagccgtgggatctaccgagcaaggcgaagatgggcgagaaggagtggtacttcttctgccacaaggaccgcaagtacccgacggggatgcgtaccaaccgcgccaccgccagcgggtactggaaggcgacgggcaaggacaaggagatcttccgcggccaccgcgtgctcgtcggcatgaagaagacgctcgtcttctacacgggccgcgcgccgcacggcggcaagacgccatgggtgatgcatgagtaccgcctcgagggaagcctgccgtccaacctccgccgcggtgccaaggacgaatgggctgtctgcaaggtgttcaacaaagacttggcggccaaggctgggcaaatggcaccggcgcacgccgtcgggggtggcatggtgcgcagcgactcgctggccttcctcgacgacctggtgttcgacaacgccgacctgcccccgctcatcgactcgccgtacgccgagggcggcctcatcgacttcaacaagatcgccggcggtggggcttccagctcctcgatcgccgcggcgggcaccaacgacagcgccgggtaccaagtcatcaaggcggaggcgcagctgccggcggcggccaacaactccgcaggcggcgggtcgtactcgtacgagtaccagcagcaggccatacggaggctctgcaaggcggaggcggaggcgccggcgacgctgctgctgagcccgtcgcgcggcggcggcgagtcgagcacagacatgttccatgtggacgacctcctccagctggacggcttcatggacgactactccaacatgtggaagttctag

SEQ ID NO: 16411 - protein, 333 aa, Sorghum bicolor
  misc_feature: The sequence is a functional homolog of SEQ ID NO 106 in the 10/225,068 US patent application
  misc_feature: The sequence is a functional homolog of SEQ ID NO 2348 in the 10/374,780 US patent application
  misc_feature: The sequence is a functional homolog of SEQ ID NO 340 in the 10/412,699 US patent application
  misc_feature: The sequence is a functional homolog of SEQ ID NO 778 in the 11/479,226 US patent application
  misc_feature: Useful for making plants with altered lignin content
  misc_feature: Functional homolog of the protein sequence given in SEQ ID NO 13619
  misc_feature: Useful for making plants with modulated light quality sensitivity
  misc_feature: Functional homolog of the protein sequence given in SEQ ID NO 13618
  misc_feature: The sequence is a functional homolog of SEQ ID NO 2346 in the 10/374,780 US patent application
  misc_feature: The sequence is a functional homolog of SEQ ID NO 238 in the 10/225,068 US patent application
  misc_feature: The sequence is a functional homolog of SEQ ID NO 338 in the 10/412,699 US patent application
  misc_feature: The sequence is a functional homolog of SEQ ID NO 774 in the 11/479,226 US patent application
  misc_feature: Useful for making plants with altered terpenoid content
  misc_feature: Functional homolog of the protein sequence given in SEQ ID NO 13140
  misc_feature: The sequence is a functional homolog of SEQ ID NO 326 in the 10/412,699 US patent application
  misc_feature: The sequence is a functional homolog of SEQ ID NO 760 in the 11/479,226 US patent application
  misc_feature: The sequence is a functional homolog of SEQ ID NO 492 in the 11/435,388 US patent application
  misc_feature: The sequence is a functional homolog of SEQ ID NO 741 in the 11/479,226 US patent application
  misc_feature: The sequence is a functional homolog of SEQ ID NO 2776 in the 10/374,780 US patent application
  misc_feature: The sequence is a functional homolog of SEQ ID NO 416 in the 10/225,066 US patent application
  misc_feature: The sequence is a functional homolog of SEQ ID NO 2418 in the 10/374,780 US patent application
  misc_feature: The sequence is a functional homolog of SEQ ID NO 554 in the 10/225,066 US patent application
  misc_feature: The sequence is a functional homolog of SEQ ID NO 68 in the 10/286,264 US patent application
  misc_feature: The sequence is a functional homolog of SEQ ID NO 2470 in the 10/374,780 US patent application
  misc_feature: The sequence is a functional homolog of SEQ ID NO 798 in the 10/225,066 US patent application
  misc_feature: Useful for making plants with altered cell wall content and/or composition
  misc_feature: Functional homolog of the protein sequence given in SEQ ID NO 14383
  misc_feature: Useful for biocontainment applications
  misc_feature: Functional homolog of the protein sequence given in SEQ ID NO 13684
  misc_feature: Useful for making plants with altered carbohydrate content
  misc_feature: Functional homolog of the protein sequence given in SEQ ID NO 13622
  misc_feature: The sequence is a functional homolog of SEQ ID NO 853 in the 10/374,780 US patent application
  misc_feature: Useful for making plants with modulated oxidative stress sensitivity
  misc_feature: Functional homolog of the protein sequence given in SEQ ID NO 13621
  misc_feature: The sequence is a functional homolog of SEQ ID NO 890 in the 10/374,780 US patent application
  misc_feature: The sequence is a functional homolog of SEQ ID NO 1198 in the 10/412,699 US patent application
  misc_feature: The sequence is a functional homolog of SEQ ID NO 867 in the 10/374,780 US patent application
  misc_feature: The sequence is a functional homolog of SEQ ID NO 2478 in the 10/374,780 US patent application
  misc_feature: The sequence is a functional homolog of SEQ ID NO 572 in the 10/225,066 US patent application
  misc_feature: The sequence is a functional homolog of SEQ ID NO 316 in the 10/412,699 US patent application
  misc_feature: The sequence is a functional homolog of SEQ ID NO 738 in the 11/479,226 US patent application
  misc_feature: The sequence is a functional homolog of SEQ ID NO 1196 in the 10/412,699 US patent application
  misc_feature: The sequence is a functional homolog of SEQ ID NO 865 in the 10/374,780 US patent application
  misc_feature: The sequence is a functional homolog of SEQ ID NO 2012 in the 10/374,780 US patent application
  misc_feature: The sequence is a functional homolog of SEQ ID NO 312 in the 10/412,699 US patent application
  misc_feature: The sequence is a functional homolog of SEQ ID NO 731 in the 11/479,226 US patent application
  misc_feature: The sequence is a functional homolog of SEQ ID NO 2060 in the 10/374,780 US patent application
  misc_feature: The sequence is a functional homolog of SEQ ID NO 516 in the 10/412,699 US patent application
  misc_feature: Useful for making plants with modulated nitrogen use efficiency
  misc_feature: Functional homolog of the protein sequence given in SEQ ID NO 13624
  misc_feature: The sequence is a functional homolog of SEQ ID NO 1197 in the 10/412,699 US patent application
  misc_feature: The sequence is a functional homolog of SEQ ID NO 866 in the 10/374,780 US patent application
  misc_feature: The sequence is a functional homolog of SEQ ID NO 854 in the 11/435,388 US patent application
  misc_feature: The sequence is a functional homolog of SEQ ID NO 26 in the 10/286,264 US patent application
  misc_feature: The sequence is a functional homolog of SEQ ID NO 336 in the 10/412,699 US patent application
  misc_feature: The sequence is a functional homolog of SEQ ID NO 770 in the 11/479,226 US patent application
  misc_feature: Ceres ANNOT ID no. 8657374
  misc_feature (23)..(150): Pfam ID: NAM Pfam Description: No apical meristem (NAM) protein
MASEVSSEINQNQGGEEETRLDLPPGFRFHPTDEEVVSHYLTHKALNSSFSCLVIADVDLNKIEPWDLPSKAKMGEKEWYFFCHKDRKYPTGMRTNRATASGYWKATGKDKEIFRGHRVLVGMKKTLVFYTGRAPHGGKTPWVMHEYRLEGSLPSNLRRGAKDEWAVCKVFNKDLAAKAGQMAPAHAVGGGMVRSDSLAFLDDLVFDNADLPPLIDSPYAEGGLIDFNKIAGGGASSSSIAAAGTNDSAGYQVIKAEAQLPAAANNSAGGGSYSYEYQQQAIRRLCKAEAEAPATLLLSPSRGGGESSTDMFHVDDLLQLDGFMDDYSNMWKF

SEQ ID NO: 16412 - DNA, 1455 bp, Sorghum bicolor
  misc_feature: Ceres ANNOT ID no. 8657381
  misc_feature: Encodes the peptide sequence at SEQ ID NO 16413
atggaggacatatcatggtcagaaacaagtgcaagcataaagcaaaagaagaaggatgcagggcaatccaagaaccagggctccattttaagctcgcttttcaaactggaggccagaaactcagtggagactggaattggttctcaaactaagatatcattgaggaatctgagagaggaggctggcaagttctacgacatcagaatgcagaccacagcccccaaaagaaaagaaaagaaaaagaaaagaggagaaaagattgtgcttcgctttcacccttctcatgtggcaagtaatttcaaccaaaagctggtacagatgtatcatcagcaacagctccataaccataaccagcacctgtcctcgaggccgggcttacctcctgagaagcagttcctcctgcaaggaggaggagatgcagggctggtcctctccaccgatgctaagcctcggttgaaatggacacccgagctgcatgaacgttttgtggaggcagtacatcagctaggagggccagacaaagctacgccgaaaacaatcatgaggctcatggggatccctggactcaccctgtaccatcttaagagccatctccagaaatacagactcagcaagaatctccaggcccaagctaatgctgtcaacgcaaagaatggtaggctactacatgcttcttatcttaaagctgaagtaactaatatcccaaccgtccgttgggacaggaacagacaacccatgcgaagggagcggatcaccaccaccacacttgaacctagagccccagataaacagaaggtggcattaattcagaaatttatcaggtcaatgcacataagcgaagccctccagatgcagatcgaagttcagagacggcttcatgagcagctagaggttcagagacacctgcagctgcggatcgaagcgcagggcaagtacctgcagtccgtgctggagaaggcgcaggaggcgctggccaagcatagcggcgtccacctcgacggcggcgagacgtcgacgcagcagctgtccgagctcatctcgagagccacggcgacgaggcgcgcccatgtccagcaggatcaccagcaccagcaccagcaccagcaccagcgccacctcggcggcgatgggtcggtggacagctgcctgaccgcgtgcgagggatcccagtgccagagggagagggagagggaccaggacctgctgtccatcggcctctcgtccgcgacgcctcccactcccagcaggagaggctacaacaacgacagatgcggcgccatctgcgaggagttcctgtttcttgacgagcccggcaggagagaacgaggaggaggaggagggtcctcggatgagcatggccagcaggagctggacctcagcatcaacggcaggagcaatccaccaaagccacgcgacagccaaaggatcgacctgaacgggtccagctggaattga

SEQ ID NO: 16413 - protein, 484 aa, Sorghum bicolor
  misc_feature: The sequence is a functional homolog of SEQ ID NO 2000 in the 11/479,226 US patent application
  misc_feature: The sequence is a functional homolog of SEQ ID NO 1995 in the 11/479,226 US patent application
  misc_feature: The sequence is a functional homolog of SEQ ID NO 1996 in the 11/479,226 US patent application
  misc_feature: The sequence is a functional homolog of SEQ ID NO 1997 in the 11/479,226 US patent application
  misc_feature: The sequence is a functional homolog of SEQ ID NO 1998 in the 11/479,226 US patent application
  misc_feature: The sequence is a functional homolog of SEQ ID NO 2001 in the 11/479,226 US patent application
  misc_feature: The sequence is a functional homolog of SEQ ID NO 1999 in the 11/479,226 US patent application
  misc_feature: Ceres ANNOT ID no. 8657381
  misc_feature (151)..(202): Pfam ID: Myb_DNA-binding Pfam Description: Myb-like DNA-binding domain
MEDISWSETSASIKQKKKDAGQSKNQGSILSSLFKLEARNSVETGIGSQTKISLRNLREEAGKFYDIRMQTTAPKRKEKKKKRGEKIVLRFHPSHVASNFNQKLVQMYHQQQLHNHNQHLSSRPGLPPEKQFLLQGGGDAGLVLSTDAKPRLKWTPELHERFVEAVHQLGGPDKATPKTIMRLMGIPGLTLYHLKSHLQKYRLSKNLQAQANAVNAKNGRLLHASYLKAEVTNIPTVRWDRNRQPMRRERITTTTLEPRAPDKQKVALIQKFIRSMHISEALQMQIEVQRRLHEQLEVQRHLQLRIEAQGKYLQSVLEKAQEALAKHSGVHLDGGETSTQQLSELISRATATRRAHVQQDHQHQHQHQHQRHLGGDGSVDSCLTACEGSQCQRERERDQDLLSIGLSSATPPTPSRRGYNNDRCGAICEEFLFLDEPGRRERGGGGGSSDEHGQQELDLSINGRSNPPKPRDSQRIDLNGSSWN

SEQ ID NO: 16414 - DNA, 1017 bp, Sorghum bicolor
  misc_feature: Ceres ANNOT ID no. 8657403
  misc_feature: Encodes the peptide sequence at SEQ ID NO 16415
atgggtcccaactcgtcggcgctgggcaagcagcagcaggcggcggcggccatggcgccgaagcgggcgtacgtgaccttccttgcgggcgacggcgactactggaagggcgtggtgggccttgccaagggcctgcgccgtgtcggcgccgcctacccgctggtggttgccgtgctccccgacgtgcccgaggagcaccgccgcaagctccgcgaccagggctgcgtcgtccgcgagattgagcccgtgtacccgcccgacagccagacgcagttcgccatggcctactacgtcatcaactactccaagctccgcatctgggagttggtggagtacgagcgcatggtgtaccttgacgcggacatccaggtgtactccaacatcgaccacctgttcgacctggagaaaggcaagttccacgccgtcatggactgcttctgcgagaagacgtggagccacacgccgcagtacaagatcggctactgccagcagtgccctgagcgcgtggcgtggccggagcaggagcaggagcaggagcttggcccgccgccgccgctctacttcaacgccggcatgttcgtgcacgagcccagcctgcgcaccgcgaaagacctgctggacgcgctggtggtgacgccgccgacgccgttcgcggagcaggacttcctcaacctcttcttccgcgacgtctactcgcccatcccgccggtgtacaacctggtgctcgccatgctgtggaggcatcccgacaagcttaaggtggtgcggctcgacgaggtcaaggtggtgcactactgcgccgccgggtcaaagccgtggaggtacacggggaaggagcccaacatggaccgcgacgacatcaaggcgctggtggccaagtggtggcacatcttcgacgaccagaccctcgactacaacggcggcgaggcggcggcggaccaggcgagtctgccgctgcgccaggccctggctcaggccggcgccgtcaagtacttccccgcgccgtcggctgcctag

SEQ ID NO: 16415 - protein, 338 aa, Sorghum bicolor
  misc_feature: Useful for making plants with altered carbohydrate content
  misc_feature: Functional homolog of the protein sequence given in SEQ ID NO 14194
  misc_feature: Useful for making plants with modulated water use efficiency
  misc_feature: Functional homolog of the protein sequence given in SEQ ID NO 14196
  misc_feature: Useful for making plants with altered cell wall content and/or composition
  misc_feature: Functional homolog of the protein sequence given in SEQ ID NO 14195
  misc_feature: Ceres ANNOT ID no. 8657403
  misc_feature (22)..(144): SWISSPROT Homolog: EC 2.4.1.186 Glycogenin glucosyltransferase
  misc_feature (25)..(277): Pfam ID: Glyco_transf_8 Pfam Description: Glycosyl transferase family 8
MGPNSSALGKQQQAAAAMAPKRAYVTFLAGDGDYWKGVVGLAKGLRRVGAAYPLVVAVLPDVPEEHRRKLRDQGCVVREIEPVYPPDSQTQFAMAYYVINYSKLRIWELVEYERMVYLDADIQVYSNIDHLFDLEKGKFHAVMDCFCEKTWSHTPQYKIGYCQQCPERVAWPEQEQEQELGPPPPLYFNAGMFVHEPSLRTAKDLLDALVVTPPTPFAEQDFLNLFFRDVYSPIPPVYNLVLAMLWRHPDKLKVVRLDEVKVVHYCAAGSKPWRYTGKEPNMDRDDIKALVAKWWHIFDDQTLDYNGGEAAADQASLPLRQALAQAGAVKYFPAPSAA

SEQ ID NO: 16416 - DNA, 1260 bp, Sorghum bicolor
  misc_feature: Ceres ANNOT ID no. 8657416
  misc_feature: Encodes the peptide sequence at SEQ ID NO 16417
atggataaggtgctccacagcgccgatataatggggaactgctgcacaggctctgcaaagtgtgccaatgcctccactccatttgaatcaaaggtcacaagcaggagcaccgcgtccaacaacagtaacaactcgacggcgacagcaggctccaagctagcgtcgcgccgcagcatcggcagctcgtcggccttgtccggccagctagcgggctccgacgtgcaggtgcaggtgcaggcggcgaccggggccggggccgggctcaagtcgttcagcatgagcgagctccgggcggcgaccaagaacttcgggtcgacgtcgtacctgggcgagggcgggttcgggtgcgtgtacaagggctggatcgacgaggcgacgctggcgccgaccaggccgggcgtcggccggatggtggccatcaagaagctcaaggaggagagcttccagggccaccgggagtggctggccgaggtcacctacctgggccagctccaccacgccaacctcgtcaccctcgtcggctactgctccgactccggcgccaacaagctgctggtgtacgagtacatgctccgcggcagcctggagaaccacctcttccgccgcgccacgcagccgctgtcgtggcccatgcgcgtctccatcgccgtcgacgtcgcgcgcggcctcaccttcctgcacgcgcgcgacgacagccccgtcatcttccgcgacctcaagtcctccaacgtcctcctcgactccgactaccgggccaagctgtcggacttcgggctggccaggaacgggcccacgggggacaagagccacgtctccacgcgcgtcgtcgggacccggggctacgccgcgccggagtacatcgccacgggccacctgtcgaccaagagcgacgtgtacagcttcggcgtcgtgctgctggagctcatgacggggcggcgtgccgtggacgacgcccgcggcgggacgctggtggactgggcgtacccgcagctcggggatcgccggaaggtgatccggatcatggacaccaggctgggcgggcagtaccccaagaagcaggcgcaggaggtggccgcgctcgcgctgcgatgcctccagaacgaccccaagaaccgccccgccatggccgacgccgtcctgccggagctcgagcagctgctgctgcacaacagccacaagtcctcctcctacacctcgtccacgccgccgccggtgcaccggccaccaccaggacgcccccacgccaagcccaagagctaa

SEQ ID NO: 16417 - protein, 419 aa, Sorghum bicolor
  misc_feature: Useful for making plants with modulated drought sensitivity
  misc_feature: Functional homolog of the protein sequence given in SEQ ID NO 14078
  misc_feature: Useful for making plants with modulated heat sensitivity
  misc_feature: Functional homolog of the protein sequence given in SEQ ID NO 14079
  misc_feature: Ceres ANNOT ID no. 8657416
  misc_feature (88)..(386): SWISSPROT Homolog: EC 2.7.11.1 Non-specific serine/threonine protein kinase
  misc_feature (103)..(389): Pfam ID: Pkinase Pfam Description: Protein kinase domain
MDKVLHSADIMGNCCTGSAKCANASTPFESKVTSRSTASNNSNNSTATAGSKLASRRSIGSSSALSGQLAGSDVQVQVQAATGAGAGLKSFSMSELRAATKNFGSTSYLGEGGFGCVYKGWIDEATLAPTRPGVGRMVAIKKLKEESFQGHREWLAEVTYLGQLHHANLVTLVGYCSDSGANKLLVYEYMLRGSLENHLFRRATQPLSWPMRVSIAVDVARGLTFLHARDDSPVIFRDLKSSNVLLDSDYRAKLSDFGLARNGPTGDKSHVSTRVVGTRGYAAPEYIATGHLSTKSDVYSFGVVLLELMTGRRAVDDARGGTLVDWAYPQLGDRRKVIRIMDTRLGGQYPKKQAQEVAALALRCLQNDPKNRPAMADAVLPELEQLLLHNSHKSSSYTSSTPPPVHRPPPGRPHAKPKS

SEQ ID NO: 16418 - DNA, 2001 bp, Sorghum bicolor
  misc_feature: Ceres ANNOT ID no. 8657414
  misc_feature: Encodes the peptide sequence at SEQ ID NO 16419
atgggcgtgcagagagccaatggcgcttccttgctccgtgcactagttgttgtgtgcgccctgtgctgggcattgtcttctcggtgtgcggaggggcagaactcaaatggtcagctgagtgtgaatgcctcgccacagaatgctaggaagatccctgataagatgtttggtatctttttcgaggagatcaaccatgctggagctggtgggttgtgggcagagcttgtaagcaacagaggattcgaggccggtgggcctaatacaccttccaatattgatccatggctgatcattggggatgaatcaagtatcattgttggaactgatcggacatcatgctttgaacgtaacccggttgcacttcggatggaagttctttgtgcttctaagaaaactaatgcctgcccgtcaggaggtgttggggtctataatcctggttactggggcatgaacattgaaaaaggaaaggtttataaggtgagcctgcatattaggtcatcagacacagtgtccttgactgtttccttgacaagctccgatggtctacaaaaacttgctgctcacaccatcacaggtagcaagaaaacctttgcaaaatggacaaagatagaatttcatttgagatccaaccaaaataacaccaactcaaggcttcaacttacaacaagtaaaagtggggtagtttggcttgatcaagtatcagttatgccaatggacacttacatggggcatggttttcggaaagatcttgcttctatgttggccaatctcaagcctcagtttctcaagtttccaggcggcaactatgccatgggaaattatctacgaaatgcatttcggtggagtgagactgttgggccatgggaggaaagacctggtcactttaatgatgcctggggatactggactgatgatggacttggattttttgagttccttcagttggctgaagaccttggtgcttccccagtttgggtggtgaatgatggagcaagccttaatgaagaagtttccacaaaaacaattgcttcattggttaaggatgttgttaatggcatagagtttgccaggggaggacccaagacaacttggggttcagttcgcgcatcaatgggacacccagaatcgtttaagcttgattatgtttcaataggaaatcaagaatgttggatgctgtactacagaggaaattaccaaaagttttactctgcgattaaatctgcctacccagacatcaacattatatcaagttgtgataggccaactatttcaccatccaaccctgccgatctttatgatgttcatgtctacacctctttgactaatatgttttcaaaaactagtatgtttgacaacacaccacgtggagcaccgaaggcaattgttagtgagtacgctgtgactgggaatgatgctggcaaaggaacactggtagcagcacttgcagaagctgcatttctcattggattggaaaggaacagtgatgtggttgagatggcaagctgtgcacccctttttgtaaatgacaatgatcgcaggtggagcccagatgccatcgtcttcaactcatggcagcactatgggtgtcccaactattggatgctacacttcttcaaggaatctagtggcgccacccttcatcctacagccatccagatctccaactatgatcagctgcttgcgtctgccatcacttggcagaatgctaaggacaggagcacttacctcaggataaaggtggtcaattttggcaaccaagctgtggatctcaacatatccattgcggaactgcccactggcatcaagaagtctggatcgaaacagatggttctaacatccagcagcccgcttgacgagaactccttccagcagccagagaaggtggtgccagtgttgagcccaatggtgaacgtggggcagcagatgggcgcgtccgtggggccctactccctcacctcgtttgatctgctgctggagccgagcaagcatgacagcatttga

SEQ ID NO: 16419 - protein, 666 aa, Sorghum bicolor
  misc_feature: Useful for making plants with altered carbohydrate content
  misc_feature: Functional homolog of the protein sequence given in SEQ ID NO 13603
  misc_feature: Useful for making plants with altered cell wall content and/or composition
  misc_feature: Functional homolog of the protein sequence given in SEQ ID NO 13604
  misc_feature: Ceres ANNOT ID no. 8657414
  misc_feature (40)..(549): SWISSPROT Homolog: EC 3.2.1.55 Alpha-N-arabinofuranosidase
  misc_feature (463)..(650): Pfam ID: Alpha-L-AF_C Pfam Description: Alpha-L-arabinofuranosidase C-terminus
  misc_feature (73)..(238): Pfam ID: CBM_4_9 Pfam Description: Carbohydrate binding domain
MGVQRANGASLLRALVVVCALCWALSSRCAEGQNSNGQLSVNASPQNARKIPDKMFGIFFEEINHAGAGGLWAELVSNRGFEAGGPNTPSNIDPWLIIGDESSIIVGTDRTSCFERNPVALRMEVLCASKKTNACPSGGVGVYNPGYWGMNIEKGKVYKVSLHIRSSDTVSLTVSLTSSDGLQKLAAHTITGSKKTFAKWTKIEFHLRSNQNNTNSRLQLTTSKSGVVWLDQVSVMPMDTYMGHGFRKDLASMLANLKPQFLKFPGGNYAMGNYLRNAFRWSETVGPWEERPGHFNDAWGYWTDDGLGFFEFLQLAEDLGASPVWVVNDGASLNEEVSTKTIASLVKDVVNGIEFARGGPKTTWGSVRASMGHPESFKLDYVSIGNQECWMLYYRGNYQKFYSAIKSAYPDINIISSCDRPTISPSNPADLYDVHVYTSLTNMFSKTSMFDNTPRGAPKAIVSEYAVTGNDAGKGTLVAALAEAAFLIGLERNSDVVEMASCAPLFVNDNDRRWSPDAIVFNSWQHYGCPNYWMLHFFKESSGATLHPTAIQISNYDQLLASAITWQNAKDRSTYLRIKVVNFGNQAVDLNISIAELPTGIKKSGSKQMVLTSSSPLDENSFQQPEKVVPVLSPMVNVGQQMGASVGPYSLTSFDLLLEPSKHDSI

SEQ ID NO: 16420 - DNA, 1350 bp, Sorghum bicolor
  misc_feature: Ceres ANNOT ID no. 8657413
  misc_feature: Encodes the peptide sequence at SEQ ID NO 16421
atgtatagggctaagagggctgcttcgctcaaagcgaagcgccgcgttggcaagtatgagctcggacgcaccattggggaaggaacatttgcaaaggtccggatcgccaagaacttggacaatggggatcatgttgctgtcaagatccttgacaaggcaaaggttcacaagaacagactggctgaacagattaggagggaaatctgtaccatgaagttaatacagcatcccaatgttgttcgcctgtacgaggtgatgggaagtaaaacaaggatttacattgtgctggagtttgttatgggtggagagctccatgatatcattgccacaagtggaagattgaaggaggaggaagcgcgtagatactttcagcagttgatcaatgctgtagactattgccacagtaggggtgtataccacagagacttgaagctagagaacctgttactcgatgttgctggaaacctcaagatttcagatttcgggttaagtgctttatcagaccaagtgaagcagaatgatggattgctgcatactacatgtggaacacctaactatgtttctccagaggttattgatgacaaaggctatgatggtgcccttgctgacctttggtcttgtggggtgatcctttttgtgctgctcgcaggatgtctgcctttcgaggatgacaacatcgcatccctttataaaaagatctcagaagctcagtttacttgtccatcttggttttctgctggagcaaagaggttgatcaacagaattctggatcctaacccttccactcgcattacaattcctcaagtacaaaaagatccatggtttaaaaaaggttacaagcaacctgttttttatgaacaatgtcaagctagtctagatgatgttgatgccgcctttggagactcagaggaacatcatgtgacagaggaaatggaagggcaacctgcctcgatgaatgcatttgaattgatttcaatgaacaaggggctgaatctggataatttttttgaatctgataagaagtacaagcgagaaacgcgattcacatcacaatgtcctccgaaagaaatcatcgatagaatagaagaagctgctaagccacttgggttcgatatccaaaagaaaaattacaagatgctaatggagaacccaaaagcaggaaggaaaggaaatctaaatgttgagactgaggttttccaagtggctccatcgcttcatgtggttgagctgaagaaggcaaagggagatactctggagtttcaaaatttctacaaaactctgtccacagagctgaaggacgtcgtttgggcgtgtgatgatgaaatccaagacagaagctcctcgccatga

SEQ ID NO: 16421 - protein, 449 aa, Sorghum bicolor
  misc_feature: Useful for making plants with modulated salt sensitivity
  misc_feature: Functional homolog of the protein sequence given in SEQ ID NO 14255
  misc_feature: Ceres ANNOT ID no. 8657413
  misc_feature (16)..(448): SWISSPROT Homolog: EC 2.7.11.1 Non-specific serine/threonine protein kinase
  misc_feature (19)..(275): Pfam ID: Pkinase Pfam Description: Protein kinase domain
  misc_feature (314)..(374): Pfam ID: NAF Pfam Description: NAF domain
MYRAKRAASLKAKRRVGKYELGRTIGEGTFAKVRIAKNLDNGDHVAVKILDKAKVHKNRLAEQIRREICTMKLIQHPNVVRLYEVMGSKTRIYIVLEFVMGGELHDIIATSGRLKEEEARRYFQQLINAVDYCHSRGVYHRDLKLENLLLDVAGNLKISDFGLSALSDQVKQNDGLLHTTCGTPNYVSPEVIDDKGYDGALADLWSCGVILFVLLAGCLPFEDDNIASLYKKISEAQFTCPSWFSAGAKRLINRILDPNPSTRITIPQVQKDPWFKKGYKQPVFYEQCQASLDDVDAAFGDSEEHHVTEEMEGQPASMNAFELISMNKGLNLDNFFESDKKYKRETRFTSQCPPKEIIDRIEEAAKPLGFDIQKKNYKMLMENPKAGRKGNLNVETEVFQVAPSLHVVELKKAKGDTLEFQNFYKTLSTELKDVVWACDDEIQDRSSSP

SEQ ID NO: 16422 - DNA, 420 bp, Sorghum bicolor
  misc_feature: Ceres ANNOT ID no. 8657405
  misc_feature: Encodes the peptide sequence at SEQ ID NO 16423
atgggtgtgaaaggcactttaggtgtgcaggtgctggttggaatggcaagtacagcatgctttgtgattgtcagtaagaatgacatcccgatctatgaggcagaagttggatctgcacccaaaaaagaagatttgtcttatcaccatcagtttatcctgcatgctgcgttagatgttgttcaggacctagcatggaccacaaatgcaatgttcctgaagtcagttgatagattcaatgaccttgtggtattcatgttgcttcatgactcacgtagtgaagatggaataaaaagcttttttcaagaggtccatgaactttacatcaagatattcctcaacccgctttacctgcccggttctcgcatcacatcctctcatttcgataccaaggtcagggccctcgcaaggaagtacctgtaa

SEQ ID NO: 16423 - protein, 139 aa, Sorghum bicolor
  misc_feature: Useful for biocontainment applications
  misc_feature: Functional homolog of the protein sequence given in SEQ ID NO 12968
  misc_feature: Ceres ANNOT ID no. 8657405
  misc_feature (23)..(137): Pfam ID: Sedlin_N Pfam Description: Sedlin, N-terminal conserved region
MGVKGTLGVQVLVGMASTACFVIVSKNDIPIYEAEVGSAPKKEDLSYHHQFILHAALDVVQDLAWTTNAMFLKSVDRFNDLVVFMLLHDSRSEDGIKSFFQEVHELYIKIFLNPLYLPGSRITSSHFDTKVRALARKYL

SEQ ID NO: 16424 - DNA, 1986 bp, Sorghum bicolor
  misc_feature: Ceres ANNOT ID no. 8657457
  misc_feature: Encodes the peptide sequence at SEQ ID NO 16425
atggccatggccatgcccgtcgcccagctgtccttcgtcttccttgtgctcctcctcgcgcacaccgcctctgcacagctcgcgccggcgccggcgcctgacgccggctgcaacggcatcttcctcagctactcgctgcagggccgcgaccagatcaggcctcacgtcgccgaggccgagcgcaactcccagccatactcgttccgcgccagagccaccgtcgtcaactcggacacccgcccgctccgctcctgggcgctgcaggtcacgttcgtgcacggcgagatcctcgtcagcgtcgacggcgccgtgctcacctcgggcgccgacctgccctacaacaccacggcgggggacgccggcaggcccacgtccttcaccgggtacccgcagacggacctcctcaccccgatctccacggccggggaccccgccaagacacaggccaccgtcaacctcgtcggcacgctcttcgccgggcccaggccctacgaaccgctcccatcctttctctcgctcgccgacccttcctacacgtgcccgccggccaccaacgccacgtcgccgaccaacctcaccacctgctgcgtgttcacggccgacgacgacgggaccgacccggcgaggagcttgagcttcctcccgcgccgcacgggcgacctggtgatcacctacgacgtgctccagtcgcacgagaccacctacctggcgctcgtgacgctcgagaacgacgcgccgctcggccgcctcgacggctggcagctgtcgtggcggtggcagcgcgaagaattcatcagcaccatgcgaggcgcctacccgcgggaggtggacaccgccggctgcctgtacggtccccagggacagtactacaagggcctcgacttgtccaaggtgctcaactgcgaccgcacccccgtcgtccacgacctgccgctgtcgcgggccaacgacaccgacatcggccggatcgaccactgctgccggaacggcaccgtcctgcccaagtccatggacgccgccgcgcagtccaagtcggcgttccagatggaggtctacaagatgccgcccgacctcaaccggaccaagctctacccgcccacaggattcaacgtcaccggctcgtcgccgttcaacccggagtacgcgtgcggggcgcccatcccggtgaccccgtcggagtaccccgaccccagcggcctcgcgtccaccacggcggccgtggccacgtggcaggtggtgtgcaacatcaccaccgcgtcgaagccacccaggtgctgcgtctccttctccgccttctacaacgagtcggtggtcccctgccggacctgcgcgtgcggctgccccgccactcagccggcgacggcgacctgcagcaccacggcgccggcgatgctgctcccgccgcaggcgctgctcatgccgttcgaccggcgggccagcgaggcgctcgagtgggcggaccagaagcacctgggcgtgcccaaccccatgccctgcggcgacttctgcggcgtcagcatcaactggcacgtcgccacggacttcaccggcggctggagcgcgcgcctgacgctcttcaactgggacgccacggacatgccggactggttcacggccatcgtcatggacggggcgtacgacggcttcgaacaggcatactccttcaacgccacacgcgtcgggaacaacaccatcttcgtcaagggctcccaaggcttcaacttcctgctcggcgagagcaacatgagcggcgtcgattaccccgtgcccgggaagctgcagtccgtcttctccttcaccaagaagaccacccccggcatcgacgtcatcgcaggcgacggcttcccgtccaaggtcttcttcaacggcgacgagtgcgccatgcccttgaggatcccgagccaggggaccaagcctgctgctctccctgtccccctgcacttgtgtttattgcttctttccactttcctcttgttggcttactaa

SEQ ID NO: 16425 - protein, 661 aa, Sorghum bicolor
  misc_feature: Useful for making plants with altered carbohydrate content
  misc_feature: Functional homolog of the protein sequence given in SEQ ID NO 13790
  misc_feature: Ceres ANNOT ID no. 8657457
  misc_feature (235)..(418): Pfam ID: Phytochel_synth Pfam Description: Phytochelatin synthetase-like conserved region
MAMAMPVAQLSFVFLVLLLAHTASAQLAPAPAPDAGCNGIFLSYSLQGRDQIRPHVAEAERNSQPYSFRARATVVNSDTRPLRSWALQVTFVHGEILVSVDGAVLTSGADLPYNTTAGDAGRPTSFTGYPQTDLLTPISTAGDPAKTQATVNLVGTLFAGPRPYEPLPSFLSLADPSYTCPPATNATSPTNLTTCCVFTADDDGTDPARSLSFLPRRTGDLVITYDVLQSHETTYLALVTLENDAPLGRLDGWQLSWRWQREEFISTMRGAYPREVDTAGCLYGPQGQYYKGLDLSKVLNCDRTPVVHDLPLSRANDTDIGRIDHCCRNGTVLPKSMDAAAQSKSAFQMEVYKMPPDLNRTKLYPPTGFNVTGSSPFNPEYACGAPIPVTPSEYPDPSGLASTTAAVATWQVVCNITTASKPPRCCVSFSAFYNESVVPCRTCACGCPATQPATATCSTTAPAMLLPPQALLMPFDRRASEALEWADQKHLGVPNPMPCGDFCGVSINWHVATDFTGGWSARLTLFNWDATDMPDWFTAIVMDGAYDGFEQAYSFNATRVGNNTIFVKGSQGFNFLLGESNMSGVDYPVPGKLQSVFSFTKKTTPGIDVIAGDGFPSKVFFNGDECAMPLRIPSQGTKPAALPVPLHLCLLLLSTFLLLAY

SEQ ID NO: 16426 - DNA, 1824 bp, Sorghum bicolor
  misc_feature: Ceres ANNOT ID no. 8657499
  misc_feature: Encodes the peptide sequence at SEQ ID NO 16427
atgggcaccacgtacaagtgctgcctcatcttcaagcgccggttccacgcccgcgacgcgccgccgcccgaggacgtccgcgccctcttctccctccacaccggcgggggtacccacatgggcgccgacggcctgcgacgctacctggacgccacacaggaggaggcgtcgcggctggacgacgccgaggtggagcggctgctggagcagatccgcctgcagcagcaccagggcggccaccgcgcccgcctcccgcgcctggcccgcccgctcctcgccctcgacgacttccaccgctacctcttctcgcacgacctcaacccgcccctccgacaccaccaggtgcaccacgacatgacgcgcccgctctcccactacttcatctacaccggacacaactcctacctcaccggcaaccagctcagcagcgactgcagcgacgtccccatcatcaaggcgctgcagagaggggtcagggtcatcgagctcgacatgtggccaaattcaacaaaggacgacatcaacatcctgcacggaaggacactgaccaccccagtttcgctcatcaaatgcttgatatccatcaaagaatatgcctttgttgcatctccctatcctgtcatcataacgcttgaagaccaccttccctctgaactccaggaaaaagttgccaagatggttcttgatgtatttggtgacatactgtactacccgcctgactccgatcacctcaaagaattcccatcacctgaacaactcaagggccgtgtcctcctctcaacaaagccccccaaggagtaccttgaagccaaggctgatgacaccatgaaagagggtgatgctgacctccatcttgccaaaggggctaatgatgatgccgcgtggggaaaagaagtaccggattttcagactgagatccagtccgcaaaaaagcacgacgatgatgccccaggacaccaaagagaagatgatgacgacgacgatgatgaggaggaagaacagaaaatgcaaccacatttagctccacagtataaacaccttatcacaatcagagcagggaagccaaaaggctctctagctgatgccttgaagagtgatccagaaaaagttaggcgtctcagtttgagcgagcaacaacttgccaaagtggcagaggatcacgccacagaaattgtgaggttcacgcagaggaacatattgaggatatacccgaagggcactcgagtcacttcatctaactacaacccgtttattggttgggtgcatggtgctcaaatggtggcattcaatatgcagggatatggaagagcgctttggctaatgcacggattttataaagcgaacggtgggtgcggttatgtgaagaagccagatttcttgatgcagacagaaccacaagtctttgacccaagagaaccccaacctgtgaagaaaaccttgaaggtgaaggtgtacatgggcgatgggtggcgaatggacttcaagcagacacacttcgatcaatattctcctccagatttctacacacgggttgggatcgctggggtcccagcagactcggtgatgaagaagaccaaggctatcgaggacaactggatgccggtgtgggaggaggagttcagcttcccgctgacggtcccggagatcgctctgctgcgggtggaagtgcacgagtacgacatgtcggagaaggacgacttcggtggacagacggtgctgccggtgtcggagctgcggccggggatccgggcggtggcgctcttcgaccgcaaagggaacaagtacaacaacgtgaagcttctcatgcgtttcgagtttgcctag

SEQ ID NO: 16427 - protein, 607 aa, Sorghum bicolor
  misc_feature: Useful for making plants with modulated water use efficiency
  misc_feature: Functional homolog of the protein sequence given in SEQ ID NO 13598
  misc_feature: Ceres ANNOT ID no. 8657499
  misc_feature (95)..(602): SWISSPROT Homolog: EC 3.1.4.11 Phosphoinositide phospholipase C
  misc_feature (119)..(263): Pfam ID: PI-PLC-X Pfam Description: Phosphatidylinositol-specific phospholipase C, X domain
  misc_feature (343)..(461): Pfam ID: PI-PLC-Y Pfam Description: Phosphatidylinositol-specific phospholipase C, Y domain
  misc_feature (480)..(572): Pfam ID: C2 Pfam Description: C2 domain
  misc_feature (25)..(116): Pfam ID: efhand_like Pfam Description: Phosphoinositide-specific phospholipase C, efhand-like
MGTTYKCCLIFKRRFHARDAPPPEDVRALFSLHTGGGTHMGADGLRRYLDATQEEASRLDDAEVERLLEQIRLQQHQGGHRARLPRLARPLLALDDFHRYLFSHDLNPPLRHHQVHHDMTRPLSHYFIYTGHNSYLTGNQLSSDCSDVPIIKALQRGVRVIELDMWPNSTKDDINILHGRTLTTPVSLIKCLISIKEYAFVASPYPVIITLEDHLPSELQEKVAKMVLDVFGDILYYPPDSDHLKEFPSPEQLKGRVLLSTKPPKEYLEAKADDTMKEGDADLHLAKGANDDAAWGKEVPDFQTEIQSAKKHDDDAPGHQREDDDDDDDEEEEQKMQPHLAPQYKHLITIRAGKPKGSLADALKSDPEKVRRLSLSEQQLAKVAEDHATEIVRFTQRNILRIYPKGTRVTSSNYNPFIGWVHGAQMVAFNMQGYGRALWLMHGFYKANGGCGYVKKPDFLMQTEPQVFDPREPQPVKKTLKVKVYMGDGWRMDFKQTHFDQYSPPDFYTRVGIAGVPADSVMKKTKAIEDNWMPVWEEEFSFPLTVPEIALLRVEVHEYDMSEKDDFGGQTVLPVSELRPGIRAVALFDRKGNKYNNVKLLMRFEFA

SEQ ID NO: 16428 - DNA, 1227 bp, Sorghum bicolor
  misc_feature: Ceres ANNOT ID no. 8657495
  misc_feature: Encodes the peptide sequence at SEQ ID NO 16429
atggcacgcctgctcctctccctctccgtcccagtctccgctagcattgtgctgccgtcgtcgtcgagtactagtactagtaccgcacgggcacggcgccgagggagaggccgcgtggctgtgcccgccacctccaccgccaccgccacccaaggacaagaagcaccggcgtttgaccccgcggcggcgccaccgttcgggctggccgacatccgcgccgccatccccaagcactgctgggtgaaggacccctggcgctccatgggctacgtcctgcgcgacgtcgtcctggtgctggggctcgccgccgccgccgcgcgcctcgacagctggctcgtgtggccgctctactgggcggcgcagggcaccatgttctgggcgctcttcgtgctgggacacgactgtgggcacggcagcttctccaacaactccaacctcaacagtgtggtcggccacatcctgcactcctccatcctggtgccataccacggctggcggattagccacaggacacaccaccagaaccacggccacgtcgacaaggacgagtcatggcatcccctccccgagcggctttacaagagcctggacagcgtcgtcctgatgctgcgcttcaggcttcccttccccatgctcgcctacccattctacctggccaacaggagccccggcaagtcaggctcccacttccacccggccagcgacctcttccagcccagcgagagcaacgacgtgctcacctccacggcgtgctggctcgccatggctgccctcctagctgcgctcaccttcctcatgggccctctgcagatgctcaagctctacttcgtaccctattggggttttgtcatgtggctcgactttgttacctacctgcaccatcacggccacaatgacaagcttccatggtaccgaggaaaggaatggacctatcttcggggtggcctgacgacgctcgaccgggactacggatggatcaacaacatccaccatgacattgggactcatgtcatccaccatctcttcccgcagatcccacattaccatctcatagaggcaacagaggcagccaagccggtgctgggaaagtactacagagagccgcaaaagtctggtcctctcccctttcatctacttggtgatctggttcggagtttgagacgtgaccactatgtcagcgacacaggggatgtggtctactaccaaactgacccaaaactccattag

SEQ ID NO: 16429 - protein, 408 aa, Sorghum bicolor
  misc_feature: Useful for making plants with modulated heat sensitivity
  misc_feature: Functional homolog of the protein sequence given in SEQ ID NO 13709
  misc_feature: Ceres ANNOT ID no. 8657495
  misc_feature (68)..(366): SWISSPROT Homolog: EC 1.14.99.33 Delta(12)-fatty acid dehydrogenase
  misc_feature (117)..(361): Pfam ID: FA_desaturase Pfam Description: Fatty acid desaturase
MARLLLSLSVPVSASIVLPSSSSTSTSTARARRRGRGRVAVPATSTATATQGQEAPAFDPAAAPPFGLADIRAAIPKHCWVKDPWRSMGYVLRDVVLVLGLAAAAARLDSWLVWPLYWAAQGTMFWALFVLGHDCGHGSFSNNSNLNSVVGHILHSSILVPYHGWRISHRTHHQNHGHVDKDESWHPLPERLYKSLDSVVLMLRFRLPFPMLAYPFYLANRSPGKSGSHFHPASDLFQPSESNDVLTSTACWLAMAALLAALTFLMGPLQMLKLYFVPYWGFVMWLDFVTYLHHHGHNDKLPWYRGKEWTYLRGGLTTLDRDYGWINNIHHDIGTHVIHHLFPQIPHYHLIEATEAAKPVLGKYYREPQKSGPLPFHLLGDLVRSLRRDHYVSDTGDVVYYQTDPKLH

SEQ ID NO: 16430 - DNA, 174 bp, Sorghum bicolor
  misc_feature: Ceres ANNOT ID no. 8657494
  misc_feature: Encodes the peptide sequence at SEQ ID NO 16431
atgggcgtgattcacatgggaggcgtccccacacctcgtccaggtggtttggactgcaaacatctagccaggataactcagcttaatgaatatgtctctaaaagagttcctgaaatcttgttgggtgatcctagaagatctcgacagaaaattacaaatttagtggggaactaa

SEQ ID NO: 16431 - protein, 57 aa, Sorghum bicolor
  misc_feature: The sequence is a functional homolog of SEQ ID NO 5 in US patent 7026530
  misc_feature: Ceres ANNOT ID no. 8657494
MGVIHMGGVPTPRPGGLDCKHLARITQLNEYVSKRVPEILLGDPRRSRQKITNLVGN

SEQ ID NO: 16432 - DNA, 1215 bp, Sorghum bicolor
  misc_feature: Ceres ANNOT ID no. 8657521
  misc_feature: Encodes the peptide sequence at SEQ ID NO 16433
atggactgctgcttcccctgcctccgaggggccaagaagaaggagaagcagccgccggagaagccccagatccgccccgcctcagttgttgatgcagagaaacccaaacagcgtccgtcgtctagtgtgacgaagcaggattcattcgatttcaacatggaatctgcaaacaagggcattgtcctgagcaatggatctggccacaaccaaatcgctgcgcaaaccttcagtttcagggacctcgcagcagccacgagcaacttcagagctgattgccttcttggtgagggtggctttggacgggtgtacagaggctatctggacagtgtcagccaggttgttgctataaagcagcttgaccgtaacggattacaaggcaacagggagtttcttgttgaagttctgatgttgagcttgctgcatcacccaaatcttgtcagtcttattggctactgtgctgatggggatcagaggcttttggtttatgagtatatgcctctaggttctcttgaggatcaccttcatgatccttccccagataaggcacggcttgactggaatacaaggatgaagatagctgctggtgcagcgaaagggctagagtatttgcatgatgccagtcctcctgtcatataccgggacttgaaatgttcaaacatcttgcttggagagaggtatcacccaaagttgtctgattttggattggcaaagcttggtccaatcggtgacaaaactcatgtttccacaagagtgatggggacatatgggtattgtgctcctgagtatgctatgaccggacagttgaccctaaagtcggacatttatagcttcggtgtagtccttttggagatcattacaggacaaagggctattgacaacacccgggctggaggggagcaaaatcttgttgcatgggcccggccattgttcaaagacaggaggaaatttcccctgatggcagaccctgcactagaggggcagtatcctccaaggggattgtaccaggcccttgctgtcgctgcaatgtgcgtccaagagcaaccgagcatgagaccgctgatcggggatgtggttacagccctcacctaccttgcctcccagacctacgatccggaagcacatgccaattcacacttggtagctccagggacaccaccacggactaggaccaggattcgaagccatggtgctgcagatcagaggggaagtggctaa

SEQ ID NO: 16433 - protein, 404 aa, Sorghum bicolor
  misc_feature: Useful for making plants with modulated drought sensitivity
  misc_feature: Functional homolog of the protein sequence given in SEQ ID NO 14078
  misc_feature: Useful for making plants with altered carbohydrate content
  misc_feature: Functional homolog of the protein sequence given in SEQ ID NO 14218
  misc_feature: Ceres ANNOT ID no. 8657521
  misc_feature (67)..(371): SWISSPROT Homolog: EC 2.7.11.1 Non-specific serine/threonine protein kinase
  misc_feature (88)..(361): Pfam ID: Pkinase Pfam Description: Protein kinase domain
MDCCFPCLRGAKKKEKQPPEKPQIRPASVVDAEKPKQRPSSSVTKQDSFDFNMESANKGIVLSNGSGHNQIAAQTFSFRDLAAATSNFRADCLLGEGGFGRVYRGYLDSVSQVVAIKQLDRNGLQGNREFLVEVLMLSLLHHPNLVSLIGYCADGDQRLLVYEYMPLGSLEDHLHDPSPDKARLDWNTRMKIAAGAAKGLEYLHDASPPVIYRDLKCSNILLGERYHPKLSDFGLAKLGPIGDKTHVSTRVMGTYGYCAPEYAMTGQLTLKSDIYSFGVVLLEIITGQRAIDNTRAGGEQNLVAWARPLFKDRRKFPLMADPALEGQYPPRGLYQALAVAAMCVQEQPSMRPLIGDVVTALTYLASQTYDPEAHANSHLVAPGTPPRTRTRIRSHGAADQRGSG

SEQ ID NO: 16434 - DNA, 1707 bp, Sorghum bicolor
  misc_feature: Ceres ANNOT ID no. 8657537
  misc_feature: Encodes the peptide sequence at SEQ ID NO 16435
atggacaaggcccacctcggagtcggagggggtctgttagctctcgacgcgtcgccgcggccccttggcttcctctcccccacggcgttccacagagcaagaacaacagccatggaggccgccgacgacggaaacggaacacccccgccaggcagcagggtccgtaggtccgtcgaggtggacttcttctccgaccagaagatcgctgccgatgcagctaacaacaacacctgcggcaggaccaccgtctcgccgggatcgggatcaggagccagctgcctcgccatcaagaaggaggatctcaccattaacctccttcccggcaccggcagcaacgccaacgacgacgaggcggccacccggctccggctgctggaccaagacaagcagagcaggaacaccaacgaggcggagcttgcgcgcatgaacgacgagaaccagcggctccgcgggatgctgacccaggtcaccagcagctaccaggcgctccagatgcatctcgtggcgctcatgcaggcgcgggccggcggccaggcccagctgatgctgcctcctgtggcccaggcgctgccgccgacgaccgacggcgcggctgctgctgtcatgccattgccgagacagttcctcggcctaggaccggctgctgctgccgaggagacgtccaactcgtccacggaggtgggaagcccgcggcggtcgtcgtccaccggcggcaacaggcgggcggagcgcggcgacagcccggacgcgtcaacaaggcagcagcaggtagcgcagcagcagcaggaggcgagcatgaggaaggcgcgcgtctcggtgcgcgcgcgatccgaagcgcccatcatcgccgacggctgccagtggcgcaagtacgggcagaagatggccaagggcaacccatgcccgcgagcctactaccgctgcaccatggccaacggctgccccgtgcggaagcaggttcagcgctgcgccgacgaccgctccatcctcatcaccacctacgagggcacccacaaccacccgctcccgcccgccgccatggccatggcctccaccacctccgccgcagcctccatgctgctgtccggctccatgcccagcggggacatgatgacctccaacttcctggcgcgggccgtgctgccgtgctcctccagcatggccaccatctccgcctccgcgccgttccccaccgtcacgctcgacctcacacacggcccgcccgctgctgcacgaccgcagccgcacttccaagtcccgctgccaccgcaccagcaggtccagcagcagcaccaccacctgcaggcggccgcgctctacaacgcccaccagtcttcgtccaagttctccggcctgcacatgtcatcgtcatcgacatcggacaataacaacaatgttggcactagtagcagagccgccgtggcagcggctgacgcgccgccgcacatggacaccgtcactgcggcggcggccgccatcaccgcggaccccaacttcacggtggcgctggcggcggccatcacgtccatcataggcggcggcggaggtcatccaattccaattgcaattcatcatgggcaagggcaagggcaagagcaggggcagcagcaggccccgacgagtaacagcaacgccaacaacaacaacaatgcggtggtgacgagcagcagcaacaacacggcgaccagcaacagcgagacccagtga

SEQ ID NO: 16435 - protein, 568 aa, Sorghum bicolor
  misc_feature: The sequence is a functional homolog of SEQ ID NO 114 in the 11/375,241 US patent application
  misc_feature: The sequence is a functional homolog of SEQ ID NO 146 in the 10/286,264 US patent application
  misc_feature: The sequence is a functional homolog of SEQ ID NO 2500 in the 10/374,780 US patent application
  misc_feature: The sequence is a functional homolog of SEQ ID NO 672 in the 10/412,699 US patent application
  misc_feature: Ceres ANNOT ID no. 8657537
  misc_feature (282)..(342): Pfam ID: WRKY Pfam Description: WRKY DNA -binding domain
MDKAHLGVGGGLLALDASPRPLGFLSPTAFHRARTTAMEAADDGNGTPPPGSRVRRSVEVDFFSDQKIAADAANNNTCGRTTVSPGSGSGASCLAIKKEDLTINLLPGTGSNANDDEAATRLRLLDQDKQSRNTNEAELARMNDENQRLRGMLTQVTSSYQALQMHLVALMQARAGGQAQLMLPPVAQALPPTTDGAAAAVMPLPRQFLGLGPAAAAEETSNSSTEVGSPRRSSSTGGNRRAERGDSPDASTRQQQVAQQQQEASMRKARVSVRARSEAPIIADGCQWRKYGQKMAKGNPCPRAYYRCTMANGCPVRKQVQRCADDRSILITTYEGTHNHPLPPAAMAMASTTSAAASMLLSGSMPSGDMMTSNFLARAVLPCSSSMATISASAPFPTVTLDLTHGPPAAARPQPHFQVPLPPHQQVQQQHHHLQAAALYNAHQSSSKFSGLHMSSSSTSDNNNNVGTSSRAAVAAADAPPHMDTVTAAAAAITADPNFTVALAAAITSIIGGGGGHPIPIAIHHGQGQGQEQGQQQAPTSNSNANNNNNAVVTSSSNNTATSNSETQ

SEQ ID NO: 16436 - DNA, 1254 bp, Sorghum bicolor
  misc_feature: Ceres ANNOT ID no. 8657513
  misc_feature: Encodes the peptide sequence at SEQ ID NO 16437
atggtgaaggcctaccccacggtgagtgaggactacctcaaggcggtcgacaaggccaagcgcaagctccgcggcctcatcgctgagaagaactgcgccccgctcatgctccgcctcgcctggcactccgcgggcaccttcgatgtggccaccaagaccggggggcccttcggcaccatgaagaaccccgccgagcaggcgcacggagccaacgccggactggaaattgccgtcaggctgctagagcctatcaaggagcagttccccatcctatcctatgctgacttctaccagcttgccggagtcgtggcagttgaggtaaccggcggacctgatgtccccttccaccctgggaggcaggacaagcctgagcctccgccagaaggccgccttcctgatgccacccaaggttctgatcacctcaggcaggttttctccacacagatgggtttgagcgaccaggacattgttgcactttctggtggtcacaccctgggaagatgccacaaggatagatctgggtttgagggagcctggacatccaaccctttaatctttgacaactcttacttcacggagcttctgagtggagagaaggaaggccttctacagctaccaagtgacaaagccctcctctctgatccatccttccgcccacttgttgacaaatatgcagcggatgaggacgctttctttgctgactacgccgaggcccacctgaagctttccgaattgggtaagtttgccagctaccttatttgcctccctatgacagctatgagccatcctcaagctcttgcacaatgtgaacaaacattgaccaaattagaaattgagcatagggaagctgttgatgatacagcaggtgcagcaaatcttattgcggaacaaaagctccaagatactgctgcagttgctagctcgttagctgctcaactttatgggctggatattcttgcagaaagcattcaggatgacacagacaatgtcacccgtcttatgatgctggctcgagaacccattattcctcgcaccgacaagccattcaagaccagcgtagtcttatctctggaagagggacctggtcaactgttcaaagtactcgcggtgtttgctctgaaaaaccaacctcacaaagatcttgaagcgtcaatggctgatccaaatgctcaaagtgctcttgaaaacttgaaggaattcgcaaagttcctaaaagttcttgggagctaccctacaggtgtgagtgaagggtga

SEQ ID NO: 16437 - protein, 417 aa, Sorghum bicolor
  misc_feature: Useful for making plants with modulated heat sensitivity
  misc_feature: Functional homolog of the protein sequence given in SEQ ID NO 13793
  misc_feature: Useful for making plants with modulated water use efficiency
  misc_feature: Functional homolog of the protein sequence given in SEQ ID NO 13794
  misc_feature: Useful for making plants with altered carbohydrate content
  misc_feature: Functional homolog of the protein sequence given in SEQ ID NO 14384
  misc_feature: Useful for making plants with altered cell wall content and/or composition
  misc_feature: Functional homolog of the protein sequence given in SEQ ID NO 13796
  misc_feature: Ceres ANNOT ID no. 8657513
  misc_feature: Down-regulated in root tissues in response to methyl jasmonate treatment
  misc_feature: Up-regulated in shoot tissues in response to salicylic acid treatment
  misc_feature: Up-regulated in shoot tissues in response to methyl jasmonate treatment
  misc_feature (3)..(249): SWISSPROT Homolog: EC 1.11.1.11 L-ascorbate peroxidase
  misc_feature (258)..(375): SWISSPROT Homolog: EC 4.2.1.51 Prephenate dehydratase
  misc_feature (19)..(227): Pfam ID: peroxidase Pfam Description: Peroxidase
  misc_feature (191)..(341): Pfam ID: PDT Pfam Description: Prephenate dehydratase
MVKAYPTVSEDYLKAVDKAKRKLRGLIAEKNCAPLMLRLAWHSAGTFDVATKTGGPFGTMKNPAEQAHGANAGLEIAVRLLEPIKEQFPILSYADFYQLAGVVAVEVTGGPDVPFHPGRQDKPEPPPEGRLPDATQGSDHLRQVFSTQMGLSDQDIVALSGGHTLGRCHKDRSGFEGAWTSNPLIFDNSYFTELLSGEKEGLLQLPSDKALLSDPSFRPLVDKYAADEDAFFADYAEAHLKLSELGKFASYLICLPMTAMSHPQALAQCEQTLTKLEIEHREAVDDTAGAANLIAEQKLQDTAAVASSLAAQLYGLDILAESIQDDTDNVTRLMMLAREPIIPRTDKPFKTSVVLSLEEGPGQLFKVLAVFALKNQPHKDLEASMADPNAQSALENLKEFAKFLKVLGSYPTGVSEG

SEQ ID NO: 16438 - DNA, 1296 bp, Sorghum bicolor
  misc_feature: Ceres ANNOT ID no. 8657552
  misc_feature: Down-regulated in root tissues in response to methyl jasmonate treatment
  misc_feature: Up-regulated in shoot tissues in response to salicylic acid treatment
  misc_feature: Up-regulated in shoot tissues in response to methyl jasmonate treatment
  misc_feature: Encodes the peptide sequence at SEQ ID NO 16439
atggcaaaccctgacgcggaggtgatcgcgctctcgccgcggacgctgctggcgacgaaccggttcgtgtgcgagatctgcggcaaggggttccagcgcgaccagaacctgcagctgcaccggcgcggccacaacctcccctggaagctccggcagcgcagcggcaaggagccccggaagcgcgtgtacgtgtgcccggagaagacgtgcgtccaccacaacccgtcccgcgcgctgggcgacctcaccggcatcaagaagcacttctgccgcaagcacggcgagaagaagtggaagtgcgacaagtgcaacaagcgctacgccgtgcagtccgactggaaggcgcacgccaagacatgcggcaccagggagtacagatgcgactgcggcacgctattctcaaggcgggacagcttcatcacccaccgcgccttctgcgacgcgctcgccgaggagacggccaggctcaacgccgcctccagcgccggcgccgccacgtcctacctcttcgcgggctcgccgccggggctgcaccccaacatgatgctgccaccggccccggccccggccccggccccgggcccgcacctcaagccgctcggtccgcatgtcgtcggcggcctctcgctgtgggggggcggggacgcgctgccgtccatggtgggccacattggtgctactggtggtatcctgctgcccggtggtgagccagcggtgcccccgcagctgtacgcggatctcttctcgcccgcaccgccgcagctgggctggctgtgcgggaacggcagcaagctcgcgtcgtcgaacgccagcgagctgacgagcgccgccgctgcgtcggggaagcaggacacggacagcgtcttcagcgggcagcaccacgccaagcccacggcgccggccgccgacatgtccgcgacggcgctgctgcagaaggccgcgcagatgggtgctgtcacgtccgggtccggcaatgcgatgtcgatgccgccgggggccttggagccggccgatattggtcatcatcagtcgtcggacggtgctggaggtctgctgtttagcgcatcaagccagcagaacgctactaatctcaggctcaggggaacagatactacactaataatgagccacctcacagcggcggccgccgggaacatgccgtacgacgtgctctctgctgtgcgccatgccggcctcaaggatgctgccgtcgccgtcgggagggaggagaccagggatttcttgggcgttggcgtgcaagcgctgtgctcatcgtcgttgaatggctggatttag

SEQ ID NO: 16439 - protein, 431 aa, Sorghum bicolor
  misc_feature: The sequence is a functional homolog of SEQ ID NO 1087 in the 10/666,642 US patent application
  misc_feature: Useful for making plants with altered lignin content
  misc_feature: Functional homolog of the protein sequence given in SEQ ID NO 13275
  misc_feature: Ceres ANNOT ID no. 8657552
  misc_feature (22)..(44): Pfam ID: zf-C2H2 Pfam Description: Zinc finger, C2H2 type
MANPDAEVIALSPRTLLATNRFVCEICGKGFQRDQNLQLHRRGHNLPWKLRQRSGKEPRKRVYVCPEKTCVHHNPSRALGDLTGIKKHFCRKHGEKKWKCDKCNKRYAVQSDWKAHAKTCGTREYRCDCGTLFSRRDSFITHRAFCDALAEETARLNAASSAGAATSYLFAGSPPGLHPNMMLPPAPAPAPAPGPHLKPLGPHVVGGLSLWGGGDALPSMVGHIGATGGILLPGGEPAVPPQLYADLFSPAPPQLGWLCGNGSKLASSNASELTSAAAASGKQDTDSVFSGQHHAKPTAPAADMSATALLQKAAQMGAVTSGSGNAMSMPPGALEPADIGHHQSSDGAGGLLFSASSQQNATNLRLRGTDTTLIMSHLTAAAAGNMPYDVLSAVRHAGLKDAAVAVGREETRDFLGVGVQALCSSSLNGWI

SEQ ID NO: 16440 - DNA, 372 bp, Sorghum bicolor
  misc_feature: Ceres ANNOT ID no. 8657544
  misc_feature: Encodes the peptide sequence at SEQ ID NO 16441
atggtcagcagaggtgctcgtcggccatcggcgcggctcctgctcctctccctggggcttgtgctcctctacttcacctcagtaagcagcgtcggcgttgctgcggcccagaaaacgtggtgcgtggccaagccgtccgcgtccaacgacatcctgtctctgaacctcaactacgcgtgctcccaggtgagctgcgccgtgatccagaagggcggaccgtgctactacccggacaacctggtgtcgcgtgccgccgtcgccatgaacctctactacgcctccaatggcaggcacccctggaactgctacttcaacaactcggcgctcgtggtgcagtccgatcccagctatggctcctgcacctactactga

SEQ ID NO: 16441 - protein, 123 aa, Sorghum bicolor
  misc_feature: Useful for making plants with altered carbohydrate content
  misc_feature: Functional homolog of the protein sequence given in SEQ ID NO 14385
  misc_feature: Ceres ANNOT ID no. 8657544
  misc_feature (40)..(122): SWISSPROT Homolog: EC 3.2.1.39 Glucan endo-1,3-beta-D-glucosidase
  misc_feature (39)..(122): Pfam ID: X8 Pfam Description: X8 domain
MVSRGARRPSARLLLLSLGLVLLYFTSVSSVGVAAAQKTWCVAKPSASNDILSLNLNYACSQVSCAVIQKGGPCYYPDNLVSRAAVAMNLYYASNGRHPWNCYFNNSALVVQSDPSYGSCTYY

SEQ ID NO: 16442 - DNA, 372 bp, Sorghum bicolor
  misc_feature: Ceres ANNOT ID no. 8657547
  misc_feature: Encodes the peptide sequence at SEQ ID NO 16443
atgtcggatatgaaggactccaatgcgcctgctgcacttgatggaaatcctcaacctatggaccaaactgaagacaattctatgccctcagctcagcaacaggaagaagcaatcaagaagaagtttggaggactaatgcccaaaaagccaccactcatctcaaaggatcatgagcgggcctactttgattctgctgactgggctctaggaaagcaaggtgtggccaaacccaaaggaccgctggaggcacttaggccaaagcttcagccaacacgccaacagcagcaacaacgcgcaaggcgctccatttacacttcgtcagaaaacgaggacggagatggtgctggtgctgaggagatgagcatcaactga

SEQ ID NO: 16443 - protein, 123 aa, Sorghum bicolor
  misc_feature: Useful for biocontainment applications
  misc_feature: Functional homolog of the protein sequence given in SEQ ID NO 14200
  misc_feature: Ceres ANNOT ID no. 8657547
  misc_feature (39)..(122): Pfam ID: Lg106 Pfam Description: Lg106-like protein
MSDMKDSNAPAALDGNPQPMDQTEDNSMPSAQQQEEAIKKKFGGLMPKKPPLISKDHERAYFDSADWALGKQGVAKPKGPLEALRPKLQPTRQQQQQRARRSIYTSSENEDGDGAGAEEMSIN

SEQ ID NO: 16444 - DNA, 1065 bp, Sorghum bicolor
  misc_feature: Ceres ANNOT ID no. 8657562
  misc_feature: Encodes the peptide sequence at SEQ ID NO 16445
atggaaggcgcagcagcagggtcagggtcggggggttcgtcgtcgtcgttggtgttccgtgggtgtcatctgccgccgggcttccgattccaacccaccgatcaggagatcatcgtctgctacctgaagaagaagatcgccggcaccgccacctccgtcacctccatcatcgccgacgtcgacatctacaagttcgacccatgggacctccctgacaaggctatgttcggcgagggcgagtggttcttcttcagccctcgtgaccgcaagtacccgaacggcgcccggccaaaccgcacggcggggtcgggctactggaaggcgacgggaacggacaagcccatcctggcggccggcggcgcgcactgcctgggcgtgaagaaggcgctcgtcttctaccaggggcggtcccccaagggcagcaagacggagtgggtgatgcacgagtacagactcctcgacacagacgccgccagcaggccaaccaccgccgccgccaactccatgaggcttgacgactgggtcctctgccgcgtccgcaagaagggcgtctccttgggcccggcggcggacatggaagacaccaccgactaccaccagcaacatcatcatcagctggtgcccgagcccgagcctgacgccggcgtgtttggcgacgtcgtcatcgacgacgactggaacaacagcgacgacctgctgcagtactttatagccagcggcgcggggtccccgtccgcccaccatatgccgcagcagcagcatgatgatcaggggcccggacacggacacgccgccgccgaaagcgccgcgccgccgcacgcccaccaccaccaccatgctgggctggtctccgtgctggagtccatcaagaggaacctgtcgttccaggccatcgacgagctctacctcctgcagcccagcagcaagcgtgccaactacatgacggcgatgctcgacgccgccgccgccgccgcccacgaaaaccaacgtcgacacagcagcatgtcgtcgtcgccctcgcccacgtgcttctccatatccgacgacaccgacgaggtgttctag

SEQ ID NO: 16445 - protein, 354 aa, Sorghum bicolor
  misc_feature: Useful for making plants with modulated oxidative stress sensitivity
  misc_feature: Functional homolog of the protein sequence given in SEQ ID NO 13621
  misc_feature: The sequence is a functional homolog of SEQ ID NO 808 in the 10/225,066 US patent application
  misc_feature: The sequence is a functional homolog of SEQ ID NO 926 in the 11/435,388 US patent application
  misc_feature: The sequence is a functional homolog of SEQ ID NO 98 in the 10/374,780 US patent application
  misc_feature: The sequence is a functional homolog of SEQ ID NO 854 in the 10/374,780 US patent application
  misc_feature: Useful for making plants with altered cell wall content and/or composition
  misc_feature: Useful for making plants with altered lignin content
  misc_feature: Functional homolog of the protein sequence given in SEQ ID NO 13620
  misc_feature: The sequence is a functional homolog of SEQ ID NO 890 in the 10/374,780 US patent application
  misc_feature: The sequence is a functional homolog of SEQ ID NO 2060 in the 10/374,780 US patent application
  misc_feature: The sequence is a functional homolog of SEQ ID NO 516 in the 10/412,699 US patent application
  misc_feature: The sequence is a functional homolog of SEQ ID NO 316 in the 10/412,699 US patent application
  misc_feature: The sequence is a functional homolog of SEQ ID NO 738 in the 11/479,226 US patent application
  misc_feature: The sequence is a functional homolog of SEQ ID NO 891 in the 10/374,780 US patent application
  misc_feature: The sequence is a functional homolog of SEQ ID NO 852 in the 10/374,780 US patent application
  misc_feature: The sequence is a functional homolog of SEQ ID NO 2346 in the 10/374,780 US patent application
  misc_feature: The sequence is a functional homolog of SEQ ID NO 238 in the 10/225,068 US patent application
  misc_feature: The sequence is a functional homolog of SEQ ID NO 338 in the 10/412,699 US patent application
  misc_feature: The sequence is a functional homolog of SEQ ID NO 774 in the 11/479,226 US patent application
  misc_feature: The sequence is a functional homolog of SEQ ID NO 476 in the 10/666,642 US patent application
  misc_feature: Ceres ANNOT ID no. 8657562
  misc_feature (24)..(153): Pfam ID: NAM Pfam Description: No apical meristem (NAM) protein
MEGAAAGSGSGGSSSSLVFRGCHLPPGFRFQPTDQEIIVCYLKKKIAGTATSVTSIIADVDIYKFDPWDLPDKAMFGEGEWFFFSPRDRKYPNGARPNRTAGSGYWKATGTDKPILAAGGAHCLGVKKALVFYQGRSPKGSKTEWVMHEYRLLDTDAASRPTTAAANSMRLDDWVLCRVRKKGVSLGPAADMEDTTDYHQQHHHQLVPEPEPDAGVFGDVVIDDDWNNSDDLLQYFIASGAGSPSAHHMPQQQHDDQGPGHGHAAAESAAPPHAHHHHHAGLVSVLESIKRNLSFQAIDELYLLQPSSKRANYMTAMLDAAAAAAHENQRRHSSMSSSPSPTCFSISDDTDEVF

SEQ ID NO: 16446 - DNA, 1014 bp, Sorghum bicolor
  misc_feature: Ceres ANNOT ID no. 8657568
  misc_feature: Encodes the peptide sequence at SEQ ID NO 16447
atgggggccgattactacaaggtcctcggcgtcgaccgcggcgccggcgacgacgacctcaagaaggcctatcggaagctcgccatgcgatggcaccccgacaagaactccaccaacaagaaggaggcggaaaccaagttcaaggagatctctgtggcatacgaggtccttagcgatcccaagaaacgggcaatttatgatcagctaggggaagaagggctcaagggtcagccacccccaggagcaggaggaggtcctggctcatttcccttcttccctggcggggctcattccaccgctcaccattttaatcccaggagcgcggacgatatatttaaagagttctttggattccctggcatgggtggcatgagggcggaaccaggattccagaggtcaatgtttggcaacgatatcttctcttcacgctttggctctgagggttccaccagtatgcagcagccatcgcgcaagccacctgcaattgagaatagacttccagtcagccttgcagatctgtacaagggtgtgacaaaaaagatgaaaatctcaagagagactatagatgccagtgggagaatctcaaatgcagaggatattctgacaatagaagtaaagcctggttggaagaagggaacaaagattacatttcctgacaagggaaatgaagctccaaatatgaaacctgctgatattgttttcatcattgatgagaagccccatgatgtttttactcgggatgggaatgatcttgtcatgactgagaaaatctcactggtggaggcactgactggctatactgcacgtgtcactacgcttgacgggcggagcctatcattacctatcaactcaataatccatccgaactatgaagaggtagtccctagagagggcatgccaatacccaaggatcccactaagaagggaaatctgcggattaagttcaacatactgttcccgtctaggctgacttctgatcagaaggctgggatcaagaggctattgggttcttag

SEQ ID NO: 16447 - protein, 337 aa, Sorghum bicolor
  misc_feature: Useful for making plants with modulated heat sensitivity
  misc_feature: Functional homolog of the protein sequence given in SEQ ID NO 13683
  misc_feature: Ceres ANNOT ID no. 8657568
  misc_feature: Up-regulated in root tissues in response to salicylic acid treatment
  misc_feature (4)..(67): Pfam ID: DnaJ Pfam Description: DnaJ domain
  misc_feature (213)..(335): Pfam ID: DnaJ_C Pfam Description: DnaJ C terminal region
MGADYYKVLGVDRGAGDDDLKKAYRKLAMRWHPDKNSTNKKEAETKFKEISVAYEVLSDPKKRAIYDQLGEEGLKGQPPPGAGGGPGSFPFFPGGAHSTAHHFNPRSADDIFKEFFGFPGMGGMRAEPGFQRSMFGNDIFSSRFGSEGSTSMQQPSRKPPAIENRLPVSLADLYKGVTKKMKISRETIDASGRISNAEDILTIEVKPGWKKGTKITFPDKGNEAPNMKPADIVFIIDEKPHDVFTRDGNDLVMTEKISLVEALTGYTARVTTLDGRSLSLPINSIIHPNYEEVVPREGMPIPKDPTKKGNLRIKFNILFPSRLTSDQKAGIKRLLGS

SEQ ID NO: 16448 - DNA, 1959 bp, Sorghum bicolor
  misc_feature: Ceres ANNOT ID no. 8657585
  misc_feature: Up-regulated in root tissues in response to salicylic acid treatment
  misc_feature: Encodes the peptide sequence at SEQ ID NO 16449
atggacctcgacccctccccggcctccgcccacggggacggcggcggctgcgccgacgcctggcccttcgactcgctcaccacgtccatgctcttctcctccgtctccgcctccccgcagctccagccgctgccggccaactcctcctggcttaccccgccctcgccgctctggctcttcgaggaccgccacatgctcccgctcgacgcccccgacgccgcgcccgaggcagccgtcgcagccgccgtcgtcgaggaggtccagcgggcacgctccgagtgtgcatgccgcaatcagatgcaccacagcatcttgggctgggtaagcttcgcgctaggtgttatagcatccttcctcgccttacaattatgcttctgttatccagggaattctgacacttcaagcaagagagttgaacaaatcaatcacaaatggcagtttcatctatctctggacgaagatggcacagataactctagcttgttcaaggagaagcttacacaagctcttcggtacttcaaggagtccacagatcaacatctgttggtccaagtctgggcaccagtaaagaatggagaccgctatgtgcttactacttcaggacaaccttttgtgcttgaccaccagagcattggcctacttcagtacagagctgtatccatgatgtacatgttttcagttgatggggaaaatgttggagagctgggcctacctgggcgtgtctacaagcaaaaggtgcccgagtggacaccaaatgtgcagtactatagcagtggtgagtaccaacgacttaaccatgcgatcagttacaatgtccatggtacagttgccctgcctgtttttgatcctgccgctcagtcgtgtattgctgttgtcgaacttataatgacatcaaagaagataaactatgcctgtgaggtcgataaagtctgcaaagcacttgaggccgtaaatcttaaaagcactgaaatattggaccatccaaatgtccagatatgtaatgaaggccgtcaagctgctctggtcgaaatactggagatcttgactgtagtctgtgaagagcacaagcttcctttggcacagacctgggttccttgcaagtatagaagtgtattggcacatggtggtggtttaaagaagagttgcttaagtttcgatggaagttgcatgggggaagtctgcatgtcaactagtgatgtggcgtttcatgtgattgatgctcatatgtggggatttagagatgcatgtgtggagcatcacctacagaggggacaaggagtttcaggaaaggcatttatctcacacaaaccttgcttttcaaaagatatccagaagttctgtaagttgacatatccacttgtacactatgctcgcatgtttgggttggctggctgctttgcaatatgcttgcaaagttcttataccgggaatgacgactacgtattagagtttttcttgccgcccgattgtattgacgaagatgaccaaaatgccttactggagtctatattaactctgatgaagcggtgtcttcgtagcctaaaggtagttggtgacagatattcgagtggggcttctcttcaacttagtaatgtgctaaaacttgagaatgaagaattcaaaacagatgcacagtttgataactctgatggttcccttcatgaatcacctggtggtgatagacatggaggagcgcacaagtttgataacgggaacaagaaagttttggatttgacagagggacaattgttgactgatgactactctcaagacaatggtacttctgctggcaggccaaatggtagcggtgcttctgattcttcattgcttcacaaaaccaacaaaccccctgaaaggagacgtgggaaagctgaaaagactatcagtttagaggttcttcagcaatatttttctgggagcttgaaaaacgcagctaaaagccttggtggtatgttctaa

SEQ ID NO: 16449 - protein, 652 aa, Sorghum bicolor
  misc_feature: The sequence is a functional homolog of SEQ ID NO 1911 in the 10/374,780 US patent application
  misc_feature: The sequence is a functional homolog of SEQ ID NO 422 in the 10/374,780 US patent application
  misc_feature: The sequence is a functional homolog of SEQ ID NO 806 in the 10/225,066 US patent application
  misc_feature: Ceres ANNOT ID no. 8657585
MDLDPSPASAHGDGGGCADAWPFDSLTTSMLFSSVSASPQLQPLPANSSWLTPPSPLWLFEDRHMLPLDAPDAAPEAAVAAAVVEEVQRARSECACRNQMHHSILGWVSFALGVIASFLALQLCFCYPGNSDTSSKRVEQINHKWQFHLSLDEDGTDNSSLFKEKLTQALRYFKESTDQHLLVQVWAPVKNGDRYVLTTSGQPFVLDHQSIGLLQYRAVSMMYMFSVDGENVGELGLPGRVYKQKVPEWTPNVQYYSSGEYQRLNHAISYNVHGTVALPVFDPAAQSCIAVVELIMTSKKINYACEVDKVCKALEAVNLKSTEILDHPNVQICNEGRQAALVEILEILTVVCEEHKLPLAQTWVPCKYRSVLAHGGGLKKSCLSFDGSCMGEVCMSTSDVAFHVIDAHMWGFRDACVEHHLQRGQGVSGKAFISHKPCFSKDIQKFCKLTYPLVHYARMFGLAGCFAICLQSSYTGNDDYVLEFFLPPDCIDEDDQNALLESILTLMKRCLRSLKVVGDRYSSGASLQLSNVLKLENEEFKTDAQFDNSDGSLHESPGGDRHGGAHKFDNGNKKVLDLTEGQLLTDDYSQDNGTSAGRPNGSGASDSSLLHKTNKPPERRRGKAEKTISLEVLQQYFSGSLKNAAKSLGGMF

SEQ ID NO: 16450 - DNA, 948 bp, Sorghum bicolor
  misc_feature: Ceres ANNOT ID no. 8657583
  misc_feature: Encodes the peptide sequence at SEQ ID NO 16451
atgaagcgcatctgccggcagcatggaatttctcgttggccatctcgaaaaattaataaggtcaaccggtctctctcaaaattaaagcaggtaattgagtctgttcaaggctccgatgcggcatttaatctcacgtctatcacaggtcctcttcctatacctgttggcccttcatcagagtctctcaatgtagagagattaactcaaagtaaagtggcagaactttcgaatcttgctgttgatggtgacagagattctttgcaaaaatcacttgaaaatgatgaccattttggtatagtcatggcccaccaaggatttatagacaataacaatgactctcagcttgaagctgacaaagcttctcactcgagaagttcatctggagaaggcagcataaattcacgtacttcagaaggctcatgccagggaagtccagcaaaccaaacatttgtttgtaagccaattgcttcaacatttgcagaaccccaacttaatcaagagttcaacaaagagccttttcaagaaccacaactaccactttccaggatgctgattgaagattctggtagctccaaagatttgaagaatcttttcacttcaacatcggaccaaccatttttggcccctcccaacaacttggtgtcagtgaagcattcagggactgtaacaataaaggctagttttaaggaagatattgtaaggttccgtttcccatgctcaggtggtgttattgtattgaaagaggaggtagcgaaaaggctaaggatggatgttggtacgttcgatatcaagtatctcgatgatgaccatgagtgggtaaagttggcgtgcaacgcagacttggaagaatgcatggagatctcgcggctttctggtagccatgtcatcaggctactggttagcgatattgcagcacactttggcagttcttgtggaagctctggttga

SEQ ID NO: 16451 - protein, 315 aa, Sorghum bicolor
  misc_feature: The sequence is a functional homolog of SEQ ID NO 1911 in the 10/374,780 US patent application
  misc_feature: Ceres ANNOT ID no. 8657583
  misc_feature (221)..(303): Pfam ID: PB1 Pfam Description: PB1 domain
MKRICRQHGISRWPSRKINKVNRSLSKLKQVIESVQGSDAAFNLTSITGPLPIPVGPSSESLNVERLTQSKVAELSNLAVDGDRDSLQKSLENDDHFGIVMAHQGFIDNNNDSQLEADKASHSRSSSGEGSINSRTSEGSCQGSPANQTFVCKPIASTFAEPQLNQEFNKEPFQEPQLPLSRMLIEDSGSSKDLKNLFTSTSDQPFLAPPNNLVSVKHSGTVTIKASFKEDIVRFRFPCSGGVIVLKEEVAKRLRMDVGTFDIKYLDDDHEWVKLACNADLEECMEISRLSGSHVIRLLVSDIAAHFGSSCGSSG

SEQ ID NO: 16452 - DNA, 1518 bp, Sorghum bicolor
  misc_feature: Ceres ANNOT ID no. 8657591
  misc_feature: Encodes the peptide sequence at SEQ ID NO 16453
atgtcgaccttcgccgcctcccgccgctcctcctcgtccgcagcctccaagcgccccgcgatggacgagaacgccgccggtggaccgcgatggacgagaccgcaggccacgaagcgcgtcgcgctcggaaacatcaccaacgtcgccgctcccgctccagggaggagggccgccgtggggaaggtcgcgccacccgccaccacccgcgcgaagttgaatccggcaacctcagcagcacccttgaagaaaccatatccagcaaatgcacgcaatgtgagctccattcggggttctgctgtgaagtcggcttccatcaagccaggtccaccagtatcatgcctttgcagcagcacaatgcagcagaagcataatgttcctccacctaaagtgcctaccactgtcaatgtgccaagtcgtgctccagccttggtaccctgcagcagcttcatgtctcctggacgttcaggagattcagtttctatggatgagacgatgtcgatttgtgactccatgaaaagcccggactttgagttcatagacaatggggattcctcggtgctggcttcgttgcagcggcaggcaaatgaacatttgcgcatatcagaggaaaataagtggaagaaaaatgcccctgccccatttgaaatcgaccacatctgtgatgttgacaatgactacgaggatccacagttgtgcgctactctggcttccgacatttacatgcatctgcgagaggctgagatgaagaaaagcaaaagaccatcaactgacttcatggaaactattcacaaaagtgtcaacccaagcatgagggctattttgatcgactggcttgtggaagttgctgaagaatatcgtcttgttcctgatactctctacctgacagttaactacattgaccgttatctttctggcaatgaaatcgaccgccaaaggctgcaattacttggtgttacttgcatgcttatagccgcaaaatacgaggagatatgtgcaccccaagtagaagagttctgctacataactgatagtacatacttcagagatgatgttttagagatggaagcttctgtactgaattacttgaagtttgaaatggcagcacctacaccaaagtgctttctgaggagatttgcccgtgctgcacaagcgtgtgatgaggatcctgctttgcatctcgagttcctcgccaattacatcgctgagctatcactgctggagtacaatctactctcttacccgccatcactaatagctgcctcagctgttttcttggcaagatatgtactgcagccaacaaagtatccttggaattccacacttgctcattacacacagtataagccgtcggaactgagtgactgtgtaaaggcattgcaccgccttttcagcgttggtcctgggagtaaccttccagcaatcagagaaaaatacagtcaacataagtacaaatttgttgcaaggaagcagtgcccaccgtcaatccctacagaattctttcgtgatgtaacatggtaa

SEQ ID NO: 16453 - protein, 505 aa, Sorghum bicolor
  misc_feature: Useful for making plants with modulated oxidative stress sensitivity
  misc_feature: Functional homolog of the protein sequence given in SEQ ID NO 13710
  misc_feature: Ceres ANNOT ID no. 8657591
  misc_feature (238)..(367): Pfam ID: Cyclin_N Pfam Description: Cyclin, N-terminal domain
  misc_feature (369)..(496): Pfam ID: Cyclin_C Pfam Description: Cyclin, C-terminal domain
MSTFAASRRSSSSAASKRPAMDENAAGGPRWTRPQATKRVALGNITNVAAPAPGRRAAVGKVAPPATTRAKLNPATSAAPLKKPYPANARNVSSIRGSAVKSASIKPGPPVSCLCSSTMQQKHNVPPPKVPTTVNVPSRAPALVPCSSFMSPGRSGDSVSMDETMSICDSMKSPDFEFIDNGDSSVLASLQRQANEHLRISEENKWKKNAPAPFEIDHICDVDNDYEDPQLCATLASDIYMHLREAEMKKSKRPSTDFMETIHKSVNPSMRAILIDWLVEVAEEYRLVPDTLYLTVNYIDRYLSGNEIDRQRLQLLGVTCMLIAAKYEEICAPQVEEFCYITDSTYFRDDVLEMEASVLNYLKFEMAAPTPKCFLRRFARAAQACDEDPALHLEFLANYIAELSLLEYNLLSYPPSLIAASAVFLARYVLQPTKYPWNSTLAHYTQYKPSELSDCVKALHRLFSVGPGSNLPAIREKYSQHKYKFVARKQCPPSIPTEFFRDVTW

SEQ ID NO: 16454 - DNA, 1788 bp, Sorghum bicolor
  misc_feature: Ceres ANNOT ID no. 8657608
  misc_feature: Encodes the peptide sequence at SEQ ID NO 16455
atggcccatatcacgctcggcttacccgagccgccgccgtcgtcgtcccagcacggatgccgccgccgtctgctcaccatccttgtgtccatcgtcatcagcgtcgcgctcgccgtcgccgtctcgctggccatctacttcgccgtgcggccggcgccgggtgatggcccgtcgctcatggctactaccgaggcgatcacgcgcacgtgcgggcccacgctgtacccggcgctgtgcgtcagcgagctcgcggcgctccccggcgcggcggccgcgcgggacgccgacctcctcgtgcccatgtcgctcgacgccacgcgccgccgcgtggcggacgcgctcgccgacgcgacggagctcgtggccgcgcgggcgccgctggaccgctccgctggtgctggtggctacggcatcagcgactgcctcgagatgctggaggccgcggccgacctactcagccgctcggtcgccgccgtcacggcgcctgctgctgcggcggccgccatcgcgcacgacgacgtcatgacctggctcagcgcggcgctcacgtaccacgacacgtgccgcgacggccttcatgaagaagtcgacgccgacggcaaggacgacggccgcgccgtgaaggcccagatgcttggatccctcggcaacctcatggagcacctaagcaacagcctcgccatcttcaaggcgtggggagcaccggtcgtctccggcggcctccccgtccagaaacgacagctactgtcagcccgcagcggccacggcgacctcacctttccggcgccaagttgggtaaaacacagcgatcggcggctcctggaggttccgaccggtgacatggtgcccgacatggtggtggccatggacggcagcggaacgcaccagagaatcggagacgccgtggaggctgctcccgtgcgcagcgcccgccgagtcgtgatctacatcaaggccggcgtgtacggcgagaacgtcaaggtggcgcgcaacaaaacgaacctgatgctcgtcggcgacggcgccgggcagacggtggtggtcgggcggcgcagcgtcgcggacggcctgaggacgttcgacacggcgacgctgtcggtgtccggggacgggttcatgatgcgcgacctgacggtggagaaccgcgcggggccccgggagcaccaggcggtggcgctgctggtgaccgcggacagggcggtggcgtaccggtgcgccgtggtggggtaccaggacacgctctacgcgcacgcgcagcggcagctgtaccgcgagtgcgaggtggccggcacggtggacgccgtgttcggcaacgcggcggcggtgctgcagaactgcacgctgcgcgcgcggcggccgctgccggggcagaagaacacggtgacggcgcaggggcgcgcggacccgaaccagagcacggggttctcggtgcacgcctgccggctggtgccggcgccggagtacccggcgagctcgacgtacctaggccggccgtggaaaccctacgcgagggtggtgtacatgatgtcgtacgtcggcgaacacgtggacgccgccgggtggctggcgtgggacgcgtcggcgggcgcgcccgacgacacggtgtactacggcgagtaccagaactacgggcccggcgcggcgctggaggggcgcgtggcgtggccgggacaccgcgtcatcacgatggcggaagaggcgatggagttcacggtgaggtggttcatcgccggctactcctggctgccggccaccgggctgccgttcgtcggcggcttgaccgcgtga

SEQ ID NO: 16455 - protein, 595 aa, Sorghum bicolor
  misc_feature: Useful for making plants with altered cell wall content and/or composition
  misc_feature: Functional homolog of the protein sequence given in SEQ ID NO 14386
  misc_feature: Ceres ANNOT ID no. 8657608
  misc_feature (199)..(595): SWISSPROT Homolog: EC 3.1.1.11 Pectinesterase
  misc_feature (284)..(579): Pfam ID: Pectinesterase Pfam Description: Pectinesterase
  misc_feature (60)..(228): Pfam ID: PMEI Pfam Description: Plant invertase/pectin methylesterase inhibitor
MAHITLGLPEPPPSSSQHGCRRRLLTILVSIVISVALAVAVSLAIYFAVRPAPGDGPSLMATTEAITRTCGPTLYPALCVSELAALPGAAAARDADLLVPMSLDATRRRVADALADATELVAARAPLDRSAGAGGYGISDCLEMLEAAADLLSRSVAAVTAPAAAAAAIAHDDVMTWLSAALTYHDTCRDGLHEEVDADGKDDGRAVKAQMLGSLGNLMEHLSNSLAIFKAWGAPVVSGGLPVQKRQLLSARSGHGDLTFPAPSWVKHSDRRLLEVPTGDMVPDMVVAMDGSGTHQRIGDAVEAAPVRSARRVVIYIKAGVYGENVKVARNKTNLMLVGDGAGQTVVVGRRSVADGLRTFDTATLSVSGDGFMMRDLTVENRAGPREHQAVALLVTADRAVAYRCAVVGYQDTLYAHAQRQLYRECEVAGTVDAVFGNAAAVLQNCTLRARRPLPGQKNTVTAQGRADPNQSTGFSVHACRLVPAPEYPASSTYLGRPWKPYARVVYMMSYVGEHVDAAGWLAWDASAGAPDDTVYYGEYQNYGPGAALEGRVAWPGHRVITMAEEAMEFTVRWFIAGYSWLPATGLPFVGGLTA

SEQ ID NO: 16456 - DNA, 1890 bp, Sorghum bicolor
  misc_feature: Ceres ANNOT ID no. 8657602
  misc_feature: Encodes the peptide sequence at SEQ ID NO 16457
atgacccaaccgaacctcacctgcacaccacctgtcttgacaccacgcaagaattgtgttgccgccgctaacatggcttcaccttcctcgcgtggccactccttgccaatgccaagacctctggtcatctcttcaaatgccaacgccgcgcccttcctcctgctccctaccaacaaccagcagcagcagcagcagctcagaaggatgggcgatgcggccatcgccaccgtgcatttgcatgacgctgaggaggagcaggagcaggagcacatcttccggagccggttcccgcccgtggccgtgccggacgacgtcacggtgccggagtttgtgctggcgggcgccgaggcctacgcggacaagacggcgctcgtggaggctgcgccgggtggccagtcctacacctacggcgaggtggtccgggacgtggcgcggttcgccagggcgctgcggtctgtcggcatccggaagggccacgtcgtggtggtcgcgctcccgaacctggcggtgtaccccgtggtgagcctcgggatcatgtccgccggcgcggtcttctccggcgtgaacccgcgcgccgtggccggcgagatcaagaagcaggtggaggactcggaggccaggctcgtggtcgccgacgccgtggcctacgacaaggtgaaggacgcgggcgtgccggtgatcggcatcggggacgccgcgcggcttcccggcgcgataagctgggacgagctcctcgccgcggcggaccggacgggcgcgccggcggtggcgctggacccggcgcagcagtccgacctgtgcgcgctcccttactcgtccggcacgacgggggtgtccaagggcgtgatgctgagccaccggaacctggtgtccagcctctgctcctccatgttcgccgtcgggccggagatggtggggcaggtggtcaccctgggcctcatgcccttcttccacatctacggcatcaccggcatctgctgcgccacgctgcggcacaagggcacggtggtggtcatggaccgcttcgacctgcgcggcttcctgggcgcgctgctgacgcacaaagtcatgttcgcgcccgtcgtgccgccgatcatgctggccatggtgaagagccccgtggccgacgagttcgacctgtcgggcctcgcactcaggtccgtcatgacggccgccgcgccgctggcgccggaactcctcgcggcgttcgagcgcaagttcccgggcgtgcaggtggaggaggcgtacgggctcacggagcacagctgcatcacgctgacgcacgccggcggcgacgacccgcagcaggggccggtccagatcgccaagaagaagtcggtcgggttcatcctgcccaacctggaggtgaagttcgtggacccggacacggggcggtcgctgcccaagaacacgcccggggagatctgcgtgcggagccaggccgtgatgcagggctactacaggaggaaggaggagacggagagcaccatcgacgccgcggggtggctccacaccggcgacgtcgggtacatcgacgacgacggcgacgtcttcatcgtcgaccggatcaaggagctcatcaagtacaagggcttccaggtggcccctgccgagctggaggccatcctcctgtctcacccgtccgtcgaggacgccgccgtcttcgggctgccggacgaggaggccggcgaggtcccggcgtcgtgcgtggtgcggcgtcgtggcgcgccggagagcgaggcggacatgatggcgtacgtggcggagcgcgtggcgtcgtacaagaagctccggctgctgcggttcgtggacgccatccccaagtcggtgtccggcaagatcctgcggaggcagctcagggacgacttcatcaagacggcagcagcctag

SEQ ID NO: 16457 - protein, 629 aa, Sorghum bicolor
  misc_feature: Useful for making plants with altered cell wall content and/or composition
  misc_feature: Functional homolog of the protein sequence given in SEQ ID NO 14387
  misc_feature: Ceres ANNOT ID no. 8657602
  misc_feature (87)..(620): SWISSPROT Homolog: EC 6.2.1.12 4-coumarate--CoA ligase
  misc_feature (135)..(554): Pfam ID: AMP-binding Pfam Description: AMP-binding enzyme
MTQPNLTCTPPVLTPRKNCVAAANMASPSSRGHSLPMPRPLVISSNANAAPFLLLPTNNQQQQQQLRRMGDAAIATVHLHDAEEEQEQEHIFRSRFPPVAVPDDVTVPEFVLAGAEAYADKTALVEAAPGGQSYTYGEVVRDVARFARALRSVGIRKGHVVVVALPNLAVYPVVSLGIMSAGAVFSGVNPRAVAGEIKKQVEDSEARLVVADAVAYDKVKDAGVPVIGIGDAARLPGAISWDELLAAADRTGAPAVALDPAQQSDLCALPYSSGTTGVSKGVMLSHRNLVSSLCSSMFAVGPEMVGQVVTLGLMPFFHIYGITGICCATLRHKGTVVVMDRFDLRGFLGALLTHKVMFAPVVPPIMLAMVKSPVADEFDLSGLALRSVMTAAAPLAPELLAAFERKFPGVQVEEAYGLTEHSCITLTHAGGDDPQQGPVQIAKKKSVGFILPNLEVKFVDPDTGRSLPKNTPGEICVRSQAVMQGYYRRKEETESTIDAAGWLHTGDVGYIDDDGDVFIVDRIKELIKYKGFQVAPAELEAILLSHPSVEDAAVFGLPDEEAGEVPASCVVRRRGAPESEADMMAYVAERVASYKKLRLLRFVDAIPKSVSGKILRRQLRDDFIKTAAA

SEQ ID NO: 16458 - DNA, 1569 bp, Sorghum bicolor
  misc_feature: Ceres ANNOT ID no. 8657611
  misc_feature: Encodes the peptide sequence at SEQ ID NO 16459
atggattccaatgcctggggccacgggaatactcggtcaaatggcgccctggggcggaatcaatccggcgtctcagttgatccgtccgctggctctgaaccagcagtgcagtcgcatgtcatcccttctgataagagatcacaccgcaacaagtctgatgatccagccgacaaagcgatcccaagtccagcggtggtgtctggaacaggtgccatgctggaggaagcagcagccagaggtgacaagaccgttcctcagtgcacctttgacacctctactagtagtgacagcttggatggctctggaactggtcatatcaagcggcatactgggagcgatcgcaggtgggaggccatccagttggccagcagcaggggctcccctctcagtctagtacactttaggcttctgaagcgccttggctatggagacattggcagtgtttacctcgtggagcttagggggacagacaccttctttgccatgaaggtgatggacaaggaggcgctcatcagtaggaacaagatgatccgtgcagagacggagagacagatacttggccttctagatcacccctttctacccaccctgtacactcattttgagaccgaaaagttttactgccttgtcatggagtactgctgcggtggcaacctgcattcgcttcggcagaagcaacctaacaggcatttcaatgagcaagcagccagattttatgcctctgaggtgttgcttgcgcttgagtacctccacatgctaggcattgtctacagagacctgaaaccagaaaatgttctggtcagagatggaggacacatcatgctgtctgactttgacctatctctgaggtgttcagtcagcccgatgctagtcaaatcctcatcaatcaatgctggtgccaatggcattgagaaaggcgtagtccatgctgatggtgtcaaccaaggctgcatacagtcatcagcattcttcccgcgcatactccccaagaagaaccgcaagaccaaatcagacttcagcatcaacggatcgctcctggagttcaatgctgagccgacagatgcgcggtcgatgtcatttgttggaacacacgagtaccttgcaccagagatcatcagaggagagggacatggaagcgcggtggattggtggacctttggcatcttcttatatgagctgctccatggcatgacaccgttcaaggggaatagcaaccgtgccacgctgtgcaacgtagtggaccagccactgcggttccctgacaccccacctgtgagcaatgtcgctcgcgacctcatccgtgggcttctggtgaaggaccctcagaagagaattgcaaccaagaggggtgccactgagatcaagcagcacccattctttgaaggggtgaactgggcacttgtgaggggtgctcacccaccttctgtccctgaccctgtagacttcgggcagtttagatctaaggggaagaaggcggcagagattgcagttgcgactgctccaagtagattaccttatggtgctgcttcagctaaaccaaagaaaggcaattttgttgagtatttttag

SEQ ID NO: 16459 - protein, 522 aa, Sorghum bicolor
  misc_feature: Useful for making plants with modulated biomass
  misc_feature: Functional homolog of the protein sequence given in SEQ ID NO 14042
  misc_feature: Ceres ANNOT ID no. 8657611
  misc_feature (107)..(502): SWISSPROT Homolog: EC 2.7.11.1 Non-specific serine/threonine protein kinase
  misc_feature (134)..(460): Pfam ID: Pkinase Pfam Description: Protein kinase domain
MDSNAWGHGNTRSNGALGRNQSGVSVDPSAGSEPAVQSHVIPSDKRSHRNKSDDPADKAIPSPAVVSGTGAMLEEAAARGDKTVPQCTFDTSTSSDSLDGSGTGHIKRHTGSDRRWEAIQLASSRGSPLSLVHFRLLKRLGYGDIGSVYLVELRGTDTFFAMKVMDKEALISRNKMIRAETERQILGLLDHPFLPTLYTHFETEKFYCLVMEYCCGGNLHSLRQKQPNRHFNEQAARFYASEVLLALEYLHMLGIVYRDLKPENVLVRDGGHIMLSDFDLSLRCSVSPMLVKSSSINAGANGIEKGVVHADGVNQGCIQSSAFFPRILPKKNRKTKSDFSINGSLLEFNAEPTDARSMSFVGTHEYLAPEIIRGEGHGSAVDWWTFGIFLYELLHGMTPFKGNSNRATLCNVVDQPLRFPDTPPVSNVARDLIRGLLVKDPQKRIATKRGATEIKQHPFFEGVNWALVRGAHPPSVPDPVDFGQFRSKGKKAAEIAVATAPSRLPYGAASAKPKKGNFVEYF

SEQ ID NO: 16460 - DNA, 1509 bp, Sorghum bicolor
  misc_feature: Ceres ANNOT ID no. 8657614
  misc_feature: Encodes the peptide sequence at SEQ ID NO 16461
atgtcgacccgcgccgcctcccgccgctcctcctcgtcgtccgcggccgccaagcgccccgcgatggcggagggcgccaaggcggcgggaaccgccgccgcgcaggccaagaagcgcgccgcgctcggcaacatcaccaacgtcgtcgccgctccggcgggaagggccgccgcccttgggaaggtcgcgccaccggtcaccggcgcgaagttgaattcagctacctcagctgtacccttaaagaagccatctttggcaaatgctcgcaatgcgagctccattcggggttctgctgtgaagtcggcttccatcaagccagctccaccagtaccacgcctcgacagcagcacaaggccgaagcataatgttcctgtgcctgccactgtccatgtgccaagtcgtgctcctgccttggtaccctgcagcagtttcgtgtcgcctgcacgttcaggagattcagtttctatcgatgagacgatgtcgacttgcgactccatgaaaagcccggactttgagtacatagacaatggggattcctcgatgctggcctcgttgcagcgacgggcagatgaacatctgcgtatatcagaggatacagatgttgaagaaaataaatggaagaaaaatgcccctgccccaatggaaatcgaccgcgtctgtgatgttgacaacgacttggaggatccacagttgtgcgctactctggcttctgacatctacatgcatctgcgagaagctgagacaaagaaacgaccatcaactgatttcatggaaacgattcaaaaagatgtcaacccaagcatgagggcaattttgatagactggctcgtagaagttgctgaagagtatcgtcttgttcctgatactttgtacctgacagttaactacattgaccgttatctttctggcaacgaaatcaaccgccaaaggctgcaattacttggtgttgcttgcatgcttatagctgcaaaatacgaggagatatgtgcaccccaagtagaagaattctgctacataacggacaatacatacttcagagatgaggtcctagaaatggaagcttctgtgctgaattatttgaagtttgaaatgacagcacctacagcaaagtgttttttgaggagatttgctcgttctgcacaagcgtgtgatgaggatcctgctttgcatctcgagttcctcgccagttacatcgctgagctatcccttctggagtacaatctactatcctaccctccatcactaatagctgcttcggctattttcttggcgaggtttatactccagccaacaaagtatccttggaactccacactttctcattacacacagtacaagccgtccgaattgagcgactgtgtaaaggcattgcaccgccttttcagcgttggtcctgggagcaaccttccagcaatcagagaaaagtacagtcaacataagtacaaatttgttgcgaagaagcagtgtccaccacaaatccctaccgaattcttcagggatacgacatga

SEQ ID NO: 16461 - protein, 502 aa, Sorghum bicolor
  misc_feature: Useful for making plants with modulated oxidative stress sensitivity
  misc_feature: Functional homolog of the protein sequence given in SEQ ID NO 13710
  misc_feature: Useful for making plants with modulated nitrogen use efficiency
  misc_feature: Functional homolog of the protein sequence given in SEQ ID NO 13108
  misc_feature: Ceres ANNOT ID no. 8657614
  misc_feature (238)..(365): Pfam ID: Cyclin_N Pfam Description: Cyclin, N-terminal domain
  misc_feature (367)..(494): Pfam ID: Cyclin_C Pfam Description: Cyclin, C-terminal domain
MSTRAASRRSSSSSAAAKRPAMAEGAKAAGTAAAQAKKRAALGNITNVVAAPAGRAAALGKVAPPVTGAKLNSATSAVPLKKPSLANARNASSIRGSAVKSASIKPAPPVPRLDSSTRPKHNVPVPATVHVPSRAPALVPCSSFVSPARSGDSVSIDETMSTCDSMKSPDFEYIDNGDSSMLASLQRRADEHLRISEDTDVEENKWKKNAPAPMEIDRVCDVDNDLEDPQLCATLASDIYMHLREAETKKRPSTDFMETIQKDVNPSMRAILIDWLVEVAEEYRLVPDTLYLTVNYIDRYLSGNEINRQRLQLLGVACMLIAAKYEEICAPQVEEFCYITDNTYFRDEVLEMEASVLNYLKFEMTAPTAKCFLRRFARSAQACDEDPALHLEFLASYIAELSLLEYNLLSYPPSLIAASAIFLARFILQPTKYPWNSTLSHYTQYKPSELSDCVKALHRLFSVGPGSNLPAIREKYSQHKYKFVAKKQCPPQIPTEFFRDTT

SEQ ID NO: 16462 - DNA, 2631 bp, Sorghum bicolor
  misc_feature: Ceres ANNOT ID no. 8657669
  misc_feature: Encodes the peptide sequence at SEQ ID NO 16463
atgccgagtggtaaagcaaaagctccaaagggtggggaggatcctggaattccgccagttccttgtgaaggggaaattagccatgagccacagagacaacggtcgctcaacgggaggactactggtccgacccgccgttcgaccaaaggaaattggacacccgaagaggatgctatattgtcccgcgcggttcagacgtaccaagggaaaaactggaaaaagatagcggaatgttttccagacagaaccgatgtacaatgtttgcacaggtggcaaaaggttctaaaccctgaattggtcaaagggccatggtccaaagaaatggtaaacaaatatgggccaaagaagtggtcggccattgctcaagctttgcctggacgcataggaaagcaatgtcgagaacggtggcacaatcatcttaacccagccataaacaaggaggcatggacgcaagaagaggagattactcttattcatgctcatcggatgtatggaaataaatgggctgaactgacgaaatttttacctggaaggacggataatgcaattaaaaatcactggaacagttcagtaaagaaaaaggttgattcatacatatcttctggcttactttcacaagtcccatgcctccctctgattgaatatcctgcacaatgcgattctttatcatctatggaccaagaaaacaacggagatagtgtttgcaatgctcagaacactagcatggccttgagctctgatttacaagtaaatgtggatgccaacaagagagaagcacaagactctcactcgtccttgtgtcaaggggcatgctatccttccacagaggctgtaggatctgttttgcctgatgagaaccaccatgttccttcatctttttctcaaagaatggacctgcagatggatatggatgaaggatcaggaaattctatgtttgcagatgatcaaactctttgtagcacatcaaatcaagaaaagtctatggtgccatttgttgttgcacaggaaatgcctgtctctgtgctatcaggtgtttctagcgctgagcagaaactgcacttaatctctgatgctgaaagtttgaaatctgaactttggaaagatgtttctttgcaaactcttatttcaggagttacagttgacgctgatgcttcaagattaaatcatccagattcttccaaaatggacaccaattttttgacacaggcctacccattacacacatcaaatccatccggtgtgatggaaactgtgtatgaaccgatgccgtcggagacaatctctccctcttttatatgttcagatggtttgtctgttgcacccgaaaatagatctgagccaagagaaatgccagactgtgaagcacagatggccacatcctcaaacattttttgtgatggcgatcaatctgctatacctggcagcagtgatgacaggccagaggctttcacgatgactgagagcattacaaactgtgggggtcaacagtcaacagatgccgaagaacctatggccactacagcaaaagaacagttatcgaaagacattgagactgtgccagatgaaaagaagggtgagggagctctattctatgaacctcctcgattccctggtttggatgtcccatttatcagttgcgatcttgtaacttctgctgatctgcaagaatttagtccccttgggattaggcagtggatgcggtcgaccatgaatgtccccactcctttaagattatggggctctccaacacatgatgaaagcccagatttgctaaagagtgctgctgaaagcttcccatgcacaccatcaataatgaagaaaagacagagaggtctattgtcccctactccagataaaagaattgagaagaaatctgggattgcaaagggggtgacagatatctcctatatgatcacgaccacatgttccatgaatgcaaccaacgatggagacattgttactgaatcagttgtgtgtgctgagcaaccttcttttaaacatctagacaagaaacttgagttctctaatatcaacatggaaaactctgatggagcatctaaacaggccaaagatccacaaaatgcagggaacaaacgactcgtggaggagtcctcgccaaacgttgcaaatcctaacactgatctgcaagacaatatacaacctgtacggattcttgttgagcacagcagcaataaccttattgctgctgatcatggtgcaaagccatcttgtaaggaagtaattagttcaaaatcaaagcctacagaactacttgttgaaaaatcatcaccatgtatcaatgcggattacgaatatgtgaacttattggctgataccccaggtgtcaaaagaggtttggaatctccttctgcatggaagtctccttggtatattgatatgcacatgcactttcagggttttgtcagcccagcagacagaacttatgacgcattaggattagtgaagcatttaagtaagcacagtgctgctgctgcagtggaggcctgtgaggtgctagcaagtggcaacaggacttctgataaggaaaacaaggataatactgatggcaaggagccagtggcaagaaaatcacaggtcaaaatcatggtgcgtaacatcaactggttatag

SEQ ID NO: 16463 - protein, 876 aa, Sorghum bicolor
  misc_feature: The sequence is a functional homolog of SEQ ID NO 2684 in the 10/374,780 US patent application
  misc_feature: The sequence is a functional homolog of SEQ ID NO 844 in the 10/225,066 US patent application
  misc_feature: Ceres ANNOT ID no. 8657669
  misc_feature (49)..(95): Pfam ID: Myb_DNA-binding Pfam Description: Myb-like DNA-binding domain
  misc_feature (146)..(191): Pfam ID: Myb_DNA-binding Pfam Description: Myb-like DNA-binding domain
  misc_feature (101)..(140): Pfam ID: Myb_DNA-binding Pfam Description: Myb-like DNA-binding domain
MPSGKAKAPKGGEDPGIPPVPCEGEISHEPQRQRSLNGRTTGPTRRSTKGNWTPEEDAILSRAVQTYQGKNWKKIAECFPDRTDVQCLHRWQKVLNPELVKGPWSKEMVNKYGPKKWSAIAQALPGRIGKQCRERWHNHLNPAINKEAWTQEEEITLIHAHRMYGNKWAELTKFLPGRTDNAIKNHWNSSVKKKVDSYISSGLLSQVPCLPLIEYPAQCDSLSSMDQENNGDSVCNAQNTSMALSSDLQVNVDANKREAQDSHSSLCQGACYPSTEAVGSVLPDENHHVPSSFSQRMDLQMDMDEGSGNSMFADDQTLCSTSNQEKSMVPFVVAQEMPVSVLSGVSSAEQKLHLISDAESLKSELWKDVSLQTLISGVTVDADASRLNHPDSSKMDTNFLTQAYPLHTSNPSGVMETVYEPMPSETISPSFICSDGLSVAPENRSEPREMPDCEAQMATSSNIFCDGDQSAIPGSSDDRPEAFTMTESITNCGGQQSTDAEEPMATTAKEQLSKDIETVPDEKKGEGALFYEPPRFPGLDVPFISCDLVTSADLQEFSPLGIRQWMRSTMNVPTPLRLWGSPTHDESPDLLKSAAESFPCTPSIMKKRQRGLLSPTPDKRIEKKSGIAKGVTDISYMITTTCSMNATNDGDIVTESVVCAEQPSFKHLDKKLEFSNINMENSDGASKQAKDPQNAGNKRLVEESSPNVANPNTDLQDNIQPVRILVEHSSNNLIAADHGAKPSCKEVISSKSKPTELLVEKSSPCINADYEYVNLLADTPGVKRGLESPSAWKSPWYIDMHMHFQGFVSPADRTYDALGLVKHLSKHSAAAAVEACEVLASGNRTSDKENKDNTDGKEPVARKSQVKIMVRNINWL

SEQ ID NO: 16464 - DNA, 1113 bp, Sorghum bicolor
  misc_feature: Ceres ANNOT ID no. 8657709
  misc_feature: Encodes the peptide sequence at SEQ ID NO 16465
atgcggcgaaccctcctcctcgcatggccggtggcgcgccggcggctgctgagcaacttgccggattccaccgtctactgggggccgcgaccgcatccgcaggagtcggcggcggcggcgcggcgcgtgacgctggcgacgctgcgcgggaagcaccggcgcggggagcccatcagcatggtgaccgcgtacgactactcgtcggcggtccacctggactccgcgggggtggacgtcgtcctcgtgggcgactccgccgcgatgaccgcgcacggccacgacaacaccctccccatctccctcgacctcatgctccagcattgccgcgccgtcgtgcgcggcgctgccaggccgctcgtcgtcggcgacctgcccttcggctcctacgagtcctcgcccgcacaagctgtggaatcggcggtgaggctgatgaaagaaggcgtagtggacgcggtgaagatggaaggaggcgcggcgtcgagagtgggcgcggcgagggcgatcgtggacgccgggatagccgtgatggggcacgtcggccttactccgcagaccatcagcgtgctcggcggcttccgggcgcaggggaagacggtcgacggcgctctcaaggtcgtagaggcggcgctcgcgctgcaggacgccgggtgcttcgcggtcgtcctcgagtgcgtgcccgctccggtggcagcagctgccactgcagcactgcaaatccccaccatcggcgtcggggctggacccttgtgcagtggccaggctctagtctacgccgacttggtggggatgttccagagcccagaacactcgaaggtgacgcccaagttctgcaagcagtttggcgacgtcggcgccgccatcggcaaggcgctcgccgagtacaagcagcaggtggaggatcgggctttcccggacgctgaccatacgccctacaagatatcttccgtggacgtggatgccttcacggatgcgctgcggaagatcggcttcgatggggctgcggcagccgccgctgccgctgccgcaaaaacagaggaaatagttggcgatggaaagccacaggatggggacgtcagcaatggcatcttgagccatgcgggtgctgcagtttaa

SEQ ID NO: 16465 - protein, 370 aa, Sorghum bicolor
  misc_feature: Useful for making plants with modulated oxidative stress sensitivity
  misc_feature: Functional homolog of the protein sequence given in SEQ ID NO 13128
  misc_feature: Ceres ANNOT ID no. 8657709
  misc_feature (52)..(328): SWISSPROT Homolog: EC 2.1.2.11 3-methyl-2-oxobutanoate hydroxymethyltransferase
  misc_feature (41)..(307): Pfam ID: Pantoate_transf Pfam Description: Ketopantoate hydroxymethyltransferase
MRRTLLLAWPVARRRLLSNLPDSTVYWGPRPHPQESAAAARRVTLATLRGKHRRGEPISMVTAYDYSSAVHLDSAGVDVVLVGDSAAMTAHGHDNTLPISLDLMLQHCRAVVRGAARPLVVGDLPFGSYESSPAQAVESAVRLMKEGVVDAVKMEGGAASRVGAARAIVDAGIAVMGHVGLTPQTISVLGGFRAQGKTVDGALKVVEAALALQDAGCFAVVLECVPAPVAAAATAALQIPTIGVGAGPLCSGQALVYADLVGMFQSPEHSKVTPKFCKQFGDVGAAIGKALAEYKQQVEDRAFPDADHTPYKISSVDVDAFTDALRKIGFDGAAAAAAAAAAKTEEIVGDGKPQDGDVSNGILSHAGAAV

SEQ ID NO: 16466 - DNA, 1215 bp, Sorghum bicolor
  misc_feature: Ceres ANNOT ID no. 8657708
  misc_feature: Encodes the peptide sequence at SEQ ID NO 16467
atggaacacgccgctcttgcacgggtcactcatcgccaaccggcggcacacgggcaggcgagggccgccgccgccaggacatggccacggctgcagacggcgttccggcacctgagctcatggcggctgctgagcagcgccccggagacgacgacggccgtctatggcggcggcgcaaaggcaaggccgccacaggatcatcagccggcggcggcgcggcgcgtgacgctggcgacgctgcgcgggaagcaccgtcgcggggagcccatcagcatggtgaccgcgtacgactactcgtcggcggtccacgtggactccgcgggcgtggacctcatcctcgtgggcgactctgccgcgatggtcgcgcacggccacgacaacaccctccccatctccctcgacctcatgctccaacactgccgcgccgtcgtccgcggcgcgccgaggccgctcgtcgtcggcgacctcccgttcgggtcctacgagtcctcacccgcacaggccgtggaatcggcggtgaggctgatgaaagaaggcggagtggacgcggtgaagatggaaggaggcacggcgtcgagggtgagcgcggcgaaggcgatcgtggacgccggcatagccgtgatggggcacgtcggcctcactccgcaggccatcagcgtgctcggcggcttccgggcgcaggggaagacggtcgacggcgctctcaaggtcgtggaggcggcgctcgcgctgcaggacgctggctgcttcgcggtcgtccttgagtgcgtgcccgctccggtggcagccgccgccacggcggcgctgcagatcccaaccatcggcatcggagctgggcccttgtgcagtggccaggttctagtgtaccatgacttgctagggatgttccagagcccagaccactcgaaggtgacgcccaagttctgcaagcagtttggggacgtcggcgccgtcatcggcaaggcgctcgcggagtacagggagcaggtggaggctcgggctttcccggacgctgagcacacgccctacaagatatcatccgcggacgtcgatgtcttcgcggacgcgctgcgaaacatcggcttcgatggagctgcagcagctgccgccgccgctgccggaaaaaaggagaaaatagtaggcaatggaaagccacaggatggggataacatcaataatggcatcttgagcggtagcgcaggtgctgcagtttaa

SEQ ID NO: 16467 - protein, 404 aa, Sorghum bicolor
  misc_feature: Useful for making plants with modulated oxidative stress sensitivity
  misc_feature: Functional homolog of the protein sequence given in SEQ ID NO 13128
  misc_feature: Ceres ANNOT ID no. 8657708
  misc_feature (90)..(341): SWISSPROT Homolog: EC 2.1.2.11 3-methyl-2-oxobutanoate hydroxymethyltransferase
  misc_feature (73)..(339): Pfam ID: Pantoate_transf Pfam Description: Ketopantoate hydroxymethyltransferase
MEHAALARVTHRQPAAHGQARAAAARTWPRLQTAFRHLSSWRLLSSAPETTTAVYGGGAKARPPQDHQPAAARRVTLATLRGKHRRGEPISMVTAYDYSSAVHVDSAGVDLILVGDSAAMVAHGHDNTLPISLDLMLQHCRAVVRGAPRPLVVGDLPFGSYESSPAQAVESAVRLMKEGGVDAVKMEGGTASRVSAAKAIVDAGIAVMGHVGLTPQAISVLGGFRAQGKTVDGALKVVEAALALQDAGCFAVVLECVPAPVAAAATAALQIPTIGIGAGPLCSGQVLVYHDLLGMFQSPDHSKVTPKFCKQFGDVGAVIGKALAEYREQVEARAFPDAEHTPYKISSADVDVFADALRNIGFDGAAAAAAAAAGKKEKIVGNGKPQDGDNINNGILSGSAGAAV

SEQ ID NO: 16468 - DNA, 1812 bp, Sorghum bicolor
  misc_feature: Ceres ANNOT ID no. 8657762
  misc_feature: Encodes the peptide sequence at SEQ ID NO 16469
atgccggagaagaagacgacgacgacgacgctgctgcagcagcagcagcagcagcagcaggccgcgttctgcggcgaggcggtgatcgccgagttcgagtccctgacgcgggacgccgccgccgtgcagcgggacacgctgcgccggatcctcggcgacaacgccaccgccgagtacctccggtgccggggcctcgcgggacgcaccgacgccgccagcttccgggcgtgcgtgccgctcgctacgcacgccgacatcgagccctacattacgcgcatcgccgacggcgacacctccgccttgctcaccgccaaccccatcacctccatctccctcagctccggcacgacgcagggcaagcgcaagtacctgcccttcaaccaggagctcgtcaagtccacgatgcagatataccggacttcctacgccttcaggaacagggcgttccccgtggaggacggcaaggcgctgcagttcatctacggcagccgccagttcaccaccacgggcgggctgacagcgacgacggccaccaccaacgtgtaccggagcgaggagttcatgcccacgatgcgcgccatccagtcgcaggtgtgcagcccggaggccgtcatcttcggcgccgacttcgcgcagtcgctctactgccacctcctgtgcggcctgctgtacgccgacgaggtccgcatcgtgtccgccaccttcgcgcacagcctcgtcctcgccttccagaccttcgagcgcgtctgggaggacctgtgcgccgacatccgcgcaggctccctctcccagacgcgcgtcaccgcccccgccgtccgcagggccgtcgaggcgttgctcacgggccccaacccggcgctcgccgacgaggtggtgcgcaggtgcgccgggctcagcaactggtacggcgtcatcccggcgctgttccccaacgccaggtacgtgcacggcatcatgacgggatccatggagcactacgtcaagaagctccgccactacgcgggcgggctgccactcgtcgccgccgagtacggcgcgtccgagggatgggtcggcgctaacgtcgagcccgagacgccgccggagtccgtcacgttcaccgtcctccccaacatcgcctacttcgagttcatcccgctcaaggccaccagctgctgccacggcggcgccgatgacgacgacacgtcctacgccgaggccgagcccgtcgggctcaccgaggtcgccgtcggcgagcactacgaggttgtcgtcaccaccttcgcagggctgtaccggtaccgtctaggggacgtggtgaaggtagccgggttctacaactcgacgccgaagctcaagttcgtgtgccggcggaacctgatgctgagcatcaacatcgacaagaacagcgagcaggacctgcagctggccgtggacagcgcggccaagatcctggcggcggagaagctggaggtggtggactacagcagccacgcggaggtgtcgcgcgacccgggccactacgtcgtgttctgggagctcaacgccgacggcaacgacgacgtgctgcagagctgctgcgacgagctggaccgcgccttcacggaccccgggtacgtcgggtcacggaaggccagcggcatcgggcccctggagctcagggtgctgcagcgcgggacgttccagaaggtgctccgccactacctctccctcggcgccccggtgagtcagttcaagtcgccgcggtgcgtcggacggtcgaacaactccggcgtcctccagatcctctccgccaacgtcgtcaaggtcttcttcagcgccgcctacgactga

SEQ ID NO: 16469 - protein, 603 aa, Sorghum bicolor
  misc_feature: Useful for making plants with modulated light quality sensitivity
  misc_feature: Functional homolog of the protein sequence given in SEQ ID NO 13895
  misc_feature: Ceres ANNOT ID no. 8657762
  misc_feature (27)..(588): Pfam ID: GH3 Pfam Description: GH3 auxin-responsive promoter
MPEKKTTTTTLLQQQQQQQQAAFCGEAVIAEFESLTRDAAAVQRDTLRRILGDNATAEYLRCRGLAGRTDAASFRACVPLATHADIEPYITRIADGDTSALLTANPITSISLSSGTTQGKRKYLPFNQELVKSTMQIYRTSYAFRNRAFPVEDGKALQFIYGSRQFTTTGGLTATTATTNVYRSEEFMPTMRAIQSQVCSPEAVIFGADFAQSLYCHLLCGLLYADEVRIVSATFAHSLVLAFQTFERVWEDLCADIRAGSLSQTRVTAPAVRRAVEALLTGPNPALADEVVRRCAGLSNWYGVIPALFPNARYVHGIMTGSMEHYVKKLRHYAGGLPLVAAEYGASEGWVGANVEPETPPESVTFTVLPNIAYFEFIPLKATSCCHGGADDDDTSYAEAEPVGLTEVAVGEHYEVVVTTFAGLYRYRLGDVVKVAGFYNSTPKLKFVCRRNLMLSINIDKNSEQDLQLAVDSAAKILAAEKLEVVDYSSHAEVSRDPGHYVVFWELNADGNDDVLQSCCDELDRAFTDPGYVGSRKASGIGPLELRVLQRGTFQKVLRHYLSLGAPVSQFKSPRCVGRSNNSGVLQILSANVVKVFFSAAYD

SEQ ID NO: 16470 - DNA, 489 bp, Sorghum bicolor
  misc_feature: Ceres ANNOT ID no. 8657777
  misc_feature: Encodes the peptide sequence at SEQ ID NO 16471
atgccgctgtacgactgcatgctgctggtgaagccgacggtgaccagggaggtcgtagcggacctggtgacccgggtggcgcgccgcgcctgccagcgcaacggggtcgtcaccgacgtcaagtccttcggcaaggtcaacctcggctacggcatcaagaagctcgacggccgccacttccagggccaacttatgcaaatgaccatgatggttccaccttcgttcccacaagaacttcactatctgaacaaggaggacaggctgcttcgctggctggtcgtcaagcacagagacgcggtatatggactggagttcatcaacgaggatgacgggaggaacgagctgagcggttacagccaggctcatacgaaggatgactatgatatcgagtttgactctgatgatgaccgctgggacgacgatgactcagacgacgacgacgagtatgcaatcgaggaggaggaagagaaggaggagaagcagaagtag

SEQ ID NO: 16471 - protein, 162 aa, Sorghum bicolor
  misc_feature: Useful for making plants with modulated biomass
  misc_feature: Useful for making plants with modulated flowering time
  misc_feature: Functional homolog of the protein sequence given in SEQ ID NO 14388
  misc_feature: Ceres ANNOT ID no. 8657777
MPLYDCMLLVKPTVTREVVADLVTRVARRACQRNGVVTDVKSFGKVNLGYGIKKLDGRHFQGQLMQMTMMVPPSFPQELHYLNKEDRLLRWLVVKHRDAVYGLEFINEDDGRNELSGYSQAHTKDDYDIEFDSDDDRWDDDDSDDDDEYAIEEEEEKEEKQK

SEQ ID NO: 16472 - DNA, 1263 bp, Sorghum bicolor
  misc_feature: Ceres ANNOT ID no. 8657779
  misc_feature: Encodes the peptide sequence at SEQ ID NO 16473
atgaaggattctcaggatattcagagcacgacagagttgcagtcatcagcacaaggtactaatgaagtgcaaagtcagcaaccaaaccctatggccactgatgctcctgcaggaaattcgggttccttatctgtagctagtaatgacaataagaaggtgtctcgcgaagatattgaacttgttcagaatttgatagagcgttgtctacagctatacatgaacaaaggagaagttgttagaactctttctactcgtgctagaatagaacctggcttcactactttagtatggcagaaacttgaagaagagaactctgagttctttagggcttactatatacggctgaaattgaaaaggcagatcatcttgttcaatcatttattgcaacaccagtacaatttgatgaaatatccagcacctccaaatatacccttggctccaatacaaaatggaattcatcatatgccagttagcaatttaccaatggggtatccagtacttcagcagcctatcatgcctgctcctggccagcctcacatggatccaatggcctgtggtctgtccagtggtcatgtggttaatggaatacctgcaggtggttatcatccaatgcgcatgaactccggaaatgacatggttgtggacaatggagcacctgaagcaccacatgctgctgctaccggtagtgctatgtcatctgagatggctgtgagtccctcatcagcggcttcaagcaaccatgctccttttacgccatcagagataccaggcatgaccatggatgtatcagccctagactcggcatttggatctgatgtggggaatcctggatctctgcaattaggaccagatggctcatcaagagactctattagatccttagggcagctctggaatttcagcctctctgatctaacagcagatttgacgagtttgggagcagatttggacgtgttggagaactacactggcacccctttcctgccttcagattcagacattttgcttgattccccagaccaagatgatataggtaggttggaacatgaacacaacacatatcagttggaaggttttaagttgacacatgtggcgactggcgagtataagcctgtgactgatggcatcgctaggcctctcggccgcaccagaaaaccaggcgtgcctgcttccgggcgctacatccggaaagttgaaaaattcaatccagacaccacacgcgcggacgcacgggattgtgaaatgaaaaatgaggaaatgtga

SEQ ID NO: 16473 - protein, 420 aa, Sorghum bicolor
  misc_feature: Useful for making plants with modulated water use efficiency
  misc_feature: Functional homolog of the protein sequence given in SEQ ID NO 14389
  misc_feature: Useful for making plants with modulated drought sensitivity
  misc_feature: Functional homolog of the protein sequence given in SEQ ID NO 13418
  misc_feature: Ceres ANNOT ID no. 8657779
MKDSQDIQSTTELQSSAQGTNEVQSQQPNPMATDAPAGNSGSLSVASNDNKKVSREDIELVQNLIERCLQLYMNKGEVVRTLSTRARIEPGFTTLVWQKLEEENSEFFRAYYIRLKLKRQIILFNHLLQHQYNLMKYPAPPNIPLAPIQNGIHHMPVSNLPMGYPVLQQPIMPAPGQPHMDPMACGLSSGHVVNGIPAGGYHPMRMNSGNDMVVDNGAPEAPHAAATGSAMSSEMAVSPSSAASSNHAPFTPSEIPGMTMDVSALDSAFGSDVGNPGSLQLGPDGSSRDSIRSLGQLWNFSLSDLTADLTSLGADLDVLENYTGTPFLPSDSDILLDSPDQDDIGRLEHEHNTYQLEGFKLTHVATGEYKPVTDGIARPLGRTRKPGVPASGRYIRKVEKFNPDTTRADARDCEMKNEEM

SEQ ID NO: 16474 - DNA, 1965 bp, Sorghum bicolor
  misc_feature: Ceres ANNOT ID no. 8657780
  misc_feature: Encodes the peptide sequence at SEQ ID NO 16475
atggccaggggaggaggacgaggaggcgggggatcgcgcggcgcggtggtggactccatggccgtcgtgcttattggcctcgccatggcgctcgccgccgcgacgacgcaagtggcgtcggccgccgggcacgactaccgccaggcgctgagcaagagcatcctctacttcgaggcgcagcggtccgggcggctccccggcagccagagggtctcctggcgcgccgactccggcctgcgcgacggcaaggccaacggggtggatcttgtgggcggctactacgacgccggcgacaacgtcaagttcggcctgccgatggcgttcacggtgaccatgatgtcgtggagcgttctcgagtacggcaaacagatggcggcggccggcgagctcggccacgccgtcgaggccattaagtggggcacggactacctggtcaaggcgcacccggagcccaacgtcctgtacggagaggtcggcgatggtgactcggaccacgactgctggatgcggccggaggacatgacgacgagccgtcaggcctaccgccttgacccccagaaccccggctccgaactcgccggggagaccgcggcagcaatggcggcggcgtcgctcgtgttccgcagctccaaccccggctacggcaacactctactccagcactccaagcagctgttcgatttcgcggacaagtaccgggggcggtacgacagcagcatcacggtggcgcgcaagtactacgcctcgtcgagcgggtacggcgacgagctgctgtgggcggcggcctggctgcacgaggcgaccggcgagtcgcgctacctggactacctggccaccaacgccgacgcgctgggcgggaccggctggtccatcaaccagttcggctgggacgtcaagtaccccggcgtgcaggtcctggccgccatgttcctcctgcggcgtggcggcaacgccggagcgcacgccgacgtgctgcggcggtacaagcagaaggcggacctgttcgcgtgctcctgcctcggcaggggcggcgccaacagcgtgcggcggacgcccggcgggatggtctaccaccagagctggaacaacgtgcagttcgtgaccagcgccgcgttcctcctcgccgcctacgccgaccacctcgccgcggcggggcaggccgcgcagtgcccgtcggccggcgggtcgtccgcgcagccgtcggagctcctggccttcgctaggtcccaggtggactacatcctgggcagcaacccgagggcgacgagctacatggtcgggtacggcgccacgtacccgcggcaggcgcaccaccgcggcgcctccatcgtctccgtcaaggccaacccctcgttcgtcagctgccaggccgggtacagcagctggtaccaccgccggagcgccaaccccaacctgctcgacggcgccaccgtcggcgggcccgacgagtacgacaacttcgccgacgagagggataactacgagcagacggaggccaccacctacaacaacgccccgctcatgggcgtgctcgctcggttggccgccggtcacggcggcggccggtttggtcaccactctgtcgccgccgatttgcctgcagaagcttcttcctccacggccattaatcggacctcactgccatctcctactccggcagctcctgagcacgcgtcgcccattgagatcgagcagaacgcgacggcgtcgtggacggagcggggcaagacgtaccaccggtacgcggtgacggtgaccaacaggtcgctcatcaagaccgtccacgagctccacatcggcatctccaagctctacggccaggtgtggggcgtcgacaaggcgcggtacggctacgtgctcccgagcgggctgccgtcgctgcccgccggcaagagcgcctcgttcgtgtacgtccaggccgcgccgccggccgacgtctgggtcaccggctacaagctcctctga

SEQ ID NO: 16475 - protein, 654 aa, Sorghum bicolor
  misc_feature: Useful for making plants with altered cell wall content and/or composition
  misc_feature: Functional homolog of the protein sequence given in SEQ ID NO 14390
  misc_feature: Useful for making plants with altered carbohydrate content
  misc_feature: Functional homolog of the protein sequence given in SEQ ID NO 13874
  misc_feature: Useful for making plants with altered lignin content
  misc_feature: Functional homolog of the protein sequence given in SEQ ID NO 13875
  misc_feature: Ceres ANNOT ID no. 8657780
  misc_feature (43)..(654): SWISSPROT Homolog: EC 3.2.1.4 Cellulase
  misc_feature (45)..(512): Pfam ID: Glyco_hydro_9 Pfam Description: Glycosyl hydrolase family 9
MARGGGRGGGGSRGAVVDSMAVVLIGLAMALAAATTQVASAAGHDYRQALSKSILYFEAQRSGRLPGSQRVSWRADSGLRDGKANGVDLVGGYYDAGDNVKFGLPMAFTVTMMSWSVLEYGKQMAAAGELGHAVEAIKWGTDYLVKAHPEPNVLYGEVGDGDSDHDCWMRPEDMTTSRQAYRLDPQNPGSELAGETAAAMAAASLVFRSSNPGYGNTLLQHSKQLFDFADKYRGRYDSSITVARKYYASSSGYGDELLWAAAWLHEATGESRYLDYLATNADALGGTGWSINQFGWDVKYPGVQVLAAMFLLRRGGNAGAHADVLRRYKQKADLFACSCLGRGGANSVRRTPGGMVYHQSWNNVQFVTSAAFLLAAYADHLAAAGQAAQCPSAGGSSAQPSELLAFARSQVDYILGSNPRATSYMVGYGATYPRQAHHRGASIVSVKANPSFVSCQAGYSSWYHRRSANPNLLDGATVGGPDEYDNFADERDNYEQTEATTYNNAPLMGVLARLAAGHGGGRFGHHSVAADLPAEASSSTAINRTSLPSPTPAAPEHASPIEIEQNATASWTERGKTYHRYAVTVTNRSLIKTVHELHIGISKLYGQVWGVDKARYGYVLPSGLPSLPAGKSASFVYVQAAPPADVWVTGYKLL

SEQ ID NO: 16476 - DNA, 1980 bp, Sorghum bicolor
  misc_feature: Ceres ANNOT ID no. 8657810
  misc_feature: Encodes the peptide sequence at SEQ ID NO 16477
atgcggttatctactcccattcccagacgcttcccttccaccactgcgctgcctccgcaactaccgccgcctctgctgttgccgcggccgtcctaccgcctcgcggccgtccttgcccctggctcagcggcgcggcgcggcggcctcccgccccctcctccgtctgtggcctccgccatgcgccggtgcagtcgtcgccgcagggccgcgccccctccggccgctgccgccggcgggggcggggaggtcgctgcccccgattcccagagagctggtacagacctcaagacactggctacaagattttggaaagttgcagctccctactggtggtcagaggataaaacgcaagcaaggctgaggcttgctgctgtgtttgctctcacattgggaaccacagggattagtgttggatttaacttcctcggccgtgacttctataatgcccttgctgataaggatcaagaaaagtttaccacacaactgctctactacctgggtgcttttgctggaggaattccgttctttgtcttgagagactatgcaagagaaactctttctttgagatggcgatcttggatgacaagttattatatgaagcgttactttaaaaaccgaactttttacaagattcaatctcaatcaataattgacaatccagaccaaaggataaatgatgatctcagcgcattcactggaacagcacttgcattctctctcacacttttcaatgctgctgtggacttggtatcattcagcaacatcctctatggaatctacccaccattgtttattgttcttgttgtctactctcttgggggtactgctattagtgtcttccttggtaagaatttggtcaacttgaacttcatgcaagagaagaaagaagctgattttcgttacggacttgtccgtgttagagaaaatgctgaatcaattgctttttatggtggcgaggaaaatgaattacaacttttattggatcggttcaggagggcttttgagaacctaagtgaattgctgatagcttctcggaatctggagtttttcaccaatggttatcgatatttaattcagattctgccagctgcagttgttgctccaatgtacttctcagggaaaattgagtttggagtaataaaccaatcggtgtctgctttcaatcatattcttagtgatttttctctcattgttttccaatttcagtcaattagtgcattctcagcagttatcgatcgtctaggtgaatttgatgatctattggatggaaatgagccatctgtatcatctcaacgtgatagcattgatgggatcaacattgttttcaaaagcagtggtccttctgttcttagttctaatggatcactaacgcaatctgatccatgcatggttctggagattcgtaacttgacattgttaacaccaagaagtggaaatgttcttattactggcctcactatggagctaaaagaaaaggaccacctattggtaatgggacctagtggaagtgggaagacctcactattacgtgctttggctggcctctggactagtggtactggggaaatcatataccatgtgagagctgaactgatcgaagtccttgaggtcgttaagttgggctacatattgcctcgttttaatggcttggactctatgcatgactgggccagtgttctttcactgggggagcagcagcgtctcgcattcgcccggttgttacttgctacacccactttggtcctactggacgagtcgacaagcgcacttgatgaagcaaacgaggctcatctatacagtcagattgaagctgcaggcattacttacgtaagcattggacaccggaaaacacttcacaagttccacaacaaggccttgtacatttcgaagtctgattcgacagacacaaatctacgcagctgggagctaaagcccacagaccagcttccacttgaagagtcttctccattcccttcatga

SEQ ID NO: 16477 - protein, 659 aa, Sorghum bicolor
  misc_feature: Useful for making plants with modulated biomass
  misc_feature: Useful for making plants with modulated flowering time
  misc_feature: Functional homolog of the protein sequence given in SEQ ID NO 14391
  misc_feature: Ceres ANNOT ID no. 8657810
  misc_feature (460)..(525): SWISSPROT Homolog: EC 3.6.3.31 Polyamine-transporting ATPase
  misc_feature (91)..(371): Pfam ID: ABC_membrane_2 Pfam Description: ABC transporter transmembrane region 2
  misc_feature (492)..(631): Pfam ID: ABC_tran Pfam Description: ABC transporter
MRLSTPIPRRFPSTTALPPQLPPPLLLPRPSYRLAAVLAPGSAARRGGLPPPPPSVASAMRRCSRRRRAAPPPAAAAGGGGEVAAPDSQRAGTDLKTLATRFWKVAAPYWWSEDKTQARLRLAAVFALTLGTTGISVGFNFLGRDFYNALADKDQEKFTTQLLYYLGAFAGGIPFFVLRDYARETLSLRWRSWMTSYYMKRYFKNRTFYKIQSQSIIDNPDQRINDDLSAFTGTALAFSLTLFNAAVDLVSFSNILYGIYPPLFIVLVVYSLGGTAISVFLGKNLVNLNFMQEKKEADFRYGLVRVRENAESIAFYGGEENELQLLLDRFRRAFENLSELLIASRNLEFFTNGYRYLIQILPAAVVAPMYFSGKIEFGVINQSVSAFNHILSDFSLIVFQFQSISAFSAVIDRLGEFDDLLDGNEPSVSSQRDSIDGINIVFKSSGPSVLSSNGSLTQSDPCMVLEIRNLTLLTPRSGNVLITGLTMELKEKDHLLVMGPSGSGKTSLLRALAGLWTSGTGEIIYHVRAELIEVLEVVKLGYILPRFNGLDSMHDWASVLSLGEQQRLAFARLLLATPTLVLLDESTSALDEANEAHLYSQIEAAGITYVSIGHRKTLHKFHNKALYISKSDSTDTNLRSWELKPTDQLPLEESSPFPS

SEQ ID NO: 16478 - DNA, 1563 bp, Sorghum bicolor
  misc_feature: Ceres ANNOT ID no. 8657885
  misc_feature: Encodes the peptide sequence at SEQ ID NO 16479
atggcggcggtggcggagtctctgtccgtgtccgtgtccggttccagtttcctggacctccgcgcggcggcgccgttcctggtggcggcggtggccttctacttcctggtggagcagctgtcctaccaccggaagaaggggccgctccccggcccctcgctcgtggtgccgttcctcggcagcgtggcgcacatgattcgtgacccgacggggttctgggacgcgcaggcggcgcgcgcgaagcgctccggcgtgggcctcgccgccgacttcctggtgggtcggttcgtggtgttcatccgcgacacggagctgtcccaccgcgtgttcgccaacgtccgccccgacgcgttccacctcatcggccaccctttcggcaagaagctcttcggcgaccacaacctcatctacatgttcggcgaggaccacaaggacctgcggcgccggatcgcgcccaacttcaccccgcgcgcgctctccacctacgccgcgctccagcagcgcgtcatcctggcgcacctccgccggtggctggaccggagcgagggcgaagggagcagggccagggcgttccccatccgcgtgccctgccgcgacatgaatctagagacctcgcagacggtgttcgcggggccgtacctgaccggcgaggcccggcggcggttcgagcgggactacaacctcttcaacgtcgggctgatggcgctgcccgtggacctccccggcttcgcgttccggcgcgcgaggcagggcgtggcgcggctggtgcgcacgctgggcgagtgcgcgcggcagagcaaggcgcggatgcgcgccggcggcgagcccgagtgcctggtggacttctggatgcaggacacgctgcgggagatggacgaggccgcggcggcggggcgcccaccgcccgcgcacaccgacgacgaggagatcggcgggttcatgttcgacttcctcttcgcggcgcaggacgcgtccacctcgtccctctgctgggcggtgtcggcgctggactcccacccggaggttctcgcccgcgtgcgcgccgaggtgtctgccgcctggtccccggactcgggcgagccgatgacggcggaggtgatccaggggatgcggtacacgcaggcggtggcgcgggaggtgatccggtaccgtcccccggcgacgctggtgccgcacatcgcgggggaggcgttccagctgacggagtggtacacggtgcccaagggcaccatcgtgttcccgtccgtgtacgagtcgtcgttccaggggttcccggaggcggaggcgttcgacccggagcggttcttctcggagtcgcggcgggaggacgtggcgtacaagcgcaacttcctggcgttcggcgcggggccgcaccagtgcgtcgggcagcggtacgcgctgaaccacctcgtcctgttcatggcgctgttcgtgtcggtggtggagttccggcgggagaggacgcccgggtgcgacgaccccgtgtacatgcccaccatcgtgcccaaggacggctgcaccgtgtacctcaagcagcgatgcgccaagttcccatcgttctga

SEQ ID NO: 16479 - protein, 520 aa, Sorghum bicolor
  misc_feature: Useful for making plants with altered sterol content
  misc_feature: Functional homolog of the protein sequence given in SEQ ID NO 14392
  misc_feature: Ceres ANNOT ID no. 8657885
  misc_feature (45)..(506): SWISSPROT Homolog: EC 1.14.13.79 Ent-kaurenoic acid oxidase
  misc_feature (50)..(510): Pfam ID: p450 Pfam Description: Cytochrome P450
MAAVAESLSVSVSGSSFLDLRAAAPFLVAAVAFYFLVEQLSYHRKKGPLPGPSLVVPFLGSVAHMIRDPTGFWDAQAARAKRSGVGLAADFLVGRFVVFIRDTELSHRVFANVRPDAFHLIGHPFGKKLFGDHNLIYMFGEDHKDLRRRIAPNFTPRALSTYAALQQRVILAHLRRWLDRSEGEGSRARAFPIRVPCRDMNLETSQTVFAGPYLTGEARRRFERDYNLFNVGLMALPVDLPGFAFRRARQGVARLVRTLGECARQSKARMRAGGEPECLVDFWMQDTLREMDEAAAAGRPPPAHTDDEEIGGFMFDFLFAAQDASTSSLCWAVSALDSHPEVLARVRAEVSAAWSPDSGEPMTAEVIQGMRYTQAVAREVIRYRPPATLVPHIAGEAFQLTEWYTVPKGTIVFPSVYESSFQGFPEAEAFDPERFFSESRREDVAYKRNFLAFGAGPHQCVGQRYALNHLVLFMALFVSVVEFRRERTPGCDDPVYMPTIVPKDGCTVYLKQRCAKFPSF

SEQ ID NO: 16480 - DNA, 1062 bp, Sorghum bicolor
  misc_feature: Ceres ANNOT ID no. 8657905
  misc_feature: Encodes the peptide sequence at SEQ ID NO 16481
atggtggtcctcgccaagggtgagctcgagcagatcgccctgccggcggcggagccgccgccagccgacgtgcggtcggtggacctgtcggccccggcgggccccgcgcgcgaggccgcagcgcgcgcgctggtggcggcgtgcgaggagcacgggttcttccgggtgacgggccacggcgtgccgccggagctcgtgcgcgccgcggaggccgcggcggccgggttcttcgcgcagccgcaggacgagaaggacgaggaggctcccacgctcgggtacggcagcaagcgcatcggcggcaacggcgacctcgggtgggtcgagtacctcctgctcggcgtcacccccgccggcgccgccgtgccggctgcctccgcgtcctcctcgacattgccgtgcgctgccgccgccgccgccgccaccgcatcgtcgccgtccgcgccggccgggtcggccgggctgttacgggaccttctggacgagtacacggtggcggtgcggcggatggcgtgcgcggtgctggagctgatggcggaggggctgggcatcgccggcggcgccggggacggggacgtgctggcgcggctggtgacgcgcgcggacagcgactgcatgctgcgggtgaaccactacccgccgcggccggcgttgaacccctgcagcctgacggggttcggcgagcacacggacccgcagatcatctcggtgctccgcgccaacggcacctccggcctggagatcgcgctgcgggacggcgcctgggcctccgtcccgcccgacggcgacggcttcttcgtcaacgtcggcgacaccctgcaggtgttgacgaacgggaggttcaggagcgtgaggcacagggtggtggtgaacagcgagaagtcccgggtgtccatggtcttcttcggcgggccgccgccgggcgagaggctggcgccgctgccgcagctgctgggcgacggcggccggagccggtaccgggacttcacctggagcgagttcaagaacagcgggtgcaggaccaggctcgcggaagaccggctgtcccgcttcgagaacaagtag

SEQ ID NO: 16481 - protein, 353 aa, Sorghum bicolor
  misc_feature: The sequence is a functional homolog of SEQ ID NO 4 in US patent 7154028
  misc_feature: Ceres ANNOT ID no. 8657905
  misc_feature (156)..(351): SWISSPROT Homolog: EC 1.14.11.13 Gibberellin 2-beta-dioxygenase
  misc_feature (202)..(304): Pfam ID: 2OG-FeII_Oxy Pfam Description: 2OG-Fe(II) oxygenase superfamily
MVVLAKGELEQIALPAAEPPPADVRSVDLSAPAGPAREAAARALVAACEEHGFFRVTGHGVPPELVRAAEAAAAGFFAQPQDEKDEEAPTLGYGSKRIGGNGDLGWVEYLLLGVTPAGAAVPAASASSSTLPCAAAAAAATASSPSAPAGSAGLLRDLLDEYTVAVRRMACAVLELMAEGLGIAGGAGDGDVLARLVTRADSDCMLRVNHYPPRPALNPCSLTGFGEHTDPQIISVLRANGTSGLEIALRDGAWASVPPDGDGFFVNVGDTLQVLTNGRFRSVRHRVVVNSEKSRVSMVFFGGPPPGERLAPLPQLLGDGGRSRYRDFTWSEFKNSGCRTRLAEDRLSRFENK

SEQ ID NO: 16482 - DNA, 1533 bp, Sorghum bicolor
  misc_feature: Ceres ANNOT ID no. 8657935
  misc_feature: Encodes the peptide sequence at SEQ ID NO 16483
atggcaggcaagggaggaagcaatggcagcggcggcggtcgggagtccaagcagaagccggcgctcctcctggggcggtacgaggtggggaagctgctggggcagggcaacttcgccaaggtgtaccacgcgcgcaacgtgctgacgggcgaggaggtggccatcaaggtgatggagaaggagaagatcttcaagtccggtctgatggcgcacatcaagcgcgagatcgccgtgctccggcgggtgcgccacccgcacatcgtgcagctctacgaggtgatggccaccaagctgcgcatctacttcgtgatggagtacgtgcgcggcggcgagctgttcgcgcgcgtcgcgcggggccggctccgggacgccgacgcccggcgctacttccagcagctggtgtcctccgtcgccttctgccacgcgcgcggggtgtaccaccgggacatcaagcccgagaacctcctcctcgacgacgccggcgacctcaaggtctccgacttcggcctctccgcggtggccgaccagatgcgacacgacggtctgttccacactttctgcggcaccccggcctacgtggcgccggaggtgctctcccgccgcggctacgacgccgccaaggccgacctctggtcctgcggcgtcgtgctcttcgtgctcgccgccggctacctcccgttccaggaccgcaacctcgtggccatgtaccgcaagatccacaggggcgagttccgctgccccaagtggttctcgccggagctgacccgcctcctgcgccgcgtcctcgacaccaacccgcagcgacgcgccaccgccgacgagatcatggacgacgagtggttcaaggtcggcttccgccgcttctccttccgcatcgaggacgaccgctccttcacctgcttcgacctggacgacgacgacgacgtcgacgcgtccacctcgccgcccgagcccgacacgccacgggcagacgccgctcccaagaagccgagaaagggtagcgccgccgggctgacgtcgtgcgcgtcggcgccgtcgctgctgcagctggaatcgcgcagcagcgggctcggcgggagcagccggcggcggtcgagcctgaacgcgttcgacatcatctcgttctcgaggggattcgacctctcgggcctgttcgaggacggcgaagggggaggtgtgccggagcatccgccccacccggcggcggcgcggttcgtgtcggcggctcccgtggagcagatcctggccacgctggagggggccgcgtcggcggccggcatggtggtgcgcgagagggacgacgggtccatcagcatggaggggacgcgagagggcgagcacggcgcgctggcggtcgccgcggagatctacgagctcacgccggagctgcttgtcgtggaggttcgccgcaagtccggcggtgccgccgagtacgaggagttcttccgggcgcagctgaagcccaacctgcgcgacctcgtctgcgacgagccgacactgctccaatccgacgaccgctctcggagcctatga

SEQ ID NO: 16483 - protein, 510 aa, Sorghum bicolor
  misc_feature: Useful for making plants with modulated biomass
  misc_feature: Functional homolog of the protein sequence given in SEQ ID NO 14256
  misc_feature: Useful for making plants with modulated salt sensitivity
  misc_feature: Functional homolog of the protein sequence given in SEQ ID NO 14255
  misc_feature: Ceres ANNOT ID no. 8657935
  misc_feature (23)..(290): SWISSPROT Homolog: EC 2.7.11.1 Non-specific serine/threonine protein kinase
  misc_feature (27)..(281): Pfam ID: Pkinase Pfam Description: Protein kinase domain
  misc_feature (363)..(431): Pfam ID: NAF Pfam Description: NAF domain
MAGKGGSNGSGGGRESKQKPALLLGRYEVGKLLGQGNFAKVYHARNVLTGEEVAIKVMEKEKIFKSGLMAHIKREIAVLRRVRHPHIVQLYEVMATKLRIYFVMEYVRGGELFARVARGRLRDADARRYFQQLVSSVAFCHARGVYHRDIKPENLLLDDAGDLKVSDFGLSAVADQMRHDGLFHTFCGTPAYVAPEVLSRRGYDAAKADLWSCGVVLFVLAAGYLPFQDRNLVAMYRKIHRGEFRCPKWFSPELTRLLRRVLDTNPQRRATADEIMDDEWFKVGFRRFSFRIEDDRSFTCFDLDDDDDVDASTSPPEPDTPRADAAPKKPRKGSAAGLTSCASAPSLLQLESRSSGLGGSSRRRSSLNAFDIISFSRGFDLSGLFEDGEGGGVPEHPPHPAAARFVSAAPVEQILATLEGAASAAGMVVRERDDGSISMEGTREGEHGALAVAAEIYELTPELLVVEVRRKSGGAAEYEEFFRAQLKPNLRDLVCDEPTLLQSDDRSRSL

SEQ ID NO: 16484 - DNA, 996 bp, Sorghum bicolor
  misc_feature: Ceres ANNOT ID no. 8657936
  misc_feature: Encodes the peptide sequence at SEQ ID NO 16485
atgggatgttcgtccttgccgtcctcccgtgctctgtggctcacgacggccgtcgtcgcggcgctcgccgccggcgcgcaggcgtcgctgtcgccggggttctacgacgcgacgtgcccggggctgcagcccatcgtgcgccgcgtcgtggcgcgggccgtccagatggagccgcgcatgggggcgtccctcctccgcctcttcttccacgactgcttcgtcaatggctgcgacgcctccgtcttgctggacgacgtgcccggtagcttcgtcggggagaagaacgcgggtcccaacgccaactcgctgcgcgggttcgaggtcatcgacgccatcaaggcgcaggtcgaggcgtcctgcaacgccaccgtctcctgcgccgacatcgtcgccctcgccgcgcgcgacgccgtcaacctgctcggtgggccgaggtggtcggtgccgctaggccggcgagacgcgcggaacacgagcgcgaacgcggcgaacgccaacctaccgccgccggacgcgagcctaccgacgctgctgtccatgttcggcgccaagggcctggacgcgcgggacctgacggcgctgtcgggggcgcacacggtggggcgcgcccgctgcgtggtgttccgctcccacatctacaacgacacggccaccaccaacgccaccttcgcggcggagctccggagcaccgtctgcccctacacgggcggcgacgccaacctggcgccgctgaagctgcaggcgcccgacgtcttcgacaacggctacttccgggacctggtcacccgccgcgtgctgctgcggtccgaccaggcgctgtacgacggcggcaacggcaccacggacgcgctcgtgcgcgcctacgccgccaacgggacggcgttcgccgccgacttcgccgccgccatggtcaggatggggaacctgggaccgcctgccgggagcgccgccgccgccgccaccgaggtccggctcaactgccggcgagtgaactga

SEQ ID NO: 16485 - protein, 331 aa, Sorghum bicolor
  misc_feature: Useful for making plants with altered carbohydrate content
  misc_feature: Functional homolog of the protein sequence given in SEQ ID NO 13713
  misc_feature: Useful for making plants with altered cell wall content and/or composition
  misc_feature: Functional homolog of the protein sequence given in SEQ ID NO 13958
  misc_feature: Useful for making plants with modulated oxidative stress sensitivity
  misc_feature: Functional homolog of the protein sequence given in SEQ ID NO 13607
  misc_feature: Ceres ANNOT ID no. 8657936
  misc_feature (34)..(331): SWISSPROT Homolog: EC 1.11.1.7 Peroxidase
  misc_feature (46)..(291): Pfam ID: peroxidase Pfam Description: Peroxidase
MGCSSLPSSRALWLTTAVVAALAAGAQASLSPGFYDATCPGLQPIVRRVVARAVQMEPRMGASLLRLFFHDCFVNGCDASVLLDDVPGSFVGEKNAGPNANSLRGFEVIDAIKAQVEASCNATVSCADIVALAARDAVNLLGGPRWSVPLGRRDARNTSANAANANLPPPDASLPTLLSMFGAKGLDARDLTALSGAHTVGRARCVVFRSHIYNDTATTNATFAAELRSTVCPYTGGDANLAPLKLQAPDVFDNGYFRDLVTRRVLLRSDQALYDGGNGTTDALVRAYAANGTAFAADFAAAMVRMGNLGPPAGSAAAAATEVRLNCRRVN

SEQ ID NO: 16486 - DNA, 1215 bp, Sorghum bicolor
  misc_feature: Ceres ANNOT ID no. 8657940
  misc_feature: Encodes the peptide sequence at SEQ ID NO 16487
atggaggcgccgccgggaccggagcccatggagctcgacgcgccccctcccgccgccgccgaggccgcggcggcggttccccccgccgggagcgacaagaagaaggaaggggaagggggagacgctgttacgggtcatatcatctccaccaccatcggtgggaagaacggcgaaccgaagcggaccatcagttacatggcagagcgtgtcgtgggtacaggctcatttgggatcgtcttccaggctaagtgtttggagaccggagagaccttcgccatcaagaaggtgctgcaagatcggcgatacaagaaccgggagctgcaacttatgcgtgccatggagcaccccaacgtcatctgcctgaagcactgcttcttctcgacaacaagcagggatgaactgtttttaaacctggtcatggaatttgtcccagagaccctataccgagtcctgaagcactacagcaacgcgaaccagaggatgcctcttatctatgttaagctgtacatgtatcagctttttagaggcctagcttatattcataatgtaccaggtgtctgccatagggatgtaaagccccaaaatgttttggttgatcctctcactcaccaggtcaagctctgtgactttggtagcgcaaaagtcctggttcctggtgaaccgaacatatcttatatatgttctcgttattatcgtgccccggagctcatatttggcgcaacggagtatactacttcaatagacatatggtcagctggttgtgttctagctgagttgcttcttggtcagccactgtttccgggagagagcgcagttgatcagctggtagagattatcaaggttcttggtactccaacccgggaggagataagatgcatgaatcccaactatactgagttcaggtttcctcagataaaggctcatccgtggcacaagattttccacaagagaatgcctcctgaagctatagaccttgcttcccgtctccttcagtattcaccaagtcttcgctgctctgctcttgatgcatgtgctcatcccttctttgatgagctgcgggcgccgaatgcgcgcctaccaaatggccgtccattccctctgctctttaacttcaaacatgaactagcaaatgcatctccggacctcatcaacaggcttgtaccggagcacattagacggcagaacggtgtcaacttcgggcatgttgggagctag

SEQ ID NO: 16487 - protein, 404 aa, Sorghum bicolor
  misc_feature: Useful for making plants with modulated biomass
  misc_feature: Functional homolog of the protein sequence given in SEQ ID NO 14074
  misc_feature: Useful for making plants with modulated water use efficiency
  misc_feature: Functional homolog of the protein sequence given in SEQ ID NO 14073
  misc_feature: Ceres ANNOT ID no. 8657940
  misc_feature (43)..(399): SWISSPROT Homolog: EC 2.7.11.1 Non-specific serine/threonine protein kinase
  misc_feature (65)..(349): Pfam ID: Pkinase Pfam Description: Protein kinase domain
MEAPPGPEPMELDAPPPAAAEAAAAVPPAGSDKKKEGEGGDAVTGHIISTTIGGKNGEPKRTISYMAERVVGTGSFGIVFQAKCLETGETFAIKKVLQDRRYKNRELQLMRAMEHPNVICLKHCFFSTTSRDELFLNLVMEFVPETLYRVLKHYSNANQRMPLIYVKLYMYQLFRGLAYIHNVPGVCHRDVKPQNVLVDPLTHQVKLCDFGSAKVLVPGEPNISYICSRYYRAPELIFGATEYTTSIDIWSAGCVLAELLLGQPLFPGESAVDQLVEIIKVLGTPTREEIRCMNPNYTEFRFPQIKAHPWHKIFHKRMPPEAIDLASRLLQYSPSLRCSALDACAHPFFDELRAPNARLPNGRPFPLLFNFKHELANASPDLINRLVPEHIRRQNGVNFGHVGS

SEQ ID NO: 16488 - DNA, 255 bp, Sorghum bicolor
  misc_feature: Ceres ANNOT ID no. 8657944
  misc_feature: Encodes the peptide sequence at SEQ ID NO 16489
atgacgctcgaccaggactatggatggatcaacaacatccaccatgacatcgggactcatgtcatccaccatctcttcctgcagatcccacattaccatctcataatagaggcagctaagccggtgctgggaaagtactacagagagccgcaaaagtctggccctctcccctttcatctacttggtgatctggttcggagtttgagacgtgaccactgtgtcaacgacacaggggatgtcctactaccaaactga

SEQ ID NO: 16489 - protein, 84 aa, Sorghum bicolor
  misc_feature: Useful for making plants with modulated heat sensitivity
  misc_feature: Functional homolog of the protein sequence given in SEQ ID NO 13709
  misc_feature: Ceres ANNOT ID no. 8657944
  misc_feature (2)..(48): SWISSPROT Homolog: EC 1.14.99.33 Delta(12)-fatty acid dehydrogenase
MTLDQDYGWINNIHHDIGTHVIHHLFLQIPHYHLIIEAAKPVLGKYYREPQKSGPLPFHLLGDLVRSLRRDHCVNDTGDVLLPN

SEQ ID NO: 16490 - DNA, 975 bp, Sorghum bicolor
  misc_feature: Ceres ANNOT ID no. 8657974
  misc_feature: Encodes the peptide sequence at SEQ ID NO 16491
atgcagagaggcactgccgcaccaccaccaccaccacccatgctcaacatgatgactgatctgagctgccggccgtcggaggtgacagagcagctggcggcgccgacgggctccggcgacaagcaggggaggggcaagatcgagatcaagcgcatcgagaacaccacgaaccggcaggtcaccttctgcaagcgccgcaacggcctcctcaagaaggcgtacgagctctcggtgctctgcgacgccgaggtcgcgctcatcgtcttctccagccgcggccgcctctacgagtacgccaacaacagtgtgaagtccaccattgagaggtacaagaaggccaacagtgacacctccaactctggcacagttgcagaagtcagtgcccagcactaccagcaggagtcctccaagctgcgccagactatcagtagcttgcaaaacgcaaacaggaccatagtgggagattcaatccacaccatgagcctcagggatcttaagcagctggagggcaggctggagaaaggcataagcaagattagagctagaaagaatgagctgttatatgctgaagttgactatatgcaaaaaagggagatggatctgcagactgacaacatgtacctgaggagcaagatcgctgagaataatgaaacggggcagccggcgatgaacatgatgggagtgccatcgacaagcgaatacgagcacatggtcccttttgactcgagaaactttcttcaagtgaacatcatgcagcagcctcagcactactcccatcagctgcaaccaacaaccctgcaactcgggtgtggagtctggatgcggtggcagcggtcgggtgaaggtcaagtagggcgtgccgtgctgacggaccggttgcggtcgagcagcaggagctgcactcgtgctctcaggcaccgagctagtgctcgtccatgtgcacaggcacccgcctgttcttgctgtgagccatga

SEQ ID NO: 16491 - protein, 324 aa, Sorghum bicolor
  misc_feature: Useful for biocontainment applications
  misc_feature: Functional homolog of the protein sequence given in SEQ ID NO 14236
  misc_feature: The sequence is a functional homolog of SEQ ID NO 14 in the 10/666,642 US patent application
  misc_feature: Useful for making plants with altered terpenoid content
  misc_feature: Useful for making plants with modulated flowering time
  misc_feature: Functional homolog of the protein sequence given in SEQ ID NO 13438
  misc_feature: The sequence is a functional homolog of SEQ ID NO 32 in the 10/666,642 US patent application
  misc_feature: Useful for making plants with altered alkaloid content
  misc_feature: Useful for making plants with altered lignin content
  misc_feature: Useful for making plants with modulated biomass
  misc_feature: Functional homolog of the protein sequence given in SEQ ID NO 13528
  misc_feature: The sequence is a functional homolog of SEQ ID NO 1701 in the 10/412,699 US patent application
  misc_feature: The sequence is a functional homolog of SEQ ID NO 1965 in the 10/412,699 US patent application
  misc_feature: The sequence is a functional homolog of SEQ ID NO 1967 in the 10/412,699 US patent application
  misc_feature: The sequence is a functional homolog of SEQ ID NO 1949 in the 10/412,699 US patent application
  misc_feature: The sequence is a functional homolog of SEQ ID NO 1963 in the 10/412,699 US patent application
  misc_feature: Useful for making plants with modulated nitrogen use efficiency
  misc_feature: Functional homolog of the protein sequence given in SEQ ID NO 12982
  misc_feature: The sequence is a functional homolog of SEQ ID NO 1957 in the 10/412,699 US patent application
  misc_feature: The sequence is a functional homolog of SEQ ID NO 1959 in the 10/412,699 US patent application
  misc_feature: Ceres ANNOT ID no. 8657974
  misc_feature (115)..(214): Pfam ID: K-box Pfam Description: K-box region
  misc_feature (50)..(100): Pfam ID: SRF-TF Pfam Description: SRF-type transcription factor (DNA-binding and dimerisation domain)
MQRGTAAPPPPPPMLNMMTDLSCRPSEVTEQLAAPTGSGDKQGRGKIEIKRIENTTNRQVTFCKRRNGLLKKAYELSVLCDAEVALIVFSSRGRLYEYANNSVKSTIERYKKANSDTSNSGTVAEVSAQHYQQESSKLRQTISSLQNANRTIVGDSIHTMSLRDLKQLEGRLEKGISKIRARKNELLYAEVDYMQKREMDLQTDNMYLRSKIAENNETGQPAMNMMGVPSTSEYEHMVPFDSRNFLQVNIMQQPQHYSHQLQPTTLQLGCGVWMRWQRSGEGQVGRAVLTDRLRSSSRSCTRALRHRASARPCAQAPACSCCEP

SEQ ID NO: 16492 - DNA, 348 bp, Sorghum bicolor
  misc_feature: Ceres ANNOT ID no. 8657979
  misc_feature: Encodes the peptide sequence at SEQ ID NO 16493
atggcggatggacggtgtgcatggcgcgcagcctcgcttgatggaaccatttctgttgccgcacggcataaagctgtgaaagacttcaatatggttccagaggttactattataatcatgtcactcaaagcagcaagtctcagcttgaacatggttgctgcttgccatgtacttatgctatatctttggtggaactcgaccactgaggaccaagctatggatagagctcaccgtattggccaaacatgggttgtcatggtatcacaattaactataaaagacaccttggaagattgtattctgggtctccaggagaaaaaagtgggagatggttgcttttgtgtttga

SEQ ID NO: 16493 - protein, 115 aa, Sorghum bicolor
  misc_feature: The sequence is a functional homolog of SEQ ID NO 208 in the 10/412,699 US patent application
  misc_feature: The sequence is a functional homolog of SEQ ID NO 148 in the 10/666,642 US patent application
  misc_feature: The sequence is a functional homolog of SEQ ID NO 164 in the 10/225,066 US patent application
  misc_feature: The sequence is a functional homolog of SEQ ID NO 2662 in the 10/374,780 US patent application
  misc_feature: Ceres ANNOT ID no. 8657979
  misc_feature (3)..(80): Pfam ID: Helicase_C Pfam Description: Helicase conserved C-terminal domain
MADGRCAWRAASLDGTISVAARHKAVKDFNMVPEVTIIIMSLKAASLSLNMVAACHVLMLYLWWNSTTEDQAMDRAHRIGQTWVVMVSQLTIKDTLEDCILGLQEKKVGDGCFCV

SEQ ID NO: 16494 - DNA, 240 bp, Sorghum bicolor
  misc_feature: Ceres ANNOT ID no. 8657991
  misc_feature: Encodes the peptide sequence at SEQ ID NO 16495
atgtcggccacctgcggcaactgcgactgtgctgacaagacccagtgcacgaagaagggcgacagctatggcgccgtcgtagttgacaccgagagctactcacgtgctgctaagataactattactcgtaccatgcatgggtctatcgttgaggaggaggtgaccgttgcggagcacgacggcgcctgcaagtgcggcgccagctgctactgcggcaccagctgcagctgcggcaagtga

SEQ ID NO: 16495 - protein, 79 aa, Sorghum bicolor
  misc_feature: Useful for making plants with modulated nitrogen use efficiency
  misc_feature: Functional homolog of the protein sequence given in SEQ ID NO 14393
  misc_feature: Ceres ANNOT ID no. 8657991
MSATCGNCDCADKTQCTKKGDSYGAVVVDTESYSRAAKITITRTMHGSIVEEEVTVAEHDGACKCGASCYCGTSCSCGK

SEQ ID NO: 16496 - DNA, 1602 bp, Sorghum bicolor
  misc_feature: Ceres ANNOT ID no. 8658010
  misc_feature: Encodes the peptide sequence at SEQ ID NO 16497
atggagtccgtcgcagcccttatggactcgacaagctccaagatacagcagcttcaggaggcatttgctgagcttgagagccagagtgctgtctccatgaaccttaagtggaagcagcttgaagaccactttcgtggccttgaacagtccctcaagaaaaagtttgacgagctaaaagagcaggaggaggagttccaggagattgtcgcaaaatcagatctgatgctggagcagcgggaggcagctgttgtggccaaggaactgacctctctggagaggttgcaggagaagagggatgctgcattagctatgatctttagcaagtctaggctttccttacctgttcctgccatcaatccaatgaacaaggcactggataatcttggtgtcaagtggcctaaaccggcttctgaagagagtgtgcacttgcaagatggtaatgctgcagtgaggcctcgttctgagcttgcctcactctgtgaggaaatgaatgttaaggggcttcataagttcatatccgacaacaggaagaacttggcagccatccgcgaggaaattcccagtgcactgaagaaaacatctgatccttatggcttggtgttggattccctggaagacttctattctggagataatcttgtattagatggcaaaaaggatggagaccttctgggtgttagaaggacctgcctgatgttgatggagtcacttggacagctgcaaactaataatataacttgtttctctttggaggggcacatgcttacaactaatatcgtagagcgagcaaagaagattgcatttgagtggaagtccaagttagataatcttgacattgatgctagtaatgggaactgtcttgaagctcatgcatttcttcaactcctggcaacctttggtatttctgctgaatataacgaagatgacctgtgcaaattgcttccatatgtcagtcgtcgtcgtcagacacctgaactttgtcgattgcttgggttgtcgcagaaaatgccaggtgtcattgaagttctggtggaaagtggaagacctattgatgcaattaatttggcttatgtgtttgagcttactgaacagtttgagccagtgcaactgcttaaagcatatctgagggatgttaagaaagtgtcacatgccaggaatgtcaaaggttctcctggggcacagaatgagatgaatgaacgcgagttgtctgcactgaaatctgtcattaagtgcattgaagagcacaagcttgaggagcagtaccctgtggatccacttcagaaaagggttttgcagctagagaaagcaaaggcagacaagaggagggctgttgaagcagcaaagccacagtccaagcggcctcgtgccaatggatcggcctttgcacaccgtgctacaggctttgctgacaagagcttctacccagcagcagcaaccccagagaggcatccctccaatccttacgagaggcagtttgtgtatggtgctgaggctcatcttccaccaatggtgagctcagcgtcttacaccatgcaacctgcccacggaccttattacggtaatggctacccagttcagtaccaggtcccgtatatccactaa

SEQ ID NO: 16497 - protein, 533 aa, Sorghum bicolor
  misc_feature: Useful for making plants with altered carbohydrate content
  misc_feature: Functional homolog of the protein sequence given in SEQ ID NO 14045
  misc_feature: Ceres ANNOT ID no. 8658010
  misc_feature (142)..(448): Pfam ID: Frigida Pfam Description: Frigida-like protein
MESVAALMDSTSSKIQQLQEAFAELESQSAVSMNLKWKQLEDHFRGLEQSLKKKFDELKEQEEEFQEIVAKSDLMLEQREAAVVAKELTSLERLQEKRDAALAMIFSKSRLSLPVPAINPMNKALDNLGVKWPKPASEESVHLQDGNAAVRPRSELASLCEEMNVKGLHKFISDNRKNLAAIREEIPSALKKTSDPYGLVLDSLEDFYSGDNLVLDGKKDGDLLGVRRTCLMLMESLGQLQTNNITCFSLEGHMLTTNIVERAKKIAFEWKSKLDNLDIDASNGNCLEAHAFLQLLATFGISAEYNEDDLCKLLPYVSRRRQTPELCRLLGLSQKMPGVIEVLVESGRPIDAINLAYVFELTEQFEPVQLLKAYLRDVKKVSHARNVKGSPGAQNEMNERELSALKSVIKCIEEHKLEEQYPVDPLQKRVLQLEKAKADKRRAVEAAKPQSKRPRANGSAFAHRATGFADKSFYPAAATPERHPSNPYERQFVYGAEAHLPPMVSSASYTMQPAHGPYYGNGYPVQYQVPYIH

SEQ ID NO: 16498 - DNA, 1497 bp, Sorghum bicolor
  misc_feature: Ceres ANNOT ID no. 8658060
  misc_feature: Encodes the peptide sequence at SEQ ID NO 16499
atgatgctcaaggatctggcagcaattcagcagcaccagcaccaccagcagctgcagctggccgccgccgccgacgagaacatgtctaacctgacctccgcctccggcgaccaggccagcgtctcgtcccaccccgccccgcctcccgccaagaagaaacgcagcctcccggggaatccagacccggacgcggaggtcatcgcgctgtcgccgcggacgcttatggcgacgaaccgctacgtgtgcgaggtgtgcggcaaggggttccagcgtgaccagaacctgcagctgcaccggcgcggccacaacctcccctggaagctcaagcagcgcaaccccaaggaggttgtgcgcaagaaggtgtacgtgtgcccggagcccggctgcgtgcaccacgacccggcgcgcgccctcggcgacctcaccggcatcaagaagcacttcagccgcaagcacggcgagaagaagtggaagtgcgaccgctgcgccaagcgctacgccgtccactccgactggaaggcgcactccaaggtgtgcggcacgcgcgagtaccgatgcgactgcggcaccctcttctcaaggagggacagcttcatcacgcacagggccttctgcgacgcgctcgcggaggagagcgcgagggcggtgaccgcggcggcggcggtcgtcgcgggccagcagcatcacccggggatgctcttctctcaggccggcggtggcgggggcgacggcagcgcggggttgcacctgccgccgggcgtgctggacccgtcgcagactctaggcggcgggcacggcatgtccttgcaagagctgtgcctcaagagggaacagcagcagcagcagcagttcgccccgtcgtcgtggctcacggcgcatcgtcagcaggagctggagcttcccggcgcaggcaactcggccgtgttcggatcagcgaggccgctagaccagcaggactacatggggagctccacgcatgagagcacggcgggcctcagcggcttcgtcgggttctcctcgccgtccgccgctggtggaggggcggcctcggcgcacatgtctgccaccgcgctgctgcagaaggccgcgcagatgggtgcaacgctgagccggccgtcgaaccagggacagatggcgagcacccacagcaccaccaccaccaccaatgctggcactggcgctgccaacgcggcagctgcaagcaacgtgcctggcactggcgctggtgccctcggcttcggggcacctcatcactttggagcggaggagaggaccaccaggcctgatcatcgcgacgccggcaacggcggcaatgccgccaccggaggcggcaacgaaggcctcaccagggacttcttggggctgagagccttctcccacggcgacatactcagcatggccggcttcgacccctgcatgtcgtcggcctcgtcggccgcgtacgagcaagggcaccaccaccaccaccaccagagcagcaagcagtggcatgtctag

SEQ ID NO: 16499 - protein, 498 aa, Sorghum bicolor
  misc_feature: The sequence is a functional homolog of SEQ ID NO 1086 in the 10/666,642 US patent application
  misc_feature: The sequence is a functional homolog of SEQ ID NO 1087 in the 10/666,642 US patent application
  misc_feature: Useful for making plants with altered lignin content
  misc_feature: Functional homolog of the protein sequence given in SEQ ID NO 13275
  misc_feature: Ceres ANNOT ID no. 8658060
  misc_feature (80)..(102): Pfam ID: zf-C2H2 Pfam Description: Zinc finger, C2H2 type
MMLKDLAAIQQHQHHQQLQLAAAADENMSNLTSASGDQASVSSHPAPPPAKKKRSLPGNPDPDAEVIALSPRTLMATNRYVCEVCGKGFQRDQNLQLHRRGHNLPWKLKQRNPKEVVRKKVYVCPEPGCVHHDPARALGDLTGIKKHFSRKHGEKKWKCDRCAKRYAVHSDWKAHSKVCGTREYRCDCGTLFSRRDSFITHRAFCDALAEESARAVTAAAAVVAGQQHHPGMLFSQAGGGGGDGSAGLHLPPGVLDPSQTLGGGHGMSLQELCLKREQQQQQQFAPSSWLTAHRQQELELPGAGNSAVFGSARPLDQQDYMGSSTHESTAGLSGFVGFSSPSAAGGGAASAHMSATALLQKAAQMGATLSRPSNQGQMASTHSTTTTTNAGTGAANAAAASNVPGTGAGALGFGAPHHFGAEERTTRPDHRDAGNGGNAATGGGNEGLTRDFLGLRAFSHGDILSMAGFDPCMSSASSAAYEQGHHHHHHQSSKQWHV

SEQ ID NO: 16500 - DNA, 1752 bp, Sorghum bicolor
  misc_feature: Ceres ANNOT ID no. 8658063
  misc_feature: Encodes the peptide sequence at SEQ ID NO 16501
atggagcccatggaaagccagctgaccgccgtcgcgctctccgactccgacagcgcctccgtcgagggcgccgccgcggcggacgcggcggacgccgacctgcaggcgctccgccgcctctccgacaacctcgcggcggcgttccgctcccccgatgactacggcttcctctccgacgcgcgcatcgcggtgcccggcgcgcccgacctccgcgtgcaccgctgcgtgctctgcgcgcgcagccccttcctgcgcgacgtcttcgcgcgccgcgccgccagcgacggcgaggagaaggacaagggcagggacaggggcaaggtggagctccgggatctcctcggcgacgaggtggaggtcgggtacgaggcgctgcggctggtggtcgactacctctacagcggccgcgtcgccgccctccccaaggcggcctgcctctgcgtcgacgaggacggctgcgcgcacgtcggctgccgccccgccgtcgccttcatggcgcaggtcctcttcgccgcgtccaccttcgacgtcgccgagctcaccaacctcttccagcggcgtctccttgatgtccttgataaggttgaagtggacaacctcccattgatcttatctgttgccaacttatgcaacaaatcttgtgtgaaactgcttgagagatgccttgatgtagtagttcggtcaaatctggatatgattactcttgagaaggcattgcctccagatgttgtcaaagcaattgttgatgcaaggctaagtcttggattagttttaccagaggacaagggcttccctaacatacatgtaagaagagtacacagggcgctggattctgatgatgtagagctagtccgaatgctactcaaggaaggaaaaactaatctcgatgatgcatatgcgttacactatgctgtcgaacattgcgactcaaagatcacaacagaacttctggatttcgcacttgcagatgttaatcataggaacccaagaggctatacggttcttcacattgctgctatgagaagggaacctaaaatcattgtctctcttttgaccaagggagctcggccgtcagatctcacatttgatcacagaaaagcagtacagatctctaaacgacttacaaatcatggggattactttgggcctactgaggatggaaagccttctcctaaagatagattatgtattgagatactagagcaagctgaaagaagggacccacatcttggagaagcatcagtttctcttgcaatagaaggagactctgcgcgtggaaggttgctctaccttgaaaaccgagttgctttagcgaggatattgttccccatggaggcaagggtagcaatggacattgctcaagttgatggaaccttggaatttacccttggttctaatgctaatctgcctaccgagattcagcggacagttgacctgaacgatactcctttcataatgaaggaagagcacttggctcggatgagagccctagccaaaacagttgaactcgggaaacgtttcttcccacggtgttcaaaagtgctcgacaagatcatggatgacgaaaccgagctggcttccctcggacgagacacatccacagagaagaagaggaggttccatgacctgcaagacttggttcacaaggcattcagcgaggacaaggaggagaacgacaggtcggcggcccggtcgtcttcctcgtcgtcgacgacgtcgatcggaatcggagccgtccggcctcggagatga

SEQ ID NO: 16501 - protein, 583 aa, Sorghum bicolor
  misc_feature: The sequence is a functional homolog of SEQ ID NO 597 in the 10/374,780 US patent application
  misc_feature: Ceres ANNOT ID no. 8658063
  misc_feature (330)..(362): Pfam ID: Ank Pfam Description: Ankyrin repeat
  misc_feature (48)..(161): Pfam ID: BTB Pfam Description: BTB/POZ domain
MEPMESQLTAVALSDSDSASVEGAAAADAADADLQALRRLSDNLAAAFRSPDDYGFLSDARIAVPGAPDLRVHRCVLCARSPFLRDVFARRAASDGEEKDKGRDRGKVELRDLLGDEVEVGYEALRLVVDYLYSGRVAALPKAACLCVDEDGCAHVGCRPAVAFMAQVLFAASTFDVAELTNLFQRRLLDVLDKVEVDNLPLILSVANLCNKSCVKLLERCLDVVVRSNLDMITLEKALPPDVVKAIVDARLSLGLVLPEDKGFPNIHVRRVHRALDSDDVELVRMLLKEGKTNLDDAYALHYAVEHCDSKITTELLDFALADVNHRNPRGYTVLHIAAMRREPKIIVSLLTKGARPSDLTFDHRKAVQISKRLTNHGDYFGPTEDGKPSPKDRLCIEILEQAERRDPHLGEASVSLAIEGDSARGRLLYLENRVALARILFPMEARVAMDIAQVDGTLEFTLGSNANLPTEIQRTVDLNDTPFIMKEEHLARMRALAKTVELGKRFFPRCSKVLDKIMDDETELASLGRDTSTEKKRRFHDLQDLVHKAFSEDKEENDRSAARSSSSSSTTSIGIGAVRPRR

SEQ ID NO: 16502 - DNA, 2064 bp, Sorghum bicolor
  misc_feature: Ceres ANNOT ID no. 8658096
  misc_feature: Encodes the peptide sequence at SEQ ID NO 16503
atggcgcatgggagggggacctgtgctgtctgcctgccccaagtgccgagcacgaccagagcaggttgcgccacgcagagaaagctgcctgtgaccgttgaacaacgcgtctgctctgctacatctattatattgattcagcctttctggggtgttgctttcagcaaagccaggaaaaagaacatattacacacactgcggtttacagtgcactcatggcatcaggatacgtatttgctgcgacttgagcatcagcgtttgcgcgcccaccaagcaaattggatggcaattattgcgtgggtggcgacggatccgtcggttggccagaaccgcgactccaagtgtatgtacgcacagtcgtacaccgtctttaacctagaccttaggcatatgatacctgtccgtccgagcagggtggcccaccctatggccctctgcgagtggggacaccaccagccctgccgctggtctggtcaggttcatgctctgttctgccgtctggggtctccgtccatacatgacagcaatgggaggggagccacagggatagctgaacggtgtggtgccggaccgggcaagtggcgcctgggccccagttgttcggacttcggacaaccagtcgattgtgatctttgccttgtgcattcaagttacagcgcagcaagacggagaaacaagaatcatccctcgcctattactactactcatgcatgcgcactgcctcctggtgccgcgtatgaaccagacatgaatagggggcacagcagcagctccaagctcatcaacgagaagctcgaggaacaccggatctccaccgcgaagcactgcccccactgcggcgagaaaatcgacagcaaaccgaaggattgggtggggctgccggcaggcgtcaagttcgatccaactgaccaggagctgatcgagcacctcgaggcgaaagtgaaggatgaaggctcgagatctcaccctctcatcgatgagttcatacccacgatagatggggaggacggcatatgttacacccaccccgagaaacttccaggtgtgacgagggatggcctaagcaagcacttcttccaccggccgtccaaggcctacacgacgggcacgaggaagaggaggaagatacagacggagtgtgatgtccacaagggcgagacgaggtggcacaagactggaaagacgcggcccgtgatggtgaacggccggcagaaggggtgcaagaagatattggtactgtacactaactttggcaagcaccgcaagccggagaagacgaactgggtcatgcaccagtaccacctcggcgacctagaagaggagaaggagggggagctggtggtgtgcaagatcttctaccagacacaacccaggcagtgcagctggtcctctgatcggggcaccgccgccactgctgccatggcagcaacgacgatggcggcgcaggagcagcataggagggatagtggcagtggcagctgctcgtctagggaccacgaagtgtcagcgacatcgttcccggccggatacacagtcaccacggccgtcgagatgcagcagcatatgaagcagcctgcggaccatttcagcttcgcgcctttcaggaaaaccttcgatcaggaggttggtataggtggtgatcaggtgccatctaatcagcttggacgatcagagccgcatcatgccggccaggggcagcagccacacggtccagtgctctcgacgacgacggccgtgcctgctacagctttcctgatcagtaggccatcgaaccccgtctcgactatagtgccacctgaaatgcagcacgcatcggttgttctcgatcatgatcagttccatgtgccagcaatccttctccatcaccatgacaaatttcagcctcagcaccaacagcatcagccacaacaaaagcttgaccgcaggtctgccggcttggaagaactgataatgggatgcacgtcgtccacaagcacgaaaggggaaacttcaattgctcacccccaagagacagaatggccttacccgtactggccacctgacaaccaagatcatcatggatag

SEQ ID NO: 16503 - protein, 687 aa, Sorghum bicolor
  misc_feature: The sequence is a functional homolog of SEQ ID NO 1710 in the 10/374,780 US patent application
  misc_feature: The sequence is a functional homolog of SEQ ID NO 1713 in the 10/374,780 US patent application
  misc_feature: The sequence is a functional homolog of SEQ ID NO 318 in the 10/374,780 US patent application
  misc_feature: The sequence is a functional homolog of SEQ ID NO 848 in the 10/225,066 US patent application
  misc_feature: The sequence is a functional homolog of SEQ ID NO 210 in the 10/666,642 US patent application
  misc_feature: Useful for making plants with altered carbohydrate content
  misc_feature: Functional homolog of the protein sequence given in SEQ ID NO 14394
  misc_feature: The sequence is a functional homolog of SEQ ID NO 562 in the 11/435,388 US patent application
  misc_feature: Ceres ANNOT ID no. 8658096
  misc_feature (293)..(436): Pfam ID: NAM Pfam Description: No apical meristem (NAM) protein
MAHGRGTCAVCLPQVPSTTRAGCATQRKLPVTVEQRVCSATSIILIQPFWGVAFSKARKKNILHTLRFTVHSWHQDTYLLRLEHQRLRAHQANWMAIIAWVATDPSVGQNRDSKCMYAQSYTVFNLDLRHMIPVRPSRVAHPMALCEWGHHQPCRWSGQVHALFCRLGSPSIHDSNGRGATGIAERCGAGPGKWRLGPSCSDFGQPVDCDLCLVHSSYSAARRRNKNHPSPITTTHACALPPGAAYEPDMNRGHSSSSKLINEKLEEHRISTAKHCPHCGEKIDSKPKDWVGLPAGVKFDPTDQELIEHLEAKVKDEGSRSHPLIDEFIPTIDGEDGICYTHPEKLPGVTRDGLSKHFFHRPSKAYTTGTRKRRKIQTECDVHKGETRWHKTGKTRPVMVNGRQKGCKKILVLYTNFGKHRKPEKTNWVMHQYHLGDLEEEKEGELVVCKIFYQTQPRQCSWSSDRGTAATAAMAATTMAAQEQHRRDSGSGSCSSRDHEVSATSFPAGYTVTTAVEMQQHMKQPADHFSFAPFRKTFDQEVGIGGDQVPSNQLGRSEPHHAGQGQQPHGPVLSTTTAVPATAFLISRPSNPVSTIVPPEMQHASVVLDHDQFHVPAILLHHHDKFQPQHQQHQPQQKLDRRSAGLEELIMGCTSSTSTKGETSIAHPQETEWPYPYWPPDNQDHHG

SEQ ID NO: 16504 - DNA, 243 bp, Sorghum bicolor
  misc_feature: Ceres ANNOT ID no. 8658103
  misc_feature: Encodes the peptide sequence at SEQ ID NO 16505
atgtcgcttagcacatcgtgtgtatgtctaggtgtagacattgaagcaaaaaaaatttcacgcttgaagaatgcgcacctgagggcgctccccggcgcggcggagaggctggcgctgtgcaaggccgacctactcgactacgacgtgctgcggtcgaccgtttccggctgccacggcgtcttccacaacgcgtcgcccggatccaatccggtatgtatacgtgtaacctatagtagtacttga

SEQ ID NO: 16505 - protein, 80 aa, Sorghum bicolor
  misc_feature: Useful for making plants with altered carbohydrate content
  misc_feature: Functional homolog of the protein sequence given in SEQ ID NO 14118
  misc_feature: Useful for making plants with altered cell wall content and/or composition
  misc_feature: Useful for making plants with altered lignin content
  misc_feature: Functional homolog of the protein sequence given in SEQ ID NO 13818
  misc_feature: Ceres ANNOT ID no. 8658103
  misc_feature (23)..(66): SWISSPROT Homolog: EC 1.1.1.219 Dihydrokaempferol 4-reductase
MSLSTSCVCLGVDIEAKKISRLKNAHLRALPGAAERLALCKADLLDYDVLRSTVSGCHGVFHNASPGSNPVCIRVTYSST

SEQ ID NO: 16506 - DNA, 705 bp, Sorghum bicolor
  misc_feature: Ceres ANNOT ID no. 8658105
  misc_feature: Encodes the peptide sequence at SEQ ID NO 16507
atggcgtggcgtggcccgctcggagccggagacgccggggacagcggcctcgagctcagcctcggcctcccggcctacttcgccaagccatcatcaggtttggacgtcgccgccggcgaggagtccggtgaggcctctgctttcgctcaccaggctgccaatgggagcaatggctccaaagcaagggtcaggccagcacccgcggcgccggtggttgggtggccgccggtgcggtcgttccggaggaacctggcctcgtcctcctcctcaaggccgtcgccgccgtcgtcgtcgggtcaccacaaggttcaggacggcggcgcgcacaagggcggactgttcgtgaagatcaacatggacggcgtgccgatcgggcggaaagtggacctcaccgcgtacggcggctacgccgacctctccgccgccgtcggcaagctcttccgcggcctgctcgccgctcagagggacccggccgcgacggcgggtggcgaggcggcggcggaggaggaggtgcaggagccggtgatcggcggcgactacacgctggtgtacgaggacgacgagggagacagggtccttgtcggcgacgtcccctgggagatgttcgtggccaccgccaagaggctgcgcgtgctcaagagctccgacgtgccggcatcgtcgctgagagcagggggcaggaagagggctgcagccgattgctga

SEQ ID NO: 16507 - protein, 234 aa, Sorghum bicolor
  misc_feature: The sequence is a functional homolog of SEQ ID NO 1757 in the 11/479,226 US patent application
  misc_feature: Useful for making plants with altered alkaloid content
  misc_feature: Functional homolog of the protein sequence given in SEQ ID NO 13232
  misc_feature: Useful for making plants with altered lignin content
  misc_feature: Useful for making plants with modulated nitrogen use efficiency
  misc_feature: Functional homolog of the protein sequence given in SEQ ID NO 13704
  misc_feature: Ceres ANNOT ID no. 8658105
  misc_feature (18)..(226): Pfam ID: AUX_IAA Pfam Description: AUX/IAA family
MAWRGPLGAGDAGDSGLELSLGLPAYFAKPSSGLDVAAGEESGEASAFAHQAANGSNGSKARVRPAPAAPVVGWPPVRSFRRNLASSSSSRPSPPSSSGHHKVQDGGAHKGGLFVKINMDGVPIGRKVDLTAYGGYADLSAAVGKLFRGLLAAQRDPAATAGGEAAAEEEVQEPVIGGDYTLVYEDDEGDRVLVGDVPWEMFVATAKRLRVLKSSDVPASSLRAGGRKRAAADC

SEQ ID NO: 16508 - DNA, 1647 bp, Sorghum bicolor
  misc_feature: Ceres ANNOT ID no. 8658139
  misc_feature: Encodes the peptide sequence at SEQ ID NO 16509
atggaggtcgccgtcgaaaggccgccgccggcgccgcaggtgaaggcggaggagaagagacccgacgccaagccagagatcgccgcccggccaccgatggtaggaagcgctcttccgatagtcttcgaaagctttccatcgacgcaaagagacgcggccggcggcatcaacgtcaagcaggaggaacgcaggctggaggcggccagggcggagatgggcgaggtgagggaggagaacgagcgcctcaagtcgatgctgtcccgcatcgtcagccagtaccagtccctgcagatgcacttcctcgacgtcgtcaaggtgcaggagcaagcatcgtctgcagccaaggtggccgagaagaagctccccgtcgcgccggcgccggcgccgaatcccggcaccgacgacgacggccccgacgacctcgtctccctgagcctcggcaccagggcaaatagcggtggcgcaccccgccgcaaggggcacgagaggtcgtcgtcctcgtccggcaccgctgagacaaccaccgccgccgacgctgatgaccaaggccaccaccagctctccctcggtcttggtttcgcgcgcggaaacgggctgccgtcgtccaccacgacggccacggacgacgacaaggcgagccacgcgtccacggcgcccgtcctgaacctgacctccgacagcagcggcagtgccgacgacaacgacgacgccaagcctgccctggcggccgcgggcacagcccgtaagagcccgagcgccggtgccggtgccggagacagatcagctgacgatgaggtgcagcagcaggccaagaaggctagggtttccgtcagggtcaaatgcgacactcccacgatgcccgatggctgccaatggcgcaagtacgggcagaagatctccaaggggaacccgtgcccgcgcgcctactaccgctgcacggtggcggcgcactgcccggtgagaaagcaggtgcagcggtgcgcggaggacacgtcgatcctgatcaccacgtacgagggcgcgcacaatcacccgctaacgccggcggcgacggccatggcgtccacgacctccgcggcggtggccatgctcacctcgggctccaccacctccgccgcctcggcctcgctcgtccacggccacggccacccgctgccggccgccgccgggctgttcggccccaccaccatggtctccaccgccgcgtcctgccccaccatcacgctcgacctcacctcccccgccgcgccgcactccctcatgcactcctcgccctacgccgccgccgcagcagcagcagcagcagcggggttcgagtccaaggcgttcccggcggcgtggagcaacgggtacctggcgtacggcggcgcccacccgtcctactactccaagagctcgacgtcgccggctctggggcacctgttcggtggaagcctgggcgtgccatcgagaccggaacagctgtacgcccagtcgtacctgcagagagccagcagcctgggcggcggccatggcgcggtggcgccggcggccgtcacggacacgctcgcgaaggcgatcacgtccgatccgagcttccagtccgccctggccgcggcgatcacgtccgtcatgggccgcggcggggccgctgctgcccagaagtga

SEQ ID NO: 16509 - protein, 548 aa, Sorghum bicolor
  misc_feature: The sequence is a functional homolog of SEQ ID NO 114 in the 11/375,241 US patent application
  misc_feature: The sequence is a functional homolog of SEQ ID NO 146 in the 10/286,264 US patent application
  misc_feature: The sequence is a functional homolog of SEQ ID NO 2500 in the 10/374,780 US patent application
  misc_feature: The sequence is a functional homolog of SEQ ID NO 672 in the 10/412,699 US patent application
  misc_feature: Ceres ANNOT ID no. 8658139
  misc_feature (286)..(346): Pfam ID: WRKY Pfam Description: WRKY DNA -binding domain
MEVAVERPPPAPQVKAEEKRPDAKPEIAARPPMVGSALPIVFESFPSTQRDAAGGINVKQEERRLEAARAEMGEVREENERLKSMLSRIVSQYQSLQMHFLDVVKVQEQASSAAKVAEKKLPVAPAPAPNPGTDDDGPDDLVSLSLGTRANSGGAPRRKGHERSSSSSGTAETTTAADADDQGHHQLSLGLGFARGNGLPSSTTTATDDDKASHASTAPVLNLTSDSSGSADDNDDAKPALAAAGTARKSPSAGAGAGDRSADDEVQQQAKKARVSVRVKCDTPTMPDGCQWRKYGQKISKGNPCPRAYYRCTVAAHCPVRKQVQRCAEDTSILITTYEGAHNHPLTPAATAMASTTSAAVAMLTSGSTTSAASASLVHGHGHPLPAAAGLFGPTTMVSTAASCPTITLDLTSPAAPHSLMHSSPYAAAAAAAAAAGFESKAFPAAWSNGYLAYGGAHPSYYSKSSTSPALGHLFGGSLGVPSRPEQLYAQSYLQRASSLGGGHGAVAPAAVTDTLAKAITSDPSFQSALAAAITSVMGRGGAAAAQK

SEQ ID NO: 16510 - DNA, 498 bp, Sorghum bicolor
  misc_feature: Ceres ANNOT ID no. 8658175
  misc_feature: Encodes the peptide sequence at SEQ ID NO 16511
atggacgcgaggatgttcggtctcgagaccccgctgatggtggcgctgcagcacctgctggacgtgcccgacggcgacgccggcgcggcgggcggcgacaaggcgggcgccggcgcgggcggcggggccacgcgcacctacgtccgcgacgcgcgcgccatggcggccaccccggccgacgtcaaggagcttccgggcgcgtacgcgttcgtggtggacatgccggggctgggcacgggcgacatcaaggtgcaggtggaggacgaccgggtgctggtgatcagcggcgagcggcgccgggaggagcgcgaggacgccaagtacctgcgcatggagcggcggatgggcaagttcatgcgcaagttcgtgctcccggacaacgccgacatggacaagatctcggccgtgtgcagggacggcgtgctcacggtcaccgtcgacaagctgcccccgcctgagcccaagaagcccaagaccatcgaggtcaaggtcgcctga

SEQ ID NO: 16511 - protein, 165 aa, Sorghum bicolor
  misc_feature: Useful for making plants with modulated heat sensitivity
  misc_feature: Functional homolog of the protein sequence given in SEQ ID NO 14395
  misc_feature: Useful for making plants with modulated drought sensitivity
  misc_feature: Useful for making plants with modulated water use efficiency
  misc_feature: Functional homolog of the protein sequence given in SEQ ID NO 14396
  misc_feature: Ceres ANNOT ID no. 8658175
  misc_feature (60)..(163): Pfam ID: HSP20 Pfam Description: Hsp20/alpha crystallin family
MDARMFGLETPLMVALQHLLDVPDGDAGAAGGDKAGAGAGGGATRTYVRDARAMAATPADVKELPGAYAFVVDMPGLGTGDIKVQVEDDRVLVISGERRREEREDAKYLRMERRMGKFMRKFVLPDNADMDKISAVCRDGVLTVTVDKLPPPEPKKPKTIEVKVA

SEQ ID NO: 16512 - DNA, 861 bp, Sorghum bicolor
  misc_feature: Ceres ANNOT ID no. 8658195
  misc_feature: Encodes the peptide sequence at SEQ ID NO 16513
atggcgctgggccacggtggccagcacatgacctcgtcgtccaccgccggagccgccggcggcatggcggccgcctcgtcgtcgtccacccccaccataaccttcgcgttccaaccgtcccctccgccgacgagcggcctcgccctcgcccaccatggcgtgctaggttacggctcctcttcccttctcctggaccaccaccaccacccaacaaccaccaccacctcctcggcggcctcttcctcgcacgcggcttcgtccatcaccctccaccaccacctccatggccatgcagcagcagcagcgccgcacgcttccctttcccctcccacgagggcgtcgcctcctcctcacccatggtcgacgacgacgacggcctgcgaagaagcaggagggccggcgccggcgcatgatcgccaagcaggccaacaaggcgggaggccgccgagggggaagggagctgctccggtgatcagcgaggggtcggcggcggcggcgctgggggtgggcgccgtgaggatgaagaaggcgggcggcggcggaggaggaggaggagggaaggcgcggcggaaggtgcgcgagccgcggttctgcttcaagacgatgagcgacgtcgacgtgctcgacgacggctacaagtggcgcaagtacggccagaaggtcgtcaagaacacgcagcacccaaggagctactaccgttgcacgcaggacaactgtagggtgaagaagcgggtggagcggctagctgaggaccctcgcatggtgatcaccacctacgagggccgccatgtccactccccgtcccgcgacgatgacgacgacgctgcgcgcgccaacgccgagatgagcttcatctggtag

SEQ ID NO: 16513 - protein, 286 aa, Sorghum bicolor
  misc_feature: The sequence is a functional homolog of SEQ ID NO 114 in the 11/375,241 US patent application
  misc_feature: The sequence is a functional homolog of SEQ ID NO 146 in the 10/286,264 US patent application
  misc_feature: The sequence is a functional homolog of SEQ ID NO 2500 in the 10/374,780 US patent application
  misc_feature: The sequence is a functional homolog of SEQ ID NO 672 in the 10/412,699 US patent application
  misc_feature: Ceres ANNOT ID no. 8658195
  misc_feature (208)..(267): Pfam ID: WRKY Pfam Description: WRKY DNA -binding domain
MALGHGGQHMTSSSTAGAAGGMAAASSSSTPTITFAFQPSPPPTSGLALAHHGVLGYGSSSLLLDHHHHPTTTTTSSAASSSHAASSITLHHHLHGHAAAAAPHASLSPPTRASPPPHPWSTTTTACEEAGGPAPAHDRQAGQQGGRPPRGKGAAPVISEGSAAAALGVGAVRMKKAGGGGGGGGGKARRKVREPRFCFKTMSDVDVLDDGYKWRKYGQKVVKNTQHPRSYYRCTQDNCRVKKRVERLAEDPRMVITTYEGRHVHSPSRDDDDDAARANAEMSFIW

SEQ ID NO: 16514 - DNA, 1479 bp, Sorghum bicolor
  misc_feature: Ceres ANNOT ID no. 8658220
  misc_feature: Encodes the peptide sequence at SEQ ID NO 16515
atgccggccatggtggaggaggaggtcgtcatcaggggggcagcggcggcgcccgagccggagccgcacttcctggtggtgaccttcccggcaatgggccacatcaacccggcgcgccacctcgcgcgccgcctgctgcgcgccacgggggcgcgggtcaccgtctccacgtccgtgttcgcgctccgcaagatgttcccgggcgccgccgccgagacggagccggagggccaccgcgacgcctcgggggtgtggtacgtgccctactccgacggctacgacgacgggttcgacaaagccgtgcacgacgccacgcactacatggaccagatcaagctggaggggtcgcgcacgctggggaacgtcctcgaccgcctccgcgacgccggcaggcccgtcacgctcgtcgtgtacacgctgctgctgtcgtgggtggccgacgtggcgcgcgcccacgccgtgcccgccgcgctctactggatccagccggccaccgtgctcgccgcctacctccacttcttccgcgccacggacggcgtcgacgcggccatcgccgcggcgggcggcgacccgtgggcgaccgtccggttcccgggcctcccgccgctccgcgtccgcgacctgccgtcgttcatcgtctccacctccgagaacgacccctacgcgttcgtcgtcgacgcgttccgccagctcatcgagctgctggacggcgaggacagccccagcgtgctcgccaacacgttcgacgctatggagcccgagggggtggcgtcgctgcgggaccacggtgtggacgtggtccccgtcggccccgtcctctccttcctcgacgacgacgacgacgacgacgcggcggccggcggcgggaacgacctgttcagtcaggacggcaagggctacctcgactggctggacgcgcaggcgccgggctccgtggtgtacatctcgttcgggagcctgtcggtgatgagcgagcggcagatcgaggaggtggcccggggcatgtccgagagcggccgcccatttctgtgggtgctgcgggaggacaaccggagcagcgagggcgccgcgccgctcggcggggagcgcggcatggtggtggggtggtgcgaccaggtgcgcgtgctgtcgcacccggccgtgggctgcttcgtcacgcactgcgggtggaactccacgctggagagcatggcgtgcggcgtccccgtcgtctgcgtgccgcagtggacggaccagggcaccaacgcgtggctagtggagaggatcggcaccggcgtcagggccgccgtcagcgacaaggacggcgtgctggaggccgacgagctgcggaggtgcctcgacttcgccacctccgagatggtgcgcgccaaggccgccgtgtggagggagaaggcgcgcgccgccgcgtcggagggcggctcgtcggagaggaacctcaaggcgttcgtcgccaagcagatcgccggcggcaacaactag

SEQ ID NO: 16515 - protein, 492 aa, Sorghum bicolor
  misc_feature: Useful for making plants with altered carbohydrate content
  misc_feature: Functional homolog of the protein sequence given in SEQ ID NO 14397
  misc_feature: Ceres ANNOT ID no. 8658220
  misc_feature (301)..(451): SWISSPROT Homolog: EC 2.4.1.210 Limonoid glucosyltransferase
  misc_feature (26)..(490): Pfam ID: UDPGT Pfam Description: UDP-glucoronosyl and UDP-glucosyl transferase
MPAMVEEEVVIRGAAAAPEPEPHFLVVTFPAMGHINPARHLARRLLRATGARVTVSTSVFALRKMFPGAAAETEPEGHRDASGVWYVPYSDGYDDGFDKAVHDATHYMDQIKLEGSRTLGNVLDRLRDAGRPVTLVVYTLLLSWVADVARAHAVPAALYWIQPATVLAAYLHFFRATDGVDAAIAAAGGDPWATVRFPGLPPLRVRDLPSFIVSTSENDPYAFVVDAFRQLIELLDGEDSPSVLANTFDAMEPEGVASLRDHGVDVVPVGPVLSFLDDDDDDDAAAGGGNDLFSQDGKGYLDWLDAQAPGSVVYISFGSLSVMSERQIEEVARGMSESGRPFLWVLREDNRSSEGAAPLGGERGMVVGWCDQVRVLSHPAVGCFVTHCGWNSTLESMACGVPVVCVPQWTDQGTNAWLVERIGTGVRAAVSDKDGVLEADELRRCLDFATSEMVRAKAAVWREKARAAASEGGSSERNLKAFVAKQIAGGNN

SEQ ID NO: 16516 - DNA, 1227 bp, Sorghum bicolor
  misc_feature: Ceres ANNOT ID no. 8658240
  misc_feature: Encodes the peptide sequence at SEQ ID NO 16517
atggctcagactggaaacttgagccaacgcgatcacacaattgacataccaatgagtgatggtacctccccatcaacatctcaccaggatgatcccagtggcttggatgagttgcatcacagcagaggtccttcaaatgaagttccaccaggaccagaaagatcttctggcacaaatgatgcatctgactctcataatgcatcctctgcaagaatagatcgaggccatcgtcaacagaatcctttgaactctggcttctggatctcaatcgagcttattgtaaaccttagccagattgtagcagctattgctgttctgtctgtatcaaggaatgagcacccacacgctccattatttacgtggcttcttggctatacaatcggttgtatcgctattcttccacatctttattggcgctatcttcaccgcaaccgcccgaacatggagcaggagatgacaccacaaagtttgtcagaacggaacatgtctgagactaattcttatgcagcagtctcatctcctcgcacatcagaagctgtggacggtaccaacagtactggagtctcaagaatgaacttaccactggcaagtccaaggttttacgcaatggtcgcttgctttaaattgatgctggattgtttctttgctgtctggtttgtcgtgggaaatgtgtggatatttggtagtcgttcttctgcccatgatgcccctaacttgtacaggatctgtatagtatttcttgcgttcggcttcattgtctatgcgctgcctttcattttatgtacaatgatatgctgctgcctgccctgtataatatccattctgggcgtccatgaggatttggatctgaacagaggcgctaccacggaggcgatcaataccttggtggcttacaagttccaatcgaaaagagttcatgatggggatgtgggagaagatggtggtggagtcttggcggctggaactgacaaggagcgaattatttctgcagaagatgctatttgctgcatctgcctgtcaaagttctcaaacaatgaagatttgcgcgaacttccttgtgcacatgtcttccacatggaatgcatagataaatggctccagataaacgcgttgtgccctctttgcaaggctgagatagggggctcaacaacaagtaatccggagagtggctctgtgggtcctgacaacgccaacagagtaggcaatgacgtcgagtcacaacggtag

SEQ ID NO: 16517 - protein, 408 aa, Sorghum bicolor
  misc_feature: The sequence is a functional homolog of SEQ ID NO 2 in US patent 7053203
  misc_feature: Ceres ANNOT ID no. 8658240
  misc_feature (319)..(379): SWISSPROT Homolog: EC 6.3.2.19 Ubiquitin--protein ligase
  misc_feature (335)..(375): Pfam ID: zf-C3HC4 Pfam Description: Zinc finger, C3HC4 type (RING finger)
MAQTGNLSQRDHTIDIPMSDGTSPSTSHQDDPSGLDELHHSRGPSNEVPPGPERSSGTNDASDSHNASSARIDRGHRQQNPLNSGFWISIELIVNLSQIVAAIAVLSVSRNEHPHAPLFTWLLGYTIGCIAILPHLYWRYLHRNRPNMEQEMTPQSLSERNMSETNSYAAVSSPRTSEAVDGTNSTGVSRMNLPLASPRFYAMVACFKLMLDCFFAVWFVVGNVWIFGSRSSAHDAPNLYRICIVFLAFGFIVYALPFILCTMICCCLPCIISILGVHEDLDLNRGATTEAINTLVAYKFQSKRVHDGDVGEDGGGVLAAGTDKERIISAEDAICCICLSKFSNNEDLRELPCAHVFHMECIDKWLQINALCPLCKAEIGGSTTSNPESGSVGPDNANRVGNDVESQR

SEQ ID NO: 16518 - DNA, 1170 bp, Sorghum bicolor
  misc_feature: Ceres ANNOT ID no. 8658260
  misc_feature: Encodes the peptide sequence at SEQ ID NO 16519
atgccgacgccgtcgcacctcgcgaacccgcgctacttcgacttccgtgcggcgcggcgggtgccggagacgcacgcctggccggggctgcacgaccaccccgtcgtggacggcggcgcgccggggccagacgccgtccccgtggtggacctcgcgggggcggcggacgagccgagagccgcggtggtggcccaagtggcgcgcgccgccgagcaatggggcgcgttcctgctcacggggcacggcgtccccgcggagctgctggcgcgcgtcgaggaccggatcgccaccatgttcgcgctgccagcggacgacaagatgcgcgccgtgcgcgggcctggcgacgcctgcggctacggctccccgcccatctcctccttcttctccaagtgcatgtggtcggagggatacaccttctcgccggccaacctccgcgccgacctccgcaagctctggcctaaggccggcgacgactacaccagcttctgtgatgtgatggaggagttccacaagcacatgcgtgccctcgcggacaagctgctggagctgttcctcatggcgctggggctcaccgacgagcaggtcggcggcgtggaggcggagcggaggatcgccgagacgatgaccgccaccatgcacctcaactggtaccctcggtgcccggacccgcgccgcgcgctggggctgatcgcgcacaccgactcgggcttcttcaccttcgtgctgcagagcctcgtcccggggctgcagctcttccgccacgccccggaccggtgggtggcggtgccggcggtaccgggcgccttcgtcgtcaacgtgggcgacctcttccacatcctcaccaacggccggttccacagcgtgtaccaccgcgccgtcgtgaaccgggacctcgacaggatatctctcggctacttcctcggcccgccgccgcacgccaaggtggcgccgctaagggaggccgtgccgcccggccgcacccccgcgtaccgcgccgtcacgtggcccgagtacatgggcgtccgcaagaaggccttcaccaccggcgcatccgcgctcaagatggtcgccctcgccgccgccgccgccgccgccgacctcgacgatgacgccggtgctggcgccgccgccgaacctgtcgtccatcagcagctactcgtctcgtcgtag

SEQ ID NO: 16519 - protein, 389 aa, Sorghum bicolor
  misc_feature: The sequence is a functional homolog of SEQ ID NO 2 in US patent 7049490
  misc_feature: Ceres ANNOT ID no. 8658260
  misc_feature (1)..(356): SWISSPROT Homolog: EC 1.14.11.15 Gibberellin 3-beta-dioxygenase
  misc_feature (208)..(309): Pfam ID: 2OG-FeII_Oxy Pfam Description: 2OG-Fe(II) oxygenase superfamily
MPTPSHLANPRYFDFRAARRVPETHAWPGLHDHPVVDGGAPGPDAVPVVDLAGAADEPRAAVVAQVARAAEQWGAFLLTGHGVPAELLARVEDRIATMFALPADDKMRAVRGPGDACGYGSPPISSFFSKCMWSEGYTFSPANLRADLRKLWPKAGDDYTSFCDVMEEFHKHMRALADKLLELFLMALGLTDEQVGGVEAERRIAETMTATMHLNWYPRCPDPRRALGLIAHTDSGFFTFVLQSLVPGLQLFRHAPDRWVAVPAVPGAFVVNVGDLFHILTNGRFHSVYHRAVVNRDLDRISLGYFLGPPPHAKVAPLREAVPPGRTPAYRAVTWPEYMGVRKKAFTTGASALKMVALAAAAAAADLDDDAGAGAAAEPVVHQQLLVSS

SEQ ID NO: 16520 - DNA, 1185 bp, Sorghum bicolor
  misc_feature: Ceres ANNOT ID no. 8658257
  misc_feature: Encodes the peptide sequence at SEQ ID NO 16521
atgggtagcttcgctaagctggcgaagagggcggtggagacggacgcgccggtcatggtgaagatacaagaactgcttcgaggggccacggatgtcatgtcgcttgcgcagggagttgtttactggcaacctcctgagtcagctctggataagatcgaaaaaatcgtcagggaaccaacagtcagtaagtatggttctgatgatggacttcctgagcttcgagaagcacttctcgaaaagctacgcagagagaataagcttaccaagtcatcagtcatggtcactgctggtgcaaatcaggcttttgtgaacttggtcctcactctttgtgatgctggtgattctgttgtcatgtttgcaccatattatttcaatgcctacatgtcattccagatgacaggtgttactgacatattaattggtggttgcgatcccaagacacttcatcctgatgttgattggttggagaaggttctgaaagaaaatgaccctatccctaaacttgttactgttgtgaatccggggaacccctctggagcttttgttcccaggcctatgcttgagagaatttcagatctgtgcaaaaatgctggtgcatggcttgtggttgacaatacctatgaatactttatgtatgatggaatggagcactattgcttagaagatactcatattgtcaacctcttctcattctcaaaggcttatggaatgatggggtggcgtgtaggatacattgcatttccaaatgaagctgatggcttccacgatcagctcctcaaagtgcaagacaacatacctatctgtgcctccatcatcgggcagcgcctggcgctctactcactggaggctggccccgagtggatcaaagaaagggtgaaagacttggtgaaaaaccgagcactgctcgtggaggcgctgtccccgctcggtgaggacaatgtgaagggcggggagggcgccatctacctctgggccaaactgccggacaactgctccaacgattttgaagttgtcaggtggcttgcaaacaagcacggtgtcgctgtgatccctggcagcgccagtggaggccccggatacatccgcgtctccttcggagggctcaaagaagaagacaccaggctcgctgctgagaggctaaggcgcggcttgcaggagctggtgactgatggaatggtacagtaa

SEQ ID NO: 16521 - protein, 394 aa, Sorghum bicolor
  misc_feature: Useful for making plants with modulated nitrogen use efficiency
  misc_feature: Functional homolog of the protein sequence given in SEQ ID NO 14398
  misc_feature: Ceres ANNOT ID no. 8658257
  misc_feature: Up-regulated in shoot tissues in response to methyl jasmonate treatment
  misc_feature: Up-regulated in root tissues in response to methyl jasmonate treatment
  misc_feature (10)..(380): SWISSPROT Homolog: EC 2.6.1.1 Aspartate transaminase
  misc_feature (30)..(380): Pfam ID: Aminotran_1_2 Pfam Description: Aminotransferase class I and II
MGSFAKLAKRAVETDAPVMVKIQELLRGATDVMSLAQGVVYWQPPESALDKIEKIVREPTVSKYGSDDGLPELREALLEKLRRENKLTKSSVMVTAGANQAFVNLVLTLCDAGDSVVMFAPYYFNAYMSFQMTGVTDILIGGCDPKTLHPDVDWLEKVLKENDPIPKLVTVVNPGNPSGAFVPRPMLERISDLCKNAGAWLVVDNTYEYFMYDGMEHYCLEDTHIVNLFSFSKAYGMMGWRVGYIAFPNEADGFHDQLLKVQDNIPICASIIGQRLALYSLEAGPEWIKERVKDLVKNRALLVEALSPLGEDNVKGGEGAIYLWAKLPDNCSNDFEVVRWLANKHGVAVIPGSASGGPGYIRVSFGGLKEEDTRLAAERLRRGLQELVTDGMVQ

SEQ ID NO: 16522 - DNA, 1458 bp, Sorghum bicolor
  misc_feature: Ceres ANNOT ID no. 8658267
  misc_feature: Up-regulated in shoot tissues in response to methyl jasmonate treatment
  misc_feature: Up-regulated in root tissues in response to methyl jasmonate treatment
  misc_feature: Encodes the peptide sequence at SEQ ID NO 16523
atggcttcttcgccgtccgacctaaccctagactacaagcccaacggcaacgccgccgcctacgcagtgacgatcccgaagccgcagcaggagccgctcgtcgacggccaccatcaccaccaccatctgacgacggcggagcaggcgacgcagaagctccgggagttcctcgcccgcctggaggaggagtggctcaagatcgacgcctttaagcgcgagctccccctctgcatgcagctcctcaaccacggtggcgcgccggcgaggcccctggtgctcgaggagttcatgccgctcaagaacatcgggatcgacgccgccgccgccgacaagatggggaacccgccgtcggagaaggcgagctggatggagtcggcgcagctctggaacgggcccgccgcggccacggcggccgacatggcggcgaaagggccgcagacgcccaaggagagctcggagcacccgctcccgatcgacacgctctgcgcgcacgacgccgctgcggccgggcagcgcaacggcggcggtgcgttcctcccgttcgccaaggacaagaccgcgtccgccgcggaaggcgcggcgctgccggagctcgccctcgcgcccgcggacaaagacgcgggtgacgccgagaggaagccgtacctcgacgccagcagcaacaacggcgtcctgggcgcgcggagagacgtagtacagaacggcgtcaagccggggacgaacgccccggaagggcagcaggcagccgcgacgccgccgccgcagacgcaccgcaaggcgcggcggtgctggtcgccggagctgcaccgccgcttcgtcaatgccctccagatcctcggcggcgctcaagtggcgaccccgaagcagatccgcgagctgatgaaggtggatggattgaccaatgatgaggtgaaaagccatctccagaagtacaggctgcacacacggcggccgatgccggcgccgcccgcgccggcgaccgcggcgccacagctagtggtcctcggcggcatctgggtcccgccggagtacgcgacgcaggcggcgggccaggccatctacggcgcgcacccggcgacgcagccgcactacacggcggcggtggcggcgcaggagtactacccgtcccccgccgcggtgcaccacctgcagcaccacccggcggccgccgcagccgccatggtgcaccgtgcggccgcggcaccgcagcaggccgcgtacaaggcggcggcggcggcaatggcgggctcgccgccgggatcggaggggcggggcagcgccggaggaggcagtgtcggcggcggcggaggcggcagggagaggtcggagagcatcgaggaggaaggcgagggcgaggagcgggaagaggatgacgacgacgacgacgacgacatggcggccgccaaggccgacggcgaggaggccgccgccggtgccggagccggcgtcaagtactaa

SEQ ID NO: 16523 - protein, 485 aa, Sorghum bicolor
  misc_feature: The sequence is a functional homolog of SEQ ID NO 1995 in the 11/479,226 US patent application
  misc_feature: The sequence is a functional homolog of SEQ ID NO 1996 in the 11/479,226 US patent application
  misc_feature: The sequence is a functional homolog of SEQ ID NO 1997 in the 11/479,226 US patent application
  misc_feature: The sequence is a functional homolog of SEQ ID NO 1998 in the 11/479,226 US patent application
  misc_feature: The sequence is a functional homolog of SEQ ID NO 2001 in the 11/479,226 US patent application
  misc_feature: The sequence is a functional homolog of SEQ ID NO 2000 in the 11/479,226 US patent application
  misc_feature: The sequence is a functional homolog of SEQ ID NO 1999 in the 11/479,226 US patent application
  misc_feature: Ceres ANNOT ID no. 8658267
  misc_feature (261)..(312): Pfam ID: Myb_DNA-binding Pfam Description: Myb-like DNA-binding domain
MASSPSDLTLDYKPNGNAAAYAVTIPKPQQEPLVDGHHHHHHLTTAEQATQKLREFLARLEEEWLKIDAFKRELPLCMQLLNHGGAPARPLVLEEFMPLKNIGIDAAAADKMGNPPSEKASWMESAQLWNGPAAATAADMAAKGPQTPKESSEHPLPIDTLCAHDAAAAGQRNGGGAFLPFAKDKTASAAEGAALPELALAPADKDAGDAERKPYLDASSNNGVLGARRDVVQNGVKPGTNAPEGQQAAATPPPQTHRKARRCWSPELHRRFVNALQILGGAQVATPKQIRELMKVDGLTNDEVKSHLQKYRLHTRRPMPAPPAPATAAPQLVVLGGIWVPPEYATQAAGQAIYGAHPATQPHYTAAVAAQEYYPSPAAVHHLQHHPAAAAAAMVHRAAAAPQQAAYKAAAAAMAGSPPGSEGRGSAGGGSVGGGGGGRERSESIEEEGEGEEREEDDDDDDDDMAAAKADGEEAAAGAGAGVKY

SEQ ID NO: 16524 - DNA, 1458 bp, Sorghum bicolor
  misc_feature: Ceres ANNOT ID no. 8658282
  misc_feature: Encodes the peptide sequence at SEQ ID NO 16525
atggcggggcttcacttcttgctcgtgccgctggtggcacagggccacatcatcccgatggtggacctggcccgcctcctcgccggccggggcgcgcgagtcaccgtggtgaccacgcccgtcaacgccgcgcgcaaccgggccgtcgtcgacagcgcgcggcgggcgggcctcgacgtcgagctcgcggagatcgcgttccccggcccgggccacgggctgccggagggtctggagaacatggaccagctcacggagagggagcacttcctgcccttcttccaggccgcgtggagcatggacgcgccgctggaggagtacgtgcggtcgctgccccggcgcccggactgcctcatcgccgactcgtgcaacccgtggacggccgaggtgtgcgcacgccacggcatcccgcgcctggtgctgcactgcccgtccacctacttcctcctcgccatgcacagcctgtccaagcacggcgtccacgaccgcgtcgccgacgagctggagaccttcgagattcccgacttcccggtgcccgccgtcgcgaacaaggccacgttccgcggcttcttccagtggcccggcgtggagggcttccagcgcaacatcgccgaggccgaggccaccgccgacggcctgctcctcaacaccttccgcgacatcgagggtgtcttcatcgaccgctacgcggcggcgctgggacggaagacgtggaccatcgggccgatgtgcgcctccgtcggcggcttggacgcgcacgccagggccagcaggggcaaccgcccggacgtcgacgcagggattttcgtgtcgtggctagacgcccggccgccgtcgtccgtgctctacatcagcttcggcagcctcgcgcacctgccggcgaagcaggtcgtcgagctcggccgtggcctcgaggcgtcggagcggccgttcgtctgggccatcaaggaggccagttcgaacgccgacgtgcaggcgtggctcgccgaggggttcgaggaccgcgtcaaggacagggggctcctggtccgcggctgggcgccgcaggtgaccatcctctcgcacccggcggtgggcggcttcttgacacattgcgggtggaacgccgcgctggaagccatcgcccacggcgtgccggtgctgacgtggcccaacttttccgaccagttcagcagcgagcggctgctcgtcgacgtcctcgacgtcggcgtcaggtccagtgtcaaggtgcccgccatgttcttacccaaggaggccgagggggtgcaggtcacgagcgccggcgtggagaaggcggtggccgagctcatggacgaggggcccaaggggacggagaggagagcgagggccaaggagctcgccgccaaggcgaaggcagccatggaggaaggcgggtcgtcgtacgccgacttgaccgacatgatggaccacgtcgtggtgctcggcagacggcagtaa

SEQ ID NO: 16525 - protein, 485 aa, Sorghum bicolor
  misc_feature: Useful for making plants with altered carbohydrate content
  misc_feature: Functional homolog of the protein sequence given in SEQ ID NO 14399
  misc_feature: Ceres ANNOT ID no. 8658282
  misc_feature (1)..(475): SWISSPROT Homolog: EC 2.4.1.238 Anthocyanin 3'-O-beta-glucosyltransferase
  misc_feature (5)..(479): Pfam ID: UDPGT Pfam Description: UDP-glucoronosyl and UDP-glucosyl transferase
MAGLHFLLVPLVAQGHIIPMVDLARLLAGRGARVTVVTTPVNAARNRAVVDSARRAGLDVELAEIAFPGPGHGLPEGLENMDQLTEREHFLPFFQAAWSMDAPLEEYVRSLPRRPDCLIADSCNPWTAEVCARHGIPRLVLHCPSTYFLLAMHSLSKHGVHDRVADELETFEIPDFPVPAVANKATFRGFFQWPGVEGFQRNIAEAEATADGLLLNTFRDIEGVFIDRYAAALGRKTWTIGPMCASVGGLDAHARASRGNRPDVDAGIFVSWLDARPPSSVLYISFGSLAHLPAKQVVELGRGLEASERPFVWAIKEASSNADVQAWLAEGFEDRVKDRGLLVRGWAPQVTILSHPAVGGFLTHCGWNAALEAIAHGVPVLTWPNFSDQFSSERLLVDVLDVGVRSSVKVPAMFLPKEAEGVQVTSAGVEKAVAELMDEGPKGTERRARAKELAAKAKAAMEEGGSSYADLTDMMDHVVVLGRRQ

SEQ ID NO: 16526 - DNA, 1560 bp, Sorghum bicolor
  misc_feature: Ceres ANNOT ID no. 8658281
  misc_feature: Encodes the peptide sequence at SEQ ID NO 16527
atggcggagcttcacttcgtgctcgtcccgctggtggcgcagggccacatcatcccgatggtggacctggcgcgcctcctcgccggccgcggcgcgcgcgtcagcgtggtcaccacgcccgtcaacgccgcgcgcaaccgggccgtcgtcgacagcgcgcggcgggcggggctcgacgtcgagctcgcggaggtcgcgttccccggcccgggcctcgggctgccggacgggatggagaacgtcgacatggttgtggagaaagaccacttcatgcccttcttccaggccttgtggaagatggacgagccgctggacgagtacgtgcggtcgctgccccggcgtcccgactgcctcatcgccgactggtgcaacccgtggacggcagcggtgtgcgcccgccacggcatccctcgcctggtgatgcactgcccgtccgcctactacctcctcgccacgcacagcctgtccaagcacggcgtgtacgaccgcgtcgccgacgagctggagacgttcgaggtgccggacttccccgtgcgcgccgtcgggaacagggccacgttccgcggcttcttccagtggccaggaatggagaactacgagcgcgacatcgtcgaggccgaggccaccgccgacggcctgctgatcaacacgttccgcgacctcgagggcgtcttcgtcgaccactacgaggcggcgctcggcaggaagacgtgggccgtcgggccgacgtgcgcctccggcggttggacgcggacgcaatggccgggcgggggcaaacgcgcggacgtcgacgtcggcgtcgtcctgtcctggcttgacgcccggccgccgtcgtccgtgctctacatcagcttcggcagcctcgcgcagctgtcgccgaagcagatcatcgagcttggccggggcctcgaggcgtcggagcggccgttcgtgtgggctatcaaggaggccaagtccaacgccgacgtgcaggcgtggctcgccgagggtttcgaggagcgcgtcgcggacaggggcctcctcgtccgcgggtgggcgccgcaggtgaccatcctctcgcaccaggcggtgggcggcttcttgtcccactgcgggtggaacgccacgctggaagccatcgcccacggcgtgccggtgctgacatggccctacttcgccgaccagttctgcagcgagcggctgctcgtcgaggtcctcgacgtcggcgtcaggtccggcgtcaagctgccgcccatgaacctaccggaggaggccgagggggtgcaggtgacgagcgccgacgtggagaaggcggtggccgagctcatggacgtgggtcccgacgggacggcgaggagggcaagggcgaaggagctcgccgcaaaggcgaaggcagccatggaggaaggtgggtcgtcgtacgccgacttggacgacatgttgcgccacgtcgcggagctaagcatgaagaagagccacgacgaggacacgagcgtgagcactctgccttctgcgccagagcttgggagtaagaacaaggagaacttaggagccggcgccacattgtcagtagagtcctaa

SEQ ID NO: 16527 - protein, 519 aa, Sorghum bicolor
  misc_feature: Useful for making plants with altered carbohydrate content
  misc_feature: Functional homolog of the protein sequence given in SEQ ID NO 14399
  misc_feature: Ceres ANNOT ID no. 8658281
  misc_feature: Down-regulated in shoot tissues in response to methyl jasmonate treatment
  misc_feature: Down-regulated in shoot tissues in response to aminocyclopropane carboxylic treatment
  misc_feature: Down-regulated in shoot tissues in response to salicylic acid treatment
  misc_feature: Up-regulated in root tissues in response to salicylic acid treatment
  misc_feature (1)..(474): SWISSPROT Homolog: EC 2.4.1.238 Anthocyanin 3'-O-beta-glucosyltransferase
  misc_feature (5)..(481): Pfam ID: UDPGT Pfam Description: UDP-glucoronosyl and UDP-glucosyl transferase
MAELHFVLVPLVAQGHIIPMVDLARLLAGRGARVSVVTTPVNAARNRAVVDSARRAGLDVELAEVAFPGPGLGLPDGMENVDMVVEKDHFMPFFQALWKMDEPLDEYVRSLPRRPDCLIADWCNPWTAAVCARHGIPRLVMHCPSAYYLLATHSLSKHGVYDRVADELETFEVPDFPVRAVGNRATFRGFFQWPGMENYERDIVEAEATADGLLINTFRDLEGVFVDHYEAALGRKTWAVGPTCASGGWTRTQWPGGGKRADVDVGVVLSWLDARPPSSVLYISFGSLAQLSPKQIIELGRGLEASERPFVWAIKEAKSNADVQAWLAEGFEERVADRGLLVRGWAPQVTILSHQAVGGFLSHCGWNATLEAIAHGVPVLTWPYFADQFCSERLLVEVLDVGVRSGVKLPPMNLPEEAEGVQVTSADVEKAVAELMDVGPDGTARRARAKELAAKAKAAMEEGGSSYADLDDMLRHVAELSMKKSHDEDTSVSTLPSAPELGSKNKENLGAGATLSVES

SEQ ID NO: 16528 - DNA, 1590 bp, Sorghum bicolor
  misc_feature: Ceres ANNOT ID no. 8658299
  misc_feature: Down-regulated in shoot tissues in response to methyl jasmonate treatment
  misc_feature: Down-regulated in shoot tissues in response to aminocyclopropane carboxylic treatment
  misc_feature: Down-regulated in shoot tissues in response to salicylic acid treatment
  misc_feature: Up-regulated in root tissues in response to salicylic acid treatment
  misc_feature: Encodes the peptide sequence at SEQ ID NO 16529
atggggtgggggtggacggcgctggcggcggcaggcgcggtggcgtacgtggtggtgaagctgatggaggtgctgtggtggcggccgcggcgggtggagcggcacttcgcgcggcaggggatcaggggcccccgctaccgcttcttcgtcggctgcgtccgcgagatggtggcgctcatggtggccgcctccgccaagccaatgccgcgcccctaccgctcccacaacgtcctcccgcgcgtcctcgccttctaccaccactggaagaaaatctacggttccacgttcctgatatggttcggcccgacgccgaggctcgccgtcgccgacccggacctcatccgggagatcctcctgtcccgcgccgaccacttcgaccgctacgagtcgcacccgatggtgcgccagctcgagggcgaggggctcgtcagcctgcgcggcgacaagtgggcgcaccgccgcaaggtgctcacgccggcgttccacatggagaacctcaagctgctgctgccgttcgtcgggcagacagtggtcgacatggtggacaagtggcacgacatggccgccgcggcgtccggcgaggtcgagatcgacgtgtccgagtggttccaggtggtgacggaggacgccatcacccgcacggcgttcggccggagctacgaggacggcaaggccgtcttcaagctccagactcagctcatggccttcgcctccgaggcatttcgcaaggtcttcatccctggatacaggttcctgccgaccaagaagaacacgagctcgtggaagctggacaaggagatcagaaagaacctggtgacgctcatcggccggcggcaggaagctgcggacgacgagaagctcagcggctgtgccaaggacctcctcggcctcatgatcagcgcgagcagcaacggcggcaaggtgagccccatcaccgtcaacgacatagtggaggagtgcaagacgttcttcttcgccggcaagcagaccacgtcgaacctcctgacatggaccacagtcttgctcgccatgcaccccgagtggcaggagctcgcccgacaggaggtactccaagtctgcggggcgcgtgacatcccctcccgcgagcagctcgccaagctcaagacactcgggatgatcctgaacgagacgctgcggctgtacccgccggctgtggcgacggtgcgccgagccaagaccgacgtggagctcggcgggtgcctgatcccgcgcgacacggagctgctgatcccgatcatggccgtgcaccacgacgcgcggctgtggggcgcggacgccacgcagttcaacccggcgcggttcgccaagggcgtggcgcaggccgccgcgcaccccacggcgttcatcccgttcggcctgggcgcgcggatgtgcattggccagaacctggcgctcctcgagtccaagctcacggtggccatcatcctccagcggttcgacttccggctgtcgcccagctacctccatgcgccgacggtactgatgctcctccacccgcaatacggggcgcccgtgatcttccggccgcgatcatgtgagccgtccgatcgcgacaatcgggatatgtga

SEQ ID NO: 16529 - protein, 529 aa, Sorghum bicolor
  misc_feature: The sequence is a functional homolog of SEQ ID NO 2 in US patent 7034205
  misc_feature: Ceres ANNOT ID no. 8658299
  misc_feature (20)..(515): SWISSPROT Homolog: EC 1.3.3.9 Secologanin synthase
  misc_feature (67)..(514): Pfam ID: p450 Pfam Description: Cytochrome P450
MGWGWTALAAAGAVAYVVVKLMEVLWWRPRRVERHFARQGIRGPRYRFFVGCVREMVALMVAASAKPMPRPYRSHNVLPRVLAFYHHWKKIYGSTFLIWFGPTPRLAVADPDLIREILLSRADHFDRYESHPMVRQLEGEGLVSLRGDKWAHRRKVLTPAFHMENLKLLLPFVGQTVVDMVDKWHDMAAAASGEVEIDVSEWFQVVTEDAITRTAFGRSYEDGKAVFKLQTQLMAFASEAFRKVFIPGYRFLPTKKNTSSWKLDKEIRKNLVTLIGRRQEAADDEKLSGCAKDLLGLMISASSNGGKVSPITVNDIVEECKTFFFAGKQTTSNLLTWTTVLLAMHPEWQELARQEVLQVCGARDIPSREQLAKLKTLGMILNETLRLYPPAVATVRRAKTDVELGGCLIPRDTELLIPIMAVHHDARLWGADATQFNPARFAKGVAQAAAHPTAFIPFGLGARMCIGQNLALLESKLTVAIILQRFDFRLSPSYLHAPTVLMLLHPQYGAPVIFRPRSCEPSDRDNRDM

SEQ ID NO: 16530 - DNA, 1275 bp, Sorghum bicolor
  misc_feature: Ceres ANNOT ID no. 8658331
  misc_feature: Encodes the peptide sequence at SEQ ID NO 16531
atggcgcgggcggagaagaggcgcgccgcgagcacggaggcggcggagatgccagccaggtcggcggatcaccggagggcgctctacttcgccgcgttcctggtgctcgccgacgctgcgctcgtcgccctcatcatcgccttcgtcccgtataccaagatcgactgggacgcctacatgtctcaggtggacgtttttctggagggggagagggactacaccaagatcgagggagacacagggccattggtctacccggccggcttcctctacatctactccgccattaagttccttaccggaggccatgtcttccctgctcagattttgttcggcgtattatacattgtcaacttgagcctcgttcttctgctttacgtcaagaccgaagtgcttccatggtgggctttaggtttgctttgtttgtccaagagggttcactccatatttgttctccgccttttcaatgattgcttcgccatgacattgcttcacgctgctatggtactgatcatatatcacaagtggtaccttggtctaatagttttcagtggagctgtctcagttaagatgaatgtccttcttttcgctccttctttgcttctactgatggtcaaggccatgagcatcaaaggagtcttctttgccttgttgggagctgctgttgtacaggttttgttgggtatgccattcttgctctcacatccagttgagtacatctcaagagcattcaatcttggccgtgtgtttatccatttctggtctgtgaactttaaattcgtcccagagaaggtgtttatatcgaaagagcttgctattgcgttgttgattcttcacctcaccacccttctgatatttgcacactacaagtggttaaagcatgaaggaggtctattcggtttcttgcattccagatttaaagatgccaaatcaatcaaacagcttgtttccagccggcccagatcatccattctcagcatagaacatattgtaactgttatgtttattggcaacttcattggcattgtgtatgcccgatcattacactaccaattctattcctggtacttctattccttgccttttctattgtggaaaacacgttttcagacacctttgaggatcattctatttctcgctgtggagttctgctggaacatttacccttctagtgcctattcatcactccttttgctattttcgcacttgtgcattttgtttggtatatggtttgcacctgctgagtacccctatgtcatcaataaagagacataa

SEQ ID NO: 16531 - protein, 424 aa, Sorghum bicolor
  misc_feature: Useful for making plants with altered carbohydrate content
  misc_feature: Functional homolog of the protein sequence given in SEQ ID NO 13632
  misc_feature: Ceres ANNOT ID no. 8658331
  misc_feature (30)..(395): Pfam ID: ALG3 Pfam Description: ALG3 protein
MARAEKRRAASTEAAEMPARSADHRRALYFAAFLVLADAALVALIIAFVPYTKIDWDAYMSQVDVFLEGERDYTKIEGDTGPLVYPAGFLYIYSAIKFLTGGHVFPAQILFGVLYIVNLSLVLLLYVKTEVLPWWALGLLCLSKRVHSIFVLRLFNDCFAMTLLHAAMVLIIYHKWYLGLIVFSGAVSVKMNVLLFAPSLLLLMVKAMSIKGVFFALLGAAVVQVLLGMPFLLSHPVEYISRAFNLGRVFIHFWSVNFKFVPEKVFISKELAIALLILHLTTLLIFAHYKWLKHEGGLFGFLHSRFKDAKSIKQLVSSRPRSSILSIEHIVTVMFIGNFIGIVYARSLHYQFYSWYFYSLPFLLWKTRFQTPLRIILFLAVEFCWNIYPSSAYSSLLLLFSHLCILFGIWFAPAEYPYVINKET

SEQ ID NO: 16532 - DNA, 444 bp, Sorghum bicolor
  misc_feature: Ceres ANNOT ID no. 8658320
  misc_feature: Encodes the peptide sequence at SEQ ID NO 16533
atggtggtggaggagatcaccgagggcgtgaagaacctcgccgtcgccggagatgcggcggcggcctcaggcggagaggggcagaggaggggcggcggcggcagcagcaaccgcatccaggtgtctaacaccaagaagcccctcttcttttacgtcaacctcgccaagaggtatatgcaacagcacggcgatgttgagctatccgctcttggaatggccatagcgacagttgtgaccgtggcagaaattctgaagaacaatggatttgctgttgaaaagaagattaggacatctactgttgaaataaacgacgaatcaagagggcgtccattccaaaaggccaagattgagataatcttgggaaagagtgataaatttgatgagttgatggccgctgctgcggaagagaggggagaagtggaagatggtgaagagcaggcttga

SEQ ID NO: 16533 - protein, 147 aa, Sorghum bicolor
  misc_feature: Useful for making plants with modulated nitrogen use efficiency
  misc_feature: Functional homolog of the protein sequence given in SEQ ID NO 13593
  misc_feature: Ceres ANNOT ID no. 8658320
  misc_feature (35)..(104): Pfam ID: Alba Pfam Description: Alba
MVVEEITEGVKNLAVAGDAAAASGGEGQRRGGGGSSNRIQVSNTKKPLFFYVNLAKRYMQQHGDVELSALGMAIATVVTVAEILKNNGFAVEKKIRTSTVEINDESRGRPFQKAKIEIILGKSDKFDELMAAAAEERGEVEDGEEQA

SEQ ID NO: 16534 - DNA, 1959 bp, Sorghum bicolor
  misc_feature: Ceres ANNOT ID no. 8658345
  misc_feature: Encodes the peptide sequence at SEQ ID NO 16535
atgggtcctcccgtcctcctcctcccactgatgactgagatatcttttactctttcgcccacaccctgtggcctatggcccggccgtgtgcagtgcaaaaggcaccacaccggtggccctcacagtcttgcggctgtggcctcactcagtgtggccctcaagcagaccgcctttatgaacgaaagcaatgcactactgcagtggcttgtgtgtttgttttcagatgcagtgatcgagttgagatccgttcattcaaggaggatcatcatatcagaaaatgtaggccatgcacggagatgtcttgacctcggagtcggagagagctccacctcaacctccgctccttcccccacgctacgcggctgtatttatagcgagcgtcctggcctctcttctcctgctcgctcctggggagggaagaagaagaggaagaggacaagcactacgccaatgcgcgagcaaaccgacagctccagaggaggaggaagaagaagaagaacaagaggtgggatacagacaacgaggagaacgacgagcaccgaccgcgaccgcgacgccatcaccccctcctccacctcgtgctacaaagcaataatcatccgaggtcggcccatggctgctgctgcttcttcttcttctactactagttgcagccgcggccgaacgctcccaatcattgcctcccttgtccccttcctcctcctcgtcgtcgcctcgtgcccggccgccctggcctccgccacgcacggacacggcggcggcggcaggaagcatgccgcggtgcgggcgaatcaccaggcggtgttccgtgccggggacgagcgggaggcgtacaggaggatcatggcgcgcatggccaggatggccaaggattccaacatgacaatccagagccccgacggcgacgtcatccactgcgtgccggcgcacctgcagccggcgttcgaccaccccatgctcagaggccagaagcccgaggacgagcccgtggagaggcccatgcccaagagcggcgctgccgaggaagaggaggaggaggccggcgtgttcccgcaggcgtggagcgacggcggcaagcggtgcccggcggggacggtgccgatacggcggacgacgaagcgcgacgtgctgcggactagctccgcccgccggttcgggatgaaggcccgggccagcagcaacgcccgccgcgactccaccagcagcgggcacgagcacgcggtggggtacgtgacgggggaccagttctacggcgccaaggccagcctgaacgtgtggtcggccaaggtggcgtcggcggcggagttcagcctctcccagatctgggtcatctccggctccttcggcaacgacctcaacaccattgaggccggatggcaggtgagccctgaactgtatggagatagcaacccgaggttcttcacatactggacgacggatgcataccaggagactggatgctacaacctgcactgctccggcttcgtccagaccaacaaccggatcgccattggagctgccatctcgccgacctccgtttacaacggccggcagttcgacatcagcctgctcatatggaaggacccacaccgggggaactggtggctgcagctggggtcaggtccgctggtggggtactggccgtcgctgctgttcacgcacctgggcgggcacgccaacatggtgcagttcggcggcgaggtggtgaactcgcgcccgtcggggtcgcacacgccgacgcagatggggagcggccacttcccccgcgagggcttcaaccgcgccgcctacttccgcaacgtgcaggtggtggacggcgacaacagcctcgtccccgccgccgcgctccgcctcgtcgccgaccaccccggatgctacgacatccagggcgcgtacaaccgcgcctggggcaactacttctactacggagggcccggcaggaacgtgcactgcccgtga

SEQ ID NO: 16535 - protein, 652 aa, Sorghum bicolor
  misc_feature: Useful for biocontainment applications
  misc_feature: Functional homolog of the protein sequence given in SEQ ID NO 14085
  misc_feature: Ceres ANNOT ID no. 8658345
MGPPVLLLPLMTEISFTLSPTPCGLWPGRVQCKRHHTGGPHSLAAVASLSVALKQTAFMNESNALLQWLVCLFSDAVIELRSVHSRRIIISENVGHARRCLDLGVGESSTSTSAPSPTLRGCIYSERPGLSSPARSWGGKKKRKRTSTTPMREQTDSSRGGGRRRRTRGGIQTTRRTTSTDRDRDAITPSSTSCYKAIIIRGRPMAAAASSSSTTSCSRGRTLPIIASLVPFLLLVVASCPAALASATHGHGGGGRKHAAVRANHQAVFRAGDEREAYRRIMARMARMAKDSNMTIQSPDGDVIHCVPAHLQPAFDHPMLRGQKPEDEPVERPMPKSGAAEEEEEEAGVFPQAWSDGGKRCPAGTVPIRRTTKRDVLRTSSARRFGMKARASSNARRDSTSSGHEHAVGYVTGDQFYGAKASLNVWSAKVASAAEFSLSQIWVISGSFGNDLNTIEAGWQVSPELYGDSNPRFFTYWTTDAYQETGCYNLHCSGFVQTNNRIAIGAAISPTSVYNGRQFDISLLIWKDPHRGNWWLQLGSGPLVGYWPSLLFTHLGGHANMVQFGGEVVNSRPSGSHTPTQMGSGHFPREGFNRAAYFRNVQVVDGDNSLVPAAALRLVADHPGCYDIQGAYNRAWGNYFYYGGPGRNVHCP

SEQ ID NO: 16536 - DNA, 807 bp, Sorghum bicolor
  misc_feature: Ceres ANNOT ID no. 8658353
  misc_feature: Encodes the peptide sequence at SEQ ID NO 16537
atggcatcgccgtcgagcaccagcaacaactcggccctctcccctgtggccgcgtcaggggcgacgacgcccggtgccggggcgccgtgcgcggcgtgcaagttcctgcggcgcaagtgcctgccggggtgcgtgttcgcgccctacttcccgccggaggagccgcagaagttcgccaacgtgcacaaggtgttcggcgccagcaacgtgaccaagctgctcaacgagctgctgccgcaccagcgggaggacgccgtgagctcgctcgcctacgaggccgaggcgcgcgtcaaggaccccgtctacggctgcgtcggcgccatctccgtgctccagcgccaggtccaccgcctgcagaaggagctggacgccgcgcacgccgagctcctccgctacgcctgcggcgacgtcgccgccggcatccccaccgcgctccccgtcagcgtgagcgtcagcgccgcgcccaggctctccacggcaatgacgacgagccccgggcagttcgctgcagcagcagccactgcgcatgccaccgccggcatgtacggcagcagccggaggctcggggtcttggatggcgtagtagcggcgccaccaccgccaccgccagcgggcggctgctacttcatgcggaaccacagcaacgtcattagtagccccccaggcgctgacgtggcgcccgtcctgccttacgcttccatggctaattgggccgtgaatgccatcagcgcctcgacgaccaccacctctggatcagagagcattggtgggttggatcacaaggaagggggagacagcagcatgtga

SEQ ID NO: 16537 - protein, 268 aa, Sorghum bicolor
  misc_feature: Useful for making plants with modulated biomass
  misc_feature: Functional homolog of the protein sequence given in SEQ ID NO 13858
  misc_feature: Ceres ANNOT ID no. 8658353
MASPSSTSNNSALSPVAASGATTPGAGAPCAACKFLRRKCLPGCVFAPYFPPEEPQKFANVHKVFGASNVTKLLNELLPHQREDAVSSLAYEAEARVKDPVYGCVGAISVLQRQVHRLQKELDAAHAELLRYACGDVAAGIPTALPVSVSVSAAPRLSTAMTTSPGQFAAAAATAHATAGMYGSSRRLGVLDGVVAAPPPPPPAGGCYFMRNHSNVISSPPGADVAPVLPYASMANWAVNAISASTTTTSGSESIGGLDHKEGGDSSM

SEQ ID NO: 16538 - DNA, 3291 bp, Sorghum bicolor
  misc_feature: Ceres ANNOT ID no. 8658394
  misc_feature: Encodes the peptide sequence at SEQ ID NO 16539
atggcaagcacgtttgtttggttccttactgtgttcctgatgaatgtctggggtgcgccaagttgcagagcagtgcgccaacgccccttgaccggaaacaggaggggttggggcccctactggaaagaatcaataaaacgaacatggcaaccaagtactttgcgccaggatagcagtgctatgtcaaaagctccagatgatcagttgcaagcaacagagcaggaagaaagtgtccatccaagtcaacaagcagggcaacaacatgttaatacaccagatcagatctccaaaacagaactaactgaagggtcaaaaaatgaacaacctgtccaagtagagcaacagaattccaacctacaacaagcacattcagaaattcaactacaacaggctgaaacaaatagcttccagttagctgaaaaagaaacagggtattttggtcaacagagttttgcaggtgccaaggtggatgtagcccagccttcagtagttcagcagaatgtaaagcaaactgttggtcaacaagcatcatctggtgctcaggatacaaggaaaggaccatcaataccatttaatttgttaattccaatcctacaggcacatcttgacagagacaaagatatgcagcttcaagctgtatgggcaaaacttaggcgtaatgaagtccacaaagatgatttcttaagagttatcaggaatattgttggggatcaaatgctcaagcaggcagctcataaagtttttgtacagatgcaagcacaggcgcaaagaaatagccaggcaaatccaagtcagcagtctttattctctcaggtttcttcacagcagatgccttccagtggttccactcaaacgcagaacagtgtacactatcttgctcatgataacactaaccaaaaccctgacgcaaagggaacaaatgctgtaccaaatcaaccacctagaatgaacacagcagttccattgcaagcaaagaacaaacaacatcaaccaacacagttgcagcaggcctcacagcaaatatatggagcaagtaatcccggtgcccaggcttaccctcggtcaatcactggttctcttagatcaccgagtcctgttccagaaacacagccatccatgcatgctcctggaatggctcctgcaaaaatcgtccctcctcctactcatccaatgatgcagcacaatgcagttgcatggcaaatgcatcaaaacaaggaattgaaaactaatgccccccctccaaatgctattgttaagcaaaattctgaatctgttggcaaagcacgcatggctggcacaggaaattcttcagctaaaggaaaacagggaactcctaactctacacccaatgctagtggaggtgcaaagagcaagaaatcaggtgggcagaagaaatcattggaagcagcaggctctacacaaccttcaagcaaaaagcagaagacatctggagccttccaggaacaaagcattgatcaacttaatgatgtcacagccgttagtggtgttaatatcagggaagaggaagagcaattactgtctgcccctaaggaagagagccttgcctcacaagaagcacgaagaattgcacaggaagaagaagaaaatcttttcctaaggaagggtccactcctgaagaaactagcagaaatcgctcggaaatgcgatctgaagaatattagtggcgatgtggaacactgtttatcaatgagaatcgatactgaaaagaccgggcatcgactagttattacttcggatgttggtcgtcaaattttacagatgaatcagaaagctaaggaagaatgggataaaaaacaagcagaagaagctgacaagaacaagaaacaaactgaggctgatggcagtggtgctaccgatttggaaaaagaaaaagaggaaagtcgcccaaagaatgtcaagcccaacaaggaagaagatgataaaatgagaacaaatgctgctaatgttgctgcccggcaagctgttggaggaagtgatatgctgtcaaagtggcagttgatggctgagcaagccaggcagaagcgagaaggccttgatgtgtctgctgcttcacagccaggcagaggacctggttccaggccattcttgaaatttggaaacggtcctggcgaacaccaggaaggttcaaagaggagccattcggtggcattcggaactggaggcatgaaaagaccaggcaggacaccttttgctggtccacagcgattgatctccgtgaaggatgtcatttgtgcccttgagagggagcctcagatgacaaaatcacggctcatctaccggctgcacgagcggtttcctgtagattcaactcctattccagtccgaccggggccccgaagattggcgaacccggccgccgagctcctgccgcacggcgatggccctgcctggcctggccgcctgagcgcgcggcgcggttgccaggtgccgcagaagtccggcgtcatgagggcttcctggtgtcgccaagagaggagggggtcgttccacggccgtgccggcgtctccgagaagcgcgcgccgccgtcgcttgtgcttgtctgctgcatcggcgccattgccctgcttgcgggcgctagccgcaccctagccccaaaggaggagctctgtcttggctctttttggtgcattcgcttgacacctgttggccgtaaacatcaaggggttaagtatgagttgcgcactctccctgtggatgctaaggctgtaactgacggcgacacgattactgtgtatgttaacatggctcaccatccagagtctagcaatgtgccccacgaagtgcgtgaagcgggcattgagcggagcaaggcactggcagcaaataattaccaaagagctggtgttttactgaagatcatacttgatgcaggatataggcaggtttgtggcattgatggggaacaaattctcgcaaagaagtacaggataaggctaagggggattgatgcaccagagagcttaatgccatatggcaaagaggccaaagaggagctggtgaggctggtgcaggggaaaagcttaaagatttccatatatgacactgattggtacggtcgcttagttggagatgttgactgtgatggggttttcgtgcaggaacacatgctgaagaaaggacttgcatggcactatactacttatgatcatcggatggagctcaccaagtgggagaatcaggcgaagacaaggcgaacaggcttgtgggcatcgtcgaaccctgagaaaccatgggaatggagaaagaaaaagcgcactgggacagtatga

SEQ ID NO: 16539 - protein, 1096 aa, Sorghum bicolor
  misc_feature: Useful for making plants with altered terpenoid content
  misc_feature: Functional homolog of the protein sequence given in SEQ ID NO 13227
  misc_feature: Ceres ANNOT ID no. 8658394
  misc_feature (972)..(1095): SWISSPROT Homolog: EC 3.1.31.1 Micrococcal nuclease
  misc_feature (591)..(684): SWISSPROT Homolog: EC 3.1.2.15 Ubiquitin thiolesterase
  misc_feature (494)..(770): Pfam ID: TAF4 Pfam Description: Transcription initiation factor TFIID component TAF4 family
  misc_feature (901)..(1078): Pfam ID: SNase Pfam Description: Staphylococcal nuclease homologue
MASTFVWFLTVFLMNVWGAPSCRAVRQRPLTGNRRGWGPYWKESIKRTWQPSTLRQDSSAMSKAPDDQLQATEQEESVHPSQQAGQQHVNTPDQISKTELTEGSKNEQPVQVEQQNSNLQQAHSEIQLQQAETNSFQLAEKETGYFGQQSFAGAKVDVAQPSVVQQNVKQTVGQQASSGAQDTRKGPSIPFNLLIPILQAHLDRDKDMQLQAVWAKLRRNEVHKDDFLRVIRNIVGDQMLKQAAHKVFVQMQAQAQRNSQANPSQQSLFSQVSSQQMPSSGSTQTQNSVHYLAHDNTNQNPDAKGTNAVPNQPPRMNTAVPLQAKNKQHQPTQLQQASQQIYGASNPGAQAYPRSITGSLRSPSPVPETQPSMHAPGMAPAKIVPPPTHPMMQHNAVAWQMHQNKELKTNAPPPNAIVKQNSESVGKARMAGTGNSSAKGKQGTPNSTPNASGGAKSKKSGGQKKSLEAAGSTQPSSKKQKTSGAFQEQSIDQLNDVTAVSGVNIREEEEQLLSAPKEESLASQEARRIAQEEEENLFLRKGPLLKKLAEIARKCDLKNISGDVEHCLSMRIDTEKTGHRLVITSDVGRQILQMNQKAKEEWDKKQAEEADKNKKQTEADGSGATDLEKEKEESRPKNVKPNKEEDDKMRTNAANVAARQAVGGSDMLSKWQLMAEQARQKREGLDVSAASQPGRGPGSRPFLKFGNGPGEHQEGSKRSHSVAFGTGGMKRPGRTPFAGPQRLISVKDVICALEREPQMTKSRLIYRLHERFPVDSTPIPVRPGPRRLANPAAELLPHGDGPAWPGRLSARRGCQVPQKSGVMRASWCRQERRGSFHGRAGVSEKRAPPSLVLVCCIGAIALLAGASRTLAPKEELCLGSFWCIRLTPVGRKHQGVKYELRTLPVDAKAVTDGDTITVYVNMAHHPESSNVPHEVREAGIERSKALAANNYQRAGVLLKIILDAGYRQVCGIDGEQILAKKYRIRLRGIDAPESLMPYGKEAKEELVRLVQGKSLKISIYDTDWYGRLVGDVDCDGVFVQEHMLKKGLAWHYTTYDHRMELTKWENQAKTRRTGLWASSNPEKPWEWRKKKRTGTV

SEQ ID NO: 16540 - DNA, 993 bp, Sorghum bicolor
  misc_feature: Ceres ANNOT ID no. 8658402
  misc_feature: Encodes the peptide sequence at SEQ ID NO 16541
atgtggaacagcatctaccggttcttgtgcggcctgtgcgcgccgtcgtcgtcggagcacgggctccacggcgcgcaccccgtcgccgcgctcggccgcgacatcctcagcttccagagcacctcgcaggttccggacgagctgagccggcacgtcgtctcctccaagaaagcgcaggcgaattggtacaagaagctgctggtggcatggaagaaagcccggccgcctccgaagacgcccgaggaagctgcggccttcgttgtgcagacgctcaagaaccatcagaaagcagatgtggagggcctgctgtctttctacggcctgccgcatccgaacgcggcagcaggcacacccgctgctccgccgccgcccaagaagccccagggcgccaagttcgagctgcacacgctccccattgatcccaagtctgtggccgacggcgacaccgtcaacgtgtacgtcgacacggcggacccccgggaggccggcagcgtgccccgcgaggtgcagaaggctgcggcggagcgggccaaggcgcgggccgccaagaactaccagaaggccgacgcgctgcagaagatcatagtcgacgcaggatacaggccggttcctaacgcgagaggcgaggaggtgctagcgaagaagtacaggatcaggctgagggggatcgatgcgcccgagagcgcgatgccgtatggcaaggaggccaaagaggcgctgctcaaacttgtccaggggaagagcttgaaggtctacgtgtacgacgaggaccggtatggtagatgcgtcggagacatctactgcgacggcgtatttgtgcaggagcaaatgctgaagaaaggttttgcctggcactacaccgcctatgatcaacgcccagagctggccaagtgggagaaacaagcacagactgggcggaagggcttgtgggcgtcgtcgaagccacagaaaccatgggagtggaggaaggacaagcgcaacgggacagcatga

SEQ ID NO: 16541 - protein, 330 aa, Sorghum bicolor
  misc_feature: Useful for making plants with altered terpenoid content
  misc_feature: Functional homolog of the protein sequence given in SEQ ID NO 13227
  misc_feature: Ceres ANNOT ID no. 8658402
  misc_feature (217)..(329): SWISSPROT Homolog: EC 3.1.31.1 Micrococcal nuclease
  misc_feature (135)..(312): Pfam ID: SNase Pfam Description: Staphylococcal nuclease homologue
MWNSIYRFLCGLCAPSSSEHGLHGAHPVAALGRDILSFQSTSQVPDELSRHVVSSKKAQANWYKKLLVAWKKARPPPKTPEEAAAFVVQTLKNHQKADVEGLLSFYGLPHPNAAAGTPAAPPPPKKPQGAKFELHTLPIDPKSVADGDTVNVYVDTADPREAGSVPREVQKAAAERAKARAAKNYQKADALQKIIVDAGYRPVPNARGEEVLAKKYRIRLRGIDAPESAMPYGKEAKEALLKLVQGKSLKVYVYDEDRYGRCVGDIYCDGVFVQEQMLKKGFAWHYTAYDQRPELAKWEKQAQTGRKGLWASSKPQKPWEWRKDKRNGTA

SEQ ID NO: 16542 - DNA, 774 bp, Sorghum bicolor
  misc_feature: Ceres ANNOT ID no. 8658407
  misc_feature: Encodes the peptide sequence at SEQ ID NO 16543
atggctgttggacgaggagggggtgttacggcattgttagcgggtcagggtggcatcgggctttgtcgacgagggcctggcgtggggtggtggcggctcctattttatctcaaaatgcagcgatttaatccttccgagacctttgggggcataatgattgattacccgtatgttgaatgcacatcagcatcaattcaatgtctagctttattcaaggaactctacccagggcaccgcaagaaagaggtgtacaactgtatcaggaagggcgcaaatttcattgagagtatgcaaagaaacgatggttcatggtacggatcttggggcatttgtttcacccacgccacatggtttgcagtgagggggttagtttgtgctggccggacgttcaagaataatcctgcaataaaaaaggcatgtgagtttctattgtcaaaagagcttccttctggtggttggggagaaagctatttgtcatgtgagaacaaggtttacacacatcttgaaggcatgcgacctcatgcagtcaacacagcttgggccatgctggccctaattggtgctggacaggctgaaagagatccaacaccactgcatcgggcagctaaggtcttgatcaacttacagtcagtggacggagaatttccacagcaagagattattggagtcttcagccaaaattgcatgatcagttactcccagtataggaacatcttccctatatgggctctaggagagtatcgcactaaggtccatgttgcagggaagaaatag

SEQ ID NO: 16543 - protein, 257 aa, Sorghum bicolor
  misc_feature: The sequence is a functional homolog of SEQ ID NO 6 in US patent 7122717
  misc_feature: The sequence is a functional homolog of SEQ ID NO 4 in US patent 7135624
  misc_feature: The sequence is a functional homolog of SEQ ID NO 15 in US patent 7186884
  misc_feature: Ceres ANNOT ID no. 8658407
  misc_feature (36)..(251): SWISSPROT Homolog: EC 5.4.99.8 Cycloartenol synthase
  misc_feature (134)..(189): Pfam ID: Prenyltrans Pfam Description: Prenyltransferase and squalene oxidase repeat
  misc_feature (85)..(127): Pfam ID: Prenyltrans Pfam Description: Prenyltransferase and squalene oxidase repeat
MAVGRGGGVTALLAGQGGIGLCRRGPGVGWWRLLFYLKMQRFNPSETFGGIMIDYPYVECTSASIQCLALFKELYPGHRKKEVYNCIRKGANFIESMQRNDGSWYGSWGICFTHATWFAVRGLVCAGRTFKNNPAIKKACEFLLSKELPSGGWGESYLSCENKVYTHLEGMRPHAVNTAWAMLALIGAGQAERDPTPLHRAAKVLINLQSVDGEFPQQEIIGVFSQNCMISYSQYRNIFPIWALGEYRTKVHVAGKK

SEQ ID NO: 16544 - DNA, 762 bp, Sorghum bicolor
  misc_feature: Ceres ANNOT ID no. 8658455
  misc_feature: Encodes the peptide sequence at SEQ ID NO 16545
atggagaaggcaatgctgctcttgttgctgagcttgtgcgcctctcgactcggcggcgcagtggcgcagcagtaccagtactggacgccggccaccgcgacgttctacggcgggagcgacgcgtccggcaccatgggcggatcgtgcgggtacggcgacctgtacagcgccgggtacgggacgcagacgacggcgctgagcacagcgctctacggcgacggcgcctcctgcggcgcgtgctacctcgtcacctgcgacgcgacggggacgcagtactgcaagccggggtcgccgtcggtcaccgtcacggccaccaacttctgcccgcccaactacgacgacgccaacgggtggtgcaactcgccgcggcggcacttcgacatgtcgcagccggcgtgggagaccatcggcgtgtaccaggccggcgtaatacccgtcaactaccggagggtctcgtgccagcggtccggcgggatcaggttcgccatcagcgggcacgactacttcgaccttgtcaccatcaccaacgtcggcggcgccggcgcggtggccgcggcgtggatcatgggcaccggcggcacggactggctggccatgagccgcaactggggggagaactggcagagcggagcctacctcaccggaaaggccctgtcgttcaaggtgcagacggacgacggcaaggtcgtcgtggcggataacgtggcgccggcgaactggcagttcggcagcacctaccaggcctcggtcaacttctactag

SEQ ID NO: 16545 - protein, 253 aa, Sorghum bicolor
  misc_feature: Useful for making plants with altered cell wall content and/or composition
  misc_feature: Functional homolog of the protein sequence given in SEQ ID NO 13785
  misc_feature: Useful for making plants with altered carbohydrate content
  misc_feature: Functional homolog of the protein sequence given in SEQ ID NO 14012
  misc_feature: Useful for making plants with altered lignin content
  misc_feature: Functional homolog of the protein sequence given in SEQ ID NO 12888
  misc_feature: Ceres ANNOT ID no. 8658455
  misc_feature (17)..(119): SWISSPROT Homolog: EC 3.2.1.4 Cellulase
  misc_feature (63)..(148): Pfam ID: DPBB_1 Pfam Description: Rare lipoprotein A (RlpA)-like double-psi beta-barrel
  misc_feature (159)..(237): Pfam ID: Pollen_allerg_1 Pfam Description: Pollen allergen
MEKAMLLLLLSLCASRLGGAVAQQYQYWTPATATFYGGSDASGTMGGSCGYGDLYSAGYGTQTTALSTALYGDGASCGACYLVTCDATGTQYCKPGSPSVTVTATNFCPPNYDDANGWCNSPRRHFDMSQPAWETIGVYQAGVIPVNYRRVSCQRSGGIRFAISGHDYFDLVTITNVGGAGAVAAAWIMGTGGTDWLAMSRNWGENWQSGAYLTGKALSFKVQTDDGKVVVADNVAPANWQFGSTYQASVNFY

SEQ ID NO: 16546 - DNA, 1362 bp, Sorghum bicolor
  misc_feature: Ceres ANNOT ID no. 8658448
  misc_feature: Encodes the peptide sequence at SEQ ID NO 16547
atgagggagcagtacagctacagcagcaagccggccggcatccggcggcactatcgccgctgcgcgccggcagcggcccacatcgccgtggccttcctcctcgtcgcgctcggcgtgctttacctcatcttcggcccgaccaactccgacctcaacctcgtcctcgccatgccgcgcgtccacgtcgtgttcaataacaaacccgccgtcgtcccagcggcgcctgctgcggccgcgccttccctgggcagcaacgccaccgacgacgacgtggacagcggcctcccgccgccgcggcagctgacggacccgccctactcgctgggccgggtcatcctggactacgacgcgcgacggtccgcgtggctcgcggcgcacccggagttccagccggcggcggcggggcggccgcggccgcgggtgctggtggtgacgggttcggcgcccgcccggtgccccgaccccgacggcgaccacctgctgctgcgggcgttcaagaacaaggcggactactgccgcgtgcacggcctcgacgtgttctacaacgcggcgttcctggacgccgagatgtccgggttctgggcgaagctgccgctgctgcgtgcgctgatgctggcgcacccggaggtggagctcctctggtgggtggactccgacgccgtcttcacggacatggcgttcgagccgccgtgggggaggtacgagcgccacaacctggtgctccatggctggtccgccaaggtgttcgaggagaggagctgggtcggcgtcaacaccggcagcttcctcatccggaactgccagtggtcgctcgacctcctcgacgcgtgggcgcccatggggtcgcgcggccccgtccgcgacagctacggcgagctcttcgcgcgggagctcaccgggcgcccgccgttcgaggcggacgaccagtcggcgctcgtgtacctgctcgtcacgcagcggagcaggtggggggacaagacgttcatcgagagcgcctacgagctcaacggcttctgggaagggatagtggacaggtacgaggagctgcggcggaaggggcgacccgccgggggcctcggcgacggcgacgaccggtggccgttcgtcacgcacttcgtcgggtgcaagccgtgccggcggtacgcggacagctacccggcggaccggtgccggcgggggatggagcgcgcgttcaacttcgccgacgaccagataatgaggctgtacgggttccagcacgagtcgctcaacaccaccgccgtgcagcgcgtcggaaacgagaccggcggcccgctggacgcggacgacgaggagctggcccggctattgcaccccacgttcagggctgccaggcccgcatag

SEQ ID NO: 16547 - protein, 453 aa, Sorghum bicolor
  misc_feature: Useful for making plants with altered carbohydrate content
  misc_feature: Functional homolog of the protein sequence given in SEQ ID NO 13770
  misc_feature: Useful for making plants with altered cell wall content and/or composition
  misc_feature: Functional homolog of the protein sequence given in SEQ ID NO 14400
  misc_feature: Ceres ANNOT ID no. 8658448
  misc_feature (91)..(451): SWISSPROT Homolog: EC 2.4.2.39 Xyloglucan 6-xylosyltransferase
  misc_feature (137)..(385): Pfam ID: Glyco_transf_34 Pfam Description: galactosyl transferase GMA12/MNN10 family
MREQYSYSSKPAGIRRHYRRCAPAAAHIAVAFLLVALGVLYLIFGPTNSDLNLVLAMPRVHVVFNNKPAVVPAAPAAAAPSLGSNATDDDVDSGLPPPRQLTDPPYSLGRVILDYDARRSAWLAAHPEFQPAAAGRPRPRVLVVTGSAPARCPDPDGDHLLLRAFKNKADYCRVHGLDVFYNAAFLDAEMSGFWAKLPLLRALMLAHPEVELLWWVDSDAVFTDMAFEPPWGRYERHNLVLHGWSAKVFEERSWVGVNTGSFLIRNCQWSLDLLDAWAPMGSRGPVRDSYGELFARELTGRPPFEADDQSALVYLLVTQRSRWGDKTFIESAYELNGFWEGIVDRYEELRRKGRPAGGLGDGDDRWPFVTHFVGCKPCRRYADSYPADRCRRGMERAFNFADDQIMRLYGFQHESLNTTAVQRVGNETGGPLDADDEELARLLHPTFRAARPA

SEQ ID NO: 16548 - DNA, 1410 bp, Sorghum bicolor
  misc_feature: Ceres ANNOT ID no. 8658463
  misc_feature: Encodes the peptide sequence at SEQ ID NO 16549
atgactatggaccctgctccggcggcgaacggcgccgcggccgtagccggaggaggcatgaagcggcagggcggtagatggtggtacgcggcggccggtgccctcattgtggcgctcctcgccgtggccgtgagcttttacagcttccggggcatcccctcctctccaccaggaggctgcggctgccctgctgcaaggaagtacaccggaatggtggaggactgctgctgcgactatgagacggtggacgccatcaatgaggaggttctgcatccgatcctacaggaacttgttaagttgccgttcttcaggtacttcaaggttaaattgtggtgtgattgccctttttggcctgatgatggaatgtgcaagcttagagattgtagtgtctgtgagtgcccagagaatgagatccctgaaccattcaagaaaccttacagtggactttctccagatagtatgatatgccaagaaggaaaaccacaggctaccattgataaaacccttgacagcaaggttttcaaaatatgggttgaaactgacaatccgtggacatctgatgacgaggctgatagtaaagagatggcttacgtgaatcttcaactgaatcctgaacgatacactggctatactggtgattcagcaagaaggatatgggatgctatttacaaagagaactgtccaaaatatccctctgaagaactgtgccatgagaagaaggcattgtacaagcttatttcagggttgcactcctcaatttcagtgcatattgcttacgattatcttcttgatgaatctactaactcatggggacaaaatcttcctttgctgtatgaccgtgtcctgaagtacccagagcgtgtccagaatctgtacttcacctacctgtttgttcttcgggccgtgacaaaagcagcagattatctcgagcaagctgattacaatactggtaatcctgaagatgactggaaaacacgatctcttgtgaagcaattgctttacaattcaaagttaagatctgcatgtccattgccttttgatgaagccaaactctggcaaggtgaaaatggtcctgaactaaagcaagagattcagaagcaatttagaaacattagcgcaattatggactgcattgggtgcgagaagtgccggctgtggggaaagctccaagttcttggtcttggaactgcactgaaaattcttttctctgtcaatggagacagccatttgaatcagccacttcagcgaaatgaggtcattgcattgttcaatcttctgaataggctctcagagtctgtcaaatttgtacatgaaaaaggatcgtcaattgaagaagtcatcaaggaacagagcccttcaacccttcaaaagggtggttctaagccgaatgttaaactggactttctctga

SEQ ID NO: 16549 - protein, 469 aa, Sorghum bicolor
  misc_feature: The sequence is a functional homolog of SEQ ID NO 2 in US patent 7064247
  misc_feature: Ceres ANNOT ID no. 8658463
  misc_feature: Up-regulated in shoot tissues in response to salicylic acid treatment
  misc_feature: Up-regulated in root tissues in response to salicylic acid treatment
  misc_feature (88)..(437): Pfam ID: ERO1 Pfam Description: Endoplasmic Reticulum Oxidoreductin 1 (ERO1)
MTMDPAPAANGAAAVAGGGMKRQGGRWWYAAAGALIVALLAVAVSFYSFRGIPSSPPGGCGCPAARKYTGMVEDCCCDYETVDAINEEVLHPILQELVKLPFFRYFKVKLWCDCPFWPDDGMCKLRDCSVCECPENEIPEPFKKPYSGLSPDSMICQEGKPQATIDKTLDSKVFKIWVETDNPWTSDDEADSKEMAYVNLQLNPERYTGYTGDSARRIWDAIYKENCPKYPSEELCHEKKALYKLISGLHSSISVHIAYDYLLDESTNSWGQNLPLLYDRVLKYPERVQNLYFTYLFVLRAVTKAADYLEQADYNTGNPEDDWKTRSLVKQLLYNSKLRSACPLPFDEAKLWQGENGPELKQEIQKQFRNISAIMDCIGCEKCRLWGKLQVLGLGTALKILFSVNGDSHLNQPLQRNEVIALFNLLNRLSESVKFVHEKGSSIEEVIKEQSPSTLQKGGSKPNVKLDFL

SEQ ID NO: 16550 - DNA, 681 bp, Sorghum bicolor
  misc_feature: Ceres ANNOT ID no. 8658457
  misc_feature: Up-regulated in shoot tissues in response to salicylic acid treatment
  misc_feature: Up-regulated in root tissues in response to salicylic acid treatment
  misc_feature: Encodes the peptide sequence at SEQ ID NO 16551
atggccgcccgtgctccctcgtccctgcttcttggagcggtcgcggtggcgctagtccttgccgctgcgccgtcggcgctcgccggcgaccccgactacctccaggacctctgcgtcgccgacctcaactccgcggtgaaggtgaacgggttcccgtgcaaggcggcggaggcggccaccgccgacgacttcttcacgagcatcctggcgacgccgggcggcaccaacaccacgtcgggctccgtggtgacgggcgccaacgtggagaaggtcccggggctcaacacgctgggcgtctcgctctcccgcatcgactacgcgcccggcggggtgaacccgccgcacacgcacccgcgcgccaccgagctcgtcttcgtgctctacggcgcgctcgacgtcggcttcgtcaccaccgccaacaagctcgtcgccaggaccatcgcgcggggcgacgtcttcgccttcccgagggggctcgtgcacttccagaggaaccccggcaccgagcccgccgccgtcatctccgcgttcaacagccagctccccggcacgcagtccatcgccatgacgctcttcggggcctcgccggacctgcctgaccaagtgctcgccaaggccttccagatccccgacgaggaggtggccaagatcaaggccaagttcgcgcccaagaagggatga

SEQ ID NO: 16551 - protein, 226 aa, Sorghum bicolor
  misc_feature: Useful for making plants with modulated nitrogen use efficiency
  misc_feature: Functional homolog of the protein sequence given in SEQ ID NO 14277
  misc_feature: Ceres ANNOT ID no. 8658457
  misc_feature (30)..(225): SWISSPROT Homolog: EC 1.15.1.1 Superoxide dismutase
  misc_feature (67)..(215): Pfam ID: Cupin_1 Pfam Description: Cupin
  misc_feature (102)..(177): Pfam ID: Cupin_2 Pfam Description: Cupin domain
MAARAPSSLLLGAVAVALVLAAAPSALAGDPDYLQDLCVADLNSAVKVNGFPCKAAEAATADDFFTSILATPGGTNTTSGSVVTGANVEKVPGLNTLGVSLSRIDYAPGGVNPPHTHPRATELVFVLYGALDVGFVTTANKLVARTIARGDVFAFPRGLVHFQRNPGTEPAAVISAFNSQLPGTQSIAMTLFGASPDLPDQVLAKAFQIPDEEVAKIKAKFAPKKG

SEQ ID NO: 16552 - DNA, 990 bp, Sorghum bicolor
  misc_feature: Ceres ANNOT ID no. 8658479
  misc_feature: Encodes the peptide sequence at SEQ ID NO 16553
atgccaagactgaaactattggagcatagtacggttcatgagcagtcatttaatcgtgtccctgtccgtctctctcactcgtggggcagagcatggaacactagtcaatggattgcgaagactttcttccatggctgcccaattccagaagaggaatctcgtgatctgtctgtcttccatactttcagaagtttttggcagtctctgttgatgctgttcaaatattcagtcaacctctttgttgggcctctttgttccagtgaaaaggacctaaagcctctgcaagggaaggagctgcagccagtgcttcttcctcggcaggcaagctcggctccacgggccgtgagggtagcgccgccggagatgtcgtcgtcgtcggggtcggggaggagcacaacggaggcgagggcgctgaagatccacagcgaggccgagcggcggcgccgggagaggatcaatgctcatctggctacgctcaggaggatgattcctgatactaggcagatggacaaggccaccttgcttgccagagtggtagagcaagtgaagctcctgaagaggaacgcaagcgaggccaccacccagagcgtgcccctgcccccggagaccgacgaggtctccatcgagctccacaccggcgccggcgccgacaaggtcatctacataaaggcctcgatcagctgcgacgaccggccggacctcgtcgccgggctggcccaggcgttccatggcctgaggctgaggacggtgagggccgacatgacctcgttaggaggaagggtgcagcatgtgttcgtactgtgcaaagaggagggctggggtggtgcaggtgtaggtgcagcaagtgcaagcctcaggtctctgaaggaggctgtcaggcaggcgctagccagggttgcttccccagaaacggcatacgggagtagtagtccctttcagagcaagcggcagaggattcttgaatcacattactccatcatgtccatatag

SEQ ID NO: 16553 - protein, 329 aa, Sorghum bicolor
  misc_feature: The sequence is a functional homolog of SEQ ID NO 1900 in the 10/374,780 US patent application
  misc_feature: Ceres ANNOT ID no. 8658479
  misc_feature (137)..(186): Pfam ID: HLH Pfam Description: Helix-loop-helix DNA-binding domain
MPRLKLLEHSTVHEQSFNRVPVRLSHSWGRAWNTSQWIAKTFFHGCPIPEEESRDLSVFHTFRSFWQSLLMLFKYSVNLFVGPLCSSEKDLKPLQGKELQPVLLPRQASSAPRAVRVAPPEMSSSSGSGRSTTEARALKIHSEAERRRRERINAHLATLRRMIPDTRQMDKATLLARVVEQVKLLKRNASEATTQSVPLPPETDEVSIELHTGAGADKVIYIKASISCDDRPDLVAGLAQAFHGLRLRTVRADMTSLGGRVQHVFVLCKEEGWGGAGVGAASASLRSLKEAVRQALARVASPETAYGSSSPFQSKRQRILESHYSIMSI

SEQ ID NO: 16554 - DNA, 804 bp, Sorghum bicolor
  misc_feature: Ceres ANNOT ID no. 8658485
  misc_feature: Encodes the peptide sequence at SEQ ID NO 16555
atgcagagactcgcgcgcgtcctcgtggtgctcgtcgtagccgccgccacggcgtcggcacagggcccgacggcggcgccagcgacgcccacgccggcaacacccgcggcgccggcgcccaaggcagcgacaacgacgacgacgtcgagcaacatcacgggcgtgctggccaagggcgggcagttcaacaccttcatccggctgctcaagtccacgggggtggcgtcgcagatcgacaaccaggtcagcaatggcgggaacgggatcacggtgttcgcgcccacggacaacgccttcacgtcgctccccgccggcacgctcaactcgctgtcggaccaggacaagaacgcgctggtgcagtaccacgtcgtgtccaccgccatccccatgtcgcagttcgacaccgtcagcaacccgctccggacgcaggcagggagcgcctcccccggggagtacccgctcaacgtcacctccgagggacagcaggtgaacatcaccacgggtgtcgtcaacgccaccgtcgccaactcgctctactccgaagacagcctcgtcgtctaccaggtcgacaaggtgctgctgccgcagaagctcttcggcgcggcggaagcgcccgcgcccgcgccgctcgcgccggccaagaagaagggcaagacgccggcggccgtcgcggactcgcccgaggcggaggcggaggcgtccccggacgcgacgaccgcgtcgctcgcgccggcgaggttgacgacgggaggtgccggcctcgccgcggctcttgcgctcgccggcgtgtggtggggactgtag

SEQ ID NO: 16555 - protein, 267 aa, Sorghum bicolor
  misc_feature: Useful for making plants with altered cell wall content and/or composition
  misc_feature: Functional homolog of the protein sequence given in SEQ ID NO 13937
  misc_feature: Useful for making plants with altered carbohydrate content
  misc_feature: Functional homolog of the protein sequence given in SEQ ID NO 13936
  misc_feature: Ceres ANNOT ID no. 8658485
  misc_feature (61)..(195): Pfam ID: Fasciclin Pfam Description: Fasciclin domain
MQRLARVLVVLVVAAATASAQGPTAAPATPTPATPAAPAPKAATTTTTSSNITGVLAKGGQFNTFIRLLKSTGVASQIDNQVSNGGNGITVFAPTDNAFTSLPAGTLNSLSDQDKNALVQYHVVSTAIPMSQFDTVSNPLRTQAGSASPGEYPLNVTSEGQQVNITTGVVNATVANSLYSEDSLVVYQVDKVLLPQKLFGAAEAPAPAPLAPAKKKGKTPAAVADSPEAEAEASPDATTASLAPARLTTGGAGLAAALALAGVWWGL

SEQ ID NO: 16556 - DNA, 1449 bp, Sorghum bicolor
  misc_feature: Ceres ANNOT ID no. 8658493
  misc_feature: Encodes the peptide sequence at SEQ ID NO 16557
atgagcgctcgggacgagtcagcgtccgccgccgcggcggccgcaccgccccacgtagtcctcgtctgcttcccgagccagggccacctgaaccctacgctccgcctcgccaagcgcctcgcagccaagggcctcctcgtcacctgctgcaccacctccggcgtcggcgcctgcctcgcggccgcctcctcctcgtcggcggccgtgtcgaccggcggcgtgcgcgtgggcagcggacgcatccggttcgagttcctcgacgaccacggtaacgagaaggacgacctcatgcggtacctcgagacgtccgggcgggcggcgttcgccgagctgctcgcgcgccaggccgcggcggggcggccagtgacgtgcgtcgtcggcaacccgttccttccgtgggcggtcgacgtcgccgccgaggccggcgtccccgccgcggtgctgtgggtgcagtcgtgcgcggtgttctcgctctactaccactacgcgcgcgggctggtggagttcccgcccgaggatgacaccgacgacgcgcgggtcgcgctcccgggcctcccgccgctgtccgtcgccgacgtgccgtcgttcctgctcccgtcgaacccgtacaagatgatcgccgacgcgattctgggccagttccgcaacgtggacaaggcggcgtgggtgctcgtcaactccttcacggagctcgagcgcgacgtgctcgccgcgctcccgggcgtcacgccgcgcccgccgcagctgatccccgtcggcccgctcatcgagctcgaggaggacggcggcggtgcggtgcggggtgacctgatcaaggccgaggacgacgactgcgtggggtggctggacgcgcagccgccgcgctccgtcgtgtacgcgtcggtgggcagcatcgtggtcctgtccgccgaggaggtcgccgagatggcgcacgggctcgcgtccgccggccggcccttcctgtgggtggtgcggccggacacccgcccgctgctcccggaggggttcctggacaccgtcgcgggccgcggcatggtcgtgccgtggagcccgcaggagcgcgtgctggcgcacgctgccaccgcgtgcttcctcacgcactgcggctggaactccacgctagagacggtggccgccggcgtgcccgtggtagctttcccccaatggggcgaccagtgcacggacgccaagttcctggtggacgagctcaggatgggcgtccgcctgcgcgcgccgctgcggcgggaggccgtgcgcgaggccgtggacgccgccgtggcggggccagaggccgacgccatgctgtccagtgccaggtcgtggagcgcggtggcccgggcggccgtggcgcccggcgggtcgtcggaccggcacgtccagacgttcgtcgacgaggttgtgcggcgagcgtgtggaaggcaaccagacgaggttacgatgagcgggtaa

SEQ ID NO: 16557 - protein, 482 aa, Sorghum bicolor
  misc_feature: Useful for making plants with altered carbohydrate content
  misc_feature: Functional homolog of the protein sequence given in SEQ ID NO 14401
  misc_feature: Ceres ANNOT ID no. 8658493
  misc_feature (18)..(468): SWISSPROT Homolog: EC 2.4.1.210 Limonoid glucosyltransferase
  misc_feature (18)..(470): Pfam ID: UDPGT Pfam Description: UDP-glucoronosyl and UDP-glucosyl transferase
MSARDESASAAAAAAPPHVVLVCFPSQGHLNPTLRLAKRLAAKGLLVTCCTTSGVGACLAAASSSSAAVSTGGVRVGSGRIRFEFLDDHGNEKDDLMRYLETSGRAAFAELLARQAAAGRPVTCVVGNPFLPWAVDVAAEAGVPAAVLWVQSCAVFSLYYHYARGLVEFPPEDDTDDARVALPGLPPLSVADVPSFLLPSNPYKMIADAILGQFRNVDKAAWVLVNSFTELERDVLAALPGVTPRPPQLIPVGPLIELEEDGGGAVRGDLIKAEDDDCVGWLDAQPPRSVVYASVGSIVVLSAEEVAEMAHGLASAGRPFLWVVRPDTRPLLPEGFLDTVAGRGMVVPWSPQERVLAHAATACFLTHCGWNSTLETVAAGVPVVAFPQWGDQCTDAKFLVDELRMGVRLRAPLRREAVREAVDAAVAGPEADAMLSSARSWSAVARAAVAPGGSSDRHVQTFVDEVVRRACGRQPDEVTMSG

SEQ ID NO: 16558 - DNA, 2652 bp, Sorghum bicolor
  misc_feature: Ceres ANNOT ID no. 8658519
  misc_feature: Encodes the peptide sequence at SEQ ID NO 16559
atggttattaagctccaggtggctctgagcttcgtggcgatcatctcgatcctctgcggtttctgcacggcgtacactcctgccgacaactacctcatcagctgtggctcttcggtcaacacgaaggtcggccggagggtcttcgtcgccgacagcgactccggttccgtcactctgacaacgcccaaaagcgccgccgtgaaagcctcgcccgacacgccgtggtcgggttccgattccgacgaggccgcgccggcgctgtaccagaccgccagggtgttcacggcgccgtcgtcctactctttcggcatcagccggcccggccgccacttcgtccgcctccacttcttcgccttcgcgtgccagggctacgacctcgccgccgcgagcttcaaggtgtcgacgcaggacgtcgtcctgatggacggcttcgcaccggagaataagacgacggacggcacgacgtcctcggcggtgcgcagggagttcctgctgtacgtcacccgggacacgctcgtcgtcacgttcgtgccgctggtggccggaggcggcctcgccttcgtcaacgccgtcgaggtcgtctcggtccccgacgacctcatcgttcacccggtacggacgtcgtccgaccagctgctcgaccctgccgtgatgccgctgcagacggcgtacagggtcaacgttggcggcgccgctgtcgccgccgacggcgacacgctaacgcgggaatggaccaccgatgagcgctacctggccgcctccatcagtcggtcggtcaacatcagcacccaagagttagtctacaacgggaggctggattatctccccggccaggcgacggccgacgacgcgccggacatcgtgtacgccacggccagggagctggccatgtcggacacggtggaccaactggcgtggcagttcgacgtggacgagcggccgtcgagctacctgatcagattccactggtgtaacatcgtgggcatggcggtggcgcctcacctgctcagcatcgatgcgtacgtgggtagccacgtagtggtcaccggtcttaatctctccatgatagggaacggcgcgttggccgtcccatactacaaggatttcatcttggattccagcgatccgtccggcaagatcgcggtttatgttgcctcgtcgtcgtcgatgaagatgaacagaagcacactgccaggccccatcctgaacggggtcgagatcatgaagatgcacttcagctcaggttctgtcgtcgtcgtcgagccgacggcaggatcgaaggcacagcatttggccatcgttttgggctcagtatgtggagcattcgccgccgtgtccattgctgctgtacttgtcattttccttaggaagaaagaggagaaggtgctgcctacaccgtcgtcgtcccggagccagtcgccgactccatggatgccgctcctcgatcgactgagcttgcgcagccgacgaccgggcgccagcggaacaggttcatccaaattcgccgtcgacagagacatgatccccatcgctgcctctccggtcccgagctaccgcttcccgttcgccgtgctgcgagacgcgaccaacgacttcgacgagcggctggtcatcggagccggcggcttcggcaaggtgtaccgcgcgacgctcccggacggcaccagcgtggccgtgaagcgcgcgagcccggagtcgcggcagggcgcgcgggagttccgcacggagatcgagctgctgtccggcctgcgccaccgccacctcgtgtccctcgtcggctactgcgacgagggcgacgagatgatcctgctgtacgagtacatggagcacggctctctcaggagccgcctgtacggcgccggcgccgccacggcggagcgggcgctcggctgggcgcagcggctggaggcctgcgccggcgcggctagggggctcctctacctgcacacggccctggccaagccggtgatccaccgcgacgtcaagtcgtccaacatcctcctggacggcggcctcgccgccagggtcgccgacttcggcctgtccagggccgggccggagctggaggagacgcacgtcagcacggcggtgaagggcagcttcgggtacgtggacccggagtacgtgcgcacgaggcagctcaccaccaagtccgacgtgtactcgctcggcgtcgtgctgctggaggcgctgtgcgcgcgccccgtcgtggacccgaggctccccaagccgatggtgaacctggtggagtgggctctgcactggcagggcaggggcgagctggacaagatcgtcgaccgccggatcgccgccgcggtgaggccccaggcgctgaggaagtacggcgagacggcagccaggtgcctcgcggcgcgcggcgcggacaggccggcgatggaggacgtcgtgtggagcctgcagttcgtgacgcggctgcaggacgacgacggcctcgagttctccgacgtcaacagcctgagcctggtgcgcgagctgatgccgcctttggattctcgtcggacaagctcgcatcagaacgaagccgggtgcgaggagggagagggtgccactgacgccagcttcaccgatgtcgatgtgtccgtgtccatgcgaggtgtcttctggcagatggtcaatgtgggcggcagatga

SEQ ID NO: 16559 - protein, 883 aa, Sorghum bicolor
  misc_feature: Useful for making plants with modulated biotic stress sensitivity
  misc_feature: Functional homolog of the protein sequence given in SEQ ID NO 14099
  misc_feature: Ceres ANNOT ID no. 8658519
  misc_feature (521)..(848): SWISSPROT Homolog: EC 2.7.11.1 Non-specific serine/threonine protein kinase
  misc_feature (532)..(808): Pfam ID: Pkinase Pfam Description: Protein kinase domain
MVIKLQVALSFVAIISILCGFCTAYTPADNYLISCGSSVNTKVGRRVFVADSDSGSVTLTTPKSAAVKASPDTPWSGSDSDEAAPALYQTARVFTAPSSYSFGISRPGRHFVRLHFFAFACQGYDLAAASFKVSTQDVVLMDGFAPENKTTDGTTSSAVRREFLLYVTRDTLVVTFVPLVAGGGLAFVNAVEVVSVPDDLIVHPVRTSSDQLLDPAVMPLQTAYRVNVGGAAVAADGDTLTREWTTDERYLAASISRSVNISTQELVYNGRLDYLPGQATADDAPDIVYATARELAMSDTVDQLAWQFDVDERPSSYLIRFHWCNIVGMAVAPHLLSIDAYVGSHVVVTGLNLSMIGNGALAVPYYKDFILDSSDPSGKIAVYVASSSSMKMNRSTLPGPILNGVEIMKMHFSSGSVVVVEPTAGSKAQHLAIVLGSVCGAFAAVSIAAVLVIFLRKKEEKVLPTPSSSRSQSPTPWMPLLDRLSLRSRRPGASGTGSSKFAVDRDMIPIAASPVPSYRFPFAVLRDATNDFDERLVIGAGGFGKVYRATLPDGTSVAVKRASPESRQGAREFRTEIELLSGLRHRHLVSLVGYCDEGDEMILLYEYMEHGSLRSRLYGAGAATAERALGWAQRLEACAGAARGLLYLHTALAKPVIHRDVKSSNILLDGGLAARVADFGLSRAGPELEETHVSTAVKGSFGYVDPEYVRTRQLTTKSDVYSLGVVLLEALCARPVVDPRLPKPMVNLVEWALHWQGRGELDKIVDRRIAAAVRPQALRKYGETAARCLAARGADRPAMEDVVWSLQFVTRLQDDDGLEFSDVNSLSLVRELMPPLDSRRTSSHQNEAGCEEGEGATDASFTDVDVSVSMRGVFWQMVNVGGR

SEQ ID NO: 16560 - DNA, 141 bp, Sorghum bicolor
  misc_feature: Ceres ANNOT ID no. 8658607
  misc_feature: Encodes the peptide sequence at SEQ ID NO 16561
atgaataagctgtctggtagtattcctgatgctctggctagtattggcaacctgcaacaattgtatctagtacacaacaacctttcaggtttgatcccagcagtcctagagaacctgacattgttgtcaaaattggattga

SEQ ID NO: 16561 - protein, 46 aa, Sorghum bicolor
  misc_feature: The sequence is a functional homolog of SEQ ID NO 2 in US patent 7135625
  misc_feature: Ceres ANNOT ID no. 8658607
  misc_feature (2)..(46): SWISSPROT Homolog: EC 2.7.11.1 Non-specific serine/threonine protein kinase
MNKLSGSIPDALASIGNLQQLYLVHNNLSGLIPAVLENLTLLSKLD

SEQ ID NO: 16562 - DNA, 333 bp, Sorghum bicolor
  misc_feature: Ceres ANNOT ID no. 8658621
  misc_feature: Encodes the peptide sequence at SEQ ID NO 16563
atggcgggcgacaacgggtcggtggttcggcggctctacctctctgtgtacaactgggttagcttcttcggatgtgcaactcttccacaagttggtataaggacatcagttctctggttcatcgtgtggagatttcctgagacacagtctcatgtctgtcttacttccttggtcctaagctggtccattactgaggtcatcagatatcctttctttggtttgagggaggcatttggaatcacacctttttggctcctatggctcaggtgcatctcccacgctttttttctcgaatacgcaagagaattgtgtatcattgtgttgcccatttag

SEQ ID NO: 16563 - protein, 110 aa, Sorghum bicolor
  misc_feature: Useful for making plants with modulated drought sensitivity
  misc_feature: Functional homolog of the protein sequence given in SEQ ID NO 13082
  misc_feature: Ceres ANNOT ID no. 8658621
MAGDNGSVVRRLYLSVYNWVSFFGCATLPQVGIRTSVLWFIVWRFPETQSHVCLTSLVLSWSITEVIRYPFFGLREAFGITPFWLLWLRCISHAFFLEYARELCIIVLPI

SEQ ID NO: 16564 - DNA, 762 bp, Sorghum bicolor
  misc_feature: Ceres ANNOT ID no. 8658634
  misc_feature: Encodes the peptide sequence at SEQ ID NO 16565
atgggccgcaagttcttcgtcggcggcaactggaaatgcaacggaaccacagatcaggtcgagaagattgtcaaaaccctgaatgaaggacaggttccccctgcagatgttgttgaggtcgttgtcagccctccttatgtcttcctaactgtggtcaagagcctgctgcgcccagagttccatgttgctgctcagaactgctgggtgaagaagggaggtgctttcactggtgaagtcagtgctgagatgctcgtcaaccttggtgttccctgggtcatccttggacactctgaaaggagagctctgctgggagaatcaaatgagtttgttggagacaaggttgcttatgcgctgtctcagggactaaaggtcattgcatgtgttggtgagacccttgagcagagggaggctgggtcaacaatggaagttgttgctgcacaaacaaaagcaattgctgagaagatcagtgactggagcaacgtagttgttgcctatgaaccagtatgggccattggaactggtaaagttgccaccccagctcaggctcaggaagtgcacgcatccctgagggattggctaaagatcaacgtcagccctgaggttgctgaatctacaaggatcatctacggaggttctgtaactgcagcgaactgcaaagagctaggagcacagcctgatgtcgatggtttccttgtcggtggagcttctttgaagcccgagttcatcgacatcatcaacgcggccaccgtgaagtccgcttaa

SEQ ID NO: 16565 - protein, 253 aa, Sorghum bicolor
  misc_feature: Useful for making plants with modulated biomass
  misc_feature: Functional homolog of the protein sequence given in SEQ ID NO 14343
  misc_feature: Ceres ANNOT ID no. 8658634
  misc_feature (1)..(253): SWISSPROT Homolog: EC 5.3.1.1 Triose-phosphate isomerase
  misc_feature (5)..(245): Pfam ID: TIM Pfam Description: Triosephosphate isomerase
MGRKFFVGGNWKCNGTTDQVEKIVKTLNEGQVPPADVVEVVVSPPYVFLTVVKSLLRPEFHVAAQNCWVKKGGAFTGEVSAEMLVNLGVPWVILGHSERRALLGESNEFVGDKVAYALSQGLKVIACVGETLEQREAGSTMEVVAAQTKAIAEKISDWSNVVVAYEPVWAIGTGKVATPAQAQEVHASLRDWLKINVSPEVAESTRIIYGGSVTAANCKELGAQPDVDGFLVGGASLKPEFIDIINAATVKSA

SEQ ID NO: 16566 - DNA, 255 bp, Sorghum bicolor
  misc_feature: Ceres ANNOT ID no. 8658665
  misc_feature: Encodes the peptide sequence at SEQ ID NO 16567
atggcggcggcgcgtcgtcgcggccgcgtggagctgcggcggatcgaggaccgggtgagccggcaggtgcgcttctccaagcgccgttcgggcctcttcaagaaggccttcgagctctccctcctctgcgacgccgaggtcgcgctcctcgtcttctcccccgccggcaagctctacgagtacgcctccgccagttgggtaggctatttgttatggtgggagatacatgtgttttgtgtagttttatgtttttaa

SEQ ID NO: 16567 - protein, 84 aa, Sorghum bicolor
  misc_feature: The sequence is a functional homolog of SEQ ID NO 1364 in the 10/666,642 US patent application
  misc_feature: The sequence is a functional homolog of SEQ ID NO 1728 in the 10/412,699 US patent application
  misc_feature: Useful for making plants with modulated flowering time
  misc_feature: Functional homolog of the protein sequence given in SEQ ID NO 13660
  misc_feature: The sequence is a functional homolog of SEQ ID NO 1368 in the 10/666,642 US patent application
  misc_feature: The sequence is a functional homolog of SEQ ID NO 422 in the 11/435,388 US patent application
  misc_feature: The sequence is a functional homolog of SEQ ID NO 919 in the 10/666,642 US patent application
  misc_feature: The sequence is a functional homolog of SEQ ID NO 122 in the 10/666,642 US patent application
  misc_feature: The sequence is a functional homolog of SEQ ID NO 406 in the 10/412,699 US patent application
  misc_feature: The sequence is a functional homolog of SEQ ID NO 731 in the 10/666,642 US patent application
  misc_feature: The sequence is a functional homolog of SEQ ID NO 707 in the 10/666,642 US patent application
  misc_feature: Useful for making plants with altered alkaloid content
  misc_feature: Functional homolog of the protein sequence given in SEQ ID NO 13525
  misc_feature: Useful for making plants with altered terpenoid content
  misc_feature: Functional homolog of the protein sequence given in SEQ ID NO 13021
  misc_feature: The sequence is a functional homolog of SEQ ID NO 6 in US patent 7279615
  misc_feature: The sequence is a functional homolog of SEQ ID NO 1454 in the 10/374,780 US patent application
  misc_feature: The sequence is a functional homolog of SEQ ID NO 2191 in the 10/666,642 US patent application
  misc_feature: Useful for making plants with altered lignin content
  misc_feature: Functional homolog of the protein sequence given in SEQ ID NO 13210
  misc_feature: Useful for making plants with modulated biomass
  misc_feature: Functional homolog of the protein sequence given in SEQ ID NO 13569
  misc_feature: The sequence is a functional homolog of SEQ ID NO 1701 in the 10/412,699 US patent application
  misc_feature: The sequence is a functional homolog of SEQ ID NO 2197 in the 10/666,642 US patent application
  misc_feature: The sequence is a functional homolog of SEQ ID NO 36 in the 10/666,642 US patent application
  misc_feature: The sequence is a functional homolog of SEQ ID NO 60 in the 10/412,699 US patent application
  misc_feature: The sequence is a functional homolog of SEQ ID NO 4 in US patent 7057087
  misc_feature: The sequence is a functional homolog of SEQ ID NO 1362 in the 10/666,642 US patent application
  misc_feature: The sequence is a functional homolog of SEQ ID NO 199 in the 11/479,226 US patent application
  misc_feature: The sequence is a functional homolog of SEQ ID NO 34 in the 10/666,642 US patent application
  misc_feature: The sequence is a functional homolog of SEQ ID NO 58 in the 10/412,699 US patent application
  misc_feature: The sequence is a functional homolog of SEQ ID NO 428 in the 10/666,642 US patent application
  misc_feature: The sequence is a functional homolog of SEQ ID NO 892 in the 11/435,388 US patent application
  misc_feature: The sequence is a functional homolog of SEQ ID NO 1732 in the 10/412,699 US patent application
  misc_feature: The sequence is a functional homolog of SEQ ID NO 44 in the 10/666,642 US patent application
  misc_feature: The sequence is a functional homolog of SEQ ID NO 66 in the 10/412,699 US patent application
  misc_feature: The sequence is a functional homolog of SEQ ID NO 1468 in the 10/666,642 US patent application
  misc_feature: The sequence is a functional homolog of SEQ ID NO 282 in the 10/666,642 US patent application
  misc_feature: The sequence is a functional homolog of SEQ ID NO 46 in the 10/666,642 US patent application
  misc_feature: The sequence is a functional homolog of SEQ ID NO 1470 in the 10/666,642 US patent application
  misc_feature: The sequence is a functional homolog of SEQ ID NO 284 in the 10/666,642 US patent application
  misc_feature: The sequence is a functional homolog of SEQ ID NO 30 in the 10/666,642 US patent application
  misc_feature: The sequence is a functional homolog of SEQ ID NO 2195 in the 10/666,642 US patent application
  misc_feature: The sequence is a functional homolog of SEQ ID NO 2199 in the 10/666,642 US patent application
  misc_feature: The sequence is a functional homolog of SEQ ID NO 28 in the 10/666,642 US patent application
  misc_feature: The sequence is a functional homolog of SEQ ID NO 42 in the 10/666,642 US patent application
  misc_feature: Useful for biocontainment applications
  misc_feature: Functional homolog of the protein sequence given in SEQ ID NO 14402
  misc_feature: The sequence is a functional homolog of SEQ ID NO 2189 in the 10/666,642 US patent application
  misc_feature: The sequence is a functional homolog of SEQ ID NO 203 in the 11/479,226 US patent application
  misc_feature: The sequence is a functional homolog of SEQ ID NO 40 in the 10/666,642 US patent application
  misc_feature: The sequence is a functional homolog of SEQ ID NO 730 in the 10/666,642 US patent application
  misc_feature: The sequence is a functional homolog of SEQ ID NO 14 in the 10/666,642 US patent application
  misc_feature: The sequence is a functional homolog of SEQ ID NO 32 in the 10/666,642 US patent application
  misc_feature: Useful for making plants with modulated phosphate use efficiency
  misc_feature: Functional homolog of the protein sequence given in SEQ ID NO 13166
  misc_feature: The sequence is a functional homolog of SEQ ID NO 2064 in the 10/374,780 US patent application
  misc_feature: The sequence is a functional homolog of SEQ ID NO 572 in the 10/412,699 US patent application
  misc_feature: The sequence is a functional homolog of SEQ ID NO 816 in the 10/225,066 US patent application
  misc_feature: The sequence is a functional homolog of SEQ ID NO 2 in US patent 7273968
  misc_feature: The sequence is a functional homolog of SEQ ID NO 1460 in the 10/666,642 US patent application
  misc_feature: The sequence is a functional homolog of SEQ ID NO 938 in the 10/412,699 US patent application
  misc_feature: The sequence is a functional homolog of SEQ ID NO 1360 in the 10/666,642 US patent application
  misc_feature: The sequence is a functional homolog of SEQ ID NO 22 in the 10/666,642 US patent application
  misc_feature: The sequence is a functional homolog of SEQ ID NO 122 in the 10/225,066 US patent application
  misc_feature: The sequence is a functional homolog of SEQ ID NO 234 in the 10/374,780 US patent application
  misc_feature: The sequence is a functional homolog of SEQ ID NO 164 in the 10/666,642 US patent application
  misc_feature: The sequence is a functional homolog of SEQ ID NO 642 in the 11/435,388 US patent application
  misc_feature: The sequence is a functional homolog of SEQ ID NO 2193 in the 10/666,642 US patent application
  misc_feature: The sequence is a functional homolog of SEQ ID NO 1453 in the 10/374,780 US patent application
  misc_feature: The sequence is a functional homolog of SEQ ID NO 1243 in the 11/479,226 US patent application
  misc_feature: The sequence is a functional homolog of SEQ ID NO 1420 in the 10/666,642 US patent application
  misc_feature: The sequence is a functional homolog of SEQ ID NO 1814 in the 10/412,699 US patent application
  misc_feature: The sequence is a functional homolog of SEQ ID NO 570 in the 10/412,699 US patent application
  misc_feature: The sequence is a functional homolog of SEQ ID NO 1366 in the 10/666,642 US patent application
  misc_feature: The sequence is a functional homolog of SEQ ID NO 1730 in the 10/412,699 US patent application
  misc_feature: The sequence is a functional homolog of SEQ ID NO 207 in the 11/479,226 US patent application
  misc_feature: The sequence is a functional homolog of SEQ ID NO 64 in the 10/412,699 US patent application
  misc_feature: The sequence is a functional homolog of SEQ ID NO 1971 in the 10/412,699 US patent application
  misc_feature: The sequence is a functional homolog of SEQ ID NO 1973 in the 10/412,699 US patent application
  misc_feature: The sequence is a functional homolog of SEQ ID NO 1702 in the 10/412,699 US patent application
  misc_feature: The sequence is a functional homolog of SEQ ID NO 715 in the 10/666,642 US patent application
  misc_feature: The sequence is a functional homolog of SEQ ID NO 2232 in the 10/374,780 US patent application
  misc_feature: The sequence is a functional homolog of SEQ ID NO 232 in the 10/225,068 US patent application
  misc_feature: The sequence is a functional homolog of SEQ ID NO 310 in the 10/225,066 US patent application
  misc_feature: The sequence is a functional homolog of SEQ ID NO 729 in the 10/666,642 US patent application
  misc_feature: The sequence is a functional homolog of SEQ ID NO 1110 in the 10/225,066 US patent application
  misc_feature: The sequence is a functional homolog of SEQ ID NO 166 in the 10/374,780 US patent application
  misc_feature: The sequence is a functional homolog of SEQ ID NO 1812 in the 10/412,699 US patent application
  misc_feature: The sequence is a functional homolog of SEQ ID NO 568 in the 10/412,699 US patent application
  misc_feature: The sequence is a functional homolog of SEQ ID NO 1945 in the 10/412,699 US patent application
  misc_feature: The sequence is a functional homolog of SEQ ID NO 1947 in the 10/412,699 US patent application
  misc_feature: The sequence is a functional homolog of SEQ ID NO 14 in the 10/374,780 US patent application
  misc_feature: The sequence is a functional homolog of SEQ ID NO 328 in the 10/225,066 US patent application
  misc_feature: The sequence is a functional homolog of SEQ ID NO 34 in the 10/286,264 US patent application
  misc_feature: The sequence is a functional homolog of SEQ ID NO 468 in the 11/435,388 US patent application
  misc_feature: The sequence is a functional homolog of SEQ ID NO 68 in the 10/412,699 US patent application
  misc_feature: Useful for making plants with modulated nitrogen use efficiency
  misc_feature: Functional homolog of the protein sequence given in SEQ ID NO 13191
  misc_feature: The sequence is a functional homolog of SEQ ID NO 1949 in the 10/412,699 US patent application
  misc_feature: The sequence is a functional homolog of SEQ ID NO 4 in US patent 7303918
  misc_feature: The sequence is a functional homolog of SEQ ID NO 2822 in the 10/374,780 US patent application
  misc_feature: The sequence is a functional homolog of SEQ ID NO 82 in the 11/375,241 US patent application
  misc_feature: The sequence is a functional homolog of SEQ ID NO 1957 in the 10/412,699 US patent application
  misc_feature: The sequence is a functional homolog of SEQ ID NO 1959 in the 10/412,699 US patent application
  misc_feature: Ceres ANNOT ID no. 8658665
  misc_feature (13)..(63): Pfam ID: SRF-TF Pfam Description: SRF-type transcription factor (DNA-binding and dimerisation domain)
MAAARRRGRVELRRIEDRVSRQVRFSKRRSGLFKKAFELSLLCDAEVALLVFSPAGKLYEYASASWVGYLLWWEIHVFCVVLCF

SEQ ID NO: 16568 - DNA, 1746 bp, Sorghum bicolor
  misc_feature: Ceres ANNOT ID no. 8658700
  misc_feature: Encodes the peptide sequence at SEQ ID NO 16569
atgggagaggtcgcggacatgtacacccaagacgggacggtggacaggaaggggaatcccgccctgaagaaggacaccggcaactggagggcatgcccctacatcctcgcgaacgagtgctgcgagaggctggcctactatggcatgagcaccaaccttgttcactacatgaagacccggcttggccaggtgaacagcgtcgcctccaacaacgtcaccaactggtcagggacgtgctacatcacgccactcatcggcgccttcttcgccgacgcgtacctggggaggttctggaccatcgccagcttcatggtcatctacattttcggactggcgctgctgacgatggcgtcgtcggtgaaggggctggtgcctacgtcgtgtgacaatgacggcgtgtgccacccgacggacgcgcagtcggcggtggtgttcgtggcgctgtacctgatcgcgctgggaacgggcgggatcaagccctgcgtgtcctccttcggcgccgaccagttcgacgagaacgacgagcgggagaagaagagcaagagctccttcttcaactggttctacttctccatcaacatcggcgcgctggtggcgtccacggtgctggtgtacgtgcagacgcacatcggctggggctggggcttcggcatccccgccgtggtcatggccatcgccgtcgtcagcttcttcgtgggcacgccgctgtacaggcaccagaagcccggtggcagcccgctgacgcgcatcgcgcaggtgctcgtcgcgtgcgcgcgcaagtggaacgtggccgtgcccgccgacaagtcgcgcctccacgagacgctggacaaggagtccggcatcgagggcagccgcaagctggagcacacggaccagctcgcgtgcctcgacagggctgccgtcgtgacggccgaggacagcgccgcgggggcggcgacggcgacgagcccgtggcgcctgtgcacggtgacgcaggtggaggagctcaagagcgtgatccggctgctccccatctgggcgagcgggatcgtgttcgcggcggtgtactcgcagatgagcaccatgttcatcctccagggcgacacgctggaccagcgcatggggtccaagttcaagatcccctcggcgacgctctccatggtggacaccatcagcgtcatcttctgggtgcccgtctacgaccgcgtcatcgtgcccgtcgtgcgctcctacaccggccgtccccgagggttcacgcagctgcagcggatgggcatcggcctcgtcgtctccatcttctccatggtggcggcgggcgtgctggacatcgtgcggctgaacgccgtggcgcggcacggcctgtacggcaaggacgaccacgtgcccatctccatcttctggcagataccgcagtacttcatcatcgggtgcgcggaggtgttcaccttcgtggggcagctggagttcttctacgaccaggcgcccgacgccatgaggagcatgtgctccgcgctgtcgctcaccaccgtcgcgctcggcaactacctcagcacggtgctggtgaccatcgtcacgcacatcaccaccaggaacggcaacatcgggtggatcccggagaacctcaaccggggccacctcgactacttcttctggctgctcgccgtgctcagcctcctcaacttcctcgtctacctcgtcatcgccacctggtacaagtacaagaagacggccgatgatatcccggacgccaaaggggagcactga

SEQ ID NO: 16569 - protein, 581 aa, Sorghum bicolor
  misc_feature: Useful for making plants with altered carbon content
  misc_feature: Useful for making plants with altered nitrogen content
  misc_feature: Functional homolog of the protein sequence given in SEQ ID NO 14117
  misc_feature: Ceres ANNOT ID no. 8658700
  misc_feature (97)..(504): Pfam ID: PTR2 Pfam Description: POT family
MGEVADMYTQDGTVDRKGNPALKKDTGNWRACPYILANECCERLAYYGMSTNLVHYMKTRLGQVNSVASNNVTNWSGTCYITPLIGAFFADAYLGRFWTIASFMVIYIFGLALLTMASSVKGLVPTSCDNDGVCHPTDAQSAVVFVALYLIALGTGGIKPCVSSFGADQFDENDEREKKSKSSFFNWFYFSINIGALVASTVLVYVQTHIGWGWGFGIPAVVMAIAVVSFFVGTPLYRHQKPGGSPLTRIAQVLVACARKWNVAVPADKSRLHETLDKESGIEGSRKLEHTDQLACLDRAAVVTAEDSAAGAATATSPWRLCTVTQVEELKSVIRLLPIWASGIVFAAVYSQMSTMFILQGDTLDQRMGSKFKIPSATLSMVDTISVIFWVPVYDRVIVPVVRSYTGRPRGFTQLQRMGIGLVVSIFSMVAAGVLDIVRLNAVARHGLYGKDDHVPISIFWQIPQYFIIGCAEVFTFVGQLEFFYDQAPDAMRSMCSALSLTTVALGNYLSTVLVTIVTHITTRNGNIGWIPENLNRGHLDYFFWLLAVLSLLNFLVYLVIATWYKYKKTADDIPDAKGEH

SEQ ID NO: 16570 - DNA, 882 bp, Sorghum bicolor
  misc_feature: Ceres ANNOT ID no. 8658703
  misc_feature: Encodes the peptide sequence at SEQ ID NO 16571
atgatgcgggagatgtatatggacgtgctgccgccggtggaccacatagccgcacggagcaactggttcccggccgcggcgcgtctctggacggcggaggagaacaagcggttcgagtctgcgctcgccgggctcgacctctgccacccggactgggagaaggtggcgcaggccatccccggccggacggtccgcgaggtcgtcagccacttcaagaacctccagctcgacgtccagcagatcgagagcggccaggtgcccttgccggtctacggcagcggggccagctcgttcactctgcagtgggacggcaatggcggctacgggcccggggacttcaggcacgggtaccgcttcggcggaggctgcgggaagcggcaccatggccgcacgccggagcaggaaaggaagaagggcgtgccatggacggaggaggagcacaagttgtttctcttaggcctgaagaaatatggcaagggggattggaggaacatatcacgcaacttcgttcagacgaggacgcctactcaggtggccagtcatgcgcagaagtacttcatcaggctcaactccggcggcaaggacaagaggagatccagcattcatgacattaccactgtgaacctgacggacgagcagcctccatcaccatcccagtcctctctgatcaccaaccagtcaaacgcatcagctccgactgcggggataggccagttctcattggcagccgatgccaagcaacacggttctggaaatctgcccttcaattcaccaagccggacctctgtgatggcggcttaccggatggatttgcaagatcaaggtctgcagtgtggccctctacatgatcaattggtcgccagccagagcattctgttctag

SEQ ID NO: 16571 - protein, 293 aa, Sorghum bicolor
  misc_feature: The sequence is a functional homolog of SEQ ID NO 1897 in the 11/479,226 US patent application
  misc_feature: The sequence is a functional homolog of SEQ ID NO 120 in the 11/375,241 US patent application
  misc_feature: The sequence is a functional homolog of SEQ ID NO 2680 in the 10/374,780 US patent application
  misc_feature: The sequence is a functional homolog of SEQ ID NO 654 in the 10/225,066 US patent application
  misc_feature: Ceres ANNOT ID no. 8658703
  misc_feature (139)..(186): Pfam ID: Myb_DNA-binding Pfam Description: Myb-like DNA-binding domain
  misc_feature (27)..(75): Pfam ID: Myb_DNA-binding Pfam Description: Myb-like DNA-binding domain
MMREMYMDVLPPVDHIAARSNWFPAAARLWTAEENKRFESALAGLDLCHPDWEKVAQAIPGRTVREVVSHFKNLQLDVQQIESGQVPLPVYGSGASSFTLQWDGNGGYGPGDFRHGYRFGGGCGKRHHGRTPEQERKKGVPWTEEEHKLFLLGLKKYGKGDWRNISRNFVQTRTPTQVASHAQKYFIRLNSGGKDKRRSSIHDITTVNLTDEQPPSPSQSSLITNQSNASAPTAGIGQFSLAADAKQHGSGNLPFNSPSRTSVMAAYRMDLQDQGLQCGPLHDQLVASQSILF

SEQ ID NO: 16572 - DNA, 1530 bp, Sorghum bicolor
  misc_feature: Ceres ANNOT ID no. 8658751
  misc_feature: Encodes the peptide sequence at SEQ ID NO 16573
atgcagccgcctacctttctcccgctcgccgccgccgtcgtcgccgtcctcctactcgccgtcgccccgacacccgccgtctcccgccaccaccgctcgtccgccgacacggagacgctcgatgtagccgcctcactctccctcgcccgcgccgcgctctccaccgacgccgccgtctcgctgcaccagtccgccgccgccgccgaggcgaagcgctcttcacgggagagcggcggaggaggtagtctcacgctgcggctccactcccgggacttcctgccggaggcgcagcagcggcacgcgacgtaccggtccctggtgcaatcccgcctccgccgcgactcggcgcgcgccgcggcgctgtcggcccgcgcgacgctggcggcggacggggtgacccgtcaggaccttcgccccgcgaacgagtcggcggtcttcggggcgtccttggcggcggcgatccagggccccgtggtgtcgggcgtcgggcagggcagcggggagtacttctcccgcgtgggcatcggcagccccgcgcgggagctgtacatggtgctggacaccggcagcgacgtcacctgggtgcagtgccagccctgcgccgactgctaccagcagtcggacccggtgttcgacccgtcgctctccgcctcctacgccgccgtctcctgcgactccccgcggtgccgtgacctcgacaccgcggcgtgccgcaacgccacgggcgcgtgcctctacgaggtggcctacggcgacggatcctacaccgtgggcgacttcgccaccgagacgctgacgctcggggactccacccccgtcaccaacgtcgccatcgggtgcggccacgacaacgaaggtctcttcgtcggcgccgcggggctgctagcgctgggaggcggcccgctctcgttcccgtcccagatctccgcgtccaccttctcctactgcctcgtcgaccgcgactcccccgccgcgtccacgctccagttcggcgccgacggcgccgaggcggacaccgtgacggcgccactcgtgcgcagcccgcggacgggcaccttctactacgtggcgctgtcggggatctcggtcggcgggcaggcgctgtccatcccgtcgtcggccttcgccatggacgccacgtcgggatcgggaggcgtcatcgtggactccggcaccgcggtcacgcgtctccagtcctcggcctacgcggcgctccgcgacgccttcgtccgcggcacgccgtcgctgccgcggacctccggggtgtcgctgttcgacacgtgctacgacctgtcggaccggaccagcgtggaggtgcccgcggtgtcgctccggttcgagggcggcggcgcgctgcggcttcccgcgaagaactacctcatccccgtggacggtgccgggacctactgcctggcgttcgcgccgacgaacgccgccgtgtccatcatcgggaacgtgcagcagcagggcacccgcgtcagcttcgacaccgccaagggcgtcgtcggcttcaccccgaacaagtgctag

SEQ ID NO: 16573 - protein, 509 aa, Sorghum bicolor
  misc_feature: Useful for making plants with modulated biomass
  misc_feature: Functional homolog of the protein sequence given in SEQ ID NO 13548
  misc_feature: Ceres ANNOT ID no. 8658751
  misc_feature (168)..(509): SWISSPROT Homolog: EC 3.4.23.12 Nepenthesin
  misc_feature (168)..(507): Pfam ID: Asp Pfam Description: Eukaryotic aspartyl protease
MQPPTFLPLAAAVVAVLLLAVAPTPAVSRHHRSSADTETLDVAASLSLARAALSTDAAVSLHQSAAAAEAKRSSRESGGGGSLTLRLHSRDFLPEAQQRHATYRSLVQSRLRRDSARAAALSARATLAADGVTRQDLRPANESAVFGASLAAAIQGPVVSGVGQGSGEYFSRVGIGSPARELYMVLDTGSDVTWVQCQPCADCYQQSDPVFDPSLSASYAAVSCDSPRCRDLDTAACRNATGACLYEVAYGDGSYTVGDFATETLTLGDSTPVTNVAIGCGHDNEGLFVGAAGLLALGGGPLSFPSQISASTFSYCLVDRDSPAASTLQFGADGAEADTVTAPLVRSPRTGTFYYVALSGISVGGQALSIPSSAFAMDATSGSGGVIVDSGTAVTRLQSSAYAALRDAFVRGTPSLPRTSGVSLFDTCYDLSDRTSVEVPAVSLRFEGGGALRLPAKNYLIPVDGAGTYCLAFAPTNAAVSIIGNVQQQGTRVSFDTAKGVVGFTPNKC

SEQ ID NO: 16574 - DNA, 1071 bp, Sorghum bicolor
  misc_feature: Ceres ANNOT ID no. 8658798
  misc_feature: Encodes the peptide sequence at SEQ ID NO 16575
atgcctggtggtggtgacgatgaggcgctgacggcgcctgaggttgtgacgaggggcagagtgggggcggccgtaacgccgaccgtgggaacgcccgttggcggcggcacaggagcggaagattccccagacgtggccatcgtctctgataccaagttgcttgaaccaggcccaggtgctcttggtgttgcttctgactccagtgacagatccaaggacaaacatggagatcaaaagacactgcgtcgtcttgctcaaaatcgtgaggctgcaaggaagagccgattaaggaagaaggcatatgttcaacagttggagaatagcagactaaaacttacccaactagagcaagagttgcaacgagcacgtcagcagggcatttttatatctagttcagttgatcagtcacactccatgagtggaaatggggcattggcctttgatatggagtatgcgaggtggttggaagagcacaatcggcaaattagtgaactaagggctggtgtcagcgctcatgcaagtgatactgatctccgcagtgttgttgataagatcatgtcacactatgatgagattttcaggctcaaaggaaatgcagccaaggcagatgtctttcacgtcttatcaggcatgtggaagacaccagcagagaggtgtttcttgtggctaggaggtttccgaccatctgaggttttaaagcttctttcgacacaacttgaacctctcaccgagcagcagctgtcagggataggcaaccttcagcaatcttcacagcaagctgaagatgctctttcacaaggaatggaggcccttcagcagtccttggctgaaaccttggccgggtctctttcgtcttctggatcaacaggaaatgtggcaaactacatgggtcagatggccatggccatgggaaagctcggaacgcttgagaatttccttcgtcagaccctacaacagatgcaaaggatcctgaccactagacagtcagctcgggcgctgcttgtgataagtgattactcttcacgtctccgtgccctaagctctctctggcttgctcggccgaaggaatag

SEQ ID NO: 16575 - protein, 356 aa, Sorghum bicolor
  misc_feature: The sequence is a functional homolog of SEQ ID NO 1492 in the 10/374,780 US patent application
  misc_feature: The sequence is a functional homolog of SEQ ID NO 1562 in the 10/412,699 US patent application
  misc_feature: The sequence is a functional homolog of SEQ ID NO 1496 in the 10/374,780 US patent application
  misc_feature: The sequence is a functional homolog of SEQ ID NO 1566 in the 10/412,699 US patent application
  misc_feature: The sequence is a functional homolog of SEQ ID NO 1792 in the 10/412,699 US patent application
  misc_feature: The sequence is a functional homolog of SEQ ID NO 2030 in the 10/374,780 US patent application
  misc_feature: The sequence is a functional homolog of SEQ ID NO 206 in the 10/225,068 US patent application
  misc_feature: The sequence is a functional homolog of SEQ ID NO 356 in the 10/412,699 US patent application
  misc_feature: The sequence is a functional homolog of SEQ ID NO 831 in the 11/479,226 US patent application
  misc_feature: The sequence is a functional homolog of SEQ ID NO 934 in the 11/435,388 US patent application
  misc_feature: The sequence is a functional homolog of SEQ ID NO 1794 in the 10/412,699 US patent application
  misc_feature: The sequence is a functional homolog of SEQ ID NO 2032 in the 10/374,780 US patent application
  misc_feature: The sequence is a functional homolog of SEQ ID NO 380 in the 10/412,699 US patent application
  misc_feature: The sequence is a functional homolog of SEQ ID NO 534 in the 10/225,066 US patent application
  misc_feature: The sequence is a functional homolog of SEQ ID NO 936 in the 11/435,388 US patent application
  misc_feature: The sequence is a functional homolog of SEQ ID NO 1788 in the 10/412,699 US patent application
  misc_feature: The sequence is a functional homolog of SEQ ID NO 2026 in the 10/374,780 US patent application
  misc_feature: The sequence is a functional homolog of SEQ ID NO 354 in the 10/412,699 US patent application
  misc_feature: The sequence is a functional homolog of SEQ ID NO 823 in the 11/479,226 US patent application
  misc_feature: The sequence is a functional homolog of SEQ ID NO 930 in the 11/435,388 US patent application
  misc_feature: The sequence is a functional homolog of SEQ ID NO 1494 in the 10/374,780 US patent application
  misc_feature: The sequence is a functional homolog of SEQ ID NO 1564 in the 10/412,699 US patent application
  misc_feature: The sequence is a functional homolog of SEQ ID NO 1878 in the 10/412,699 US patent application
  misc_feature: The sequence is a functional homolog of SEQ ID NO 2138 in the 10/374,780 US patent application
  misc_feature: The sequence is a functional homolog of SEQ ID NO 372 in the 10/225,066 US patent application
  misc_feature: The sequence is a functional homolog of SEQ ID NO 878 in the 11/435,388 US patent application
  misc_feature: The sequence is a functional homolog of SEQ ID NO 1495 in the 10/374,780 US patent application
  misc_feature: The sequence is a functional homolog of SEQ ID NO 1565 in the 10/412,699 US patent application
  misc_feature: The sequence is a functional homolog of SEQ ID NO 114 in the 10/666,642 US patent application
  misc_feature: The sequence is a functional homolog of SEQ ID NO 2362 in the 10/374,780 US patent application
  misc_feature: The sequence is a functional homolog of SEQ ID NO 376 in the 10/412,699 US patent application
  misc_feature: The sequence is a functional homolog of SEQ ID NO 608 in the 10/225,066 US patent application
  misc_feature: The sequence is a functional homolog of SEQ ID NO 848 in the 11/435,388 US patent application
  misc_feature: The sequence is a functional homolog of SEQ ID NO 871 in the 11/479,226 US patent application
  misc_feature: Useful for making plants with modulated biomass
  misc_feature: Useful for making plants with modulated flowering time
  misc_feature: Functional homolog of the protein sequence given in SEQ ID NO 13559
  misc_feature: Ceres ANNOT ID no. 8658798
  misc_feature (75)..(127): Pfam ID: bZIP_1 Pfam Description: bZIP transcription factor
MPGGGDDEALTAPEVVTRGRVGAAVTPTVGTPVGGGTGAEDSPDVAIVSDTKLLEPGPGALGVASDSSDRSKDKHGDQKTLRRLAQNREAARKSRLRKKAYVQQLENSRLKLTQLEQELQRARQQGIFISSSVDQSHSMSGNGALAFDMEYARWLEEHNRQISELRAGVSAHASDTDLRSVVDKIMSHYDEIFRLKGNAAKADVFHVLSGMWKTPAERCFLWLGGFRPSEVLKLLSTQLEPLTEQQLSGIGNLQQSSQQAEDALSQGMEALQQSLAETLAGSLSSSGSTGNVANYMGQMAMAMGKLGTLENFLRQTLQQMQRILTTRQSARALLVISDYSSRLRALSSLWLARPKE

SEQ ID NO: 16576 - DNA, 456 bp, Sorghum bicolor
  misc_feature: Ceres ANNOT ID no. 8658819
  misc_feature: Encodes the peptide sequence at SEQ ID NO 16577
atgtcgctggtgaggcgcagcaacgtgttcgaccccttctccctcgacctctgggaccccttcgacaacatgttccgttccatcgtcccgtcggcctccggcgactccgagaccgccgcgttcgccaacgcccgcatcgactggaaggagacgcccgaggcgcacgtgttcaaggccgacctccccggcgtcaagaaggaggaggtcaaggtggaggtggaggacggcaacgtgctcgtcatcagcggccagcgcagcagggagaaggaggacaagaacgacaagtggcaccgcgtggagcgcagcagcggccagttcctcaggcgcttccgcctgccggagaacgccaagacggaggaggtgaaggccgggctggagaacggcgtgctcacggtcaccgtgcccaaggcggaggagaagaagcctgaggtgaaggctatcgagatctctggttaa

SEQ ID NO: 16577 - protein, 151 aa, Sorghum bicolor
  misc_feature: Useful for making plants with modulated heat sensitivity
  misc_feature: Functional homolog of the protein sequence given in SEQ ID NO 13940
  misc_feature: Ceres ANNOT ID no. 8658819
  misc_feature (47)..(150): Pfam ID: HSP20 Pfam Description: Hsp20/alpha crystallin family
MSLVRRSNVFDPFSLDLWDPFDNMFRSIVPSASGDSETAAFANARIDWKETPEAHVFKADLPGVKKEEVKVEVEDGNVLVISGQRSREKEDKNDKWHRVERSSGQFLRRFRLPENAKTEEVKAGLENGVLTVTVPKAEEKKPEVKAIEISG

SEQ ID NO: 16578 - DNA, 459 bp, Sorghum bicolor
  misc_feature: Ceres ANNOT ID no. 8658813
  misc_feature: Encodes the peptide sequence at SEQ ID NO 16579
atgtcgctggtgaggcgcagcaacgtgttcgaccccttctccatggacctctgggacccgttcgacaacatgttccgctccatcgtcccgtcggccgcctccggcgactccgagaccgcggccttcgccaacgcccgcatcgactggaaggagacgcccgaggcgcacgtgttcaaggccgacctccccggcgtgaagaaggaggaggtcaaggtggaggtggaggacggcaacgtgctcgtcatcagcggccagcgcagcagggagaaggaggacaagaacgacaagtggcaccgcgtggagcgcagcagcggccagttcacgaggcgcttccgcctgccggagaacgccaagacggaggaggtgaaggccggcctcgagaacggcgtgctcacggtcaccgtgcccaaggctgaggtcaagaagcccgaggtgaagagcatccagatctccggttga

SEQ ID NO: 16579 - protein, 152 aa, Sorghum bicolor
  misc_feature: Useful for making plants with modulated heat sensitivity
  misc_feature: Functional homolog of the protein sequence given in SEQ ID NO 13940
  misc_feature: Ceres ANNOT ID no. 8658813
  misc_feature (48)..(151): Pfam ID: HSP20 Pfam Description: Hsp20/alpha crystallin family
MSLVRRSNVFDPFSMDLWDPFDNMFRSIVPSAASGDSETAAFANARIDWKETPEAHVFKADLPGVKKEEVKVEVEDGNVLVISGQRSREKEDKNDKWHRVERSSGQFTRRFRLPENAKTEEVKAGLENGVLTVTVPKAEVKKPEVKSIQISG

SEQ ID NO: 16580 - DNA, 453 bp, Sorghum bicolor
  misc_feature: Ceres ANNOT ID no. 8658821
  misc_feature: Encodes the peptide sequence at SEQ ID NO 16581
atgtcgctggtgaggcgcagcaccaacgtgttcgaccccttcgccgacttctgggaccccttcgacgtcttccgctccatagtgcctgctgcatcaacggaccgcgacacggcggccttcgcgaacgcgcgcatcgactggaaggagacgccggaggcgcacgtgttcaaggccgacgtccccggcgtgaagaaggaggaggtcaaggtggaggtggaggacggcaacgtgctcgtcatcagcggcgagcggcgcaaggagaaggaggacaaggacgacaagtggcaccgcgtggagcgcagcagcggcaggttcatgaggcggttccggctgccggagaacgccaagacggaggaggtgaaggccgggctggagaacggcgtgctcacggtcaccgtgcctaaggccgaggtcaagaagcccgaggtgaagagcgtcgagatcgccggctaa

SEQ ID NO: 16581 - protein, 150 aa, Sorghum bicolor
  misc_feature: Useful for making plants with modulated heat sensitivity
  misc_feature: Functional homolog of the protein sequence given in SEQ ID NO 13940
  misc_feature: Ceres ANNOT ID no. 8658821
  misc_feature (46)..(149): Pfam ID: HSP20 Pfam Description: Hsp20/alpha crystallin family
MSLVRRSTNVFDPFADFWDPFDVFRSIVPAASTDRDTAAFANARIDWKETPEAHVFKADVPGVKKEEVKVEVEDGNVLVISGERRKEKEDKDDKWHRVERSSGRFMRRFRLPENAKTEEVKAGLENGVLTVTVPKAEVKKPEVKSVEIAG

SEQ ID NO: 16582 - DNA, 459 bp, Sorghum bicolor
  misc_feature: Ceres ANNOT ID no. 8658820
  misc_feature: Encodes the peptide sequence at SEQ ID NO 16583
atgtcgctcgtgaggcgcagcaacatcttcgaccccttcgccgacttctgggaccccttcgacggcgtcttccgctccctcgtcgtcccgtctgtcgcctcgtcggggcgcgacaccgctgccttcgccaacgcgcgcatcgactggaaggagatgcctgaggcgcacgtgttcaaggccgacctccccggcgtgaagaaggaggaggtcaaggtggaggtggaggacggcaacgtgctcgtcatcagcggcgagcgcagcaaggagaaagaggacaagaacgacaagtggcaccgcgtcgagcgcagcagcggcaagttcatgaggcggttccgcctgccggagaacgccaagacggaccaggtgaacgccggcctcgagaacggcgtgcttaccgtcaccgtgcccaaggccgaggtcaagaaacctgaggtgaagaccattgagatttctggttga

SEQ ID NO: 16583 - protein, 152 aa, Sorghum bicolor
  misc_feature: Useful for making plants with modulated heat sensitivity
  misc_feature: Functional homolog of the protein sequence given in SEQ ID NO 13940
  misc_feature: Ceres ANNOT ID no. 8658820
  misc_feature (48)..(151): Pfam ID: HSP20 Pfam Description: Hsp20/alpha crystallin family
MSLVRRSNIFDPFADFWDPFDGVFRSLVVPSVASSGRDTAAFANARIDWKEMPEAHVFKADLPGVKKEEVKVEVEDGNVLVISGERSKEKEDKNDKWHRVERSSGKFMRRFRLPENAKTDQVNAGLENGVLTVTVPKAEVKKPEVKTIEISG

SEQ ID NO: 16584 - DNA, 381 bp, Sorghum bicolor
  misc_feature: Ceres ANNOT ID no. 8658881
  misc_feature: Encodes the peptide sequence at SEQ ID NO 16585
atgattttgcattttttttgcgatctgtctttcctgtgtaaatatgtgcggcacacttcagcgagcagcgtccccatccaggagttgttccatctgcatgagaaatttattatgatttgtgtctacaccatcttgtttgaaaagctatcacgctctcgggctgtctggcttaaacaagaattcttcctacttatcacccttacccaacttaaggcacaacccaccagcattttttttggttgcaggctatctgtggcctataggaatttttatttatcattgcagatctttatgaagaccctcactagcaagaccatcaccctcaaggttgagtcctcgaacacaattgacaatatcaaggcaaagatccaggacaattag

SEQ ID NO: 16585 - protein, 126 aa, Sorghum bicolor
  misc_feature: Useful for making plants with modulated cold sensitivity
  misc_feature: Functional homolog of the protein sequence given in SEQ ID NO 13521
  misc_feature: Ceres ANNOT ID no. 8658881
MILHFFCDLSFLCKYVRHTSASSVPIQELFHLHEKFIMICVYTILFEKLSRSRAVWLKQEFFLLITLTQLKAQPTSIFFGCRLSVAYRNFYLSLQIFMKTLTSKTITLKVESSNTIDNIKAKIQDN

SEQ ID NO: 16586 - DNA, 2787 bp, Sorghum bicolor
  misc_feature: Ceres ANNOT ID no. 8658897
  misc_feature: Encodes the peptide sequence at SEQ ID NO 16587
atgctgtcattttctcgctcggccatcctctcctacctactgtggtgccttttatttctcaccttggcaagcagcaatggcgtggtcgccacagcaaagccgaaggttgggtacgggtacaagctggtctcccttgttcagctgcccaacggcggaggccttgtgggctacctgcaggtgaagcagtgcacctccacttacggtcctgacatccctcgcctcaggctctttgttaagcacgagaccagggacagggtgcgcgtgcagatcaccgctgcagataagcagaggtgggaggtcccctacaacctgctcccaagggagccagcgccacccgtgaccggcagcaaggtcacgggcgcgcccttcacgggcgccgagtaccccggcgaggagctggtgttcacctatggccgcgacccgttctggttcgcggtgcaccgccggtccacgaggcagccgctgttcaacaccagcgccggcgtgctggtcttcaaggaccagtacctggaggtgtccacggcgctgcccaaggacgccgccctgtacgggctcggcgagaacacgcagcccgggggtatcaggctgcggcccaacgacccttacaccatctacaccacggacatctccgccatcaacctcaacaccgacctctacggctcgcacccggtgtacatggacctccggagcctcggcggccgcggcgtcgcgcacgccgtgctgctgctcaacagcaatggcatggacgtgttctacagggggacgtcgctgacatacaaggtcatcggaggtcttctcgacttctacttcttcgccgggccgacgccgttggccatcgtggatcagtacacttcgatgatcggccgtcccgcgcccatgccatactgggcatttgggttccaccaatgtaggtgggggtacaagaacctttcagtggtagagggcgttgtggagggttatcggaatgcccagataccgctggacgtgatctggaatgatgatgaccacatggatgccgctaaggacttcacacttgatccggtcaactacccacgccccaaactgctggcattccttgacaagatccatgcgcaagggatgaagtacattgtcctcatcgaccctggcattgctgtgaacagctcctatggcgtctaccagcgtggcatggaacgtgacatcttcatcaaactggatggggagccatacctcgcccaggtgtggcctggtcctgtctacttcccagactttctcaacccgaacggcgcgtcatggtggatcgacgaggtgcggaggtttcatgatttggtcccggtggatgggctctggattgacatgaacgaggcctccaacttctgcacgggcaagtgcacaatcccaaagacacaccagtgccctattcctgactccaagacaccatgggtctgctgtttggattgcaagaaccttacaaacacaaggtgggatgagccgccatacaagatcaatgcctctgggcagactgctcgtctcggcttcaacaccattgcaaccagtgctacacactacaatggcatcctggagtacaacgcacacagtctgtatggcttctcgcaggccattgccacgcataaggcgctgcaagggctgcaggggaagaggccgttcattctgacccgctccacgttcgtcggctcgggggcatacgccgcgcactggaccggcgacaacaagggcacttgggaaaatctccgctattccatctcaacgatgctcaactttggcatcttcggcatgccaatggttggctctgacatctgtggcttctacccggcgccgactgaggagctctgcaacaggtggattgagctcggggccttctacccgttctccagggaccatgccaacttcgcgtcaccgaggcaggagctctacgtctgggagtccgtggcgaagtcggcacggaacgcgctcggcatgcggtacaagctgctcccctacctgtacacgctcagctaccaggcgcacctgaccggggcacccgtggcgcgcccggtgttcttctccttccccgacttcacgccgtgctacgggctgagcacacagttcctgctcggcgccagcgtcatggtgtccccagtcctcgagcagggcgccacttcggtgagcgccatgttcccaccgggcacctggtacaacctgttcgacatgaggaaggtggtggtgtccaagagcagcgcccccgtgacgctggaggcgccgctgaacgagatcaacgtgcacgtgttccagaacacgatcctgccgatgcagcgcggcgggttcgtctccaaggacgcccgggcgacgccgttcacgctcgtggtcgcgttcccgttcggggcgacgcaggcggacgcggagggcgcggtgtacgtggacgacgacgagcggccggagatggtgctcgcggaagggcaggcgacgtacgcgcgcttccacgcgagcgtgcgcggcaaggccgtgacggtgcggtcggaggtgctgatgggaagctacagcctgcacaaggggctggtcatcgagaagctgtcggtgctgggtctggagggcaccggcaaggacctcgccatccaggtggacggcacggacgccaccaccgccgtcgcgacgtcgagcccttacttcgcggcaggtggcaacgcgaagctgcatggggaagaaggcgtcgaggatagcaacaagagcgtcatggtggaggtcggcgggctggcattgccgctggggaagagcttcaccatgacctggaacatgcggatcgaagcatag

SEQ ID NO: 16587 - protein, 928 aa, Sorghum bicolor
  misc_feature: Useful for making plants with altered carbohydrate content
  misc_feature: Functional homolog of the protein sequence given in SEQ ID NO 14403
  misc_feature: Ceres ANNOT ID no. 8658897
  misc_feature: Down-regulated in shoot tissues in response to salicylic acid treatment
  misc_feature (128)..(452): SWISSPROT Homolog: EC 3.2.1.20 Alpha-glucosidase
  misc_feature (508)..(801): SWISSPROT Homolog: EC 3.2.1.84 Glucan 1,3-alpha-glucosidase
  misc_feature (269)..(761): Pfam ID: Glyco_hydro_31 Pfam Description: Glycosyl hydrolases family 31
MLSFSRSAILSYLLWCLLFLTLASSNGVVATAKPKVGYGYKLVSLVQLPNGGGLVGYLQVKQCTSTYGPDIPRLRLFVKHETRDRVRVQITAADKQRWEVPYNLLPREPAPPVTGSKVTGAPFTGAEYPGEELVFTYGRDPFWFAVHRRSTRQPLFNTSAGVLVFKDQYLEVSTALPKDAALYGLGENTQPGGIRLRPNDPYTIYTTDISAINLNTDLYGSHPVYMDLRSLGGRGVAHAVLLLNSNGMDVFYRGTSLTYKVIGGLLDFYFFAGPTPLAIVDQYTSMIGRPAPMPYWAFGFHQCRWGYKNLSVVEGVVEGYRNAQIPLDVIWNDDDHMDAAKDFTLDPVNYPRPKLLAFLDKIHAQGMKYIVLIDPGIAVNSSYGVYQRGMERDIFIKLDGEPYLAQVWPGPVYFPDFLNPNGASWWIDEVRRFHDLVPVDGLWIDMNEASNFCTGKCTIPKTHQCPIPDSKTPWVCCLDCKNLTNTRWDEPPYKINASGQTARLGFNTIATSATHYNGILEYNAHSLYGFSQAIATHKALQGLQGKRPFILTRSTFVGSGAYAAHWTGDNKGTWENLRYSISTMLNFGIFGMPMVGSDICGFYPAPTEELCNRWIELGAFYPFSRDHANFASPRQELYVWESVAKSARNALGMRYKLLPYLYTLSYQAHLTGAPVARPVFFSFPDFTPCYGLSTQFLLGASVMVSPVLEQGATSVSAMFPPGTWYNLFDMRKVVVSKSSAPVTLEAPLNEINVHVFQNTILPMQRGGFVSKDARATPFTLVVAFPFGATQADAEGAVYVDDDERPEMVLAEGQATYARFHASVRGKAVTVRSEVLMGSYSLHKGLVIEKLSVLGLEGTGKDLAIQVDGTDATTAVATSSPYFAAGGNAKLHGEEGVEDSNKSVMVEVGGLALPLGKSFTMTWNMRIEA

SEQ ID NO: 16588 - DNA, 1995 bp, Sorghum bicolor
  misc_feature: Ceres ANNOT ID no. 8658929
  misc_feature: Down-regulated in shoot tissues in response to salicylic acid treatment
  misc_feature: Encodes the peptide sequence at SEQ ID NO 16589
atggagggcggcggtgggaagttagcatacagctacggcggcgtggagccccgcaagttcgggctcggccttgtcgccggcctcctcctcgtatcctgcgcctacttctccaccgtcaagctcgacgccgtccacctcgtcatgagcaagcaaccgtttcaaccacaagcatattcaggcctgcaagatcaaggttcatggtcgtcgtcgaaggaggggagcaaggcagaggtgctcgagaaagacgatggcgacggcagcaacggcatttcctctttcgggcaagttcctgtaagctcgctcgaggaaaaccagaaagatgagacgtttgcgaggaataatggtggtgttgttgtctctgcggcctcaccagatccagcagcggatggtggcaaggatgaggttcctgagaaggatgatgacccaagtgccgctgctgctcttcctcccttgtcaacagattcctcagacagcacgcaagaatcatcaggtgttcttgaagatcaggaattacaggtgcagaatgccgttgcagcagctgctaatccacccaaggaaagcaatagtatccgcagcaacgacaacggcagctcctctgaaattccgtctgatccagctgaaatccctgttcctgctccctctccagaaattgagcccccttcttctgctaacgagatttctgctgattcttcggagcttaaggcggcccctccatttcagatgactccatctattcctgaggtcaagcaaacagacttggaggcgccagtgcgtgagtggaagccactgtgcgacctgacgtcgaactatcgcatcgactggtgcgagctcgagggcgacgtccgcgtggtcggctccaacggcagcgtcaccctggtggcgccccctggtgccgatgccgacaaccacaccttccacgaggagtcatggagcatcaagccgtacccgcgcaaggtggacccgaacgccatgcacagcgtccgcgcgctgacggtgcggtcggtcgtcgccatggccaccgccaccgacgcggcgccgccgccggcgtgcatggactggcacgacgtgccggcgctggtgttctcggtgcgcgggtacacgggcaactacttccacgcgtacaccgacgtgatcctgccgctgttcctgacggcgcggcagtactccggcgaggttctgctgctggtgacgggcttccaggcgtggtgggtgggcaagtacctgccggtgttcaggagcctctccaagtacgcggcggtggacctggacagcgacccgcgcgtgcactgcttccgccgcgtccaggtcgggctcaccagccaccacgacttcagcatcgacccgcgccgcgcgcccaacggctactccatgctcgacttcgcccagttcatgcgcgccacctacgcgctcccgcgcgacgtcgccctctccccctccccctcgccggagcgtcgacggcggcgcccacggctcctggtgatcgcgcgcgcgcggacgcggcggttcctgaacacggaggagatcgtgcggggcgcgcggaaggtggggttcgaggtggtggtgtcggaggggacgcacgaggtggcgccattcgcggagctggtgaacacgtgcgacgcggtggtgggcgtgcacggcgccgggctgaccaacatggtgttcctgccccggggcggggtggtggtgcaggtgctgccgctggggccgctggagttcgtggccagctacttccggggccccgccggggacatggggctcacctacctcgagtaccggatctcgccggaggagagcacgctggtggaccagtacccgcgcgaccaccccgtgctcacggaccccatgagcttgagcagcaaggccaaggactgggtgtccttcatgggggtctacctcttcaagcaggacgtccgcctcgacatgaagcgcttccggcccgtactcaagaaggcactcgcgcggcttagggccaaacccaagaataacaacaactaa

SEQ ID NO: 16589 - protein, 664 aa, Sorghum bicolor
  misc_feature: Useful for making plants with altered carbohydrate content
  misc_feature: Functional homolog of the protein sequence given in SEQ ID NO 14404
  misc_feature: Ceres ANNOT ID no. 8658929
MEGGGGKLAYSYGGVEPRKFGLGLVAGLLLVSCAYFSTVKLDAVHLVMSKQPFQPQAYSGLQDQGSWSSSKEGSKAEVLEKDDGDGSNGISSFGQVPVSSLEENQKDETFARNNGGVVVSAASPDPAADGGKDEVPEKDDDPSAAAALPPLSTDSSDSTQESSGVLEDQELQVQNAVAAAANPPKESNSIRSNDNGSSSEIPSDPAEIPVPAPSPEIEPPSSANEISADSSELKAAPPFQMTPSIPEVKQTDLEAPVREWKPLCDLTSNYRIDWCELEGDVRVVGSNGSVTLVAPPGADADNHTFHEESWSIKPYPRKVDPNAMHSVRALTVRSVVAMATATDAAPPPACMDWHDVPALVFSVRGYTGNYFHAYTDVILPLFLTARQYSGEVLLLVTGFQAWWVGKYLPVFRSLSKYAAVDLDSDPRVHCFRRVQVGLTSHHDFSIDPRRAPNGYSMLDFAQFMRATYALPRDVALSPSPSPERRRRRPRLLVIARARTRRFLNTEEIVRGARKVGFEVVVSEGTHEVAPFAELVNTCDAVVGVHGAGLTNMVFLPRGGVVVQVLPLGPLEFVASYFRGPAGDMGLTYLEYRISPEESTLVDQYPRDHPVLTDPMSLSSKAKDWVSFMGVYLFKQDVRLDMKRFRPVLKKALARLRAKPKNNNN

SEQ ID NO: 16590 - DNA, 1251 bp, Sorghum bicolor
  misc_feature: Ceres ANNOT ID no. 8658932
  misc_feature: Encodes the peptide sequence at SEQ ID NO 16591
atgccggccgcggcgcggtcgtggacgtggacctgcgcgtgctgcgcggggaggaggaggagcggcggcggcggcgctgcaggcgacacggcgggcgcgtcgggttgccgcgccgaggagggggacgagtggagcctcttcatcgacctgcccgtgctcgaggccgccaccggcggattctccgacgacaacctcctcggccgcggcggcttcggccccgtctacaagggggtgatggagaacgggcagcagatcgctgtgaagaagctgtcgatggggtcacggcaaggcgagcgcgagttcctcaacgaggtccggctcctgctcaaggtgcagcaccgcaacctggtgtctctgcttggctgctgtgcttcctccggccatttcctgctcgtttatccctacttccccaatggcagcctcgaccacattctctttgacaggaaaaagtgtgtccagctagattggccaaaacggtaccacataatcatcggattggcaagagggctcctgtaccttcacgaagaatctccggtgaagatcatccacagagacatcaaggcgagcaacgtgctccttgacgaccagctgaacccaaagatttcagatttcggcatggcaaggctgttcctggaggacgccacgcacgtgaacacattcagaatctccggcacatatggttacatggctccagagtacgcattgaacggctacttgtccaccaagactgacgtctttagcttcgggatcctggtgctggagattgtgagcggacggaagaacatcgttcggcattcggatgaccaaaagatcgacctcttgaattatacatggaagctgttcgaagaaggacgatccctggagatcgtggacccgtcgctgtccaaccccgacgacagcgagcaggcgctgctgtgcatccagctcggcctgctgtgctgccaggccgtggtgccggaccggcccgacatgcacagcgtgcacctgatgctgtccagcgactcgttcacgctgcccaagcccgggaagccggcgatccatggcaggaccggccggtggacgacgacgacgacgacggggacttcaggatccgcgtcggcggcgtcgggcgcctccaacacgaacaccaccagcggcggcagcacgttcggcaccgacacgaacacgaccagggcctctgtgctggccaatatcgccgaggacgagtctcggaactccatttccatatccttcaccacggaaggccggtag

SEQ ID NO: 16591 - protein, 416 aa, Sorghum bicolor
  misc_feature: Useful for making plants with altered cell wall content and/or composition
  misc_feature: Functional homolog of the protein sequence given in SEQ ID NO 14140
  misc_feature: Ceres ANNOT ID no. 8658932
  misc_feature (53)..(334): SWISSPROT Homolog: EC 2.7.11.1 Non-specific serine/threonine protein kinase
  misc_feature (60)..(331): Pfam ID: Pkinase Pfam Description: Protein kinase domain
MPAAARSWTWTCACCAGRRRSGGGGAAGDTAGASGCRAEEGDEWSLFIDLPVLEAATGGFSDDNLLGRGGFGPVYKGVMENGQQIAVKKLSMGSRQGEREFLNEVRLLLKVQHRNLVSLLGCCASSGHFLLVYPYFPNGSLDHILFDRKKCVQLDWPKRYHIIIGLARGLLYLHEESPVKIIHRDIKASNVLLDDQLNPKISDFGMARLFLEDATHVNTFRISGTYGYMAPEYALNGYLSTKTDVFSFGILVLEIVSGRKNIVRHSDDQKIDLLNYTWKLFEEGRSLEIVDPSLSNPDDSEQALLCIQLGLLCCQAVVPDRPDMHSVHLMLSSDSFTLPKPGKPAIHGRTGRWTTTTTTGTSGSASAASGASNTNTTSGGSTFGTDTNTTRASVLANIAEDESRNSISISFTTEGR

SEQ ID NO: 16592 - DNA, 831 bp, Sorghum bicolor
  misc_feature: Ceres ANNOT ID no. 8659042
  misc_feature: Encodes the peptide sequence at SEQ ID NO 16593
atgggcgaccatctcgcgttgatcgtggaccggctgctgacagagtcgacgctggaggcggcgatcggcggtgggaagcggatggtcgatctgcatcaggagacggtggccgtcgagtactgccatcgcgccctaggcggtggctcggcaacgaaggtggtggagtgcaggatttgccaggaggaggactgggacacctgcatggaggccccctgcgcctgctgtggcagcctcaagtatgcgcatcggaaatgcattcagcggtggtgcaatgagaaaggtgacaccatgtgtgaaatatgcctgcagcaattcaggccaggttatacttctccacagcagctgtttcactatggtagtataccaatgaacttcagagggaactgggagattacccagcaagatctcaatgattcccagataataacaatgatgcccacagagcgtgactttatggacaattacgatgactactttcctatcaggacaagaagcagcgccttgtgttgccggacaattgccataattttcatggcactcctggtccttcgccacactcttcctctcatgattggtgacaatggggagtactcattggccttattcgcgcttctggtgctgaggactgcgggaatcctattcccaatcctggtgatggtgagagcattggcaagcttccaccgtcgacggcggcagcaggaaagccgggaagcatatatatcttcatcagaaagcgaggaggaagatgaagacgaagcggaagaagaggatacaattacagattcggcacatccaaattactcacaaccacgcttcataccagtctactga

SEQ ID NO: 16593 - protein, 276 aa, Sorghum bicolor
  misc_feature: Useful for making plants with altered terpenoid content
  misc_feature: Functional homolog of the protein sequence given in SEQ ID NO 13104
  misc_feature: Ceres ANNOT ID no. 8659042
  misc_feature (56)..(101): Pfam ID: zf-C3HC4 Pfam Description: Zinc finger, C3HC4 type (RING finger)
MGDHLALIVDRLLTESTLEAAIGGGKRMVDLHQETVAVEYCHRALGGGSATKVVECRICQEEDWDTCMEAPCACCGSLKYAHRKCIQRWCNEKGDTMCEICLQQFRPGYTSPQQLFHYGSIPMNFRGNWEITQQDLNDSQIITMMPTERDFMDNYDDYFPIRTRSSALCCRTIAIIFMALLVLRHTLPLMIGDNGEYSLALFALLVLRTAGILFPILVMVRALASFHRRRRQQESREAYISSSESEEEDEDEAEEEDTITDSAHPNYSQPRFIPVY

SEQ ID NO: 16594 - DNA, 2058 bp, Sorghum bicolor
  misc_feature: Ceres ANNOT ID no. 8659051
  misc_feature: Encodes the peptide sequence at SEQ ID NO 16595
atggggatggacggcggcggcggcaagctgccgtacagctacgcggcgcaccaggacggcggcaagctggtgaagagcttcagccgcgtggagccgcgcaagttcgggctcggcctcgtcgccggcttcctcctcgtcacctgcgcctacttctccaccgccaagttcgacgccatccacatcgccatgatcagccccatttccagcaatgcggctgggatcggctcgctggtgggcgccgccgccgacacctccaactccaactccaagcagcaatttgatttgggcaagcgagacccgtccatgtccgaggaggggagcaaggccgaggtgctcgagaaagacgacggcaaggcttccccttcgggttccgggccagattccggccgcaatgcgccgctggaggacacgaggagagacgagacttttgttggggacagcggtgatgcgagcggcgtccccgcgtcttccgcggcggcgaatcctgccgcggcgggtggcaacggtgaggcggttcctgccaaggacgatgacgccgcccccgctgctgccggtcttcttcctcccgtgtcgtcagaggaagccgcgaacggcacgcaagaatcaggtggtcttgaggacgaggagctgcaggtgcaggatgctgttgccaatccttccaagaggagcaacgactccgccgccgccgccgccatcaccaccccaagcagcagcaatggcagctcgctcgctgtggttcactctgaccctgccatcctccctgctcccgcgcagcagattcctcctgctacgcaagatgtcaaggctcttgctgatcagcatgttccagcgattccagaggttaagcaagcagattcggagacgacgccggcgcgggagtggaagccgctgtgcgacctcacctcgaaccgccgcatcgactggtgcgagctcgacggcgacgtgcgcgtgctgggcgccaacgccagcgtcacgctggtggcgccgccgggcgcggacgaccgcaccttccgcgcggagtcgtggcgcatcaagccgtacccacgcaaggcggacccgaacgcgatgcacgtcgtccgcgtggtgaccgtgcagtcggtgtccggcggcggggcgccggcgtgcacggacaggtacgacgtgccggcgctggtgttctcggaccgcgggtacacgggcaactacttccacgcgttcacggacgtgatcctgccgctgttcctgacggcgcggcagtacgccggcgaggtgcggctgctggtgacggacctccaggcgtggtgggtgggcaagttctcgccggtgttcaaggccatctccaactacgagctggtggacctggacaaggacccgcgcgtgcagtgcttccgccacgtccaggtcgggctcaccagccacgacgacttcagcatcgacccgcgccgcgcgcccaacggctactccatggtcgacttcaccgcgttcatgcgcgccacctacggtctcccgcgcggcgtcgcggccgccgacgcgacgaagcggccgaggctgctgctgatcgcgcgcgcgcggacgcggcggtttgtgaacacggaggagatcgtgcgcggcgccgagaggctcgggttcgaggtggtggtgtcggaaggcacgcacgaggtggcgccattcgcggagctcgccaacagctgcgacgccatcatgggcgtgcacggcgccgggctgaccaacatggtgttcgtgccgacgggcggggtggtgatccaggtggtgccgctgggcgggctggagttcgtggcgggctacttccggggaccttccagggacatggggctgcgctacctcgagtaccggatcacgccggaggagagcacgctgatcgaccagtacccgcgcgaccaccccatcttcacggaccccaacgggatcaagagcaagggatgggagtctctcaaggacgcatacctcgacaagcaggacgtgcggctggacatgaagaggttccggccgacgctcaagaaggccatcgcgcacctcaggaaggccaaggccaaggcgaccaacggcggcggcaactaa

SEQ ID NO: 16595 - protein, 685 aa, Sorghum bicolor
  misc_feature: Useful for making plants with altered carbohydrate content
  misc_feature: Functional homolog of the protein sequence given in SEQ ID NO 14404
  misc_feature: Ceres ANNOT ID no. 8659051
MGMDGGGGKLPYSYAAHQDGGKLVKSFSRVEPRKFGLGLVAGFLLVTCAYFSTAKFDAIHIAMISPISSNAAGIGSLVGAAADTSNSNSKQQFDLGKRDPSMSEEGSKAEVLEKDDGKASPSGSGPDSGRNAPLEDTRRDETFVGDSGDASGVPASSAAANPAAAGGNGEAVPAKDDDAAPAAAGLLPPVSSEEAANGTQESGGLEDEELQVQDAVANPSKRSNDSAAAAAITTPSSSNGSSLAVVHSDPAILPAPAQQIPPATQDVKALADQHVPAIPEVKQADSETTPAREWKPLCDLTSNRRIDWCELDGDVRVLGANASVTLVAPPGADDRTFRAESWRIKPYPRKADPNAMHVVRVVTVQSVSGGGAPACTDRYDVPALVFSDRGYTGNYFHAFTDVILPLFLTARQYAGEVRLLVTDLQAWWVGKFSPVFKAISNYELVDLDKDPRVQCFRHVQVGLTSHDDFSIDPRRAPNGYSMVDFTAFMRATYGLPRGVAAADATKRPRLLLIARARTRRFVNTEEIVRGAERLGFEVVVSEGTHEVAPFAELANSCDAIMGVHGAGLTNMVFVPTGGVVIQVVPLGGLEFVAGYFRGPSRDMGLRYLEYRITPEESTLIDQYPRDHPIFTDPNGIKSKGWESLKDAYLDKQDVRLDMKRFRPTLKKAIAHLRKAKAKATNGGGN

SEQ ID NO: 16596 - DNA, 1881 bp, Sorghum bicolor
  misc_feature: Ceres ANNOT ID no. 8659084
  misc_feature: Encodes the peptide sequence at SEQ ID NO 16597
atgaagggcggcggcgccggcgacaaggccgggaggggcggcgtcggcgtcggcggcggcaggataccgcagccgctgcgcctcgactcgcagcggttcaggctgctgtccatcgtcgtcggctgctccgtcatctgcctcgtcttcctcctctcctcccgccccgacgccaccgccttcgacaccatgagccccaaggcgtcgctggtggccgcgcgccgcccggtggccgtcaagaccctgcggacctcctccgccgccgccgccgccagaggcttcggtggcgatttccatgtcgacgtccggccgcagcatcatgacgagcagaccgccggcgacaagacgatcacagaatgggtcagagacacggtgatcgtggaggagagcagcgaggcagagccggaggagacggagcccggccgtgacgccagtgccactgccgcggcgtcgtccaactccgacgaccaccctgccgcaccaggtaccgagaaggcggtccacgacgccgccgcgatcaccgtgcagccggccgcgggaacgacgacgtcgactgcgccggacaacaggccagaggagaagacgggagttgcaactggtactggtggtggtggtcagagcaaggtccagcagcagccagctcggcaacggcaagacgaggagccagcacgacaatctggcggggaccaccaccaccagcagccgctgtgcgacttctccgacttccgcagcgacatctgcgacatcgccggcgatgtccggttggacgctaacgtgtcgtcgttcgtcgtcgtcgtcgacccggcgtcggcgagcggccagcaggaggaggaggagcacaaggtccggccgtaccctcggaagggcgacgagacgtgcatggggcggatcacggagatcacggtgcgcgcgacgcgcggcgcagcgggcgcgccgcggtgcacgcggacgcacgcggcgcccgcggtggtgttctccatcggcggctacacgggcaacatcttccacgacttctccgacgtgctggtgccgctctacaacacggtgcggcggtacggcggcgacgtgcagctggtgatggccaactccgcgtcgtggtggctggtcaagtacgaccggctcctccgcgagctgtcgcgccacgcgccgctggacctcgccggcgccggcgcggcgcgggaggtgcactgcttccgccacgccgtcgtgagcctgcgcgcgcacaaggagctcatcatcgagcgggaccgcagcctggacgggctcgccacgccggacttcacgcggttcctccgccgcgcgctcgggctgccccgggacgcgcccacgcgcctcgtcgtcggcggcggcgacgggacggggaggaagaagccccggctgctgatcatctcgcgccaccgcacccggctgctcctgaacctcgacgccgtggtgcgggcggcggaggaggtcgggttcgaggcgatcgtgaacgagtcggacgtggccaacgacatcgcgcaggtcggcgggctcatcaactcgtgcgacgccatggtgggcgtgcacggagcggggctcaccaacatgatgttcctgccgccgggggcggcgctggtgcagatcgtgccgtggggcgggctgcagtggatggcgagggcggactacggcgacccggcggaggcgatggggctcaagtacatccagtacgagatcggcgtcgacgagagcacgctcaaggacaagttccccagcgggcacaagatcttcaccaacccgacggagctgcacaagaaggggttcatgttcatcaggcagacgctcatggacggccaggacatcaccgttgacgtcgcccgcttcagggaggtgctgctccaggtgctcaacaacctcgcgcagtag

SEQ ID NO: 16597 - protein, 626 aa, Sorghum bicolor
  misc_feature: Useful for making plants with altered carbohydrate content
  misc_feature: Functional homolog of the protein sequence given in SEQ ID NO 14405
  misc_feature: Ceres ANNOT ID no. 8659084
MKGGGAGDKAGRGGVGVGGGRIPQPLRLDSQRFRLLSIVVGCSVICLVFLLSSRPDATAFDTMSPKASLVAARRPVAVKTLRTSSAAAAARGFGGDFHVDVRPQHHDEQTAGDKTITEWVRDTVIVEESSEAEPEETEPGRDASATAAASSNSDDHPAAPGTEKAVHDAAAITVQPAAGTTTSTAPDNRPEEKTGVATGTGGGGQSKVQQQPARQRQDEEPARQSGGDHHHQQPLCDFSDFRSDICDIAGDVRLDANVSSFVVVVDPASASGQQEEEEHKVRPYPRKGDETCMGRITEITVRATRGAAGAPRCTRTHAAPAVVFSIGGYTGNIFHDFSDVLVPLYNTVRRYGGDVQLVMANSASWWLVKYDRLLRELSRHAPLDLAGAGAAREVHCFRHAVVSLRAHKELIIERDRSLDGLATPDFTRFLRRALGLPRDAPTRLVVGGGDGTGRKKPRLLIISRHRTRLLLNLDAVVRAAEEVGFEAIVNESDVANDIAQVGGLINSCDAMVGVHGAGLTNMMFLPPGAALVQIVPWGGLQWMARADYGDPAEAMGLKYIQYEIGVDESTLKDKFPSGHKIFTNPTELHKKGFMFIRQTLMDGQDITVDVARFREVLLQVLNNLAQ

SEQ ID NO: 16598 - DNA, 1560 bp, Sorghum bicolor
  misc_feature: Ceres ANNOT ID no. 8659143
  misc_feature: Encodes the peptide sequence at SEQ ID NO 16599
atggctgacgctagtcgtagtcgtgctcgcgttggcggcggcgggcgacgttccgtgctcgccctgcttcttctgctttccgtcggcgcccgagcgtccggcgacggcgaggcaggggcaggggagaaggttgcggcggcgtggaccggcgggctgagccggcggagctttcccaaggggttcgtgttcgggacggcggcgtcggcctaccaggtagagggcatggcgcacaaggacggccgcgggccaagcatatgggacgccttcatcagcatccccggcgagatagcaaacaacgccaccgcggacgtcactgtcgacgagtaccatcgctacaaggaggacgtgaatatcatgaaaaggatggggtttgatgcgtaccgattttcaatatcttggtcaagaatattcccaaatggaactggaaaagtgaattggaaaggagtggcatactataacaggttgataaactacatgttgaagataggcattacaccttatgcaaatctgtatcactatgatttaccagaggcactagaggtccaatatggagggctgttgaacagaaaagtggtgaattcatttgcagactatgccgatttctgtttcaagacatttggtgacagagtaaagaactggatgacatttaacgagccaagggtggttgctgccctaggatatgacgatggcagattcgcacctggaaggtgcacaaaatgcaaggctggaaactctgctaccgagccttacatcgttgctcatcacctcattctttcccatgctgctgcagttcagagataccggcaaaagtatcagcttacgcaaaagggaaggattggaattcttctggattttgtgtggtatgaggctcttacaaattcaacagctgaccaagctgcggctgaaagatcaagagacttccatgtaggatggtttctgcacccaatcatctacggtcaatatcccaattcggttcaaaaaatcgtgaaagaaaggcttccgaagttcacagctgatgagatcaacatagtgaaaggctctatcgactacgttggagtcaaccagtatactgcttattatgttcgtgatcaacagccaaatgcaacaactttgcttagctactcctctgattggcatgctgaatttgtttatgagcgcaacggtgtgccgatcggtccaagggcaaattcagattggctttacatagtgccttggggactatacaaagctgtcacttacgtcaaggagaagtatggcaaccccacaatgtttctatctgaaaacggcatggatgacccgggcaacgtcaccgtcgcccagggcgtgcacgacgcgacgagggttgcctactaccggagctacatcaccaagctgaaggaggcgatcgacggcggcgccaactgcgtgggctacttcgcctggtccctgctcgacaacttcgagtggaagctgggttacacggccaggttcggcctggtctacgtcgatttcaagacactccggcggtaccccaagagctcagcatactggttcagggatgtcatctccggcaaaatctga

SEQ ID NO: 16599 - protein, 519 aa, Sorghum bicolor
  misc_feature: Useful for making plants with altered cell wall content and/or composition
  misc_feature: Functional homolog of the protein sequence given in SEQ ID NO 14123
  misc_feature: Useful for making plants with altered carbohydrate content
  misc_feature: Functional homolog of the protein sequence given in SEQ ID NO 14124
  misc_feature: Ceres ANNOT ID no. 8659143
  misc_feature (50)..(496): SWISSPROT Homolog: EC 3.2.1.21 Beta-glucosidase
  misc_feature (53)..(518): Pfam ID: Glyco_hydro_1 Pfam Description: Glycosyl hydrolase family 1
MADASRSRARVGGGGRRSVLALLLLLSVGARASGDGEAGAGEKVAAAWTGGLSRRSFPKGFVFGTAASAYQVEGMAHKDGRGPSIWDAFISIPGEIANNATADVTVDEYHRYKEDVNIMKRMGFDAYRFSISWSRIFPNGTGKVNWKGVAYYNRLINYMLKIGITPYANLYHYDLPEALEVQYGGLLNRKVVNSFADYADFCFKTFGDRVKNWMTFNEPRVVAALGYDDGRFAPGRCTKCKAGNSATEPYIVAHHLILSHAAAVQRYRQKYQLTQKGRIGILLDFVWYEALTNSTADQAAAERSRDFHVGWFLHPIIYGQYPNSVQKIVKERLPKFTADEINIVKGSIDYVGVNQYTAYYVRDQQPNATTLLSYSSDWHAEFVYERNGVPIGPRANSDWLYIVPWGLYKAVTYVKEKYGNPTMFLSENGMDDPGNVTVAQGVHDATRVAYYRSYITKLKEAIDGGANCVGYFAWSLLDNFEWKLGYTARFGLVYVDFKTLRRYPKSSAYWFRDVISGKI

SEQ ID NO: 16600 - DNA, 1020 bp, Sorghum bicolor
  misc_feature: Ceres ANNOT ID no. 8659169
  misc_feature: Encodes the peptide sequence at SEQ ID NO 16601
atggcggaccaacagcagcaacaagagatgaacgatgtttgtgccagtggcctcaacctacctatagggttccactttgatccgagtgactttgagattgtcaaccatttcatcaggaacaaggtgcgcaatagggactatacctgcaccgccattggggaggttgatctaaataagactgagccatgggaccttctgaaagaggcaaaaatgggagagaaagagtggtacttcttctaccagaaggatcgcaagtacccgacagggcttagggtgaactgggccacgaaggctggttattggaaagcaactggcaaggacaagaaggtctataagcctagcaaaggggaagaggtggtcttactcgtcggcatgaagaagacactcgtcttctacaaaagcagggtgatgcacgagtataggctcaaaggtagcggcaggctccctgaccctgcatctacatctagctcagccgttaacaccaccgtggccatgaaagctttagcctctacttccaaggatgagtgggtagtctgtcgtgtgttccacaagaccactaggatcaagaagatgactgcactgacgtatcaagaggccatggctagtgctgagatcgatcaaaatcaaaacaacatcctgcctatgctcatccccatgtcgctgcagctgccgctactagtgcccttgccaatttcccattgtgctagaatttgccatggacccgctggccccctaccaccccaaccccaacattggtgtggggatgtcgccgatgatgccacctatggtaggtatcagtggcgttgtgggctccagattaatgctgccctgttcaccaatctgatggtcgcgccactgccgatgaacttctaccaccagatgggcatgggtgcagcagctggccagatgggcatgggggcactagcaggcctgatgggcatggggccagatggccagatggacatggtggctaagaatcctatagagatagatccattcgagggacctctctctgtctaa

SEQ ID NO: 16601 - protein, 339 aa, Sorghum bicolor
  misc_feature: The sequence is a functional homolog of SEQ ID NO 2346 in the 10/374,780 US patent application
  misc_feature: The sequence is a functional homolog of SEQ ID NO 238 in the 10/225,068 US patent application
  misc_feature: The sequence is a functional homolog of SEQ ID NO 338 in the 10/412,699 US patent application
  misc_feature: The sequence is a functional homolog of SEQ ID NO 774 in the 11/479,226 US patent application
  misc_feature: Useful for making plants with altered terpenoid content
  misc_feature: Functional homolog of the protein sequence given in SEQ ID NO 13140
  misc_feature: The sequence is a functional homolog of SEQ ID NO 326 in the 10/412,699 US patent application
  misc_feature: The sequence is a functional homolog of SEQ ID NO 760 in the 11/479,226 US patent application
  misc_feature: Ceres ANNOT ID no. 8659169
  misc_feature (20)..(143): Pfam ID: NAM Pfam Description: No apical meristem (NAM) protein
MADQQQQQEMNDVCASGLNLPIGFHFDPSDFEIVNHFIRNKVRNRDYTCTAIGEVDLNKTEPWDLLKEAKMGEKEWYFFYQKDRKYPTGLRVNWATKAGYWKATGKDKKVYKPSKGEEVVLLVGMKKTLVFYKSRVMHEYRLKGSGRLPDPASTSSSAVNTTVAMKALASTSKDEWVVCRVFHKTTRIKKMTALTYQEAMASAEIDQNQNNILPMLIPMSLQLPLLVPLPISHCARICHGPAGPLPPQPQHWCGDVADDATYGRYQWRCGLQINAALFTNLMVAPLPMNFYHQMGMGAAAGQMGMGALAGLMGMGPDGQMDMVAKNPIEIDPFEGPLSV

SEQ ID NO: 16602 - DNA, 1143 bp, Sorghum bicolor
  misc_feature: Ceres ANNOT ID no. 8659279
  misc_feature: Encodes the peptide sequence at SEQ ID NO 16603
atgacaattgaccttggcctggctgcgtcggcggcgtcatcgtcttccggtggacgacgcgtcggcggcgtgccgccgccgtcgaccccgtgcacggcgctgccgccggggttccggttccacccgacggatgaggagctcatcctccactacctccgcaagcgcgccgccgcggcgccgtgcccggcccccgtcatcgccgaggtcgacatctacaagttcgacccatgggacctgccagccaaggcagttttcggggaggcggagtggtacttcttcagcccgagagaccgcaagtaccccaacggcgtccgccccaaccgcgccgccggctccggctactggaaggccaccggcaccgacaagcccatcacgctctccgccgccggagccggctctagttccgacagcagcagccgcgccgccatgatcggcgtcaagaaggcgctcgtcttctacaagggtcgcccgcccaagggcatgaagacgagctggatcatgcacgagtaccgcctcgccgaggcgctcaacgccgccaacacctacagacccatcaggttcaagaactcctccatgaggctggacgactgggtgctgtgcaggatctacaagaagaccacaccgcagctggcgtacatgtcgccgccgcacgaggaggcgtcgccgtccatggacggcggcggcggcggcggcttcgacctcggcctgcagccggacgactccgtctccgccgacgacatcatggcggccacgtcgtcgtcgtatgcaagccggctgccgcgcccggcgtccatctcggactacctcgtcgactactcggccgtgtccgagctgttcgaggccctgccgccgccgccgccggagacgacgacgacgacggcggcgcagacagggacagacgcagccacgaggttctacttcggtaacggcgagcctagcacctccgtagcgcagcagcagagcccactcaagaggcgatcgatggaggaggattacacaaacagtggcatgaacatgctacacgcgtcgtcgtccagcaagagggtgatgatgagtgatcaccatcatgcatcatccatggcagccagcaatgccttctccgtgtttgagcctggacagacttctctgcaggacagaatatga

SEQ ID NO: 16603 - protein, 380 aa, Sorghum bicolor
  misc_feature: The sequence is a functional homolog of SEQ ID NO 851 in the 10/374,780 US patent application
  misc_feature: Useful for making plants with modulated oxidative stress sensitivity
  misc_feature: Functional homolog of the protein sequence given in SEQ ID NO 13621
  misc_feature: The sequence is a functional homolog of SEQ ID NO 808 in the 10/225,066 US patent application
  misc_feature: The sequence is a functional homolog of SEQ ID NO 926 in the 11/435,388 US patent application
  misc_feature: The sequence is a functional homolog of SEQ ID NO 98 in the 10/374,780 US patent application
  misc_feature: Useful for making plants with altered carbohydrate content
  misc_feature: Functional homolog of the protein sequence given in SEQ ID NO 13622
  misc_feature: Ceres ANNOT ID no. 8659279
  misc_feature (34)..(173): Pfam ID: NAM Pfam Description: No apical meristem (NAM) protein
MTIDLGLAASAASSSSGGRRVGGVPPPSTPCTALPPGFRFHPTDEELILHYLRKRAAAAPCPAPVIAEVDIYKFDPWDLPAKAVFGEAEWYFFSPRDRKYPNGVRPNRAAGSGYWKATGTDKPITLSAAGAGSSSDSSSRAAMIGVKKALVFYKGRPPKGMKTSWIMHEYRLAEALNAANTYRPIRFKNSSMRLDDWVLCRIYKKTTPQLAYMSPPHEEASPSMDGGGGGGFDLGLQPDDSVSADDIMAATSSSYASRLPRPASISDYLVDYSAVSELFEALPPPPPETTTTTAAQTGTDAATRFYFGNGEPSTSVAQQQSPLKRRSMEEDYTNSGMNMLHASSSSKRVMMSDHHHASSMAASNAFSVFEPGQTSLQDRI

SEQ ID NO: 16604 - DNA, 549 bp, Sorghum bicolor
  misc_feature: Ceres ANNOT ID no. 8659293
  misc_feature: Encodes the peptide sequence at SEQ ID NO 16605
atgaccatcgaaaggattatcaagagattcacctgcaacaggggaagatgtcgagggttatccaagaccgaccgtctgctcatgtgctggtgggcgttcaccggcctcacccacatcttcatcgaggggcccttcgtcttcacccccggattctttagaaaggagaaccctaactacttggatgaagtttggaaggagtacagcaaagccgattccagatacgtcgctagggatcctgcgatcgtcacagttgaagggtctacagctgtgctaggaggccctgcatcactctatgccattgcatcccacaagtcctatagccatattctccagttcaccgtctgcatgggtcatctctacgggggccttgtttacttcatcactgcttacttggatggcttcaacttctggatcagtccattctacttctgggcatatttcattagcgcaaacagtttctgggtttggataccaacgctcatcgccatgaggagctggaagatgatttgcgcagcatttcgagctgaaatggcgaagaagacaaaataa

SEQ ID NO: 16605 - protein, 182 aa, Sorghum bicolor
  misc_feature: Useful for making plants with altered sterol content
  misc_feature: Useful for making plants with modulated nitrogen use efficiency
  misc_feature: Functional homolog of the protein sequence given in SEQ ID NO 13509
  misc_feature: Ceres ANNOT ID no. 8659293
  misc_feature (25)..(182): SWISSPROT Homolog: EC 5.3.3.5 Cholestenol Delta-isomerase
  misc_feature (1)..(180): Pfam ID: EBP Pfam Description: Emopamil binding protein
MTIERIIKRFTCNRGRCRGLSKTDRLLMCWWAFTGLTHIFIEGPFVFTPGFFRKENPNYLDEVWKEYSKADSRYVARDPAIVTVEGSTAVLGGPASLYAIASHKSYSHILQFTVCMGHLYGGLVYFITAYLDGFNFWISPFYFWAYFISANSFWVWIPTLIAMRSWKMICAAFRAEMAKKTK

SEQ ID NO: 16606 - DNA, 672 bp, Sorghum bicolor
  misc_feature: Ceres ANNOT ID no. 8659290
  misc_feature: Encodes the peptide sequence at SEQ ID NO 16607
atgggcggagacgggcacacgtacgcgccggcggacctgcacctcccgggcttcgtgccgctgcagctgtcgcagggccagatcctcgccccctacctgggcaccgccgtcttcgtcgtcctcgccgtctggctcctctccggtaccgctaccaccgccacctgtgaaggtgccgcgggttatccaagacggacccgtctgctcatgtgctggtgggcgttcaccggcctcacccacattgtcatcgagggggccttcgtcttcaaccccggattcttcagcaaggagaaccccacctacttcgatgaagcctataaggagtacagcaaaggcgattccagatacgtcgctagggaccccgcgaccgtcaccgtcgaagggattacagctgtgttagaaggccctgcgtcactctatgccattgcatcccacaagtcctatagtcatattcttcagttcactgtctgcctgggccaactctacgggtgccttgtttacttcatcactgcgtacttggctggcttcaacttctggatcactccattctatttctgggcatatttcattggtgcaaacagtttctgggtttggataccaacgctcattgccatgaggagctggaagatcatttgcgcagcatttcgaactgaaaaggcaaagaagacaagataa

SEQ ID NO: 16607 - protein, 223 aa, Sorghum bicolor
  misc_feature: Useful for making plants with altered sterol content
  misc_feature: Useful for making plants with modulated nitrogen use efficiency
  misc_feature: Functional homolog of the protein sequence given in SEQ ID NO 13509
  misc_feature: Ceres ANNOT ID no. 8659290
  misc_feature (3)..(208): SWISSPROT Homolog: EC 5.3.3.5 Cholestenol Delta-isomerase
  misc_feature (20)..(221): Pfam ID: EBP Pfam Description: Emopamil binding protein
MGGDGHTYAPADLHLPGFVPLQLSQGQILAPYLGTAVFVVLAVWLLSGTATTATCEGAAGYPRRTRLLMCWWAFTGLTHIVIEGAFVFNPGFFSKENPTYFDEAYKEYSKGDSRYVARDPATVTVEGITAVLEGPASLYAIASHKSYSHILQFTVCLGQLYGCLVYFITAYLAGFNFWITPFYFWAYFIGANSFWVWIPTLIAMRSWKIICAAFRTEKAKKTR

SEQ ID NO: 16608 - DNA, 312 bp, Sorghum bicolor
  misc_feature: Ceres ANNOT ID no. 8659319
  misc_feature: Encodes the peptide sequence at SEQ ID NO 16609
atggtccagcgacgtgcgcacggacaccgtgtccctgtcgctcctgctgttcccgccgcgggcgccgtcgccgatcgacgccgggagccaccgtggtcacggaggaacggatacgtctgtacacgcgcaagtgggacggcaaggtcattccaggaggtgcggctccgtgtggtggcccggtcgggggaggcagatgcgcaccgccggtgcgacgtccggcacgacgcgccggtccacgtcgtgacggcggggggatacaacggtaactacttccacgcgttcaacgacgggttcctgccatcgtgggtgtga

SEQ ID NO: 16609 - protein, 103 aa, Sorghum bicolor
  misc_feature: Useful for making plants with altered carbohydrate content
  misc_feature: Functional homolog of the protein sequence given in SEQ ID NO 14380
  misc_feature: Ceres ANNOT ID no. 8659319
MVQRRAHGHRVPVAPAVPAAGAVADRRREPPWSRRNGYVCTRASGTARSFQEVRLRVVARSGEADAHRRCDVRHDAPVHVVTAGGYNGNYFHAFNDGFLPSWV

SEQ ID NO: 16610 - DNA, 1194 bp, Sorghum bicolor
  misc_feature: Ceres ANNOT ID no. 8659350
  misc_feature: Encodes the peptide sequence at SEQ ID NO 16611
atggacgactacgggaggctggcgctcgccgtggcggtggtggcagctgtggcgggcacgagcggcggcgcggcggcgtggggctggcagcagcagcagccgccgctggcgccgtgcatgtacgtcttcggcgactcgctggtggacaacggcaacaacaacgacatcctgagcctggcccgtgccaactaccgcccctacggcatcgacttccacgagggcccgccggggcgcttcaccaacggccgcaccatggtcgacttcctctccgacatgctccgcctccgcccgccgctcctcccgccctacgccacggcgaggcccgaggacctcccccgcggcgtcaacttcgcgtcgggggcctccggcatcctccccgagacaggaaacaacctggtggaccacttccgggcggcggtgagcgacatggggaacacgtcggagttccgcggcaacgccacgaaggtggcggcgcacctgggccgctgcatcttcttcgtcggcatgggcagcaacgactacctcaacaactacttcatgccggactactacgacaccgcgcgcaggtacagcccgcgcgactacgccgcgctgctcctccagggctactccgaccagctcacccagctctacggcctcggcgcccgcaagtttgtcgtcgccggcgtcggcctgatcggctgcatcccttacgagctcgctaggatggacgacgaccacggaccgtcgtctcggcctagcaatcagtccgccgtttctagccaagacattgctatatccattggcatcggcggtggtggcggcggcggcggtatcggcatcggcggcggtagagttggcgggagattaccggggcttctggccatggtgaagcgcttcaacagccgcggggggctgcgcggggccaagttcgtcttcctcgacgccgtgcagagcggcaaggacctggtggcgaacgccgccgcgcacgggttcacggtgctggaccggggctgctgcggcgtgggccggaacaacgggcagatcacgtgcctgcccctgcagcggccgtgcgacgaccggagcaagtacatgttctgggacgccttccaccccacggaggcggtccacaggatctacgccgccaaggccttcagctccaactccaccgccgaagtttaccccatcaacgtcagccagctcgccgccatttga

SEQ ID NO: 16611 - protein, 397 aa, Sorghum bicolor
  misc_feature: Useful for making plants with modulated phosphate use efficiency
  misc_feature: Functional homolog of the protein sequence given in SEQ ID NO 14406
  misc_feature: Ceres ANNOT ID no. 8659350
  misc_feature (40)..(251): SWISSPROT Homolog: EC 3.2.1.51 Alpha-L-fucosidase
  misc_feature (40)..(377): Pfam ID: Lipase_GDSL Pfam Description: GDSL-like Lipase/Acylhydrolase
MDDYGRLALAVAVVAAVAGTSGGAAAWGWQQQQPPLAPCMYVFGDSLVDNGNNNDILSLARANYRPYGIDFHEGPPGRFTNGRTMVDFLSDMLRLRPPLLPPYATARPEDLPRGVNFASGASGILPETGNNLVDHFRAAVSDMGNTSEFRGNATKVAAHLGRCIFFVGMGSNDYLNNYFMPDYYDTARRYSPRDYAALLLQGYSDQLTQLYGLGARKFVVAGVGLIGCIPYELARMDDDHGPSSRPSNQSAVSSQDIAISIGIGGGGGGGGIGIGGGRVGGRLPGLLAMVKRFNSRGGLRGAKFVFLDAVQSGKDLVANAAAHGFTVLDRGCCGVGRNNGQITCLPLQRPCDDRSKYMFWDAFHPTEAVHRIYAAKAFSSNSTAEVYPINVSQLAAI

SEQ ID NO: 16612 - DNA, 1083 bp, Sorghum bicolor
  misc_feature: Ceres ANNOT ID no. 8659347
  misc_feature: Encodes the peptide sequence at SEQ ID NO 16613
atggcgacgacgacggcgacggcgacgaaccggcgggtgatcctcaaggagtacgtggaggggtaccctcgggaggagcacatggagctgctccccggctcctcggtgccgctccgcctgacggggaccgagccggcgggctccgtcctcgtccggaacctctacctctcctgcgacccctacatgcggcccaagatgtcgcgcccgctgcgtgagtcctacacggcggcgttcgtcccgggcgacgccatcacgggctacggcgtgtcgcgcgtgctcgactcctccgacccgcgcttcgcgccgggggacctcgtctggggcatcaccggctgggaggactacagcgtcgtgaccccgcccgtctccaagttcctcgccaagatctcccaccacggcgagggcgtgccgctgtcctactacaccggcatcctcggcatgccggggctcaccgcctacgtgggcttccacgagatctgcgcgccgaagaaaggcgagaccgtgttcgtgtccgcggcctcgggcgccgtcggccagctggtgggacagttcgcgaggctcgccgggtgccacgtcgtcggcagcgccgggtccaaggagaaggtggagctgctcaagaccaagttcggcttccacgacgccttcaactacaaggaggagcccgacctcggcgccgcgctgaagcgctgcttcccggacgggatcgacatctacttcgagaacgtcgggggcgccatgctcgacgccgtcctgctcaacatgcgcgtgcacggccggatcgccgtctgcggcttcatctcgcagtacaacctggcggacggggagaaggacgccgtgcgcaacctggccgccgtcattgccaagcgactccgcctgcaggggttcatcgagcccgaccacaagcacctgtacccgcagtacgaggcgtgggtgctgccttacatcagggacggcacgctcgcctacgtcgaggacgtcgccgaggggctcgagaacgcgcccaaggcactcatcggactcttccacggacgcaacgtcgggaagcagctcgtccgcgtcgccgacgacgagtcggcggcgtga

SEQ ID NO: 16613 - protein, 360 aa, Sorghum bicolor
  misc_feature: Useful for biocontainment applications
  misc_feature: Useful for making plants with modulated nitrogen use efficiency
  misc_feature: Functional homolog of the protein sequence given in SEQ ID NO 12982
  misc_feature: Ceres ANNOT ID no. 8659347
  misc_feature: Up-regulated in root tissues in response to methyl jasmonate treatment
  misc_feature: Up-regulated in shoot tissues in response to methyl jasmonate treatment
  misc_feature (78)..(351): SWISSPROT Homolog: EC 1.6.5.5 NADPH:quinone reductase
  misc_feature (164)..(317): Pfam ID: ADH_zinc_N Pfam Description: Zinc-binding dehydrogenase
MATTTATATNRRVILKEYVEGYPREEHMELLPGSSVPLRLTGTEPAGSVLVRNLYLSCDPYMRPKMSRPLRESYTAAFVPGDAITGYGVSRVLDSSDPRFAPGDLVWGITGWEDYSVVTPPVSKFLAKISHHGEGVPLSYYTGILGMPGLTAYVGFHEICAPKKGETVFVSAASGAVGQLVGQFARLAGCHVVGSAGSKEKVELLKTKFGFHDAFNYKEEPDLGAALKRCFPDGIDIYFENVGGAMLDAVLLNMRVHGRIAVCGFISQYNLADGEKDAVRNLAAVIAKRLRLQGFIEPDHKHLYPQYEAWVLPYIRDGTLAYVEDVAEGLENAPKALIGLFHGRNVGKQLVRVADDESAA

SEQ ID NO: 16614 - DNA, 759 bp, Sorghum bicolor
  misc_feature: Ceres ANNOT ID no. 8659376
  misc_feature: Up-regulated in root tissues in response to methyl jasmonate treatment
  misc_feature: Up-regulated in shoot tissues in response to methyl jasmonate treatment
  misc_feature: Encodes the peptide sequence at SEQ ID NO 16615
atggcaatgctgctcttgtacttgctgagcttgtgcgcctctcgtctcggcggcgcagtggcgcagcagtatcagtactggacgccggccaccgcgacgttctacggcgggagcgacgcgtccggcaccatgggcggatcgtgcgggtacggcgacctgtacagcgccgggtacgggacgcagacgacggcgctgagcacggcgctctacggcgacggcgcctcctgcggcgcgtgctacctcgtcacctgcgacgcgacggggacgcagtactgcaagccggggtcgccgtcggtcaccgtcacggccaccaacttctgcccgcccaactacgacgacgccaacgggtggtgcaactcgccgcggcggcacttcgacatgtcgcagccggcctgggagaccatcggcgtgtaccaggccggcgtaatacccgtcaactaccggagggtatcgtgccagaggtccggcgggatcaggttcgccatcagcgggcacgactacttcgaccttgtcaccatcaccaacgtcggcggcgccggcgcggtggccgcggcgtggatcatgggcaccggcggcacggactggctggccatgagccgcaactggggggagaactggcagagcggagccaacctcaccgggaaggccctgtcgttcaaggtgcagacggacgacggcaaggtcgtcgtggcggataacgtggcgccggcgaactggcagttcggcagcacctaccaggcctcggtcaacttctactag

SEQ ID NO: 16615 - protein, 252 aa, Sorghum bicolor
  misc_feature: Useful for making plants with altered carbohydrate content
  misc_feature: Functional homolog of the protein sequence given in SEQ ID NO 14012
  misc_feature: Useful for making plants with altered cell wall content and/or composition
  misc_feature: Functional homolog of the protein sequence given in SEQ ID NO 13785
  misc_feature: Useful for making plants with altered lignin content
  misc_feature: Functional homolog of the protein sequence given in SEQ ID NO 12888
  misc_feature: Ceres ANNOT ID no. 8659376
  misc_feature (16)..(118): SWISSPROT Homolog: EC 3.2.1.4 Cellulase
  misc_feature (62)..(147): Pfam ID: DPBB_1 Pfam Description: Rare lipoprotein A (RlpA)-like double-psi beta-barrel
  misc_feature (158)..(236): Pfam ID: Pollen_allerg_1 Pfam Description: Pollen allergen
MAMLLLYLLSLCASRLGGAVAQQYQYWTPATATFYGGSDASGTMGGSCGYGDLYSAGYGTQTTALSTALYGDGASCGACYLVTCDATGTQYCKPGSPSVTVTATNFCPPNYDDANGWCNSPRRHFDMSQPAWETIGVYQAGVIPVNYRRVSCQRSGGIRFAISGHDYFDLVTITNVGGAGAVAAAWIMGTGGTDWLAMSRNWGENWQSGANLTGKALSFKVQTDDGKVVVADNVAPANWQFGSTYQASVNFY

SEQ ID NO: 16616 - DNA, 681 bp, Sorghum bicolor
  misc_feature: Ceres ANNOT ID no. 8659377
  misc_feature: Encodes the peptide sequence at SEQ ID NO 16617
atggccgcccgtcctccctcgtccctgcttcttggagcggtcgcggtgctgctagtccttgccgctgcgccgtcggcgctcgccggcgaccccgactacctccaggacctctgcgtcgccgacctcaactccgcggtgaaggtgaacgggttcccgtgcaaggcggcggaggcggccaccgccgacgacttcttcacgagcatcctggcgacgccgggcggcaccaacaccacgtcgggctccgtggtgacgggcgccaacgtggagaaggtcccggggctcaacacgctgggcgtctcgctctcccgcatcgactacgcgccgggcggggtgaacccgccgcacacgcacccgcgcgccaccgagctcgtcttcgtgctctacggcaagctcgacgtcggcttcgtcaccaccgccaacaagctcgtcgccaggaccatcgcgcggggcgacgtcttcgccttcccgagggggctcgtgcacttccagaggaaccccggcaccgagcccgccgccgtcatctccgcgttcaacagccagctccccggcacgcagtccatcgccatgacgctcttcggggcctcgccggacctgcccgacgatgtgctcgccaaggccttccagatccccgacgaggaggtggccaagatcaaggacaagttcgcgcccaagaagggatga

SEQ ID NO: 16617 - protein, 226 aa, Sorghum bicolor
  misc_feature: Useful for making plants with modulated nitrogen use efficiency
  misc_feature: Functional homolog of the protein sequence given in SEQ ID NO 14277
  misc_feature: Ceres ANNOT ID no. 8659377
  misc_feature (30)..(225): SWISSPROT Homolog: EC 1.15.1.1 Superoxide dismutase
  misc_feature (67)..(215): Pfam ID: Cupin_1 Pfam Description: Cupin
  misc_feature (102)..(177): Pfam ID: Cupin_2 Pfam Description: Cupin domain
MAARPPSSLLLGAVAVLLVLAAAPSALAGDPDYLQDLCVADLNSAVKVNGFPCKAAEAATADDFFTSILATPGGTNTTSGSVVTGANVEKVPGLNTLGVSLSRIDYAPGGVNPPHTHPRATELVFVLYGKLDVGFVTTANKLVARTIARGDVFAFPRGLVHFQRNPGTEPAAVISAFNSQLPGTQSIAMTLFGASPDLPDDVLAKAFQIPDEEVAKIKDKFAPKKG

SEQ ID NO: 16618 - DNA, 1593 bp, Sorghum bicolor
  misc_feature: Ceres ANNOT ID no. 8659383
  misc_feature: Encodes the peptide sequence at SEQ ID NO 16619
atgactatggaccctgctccggcggcgaacggcgccgcggccgtagccggcggaggcatgaagcggcagggcggtagatggtggtacgcggcggccggtgccctcattgtggcgctcctcgccgtggccgtgagctattacagcttccggggcatcccctcctctccaccaggaggctgcggctgccctgctgcaaggaagtacaccggaatggtggaggactgctgctgcgactatgagacggtggacgccatcaatgaggaggttctgcatccgatcctacaggaacttgttaagttgccgttcttcaggtacttcaaggttaaattgtggtgtgattgccctttttggcctgatgatggaatgtgcaagcttagagattgtagtgtctgtgagtgcccagagaatgagatccctgaaccattcaagaaatcttacagtggactttctccagatagtatgatatgccaagaaggaaaaccacaggctaccattgataaaacccttgacagcaaggttttcaaaatatgggttgaaactgacaatccgtggacatctgatgacgaggctgatagtaaagagatggcttacgtgaatcttcaactgaatcctgaacgatacactggctatactggtgattcagcaagaaggatatgggatgctatttacaaagagaactgtccaaaatatccctctgaagaactgtgccatgagaagaaggcattgtacaagcttatttcagggttgcactcctcaatttcagtgcatattgcttacgattatcttcttgatgaatctactaactcatggggacaaaatcttcctttgctgtatgaccgtgtcctgaagtacccagagcgtgtccagaatctgtacttcacctacctgtttgttcttcgggccgtgacaaaggcagcagattatctcgagcaagctgattacaatactggtaatcctgaagacgactggaaaacacgatctcttgtgaagcaattgctttacaattcaaagttaagatctgcatgtccattgccttttgatgaagccaaactctggcaaggtgaaaatggtcctgaactaaagcaagagattcagaagcaatttagaaacattagcgcaattatggactgtattggatgcgagaagtgccggctgtggggaaagctccaagttcttggtcttggaactgcactgaaaattcttttctctgtcaatggagacagccatttgaatcagccacttcagcgaaatgaggtcattgcattgttcaatcttctgaataggctctcagagtctgtcaaatttgtacatgaaaaaggatcgtcaattgaagaagtcatcaaggaacagagcccttcaacccttcaaaagggtggttctaagccgaatgttaaactgaagttgatgcctcaggcccttcaagcatggcaatgcagctgtgtgctggcctgctgtgacatgtcggctatgtcgcaggagagctacttgggtcacacagtggtagtcagggtcatggatcagaaggcatcttggtgtatggctacttttgcagacatcatatttatgtcacatatggagcagagagataaataa

SEQ ID NO: 16619 - protein, 530 aa, Sorghum bicolor
  misc_feature: The sequence is a functional homolog of SEQ ID NO 2 in US patent 7064247
  misc_feature: Ceres ANNOT ID no. 8659383
  misc_feature: Up-regulated in shoot tissues in response to salicylic acid treatment
  misc_feature: Up-regulated in root tissues in response to salicylic acid treatment
  misc_feature (88)..(437): Pfam ID: ERO1 Pfam Description: Endoplasmic Reticulum Oxidoreductin 1 (ERO1)
MTMDPAPAANGAAAVAGGGMKRQGGRWWYAAAGALIVALLAVAVSYYSFRGIPSSPPGGCGCPAARKYTGMVEDCCCDYETVDAINEEVLHPILQELVKLPFFRYFKVKLWCDCPFWPDDGMCKLRDCSVCECPENEIPEPFKKSYSGLSPDSMICQEGKPQATIDKTLDSKVFKIWVETDNPWTSDDEADSKEMAYVNLQLNPERYTGYTGDSARRIWDAIYKENCPKYPSEELCHEKKALYKLISGLHSSISVHIAYDYLLDESTNSWGQNLPLLYDRVLKYPERVQNLYFTYLFVLRAVTKAADYLEQADYNTGNPEDDWKTRSLVKQLLYNSKLRSACPLPFDEAKLWQGENGPELKQEIQKQFRNISAIMDCIGCEKCRLWGKLQVLGLGTALKILFSVNGDSHLNQPLQRNEVIALFNLLNRLSESVKFVHEKGSSIEEVIKEQSPSTLQKGGSKPNVKLKLMPQALQAWQCSCVLACCDMSAMSQESYLGHTVVVRVMDQKASWCMATFADIIFMSHMEQRDK

SEQ ID NO: 16620 - DNA, 2649 bp, Sorghum bicolor
  misc_feature: Ceres ANNOT ID no. 8659420
  misc_feature: Up-regulated in shoot tissues in response to salicylic acid treatment
  misc_feature: Up-regulated in root tissues in response to salicylic acid treatment
  misc_feature: Encodes the peptide sequence at SEQ ID NO 16621
atggctggcagagctcggcgcccattgctggtgctgctactcgtcgccggcgttgctgccaccgcagagtccaaggtgtactctccggcggataaggtgctgctcaactgtgggtcgacgacggacggcctggacgcggacgggcggaagtgggtggccgacacgaacgacaacacgtggctgaccgactccggcaagtcgtcgctgttgatggcggccgacaaggtggacaatggtctgccgtccaccatcccctacatgacggctcgggtgttcaccacggaggccgtgtacaacttctcggtgaaaccgcacgaccggcactgggtgcgcctccacttctacccgtcctcgtacaacggcatcgccgccaaaggcttccacttctccgtgtccacgtccaccggcatcaccctgctccgcaacttcagcgtctacacctacaccaaggcgctgacccaggcgtacgtcatccgggagttctccctcccgcctacccccgcgggtttcctcaccctcaccttcaccccgacgcccatgggcaacgagacctacgccttcgtcaacggcatcgaggtgatctccatgcccgacatcttcgtcgacccggccatcatggtcggcttcgcggaccagaccgtggacatcgccagctccacgctcgagaccatgtaccggttcaacgtcggcggctcctacatcccgccgtccaacgactccggcctcacccggaactggtacgacgacacgccctacgtgtacggccccacgcagggcgtcacctacagggccggcccgcatttccagatcaagtaccccagcgagaccgccgagtacgccgcgccgccggaggtgtacctgggcacccgctccatgggctccgaccctcgcctcaaccagaactacaacctcacctggaccatgccggtggacggcaacttcacctacgtcgcgcgcctccacttctgcgagctgctgctcagccgtgccaaccagcgggcgttcgacatctacgtcaacaacaagacggcgcagtccgacgccgacgtgatcggcatgacgtcggagaagggcgtgcccttgtacaaggactacgcggcgtacgtctcccaggagcccgacggccagtccatgtgggtggcgctgcacccgtccgtggcgctccgcccgcagttctacgacgccatcctcaacggcctcgagatcttcaagctcaacgacaccgccggcaacctcgccgcgccagaccccgagccgtccaggttgctcgccaaggcggagatgggcgccggagaccacgcggcgcacaagtccaagccgcatccccacatggcgagggtgatgggcggcacggcgggcggcgcggccgcgctcgggatcgtcgccgccatctgcgtcgtgtggtaccatgagaagaagaagagggaggcagcagccagcgccggcggctcgcacgcctccgggtggctgccgctctaccactcctacaccagcaacaagtcgtcgggccacctcccggcgaacctcgcgggcatgtgccggcacttctcgttcgccgacatcaaggtggccaccaagaacttcagcgagtcgctggtgatcggcgtcggcgggttcggcaaggtgtaccggggcgtcgtggatggcgacaccaaggtggccatcaagcggtccaacccgtcgtcggagcagggcgtgcacgagttccagacggaggtggagatgctgtccaagctgcggcaccggcacctcgtctccctcatcggcttctgcgaggacgccggcgagatgatcctcgtgtacgactacatggagcacggcacgctgcgggagcacctctacatgggcggcaagccgccgctgtcgtggcggaagcgcctcgacatctgcatcggcgccgcgcggggattgcactacctccacacgggcgccaagtacaccatcatccaccgcgacgtcaagaccaccaacatcctcgtcgacggggactgggtcgccaaggtctccgacttcggcctctccaagtccggcccgaccaccatgaaccagacacacgtcagcaccatggtcaagggcagcttcgggtacctcgacccggagtacttccggcggcagcagctcacggacaagtccgacgtctactccttcggcgtcgtcctcttcgaggtgctgctcgcgcggccggcgctcgacccggcgctgccacgggagaaggtcagcctcgccgactacgcgctcagctgccagcggaacggcaccctgatggacgtcatcgacccagcgatcaaggaccagatcgcgccggagtgtttcaagaagatcgccgacacggccgagaagtgcctcgccgagatgagcatcgagcggccgtccatgggggacgtcctgtggaacctcgagttcgcgctgcagctgcaggacaccttcgaaggaggcagcagcgggcggcggaccgtcggcgacggcagcggcacgggccgcgccgcgctcgagccgagcaacagcaacgggagcacggcaagtgtcacgacgctggggacgtcgtccacgtcccgggcgcacgaggcgtgcgtcatcatggaggagaccgacgacgaggtggctaacagcgcggccttctcgcagctcgtgtgcccaactggccggtaa

SEQ ID NO: 16621 - protein, 882 aa, Sorghum bicolor
  misc_feature: Useful for making plants with modulated biotic stress sensitivity
  misc_feature: Functional homolog of the protein sequence given in SEQ ID NO 14099
  misc_feature: Ceres ANNOT ID no. 8659420
  misc_feature (516)..(848): SWISSPROT Homolog: EC 2.7.11.1 Non-specific serine/threonine protein kinase
  misc_feature (528)..(799): Pfam ID: Pkinase_Tyr Pfam Description: Protein tyrosine kinase
MAGRARRPLLVLLLVAGVAATAESKVYSPADKVLLNCGSTTDGLDADGRKWVADTNDNTWLTDSGKSSLLMAADKVDNGLPSTIPYMTARVFTTEAVYNFSVKPHDRHWVRLHFYPSSYNGIAAKGFHFSVSTSTGITLLRNFSVYTYTKALTQAYVIREFSLPPTPAGFLTLTFTPTPMGNETYAFVNGIEVISMPDIFVDPAIMVGFADQTVDIASSTLETMYRFNVGGSYIPPSNDSGLTRNWYDDTPYVYGPTQGVTYRAGPHFQIKYPSETAEYAAPPEVYLGTRSMGSDPRLNQNYNLTWTMPVDGNFTYVARLHFCELLLSRANQRAFDIYVNNKTAQSDADVIGMTSEKGVPLYKDYAAYVSQEPDGQSMWVALHPSVALRPQFYDAILNGLEIFKLNDTAGNLAAPDPEPSRLLAKAEMGAGDHAAHKSKPHPHMARVMGGTAGGAAALGIVAAICVVWYHEKKKREAAASAGGSHASGWLPLYHSYTSNKSSGHLPANLAGMCRHFSFADIKVATKNFSESLVIGVGGFGKVYRGVVDGDTKVAIKRSNPSSEQGVHEFQTEVEMLSKLRHRHLVSLIGFCEDAGEMILVYDYMEHGTLREHLYMGGKPPLSWRKRLDICIGAARGLHYLHTGAKYTIIHRDVKTTNILVDGDWVAKVSDFGLSKSGPTTMNQTHVSTMVKGSFGYLDPEYFRRQQLTDKSDVYSFGVVLFEVLLARPALDPALPREKVSLADYALSCQRNGTLMDVIDPAIKDQIAPECFKKIADTAEKCLAEMSIERPSMGDVLWNLEFALQLQDTFEGGSSGRRTVGDGSGTGRAALEPSNSNGSTASVTTLGTSSTSRAHEACVIMEETDDEVANSAAFSQLVCPTGR

SEQ ID NO: 16622 - DNA, 1794 bp, Sorghum bicolor
  misc_feature: Ceres ANNOT ID no. 8659451
  misc_feature: Encodes the peptide sequence at SEQ ID NO 16623
atggcgtcgtctacgagcgctaccagctgcccctgcctgctgctgacgctcttggtcctcctcctcctcatggtcatggcacgccgcgccgacgccagcgccgtgttcgccggcctgtccttcgagagccccggtgaggcggaggccttcgaggacgcgctgctgcgccaggcctgcgtcaacgtctcgttcctgtcgggtggccgcgaccgcgaggcctgcgtgtcgcggctcgacacggcccgcggcggcgcgggcagcgggcccgtgcccgtcctccgcgccgcgctccgcgacacgctcggcgaggccgtgggcgccgtgcgcgcggtccgcggactcgcctcgctgtccaaccgcccgcgcgaggagatggcggtgcgcgactgcgtcgagctcctgggatactccgtcgacgagctcgggtgggcgctggacgccatggccgagaccgacaccgagaccgacgccagcggcggcggctccgcggcgcggcgcgccgaggacgacctccacgcgtggctcagcgctgcgctcggcaaccaggacacctgcgtggagggcttccacggcaccgacggccgcctgctgcaccgcgtggaggccgccgtagcgcagctcacgcagctggtcagcaacctcctcgccatgcacaagcgcctgcgcagcatcacgccgctgctgcaccatggacctcctactaataaaaacaacggcacctccggcggcggcgccggcgacgaactgccgccgtgggtgatggacatcgaggtcgacgacggcgacaagcaggaccaggacgaggaggagctcgtcgccaagcgcgcccgcgccggcagggtgtcgacgcgcgtggacgtcgtggtggcgcaggacggcagcgggcgctaccgcaccgtcagcgaggcggtggcacgggcgcccaaccacagcaagcggaagtacgtgatctacgtgaagcgaggggtgtaccacgagaacgtggaggtgaggaagaagaagaccaacatcgtcatcgtcggcgagggcatgggcgagacggtcatctccggcagccggagcttctccagcggctggaccaccttccggagcgccaccttcgcggtggccggcgccgggttcgtcgcgcgggacctgacgttcaggaacacggcggggccggcggcgcaccaggcggtggcgctgcgggtggactcggaccgctccgccttcttccgcgtggcggtggaggggcaccaggacacgctgtacgcgcactcgctccggcagctctaccgggactgccgcgtcgccggcaccgtggacttcgtcttcggcaacggcatcgtcgtggtgcagcggagcctggtggccacgctgccgctggcgcccggccagacggggagcgtcaccgcgcagggccggaaggaccccaaccagaacacgggcttctccttccacggctgcgtggtggagggcaagtacccgacgtacctgggccgcccgtggaagcccttctcgcgggtcgtcgtgatggagtcctacctgggccctggaattcaggcccgcgggtggctcgagtgggccgctgccggctcaggggaccacagcacgggcctcgccacgctgttctacggagagtacaagaactacgggcccggggcgggcgtcgcgggccgagtgaagtggcccggctaccacgtgatcatggacgccgccgtcgccagccggttcaccgtcaggcgattcattgacgggctcgcgtggctgcccggcaccgggatcaccttcacggccgatctcttcaggaaatga

SEQ ID NO: 16623 - protein, 597 aa, Sorghum bicolor
  misc_feature: Useful for making plants with altered cell wall content and/or composition
  misc_feature: Functional homolog of the protein sequence given in SEQ ID NO 14407
  misc_feature: Useful for making plants with altered carbohydrate content
  misc_feature: Functional homolog of the protein sequence given in SEQ ID NO 14329
  misc_feature: Ceres ANNOT ID no. 8659451
  misc_feature (274)..(593): SWISSPROT Homolog: EC 3.1.1.11 Pectinesterase
  misc_feature (286)..(580): Pfam ID: Pectinesterase Pfam Description: Pectinesterase
  misc_feature (49)..(217): Pfam ID: PMEI Pfam Description: Plant invertase/pectin methylesterase inhibitor
MASSTSATSCPCLLLTLLVLLLLMVMARRADASAVFAGLSFESPGEAEAFEDALLRQACVNVSFLSGGRDREACVSRLDTARGGAGSGPVPVLRAALRDTLGEAVGAVRAVRGLASLSNRPREEMAVRDCVELLGYSVDELGWALDAMAETDTETDASGGGSAARRAEDDLHAWLSAALGNQDTCVEGFHGTDGRLLHRVEAAVAQLTQLVSNLLAMHKRLRSITPLLHHGPPTNKNNGTSGGGAGDELPPWVMDIEVDDGDKQDQDEEELVAKRARAGRVSTRVDVVVAQDGSGRYRTVSEAVARAPNHSKRKYVIYVKRGVYHENVEVRKKKTNIVIVGEGMGETVISGSRSFSSGWTTFRSATFAVAGAGFVARDLTFRNTAGPAAHQAVALRVDSDRSAFFRVAVEGHQDTLYAHSLRQLYRDCRVAGTVDFVFGNGIVVVQRSLVATLPLAPGQTGSVTAQGRKDPNQNTGFSFHGCVVEGKYPTYLGRPWKPFSRVVVMESYLGPGIQARGWLEWAAAGSGDHSTGLATLFYGEYKNYGPGAGVAGRVKWPGYHVIMDAAVASRFTVRRFIDGLAWLPGTGITFTADLFRK

SEQ ID NO: 16624 - DNA, 582 bp, Sorghum bicolor
  misc_feature: Ceres ANNOT ID no. 8659444
  misc_feature: Encodes the peptide sequence at SEQ ID NO 16625
atgttcctggtggactggttctacggggtgctggcgtcgcttgggctgtggcagaaggaggcgaagatcctcttcctcggcctcgacaacgccggcaagaccaccctcctccacatgctcaaggacgagcggctcgtgcagcaccagccgacgcagtacccgacgtcagaagagctgagcatcggcaggatcaagttcaaggccttcgacctcgggggccaccagatcgcccgccgcgtctggaaggactactacgccaaggttgatgctgttgtgtacttggtggatgctgttgacaaggaacggtttgccgagtcaaagaaagagcttgatgcgcttctagcagatgactcccttgcaaacgttcctttcctcatactgggcaacaagattgacatcccatacgcggcttcagaggaggaactgcggtactaccttggcctgagcaacttcacaacggggaagggcaacgtgaacttggctgattccaatgttcgccccctggagatcttcatgtgcagtgtggtgcgcaagatgggctatggtgaaggcttcaaatggatgtctcagtacatcaagtga

SEQ ID NO: 16625 - protein, 193 aa, Sorghum bicolor
  misc_feature: The sequence is a functional homolog of SEQ ID NO 11 in US patent 7259294
  misc_feature: Ceres ANNOT ID no. 8659444
  misc_feature (6)..(192): Pfam ID: Arf Pfam Description: ADP-ribosylation factor family
MFLVDWFYGVLASLGLWQKEAKILFLGLDNAGKTTLLHMLKDERLVQHQPTQYPTSEELSIGRIKFKAFDLGGHQIARRVWKDYYAKVDAVVYLVDAVDKERFAESKKELDALLADDSLANVPFLILGNKIDIPYAASEEELRYYLGLSNFTTGKGNVNLADSNVRPLEIFMCSVVRKMGYGEGFKWMSQYIK

SEQ ID NO: 16626 - DNA, 1011 bp, Sorghum bicolor
  misc_feature: Ceres ANNOT ID no. 8659552
  misc_feature: Encodes the peptide sequence at SEQ ID NO 16627
atggcggcttccatgagtcatcgttgtcacatgctgctgctctgcgtcgtcctcctcgccggcgccgtccgtggccacccttggggcggcggcctgttcccgcagttctacgaccactcgtgtcccaaggcgaaggagatcgttaggtccgtcgtggcgcaggccgtcgccagggagaccaggatggcggcgtcacttgtcaggctgcatttccatgactgcttcgtcaagggctgcgacgcttctgtgctgctggacaacagcagcagcatcgtgagcgagaaaggctccaaccccaacaagaactcgcttcgtggcttcgaggtcgtggaccagatcaaggccgcgctggaggccgcgtgcccgggcgtcgtctcctgcgccgacatcctcgccctggccgcgcgcgactccacggtgctcgtcggcggtccatcctgggacgtgccgctggggcggagggactcgctgggcgccagcatccagggctccaacaacgacatcccggcgcccaacaacacgctccccaccatcgtcaccaagttcaggcgccagggcctggacgtcgccgacgtcgtcgcgctctccggcggccacaccatcggcatgtcccgctgcaccagcttcaggcagaggctctacaaccagacgggcaacggcatggcggacgccacgctggacgtctcctacgcggcgcagctgaggcggggatgcccgcgctccggcggcgacaacaacctcttcccgctcgacctcgccaccccggccaggttcgacaacctctacttcaagaacatcctggccggaagggggctgctcagctccgacgaggtgctgctcaccaagagcgccgagacggcggcgctcgtcaaggcctacgccgcggacgtcaacctcttcttccagcacttcgcgcagtcgatggtgaagatgggcaacatctcgccgctgacggggccgcagggggagatcaggaagaactgcaggaggattaacggcaaccattactga

SEQ ID NO: 16627 - protein, 336 aa, Sorghum bicolor
  misc_feature: Useful for making plants with altered carbohydrate content
  misc_feature: Functional homolog of the protein sequence given in SEQ ID NO 13815
  misc_feature: Useful for making plants with altered cell wall content and/or composition
  misc_feature: Functional homolog of the protein sequence given in SEQ ID NO 13819
  misc_feature: Useful for making plants with modulated nitrogen use efficiency
  misc_feature: Functional homolog of the protein sequence given in SEQ ID NO 13820
  misc_feature: Useful for making plants with modulated oxidative stress sensitivity
  misc_feature: Functional homolog of the protein sequence given in SEQ ID NO 13607
  misc_feature: Useful for making plants with modulated light quality response
  misc_feature: Functional homolog of the protein sequence given in SEQ ID NO 13816
  misc_feature: Ceres ANNOT ID no. 8659552
  misc_feature (29)..(332): SWISSPROT Homolog: EC 1.11.1.7 Peroxidase
  misc_feature (48)..(296): Pfam ID: peroxidase Pfam Description: Peroxidase
MAASMSHRCHMLLLCVVLLAGAVRGHPWGGGLFPQFYDHSCPKAKEIVRSVVAQAVARETRMAASLVRLHFHDCFVKGCDASVLLDNSSSIVSEKGSNPNKNSLRGFEVVDQIKAALEAACPGVVSCADILALAARDSTVLVGGPSWDVPLGRRDSLGASIQGSNNDIPAPNNTLPTIVTKFRRQGLDVADVVALSGGHTIGMSRCTSFRQRLYNQTGNGMADATLDVSYAAQLRRGCPRSGGDNNLFPLDLATPARFDNLYFKNILAGRGLLSSDEVLLTKSAETAALVKAYAADVNLFFQHFAQSMVKMGNISPLTGPQGEIRKNCRRINGNHY

SEQ ID NO: 16628 - DNA, 1011 bp, Sorghum bicolor; identical to SEQ ID NO: 16626
  misc_feature: Ceres ANNOT ID no. 8659557
  misc_feature: Encodes the peptide sequence at SEQ ID NO 16629

SEQ ID NO: 16629 - protein, 336 aa, Sorghum bicolor; identical to SEQ ID NO: 16627
  misc_feature: Useful for making plants with altered carbohydrate content
  misc_feature: Functional homolog of the protein sequence given in SEQ ID NO 13815
  misc_feature: Useful for making plants with altered cell wall content and/or composition
  misc_feature: Functional homolog of the protein sequence given in SEQ ID NO 13819
  misc_feature: Useful for making plants with modulated nitrogen use efficiency
  misc_feature: Functional homolog of the protein sequence given in SEQ ID NO 13820
  misc_feature: Useful for making plants with modulated oxidative stress sensitivity
  misc_feature: Functional homolog of the protein sequence given in SEQ ID NO 13607
  misc_feature: Useful for making plants with modulated light quality response
  misc_feature: Functional homolog of the protein sequence given in SEQ ID NO 13816
  misc_feature: Ceres ANNOT ID no. 8659557
  misc_feature (29)..(332): SWISSPROT Homolog: EC 1.11.1.7 Peroxidase
  misc_feature (48)..(296): Pfam ID: peroxidase Pfam Description: Peroxidase

SEQ ID NO: 16630 - DNA, 450 bp, Sorghum bicolor
  misc_feature: Ceres ANNOT ID no. 8659587
  misc_feature: Encodes the peptide sequence at SEQ ID NO 16631
atgcacctccggaagatgtggaccatcgggccgacgtgcgcctccgtcggcggcttggacgcgcacaccagggccagcaggggaaaccgcctggacgtcgacgctgggcttttcgtgtcgtggctagacgcccggccgtcatccgtgctctacatcagcttcggcagcctcgcgcacctgctggtgaacctcgaggcgtcggagcggccgttcgtctgggccatcaaggaggccaattcgaacgccgacgtgcaggcgtggctcaccgaggggttcgaggaccacgtcaaggacagggggctcctggtcagcggctgggcgccgcaggtgaccatccgaggcagaaccagccgccatggaagaacaccgcgacgtccaagatgcttgtgtcaagatgctcgagagaatgcttcaaagaaaggtaaactcaccttctccaggaagaggtga

SEQ ID NO: 16631 - protein, 149 aa, Sorghum bicolor
  misc_feature: Useful for making plants with altered carbohydrate content
  misc_feature: Functional homolog of the protein sequence given in SEQ ID NO 14399
  misc_feature: Ceres ANNOT ID no. 8659587
  misc_feature (4)..(112): SWISSPROT Homolog: EC 2.4.1.238 Anthocyanin 3'-O-beta-glucosyltransferase
MHLRKMWTIGPTCASVGGLDAHTRASRGNRLDVDAGLFVSWLDARPSSVLYISFGSLAHLLVNLEASERPFVWAIKEANSNADVQAWLTEGFEDHVKDRGLLVSGWAPQVTIRGRTSRHGRTPRRPRCLCQDARENASKKGKLTFSRKR

SEQ ID NO: 16632 - DNA, 114 bp, Sorghum bicolor
  misc_feature: Ceres ANNOT ID no. 8659614
  misc_feature: Encodes the peptide sequence at SEQ ID NO 16633
atgccaaatctggtgaagctgattggctattgcgttgtggattcagaagtcatctacagggatttcaaagcgcccaacgtttttctggacgccaaattcaagccaaaactgtaa

SEQ ID NO: 16633 - protein, 37 aa, Sorghum bicolor
  misc_feature: Useful for making plants with modulated drought sensitivity
  misc_feature: Functional homolog of the protein sequence given in SEQ ID NO 14078
  misc_feature: Ceres ANNOT ID no. 8659614
  misc_feature (14)..(37): SWISSPROT Homolog: EC 2.7.11.1 Non-specific serine/threonine protein kinase
MPNLVKLIGYCVVDSEVIYRDFKAPNVFLDAKFKPKL

SEQ ID NO: 16634 - DNA, 924 bp, Sorghum bicolor
  misc_feature: Ceres ANNOT ID no. 8659619
  misc_feature: Encodes the peptide sequence at SEQ ID NO 16635
atggagcggctgcagcggatcttcggcgcctccggcatggggcagccgccgacggactcgccgctgctcgactcctccgagcaggtctacatctcctccctcgcgcttctcaagatgctcaagcacgggagggcgggcgtgcccatggaggtcatgggcctcatgctcggcgagttcgtcgacgactacaccgtcagggtcgtcgatgtcttcgccatgccgcagagcgggactggggtcagcgtcgaggccgttgaccacgtcttccagacaaacatgcttgacatgctcaagcagaccggcaggccagaaatggttgtaggctggtatcactcacatcctggcttcggttgctggttatcaggcgttgatatcaatactcagcagagttttgaagctttgaaccccagggcggttgctgttgtgatagaccccatccagagtgtgaaggggaaggtggttattgatgcattccgcctcattaatcctcagaccatgatgcttggccaggagccacggcagacaacatcaaatgttgggcatctaaataagccatctattcaggctcttatccatgggctgaacagacactactactcaattgcaatcaattaccggaaaaatgagcttgaggagaaaatgttgttgaacttgcacaaaaagaaatggacggatgggctaattttgaagaggtttgacactcactcaaaaaccaacgagcagactgtccaggaaatgctgaacctagccatcaagtacaataaggcagtgcaagaggaggacgagctgccacctgagaaacttgcgatagcaaatgtgggtcggcaagatgcaaaaaagcatttggaagagcatgtgtcgaatttgatgtcatcaaacatagttcagaccctaggaaccatgctcgacacggttgtcttttag

SEQ ID NO: 16635 - protein, 307 aa, Sorghum bicolor
  misc_feature: Useful for making plants with altered terpenoid content
  misc_feature: Functional homolog of the protein sequence given in SEQ ID NO 13056
  misc_feature: Useful for making plants with altered alkaloid content
  misc_feature: Functional homolog of the protein sequence given in SEQ ID NO 12892
  misc_feature: Ceres ANNOT ID no. 8659619
  misc_feature (49)..(162): SWISSPROT Homolog: EC 3.1.2.15 Ubiquitin thiolesterase
  misc_feature (24)..(137): Pfam ID: Mov34 Pfam Description: Mov34/MPN/PAD-1 family
MERLQRIFGASGMGQPPTDSPLLDSSEQVYISSLALLKMLKHGRAGVPMEVMGLMLGEFVDDYTVRVVDVFAMPQSGTGVSVEAVDHVFQTNMLDMLKQTGRPEMVVGWYHSHPGFGCWLSGVDINTQQSFEALNPRAVAVVIDPIQSVKGKVVIDAFRLINPQTMMLGQEPRQTTSNVGHLNKPSIQALIHGLNRHYYSIAINYRKNELEEKMLLNLHKKKWTDGLILKRFDTHSKTNEQTVQEMLNLAIKYNKAVQEEDELPPEKLAIANVGRQDAKKHLEEHVSNLMSSNIVQTLGTMLDTVVF

SEQ ID NO: 16636 - DNA, 735 bp, Sorghum bicolor
  misc_feature: Ceres ANNOT ID no. 8659691
  misc_feature: Encodes the peptide sequence at SEQ ID NO 16637
atggggtccttaggcttgctggttctagcgatcgctgcctttctggagctcaccagagccgactcctggcatggtggccgcgccacgttctacggcggcggtgacgcctctggtactatgggaggagcgtgtgggtatggcaacttgtacaatgccgggtacgggaagaacaccgcggcgctgagcaccgcgctgttcaacaacgggcagagctgcggcgcgtgctttgagatccggtgcacgggcagtggcagctgccggtctggttccgccactgtgacggccaccaacttctgcccgcccaactatgcgctcgccaacaacaatggtggatggtgcaacccaccacagccgcacttcgacctctccgagccggtcttcacccagatcgccattgccggtgccggcgtcgtgcctgtccaatacaggagggtggcgtgcgtcaagcagggtggcatccggttcaccatcaacggccactcctacttcgtcctggtgctcatcacaaacgtgggcggcgctggcgacttgacggcggtgtcggtgaagggatcggggacgggctggcagacgatgagccacaactggggcgccaactggcagaacggcgccctgctcgacggccaggcgctgtcgttccaggtcaccggcagcgatggccgcaccctcacgtgcgacaacgccgcaccagttggctggagctacggccagacctacaccggcaaacagttttaa

SEQ ID NO: 16637 - protein, 244 aa, Sorghum bicolor
  misc_feature: Useful for making plants with altered cell wall content and/or composition
  misc_feature: Functional homolog of the protein sequence given in SEQ ID NO 14408
  misc_feature: Useful for making plants with altered carbohydrate content
  misc_feature: Functional homolog of the protein sequence given in SEQ ID NO 14012
  misc_feature: Useful for making plants with altered lignin content
  misc_feature: Functional homolog of the protein sequence given in SEQ ID NO 12888
  misc_feature: Ceres ANNOT ID no. 8659691
  misc_feature (153)..(230): Pfam ID: Pollen_allerg_1 Pfam Description: Pollen allergen
  misc_feature (58)..(142): Pfam ID: DPBB_1 Pfam Description: Rare lipoprotein A (RlpA)-like double-psi beta-barrel
MGSLGLLVLAIAAFLELTRADSWHGGRATFYGGGDASGTMGGACGYGNLYNAGYGKNTAALSTALFNNGQSCGACFEIRCTGSGSCRSGSATVTATNFCPPNYALANNNGGWCNPPQPHFDLSEPVFTQIAIAGAGVVPVQYRRVACVKQGGIRFTINGHSYFVLVLITNVGGAGDLTAVSVKGSGTGWQTMSHNWGANWQNGALLDGQALSFQVTGSDGRTLTCDNAAPVGWSYGQTYTGKQF

SEQ ID NO: 16638 - DNA, 1518 bp, Sorghum bicolor
  misc_feature: Ceres ANNOT ID no. 8659692
  misc_feature: Encodes the peptide sequence at SEQ ID NO 16639
atgtcgaccatcgccgcctcccgccgctcgtcctcgtcctcgtccgcggccgccaagcgccccgcgatttcggagggcgccgggggacccaaggtggccgccgcgcaggccaagaagcgcgtggcgctcggcaacatcaccaacgttgccgcgcgaggagggagggccgtcgttggcggcggccttgggaatgccgcgccacccaccaccagcgcgaaattgaatccagcggtacccttgaagaagccatctttggcaagtgctcggagtgtgagctccattcggggtcaagctgtcaagtcggcttccatcaagccagctccaccagtgtcacgccatggcagtgcaattcaaaaacataatgttcctcctcctaaagtgcctaccattgccgatgtgccaagtcacgctcctgccttggtaccctgcaccggcttggtgtctcctggacgctcaggagattttgtttcgattgatgatacgatgtcgacttgcgactccatgaagagcccggactttgagtacatagacaatcaggattcctcgatgctggcttcattgcagcgacggacaaatgaacatctgcgaataacagaggatagagatgttgaagaaaataagtggaagaaaaatgccattgccccaatggaaattgaccgcatttgtgatgttgacaacgaatatgaggacccacagttgtgtgctactctggcttctgacatttacatgcacctgcgggaggctgagacgaagaaaagaccatcaactgatttcatggaaacaattcaaaaagacatcaacccaagcatgagggcaattttgatcgactggcttgtggaagtttctgaagaatatcgtcttgttcctgatactttgtacctgacagttaactacattgaccgttatctttctggtaacgaaattaaccgccaacggttgcaattacttggtgttgcttgcatgcttatagctgcaaaatatgaggagatatgtgcaccccaagtagaagaattctgctacataacagacaatacatacttcagagatgaggttctagatatggaaacttctgtactgaaatacttgaagtttgaaatgacagcacctacagcaaagtgctttttgaggaggtttgctcgtgctgcacaagcgtgtgacgaggatcctgctttgcatctcgagttccttgccaattacatcgctgagctatcactactggagtacaatctactctcttaccctccatcactaatagctgcatcggctattttcttggcgaggtttatactacagccaacaaagtatccttggaattccacacttgctcattatacacagtacaagccgtccgagttgagtgactgtgtaaaggcattgcatcgcctgtgcagtgttggttctgggaccaaccttccagcaatcagagaaaagtacagtcaacataagtacaaatttgttgcaaagaagcagtgtccaccacagatacctactgaattctttcgggatgccacatgctag

SEQ ID NO: 16639 - protein, 505 aa, Sorghum bicolor
  misc_feature: Useful for making plants with modulated oxidative stress sensitivity
  misc_feature: Functional homolog of the protein sequence given in SEQ ID NO 13710
  misc_feature: Ceres ANNOT ID no. 8659692
  misc_feature (240)..(367): Pfam ID: Cyclin_N Pfam Description: Cyclin, N-terminal domain
  misc_feature (369)..(496): Pfam ID: Cyclin_C Pfam Description: Cyclin, C-terminal domain
MSTIAASRRSSSSSSAAAKRPAISEGAGGPKVAAAQAKKRVALGNITNVAARGGRAVVGGGLGNAAPPTTSAKLNPAVPLKKPSLASARSVSSIRGQAVKSASIKPAPPVSRHGSAIQKHNVPPPKVPTIADVPSHAPALVPCTGLVSPGRSGDFVSIDDTMSTCDSMKSPDFEYIDNQDSSMLASLQRRTNEHLRITEDRDVEENKWKKNAIAPMEIDRICDVDNEYEDPQLCATLASDIYMHLREAETKKRPSTDFMETIQKDINPSMRAILIDWLVEVSEEYRLVPDTLYLTVNYIDRYLSGNEINRQRLQLLGVACMLIAAKYEEICAPQVEEFCYITDNTYFRDEVLDMETSVLKYLKFEMTAPTAKCFLRRFARAAQACDEDPALHLEFLANYIAELSLLEYNLLSYPPSLIAASAIFLARFILQPTKYPWNSTLAHYTQYKPSELSDCVKALHRLCSVGSGTNLPAIREKYSQHKYKFVAKKQCPPQIPTEFFRDATC

SEQ ID NO: 16640 - DNA, 2703 bp, Sorghum bicolor
  misc_feature: Ceres ANNOT ID no. 8659717
  misc_feature: Encodes the peptide sequence at SEQ ID NO 16641
atggagtctcacaatggcgaggctgatgacttgcctccaccacctcctttgaatgctggtgttgaaccacttaaagctgatgaaacaaaggtgccattgaaacataggactctggtccagaggaatggctttggcagaaaggggcagcagataaaactgctaacaaatcacttcaaagtttctctcatgaatgctgcagattatttctatcattactacgtcaacttgaagtatgaagatgatacaccggttgatcgcaaagggtcgggaagaaaagttatagaaaaactgcagcagacttatgctgctgaacttgcaaataaagattttgcatatgatggtgagaagagcctgttcacaatcggtgctcttcctcaagttaaaaatgagttcactgttgttgttgatgatgtttcaactggaaagactcctgcaaatggcagtccaggaaatgacagtcctcctggaagtgacaggaaaaggatcagaaggccttacaatacaaagacgtacaaggtcgaactctcttttgcggcaagaattcctatgagtgcaatctcacaggccctcagaggtcaggaatcagagcacacgcaggaagcaattcgagtgattgacattattctgaggcagcactcagctaagcagggttgcctattagtaaggcaatcattcttccacaataatccttctaactttgttgacctgggtggtggtgtagtgggctgtagagggtttcattctagttttcgtgcaacccagagtggactttcactcaacatcgatgtgtccaccacaatgatagtgaaacctggtcctgtcattgattttctgcttgccaatcagaaagttaatcatccaggcatgattgattgggctaaggccaagcgttcactgaagaacttgaggatcaaaacaagtccagcaaaccaagaacagaagattgttggtctcagcgacagaccttgctgtgagcaattattcacactgaaacataagaatggtaatggagactctgaagagatcactgtttatgattacttcgtaaagaaccgtggcatagagctgcaatactctggtgatcttccatgtatcaatgtgggaaaaccaaagcggccaacatattttccagttgagttatgcagtcttttgcctttacaaaggtacactaaagctttgagcacacttcagaggtcatcacttgttgagaaatctaggcagaaaccacaagaaaggataggtgttttgtctgatgtactgcaaagaagcaactatgatgcagagcccatgctgaaggcctgcgggattacaattgctagaagttttaccgaagttgatggtaggatactgcagccccccaagcttaaagctggcaatggagaagacatttttacacgcaatggtagatggaacttcaacaataagaggctcattaagggtagcagtgttgagaaatgggcagtggtcaacttttctgcacgatgcaatgtcagggatcttgtccgtgatctcatcaagtgtggaggcatgaaggggattatggttgaagctccttttgatgtatttgaggagaatccttcgatgagacggtcgcctgctgtaagaagggttgaagacatgtttgaacaagtcaaaaccaagcttcctggagctccgaagtttcttttgtgtgttctagctgaaagaaagaattctgatatttatgggccttggaagaagaaatgccttgctgaatttgggatcgttacacagtgcgtggcaccaactagagtcaatgatcagtatcttacaaatgtcctactaaagataaatgcaaagctgggtggcatgaattcgttgctccaaattgaaacatccccagcaattcctcaagtatccaaggtcccaactataatcttgggaatggatgtctcccatggttctcctggacattctgatgtaccgtccattgctgctgttgttagttctcgtgaatggcctcttatctcgaaatatagagcttctgtccgcacccaatcacctaagatggaaatgattgactctttgtttaagccacgggaaactgaagatgatggtctgatccgggagtgtctgattgacttctacaccagttctgggaagaagaagcctgaccaagtcatcatcttcagggatggtgttagtgaaagtcagtttaatcaggtgctgaacattgagttgcaacaaatcatcgaggcttgcaagtttttggatgaaaaatggaatccaaagttcacgttgattattgcccagaagaatcaccacactaaattttttattcctggaaagacagaaaatgttccagctggaactgttgtggacaacaaagtttgtcatccaaggaactttgacttctacatgtgttcacatgctggaatgatcgggactacgaggccaactcattatcatatactgcatgatgagataggcttcaatcctgatgatctgcaggagctggtgcattcgctctcttacgtgtaccaaaggagcacaacagccatatcagttgttgctcccatctgctatgcacatctggcagcagctcaggtcggccagttcattaagttcgatgagatgtcggagacatcctccagccatggcggccatacttcggcgggcagcgtccctgtccaggagctacctcgtctacatgagaaagtcaggagctcgatgttcttttgctga

SEQ ID NO: 16641 - protein, 900 aa, Sorghum bicolor
  misc_feature: The sequence is a functional homolog of SEQ ID NO 2 in the 11/375,241 US patent application
  misc_feature: The sequence is a functional homolog of SEQ ID NO 2562 in the 10/374,780 US patent application
  misc_feature: Ceres ANNOT ID no. 8659717
  misc_feature: Down-regulated in shoot tissues in response to salicylic acid treatment
  misc_feature (554)..(861): Pfam ID: Piwi Pfam Description: Piwi domain
  misc_feature (272)..(408): Pfam ID: PAZ Pfam Description: PAZ domain
MESHNGEADDLPPPPPLNAGVEPLKADETKVPLKHRTLVQRNGFGRKGQQIKLLTNHFKVSLMNAADYFYHYYVNLKYEDDTPVDRKGSGRKVIEKLQQTYAAELANKDFAYDGEKSLFTIGALPQVKNEFTVVVDDVSTGKTPANGSPGNDSPPGSDRKRIRRPYNTKTYKVELSFAARIPMSAISQALRGQESEHTQEAIRVIDIILRQHSAKQGCLLVRQSFFHNNPSNFVDLGGGVVGCRGFHSSFRATQSGLSLNIDVSTTMIVKPGPVIDFLLANQKVNHPGMIDWAKAKRSLKNLRIKTSPANQEQKIVGLSDRPCCEQLFTLKHKNGNGDSEEITVYDYFVKNRGIELQYSGDLPCINVGKPKRPTYFPVELCSLLPLQRYTKALSTLQRSSLVEKSRQKPQERIGVLSDVLQRSNYDAEPMLKACGITIARSFTEVDGRILQPPKLKAGNGEDIFTRNGRWNFNNKRLIKGSSVEKWAVVNFSARCNVRDLVRDLIKCGGMKGIMVEAPFDVFEENPSMRRSPAVRRVEDMFEQVKTKLPGAPKFLLCVLAERKNSDIYGPWKKKCLAEFGIVTQCVAPTRVNDQYLTNVLLKINAKLGGMNSLLQIETSPAIPQVSKVPTIILGMDVSHGSPGHSDVPSIAAVVSSREWPLISKYRASVRTQSPKMEMIDSLFKPRETEDDGLIRECLIDFYTSSGKKKPDQVIIFRDGVSESQFNQVLNIELQQIIEACKFLDEKWNPKFTLIIAQKNHHTKFFIPGKTENVPAGTVVDNKVCHPRNFDFYMCSHAGMIGTTRPTHYHILHDEIGFNPDDLQELVHSLSYVYQRSTTAISVVAPICYAHLAAAQVGQFIKFDEMSETSSSHGGHTSAGSVPVQELPRLHEKVRSSMFFC

SEQ ID NO: 16642 - DNA, 297 bp, Sorghum bicolor
  misc_feature: Ceres ANNOT ID no. 8659784
  misc_feature: Down-regulated in shoot tissues in response to salicylic acid treatment
  misc_feature: Encodes the peptide sequence at SEQ ID NO 16643
atgactaatgtacctggaaatggagattgcttggtcgatgtgtacgctaatcaactggaattcgctgatcaccgtctccctgtcgtctggcgtcacaagcaaaaaaaaatttcacgcttgaagaacgcgcacctgagggcgctccccggcgcggcggagaggctggcgctgtgcaaggccgacctgctcgactacgatgcgctgcagtcggccgttgccggctgccacgacgtcttccacaccgcgtcgcctggatccgatccgatacgtatacgtgtaacctatagtagtacttga

SEQ ID NO: 16643 - protein, 98 aa, Sorghum bicolor
  misc_feature: Useful for making plants with altered carbohydrate content
  misc_feature: Functional homolog of the protein sequence given in SEQ ID NO 13817
  misc_feature: Ceres ANNOT ID no. 8659784
  misc_feature (41)..(84): SWISSPROT Homolog: EC 1.1.1.219 Dihydrokaempferol 4-reductase
MTNVPGNGDCLVDVYANQLEFADHRLPVVWRHKQKKISRLKNAHLRALPGAAERLALCKADLLDYDALQSAVAGCHDVFHTASPGSDPIRIRVTYSST

SEQ ID NO: 16644 - DNA, 1311 bp, Sorghum bicolor
  misc_feature: Ceres ANNOT ID no. 8659828
  misc_feature: Encodes the peptide sequence at SEQ ID NO 16645
atgggttttttgggttcagggacgcgaaacggggcagctctaccgatccaatcattgttcccttatctatacttcatgatcagggacttgaaagttgcaaaagaagagcaagacattggattttatgctggttttgtcggggcaacctatttccttggaagaaccataagtgctgtgccatggggcatgtttgctgacaagtatggaaggaagccatgcattgtgattagtatcctctcagtgattattttcaacacactctttggacttagcacaacttattggatggcaattgtaactaggggattgcttggattgctatgtggtatattgggacccatcaaggcctatgcttcagaagtcagtaggaaagaacatcaagctctaggaatctcttttgttacatcatcacgagcgatagctcttgttattgggccatctattggaggctttctttcacagcctgcacaaaagtacccaaaaattatctctgaagagtccatatttggaaggtttccatacttcctcccttgcttcgtcatttcagtgctagcagtaggatcatgtattgcatgcatttggcttccggaaacgctgcactttcatgatgacgacaaagtagaagctattgaagaacttgagtcacaagttggtggttctaaatctacagagaatctgctaaagaactggcaattgatgtcagcaataatcatcttttctatcttttctctccatgacactgcttatcttgagatattttcactctgggctgtgagcagcagaaaatttcagggcctaagctttacatcccaggatgttggtactgtgttcgccttctcagggcttagtgtactggtatatcaacttaccatttatcccttcatttcgaagtttggaccaatcaagacatttcggcctgcagcgatcttgtccattcttctcctcacaacgtatccattcatgtccaatctacatggcctggagctcaaaatacttattaacatggcatcaattctgaagaatgtgtttgctgctactattactattgcgtgcaacattttgcaaaatactgcagtgacacaaaagcagagaggtactgctaatggtatctctgttacagtgatgtcaacgttcaaagctgtagctccagcagcagcaggaattatattttcatgggctcagaagcacctaagcgggctattcttacctggtaaccagattctgttcctcacgcttaacatggtgtcgataattggcctagtgctgacattcaagccatttctctccctgccaactccaatgaggcattaa

SEQ ID NO: 16645 - protein, 436 aa, Sorghum bicolor
  misc_feature: Useful for making plants with modulated flowering time
  misc_feature: Functional homolog of the protein sequence given in SEQ ID NO 12969
  misc_feature: Ceres ANNOT ID no. 8659828
  misc_feature (5)..(383): Pfam ID: MFS_1 Pfam Description: Major Facilitator Superfamily
MGFLGSGTRNGAALPIQSLFPYLYFMIRDLKVAKEEQDIGFYAGFVGATYFLGRTISAVPWGMFADKYGRKPCIVISILSVIIFNTLFGLSTTYWMAIVTRGLLGLLCGILGPIKAYASEVSRKEHQALGISFVTSSRAIALVIGPSIGGFLSQPAQKYPKIISEESIFGRFPYFLPCFVISVLAVGSCIACIWLPETLHFHDDDKVEAIEELESQVGGSKSTENLLKNWQLMSAIIIFSIFSLHDTAYLEIFSLWAVSSRKFQGLSFTSQDVGTVFAFSGLSVLVYQLTIYPFISKFGPIKTFRPAAILSILLLTTYPFMSNLHGLELKILINMASILKNVFAATITIACNILQNTAVTQKQRGTANGISVTVMSTFKAVAPAAAGIIFSWAQKHLSGLFLPGNQILFLTLNMVSIIGLVLTFKPFLSLPTPMRH

SEQ ID NO: 16646 - DNA, 1341 bp, Sorghum bicolor
  misc_feature: Ceres ANNOT ID no. 8659793
  misc_feature: Encodes the peptide sequence at SEQ ID NO 16647
atggacggcggcggcgagagtggtttggcggcggcggcgtcgtccgccgccccgttgctggcgccggaggcgaggaggaggcaggagaggaaggtgcaggccagtgacgggatcccatacgcggacttcctctacatttggatcgcctgcctctgtgcctctctgccgatccagtcgttgttcccttatctatacttcatgatcagggacttgaaagtggcaaaagaagagcaagacattggattttatgctggttttgttggggctacctatttccttggaagaaccatcagtgccgtgccatggggcatgtttgctgacaagtatggaaggaagccatgcattgtgatcagcattctctcagtgattgtgttcaacacactttttggacttagcacaacttactggatggcaattgtaactaggggattacttgggttgctatgtggtatactaggacccatcaaggttacatcttcacgagcgatagctcttgttattgggccagctattggaggatttcttgcacagcctgcacaaaagtacccaaatcttttctccgaagactctatatttgggaggtttccatacttcctcccttgctttgtaatatcattgctagcagcaggatcatgtattgcatgcatttggcttccggaaacactacactttcatgatgatgacaaagcagaatctattgaagaactggaggcacaagttcgtggctccgaatctacaaaaaatctgctaaagaattggcaattgatgtcagcaataatcctctattgtgtcttttctctacatgacacagcttatctcgagatattttcactttgggctgtaagcagtagaaaatttcagggccttagtttgacatcccaggatgttggcactgtgctagccttctcaggttttggtgtactcgtataccaacttgctatttatcctttccttgcgaagtatgttggaccaatcaagacatttcggcctgccgcgatcttgtcaatcattctcctcagtatgtatcccttcatggccaatctacatggcatggagctcaaaatacttatcaccatggcatctgttttgaagaacatgtttgctacacaagagcagagaggtgttgctaatggcatctctgttactctgatgtcaatgttcaaagctgtagctccagccgcagcaggaattctgttttcatgggctcagaagcacataagcggactgttcttaccaggaaatcagatcttgtttctaatgctaaacatggtgtcagtaattggtctagtgctgacgttcaagccatttttctccctaccaaattcaacgaggcattcataa

SEQ ID NO: 16647 - protein, 446 aa, Sorghum bicolor
  misc_feature: Useful for making plants with modulated flowering time
  misc_feature: Functional homolog of the protein sequence given in SEQ ID NO 12969
  misc_feature: Ceres ANNOT ID no. 8659793
  misc_feature (46)..(412): Pfam ID: MFS_1 Pfam Description: Major Facilitator Superfamily
MDGGGESGLAAAASSAAPLLAPEARRRQERKVQASDGIPYADFLYIWIACLCASLPIQSLFPYLYFMIRDLKVAKEEQDIGFYAGFVGATYFLGRTISAVPWGMFADKYGRKPCIVISILSVIVFNTLFGLSTTYWMAIVTRGLLGLLCGILGPIKVTSSRAIALVIGPAIGGFLAQPAQKYPNLFSEDSIFGRFPYFLPCFVISLLAAGSCIACIWLPETLHFHDDDKAESIEELEAQVRGSESTKNLLKNWQLMSAIILYCVFSLHDTAYLEIFSLWAVSSRKFQGLSLTSQDVGTVLAFSGFGVLVYQLAIYPFLAKYVGPIKTFRPAAILSIILLSMYPFMANLHGMELKILITMASVLKNMFATQEQRGVANGISVTLMSMFKAVAPAAAGILFSWAQKHISGLFLPGNQILFLMLNMVSVIGLVLTFKPFFSLPNSTRHS

SEQ ID NO: 16648 - DNA, 1341 bp, Sorghum bicolor
  misc_feature: Ceres ANNOT ID no. 8659852
  misc_feature: Encodes the peptide sequence at SEQ ID NO 16649
atgagggagatcctccacatccagggcggccagtgcgggaaccagatcggttccaagttctgggaggttgtctgcgacgagcatggtatcgaccccaccggacgctacgtcggcacctccgacctccagctcgagcgcgtcaacgtctactacaacgaggcctcatgcggccgcttcgtgccgcgcgccgtgctcatggacctcgagcccggcaccatggacagcgtccgcaccggcccgtacggacagatcttccgccccgacaacttcgtcttcggccagtctggcgcggggaacaactgggccaagggccactacaccgagggcgctgagctcatcgactccgtgcttgacgtcgtgaggaaagaggctgagaactgcgactgcctgcaaggcttccaagtttgccactcccttggaggaggcactggatctggaatgggcacccttctcatctcaaagatcagggaggagtaccctgatcggatgatgctcaccttttctgtgttcccctcacccaaggtgtcggacactgttgtggagccatacaatgccacactgtctgttcatcagttggttgagaatgctgatgaatgcatggttctggacaacgaggcgctttatgacatttgcttccgaactctgaagcttacaacacctagctttggagacttgaatcacttgatcagtgcaacaatgagcggagtcacttgctgcctgcgcttcccaggacagctgaactctgacctgcgcaagcttgcagtcaacctgatcccattccctcgcctgcacttcttcatggttggctttgcgccactcacctcgcgtggctcgcagcagtaccgtgctctcaccgtccctgagctaacccagcagatgtgggatgccaagaacatgatgtgcgccgctgacccgcgccatggccgctatctcacagcctctgccatgttccgtggcaagatgagcaccaaggaggtggacgagcagatgatcaatgtgcagaacaagaactcgtcctacttcgtcgagtggatccccaacaacgtcaagtccagtgtctgcgacatcccgccgcgtggcctttccatggcctccaccttcattggcaactccacctccatccaggagatgttccgccgtgtgagcgagcagttcactgctatgttcaggaggaaggctttcttgcattggtacactggtgagggcatggatgagatggagttcaccgaggctgagagcaacatgaatgatctggtgtccgagtaccagcagtaccaggatgccactgccgatgaggaggcagagtacgaggacgaggaggatggcatccaagacgagtaa

SEQ ID NO: 16649 - protein, 446 aa, Sorghum bicolor
  misc_feature: Useful for making plants with modulated flowering time
  misc_feature: Functional homolog of the protein sequence given in SEQ ID NO 14090
  misc_feature: Ceres ANNOT ID no. 8659852
  misc_feature: Down-regulated in shoot tissues in response to methyl jasmonate treatment
  misc_feature: Down-regulated in root tissues in response to aminocyclopropane carboxylic treatment
  misc_feature: Down-regulated in root tissues in response to methyl jasmonate treatment
  misc_feature: Down-regulated in shoot tissues in response to salicylic acid treatment
  misc_feature (45)..(244): Pfam ID: Tubulin Pfam Description: Tubulin/FtsZ family, GTPase domain
  misc_feature (246)..(383): Pfam ID: Tubulin_C Pfam Description: Tubulin/FtsZ family, C-terminal domain
MREILHIQGGQCGNQIGSKFWEVVCDEHGIDPTGRYVGTSDLQLERVNVYYNEASCGRFVPRAVLMDLEPGTMDSVRTGPYGQIFRPDNFVFGQSGAGNNWAKGHYTEGAELIDSVLDVVRKEAENCDCLQGFQVCHSLGGGTGSGMGTLLISKIREEYPDRMMLTFSVFPSPKVSDTVVEPYNATLSVHQLVENADECMVLDNEALYDICFRTLKLTTPSFGDLNHLISATMSGVTCCLRFPGQLNSDLRKLAVNLIPFPRLHFFMVGFAPLTSRGSQQYRALTVPELTQQMWDAKNMMCAADPRHGRYLTASAMFRGKMSTKEVDEQMINVQNKNSSYFVEWIPNNVKSSVCDIPPRGLSMASTFIGNSTSIQEMFRRVSEQFTAMFRRKAFLHWYTGEGMDEMEFTEAESNMNDLVSEYQQYQDATADEEAEYEDEEDGIQDE

SEQ ID NO: 16650 - DNA, 423 bp, Sorghum bicolor
  misc_feature: Ceres ANNOT ID no. 8659829
  misc_feature: Down-regulated in shoot tissues in response to methyl jasmonate treatment
  misc_feature: Down-regulated in root tissues in response to aminocyclopropane carboxylic treatment
  misc_feature: Down-regulated in root tissues in response to methyl jasmonate treatment
  misc_feature: Down-regulated in shoot tissues in response to salicylic acid treatment
  misc_feature: Encodes the peptide sequence at SEQ ID NO 16651
atgccgccagcgccgcccgagactgttgttcccggtgcggcggcggcgaggaagcggttccgcaccaaattcagcccggagcaaaagcagcggatgcaggcgctgtcggagcggctgggctggcggctgcagaagcgcggcgaggccctggtcgacgagtgctgccaggagatgggcgtcttcaaggtctggatgcacaacaacaagcacaacttcgtcggcggccacaatgcgtgccgcagcgcctctgcctctgccgccgccgcggcggccatccaccaccatccgtccaaccatggacctggatgggagcttgggctcctgcgtgtgcgcgtgcgcaggcgccgcctccgcctcctcccgctcccgcgcggcgcggccactgatggttacggcggcgagcaggcggggcgtcgtggatag

SEQ ID NO: 16651 - protein, 140 aa, Sorghum bicolor
  misc_feature: The sequence is a functional homolog of SEQ ID NO 48 in the 10/714,887 US patent application
  misc_feature: The sequence is a functional homolog of SEQ ID NO 48 in the 11/435,388 US patent application
  misc_feature: Ceres ANNOT ID no. 8659829
MPPAPPETVVPGAAAARKRFRTKFSPEQKQRMQALSERLGWRLQKRGEALVDECCQEMGVFKVWMHNNKHNFVGGHNACRSASASAAAAAAIHHHPSNHGPGWELGLLRVRVRRRRLRLLPLPRGAATDGYGGEQAGRRG

SEQ ID NO: 16652 - DNA, 987 bp, Sorghum bicolor
  misc_feature: Ceres ANNOT ID no. 8659864
  misc_feature: Encodes the peptide sequence at SEQ ID NO 16653
atggccacagcggccggcaagccgctggtgtgcgtgaccggagctggaggcttcattgggtcgtcgctcgtcaaagagctgctccagcgtggctaccgcgtgaggggcaccgcaaggaacccagaccgcaagaatgcccatctgcatgcactggacggagccaaagaacgcctctctctgtgccgtgctgatgtgttggactacaagtcgctcgttgcggcatttaggctttgtgagggcgtcttccatgtcgcttgcccggtttcaaacaatgaccctgaactcatggctgctgctattgagggaacgaagaatgccatcaacgctgctgcagatatgggagtgcaacgcgtggtgtacacttcatcctatggtgctgtccatatgaacccaaaaaggagtcctgatgaggttgtggatgagagttgctggagcgatcttgaattctgcctaaagacaaagaacttttactgcttcgcgaagacggttgctgagaaaacagccatggaggaggcatccaagagagggatacacctggtggtggtcgtgccggcgttcacgctaggtgaaacgctgcagccggggctgcacctggcgatgtacatgctcattgtctcctacgtgaagggcaccaggaagacgtacccgaacgctgtctccgggtttgtcgatgtgcaggatgttgcgcgtgcccatgtgttggtgtatgaaacccctactgcacatggacgctacctctgcattggcgaagtggtgcaccagtcggagtttattcaaatgatgatagagctcttcccacagtatcagatcaccgctaagtgtaaggatgaaaatgcaccaaaggtcaaaccgtacaagttctctacaaaaaggctacaggatctgggcatgaagttcactcctctaaaaaaaagtttacacaagacagtgatatgcctacaagaacaaggtcatatcccaaagctcccccacaaatcggccttgtga

SEQ ID NO: 16653 - protein, 328 aa, Sorghum bicolor
  misc_feature: Useful for making plants with altered carbohydrate content
  misc_feature: Functional homolog of the protein sequence given in SEQ ID NO 13817
  misc_feature: Useful for making plants with altered cell wall content and/or composition
  misc_feature: Useful for making plants with altered lignin content
  misc_feature: Functional homolog of the protein sequence given in SEQ ID NO 13818
  misc_feature: Ceres ANNOT ID no. 8659864
  misc_feature (8)..(320): SWISSPROT Homolog: EC 1.1.1.219 Dihydrokaempferol 4-reductase
  misc_feature (10)..(249): Pfam ID: Epimerase Pfam Description: NAD dependent epimerase/dehydratase family
MATAAGKPLVCVTGAGGFIGSSLVKELLQRGYRVRGTARNPDRKNAHLHALDGAKERLSLCRADVLDYKSLVAAFRLCEGVFHVACPVSNNDPELMAAAIEGTKNAINAAADMGVQRVVYTSSYGAVHMNPKRSPDEVVDESCWSDLEFCLKTKNFYCFAKTVAEKTAMEEASKRGIHLVVVVPAFTLGETLQPGLHLAMYMLIVSYVKGTRKTYPNAVSGFVDVQDVARAHVLVYETPTAHGRYLCIGEVVHQSEFIQMMIELFPQYQITAKCKDENAPKVKPYKFSTKRLQDLGMKFTPLKKSLHKTVICLQEQGHIPKLPHKSAL

SEQ ID NO: 16654 - DNA, 660 bp, Sorghum bicolor
  misc_feature: Ceres ANNOT ID no. 8659865
  misc_feature: Encodes the peptide sequence at SEQ ID NO 16655
atggccaggatccacctctacctcgccgcggcctgcgccgtcgccctcgcgctcgccgccccggccctcgccggcgaccccgacatgctccaggacgtctgcgtcgctgactacgcctccccggtcaagctgaatgggttcccgtgcaaggcggacatctcggcggacgacttcttcttctccgggctgaggaaccccggcaacaccagcaacgcggcgggctccctggtgacggcggccaacgtggagaagttcccgggcgtgaacacgctgggcgtctccatcgcgcgcatcgactacgcccccggcggccagaacccgccgcacacgcacccgcgcgccaccgagatcatcttcgtcctcgagggcacgctcgaggtcggcttcatcaccaccgccaacaagctcttcagcaagaccctcatcaagggggacgtcttcgtcttcccgcgcggcctcgtccacttccagcagaacagagggtacggccccgccgccgtcgtcgccgccttcaacagccagctccagggcacgcagcaaatcgccatgacgctcttcggcgccacgccgccagtgcccaccgacatcctcgccaaggcattccggatcggcaacggcgaggtcgagcacatcaaggcaaacttcgcgcccaagaagtag

SEQ ID NO: 16655 - protein, 219 aa, Sorghum bicolor
  misc_feature: Useful for making plants with modulated nitrogen use efficiency
  misc_feature: Functional homolog of the protein sequence given in SEQ ID NO 14277
  misc_feature: Ceres ANNOT ID no. 8659865
  misc_feature (26)..(219): SWISSPROT Homolog: EC 1.15.1.1 Superoxide dismutase
  misc_feature (61)..(209): Pfam ID: Cupin_1 Pfam Description: Cupin
  misc_feature (96)..(171): Pfam ID: Cupin_2 Pfam Description: Cupin domain
MARIHLYLAAACAVALALAAPALAGDPDMLQDVCVADYASPVKLNGFPCKADISADDFFFSGLRNPGNTSNAAGSLVTAANVEKFPGVNTLGVSIARIDYAPGGQNPPHTHPRATEIIFVLEGTLEVGFITTANKLFSKTLIKGDVFVFPRGLVHFQQNRGYGPAAVVAAFNSQLQGTQQIAMTLFGATPPVPTDILAKAFRIGNGEVEHIKANFAPKK

SEQ ID NO: 16656 - DNA, 870 bp, Sorghum bicolor
  misc_feature: Ceres ANNOT ID no. 8659915
  misc_feature: Encodes the peptide sequence at SEQ ID NO 16657
atggcgtatccttgcgccgtgcacggcgccttgtggatcgccgtggtcgctttccttgttgcttccggcagcgtcgtcgtcatccgagtagcggaggcgaggtacggccctggccactggaaccctgccgcccctgcccctgtggcgaccctcgtcagcgagcagctgtacaactccctgttcctgcacaaggacgacgccgcctgccccgccaagggcttctacacctacgcctccttcatccaggccgccaggacgttccccaagttcgccgccacgggcgacctgagcacccgcaagcgcgaggtcgcggccttcttcgcgcaaatctctcacgagaccacaggcggctgggcgacggcgccggacgggcagtacgcgtggggcctgtgctacaaggaggagatcagcccggcgagcagctactgcgacgcgacggacaagcagtggccgtgctacccgggcaagtcctaccacggccggggccccatccagctgtcgtggaacttcaactacgggccggcggggcaggcgctgggcttcgacggcctgcgcaacccggaggtggtggccaactgctccgagaccgcgttccggacggcgctgtggttctggatgacgccgcgccggcccaagccgtcgtgccacgaggtcatggtcggcgagtaccgccccacggccgccgacgccgcggccaaccggacggcagggttcgggctcgtcaccaacatcgtcaacggcgggctcgagtgcaatcgcaccgacgatgcccgggtcaacaatcggattggcttctaccagaggtactgccagatcttcaacgtcgacgccggcgccaacctcgactgcgctcaccagcagccgtactag

SEQ ID NO: 16657 - protein, 289 aa, Sorghum bicolor
  misc_feature: Useful for biocontainment applications
  misc_feature: Useful for making plants with modulated biomass
  misc_feature: Functional homolog of the protein sequence given in SEQ ID NO 13042
  misc_feature: Ceres ANNOT ID no. 8659915
  misc_feature (37)..(289): SWISSPROT Homolog: EC 3.2.1.14 Chitinase
  misc_feature (51)..(283): Pfam ID: Glyco_hydro_19 Pfam Description: Chitinase class I
MAYPCAVHGALWIAVVAFLVASGSVVVIRVAEARYGPGHWNPAAPAPVATLVSEQLYNSLFLHKDDAACPAKGFYTYASFIQAARTFPKFAATGDLSTRKREVAAFFAQISHETTGGWATAPDGQYAWGLCYKEEISPASSYCDATDKQWPCYPGKSYHGRGPIQLSWNFNYGPAGQALGFDGLRNPEVVANCSETAFRTALWFWMTPRRPKPSCHEVMVGEYRPTAADAAANRTAGFGLVTNIVNGGLECNRTDDARVNNRIGFYQRYCQIFNVDAGANLDCAHQQPY

SEQ ID NO: 16658 - DNA, 1386 bp, Sorghum bicolor
  misc_feature: Ceres ANNOT ID no. 8659949
  misc_feature: Encodes the peptide sequence at SEQ ID NO 16659
atggcctcggctccgcacggcgacgctgccgaggtcaggaacgccgcgccgccggcaaagcgcgccagcgcaccgatcacggaagccgatatccgcgccgagttcgcccaccacgacggcagcgtggcccgcgtcaacaacggcaccttcgggtgctgcccggcctcggtcctcgcggcgcgggcgcggtggcagcggctgttcctctcgcagcccgacgcgttctacttcgactccctgcagccggggctcgcccgctcgcgtgccgcggtagcggctgccgtcggggcgtgtgacgcctccgaggtctccctcgtcgacaacgctaccacggcggcggccatcatcatgcagcacgtggcctggagcttcgcggagggcgtcttcgcgcgcggcgacgtggtgctgatgctccactacacctacagctccgtcaagaactccatccacgcgtacgtggtccgcgcgggggccaccgtcgtcgaggtgccgctcccgttccccgtcgcctcgccgggcgccgtcgtcgccgagttccgcaccgcgctcgcgctcgccaaggccgggggccgcagcgtccgcctcgccgtcatcgaccacatcacctccatgcccagcgtcctcctccccgtgaaggagctcgtcgccatctgccgcgaggagggcgtggacaaggtcttcgtcgacggcgcgcacgccatcggccaggtgcccatcgacgtgcgcgacatcggcgccgacttctacaccagcaacctccacaagtggttcttctgcccttccgccgtggcgttcctgcacatccgcaaggatgaccccgtagccaagcagctccaccaccccgtcgtgtctagcgagtacggcaacgggctgcccatggagagcgcctggattggggtgcgggattacagtgcccagctcgttgtgcctgatgccgttgacttcatgagccggttcgagggcggcgtcgaggcgataagcagacggaaccatgacaaggtgatcgagatgggcacgatgctcgccgaggcatgggggacgtttcttggctcgccgccggaaatgtgcggaagcatggctatggtcgggctgcctggttgccttgccattgagagcggtggtgatgcgatgagagtaagggacatgctgaggaacgaattcaaggtcgaggtgccaatattccacaactcaagaagtgttgaagaaggtcaagagttggccaaggatgccaagggcgatcaagtcagtgggtatgtgagaatttcacatcaggtttacaatgtcagggaggagtatgagaccctgagagatgctgtccataagcttgttcttgatggtttctcctgcagcaagatgagaccttctgggaaggctctctctaactga

SEQ ID NO: 16659 - protein, 461 aa, Sorghum bicolor
  misc_feature: Useful for making plants with modulated nitrogen use efficiency
  misc_feature: Functional homolog of the protein sequence given in SEQ ID NO 14409
  misc_feature: Ceres ANNOT ID no. 8659949
  misc_feature (39)..(442): SWISSPROT Homolog: EC 5.1.1.17 Isopenicillin-N epimerase
  misc_feature (54)..(435): Pfam ID: Aminotran_5 Pfam Description: Aminotransferase class-V
MASAPHGDAAEVRNAAPPAKRASAPITEADIRAEFAHHDGSVARVNNGTFGCCPASVLAARARWQRLFLSQPDAFYFDSLQPGLARSRAAVAAAVGACDASEVSLVDNATTAAAIIMQHVAWSFAEGVFARGDVVLMLHYTYSSVKNSIHAYVVRAGATVVEVPLPFPVASPGAVVAEFRTALALAKAGGRSVRLAVIDHITSMPSVLLPVKELVAICREEGVDKVFVDGAHAIGQVPIDVRDIGADFYTSNLHKWFFCPSAVAFLHIRKDDPVAKQLHHPVVSSEYGNGLPMESAWIGVRDYSAQLVVPDAVDFMSRFEGGVEAISRRNHDKVIEMGTMLAEAWGTFLGSPPEMCGSMAMVGLPGCLAIESGGDAMRVRDMLRNEFKVEVPIFHNSRSVEEGQELAKDAKGDQVSGYVRISHQVYNVREEYETLRDAVHKLVLDGFSCSKMRPSGKALSN

SEQ ID NO: 16660 - DNA, 2514 bp, Sorghum bicolor
  misc_feature: Ceres ANNOT ID no. 8659975
  misc_feature: Encodes the peptide sequence at SEQ ID NO 16661
atggaagctagtttcctgtggaaagagagcggcgaccaagccagtgcggcgagaatgaccggtgggaacaagaacaagagcctcaactgggatttgaacgactggaggtgggacgccaacctgttcctggccacaccggcggccgccgccgcgccgtccgagtgcagcatcagggagctgagccgagctcagggggagatcgatttcggcgtcgtcgttgacaagaggcggcgcctgtcgccagaggaggacggcagcgccggctgcagcaattctgcggtagcagatggagacaacaatcacgtggtgtctgttcagagagcgcggagcagtgaggaggaggaggaggagaggcccaggaaaggtgccagttcgagcaccactccgtcttgccaggttgacggctgccacgccgatctcagcggtgccagggactaccataagaggcacaaggtgtgtgaagcgcataccaggacgactgtggtctgcatcaagaatgtagagcatcggttctgtcagcagtgcagcaggtttcaccttcttcaagaatttgatgaagggaagaagagctgccgctcacgtctagcaaaacataatggaaggagaaggaaagttcaaccacaagctgctgtgaatgggaattccatgaatgaaaatcaatccctaagtagcgccttattccttctgttaaaacaactttccgggctagagtctggtagctcttctgagcaaatcaatcatcctaattctttggttaacattttgaagaaccttactgctattgctagcacacagtcatatcaagatattctaaagaatgcaaattcaaattcaataccgtcaaatgctgctaataatgctgcaaatggttctatcatgcatgagcaaactatacggtcaactcctatcgggagggaatcattagcagaagagcctccagtgaaaaggcgagtacaggattttgatttgaatgatgcttgcattgaagaagctgagagccgaacagataaaattgtgttcaagctctttggaaaagagccgaaagattttcctgtagatctacgggaacagatccaaaactggttgtcacattatccaactgatatggaaagctatattaggcctggctgtgttattctaactatttaccttcgcctccctaattggatgtgggatgagcttgatgatgatccagcttcttggatagaaaagcttattagcttatccaatgatggattttggagaaaaggatggttgtatgctagggtagtcttatgtttgcatctccctggcaaccgattactttgtgtgtttggtgaaaactatttaattcaagaagagacacaaatgctacttgaagattcaactatgcagcaaggccctcaatgcctaaccttctcatgttcctttccttgtacaagtggaagaggattcatagaggttgaagattatgatcaaagcagcctttctgttccctttgttgtcaccgacaatgatgtatgttctgaaattcggacgttggagcatggattgaatttaatttcatttgatgaaaccccggaaagaatagatgatcttatggcttatcgcagtcggtcgttacattttttgcatgaaatcggctggctccttcaaaggagccacgtgcgagctacatctgagcagccacagtattgtccagaccgtttccctgttgcaagatttaaatggctgttatcctttgcaattgatcatgaatggtgtgctgttgtaaggaagcttctgaacaccatgttccagggtgatattgatctagatgtgccatcaccagttgaatttgccttgggagaaaatctgttgcttactgctgtcaaaaaatgctcaaagcctttagttgaatgtctattaagatacacaacaacaaattatgctccagtgggcagtggagacggtgctccagttcagttcttgttcactcctgcgatgactggactgtcaaatattacacctcttcatattgcagccacaatcagtgatgctactggtgttttagatgctttaactgatgatcctcagcagttgggaatcaaagcgtggaagaatgctcgtgatgccactggcttcactcctgaggaatatgctcgacagagaggccacgtatcctatattcaaatggtacaggacaaaattgacagaaggatgagcagagatcatgtcttggttaccatccccaccacaattgatgctgtcggaaagcatgctagcggattgaagtctgccgatcaaatcacatttggtgtggagaaacaactaaacatcaacgaaacatcgagctgcagacaatgtgtccagcaggttcagcagtttgcattccaaccccgtacaaataggtttttgtctaataggcctgcgatgctttccttggtcgccattgctgccgtctgtgtctgtgtaggattgctcatgaagagcccgccacaagttgcttgtatgaggcctttcctctgggacaatgtacgttggggccccaattga

SEQ ID NO: 16661 - protein, 837 aa, Sorghum bicolor
  misc_feature: Useful for making plants with altered terpenoid content
  misc_feature: Useful for making plants with modulated flowering time
  misc_feature: Functional homolog of the protein sequence given in SEQ ID NO 13706
  misc_feature: The sequence is a functional homolog of SEQ ID NO 1120 in the 10/225,066 US patent application
  misc_feature: The sequence is a functional homolog of SEQ ID NO 1912 in the 10/412,699 US patent application
  misc_feature: The sequence is a functional homolog of SEQ ID NO 432 in the 10/374,780 US patent application
  misc_feature: The sequence is a functional homolog of SEQ ID NO 958 in the 10/412,699 US patent application
  misc_feature: Ceres ANNOT ID no. 8659975
  misc_feature (130)..(208): Pfam ID: SBP Pfam Description: SBP domain
MEASFLWKESGDQASAARMTGGNKNKSLNWDLNDWRWDANLFLATPAAAAAPSECSIRELSRAQGEIDFGVVVDKRRRLSPEEDGSAGCSNSAVADGDNNHVVSVQRARSSEEEEEERPRKGASSSTTPSCQVDGCHADLSGARDYHKRHKVCEAHTRTTVVCIKNVEHRFCQQCSRFHLLQEFDEGKKSCRSRLAKHNGRRRKVQPQAAVNGNSMNENQSLSSALFLLLKQLSGLESGSSSEQINHPNSLVNILKNLTAIASTQSYQDILKNANSNSIPSNAANNAANGSIMHEQTIRSTPIGRESLAEEPPVKRRVQDFDLNDACIEEAESRTDKIVFKLFGKEPKDFPVDLREQIQNWLSHYPTDMESYIRPGCVILTIYLRLPNWMWDELDDDPASWIEKLISLSNDGFWRKGWLYARVVLCLHLPGNRLLCVFGENYLIQEETQMLLEDSTMQQGPQCLTFSCSFPCTSGRGFIEVEDYDQSSLSVPFVVTDNDVCSEIRTLEHGLNLISFDETPERIDDLMAYRSRSLHFLHEIGWLLQRSHVRATSEQPQYCPDRFPVARFKWLLSFAIDHEWCAVVRKLLNTMFQGDIDLDVPSPVEFALGENLLLTAVKKCSKPLVECLLRYTTTNYAPVGSGDGAPVQFLFTPAMTGLSNITPLHIAATISDATGVLDALTDDPQQLGIKAWKNARDATGFTPEEYARQRGHVSYIQMVQDKIDRRMSRDHVLVTIPTTIDAVGKHASGLKSADQITFGVEKQLNINETSSCRQCVQQVQQFAFQPRTNRFLSNRPAMLSLVAIAAVCVCVGLLMKSPPQVACMRPFLWDNVRWGPN

SEQ ID NO: 16662 - DNA, 1737 bp, Sorghum bicolor
  misc_feature: Ceres ANNOT ID no. 8659947
  misc_feature: Encodes the peptide sequence at SEQ ID NO 16663
atgtcgtcgtggtgccgcggttgcaggcgtggtctcttgctttccacggcctttcgaccgtttggcagtcgatgggccgtgggacccgtcgccgcgcccgtccacgcagcagacgacgcaggcgaacggctgacgaacccgggcggcccaagtccggcccgtcgcggaccgcctcgagtggcgtctccaatccatcctcaacaacacacacgcgcacactactgtctctctcctatcactcccaattctccctctctctcttccccatccgggccagccaaccctagcgcggcggcgatggcgtcggacccggcccctgacgacgcggccgcggcagagaacggccacggcaacgacaacggccacggcaacggcaacggcaacggcaacggcaacggcccgtccccgaagcgggcccggtcggtgatctcggcggacgagatccgcaccgagttcgcgcaccacgacgccgccgtggcgcgcgtcaacaacggcagcttcggctgctgcccggcctcggtcctcgccgcgcaggcccactggcagggcctcttcctcgcgcagcccgacgccttctacttccacggcctccagcagggcctcctccgctcgcgcgccgccgtcgccgaggcggtgggcgccggcgacgtctccgaggtctccctcgtcgacaacgccaccacggctgccgccatcgtcctgcagcacgcggcctggagcttcgccgagggccgcttcgcgagcggggatgccgtgctcatgctccactacgcctacggtgcggtcaagaagtccatccacgcctatgtcgcgcgcgcgggggccaccgtcgtcgaggtgcccctcccgttccctgtcgcgtcggccgacgcgattatcgccgagttccgtgctgcgctcgcggtcgccaaggaaggggggcgtagggtccggctcgcagtcatcgaccacatcacctccatgcccagtgtcgtcatccccgtgaaggagctcgtcgccatctgccgagaagagggcgttgacaaggtattcgttgacgctgcacattctattgggcaggtgcctgtggacgtgcgtgacattggagctgatttctacacaagcaaccttcataagtggttcttttgcccacctgccgtggcatttttgcatactcgcaaggacccgatagcttcccagctccatcaccctgttgtctcgcatgagtatgggaatgggctgcctatggagagcggatggattggaacgagggattacagtgcccagcttgttgtgtctgaggccatagattttgtgaatcggtttgagggtggaatcgaggggatacgaagccggaatcatgagaaagttattgagatgggtatgatgcttgctgaggcttggggcacttttcttggcacacctccggaactgtgtggtagcatggttatggtcgggatgcctggttgccttggtgtcgagagtgatgatgatgcattgagagtgagaactatgttgaggaaggatttccaggtggaggttccaatatactacaactcaagaagggtggaaggacaggagatggcaaaggataggaatggtgatccagtgacaggttatgtgaggatatcacaccaggtttacaatgtcaccaaggactatgagagactcagagatgctgtcaataaacttgtttctgaagggttcaccagcatcaacttgcggccttctgagaaggtacacactctgctgaaatga

SEQ ID NO: 16663 - protein, 578 aa, Sorghum bicolor
  misc_feature: Useful for making plants with modulated nitrogen use efficiency
  misc_feature: Functional homolog of the protein sequence given in SEQ ID NO 14409
  misc_feature: Ceres ANNOT ID no. 8659947
  misc_feature (156)..(560): SWISSPROT Homolog: EC 5.1.1.17 Isopenicillin-N epimerase
  misc_feature (162)..(550): Pfam ID: Aminotran_5 Pfam Description: Aminotransferase class-V
MSSWCRGCRRGLLLSTAFRPFGSRWAVGPVAAPVHAADDAGERLTNPGGPSPARRGPPRVASPIHPQQHTRAHYCLSPITPNSPSLSSPSGPANPSAAAMASDPAPDDAAAAENGHGNDNGHGNGNGNGNGNGPSPKRARSVISADEIRTEFAHHDAAVARVNNGSFGCCPASVLAAQAHWQGLFLAQPDAFYFHGLQQGLLRSRAAVAEAVGAGDVSEVSLVDNATTAAAIVLQHAAWSFAEGRFASGDAVLMLHYAYGAVKKSIHAYVARAGATVVEVPLPFPVASADAIIAEFRAALAVAKEGGRRVRLAVIDHITSMPSVVIPVKELVAICREEGVDKVFVDAAHSIGQVPVDVRDIGADFYTSNLHKWFFCPPAVAFLHTRKDPIASQLHHPVVSHEYGNGLPMESGWIGTRDYSAQLVVSEAIDFVNRFEGGIEGIRSRNHEKVIEMGMMLAEAWGTFLGTPPELCGSMVMVGMPGCLGVESDDDALRVRTMLRKDFQVEVPIYYNSRRVEGQEMAKDRNGDPVTGYVRISHQVYNVTKDYERLRDAVNKLVSEGFTSINLRPSEKVHTLLK

SEQ ID NO: 16664 - DNA, 1191 bp, Sorghum bicolor
  misc_feature: Ceres ANNOT ID no. 8659976
  misc_feature: Encodes the peptide sequence at SEQ ID NO 16665
atggctgaacttgacacgttccttttcacatctgagtccgtcaatgaaggccatcctgataagctctgtgaccagatatctgatgcagtgcttgatgcatgcctcgctgaagaccctgacagcaaggttgcttgtgagacctgcaccaagactaacatggtcatggtctttggtgagatcactaccaaagccaatgtcgactatgagaagattgtcagggatacctgccgtgggattggctttgtgtccaatgatgtagggctggatgctgaccactgcaaggtgcttgtcaacattgaacagcagtcacctgatattgcacagggtgttcatggtcacttcaccaagcgtcctgaggagattggtgctggtgaccaggggcacatgtttggatatgcaactgacgagacccctgaaatgatgcccctgagccatgttcttgcaaccaagcttggtgctcgcctaaccgaggtccgcaagaatgggacctgcccatggctgaggcctgatgggaagacccaggtgactgttgagtaccataacgacaatggtgctatggtccctattcgtgtccacactgtgctcatctctacccagcatgacgagactgttaccaatgacgaaattgctgctgatctgaaggaacacgtcattaagcctgtcattccagagcagtaccttgatgagaagaccattttccatctcaatccatcaggtcgctttgtcattggtggacctcatggtgatgcgggtcttactggcaggaagatcatcattgacacttatggaggctggggtgcccacggtggtggcgctttctctggtaaggacccaaccaaggttgaccgcagtggagcctatattgcaaggcaggcggcaaagagcattgtggccagtggtcttgcccgccgttgcattgtccaggtgtcatatgccattggtgtgcctgaaccgctatcagtgtttgttgacacatatgggacaggcaagatccctgacaaggagatcctgaagattgtgctggagaactttgacttaaggccagggatgatcatcatcgaccttgacctgaagagaggcgggaatggccgttatctcaagacggcggcatatgggcactttggcagggatgatccggacttcacctgggagcttgtgaagcccctcaagtgggagaatccttctgcctga

SEQ ID NO: 16665 - protein, 396 aa, Sorghum bicolor
  misc_feature: Useful for making plants with modulated biomass
  misc_feature: Functional homolog of the protein sequence given in SEQ ID NO 14410
  misc_feature: Ceres ANNOT ID no. 8659976
  misc_feature (1)..(396): SWISSPROT Homolog: EC 2.5.1.6 Methionine adenosyltransferase
  misc_feature (119)..(241): Pfam ID: S-AdoMet_synt_M Pfam Description: S-adenosylmethionine synthetase, central domain
  misc_feature (243)..(385): Pfam ID: S-AdoMet_synt_C Pfam Description: S-adenosylmethionine synthetase, C-terminal domain
  misc_feature (5)..(104): Pfam ID: S-AdoMet_synt_N Pfam Description: S-adenosylmethionine synthetase, N-terminal domain
MAELDTFLFTSESVNEGHPDKLCDQISDAVLDACLAEDPDSKVACETCTKTNMVMVFGEITTKANVDYEKIVRDTCRGIGFVSNDVGLDADHCKVLVNIEQQSPDIAQGVHGHFTKRPEEIGAGDQGHMFGYATDETPEMMPLSHVLATKLGARLTEVRKNGTCPWLRPDGKTQVTVEYHNDNGAMVPIRVHTVLISTQHDETVTNDEIAADLKEHVIKPVIPEQYLDEKTIFHLNPSGRFVIGGPHGDAGLTGRKIIIDTYGGWGAHGGGAFSGKDPTKVDRSGAYIARQAAKSIVASGLARRCIVQVSYAIGVPEPLSVFVDTYGTGKIPDKEILKIVLENFDLRPGMIIIDLDLKRGGNGRYLKTAAYGHFGRDDPDFTWELVKPLKWENPSA

SEQ ID NO: 16666 - DNA, 996 bp, Sorghum bicolor
  misc_feature: Ceres ANNOT ID no. 8659983
  misc_feature: Encodes the peptide sequence at SEQ ID NO 16667
atgtcacgcggctctgacgtgatgctgctgctcttggtagccctccatgcgcttctgccggcaatcgtcactgatgccgctctgcaggaaggtttctacacgagcaacaccaattgcaccgtcgacgtcgaggccaccgtggtgagcgtcgtccagcagttcatctccgcggatcgtggcgtcggcgctggcctcatacggctccacttccacgactgtttcgtcaagggttgcgatggttcggttctccttgaccggagccctgccaacccggacccggagaaggcgtcgccggcgaacggcggcctccgcgggctggaggtgatccaggaagccaagcggcagctcgagagcgcgtgcccggggaccgtctcctgcgccgacatcctcgcgttcgccgcgcgcgacgcgtccaacatcctgagctccggggcgatcaactacggcgtcccgtccggccgccgggacgggctcacctcggcggcgtccgacgccagccagagcctgcccccgccgttcgcgcagctcgaccgtctcacggagctcttcgccgccaaggggttcacgcaggacgagctcgtcacgctctccggcgcgcactccgtcggccgcgctcactgcgcgtccttctcgcagcggatacaccccaacgtcagcgacaccatggaccaggagtacggcgccgggctgcagcagcagtgccccgccgacgccggggacgacggggtggcgccggtggaccaggaccagggcacaccggccgagctcgacaaccagtattacaggaacgtgatcgacgggaaggtgctcttcaactccgactgggcgctcatcagcgacgacacgacgagacagatggtggcggacaacgcgggaaaccaggctcggtgggcggccaagttcatcgacgccatgcgcaagatgggcaccttggacgtgctcacaggcgaccagggcgaagtgagacgtttctgcaacgtcaccaatagcggctaa

SEQ ID NO: 16667 - protein, 331 aa, Sorghum bicolor
  misc_feature: Useful for making plants with altered carbohydrate content
  misc_feature: Functional homolog of the protein sequence given in SEQ ID NO 13714
  misc_feature: Ceres ANNOT ID no. 8659983
  misc_feature (26)..(329): SWISSPROT Homolog: EC 1.11.1.7 Peroxidase
  misc_feature (47)..(293): Pfam ID: peroxidase Pfam Description: Peroxidase
MSRGSDVMLLLLVALHALLPAIVTDAALQEGFYTSNTNCTVDVEATVVSVVQQFISADRGVGAGLIRLHFHDCFVKGCDGSVLLDRSPANPDPEKASPANGGLRGLEVIQEAKRQLESACPGTVSCADILAFAARDASNILSSGAINYGVPSGRRDGLTSAASDASQSLPPPFAQLDRLTELFAAKGFTQDELVTLSGAHSVGRAHCASFSQRIHPNVSDTMDQEYGAGLQQQCPADAGDDGVAPVDQDQGTPAELDNQYYRNVIDGKVLFNSDWALISDDTTRQMVADNAGNQARWAAKFIDAMRKMGTLDVLTGDQGEVRRFCNVTNSG

SEQ ID NO: 16668 - DNA, 1047 bp, Sorghum bicolor
  misc_feature: Ceres ANNOT ID no. 8659986
  misc_feature: Encodes the peptide sequence at SEQ ID NO 16669
atgaagctctcggcggcagtcctcttcgcgcttgtggctgtccaggcggcggtgctcctcgccaccgtgccgtcggcgcaggccagcgagctggaggtcgggtactacagcaagaaatgcaagggcgtggagaacgtggtgaagtggcacgttatcagggcgatcaaggccaaccgccgcaccggcgccgccctcgtccgccttctcttccatgactgcttcgtcagggggtgtgatggttctgtcctcctggacgcttcctccgacaaccctcacccggagaaggaggcgcgggtgaacatcggtctggccgccttcgacgtcctggaggagatcaaggccgccgtcgagaagaggtgccccggcgtggtctcctgctccgacatcctcatctacgccgcccgcgacgcggccagcgccctcagcaacggccacgtccacttcgccgtcccggccggccgcctggacggcttcgtctccaaggccgatgaggcgcaggcggagctcccggactccacccacgacgtgcagcagctcatcgacaacttcgccaggaagaacttcaccgtggaggagctggtcatcctcaccggggcgcactccatcggccagggccactgctcctccttcagaggccgcctctccgagccgtcgagccagatcaccccggcgtaccgcgacctgctcaactacaagtgctcccagggatcgaacccgcccgtggacaacaacgtccgcgacgaggactacgacgtggtggccaagttcgtggcggggttcaccagccgggtgcgcaagatcccggacttcctggacaactccttctaccacaacaacctcgccaagatcgtcaccttccactccgactggacgctgctcacgcacaaggaggcgctcggccacgtcgtcgagtacgccgagaacggcacgctatgggacgaggacttctccgagtcgctgttgaagctcagcaagctgcccatgccagccggaagcaagggcgagatcaggaagaagtgcagcgtcgtcaaccaccggctatactaa

SEQ ID NO: 16669 - protein, 348 aa, Sorghum bicolor
  misc_feature: Useful for making plants with altered carbohydrate content
  misc_feature: Functional homolog of the protein sequence given in SEQ ID NO 13931
  misc_feature: Ceres ANNOT ID no. 8659986
  misc_feature (28)..(251): SWISSPROT Homolog: EC 1.11.1.7 Peroxidase
  misc_feature (47)..(308): Pfam ID: peroxidase Pfam Description: Peroxidase
MKLSAAVLFALVAVQAAVLLATVPSAQASELEVGYYSKKCKGVENVVKWHVIRAIKANRRTGAALVRLLFHDCFVRGCDGSVLLDASSDNPHPEKEARVNIGLAAFDVLEEIKAAVEKRCPGVVSCSDILIYAARDAASALSNGHVHFAVPAGRLDGFVSKADEAQAELPDSTHDVQQLIDNFARKNFTVEELVILTGAHSIGQGHCSSFRGRLSEPSSQITPAYRDLLNYKCSQGSNPPVDNNVRDEDYDVVAKFVAGFTSRVRKIPDFLDNSFYHNNLAKIVTFHSDWTLLTHKEALGHVVEYAENGTLWDEDFSESLLKLSKLPMPAGSKGEIRKKCSVVNHRLY

SEQ ID NO: 16670 - DNA, 1050 bp, Sorghum bicolor
  misc_feature: Ceres ANNOT ID no. 8659989
  misc_feature: Encodes the peptide sequence at SEQ ID NO 16671
atgaagctctcggcggcagtcctctgcgcccttgtggctgtccaggcggcggcgctcctcctcgccaccgtgccgtcggcgcaggccaaagagctggaggtcggctactacggcaagaagtgcaagggcgtggagaacgtggtgaagtggcatgtcatcaaggctatcaaggccaaccgccgcaccggcgccgcactcgtccgcctcctcttccatgactgcttcgtcagggggtgtgatggttctgtcctcctggacgcttcctccgacaaccctcacccggagaaggaggcgccggtgaacatcggcctcgccgccttcgacgtcctggaggagatcaaggccgccgtcgagaagaggtgccccggcgtggtctcctgctccgacatcctcatctacgccgcccgcgacgcggccagcgccctgagcaacggccacgtccacttcgccgtccccgccgggcgcctggacggcttcgtctccaaggccgatgaggcccaggcggagctcccggactccacccacgacgtgcagcagctcatcgacaacttcgccaggaagaacttcaccgtggaggagctggtcatcctcaccggcgcgcactccatcggccagggccactgctcctccttcagaggccgcctctccgagccgtcgagccagatcaccccggcgtaccgcgacctgctcaactacaagtgctcccagggatcgaacccgcccgtggacaacaacgtccgcgacgaggactacgacgtggtggccaagttcgtggcggggttcaccagccgggtgcgcaagatcccggacttcctggacaactccttctaccacaacaacctcgccaagatcgtcaccttccactccgactggacgctgctcacgcacaaggaggcgctcggccacgtcgtcgagtacgccgagaacggcacgctgtgggacgaggacttctccgagtcgctgctcaagctcagcaagctgcccatgccagcaggaagcaagggagagatcaggaagaagtgcagcgtcgtcaaccaccgcctgtactga

SEQ ID NO: 16671 - protein, 349 aa, Sorghum bicolor
  misc_feature: Useful for making plants with altered carbohydrate content
  misc_feature: Functional homolog of the protein sequence given in SEQ ID NO 13931
  misc_feature: Ceres ANNOT ID no. 8659989
  misc_feature (29)..(252): SWISSPROT Homolog: EC 1.11.1.7 Peroxidase
  misc_feature (48)..(309): Pfam ID: peroxidase Pfam Description: Peroxidase
MKLSAAVLCALVAVQAAALLLATVPSAQAKELEVGYYGKKCKGVENVVKWHVIKAIKANRRTGAALVRLLFHDCFVRGCDGSVLLDASSDNPHPEKEAPVNIGLAAFDVLEEIKAAVEKRCPGVVSCSDILIYAARDAASALSNGHVHFAVPAGRLDGFVSKADEAQAELPDSTHDVQQLIDNFARKNFTVEELVILTGAHSIGQGHCSSFRGRLSEPSSQITPAYRDLLNYKCSQGSNPPVDNNVRDEDYDVVAKFVAGFTSRVRKIPDFLDNSFYHNNLAKIVTFHSDWTLLTHKEALGHVVEYAENGTLWDEDFSESLLKLSKLPMPAGSKGEIRKKCSVVNHRLY

SEQ ID NO: 16672 - DNA, 1521 bp, Sorghum bicolor
  misc_feature: Ceres ANNOT ID no. 8660058
  misc_feature: Encodes the peptide sequence at SEQ ID NO 16673
atggagttcaccgccaggaccaggaccgccattgctctgcttctttcgctcgccgccttctccagcttcctctgcggcggcgtgcagggcggccgccaccaccaccaccacgccaagcacaccaagcacaactccgcgcgcccgccgtccgcgcacgctccgggcccggcgagcggcgggaggcggcacgcgtctcctcctccgcacgcgcggcggcccgtgtctcccccggccccgccgccgtcgtcgtcgggcggctacccgacgcctggcgccgccgcgccggagccagcaccggcacccgcggccgccggctccgtgtacgacgtcgtcaaggacttcggcgccgtcggggacggcgtgacggacgacaccgacgccgtcaagaccgcgtgggacaccgcgtgccaggacgacggcgacagcgtcgtgctcgccgccgccggctactcgttcctcgtgcactccaccgtcttcaccggcccgtgccaggggagcgtcacgattcagctcgacgggacgatcgtggcgccgagcgaccccgacaagtggccggccaacagcaagcgcaactggctgctgttctaccaggcgcacggcatgtcgctgaagggcgccggcctcatcgacggcaagggacagaagtggtgggagctcccctgcaagtctcagaagggccatggcggatcaagcggccacggtgcagcctgtgacagcccagtggcgatgaggtttttcatgaccaacaacgtgacgctgcaaggcctcaaggtgcagaacagccccgagttccacatccggttcgacagctgccgcggcgtggtcgccagcggcctgtccatcagctcgccggcgctgagccccaacacggacggcatccacgtggagaacagtcaggacgtcgtcatcaccaacaccgccgtctccaacggcgacgactgcgtctccatcggcgccggcaccctcaacatgcacgtcgagaacgtcacctgcggccccggcggccacggcatcagcattgggagcctgggcaagcagggttcgcgggcgtgcgtggccaacgtgaccgtgcgcaacgccgtgatccgccactcggacaacggcgtccggatcaagacgtggcagggcggctccggcgccgtctccgccgtgtccttcgagaacgtgcgcatggacgccgtccgcaaccccatcatcatcgaccagtactactgcctctccaagagctgcgagaacgccacctccgccgtcttcgtcaatggcgtctcctacgccggcatccggggcacctacgacgcgcgcacaccgcccatccacttcggctgcagcgacgccgtaccgtgcacaaacatcacgctctccgacgtcgagctgctcccggcgtccggcgagaccatcgacgaccctttctgctggaacgtgtacggcagcgccgccacgcccacggtgccgccggtgccgtgcctcatggaaggcgtgcccaggaacgtcgaggataacagcagcctcaaatgctactag

SEQ ID NO: 16673 - protein, 506 aa, Sorghum bicolor
  misc_feature: Useful for making plants with altered cell wall content and/or composition
  misc_feature: Functional homolog of the protein sequence given in SEQ ID NO 14411
  misc_feature: Ceres ANNOT ID no. 8660058
  misc_feature (142)..(482): SWISSPROT Homolog: EC 3.2.1.15 Polygalacturonase
  misc_feature (136)..(480): Pfam ID: Glyco_hydro_28 Pfam Description: Glycosyl hydrolases family 28
MEFTARTRTAIALLLSLAAFSSFLCGGVQGGRHHHHHAKHTKHNSARPPSAHAPGPASGGRRHASPPPHARRPVSPPAPPPSSSGGYPTPGAAAPEPAPAPAAAGSVYDVVKDFGAVGDGVTDDTDAVKTAWDTACQDDGDSVVLAAAGYSFLVHSTVFTGPCQGSVTIQLDGTIVAPSDPDKWPANSKRNWLLFYQAHGMSLKGAGLIDGKGQKWWELPCKSQKGHGGSSGHGAACDSPVAMRFFMTNNVTLQGLKVQNSPEFHIRFDSCRGVVASGLSISSPALSPNTDGIHVENSQDVVITNTAVSNGDDCVSIGAGTLNMHVENVTCGPGGHGISIGSLGKQGSRACVANVTVRNAVIRHSDNGVRIKTWQGGSGAVSAVSFENVRMDAVRNPIIIDQYYCLSKSCENATSAVFVNGVSYAGIRGTYDARTPPIHFGCSDAVPCTNITLSDVELLPASGETIDDPFCWNVYGSAATPTVPPVPCLMEGVPRNVEDNSSLKCY

SEQ ID NO: 16674 - DNA, 1242 bp, Sorghum bicolor
  misc_feature: Ceres ANNOT ID no. 8660010
  misc_feature: Encodes the peptide sequence at SEQ ID NO 16675
atgcagagtccgcgctcggggaccgggcctccatcttccacgacgccgaccggttatgaagcgagtaccagtggaaccactgatcgattgccagatgagatgaatggcatgagcataagggatgaaaaggaggtggaagctgttgttgtcaatggcaatgggatggaggtcggtcatacaatcgtgacaactgttggtggaagaaattcacagtcgaggcagactattagttacatggcagaacgtatcgtggggcaaggttcatttggagttgtcttccaggccaggtgtctggaaactggtgagagagtagctataaagaaagttcttcaagacgtgagatacaagaaccgtgagctgcaaacaatgcaagttcttgatcacccaaatgttgtatgcttgaagcattacttctgctcaacgactgataaggaagagctttacctcaatttggtgcttgaatatgtgccagaaactgttcaccgtgttattaaacattacaataagatgaaccaacggatgccgttgatttatgttaaactctatatgtatcagatttgtagagctttggcttacctgcacaactgcgtaggggtatgccacagggatataaagccacagaatattctggtaaacccacatacccatcagctgaagttgtgtgacttcggcagtgccaaagtcttggtacggggtgaaccaaatatttcatatatttgttctagatactacagagctccggagctcatatttggtgctacagagtacacaacagccattgatgtgtggtctgctggttgtgttcttgctgagcttcttctagggcagcctgttttccctggggacagtggtgtcgatcagcttgttgaaattattaaggttctaggtactccaacacgggatgaaattaagcgaatgaatccaaactacaccgaatttaagtttccgcaaatcaaagctcatccatggcacaagatcttccacaaaagaatgccatctgaagctgtagatcttgtttcacggcttctgcagtactcaccaaaccttcggtgcactgcattggaggcgttagtccatccgttctttgatgaactgcgggacccaaactcacgtttaccaaatggtcgttcccttccccatctcttcaattttaagcctaatgagttgagaggagtaccgacggagtttgttgtgaaattgatcccccagcatgctaagaagcaatgtgccttaggaatttga

SEQ ID NO: 16675 - protein, 413 aa, Sorghum bicolor
  misc_feature: Useful for making plants with modulated water use efficiency
  misc_feature: Functional homolog of the protein sequence given in SEQ ID NO 14073
  misc_feature: Useful for making plants with modulated biomass
  misc_feature: Functional homolog of the protein sequence given in SEQ ID NO 14074
  misc_feature: Ceres ANNOT ID no. 8660010
  misc_feature (21)..(413): SWISSPROT Homolog: EC 2.7.11.1 Non-specific serine/threonine protein kinase
  misc_feature (78)..(362): Pfam ID: Pkinase Pfam Description: Protein kinase domain
MQSPRSGTGPPSSTTPTGYEASTSGTTDRLPDEMNGMSIRDEKEVEAVVVNGNGMEVGHTIVTTVGGRNSQSRQTISYMAERIVGQGSFGVVFQARCLETGERVAIKKVLQDVRYKNRELQTMQVLDHPNVVCLKHYFCSTTDKEELYLNLVLEYVPETVHRVIKHYNKMNQRMPLIYVKLYMYQICRALAYLHNCVGVCHRDIKPQNILVNPHTHQLKLCDFGSAKVLVRGEPNISYICSRYYRAPELIFGATEYTTAIDVWSAGCVLAELLLGQPVFPGDSGVDQLVEIIKVLGTPTRDEIKRMNPNYTEFKFPQIKAHPWHKIFHKRMPSEAVDLVSRLLQYSPNLRCTALEALVHPFFDELRDPNSRLPNGRSLPHLFNFKPNELRGVPTEFVVKLIPQHAKKQCALGI

SEQ ID NO: 16676 - DNA, 1683 bp, Sorghum bicolor
  misc_feature: Ceres ANNOT ID no. 8660285
  misc_feature: Encodes the peptide sequence at SEQ ID NO 16677
atggcagcagcggccttccacaccaccactgctgcgctctccgccatcctggcgctgctgctctccctgtccctgctcgtcgccgtggtccgctccgacacggcggccacgccggtgacgccgtccacggcgtgcaacgagacgacggaccccaacttctgccggaccgtgctcccgtcgaacggcaccagcaacctctacacctacggccgcttctccgtggccaagtccctcgccaacgccaacaagttcctcggcctcgtgaaccggtacctcacccgcggcggcggcggcctctcccccggcgccgtcgccgcgctgcaggactgccagctcctctccgggctcaacatcgacttcctgtcgtcggcgggcgccacgctcaacacgtcgggcaacagcacgctcctggacccgcaggccgaggacgtgcagacgctgctgtcggcgatcctgaccaaccagcagacgtgcgccgacggcctgcaggtggccgccgccgcgtggtccgtgcgcaacgggctcgccgtgcccatggtcaacagcaccaagctgtacagcgtctcgctgtcgctcttcaccagggcatgggtgcgttcgtcggccaaggctaacaagtccaagtccaagccgccccgccatggcggcggccacgggagggggctgttcgacgccaccgacgacgagatggtccgcaggatggcgctcgacggcgtcgcggccgcggtctcggtggtcggcgaggtgacggtggacccgagcggcgcggggaactacagcaccatcggcgaggccgtggcggcggcgccgaccaaccttggcgggagcaccggctacttcgtcatacgcgtgcccgcgggcgtgtaccaggagaatgtggtggtgcccaagaacaagaagtacgtcatgatgatcggcgacggcatcggcctgtcggtggtcaccggcaaccggagcgtcgtcgacggctggacgaccttcaactccgcaacgttcgggttcgtggcggtgaacatgacgttccggaacacggcgggtccggcgaagcaccaggcggtggcgctgcgttccggcgcggacctgtcgacgttctaccagtgcagcttcgaggcgtaccaggacacgctgtacacgcactccctccggcagttctaccgcggctgcgacgtctacggcaccgtggactacgtgttcggcaacgcggcggtggtgttccaggactgcaacctctactccaggctgccgatgcaggggcagagcaacacggtgacggcgcaggggcgcacggacccgaaccagaacacgggcaccacgctccagggctgcaccgtcgccgccgcgcccgagctcgccgccaacacggcgttcgccgtcgccacctacctggggcggccatggaagctctactcccgcacggtgatcatgcagtcggaggtggacgcgctcgtcgaccccgccgggtggatgccgtgggacggcgactacgcgctcagcacgctcttctacgccgagtacaacaactccggccccggcgcggacaccagcaggagggtggcatggccgggcttccacgtgctgaacggcaccgcggacgccgccaacttcaccgtcggcaacatggtgctcggggacttctggctgccccaaaccggtgtgccgttcaccagcggtctcatcaactga

SEQ ID NO: 16677 - protein, 560 aa, Sorghum bicolor
  misc_feature: Useful for making plants with altered cell wall content and/or composition
  misc_feature: Functional homolog of the protein sequence given in SEQ ID NO 14412
  misc_feature: Useful for making plants with altered carbohydrate content
  misc_feature: Functional homolog of the protein sequence given in SEQ ID NO 14381
  misc_feature: Useful for making plants with modulated time to senescence
  misc_feature: Functional homolog of the protein sequence given in SEQ ID NO 14413
  misc_feature: Ceres ANNOT ID no. 8660285
  misc_feature (255)..(558): SWISSPROT Homolog: EC 3.1.1.11 Pectinesterase
  misc_feature (248)..(544): Pfam ID: Pectinesterase Pfam Description: Pectinesterase
  misc_feature (33)..(192): Pfam ID: PMEI Pfam Description: Plant invertase/pectin methylesterase inhibitor
MAAAAFHTTTAALSAILALLLSLSLLVAVVRSDTAATPVTPSTACNETTDPNFCRTVLPSNGTSNLYTYGRFSVAKSLANANKFLGLVNRYLTRGGGGLSPGAVAALQDCQLLSGLNIDFLSSAGATLNTSGNSTLLDPQAEDVQTLLSAILTNQQTCADGLQVAAAAWSVRNGLAVPMVNSTKLYSVSLSLFTRAWVRSSAKANKSKSKPPRHGGGHGRGLFDATDDEMVRRMALDGVAAAVSVVGEVTVDPSGAGNYSTIGEAVAAAPTNLGGSTGYFVIRVPAGVYQENVVVPKNKKYVMMIGDGIGLSVVTGNRSVVDGWTTFNSATFGFVAVNMTFRNTAGPAKHQAVALRSGADLSTFYQCSFEAYQDTLYTHSLRQFYRGCDVYGTVDYVFGNAAVVFQDCNLYSRLPMQGQSNTVTAQGRTDPNQNTGTTLQGCTVAAAPELAANTAFAVATYLGRPWKLYSRTVIMQSEVDALVDPAGWMPWDGDYALSTLFYAEYNNSGPGADTSRRVAWPGFHVLNGTADAANFTVGNMVLGDFWLPQTGVPFTSGLIN

SEQ ID NO: 16678 - DNA, 1731 bp, Sorghum bicolor
  misc_feature: Ceres ANNOT ID no. 8660286
  misc_feature: Encodes the peptide sequence at SEQ ID NO 16679
atgccacccatacccaagagagccgagcatctccttgtcctcctaattgtcgcattcgccgccgccgccgccaccagcgccgcctccaatgacgccggcaccgtccccttctacccctccgcggaggccgccgcagccgcgcactgcgacggcacgctctacccggagctctgcctgtccacactcgcggacatcccggacctgcacaagaagcccctcccggacgtcatctgcgccgccgtgaaccacaccgaggacgtggtgaccgccacctccaccaactgctcgtactacctacaggacaggtccctctcggcgcgggaccgcctcgccatcaacgactgcctggagctgctgtccaccaccatggacgagctccgcgccaccaccgccgacctcagcacgagctccggcggcaacggctccgcggcggccccgtccgtgggcacccggcgcgtgacgatggaccacgtgatgacggtgctctccgcggccatcaccaaccagtacacctgcctcgacggcttcgcgtaccagaacggcgggcgggtgcggcactacatcgagccgaccttccaccacgtctcccgcatggtgagcaactcgctcgccatggccaagaagctgcccggcgccagccccagcccctcctcggcgcctacgacgacggagactgcagcggtggcgcggcagccattcatggggtacgggcagatggtgaaggggttcccgcggtgggtgcgtcccggggaccggcggctgctgcaggccccggcgacggccatcaccgcggacgcggtggtggccaaggacgggagcggggggtacacgacggtgtcggcggccgtggcggcggcgccgaccaactcgaagaagcggtacgtgatctacatcaaggccggggcgtacatggagaacgtggaggtcgggaagaagcacgtgaacctgatgttcgtcggcgacggcatcggcaagaccgtcatcaaggccagccgcaacgttgtggacggctacaccaccttccgctcagccacagtcgctgtggtgggcaacaacttcttggcccgcgacctgacgatcgagaactcggccggcccgtccaagcaccaggcggtggcgctccgcgtgggcgccgacctgtcggcgttctaccgctgcagcttcgtgggctaccaggacacgctgtacgtgcactccctccggcagttcttccgcgactgcgacatctacggcaccatcgacttcgtcttcggcaacgccgccgtcgtgctgcagggctgcaacctgtacgcgcgcaagccgctgcccaaccagagcaacatcttcacggcgcagggccgggaggaccccaaccagaacaccggcatctccatccaccgctgcaaggtggcggcggcggcggacctgctgcagtcctcctcctccaccaagacctacctcggccggccatggaagcagtactcccgcacggttttcctgcagtcggagctggactcgctcatcgccccggcgggctggctcgagtgggacggcaacttcgcgctcgacacgctctactacggcgagtacatgaacacggggcccggcgccggaacctccggccgggtcaagtggaaggggtaccgtgtcatcaccagcgcggccgaggccagcgcgttcaccgtcggctccttcatcgacggggacgtctggctcgccggcacgtccatccccttcaccaccggcttgtga

SEQ ID NO: 16679 - protein, 576 aa, Sorghum bicolor
  misc_feature: Useful for making plants with altered carbohydrate content
  misc_feature: Functional homolog of the protein sequence given in SEQ ID NO 14381
  misc_feature: Useful for making plants with altered cell wall content and/or composition
  misc_feature: Functional homolog of the protein sequence given in SEQ ID NO 14386
  misc_feature: Useful for making plants with modulated time to senescence
  misc_feature: Functional homolog of the protein sequence given in SEQ ID NO 14413
  misc_feature: Ceres ANNOT ID no. 8660286
  misc_feature (49)..(576): SWISSPROT Homolog: EC 3.1.1.11 Pectinesterase
  misc_feature (265)..(562): Pfam ID: Pectinesterase Pfam Description: Pectinesterase
  misc_feature (39)..(205): Pfam ID: PMEI Pfam Description: Plant invertase/pectin methylesterase inhibitor
MPPIPKRAEHLLVLLIVAFAAAAATSAASNDAGTVPFYPSAEAAAAAHCDGTLYPELCLSTLADIPDLHKKPLPDVICAAVNHTEDVVTATSTNCSYYLQDRSLSARDRLAINDCLELLSTTMDELRATTADLSTSSGGNGSAAAPSVGTRRVTMDHVMTVLSAAITNQYTCLDGFAYQNGGRVRHYIEPTFHHVSRMVSNSLAMAKKLPGASPSPSSAPTTTETAAVARQPFMGYGQMVKGFPRWVRPGDRRLLQAPATAITADAVVAKDGSGGYTTVSAAVAAAPTNSKKRYVIYIKAGAYMENVEVGKKHVNLMFVGDGIGKTVIKASRNVVDGYTTFRSATVAVVGNNFLARDLTIENSAGPSKHQAVALRVGADLSAFYRCSFVGYQDTLYVHSLRQFFRDCDIYGTIDFVFGNAAVVLQGCNLYARKPLPNQSNIFTAQGREDPNQNTGISIHRCKVAAAADLLQSSSSTKTYLGRPWKQYSRTVFLQSELDSLIAPAGWLEWDGNFALDTLYYGEYMNTGPGAGTSGRVKWKGYRVITSAAEASAFTVGSFIDGDVWLAGTSIPFTTGL

SEQ ID NO: 16680 - DNA, 309 bp, Sorghum bicolor
  misc_feature: Ceres ANNOT ID no. 8660339
  misc_feature: Encodes the peptide sequence at SEQ ID NO 16681
atggagagagttgcatcaagctgtgtcagcctcctagcacaaaggagggcctactctgtggccgcggccatggcgaagggagtcgcacggaggggcgccgacgagaagaaggcggcggcggcggcggtgaccaagcgcgtgatgggcaagaaggaagtgaacaccgcagccgctgctgcggcggaggagaagaaggcgtgggtgccggaccctgtgaccggctactatcgcccagcaggtagcgctgccaaggaggtggacgccgcggagctgcgcgccaagctgctcacggaggctgcggccaactga

SEQ ID NO: 16681 - protein, 102 aa, Sorghum bicolor
  misc_feature: Useful for making plants with modulated nitrogen use efficiency
  misc_feature: Functional homolog of the protein sequence given in SEQ ID NO 14414
  misc_feature: Ceres ANNOT ID no. 8660339
  misc_feature (1)..(97): Pfam ID: LEA_3 Pfam Description: Late embryogenesis abundant protein
MERVASSCVSLLAQRRAYSVAAAMAKGVARRGADEKKAAAAAVTKRVMGKKEVNTAAAAAAEEKKAWVPDPVTGYYRPAGSAAKEVDAAELRAKLLTEAAAN

SEQ ID NO: 16682 - DNA, 291 bp, Sorghum bicolor
  misc_feature: Ceres ANNOT ID no. 8660328
  misc_feature: Encodes the peptide sequence at SEQ ID NO 16683
atggagagagttgcgtcgagctgcgccagcctcctagcacaaaggaggggctactcggtggccgcggccgtggtgaaggggatcagcgggcggaaggccgtggagaaggtggccaagcgcatcatgggcaaagaggtgaacaccgcggctgcggcctcggtgtcggcggcggagaagacgccgtgggtgccggaccccgtcaccggctactaccgcccggcgggtggcaccaaggaggtggacgccgcggagcttcgcgccaggctgctcacgcagagggtcgccaactaa

SEQ ID NO: 16683 - protein, 96 aa, Sorghum bicolor
  misc_feature: Useful for making plants with modulated nitrogen use efficiency
  misc_feature: Functional homolog of the protein sequence given in SEQ ID NO 14414
  misc_feature: Ceres ANNOT ID no. 8660328
  misc_feature (1)..(91): Pfam ID: LEA_3 Pfam Description: Late embryogenesis abundant protein
MERVASSCASLLAQRRGYSVAAAVVKGISGRKAVEKVAKRIMGKEVNTAAAASVSAAEKTPWVPDPVTGYYRPAGGTKEVDAAELRARLLTQRVAN

SEQ ID NO: 16684 - DNA, 759 bp, Sorghum bicolor
  misc_feature: Ceres ANNOT ID no. 8660354
  misc_feature: Encodes the peptide sequence at SEQ ID NO 16685
atgagccgacgcaacagccgtaccatctatgtaggcaatctccctggggacatccgtgagagggaggttgaggatctcttctacaagtatggtcgtatcttggatatcgacttgaaaatacctccaagacctcctggatacgctttcgttgagtttgaggatccacgtgatgctgatgatgcaatttatggccgtgatgggtataactttgatggctacaggttgcgcgttgaattagctcatggtggtagaggtcagtcttattcttatgatcgttcaagcagctatagcagtgcacgccgtggaggtgtttctaggcgctctgatttccgtgttatggtcactggtttaccttcatctgcatcgtggcaagatctgaaggaccacatgcggcgcgccggcgatgtctgtttctctgatgtataccgtgaggctggagaaactattggaattgtggactatacaaattatgacgatatgaaatacgcgattaggaagcttgatgactcacagttcaggaatgcattttcaagggcgtatatcagggtgagggagtatgatgccagatcacgaagcagaagccgtagccggtcgtactctagaagccccagttacagcaggagcaggagtccaaaatctctttctcggtcaccctcacctgtggatgaaagcctaagcttgctggctaacctccactgttcaaggtttgcttttgtttttcctagatttggccatgcggcgatctggggactgcattga

SEQ ID NO: 16685 - protein, 252 aa, Sorghum bicolor
  misc_feature: Useful for making plants with altered alkaloid content
  misc_feature: Useful for making plants with altered lignin content
  misc_feature: Functional homolog of the protein sequence given in SEQ ID NO 13245
  misc_feature: Ceres ANNOT ID no. 8660354
  misc_feature (5)..(80): SWISSPROT Homolog: EC 5.2.1.8 Peptidylprolyl isomerase
  misc_feature (9)..(77): Pfam ID: RRM_1 Pfam Description: RNA recognition motif. (a.k.a. RRM, RBD, or RNP domain)
  misc_feature (112)..(179): Pfam ID: RRM_1 Pfam Description: RNA recognition motif. (a.k.a. RRM, RBD, or RNP domain)
MSRRNSRTIYVGNLPGDIREREVEDLFYKYGRILDIDLKIPPRPPGYAFVEFEDPRDADDAIYGRDGYNFDGYRLRVELAHGGRGQSYSYDRSSSYSSARRGGVSRRSDFRVMVTGLPSSASWQDLKDHMRRAGDVCFSDVYREAGETIGIVDYTNYDDMKYAIRKLDDSQFRNAFSRAYIRVREYDARSRSRSRSRSYSRSPSYSRSRSPKSLSRSPSPVDESLSLLANLHCSRFAFVFPRFGHAAIWGLH

SEQ ID NO: 16686 - DNA, 1185 bp, Sorghum bicolor
  misc_feature: Ceres ANNOT ID no. 8660387
  misc_feature: Encodes the peptide sequence at SEQ ID NO 16687
atggcggctgagagcttcctcttcacctcggagtccgtgaacgaggggcaccccgacaagctgtgcgaccaggtgtcggacgccgtgctcgacgcctgcctcgcgcaggaccccgacagcaaggtggcgtgcgagacctgcaccaagaccaacatggtgatggtgttcggcgagatcaccaccaaggccaccgtggactacgagaagatcgtccgggacacctgccgcgagatcggcttcgtctccgacgacgtgggcctcgacgcggaccgctgcaaggtgctggtcaacatcgagcagcagtcccccgacatcgcgcagggcgtgcacgggcacttcaccaagcggcccgaggagatcggcgccggcgaccagggccacatgttcgggtacgccaccgacgagacccccgagctgatgccgctcagccacgtgctggccaccaagctcggcgcgcgcctcaccgaggtccgcaagaacggcacctgcgcctggctcaggcccgacggcaagacccaggtcacggtggagtacgtcaacgagggcggcgccatggtgcccgtccgcgtccacaccgtcctcatctccacccagcacgacgagaccgtcaccaacgacgagatcgccgccgacctcaaggagcacgtcatcaagcccgtcatcccggagaagtacctcgacgagaagaccatcttccacctcaacccgtcgggccgcttcgtcatcggtgggccccacggcgacgccggcctcaccggccgcaagatcatcatcgacacctacggcggctggggtgcccacggcggtggcgccttctccggcaaggaccccaccaaggtggaccgcagcggcgcctacatcgccaggcaggccgccaagagcatcgtggccagcggcctcgcccgccgctgcctcgtgcaggtctcctacgccatcggcgtgccggagcccctgtccgtgttcgtcgactcgtacggcaccgggagcatcccggacaaggagatcctcaagatcgtcaaggagaacttcgacttcaggcccggcatgatcaccatcaacctcgacctgaagaaaggcggcaacaggttcatcaagaccgccgcctacggccactttggccgtgacgacgccgacttcacctgggaggtggtgaagcccctcaagttcgacaaggcatccgcttaa

SEQ ID NO: 16687 - protein, 394 aa, Sorghum bicolor
  misc_feature: Useful for making plants with modulated biomass
  misc_feature: Functional homolog of the protein sequence given in SEQ ID NO 14410
  misc_feature: Ceres ANNOT ID no. 8660387
  misc_feature: Down-regulated in shoot tissues in response to methyl jasmonate treatment
  misc_feature: Down-regulated in root tissues in response to methyl jasmonate treatment
  misc_feature: Down-regulated in shoot tissues in response to aminocyclopropane carboxylic treatment
  misc_feature: Down-regulated in shoot tissues in response to salicylic acid treatment
  misc_feature (1)..(394): SWISSPROT Homolog: EC 2.5.1.6 Methionine adenosyltransferase
  misc_feature (118)..(240): Pfam ID: S-AdoMet_synt_M Pfam Description: S-adenosylmethionine synthetase, central domain
  misc_feature (242)..(383): Pfam ID: S-AdoMet_synt_C Pfam Description: S-adenosylmethionine synthetase, C-terminal domain
  misc_feature (4)..(103): Pfam ID: S-AdoMet_synt_N Pfam Description: S-adenosylmethionine synthetase, N-terminal domain
MAAESFLFTSESVNEGHPDKLCDQVSDAVLDACLAQDPDSKVACETCTKTNMVMVFGEITTKATVDYEKIVRDTCREIGFVSDDVGLDADRCKVLVNIEQQSPDIAQGVHGHFTKRPEEIGAGDQGHMFGYATDETPELMPLSHVLATKLGARLTEVRKNGTCAWLRPDGKTQVTVEYVNEGGAMVPVRVHTVLISTQHDETVTNDEIAADLKEHVIKPVIPEKYLDEKTIFHLNPSGRFVIGGPHGDAGLTGRKIIIDTYGGWGAHGGGAFSGKDPTKVDRSGAYIARQAAKSIVASGLARRCLVQVSYAIGVPEPLSVFVDSYGTGSIPDKEILKIVKENFDFRPGMITINLDLKKGGNRFIKTAAYGHFGRDDADFTWEVVKPLKFDKASA

SEQ ID NO: 16688 - DNA, 1074 bp, Sorghum bicolor
  misc_feature: Ceres ANNOT ID no. 8660408
  misc_feature: Down-regulated in shoot tissues in response to methyl jasmonate treatment
  misc_feature: Down-regulated in root tissues in response to methyl jasmonate treatment
  misc_feature: Down-regulated in shoot tissues in response to aminocyclopropane carboxylic treatment
  misc_feature: Down-regulated in shoot tissues in response to salicylic acid treatment
  misc_feature: Encodes the peptide sequence at SEQ ID NO 16689
atggcgggagagaggatgagcactagcagcggcggctttgccggcctggtggcgtgcgtcgccaccgtgtgcctgctgctgccgacggggagccgcgcccagctcaaggtggggttctacaacaccacctgccccaacgccgaggcgctcgtgcgtcaggtcgtcacggctgctttcgccaacaactccggcgtcgcacccggcctcatccgcctccatttccatgactgctttgtcaggggctgcgacgcctccgtcctcctatccgtgaaccccgccggcggcaacacggagcgtcagtcccgggcgaacaacccgagcctgcgcggcttcgacgtgatcgacgccgccaaggccgccgtggagcggagctgcccgcgcaccgtctcgtgcgccgacatcgtcgccttcgccgcccgcgacagcgtcaacctgacgggcaagctcttctaccaggtgcccgcggggcggcgggacggccgcgtgtccaacgagacggaggccgacaccaacctgcttggccctgacagcacggcgcaggtcctcatcgacggcttcaggaggaagaacctcaccgtcgaggacatggtggtgctgtcgggctcccacactatcggccgctcccactgcgcctccttcctggccaccaaccgccgccggctggccgacgggaccatcagcgcggcgtaccaggcgctgctggaggcgctgtgcccgcccagccccggccagttcgacccaaacacgacggagatcgacgtcagcacgccggctgtgctggacaacaactactacaagctgctgccgctcaacctcggcctccacttctccgacgaccagctcatccgcaacgccacgctcgcgccgctcgccaacgccttcgccgccgacgagacgctctggaagcagaagttcgccgccgccatggtcaagatgggcaacatcgacgtcaagaccggcaccacggatgagatccgcctcaactgcagcgtcgtcaacccgtcctcgtcgtcggcggccgccgccggggtgatcgagatgctgttcccggccgacgaggttgccacgagctga

SEQ ID NO: 16689 - protein, 357 aa, Sorghum bicolor
  misc_feature: Useful for making plants with modulated oxidative stress sensitivity
  misc_feature: Functional homolog of the protein sequence given in SEQ ID NO 13607
  misc_feature: Useful for making plants with altered cell wall content and/or composition
  misc_feature: Functional homolog of the protein sequence given in SEQ ID NO 13958
  misc_feature: Ceres ANNOT ID no. 8660408
  misc_feature (29)..(333): SWISSPROT Homolog: EC 1.11.1.7 Peroxidase
  misc_feature (51)..(297): Pfam ID: peroxidase Pfam Description: Peroxidase
MAGERMSTSSGGFAGLVACVATVCLLLPTGSRAQLKVGFYNTTCPNAEALVRQVVTAAFANNSGVAPGLIRLHFHDCFVRGCDASVLLSVNPAGGNTERQSRANNPSLRGFDVIDAAKAAVERSCPRTVSCADIVAFAARDSVNLTGKLFYQVPAGRRDGRVSNETEADTNLLGPDSTAQVLIDGFRRKNLTVEDMVVLSGSHTIGRSHCASFLATNRRRLADGTISAAYQALLEALCPPSPGQFDPNTTEIDVSTPAVLDNNYYKLLPLNLGLHFSDDQLIRNATLAPLANAFAADETLWKQKFAAAMVKMGNIDVKTGTTDEIRLNCSVVNPSSSSAAAAGVIEMLFPADEVATS

SEQ ID NO: 16690 - DNA, 1134 bp, Sorghum bicolor
  misc_feature: Ceres ANNOT ID no. 8660407
  misc_feature: Encodes the peptide sequence at SEQ ID NO 16691
atggcggccgccgctgtgctgctgtgcctccagctgccggcggtggcccgtggccagctgcaggtggggttctacaacacgagctgccccaacgctgagtccctggtccagcaggccgtggccagcgctttcgccaacgactccggcatcgccgccggcctcatccgcctccatttccacgactgcttcgtcaggggctgtgacgcgtcggtgctgctgacctccccgaacaacacggcggagcgcgacgcgccgcccaacaacccgagcctccgcgggttccaggtgatcgacgcggccaaggcggcggtggagcagagctgcccgcagacggtgtcgtgcgcggacatcgtggcgttcgcggcgcgcgacagcatcaacctcacgggcaacctcgcgtaccaggtgccctcgggccgccgcgacggcaacgtctccctcctctccgacgccaacaccaacctccccgcgccgacgttcaacgcgtcccagctggtggccggcttcgcggccaagaacctcaccgacgaggagatggtcatcctctccggcgcacacaccgtcggacgctccttctgcaccgcattcctcccgcgcatctacaacggatccaccccgatcgttgacacggggctgagcgcagggtacgccacgctgctgcaagcgctgtgcccgtccaacgccaactcgtcgacgccgacgacgacggtgatcgacccgagcacgccggcggtgctggacaacaactactacaagctgctgccgctcaacatgggcctcttcttctccgacaaccagctgcgggtcaactccacgctcaacgcctccgtcaacagcttcgcggccaacgagacgctctggaaggagaaatggggaacatcgaggtgctcacggggagccagggagagatcaggctcaactgcagcgtcgtcaacaacggctcctcgtcgtcgtcgtcgtcggtggggatccagcagaccaccgcgtccctcgatgagatcgccacgagctgatcccgatcggcggccggccggcgtgatgatgatatatgagcactctggatccatttgtgtgcatgcacctgtccatctttggggttatcttctacgtgttgtttacagtacctggctatag

SEQ ID NO: 16691 - protein, 377 aa, Sorghum bicolor
  misc_feature: Useful for making plants with altered carbohydrate content
  misc_feature: Functional homolog of the protein sequence given in SEQ ID NO 13714
  misc_feature: Ceres ANNOT ID no. 8660407
  misc_feature (7)..(294): SWISSPROT Homolog: EC 1.11.1.7 Peroxidase
  misc_feature (36)..(283): Pfam ID: peroxidase Pfam Description: Peroxidase
MAAAAVLLCLQLPAVARGQLQVGFYNTSCPNAESLVQQAVASAFANDSGIAAGLIRLHFHDCFVRGCDASVLLTSPNNTAERDAPPNNPSLRGFQVIDAAKAAVEQSCPQTVSCADIVAFAARDSINLTGNLAYQVPSGRRDGNVSLLSDANTNLPAPTFNASQLVAGFAAKNLTDEEMVILSGAHTVGRSFCTAFLPRIYNGSTPIVDTGLSAGYATLLQALCPSNANSSTPTTTVIDPSTPAVLDNNYYKLLPLNMGLFFSDNQLRVNSTLNASVNSFAANETLWKEKWGTSRCSRGARERSGSTAASSTTAPRRRRRRWGSSRPPRPSMRSPRADPDRRPAGVMMIYEHSGSICVHAPVHLWGYLLRVVYSTWL

SEQ ID NO: 16692 - DNA, 468 bp, Sorghum bicolor
  misc_feature: Ceres ANNOT ID no. 8660422
  misc_feature: Encodes the peptide sequence at SEQ ID NO 16693
atgcagatcttcgtgaagaccctgacggggaagaccatcacgctggaggtggagtcctcggacaccatcgacaacgtgaaggccaagatccaggacaaggagggcatcccgccggaccagcagcggctcatcttcgcggggaagcagctggaggatgggcgcaccctggccgactacaacatccagaaggagtcgacgctgcacctggtgctccgcctgaggggaggcgccaagaagcgcaagaagaagacgtacaccaagcccaagaagatcaagcacaagcacaagaaggtgaagctcgccgtgctccagttctacaaggtggacgacgccaccggcaaggtcacccgcctccgcaaggagtgccccaacgccgagtgcggcgccggggtcttcatggccaaccacttcgaccgccactactgcggtaagtgcggcctcacctacgtctacaaccagcaggcgtag

SEQ ID NO: 16693 - protein, 155 aa, Sorghum bicolor
  misc_feature: Useful for making plants with modulated cold sensitivity
  misc_feature: Useful for making plants with modulated flowering time
  misc_feature: Functional homolog of the protein sequence given in SEQ ID NO 14303
  misc_feature: Useful for making plants with modulated nitrogen use efficiency
  misc_feature: Functional homolog of the protein sequence given in SEQ ID NO 14348
  misc_feature: Ceres ANNOT ID no. 8660422
  misc_feature (6)..(74): Pfam ID: ubiquitin Pfam Description: Ubiquitin family
  misc_feature (101)..(148): Pfam ID: Ribosomal_S27 Pfam Description: Ribosomal protein S27a
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHKHKKVKLAVLQFYKVDDATGKVTRLRKECPNAECGAGVFMANHFDRHYCGKCGLTYVYNQQA

SEQ ID NO: 16694 - DNA, 1116 bp, Sorghum bicolor
  misc_feature: Ceres ANNOT ID no. 8660412
  misc_feature: Encodes the peptide sequence at SEQ ID NO 16695
atggaggctgcgcgtagctacttcttcgtcgccgcggttgccgtcgtccttattgcgcttctcccggccagcgccatagccgccggcctcaaggtcggcttctacaacaagtcatgcccgtcggcggaggccctggtgcagcaggcggtggctgccgccttcaagaacgacagcggcatcgccgccggcctcatccgcctgcacttccatgactgcttcgtcaggggctgcgacggctcggtgctgatcgactcgacggcgaacaacacggcggagaaggacgcgcccccgaacaacccgagccttcgtggcttcgaggtcatcgacgccgccaaggcggcgatcgaggcgcagtgccccaagacggtctcgtgcgccgacatcctggcgttcgcggcgcgggacagcgtcgcgctgtcgtcgtcgtcggcgtcggggagcggcaagaacctgacgtacaaggtccccgcggggcggcgcgacgggcgggtgtcgagggacacggacgccaacagcaacctcccctcgccgctctccaccgccgccgagctcgtcggcaacttcacgcgcaagaacctcaccgccgaggacatggtggtgctctccggcgcgcacaccgtcggccgctcccactgctcctccttcaccaaccgcctctacggcttcagcaacggcagcgacgtcgacccggccatcagctccgcctacgccttcctgctcaggagcatctgcccctccaacaccacccgcttcttcccccccaacaccaccacggacatggacctcatcacgcccgccgtgctcgacaacaagtactacgtggggctcaccaacaacctcgggctcttcacgtcggaccaggcgctgctcaccaacgccacgctcaagaagtccgtcgatgagttcgtcaagagcgacagcaagtggaagagcaagttcgccaagtccatggtcaagatgggcaacatcgaggtgctcacgggcacgcagggggagatcaggctcagctgcagggtcatcaacaacggcgccggcagcagcagcagcagcgctggattattcgagcttcaaatgacaaccgacaactctgctcaggaggaatcagcagcgaactag

SEQ ID NO: 16695 - protein, 371 aa, Sorghum bicolor
  misc_feature: Useful for making plants with altered carbohydrate content
  misc_feature: Functional homolog of the protein sequence given in SEQ ID NO 13714
  misc_feature: Useful for making plants with modulated oxidative stress sensitivity
  misc_feature: Functional homolog of the protein sequence given in SEQ ID NO 13607
  misc_feature: Ceres ANNOT ID no. 8660412
  misc_feature (31)..(342): SWISSPROT Homolog: EC 1.11.1.7 Peroxidase
  misc_feature (46)..(305): Pfam ID: peroxidase Pfam Description: Peroxidase
MEAARSYFFVAAVAVVLIALLPASAIAAGLKVGFYNKSCPSAEALVQQAVAAAFKNDSGIAAGLIRLHFHDCFVRGCDGSVLIDSTANNTAEKDAPPNNPSLRGFEVIDAAKAAIEAQCPKTVSCADILAFAARDSVALSSSSASGSGKNLTYKVPAGRRDGRVSRDTDANSNLPSPLSTAAELVGNFTRKNLTAEDMVVLSGAHTVGRSHCSSFTNRLYGFSNGSDVDPAISSAYAFLLRSICPSNTTRFFPPNTTTDMDLITPAVLDNKYYVGLTNNLGLFTSDQALLTNATLKKSVDEFVKSDSKWKSKFAKSMVKMGNIEVLTGTQGEIRLSCRVINNGAGSSSSSAGLFELQMTTDNSAQEESAAN

SEQ ID NO: 16696 - DNA, 1116 bp, Sorghum bicolor
  misc_feature: Ceres ANNOT ID no. 8660395
  misc_feature: Encodes the peptide sequence at SEQ ID NO 16697
atggctgctaaggaaagcaagctgacgacgacggccggagtggcccagcggctggccgtcgtcgccgcgtgcgtactatgcctgctgccggcgatggcccacgcgcagctccgggtgggattctacgacaccagctgccctaacgccgaggcgctcgtccgccaggccgtcgcggctgccttcgccaaggacgccggcatcgccgccggcctcatccgcctccatttccacgactgctttgtcaggggctgtgatgcctccgtcctcctcaccgtgaaccctggcggcggccagaccgagcgtgacgccgtgccaaacaacccgagcctccgcggcttcgacgtgatcgacgccgccaaggccgccgttgagcagagctgcccgggcaccgtgtcgtgcgccgacatcgtggccttcgccgcccgcgacagcatcagcctcaccgggagcgtctcgtaccaggtccccgccggccggcgcgacggccgcgtgtccaactcgtcggacaccgtcgacctgcccgcgcccagctccacagcgcagaccctcatcgacaagttcgcggccaaggacctcaccttggaggacatggtggtcctctccggcgcccacaccgtcggccgctccttctgcgtctccttcttccagcgcgtctggaacacaagcacgaaccccgctacggcaatcgtggacgcggggctgagctcgtcgtacgcggcgctgctacgcgcgctgtgcccgtcgaacacgacgcagacgacgccgatcacgacggccatggatcccgggacgcccaacgtgctggacaacaactactacaagctcctgccacgcggcatggggctcttcttctccgacaaccagctgcgcgtgaacacgcagatggccgcgctggtgagcagcttcgcggcgaacgagacgctgtggaaggagaaattcgcggcggcgatggtgaagatgggccgcatccaggtgcagacgggggcgtgcggggaggtccgtctcaactgcggcgtcgtcaacccgagttcatactcgtcgccgtcgacggtggtggagctgggttcgagcgcgccagccgccgtcgatgaagagggctacgccgccgcgagctaa

SEQ ID NO: 16697 - protein, 371 aa, Sorghum bicolor
  misc_feature: Useful for making plants with altered carbohydrate content
  misc_feature: Functional homolog of the protein sequence given in SEQ ID NO 13714
  misc_feature: Ceres ANNOT ID no. 8660395
  misc_feature (33)..(341): SWISSPROT Homolog: EC 1.11.1.7 Peroxidase
  misc_feature (53)..(305): Pfam ID: peroxidase Pfam Description: Peroxidase
MAAKESKLTTTAGVAQRLAVVAACVLCLLPAMAHAQLRVGFYDTSCPNAEALVRQAVAAAFAKDAGIAAGLIRLHFHDCFVRGCDASVLLTVNPGGGQTERDAVPNNPSLRGFDVIDAAKAAVEQSCPGTVSCADIVAFAARDSISLTGSVSYQVPAGRRDGRVSNSSDTVDLPAPSSTAQTLIDKFAAKDLTLEDMVVLSGAHTVGRSFCVSFFQRVWNTSTNPATAIVDAGLSSSYAALLRALCPSNTTQTTPITTAMDPGTPNVLDNNYYKLLPRGMGLFFSDNQLRVNTQMAALVSSFAANETLWKEKFAAAMVKMGRIQVQTGACGEVRLNCGVVNPSSYSSPSTVVELGSSAPAAVDEEGYAAAS

SEQ ID NO: 16698 - DNA, 549 bp, Sorghum bicolor
  misc_feature: Ceres ANNOT ID no. 8660455
  misc_feature: Encodes the peptide sequence at SEQ ID NO 16699
atgggcggcacacaagatcaagatgcatatgcatgcatgctacaagaggcaagatctcgtgccctcgaagcactagtagggggggatcttttctcctttctacgcgctgtgcggataaccggctccgggcagcatcagcagcagcaacatggaggcacggagcagcagctgcaggtggtggcgcagcccggggagctgaggaagcagacgctcgcgcccaagcagagctccaacaaggaccgccacaccaaggtcgacggcaggggtcgccggatcctgatgcccgcgcagtgtgctgcgcggatcttccatctcgcgcgggggctcggccagtccgacggcgagaccgtgcagtggctgctgcagaaggccgagccggccatcgacgccgccaccgacaccgacaccatgcatcccgttcacgccttcgccgtccactacatcctctccgccccccacatcgccgcctccgtcgtcgaccccggctccagcgacctccactgcatccccgtccgtgccgttgtccttctccacggcgaagtcctctga

SEQ ID NO: 16699 - protein, 182 aa, Sorghum bicolor
  misc_feature: The sequence is a functional homolog of SEQ ID NO 1391 in the 10/374,780 US patent application
  misc_feature: The sequence is a functional homolog of SEQ ID NO 1229 in the 11/479,226 US patent application
  misc_feature: The sequence is a functional homolog of SEQ ID NO 226 in the 10/225,066 US patent application
  misc_feature: The sequence is a functional homolog of SEQ ID NO 2424 in the 10/374,780 US patent application
  misc_feature: Ceres ANNOT ID no. 8660455
  misc_feature (67)..(181): Pfam ID: TCP Pfam Description: TCP family transcription factor
MGGTQDQDAYACMLQEARSRALEALVGGDLFSFLRAVRITGSGQHQQQQHGGTEQQLQVVAQPGELRKQTLAPKQSSNKDRHTKVDGRGRRILMPAQCAARIFHLARGLGQSDGETVQWLLQKAEPAIDAATDTDTMHPVHAFAVHYILSAPHIAASVVDPGSSDLHCIPVRAVVLLHGEVL

SEQ ID NO: 16700 - DNA, 1866 bp, Sorghum bicolor
  misc_feature: Ceres ANNOT ID no. 8660497
  misc_feature: Encodes the peptide sequence at SEQ ID NO 16701
atggggctcgccgccgcagcagccgcagcagtgaggccgtgccgccgacgcctcctctcgtccgcctccgcagcctcggcgtcaaagacggcggcgggcaccgcgacccggctcttccccaggttgccccacccgcaccacccgccgtacggccggcgcctccccttcctcgtctccgcggcgtcgcagtcgcaggcctcgcagaccggcccggccacccctgtaccggtccccgtcgcctccgacccccgcgccgccgtttccggcaacctccctttcttcgaccgcgtcctcttcccggactcgttcccgcttgataccccgcctgccaaggaggaggacgacgcggcggcggtgcaggccgatgaggcggtggagccgcccgcgcccttgagggaggagacggagacggagagggaggcgtggaggctgctacggcgggcggtcgtcagctactgcggcgagcctgtggggacggttgcggcggaggaccccgagtgcacggagacgctcaactacgaccaggtcttcatcagggacttcgtgccctccgctctcgccttcctcatgcgcggcgagaccgagatcgtccgcaacttcctcctccacaccctccagcttcagagctgggagaaaactgttgattgttacagccctgggcaaggattgatgccagctagcttcaagattaggaccgtaccacttgatgagaacaatgaaggatttgaggaggtcttggaccctgacttcggtgaggcagccattggccgtgtagctccggtggattctggactgtggtggattattttgttgagagcttactgcaagattacaggagacaatgctttgctagaaagagttgatgtgcagacaggaattcaattgatactgagtttgtgtttggctgatgggtttgacatgttcccaacgttactagttacagatggatcatgcatgatagacaggaggatgggaatacatgggcatcctcttgaaatccaagctttgttctactctgctttacgatgctcacgagaaatgcttgttatgaacaatggatcgaaaaacctcattcgtgccattaacaacaggctcagtgcattgtcctttcacatcagagaatattactgggttgacatgaagaagataaatgagatatacagatacaagacagaagaatactcccatgatgccactaacaaattcaacatttaccctgagcaaatcccttcctggcttgttgactggattcctgagaaaggaggttaccttatagggaatctgcagccagctcacatggattttaggttcttctctcttggcaacctttgggccatagcttcgtctctaactactccaaaacaagctgagggaattcttagccttattgatgaaaaatgggatgatcttgtagcaaacatgcccctcaagatatgctatcctgcaatggaagatgatgaatggcgcattattactggcagtgatcctaagaataccccatggtcatatcataatggtggatcttggccaaccctattgtggcagttcacgttggcgtgcataaaaatgggtagaccagaattggcccggagagccattgcagtggccgaggagagactctcagatgacaagtggccagaatactacgacacccgatctgggaggttcattgggaagcaatcccgatcttaccagacatggactattgctggttttctgacctcaaaaatgttgctggagaacccagagctggcttcaattctgacctgtgatgaggaccttgagctgctcgaaggctgcgcttgctgcctgtccacgaagaggaccaggtgctcacgccgggcagccaagtcacatattgggtga

SEQ ID NO: 16701 - protein, 621 aa, Sorghum bicolor
  misc_feature: Useful for making plants with altered carbohydrate content
  misc_feature: Functional homolog of the protein sequence given in SEQ ID NO 13652
  misc_feature: Useful for making plants with modulated oxidative stress sensitivity
  misc_feature: Functional homolog of the protein sequence given in SEQ ID NO 13231
  misc_feature: Ceres ANNOT ID no. 8660497
  misc_feature (129)..(601): Pfam ID: Invertase_neut Pfam Description: Plant neutral invertase
MGLAAAAAAAVRPCRRRLLSSASAASASKTAAGTATRLFPRLPHPHHPPYGRRLPFLVSAASQSQASQTGPATPVPVPVASDPRAAVSGNLPFFDRVLFPDSFPLDTPPAKEEDDAAAVQADEAVEPPAPLREETETEREAWRLLRRAVVSYCGEPVGTVAAEDPECTETLNYDQVFIRDFVPSALAFLMRGETEIVRNFLLHTLQLQSWEKTVDCYSPGQGLMPASFKIRTVPLDENNEGFEEVLDPDFGEAAIGRVAPVDSGLWWIILLRAYCKITGDNALLERVDVQTGIQLILSLCLADGFDMFPTLLVTDGSCMIDRRMGIHGHPLEIQALFYSALRCSREMLVMNNGSKNLIRAINNRLSALSFHIREYYWVDMKKINEIYRYKTEEYSHDATNKFNIYPEQIPSWLVDWIPEKGGYLIGNLQPAHMDFRFFSLGNLWAIASSLTTPKQAEGILSLIDEKWDDLVANMPLKICYPAMEDDEWRIITGSDPKNTPWSYHNGGSWPTLLWQFTLACIKMGRPELARRAIAVAEERLSDDKWPEYYDTRSGRFIGKQSRSYQTWTIAGFLTSKMLLENPELASILTCDEDLELLEGCACCLSTKRTRCSRRAAKSHIG

SEQ ID NO: 16702 - DNA, 2325 bp, Sorghum bicolor
  misc_feature: Ceres ANNOT ID no. 8660536
  misc_feature: Encodes the peptide sequence at SEQ ID NO 16703
atgggctctgcggcggcggcggacgtgttcatcccggcgtgcgcggcggtcggcgtcgccttcgcgctgtggcaatggttcctcgtctccagggtgaaggtgtccgcctacgcggcgcccggcggcaacggccaccacgggggccccgtcttccggatcgaggacaacgaggaggacgtcggcatgggcggtggcggcgatgatgatgaggaggagggcgccggcgacggcactgtcgccgtggcgcgctgcgcggagatccagagcgccatttcggttggcgccaactcattccttttcacacaatacaagtacctcgccgcgttcacggcgatcttcgccgtggtgatcttcctcttcctgggctccgttcaccggttcagcactgatagccggccgtgccagtacaccagcggtcgcacctgcaagcccgcgctggcaaacgcggtgttcagctccgtggccttcctcctcggcgccgccacctccgtggtgtccgggtacctcggcatgcggatcgccacgtacgcgaacgccaggaccaccctggaagctcggcgcggcgtcggcgcggcgttcgccacggcgttccggtctggcgccgtcatgggcttcctcctggcctccctcggcctcctcgtgctctacgtcaccatcaaggtgttcgggctctactacggcgacgactgggagagcctgtacgagtccatcacgggctacggcctcggcgggtcgtcgatggcgctgttcgggcgcgtcggcggcggcatctacaccaaggcggcggacgtgggcgcggacctcgtcgggaaggtggagcgcaacatccccgaggacgacccgaggaaccccgcggtgatcgcggacaacgtgggcgacaacgtcggcgacatcgccgggatggggtccgacctgttcggctcctacgccgagtccacctgcgcggcgctgttcgtcgcgtccatctcctcgttcggcgccgaccacgacttcgcggcggtggcctacccgctgctcatcagctccgcggggctcctcgtctgcctggtcaccacgctcttcgccacggacctgttcaaggtcaagaccgtccgcggcgtcgcgccggcgctgaagctgcagctcgtcgtctccaccgtgctgatgaccgtcgccgccctcgtcgtgtccttggcggcgctccccgccaacttcaccatgttcgatttcggacaagtgaagcaagtgaagaactggcacctgttcttctgcgtggccattgggctttgggccggtctcgccattggcttcaccaccgagtacttcaccagcaacgcctacagcccggtccgggacgtggccgactcatgcaggacgggcgcggcgaccaacgtcatcttcgggctcgccctcgggtacaagtccgtcatcgtgcccgtcttcgccatcgccgtgtccatctacgtcggcttcacgctggcttccatctatggcatcgcggtcgccgctctcgggatgctgagcacggtcgccactgggctggccatcgacgcctacggccccatcagcgacaacgccggcgggatcgctgagatggccggcatgagccgcaggatccggcagagaaccgacgcgctcgacgccgccggcaacaccacggccgccattggcaagggcttcgccatcggatcggccgcgctggtgtcgctggcgctgttcggcgcgttcgtgagccgcgcggggatcacggacgtgaacgtgctcaaccccaaggtgttcgtcggccttctcgtgggggcgatgctcccgtactggttctcggcgatgacgatgaagagcgtgggcagcgcagcgctgaagatggtggaggaggtccgccggcagttcatcgccatccctgggctgatggagggccgcgccgcgccggactacgcgcgctgcgtcaggatctccacggacgcgtcgctcaaggagatgatgccgcccggagcgctggtgctgctcgcgccgctggtcgccggcaccttcttcggagtcagcacgctcgcgggacttctcgccggcgcactggtctccggtgtccagattgccatatctgcttccaacagtggtggagcgtgggacaatgccaagaaatatatagaggcaggtgcgtccgaccacgctaagtctctgggtcccaaggggtcggacgctcacaaggctgccgtgatcggcgacaccatcggcgaccctcttaaggacacctccggaccgtccctcaacatcctgatcaagctcatggccgtggagtccctagtatttgcgccattcttcgctgcccatggaggcctgatattcaaatag

SEQ ID NO: 16703 - protein, 774 aa, Sorghum bicolor
  misc_feature: Useful for making plants with modulated water use efficiency
  misc_feature: Functional homolog of the protein sequence given in SEQ ID NO 13830
  misc_feature: Ceres ANNOT ID no. 8660536
  misc_feature (81)..(774): SWISSPROT Homolog: EC 3.6.1.1 Inorganic diphosphatase
  misc_feature (4)..(762): Pfam ID: H_PPase Pfam Description: Inorganic H+ pyrophosphatase
MGSAAAADVFIPACAAVGVAFALWQWFLVSRVKVSAYAAPGGNGHHGGPVFRIEDNEEDVGMGGGGDDDEEEGAGDGTVAVARCAEIQSAISVGANSFLFTQYKYLAAFTAIFAVVIFLFLGSVHRFSTDSRPCQYTSGRTCKPALANAVFSSVAFLLGAATSVVSGYLGMRIATYANARTTLEARRGVGAAFATAFRSGAVMGFLLASLGLLVLYVTIKVFGLYYGDDWESLYESITGYGLGGSSMALFGRVGGGIYTKAADVGADLVGKVERNIPEDDPRNPAVIADNVGDNVGDIAGMGSDLFGSYAESTCAALFVASISSFGADHDFAAVAYPLLISSAGLLVCLVTTLFATDLFKVKTVRGVAPALKLQLVVSTVLMTVAALVVSLAALPANFTMFDFGQVKQVKNWHLFFCVAIGLWAGLAIGFTTEYFTSNAYSPVRDVADSCRTGAATNVIFGLALGYKSVIVPVFAIAVSIYVGFTLASIYGIAVAALGMLSTVATGLAIDAYGPISDNAGGIAEMAGMSRRIRQRTDALDAAGNTTAAIGKGFAIGSAALVSLALFGAFVSRAGITDVNVLNPKVFVGLLVGAMLPYWFSAMTMKSVGSAALKMVEEVRRQFIAIPGLMEGRAAPDYARCVRISTDASLKEMMPPGALVLLAPLVAGTFFGVSTLAGLLAGALVSGVQIAISASNSGGAWDNAKKYIEAGASDHAKSLGPKGSDAHKAAVIGDTIGDPLKDTSGPSLNILIKLMAVESLVFAPFFAAHGGLIFK

SEQ ID NO: 16704 - DNA, 582 bp, Sorghum bicolor
  misc_feature: Ceres ANNOT ID no. 8660561
  misc_feature: Encodes the peptide sequence at SEQ ID NO 16705
atgttcctgtgggactggttctacggggtgctggcctccctcggcctgtggcagaaggaggccaagatcctcttccttggcctcgacaacgccggcaagaccacgctgctccacatgctcaaggacgagcggttggtgcagcaccagccgacgcagcacccgacgtcggaagagctcagcatcggcaagatcaagttcaaggccttcgacctcggcggccaccagatcgctcgccgcgtctggaaggattattacgcaaaggttgatgctgtagtatacctggtagatgcatatgacaaggagcgatttgcagaatcaaaaaaggagctcgatgctctcctgtctgatgattccttggccaatgttccatttctcatccttggcaacaagattgatatcccatatgctgcctctgaagaggagctacggtatcacctaggccttagcaacttcacaaccgggaagggcaaggtcaaccttggtgactccaatgtccggccacttgaggttttcatgtgcagtgttgttcgcaagatgggctacggtgatggtttcaagtgggtctcccagtacatcaagtag

SEQ ID NO: 16705 - protein, 193 aa, Sorghum bicolor
  misc_feature: The sequence is a functional homolog of SEQ ID NO 11 in US patent 7259294
  misc_feature: Ceres ANNOT ID no. 8660561
  misc_feature (6)..(192): Pfam ID: Arf Pfam Description: ADP-ribosylation factor family
MFLWDWFYGVLASLGLWQKEAKILFLGLDNAGKTTLLHMLKDERLVQHQPTQHPTSEELSIGKIKFKAFDLGGHQIARRVWKDYYAKVDAVVYLVDAYDKERFAESKKELDALLSDDSLANVPFLILGNKIDIPYAASEEELRYHLGLSNFTTGKGKVNLGDSNVRPLEVFMCSVVRKMGYGDGFKWVSQYIK

SEQ ID NO: 16706 - DNA, 840 bp, Sorghum bicolor
  misc_feature: Ceres ANNOT ID no. 8660593
  misc_feature: Encodes the peptide sequence at SEQ ID NO 16707
atggcgaactcaccaacgccgcctgctgccatgatcccgacggcggtcttggctctcgggctagcaatcctgatctgcgccggtaggcccacggccgcgcagaactgcggctgccagccaggcttttgctgcagcaagttcggttactgcggcaagaccagcgactactgcggcgaggggtgcaagtcgggcccgtgctggggctccggatccggaggaggccgcggcggcgcgtccgtggcgagcgtcgtcaccgagtccttcaacggcatcaagtcccaagccgggagctggtgcgagggcataggcttctacacgcgaagcgtgttcctcgaggccgtcgccgcgtacccgggcttcgcgcatggcggctcggaggtcgagatcaagcgcgagattgccgccttcttcgcgcatgtcacgcacgagaccgggaatttatgctacatcaacgaggtcgacgtggcgaaatactgcgactggaagagtgagaagcagtggccgtgctacccggggcaggggtactacgggcgcggcccgctgcagctgtcgtggaactacaattacgggccggcggggaggagcctcggcttcgacgggctgagggacccggacagattggcgcaggaccccgtgttgtcgttcaagtcggcgctctggtactggatggaaaacgtgcaccagctcatgccccatgggttcggcgccaccatcagggccatcaacggcgacgagtgccacgacggaaagaacacggccgaaatggaagaccgcgtgcgactctatctagagtactgccactacttcggcattgacccggggagtgacctcacttgctag

SEQ ID NO: 16707 - protein, 279 aa, Sorghum bicolor
  misc_feature: The sequence is a functional homolog of SEQ ID NO 12 in US patent 7087810
  misc_feature: Ceres ANNOT ID no. 8660593
  misc_feature (30)..(279): SWISSPROT Homolog: EC 3.2.1.14 Chitinase
  misc_feature (83)..(279): Pfam ID: Glyco_hydro_19 Pfam Description: Chitinase class I
  misc_feature (33)..(66): Pfam ID: Chitin_bind_1 Pfam Description: Chitin recognition protein
MANSPTPPAAMIPTAVLALGLAILICAGRPTAAQNCGCQPGFCCSKFGYCGKTSDYCGEGCKSGPCWGSGSGGGRGGASVASVVTESFNGIKSQAGSWCEGIGFYTRSVFLEAVAAYPGFAHGGSEVEIKREIAAFFAHVTHETGNLCYINEVDVAKYCDWKSEKQWPCYPGQGYYGRGPLQLSWNYNYGPAGRSLGFDGLRDPDRLAQDPVLSFKSALWYWMENVHQLMPHGFGATIRAINGDECHDGKNTAEMEDRVRLYLEYCHYFGIDPGSDLTC

SEQ ID NO: 16708 - DNA, 1044 bp, Sorghum bicolor
  misc_feature: Ceres ANNOT ID no. 8660587
  misc_feature: Encodes the peptide sequence at SEQ ID NO 16709
atggcggcgaggagggcgccgctgctcgtcgctgtcctcctcctgcaccaaacggtgtccgcgcttgctggtagaaagagctactatgaaatactgcaagtgtcaaagggtgcatcggaggataaaatcaagcgggcctaccgcaagcttgcgctaaaataccaccctgacaagaaccccaacaatgaggaagccgacaggcagtttaccgagatcaacaatgcctacgaggtcttgacgaatcaggagaagaggaaagtctatgactggtacggtgaggagggtttggagcaatcccatggcaggcatagtgatggtgatggtcatgctatgaacatcgaacacgtgtttagcaattttttcggtggtggaagtatggaagaggaggaagaacgaactttaaagggtgatgatgtcattgttgaactggatgcttcgctagaagacttgtatatgggtggttccttaaagatttggagggagaaaaatgttataaaaccagctcctggcaacaggcgatgcaaatgtaggaatgaaattcgtcaacgagaaattgctcctggtgttttttatcaaatgagtgagcaggtttgtgatacatgcccaaatgtgaagtacgtaagagaaggcgatttcattaatgttgatattgaaaaggggatgcaagatggacaggaaattttattttacgaggatggtgaacctaagattgatggagagtctggtgatttgaagtttaacattcggacagcacggcatgagcgcttcagaagagaaggcaacgacctacatacaacagtggaaatctcactgtcagaagctcttgttggatttgagaagaacataaagcaccttgacaaccatgccgtggaaatcgggaccaaggtgatcacgaaaccaaaagaagttaggaagtctgaaggagagggcatgccactgtaccatagcaacgagaagggagacctgtacgtcattttcgaggtagtcttccctaaagacctaactgatgatcaaaaggccaagctgatgaacatttttatttga

SEQ ID NO: 16709 - protein, 347 aa, Sorghum bicolor
  misc_feature: Useful for making plants with modulated heat sensitivity
  misc_feature: Functional homolog of the protein sequence given in SEQ ID NO 13683
  misc_feature: Ceres ANNOT ID no. 8660587
  misc_feature (27)..(89): Pfam ID: DnaJ Pfam Description: DnaJ domain
  misc_feature (225)..(343): Pfam ID: DnaJ_C Pfam Description: DnaJ C terminal region
MAARRAPLLVAVLLLHQTVSALAGRKSYYEILQVSKGASEDKIKRAYRKLALKYHPDKNPNNEEADRQFTEINNAYEVLTNQEKRKVYDWYGEEGLEQSHGRHSDGDGHAMNIEHVFSNFFGGGSMEEEEERTLKGDDVIVELDASLEDLYMGGSLKIWREKNVIKPAPGNRRCKCRNEIRQREIAPGVFYQMSEQVCDTCPNVKYVREGDFINVDIEKGMQDGQEILFYEDGEPKIDGESGDLKFNIRTARHERFRREGNDLHTTVEISLSEALVGFEKNIKHLDNHAVEIGTKVITKPKEVRKSEGEGMPLYHSNEKGDLYVIFEVVFPKDLTDDQKAKLMNIFI

SEQ ID NO: 16710 - DNA, 510 bp, Sorghum bicolor
  misc_feature: Ceres ANNOT ID no. 8660721
  misc_feature: Encodes the peptide sequence at SEQ ID NO 16711
atggcggagagcgcgtggggcgcgccgttgccgagcgagaggagcgtggccccggcgatggccggcggttgcggtcccgacctgggcgcgtcgtcgcggcagctctcgttggtggcgtgggaggccggaggaggggagcaagagcagcagcacgaaggtgaccctgtggtggacgtcacgatcgcagtggcggcggacaagacgagagccgcggtggtggcccaaggggcgtgcgtcgccgagcaatggggcgtgttcctgctcacggaccacgacgtccccgcggagctgctggcgcgcatcgaggaccggatcaccaccatgttcgcgctgccggcggacgacaagatgcgcgccgtgcatgggcctggtgacgcctgcagctatggctccccgcccatctcctccttcaagtgcatgtggtccaagggatacaccttctcgccagacgccagcgatggacagagattggggatgggacgggatgaagtatttccaaactcaaactga

SEQ ID NO: 16711 - protein, 169 aa, Sorghum bicolor
  misc_feature: The sequence is a functional homolog of SEQ ID NO 2 in US patent 7049490
  misc_feature: Ceres ANNOT ID no. 8660721
  misc_feature (55)..(149): SWISSPROT Homolog: EC 1.14.11.15 Gibberellin 3-beta-dioxygenase
MAESAWGAPLPSERSVAPAMAGGCGPDLGASSRQLSLVAWEAGGGEQEQQHEGDPVVDVTIAVAADKTRAAVVAQGACVAEQWGVFLLTDHDVPAELLARIEDRITTMFALPADDKMRAVHGPGDACSYGSPPISSFKCMWSKGYTFSPDASDGQRLGMGRDEVFPNSN

SEQ ID NO: 16712 - DNA, 2310 bp, Sorghum bicolor
  misc_feature: Ceres ANNOT ID no. 8660792
  misc_feature: Encodes the peptide sequence at SEQ ID NO 16713
atgtggagccgcgtgatctggcgcaaccaacagcggtggcgaggagaggccgactgctcgctcaagcgcaagtgcaatgacctctatctcagactctcagtgcgtgtggataggaggagatcggacatggctggtggattgaaggaacccgccatcaaaaaccccggcgccctaccaaaaaaaagggcaaaaccccatcgagagcgagccaaaaactccaagctgctccaagcccgcccgccattcccctcccacaaccccaccccaacgccgccaccgctcaggggtccgaaccttcttgaaccttgcgggaaccccaggggcgaggagcagatgtcggcgaggctaagggtggaggagctccgcgcggcgctgctgagccgcggcctcgatgtctccggcaccaagaacgctctcgtgcggaggctggacgccgcaatctgcaaggacgagaagatcgcggttgctgctgcggcaaccgaggtggcagatgggtatggcgtagccgtagatggtgtgctcgtggatggcaaagggaacggcaggaacaacaagaggaaaaggtccggggatggggatgaagaggggaacggcgatacgtctatagacctggcaaaactagagggcatgagctatcgcgagctgcagggattggctaaggcacggggactcgcagcaaatgggggcaagaaggatgttatccagaggttgctctcagcgactgttgatcctgttgcagttgctgatggtggtcctcagggcgaaaaggaagtcataaaaggtggtgatgaggaggctgaggtgaaaaaggagaagattgttacagccacgaagaagggagctgcagtgctggatcaacacattcctgatcacataaaagtgaactatcatgtcttgcaagtgggtgatgaaatctatgatgccaccttgaaccagactaatgttggagacaacaacaataagttctatatccttcaagttttagaatctgatgctggtggaagcttcatggtttacaatagatggggaagagtaggggcacgaggtcaagataaactacatggtccctttttaacacgagaccaagcaatatatgaatttgaggggaagttccatgacaaaactaataatcattggtctgatcgcaagaacttcaaatgttatgcaaagaaatacacttggcttgaaatggattatggtgaaactaataaagaaatagagaaaggttccattactgatcagataaaagagacaaaacttgaaactagaattgcgcagttcatatccctgatctgcaatattagcatgatgaagcaacaaatggtggaaataggttataatgctgacaagcttccccttggaaagctaagcaaatctacaatacttcagggttatgatgttttgaaaaggatatccaatgttatttcaaaggcagacaggagacagcttgagcaattgactggggaattctacaccgtgattcctcatgactttggtttcagaaagatgcgtgaatttattatcgacactcctcagaaactaaaagctaagctggagatggttgaagcccttggtgagattgaaattgcaactaaacttttggaggatgattccagtgaccaggatgatccgctatatgctcgatacaagcaacttcattgtgatctcgcacctcttgaagctgattcggatgagtactctatgataaaaacatatttgaggaatacacatggaaaaacacactctggttatacggtggacatagtgcaaatatttaatgtttcaaggcatggtgaaacagagcgatttcagaaatttgctagtacaagaaataggatgcttttgtggcatggttctcggttgagcaactggactgggatcctttctcagggtctgcgaatcgctcctcctgaagcacctgttagtggttacatgtttggcaagggtgtttactttgctgacatgttttcaaagagtgcaaactattgctgcgcttcagaagcatgtagatctggagtactgcttttatgtgaggttgcattgggcgatatgaatgagctactaaatgcagattacgatgctaataacctgcccaagggaaaattaagcacgaagggagttggtcaaacagcacctgacatggtcgagtctaagatcactgacgatggtgtggttgttccccttggcaaacctaaacaggaaccttccaaaaggggtggcttgcgttacaatgagtacattgtgtacaacgtagatcagataagaatgcggtatgtcctgcttgttaacttcaacttcaagagacggtag

SEQ ID NO: 16713 - protein, 769 aa, Sorghum bicolor
  misc_feature: Useful for making plants with modulated abiotic stress sensitivity
  misc_feature: Functional homolog of the protein sequence given in SEQ ID NO 14037
  misc_feature: Useful for making plants with altered alkaloid content
  misc_feature: Functional homolog of the protein sequence given in SEQ ID NO 13326
  misc_feature: Ceres ANNOT ID no. 8660792
  misc_feature (129)..(769): SWISSPROT Homolog: EC 2.4.2.30 NAD(+) ADP-ribosyltransferase
  misc_feature (552)..(764): Pfam ID: PARP Pfam Description: Poly(ADP-ribose) polymerase catalytic domain
  misc_feature (417)..(550): Pfam ID: PARP_reg Pfam Description: Poly(ADP-ribose) polymerase, regulatory domain
  misc_feature (301)..(386): Pfam ID: WGR Pfam Description: WGR domain
  misc_feature (113)..(147): Pfam ID: SAP Pfam Description: SAP domain
  misc_feature (207)..(241): Pfam ID: SAP Pfam Description: SAP domain
MWSRVIWRNQQRWRGEADCSLKRKCNDLYLRLSVRVDRRRSDMAGGLKEPAIKNPGALPKKRAKPHRERAKNSKLLQARPPFPSHNPTPTPPPLRGPNLLEPCGNPRGEEQMSARLRVEELRAALLSRGLDVSGTKNALVRRLDAAICKDEKIAVAAAATEVADGYGVAVDGVLVDGKGNGRNNKRKRSGDGDEEGNGDTSIDLAKLEGMSYRELQGLAKARGLAANGGKKDVIQRLLSATVDPVAVADGGPQGEKEVIKGGDEEAEVKKEKIVTATKKGAAVLDQHIPDHIKVNYHVLQVGDEIYDATLNQTNVGDNNNKFYILQVLESDAGGSFMVYNRWGRVGARGQDKLHGPFLTRDQAIYEFEGKFHDKTNNHWSDRKNFKCYAKKYTWLEMDYGETNKEIEKGSITDQIKETKLETRIAQFISLICNISMMKQQMVEIGYNADKLPLGKLSKSTILQGYDVLKRISNVISKADRRQLEQLTGEFYTVIPHDFGFRKMREFIIDTPQKLKAKLEMVEALGEIEIATKLLEDDSSDQDDPLYARYKQLHCDLAPLEADSDEYSMIKTYLRNTHGKTHSGYTVDIVQIFNVSRHGETERFQKFASTRNRMLLWHGSRLSNWTGILSQGLRIAPPEAPVSGYMFGKGVYFADMFSKSANYCCASEACRSGVLLLCEVALGDMNELLNADYDANNLPKGKLSTKGVGQTAPDMVESKITDDGVVVPLGKPKQEPSKRGGLRYNEYIVYNVDQIRMRYVLLVNFNFKRR

SEQ ID NO: 16714 - DNA, 1920 bp, Sorghum bicolor
  misc_feature: Ceres ANNOT ID no. 8660806
  misc_feature: Encodes the peptide sequence at SEQ ID NO 16715
atggaggctgggctgccgcctgaatcgccgccggcaaagacgcaaactgctccctcctcactaggctcattgctcattgattctttcttgccggcagcaaaggaagaaaagcttctacgatctactcgctatagagacgatgtacacaagtcccgctcgtccgccgaaattgttcgtcgttcccttctcccaccaaaaacgttaaacctggcaccggcaacctacccaaaaaccctatctggggcgacccaaaatctgcaactgcgctcctccttccccccgtccaccagccattctcctcccgcggtcccacttcatcgccttcaccgtgcgaggctgctgtcggcggcagccggtgatgctgccgtttcagatgatggtctgcaactccaagacggaaataaagtcacaaaaggtggtggtgggaacatggttactgccacaaagaagggtgctgctgtgctggatcaacacattcctgaccacataaaacaggcctatcatgtcttgcaagtgggtgatcagatctatgatgccaccttgaaccagactaatgtgggtaacaacaacaataagttctatatcatccaggctttagaatctgatgctggtgaacacttcatggtttaccatagatggggtagagtaggagcaggagtccaagataagctacttccctttcaaacacgaggccgagcaatctatgaatttaagaggaagtttcaggaaaaaactagtaacctttggtctaaccgcaaaaattttaaaccttatgcaaataaatacacttggcttgaaacggactacggtgaaactgagaaggaaaccaacaagactgagaagaaaggctccattactaatcggataaaagagacacagctagaaactcgaactgcacaattcatatccctgatttgcgatattagcatgatgaagcagcaaatggtggaaataggttataatgctgataaacttccccttggaaagctaagcaaatctacaatactgaagggttatgatgtcctgaaaaggatatccaatgttatttcaatggcagacaagggacagcttgagcaattgactggggaattctacaccgtgattccacatgactttggtttcagaaagatgagtgaatttattatcgacactcctgagatactaaaagctaagctggaaatggttgaagcactaggtgagattgagattgcaaccaagcttttagaggatgattcaagtgaccaggatgatctgctatatgctcgatacaagcaacttcgttgtgacttcacacctcttgaagctgattcagaagaatactctatgataaaaacatatttgatgaacacccatgaagaaacacactcgggctatactgtggacattgtgcaaatatttaagatgtcacggcatggtgaaacagagcggtttcaaaagtttgctagtacaggaaataggatgcttttgtggcatggttctcggttgagcaactgggcagggatcctttctcagggtctgcgaattgctccccctgaagcactgttcggcaagggtgttcactttgctgatatgttttcaaaaagtgcaaactactgctgcgcttcaaaagcatctagatctggagtcctgcttctatgtgaggttgcattgggcgatatgaatgagctactaaatggagattacaatgctaataacctacccaagggaaagctaagcacaaaaagagttggtcaaatgacgcctgacctaacaacgtctaggaccactgatgatggtgtgcttgttccacttgggaaacctactaaacacgaatcgtccaaaacggcttgcttgcgttacaacgactacatagtgtataatgtagatcagataaaaatgcggtatgccctccatgtcaccttcaacttcaagagatgctag

SEQ ID NO: 16715 - protein, 639 aa, Sorghum bicolor
  misc_feature: Useful for making plants with altered alkaloid content
  misc_feature: Functional homolog of the protein sequence given in SEQ ID NO 13326
  misc_feature: Useful for making plants with modulated abiotic stress sensitivity
  misc_feature: Functional homolog of the protein sequence given in SEQ ID NO 14037
  misc_feature: Ceres ANNOT ID no. 8660806
  misc_feature (144)..(638): SWISSPROT Homolog: EC 2.4.2.30 NAD(+) ADP-ribosyltransferase
  misc_feature (426)..(634): Pfam ID: PARP Pfam Description: Poly(ADP-ribose) polymerase catalytic domain
  misc_feature (291)..(424): Pfam ID: PARP_reg Pfam Description: Poly(ADP-ribose) polymerase, regulatory domain
  misc_feature (172)..(256): Pfam ID: WGR Pfam Description: WGR domain
MEAGLPPESPPAKTQTAPSSLGSLLIDSFLPAAKEEKLLRSTRYRDDVHKSRSSAEIVRRSLLPPKTLNLAPATYPKTLSGATQNLQLRSSFPPSTSHSPPAVPLHRLHRARLLSAAAGDAAVSDDGLQLQDGNKVTKGGGGNMVTATKKGAAVLDQHIPDHIKQAYHVLQVGDQIYDATLNQTNVGNNNNKFYIIQALESDAGEHFMVYHRWGRVGAGVQDKLLPFQTRGRAIYEFKRKFQEKTSNLWSNRKNFKPYANKYTWLETDYGETEKETNKTEKKGSITNRIKETQLETRTAQFISLICDISMMKQQMVEIGYNADKLPLGKLSKSTILKGYDVLKRISNVISMADKGQLEQLTGEFYTVIPHDFGFRKMSEFIIDTPEILKAKLEMVEALGEIEIATKLLEDDSSDQDDLLYARYKQLRCDFTPLEADSEEYSMIKTYLMNTHEETHSGYTVDIVQIFKMSRHGETERFQKFASTGNRMLLWHGSRLSNWAGILSQGLRIAPPEALFGKGVHFADMFSKSANYCCASKASRSGVLLLCEVALGDMNELLNGDYNANNLPKGKLSTKRVGQMTPDLTTSRTTDDGVLVPLGKPTKHESSKTACLRYNDYIVYNVDQIKMRYALHVTFNFKRC

SEQ ID NO: 16716 - DNA, 348 bp, Sorghum bicolor
  misc_feature: Ceres ANNOT ID no. 8660971
  misc_feature: Encodes the peptide sequence at SEQ ID NO 16717
atggcgaggccgacgcgcgcgctcctgctcccgctcccgctcctcatgctcctggcactggcggcgctggcccgcgcgtcgtcgggcgacgtgccagcggcggcgtccctgggctgggacctcggcgtggtgggcgcgggggaggacgaggagttcggcttccccagcggcggcgactccgtggcgcgccgggtgctgcagggcggcggctacctcagctacggcgcgctgcgcagggacaacgtgccttgctccgtccgtggcgcctcctactacaactgccgccccggcgggcaggccaacccctactcccgcggctgctccgccatcacgcgctgccgcggctga

SEQ ID NO: 16717 - protein, 115 aa, Sorghum bicolor
  misc_feature: Useful for making plants with modulated biomass
  misc_feature: Functional homolog of the protein sequence given in SEQ ID NO 13255
  misc_feature: Ceres ANNOT ID no. 8660971
  misc_feature (50)..(115): Pfam ID: RALF Pfam Description: Rapid ALkalinization Factor (RALF)
MARPTRALLLPLPLLMLLALAALARASSGDVPAAASLGWDLGVVGAGEDEEFGFPSGGDSVARRVLQGGGYLSYGALRRDNVPCSVRGASYYNCRPGGQANPYSRGCSAITRCRG

SEQ ID NO: 16718 - DNA, 309 bp, Sorghum bicolor
  misc_feature: Ceres ANNOT ID no. 8662057
  misc_feature: Encodes the peptide sequence at SEQ ID NO 16719
atgttgctcgccaagatgtaccgtgccctgaacgcctcggacatcatggtgggcgtgcacgacatggccatgacgcacttcctattcatgcgcttggcatttggcaccaactgggccactgaggcgtactacgacgagcctgcccaacggctaggtctactctacatgttgtatgaaatcctaccgtccgagagctcgagttgcggatcaatagtaatgttgaaaaccaaaagaatatctttcccacgccggatggtcagcttaacaaaactccacacagtgacaactatcacgctacctctacaatga

SEQ ID NO: 16719 - protein, 102 aa, Sorghum bicolor
  misc_feature: Useful for making plants with altered carbohydrate content
  misc_feature: Functional homolog of the protein sequence given in SEQ ID NO 14415
  misc_feature: Ceres ANNOT ID no. 8662057
MLLAKMYRALNASDIMVGVHDMAMTHFLFMRLAFGTNWATEAYYDEPAQRLGLLYMLYEILPSESSSCGSIVMLKTKRISFPRRMVSLTKLHTVTTITLPLQ

SEQ ID NO: 16720 - DNA, 972 bp, Sorghum bicolor
  misc_feature: Ceres ANNOT ID no. 8662496
  misc_feature: Encodes the peptide sequence at SEQ ID NO 16721
atggctaccagcagtttgacgttcggcgtaatactctcatgcgccctgcttttggccacggcgacccatggtctccaggtgggttactacaagaagacgtgtcccagtgccgaggtcctcgtgagggccgcggtaaagaaggccctgctggctaaccccggcgtcggcgccgggctcatccgcatgctcttccacgactgcttcgtcgagggctgtgacgcgtccgttctgctggacccgacgcaggagaacccgcagccagagaagctggggcgtcccaacaaccccagcctacgaggctacgaggtgatcgacgcggccaagagcgcagtcgagaaagcgtgccctggcacggtgtcttgcgctgacatcgtcgccttcgcggggcgcgacgcgtcctacttgctcagtaactccaaggttagcttccacatgccggcaggccggctggatggacgcaagtcactcgccagcgagacaggtgtattcctgcccggcccgtcctccaacctttccagcctcgtctcagccttcgccggcaaggggctcagcgccgaggacatggtcgtgctctcgggcgcgcactccatcggtcgctcccactgcacctccttcgtccagacccgcctgagcgccccctccgacatcgcggcgtcgctggcgacgttgctgaggaagcagtgccccgccaacccgaccaccgccaacgacgcggtggtgtcccaggacgtggtcagcccggacgtgctggacaaccagttctacaagaacgtgctggcacacaatgtgctcttcacctcggacgccgtgctgctatcggcgcccaacaccgcgaggatggtccgtgccaacgccaggttcgcgggctcctgggagaagaagttcgccaaggccatggtgaagatggccgccattggcgtgaagaccggccgtgacggcgagataaggaagaactgcaggctcgtcaactag

SEQ ID NO: 16721 - protein, 323 aa, Sorghum bicolor
  misc_feature: Useful for making plants with altered carbohydrate content
  misc_feature: Functional homolog of the protein sequence given in SEQ ID NO 13714
  misc_feature: Ceres ANNOT ID no. 8662496
  misc_feature (10)..(323): SWISSPROT Homolog: EC 1.11.1.7 Peroxidase
  misc_feature (41)..(287): Pfam ID: peroxidase Pfam Description: Peroxidase
MATSSLTFGVILSCALLLATATHGLQVGYYKKTCPSAEVLVRAAVKKALLANPGVGAGLIRMLFHDCFVEGCDASVLLDPTQENPQPEKLGRPNNPSLRGYEVIDAAKSAVEKACPGTVSCADIVAFAGRDASYLLSNSKVSFHMPAGRLDGRKSLASETGVFLPGPSSNLSSLVSAFAGKGLSAEDMVVLSGAHSIGRSHCTSFVQTRLSAPSDIAASLATLLRKQCPANPTTANDAVVSQDVVSPDVLDNQFYKNVLAHNVLFTSDAVLLSAPNTARMVRANARFAGSWEKKFAKAMVKMAAIGVKTGRDGEIRKNCRLVN

SEQ ID NO: 16722 - DNA, 96 bp, Sorghum bicolor
  misc_feature: Ceres ANNOT ID no. 8662967
  misc_feature: Encodes the peptide sequence at SEQ ID NO 16723
atgtacaaagtccagtggaatcagtgcaccaaagcggaggctatttgtaatagagaagaggatctaagaaaagcatacccgcattggtttgagtaa

SEQ ID NO: 16723 - protein, 31 aa, Sorghum bicolor
  misc_feature: The sequence is a functional homolog of SEQ ID NO 1584 in the 10/374,780 US patent application
  misc_feature: The sequence is a functional homolog of SEQ ID NO 1586 in the 10/374,780 US patent application
  misc_feature: The sequence is a functional homolog of SEQ ID NO 1585 in the 10/374,780 US patent application
  misc_feature: The sequence is a functional homolog of SEQ ID NO 1583 in the 10/374,780 US patent application
  misc_feature: Ceres ANNOT ID no. 8662967
MYKVQWNQCTKAEAICNREEDLRKAYPHWFE

SEQ ID NO: 16724 - DNA, 174 bp, Sorghum bicolor
  misc_feature: Ceres ANNOT ID no. 8663086
  misc_feature: Encodes the peptide sequence at SEQ ID NO 16725
atggtggatgatacaagtgctgatctcattatcagccagctcctactattggatgcagaagaccagactaaggatattaaattgtttatcaactcacctggaggttctataacagcaggtgtgtgttttctcattttgtcatttcaagagctatattctagagatctctgttag

SEQ ID NO: 16725 - protein, 57 aa, Sorghum bicolor
  misc_feature: Useful for making plants with modulated biomass
  misc_feature: Functional homolog of the protein sequence given in SEQ ID NO 13114
  misc_feature: Ceres ANNOT ID no. 8663086
  misc_feature (2)..(41): SWISSPROT Homolog: EC 3.4.21.92 Endopeptidase Clp
MVDDTSADLIISQLLLLDAEDQTKDIKLFINSPGGSITAGVCFLILSFQELYSRDLC

SEQ ID NO: 16726 - DNA, 735 bp, Sorghum bicolor
  misc_feature: Ceres ANNOT ID no. 8663095
  misc_feature: Encodes the peptide sequence at SEQ ID NO 16727
atggagtccctcgcgacttcgatcgactacggacggcggcgcgtggagggccaggggctttctgtcgcgaacgatggagcatatatgaacctaccattaactgagccttgctcagttccttaccagtcctctatagtcctatactggcgtttgccgtgttatgtcatgacacatcaatttgcaggaatgggagtatatgatgctatgaaattttgcaaagctgatgtctcaactgtttgctttggattggcggcttcaatgggtgcatttttacttgctgctgggacaaagggtaagaggtactgcatgccaaatgcaaggattatgatccatcagccatcaggtggtgctggcgggaaagtcacggagatgggactacagataagagagatgatgtacgagaagattaagatcaataaaataatgtcgagaattactggaaaatctaaagagcagattgatgaagacacaaagtttgattatttcatgagtccttgggaagccaaggattatgggatagttgacagtatcatagatgaggggaaaccagggttggtagctcccttggcaggatctgttcggcctccaaaatcgcgtgtgtggtacttgtggaaggcttcgggcccgaccaggaagatcatgaaacatctaccttcagaggagaaactaattaacaatggtaacggaacagcaactggagatgatgagaagctcaagagggcatcggcaacctga

SEQ ID NO: 16727 - protein, 244 aa, Sorghum bicolor
  misc_feature: Useful for making plants with modulated biomass
  misc_feature: Functional homolog of the protein sequence given in SEQ ID NO 13114
  misc_feature: Ceres ANNOT ID no. 8663095
  misc_feature (61)..(227): SWISSPROT Homolog: EC 3.4.21.92 Endopeptidase Clp
  misc_feature (41)..(181): Pfam ID: CLP_protease Pfam Description: Clp protease
MESLATSIDYGRRRVEGQGLSVANDGAYMNLPLTEPCSVPYQSSIVLYWRLPCYVMTHQFAGMGVYDAMKFCKADVSTVCFGLAASMGAFLLAAGTKGKRYCMPNARIMIHQPSGGAGGKVTEMGLQIREMMYEKIKINKIMSRITGKSKEQIDEDTKFDYFMSPWEAKDYGIVDSIIDEGKPGLVAPLAGSVRPPKSRVWYLWKASGPTRKIMKHLPSEEKLINNGNGTATGDDEKLKRASAT

SEQ ID NO: 16728 - DNA, 1005 bp, Sorghum bicolor
  misc_feature: Ceres ANNOT ID no. 8665608
  misc_feature: Encodes the peptide sequence at SEQ ID NO 16729
atggcccggccgtgcctcctccccttcctggtcgccgccgcggcggtgctcatcacgtgggcgcccggcggcgcgctcggcaagtcgaagttcgccaagaaaagcgacgacgtcgtgaacgggcccctgctgacggacaagatcaaggcgaagaagacgctgatcgttgggcccgacgaggagttcaagacggtgcagtccgccatcgacgccgtgcccgccggcaacaccgagggcaaagttattataccggagaacaagcccttcatcttcgtgaggggtaacggcaaaggccggacctccatctcccacgagtccgcctcttccgacaacgctgagtccgctgccttcaccgtcagcgcggacaacgtcgtcgtcttcggcgtcagcttcaggaacagcgcccgcgtgggtctggtgaacgacccggagatccgttcggtggcagccatggtggaaggagacaaggtggccttctaccactgcgcgttctacagcccccaccacaccctcttcgacagcgccggccgccactactacgagagctgctacatccagggcaacatcgacttcatcttcggcaacggccagtccatgttccagtgcccggagatcttcgtcaagcctgaccggcggacggagatccggggctccatcaccgcgcaggtgcgcgaggaagaggacaccaccggcttcgtcttcctcaagggcaaagtctacggcgtcggcgaggtgtacctgggccgcgtcaccgcgccggactcgcgcgtcatcttctccgacacctacctctccaggaccgtcaacgccgccgggtggaccaccataggctacaccggcagcaccgacaaggtgatgctcgcggagttcaactgcaccgggccgggcgctgacgttacgaatcgcgtgccatggtcgcggcgcttctctcagaacgacgcggccaagtacctgaccatcgacttcatcaacggcaaggaatggctgccggcgtactactactga

SEQ ID NO: 16729 - protein, 334 aa, Sorghum bicolor
  misc_feature: Useful for making plants with altered cell wall content and/or composition
  misc_feature: Functional homolog of the protein sequence given in SEQ ID NO 14416
  misc_feature: Ceres ANNOT ID no. 8665608
  misc_feature (21)..(329): SWISSPROT Homolog: EC 3.1.1.11 Pectinesterase
  misc_feature (53)..(326): Pfam ID: Pectinesterase Pfam Description: Pectinesterase
MARPCLLPFLVAAAAVLITWAPGGALGKSKFAKKSDDVVNGPLLTDKIKAKKTLIVGPDEEFKTVQSAIDAVPAGNTEGKVIIPENKPFIFVRGNGKGRTSISHESASSDNAESAAFTVSADNVVVFGVSFRNSARVGLVNDPEIRSVAAMVEGDKVAFYHCAFYSPHHTLFDSAGRHYYESCYIQGNIDFIFGNGQSMFQCPEIFVKPDRRTEIRGSITAQVREEEDTTGFVFLKGKVYGVGEVYLGRVTAPDSRVIFSDTYLSRTVNAAGWTTIGYTGSTDKVMLAEFNCTGPGADVTNRVPWSRRFSQNDAAKYLTIDFINGKEWLPAYYY

SEQ ID NO: 16730 - DNA, 1128 bp, Sorghum bicolor
  misc_feature: Ceres ANNOT ID no. 8665833
  misc_feature: Encodes the peptide sequence at SEQ ID NO 16731
atggcgagcggcggcgccggcccgtcggggccggtgcggtccacctcccaaacccggcagcggacgatggggcggatacccacgcgcgcctacaccatgcgcccggacggattgtccggtgaggacggccccggttttgaggaggaggagctcgtgccctcgtcgctcgcgcccattgtacccatcctccgggccgccaatgagatcgaggaggagaacccgcgcgtcgcctacctatgtcgctttactgcattcgagaaggctcatcttatggacccaatctcaggtggacgtggagttcggcaattcaaaacatacctcttgcataggcttgaaaaggatgaacatgagacaaatcgcaggcttgctacaactgatgcaaaggagatacaaaggttctatgagcaatactgtaaaaaatatctagaggaaggtcatgacaagaggaaaccggaggagatggctagacactatcagattgcatctgtcctatatgatgttctgaaaactgttacacctggcaagaatgagtatgataagtatgctaaaggggttgaaaaggagaaagcatccttctcacagtacaatattctaccacttaatatttctactccaagacaaccaataatggaaattcctgagatcaaagcagcagtggcgctccttcgtcagatggatgaccttccaatgccaaggattgaattaacacaaagctctgatggaaaaacagtgcctgatgaaatggacaaacctttggtccaggatttgcttgattggctttggcaaacatttggatttcagaaaggcaatgtcgagaaccaaaaggagcatttgattttgctccttgcaaacattgacatgagacaacagggtacttcccaccatagtgggagacatgttcacgtgatacatagtagcacggtgatatatttgatggacaaaattttccagaattacaactcctggtgtcgatatttgcatctggattcaaacattataatcgcaagcgatgcctccacacaacggccagagcttctatacataggactgtatttactgatatggggtgaagcttccaacgttcgcttcatgcctgaatgtctttgctacatcttccaccatgcatag

SEQ ID NO: 16731 - protein, 375 aa, Sorghum bicolor
  misc_feature: Useful for making plants with altered cell wall content and/or composition
  misc_feature: Functional homolog of the protein sequence given in SEQ ID NO 14417
  misc_feature: Ceres ANNOT ID no. 8665833
MASGGAGPSGPVRSTSQTRQRTMGRIPTRAYTMRPDGLSGEDGPGFEEEELVPSSLAPIVPILRAANEIEEENPRVAYLCRFTAFEKAHLMDPISGGRGVRQFKTYLLHRLEKDEHETNRRLATTDAKEIQRFYEQYCKKYLEEGHDKRKPEEMARHYQIASVLYDVLKTVTPGKNEYDKYAKGVEKEKASFSQYNILPLNISTPRQPIMEIPEIKAAVALLRQMDDLPMPRIELTQSSDGKTVPDEMDKPLVQDLLDWLWQTFGFQKGNVENQKEHLILLLANIDMRQQGTSHHSGRHVHVIHSSTVIYLMDKIFQNYNSWCRYLHLDSNIIIASDASTQRPELLYIGLYLLIWGEASNVRFMPECLCYIFHHA

SEQ ID NO: 16732 - DNA, 2493 bp, Sorghum bicolor
  misc_feature: Ceres ANNOT ID no. 8665834
  misc_feature: Encodes the peptide sequence at SEQ ID NO 16733
atggccgccgcgccagtcgcgctgcccttgctcctgctggcggcgctcgctgccgccgcggcggtcgcgagcgcaaccaccgtcgcatacaacgaccgtgcggtggtcatcgacggccagcgccgcattatcctatcagggtccatccattaccccaggagcacgccacagatgtggcccgatctcatcaacaaggctaaggaaggcggcctcaacaccatcgaaacgtacgtcttctggaacggccacgagccgcgccgccgccagtacaactttgagggaaactacgacatcgtgaggttcttcaaagagatccagaacgctggaatgcacgctattcttcgaattggtccctacatctgtggggaatggaactatggaggccttcctgcatggctgcgtgacatccccggaatgcagttcaggttgcacaatgacccctttgagcgcgagatggagaccttcaccaccctcattgtcaacaagatgaaggacgccaacatgttcgcaggacagggaggcccaatcatccttgctcagatcgagaacgagtatggaaacatcatgggaaaactcgagaacaaccagtctgcctcgcaatacatccactggtgtgccgacatggctaataagcaaaagattggtgtcccctggatcatgtgccagcaggacaacgatgtgccacacaacgtgatcaacacctgcaatggtttctattgctacgactggttcccgaataggaccggcattccaaagatatggacagaaaattggactggctggttcaaagcctgggataagccggatttccatagatctgctgaggacattgctttcgcggtcgccatgttcttccagaagcgtggatcggtccataactactacatgtaccatggaggaaccaatttcggacgcacttctggtggcccgtacatcacaaccagctatgactacgatgcgcctttggacgagtatggtaacattaggcagcccaaatacgggcacctgaaggatctccacaacttgctcaagtccatggagaaaatccttgtccatggagagtacaaagacacaagtcatggcaagaatgtcacggtcaccaagtacacgtatggtggttcctcggtttgcttcatcagcaaccagttcgatgacagggatgtgaacgtgaccctcgccggaactcacctcgttccggcatggtcggtcagcatcttgccggactgcaagactgttgcctacaacacggcaaagatcaagacgcagacatcggtgatggtgaagaaggccaactcggtggagaaggagccggaggccttgagatggtcttggatgccagagaacctcaagcccttcatgacggacgaccatggcagcttcaggcagtcccggctcttggagcagatcgccacgtccactgatcagagcgactacttgtggtaccggacaagccttgagcacaagggagagggaagttacacgctgtatgtgaacacaactgggcataagatctacgcttttgtcaacggaaagcttgtcgggcaaaaccaatcgtccaacggagcgttcgtattccagctccagtctccggtgaagctccactccgggaagaactacgtttctctcctgagcggcaccgtcggcctcaagaactacggacctttgtttgagcttgtgccggcgggcatcgccggaggaccagttaagcttgtgggggcaaacgacaccgccattgatctcacccacagctcttggtcttacaagtctgggttggccggtgagcacaggcagatccacctggacaagcccggctacaagtggcggagccacaacggcagcggcagcatcccggtgaaccggcccttcacgtggtacaagaccaccttcgcggctccggccggcgacgaggccgtggtggtggacctgctgggcctcaacaagggcgcggcatgggtgaacggcaacagcctgggccggtactggccgtcgtacacggcggcggagatgggcgggtgccacggcgcctgcgactaccggggcaagttcaaagccgagggcgacggcatccggtgcctgacggggtgcggcgagccgtcgcagcggttctaccacgtgccccgctccttcctccgcgccggcgagcccaacacgctggtgctcttcgaggaggccggcggcgacccggcgcgcgccgcgttccacaccgtcgccgtggggcacgtgtgcgtggcggccgccgaggtcggggacgacgtcacgctgtcgtgcggcggcggcctcggcgggggcgtcgtcgccagcgtcgacgtcgcaagcttcggcgtcacccggggcggctgcggcgactaccagggcggctgcgagtccaaggccgcgctcaaggcgttcagggacgcgtgcgtcggcagggagtcgtgcacggtcaagtacacacccgcgttcgccggcccagggtgccagtcaggcaagctcaccgtgcaggccacctgctga

SEQ ID NO: 16733 - protein, 830 aa, Sorghum bicolor
  misc_feature: Useful for making plants with altered cell wall content and/or composition
  misc_feature: Functional homolog of the protein sequence given in SEQ ID NO 14418
  misc_feature: Ceres ANNOT ID no. 8665834
  misc_feature (30)..(830): SWISSPROT Homolog: EC 3.2.1.23 Beta-galactosidase
  misc_feature (34)..(343): Pfam ID: Glyco_hydro_35 Pfam Description: Glycosyl hydrolases family 35
  misc_feature (754)..(830): Pfam ID: Gal_Lectin Pfam Description: Galactose binding lectin domain
MAAAPVALPLLLLAALAAAAAVASATTVAYNDRAVVIDGQRRIILSGSIHYPRSTPQMWPDLINKAKEGGLNTIETYVFWNGHEPRRRQYNFEGNYDIVRFFKEIQNAGMHAILRIGPYICGEWNYGGLPAWLRDIPGMQFRLHNDPFEREMETFTTLIVNKMKDANMFAGQGGPIILAQIENEYGNIMGKLENNQSASQYIHWCADMANKQKIGVPWIMCQQDNDVPHNVINTCNGFYCYDWFPNRTGIPKIWTENWTGWFKAWDKPDFHRSAEDIAFAVAMFFQKRGSVHNYYMYHGGTNFGRTSGGPYITTSYDYDAPLDEYGNIRQPKYGHLKDLHNLLKSMEKILVHGEYKDTSHGKNVTVTKYTYGGSSVCFISNQFDDRDVNVTLAGTHLVPAWSVSILPDCKTVAYNTAKIKTQTSVMVKKANSVEKEPEALRWSWMPENLKPFMTDDHGSFRQSRLLEQIATSTDQSDYLWYRTSLEHKGEGSYTLYVNTTGHKIYAFVNGKLVGQNQSSNGAFVFQLQSPVKLHSGKNYVSLLSGTVGLKNYGPLFELVPAGIAGGPVKLVGANDTAIDLTHSSWSYKSGLAGEHRQIHLDKPGYKWRSHNGSGSIPVNRPFTWYKTTFAAPAGDEAVVVDLLGLNKGAAWVNGNSLGRYWPSYTAAEMGGCHGACDYRGKFKAEGDGIRCLTGCGEPSQRFYHVPRSFLRAGEPNTLVLFEEAGGDPARAAFHTVAVGHVCVAAAEVGDDVTLSCGGGLGGGVVASVDVASFGVTRGGCGDYQGGCESKAALKAFRDACVGRESCTVKYTPAFAGPGCQSGKLTVQATC

SEQ ID NO: 16734 - DNA, 4182 bp, Sorghum bicolor
  misc_feature: Ceres ANNOT ID no. 8665845
  misc_feature: Encodes the peptide sequence at SEQ ID NO 16735
atggctgccactgcagccaccagcccaccaccgtgggcacaggtgctcttctctaactatttttccttttttttacagcgcagtacagcaagaaagcccaagaccaattttgttgaagtacgcacatttctgcacatatttagaagttttaatcgaatgtggatgttttttatacttgctttccaggcaatgctcatagtttcatggagttcttctggatctctttctggaattactgatggaactgttttcagaaatgtcttaagtgtttttatcacagcagctctactcaactttataacagtaactctggatataatgtttactgtgcaagcctggggcagtatggagtggacaaagatagccagatatttactaaaatttgttgtggccattgcttggataattattcttccattgacctattctagttccatcaaatacccatctggtgctggcaaaatcctaaatagttggattgggaattggtataatgaatcagtttataacattgcgattgtcatatatatggttccggatattcttgctgccttgtttttcttgttgccacaacttcagaatgtcatggagcgctcaaattcgcgagtgttggttctcctgatgtggtggattcagccaagattgtatgttggacgtgggatgcacgaagatatattgtcgatccttaagtatgtcttcttttgggctgtgctgctcatctccaagcttgcattcagtttctatgttgagatatcaccattgattgatccaactaagttcattcttgatcaacaagttgggaactacgaatggcatcaaatcttccctttcttgccacgcaacctgggtgttgtcattaccatatgggcaccgattgtcatggtttactttatggacacacaaatatggtatgccattttttccactgtcttcggaggtgtttcaggtgccctaagtcatgtgggtgagccaatgcctcaagacgctgaacaaattgcagccagttgtttgtatttgactaattgtgtcattcttgactgccagcaagcatttgagcacagaagcttcttttgcgtttggaattcattcatcaattccttaagagaggaagacttcattagtgacagagagaaggacatgttgattgctccatcatattcaagcaatttatctatcattcagtggccacctttcctccttgctagcaaggtacccgcagctgtccatatggccatgaattccaaagaaggggatgagcatgagcttattgagaaagtcaaacttgatcgagacagatacaatgcagttatagaatgctacgaatccttgatgattatactcaatagccttctactagactctaatgatcagaatattgtcaatgatattgatagaaaagtgacttatagcatgagaaataaaacattcttggaagacttcgaaatggcagaaatcggcaaaaagagtgaacctattaatgatgttgaagagaggaaaattgttaatgccttgcaagattttatggaaattacgacgcgtgattttatgaaagatggacagagcattttgaaagatgagaatgagagaaagcaaaggttcatgaatctaaatattaatatgataaaggaagattcttggagggagaagtttgtccggctgcacttattgttgactatgaaggattctgcaatggatgttccaacaaacttggatgctcgccgtaggatcaccttctttgcaaactcgctttttatgaaaatgccaagagcaccatgtgtgcatgatatgatttcatttagtgttctaacaccatactacaacgaagaagtactctattcatcacatgaactgaatagaaagaatgaagatggtatctcaattttgttctacctacaaaagatctatccagatgaatggaagaacttcctagaacgtattggagttgagccagataatgaagtgtcaataaaagggcacatggatgatatccgtttatgggcatcttaccgtggtcaaacgcttgccagaactgtgagaggaatgatgtactacagacgagctctcgaactacaatgctacgaggatatgataaatgaccaaggttatgggttagctgatttggatagagctaaggctgttaggtccaaggccattgctgatattaaatttacttatgttgtctcctgtcaactctatggcgtgcataaggcatccaaggattctcgagaaaaaggtctctatgagaacatcttaaacctcatgctgacgtatccagcattgcgcattgcttacatcgatgagaaagaagtacaattacaaaatggcaaaatagagaaacaatattactctgttcttgtgaaaggtgatgatgaggaaatctaccggataaggctccctggtaaaccaacagaagttggagaaggcaagcctaataatcaaaatcatgccataatcttcactagaggagaagcacttcaagcaattgacatgaaccaggataactatctagaggaagcatttaaaatgagaaatctcttggaagagttccttcttacacatggaaagtcagagcccaccatattgggtgttcgggagcatatatttacaggaagccaggagaccagcttcgtcactatcggacaacgtgttcttgccaaccctcttaaggtacgattccattatggccatcctgatgtttttgatagactctttcacctgacaaggggtggcataagcaaggcatcaaaggttatcaaccttagcgaggatatatttgccgggttcaattcaaccctgcgtcaaggaaatgttacgcatcatgaatacatacaattgggcaaagggcgtgatgttggaatgaaccaaatatccaactttgaggccaaggtggcaaacggaaatggtgaacaaacattatgtcgtgatatttatcgactaggacacagatttgatttctacaggatgctgtctctgtattttaccacagttggcttctacttcaatagcatggtggctgttctcacagtgtatgtatttttatatgggaggttataccttgttttgagtggcttagaaaagtcaatactccaagatccaaatatccaaaacatcaaaccgtttgaaaatgcacttgctactcaatctgtattccaacttgggatgttgctcgttctcccaatgatgatggaggttggcctggagaaaggatttggcagagcactggcagagtttgtgattatgcaacttcagctagctcctgtattcttcacttttcatcttggaacaaagactcactactatggcaggacaatacttcacggtggagcaaagtatagagctactgggagagggtttgttgtgcggcatgcgaagttcgctgagaattatcggatgtactcccggagtcactttgtgaaagcactggagctgcttattcttttggttgtttacctagcatatgggagttcatacagaagctcaagtttgtatctgtacgtcactgtttcgatatggttccttgttttctgttggctgtttgcaccttttattttcaacccatcctgctttgagtggcacaagactgttgatgactggattgactggtggaagtggatgggcaatagaggtggtattggattagcacctgagcaaagttgggaggcttggtgggtgagtgaacatgaccacctgaggaatgcaacaattcgaagcttgctcttggagttcatcctttccctgcgattcttgatctatcaatatggtattgtttaccacttgcacatagtgcatgttgctcttgtgtcgctaaaggttgtttcattgggaagagagaagtttgttacaaggtttcaactagtgttccgcatcctcaagggcattgtgttccttgtgctcatcggtttgcttgtccttttatttgttggttttgatctcgctgtcgcggacgttggcgccagtatcttggcattcattcccactgggtggtttattcttctggagatggcgaggatgtacgagtacaccatggggctcctcatcttcctgcccattgctgtgctttcatggttccccttcgtctctgagttccagacacggctgctcttcaaccaggccttcagcaggggactgcagatctctaggatcctcgctgggcagaacggtagcggcacaaggagcgactga

SEQ ID NO: 16735 - protein, 1393 aa, Sorghum bicolor
  misc_feature: Useful for making plants with altered cell wall content and/or composition
  misc_feature: Functional homolog of the protein sequence given in SEQ ID NO 14417
  misc_feature: Useful for making plants with altered carbohydrate content
  misc_feature: Functional homolog of the protein sequence given in SEQ ID NO 14257
  misc_feature: Ceres ANNOT ID no. 8665845
  misc_feature (860)..(1210): SWISSPROT Homolog: EC 2.4.1.34 1,3-beta-glucan synthase
  misc_feature (566)..(1319): Pfam ID: Glucan_synthase Pfam Description: 1,3-beta-glucan synthase component
MAATAATSPPPWAQVLFSNYFSFFLQRSTARKPKTNFVEVRTFLHIFRSFNRMWMFFILAFQAMLIVSWSSSGSLSGITDGTVFRNVLSVFITAALLNFITVTLDIMFTVQAWGSMEWTKIARYLLKFVVAIAWIIILPLTYSSSIKYPSGAGKILNSWIGNWYNESVYNIAIVIYMVPDILAALFFLLPQLQNVMERSNSRVLVLLMWWIQPRLYVGRGMHEDILSILKYVFFWAVLLISKLAFSFYVEISPLIDPTKFILDQQVGNYEWHQIFPFLPRNLGVVITIWAPIVMVYFMDTQIWYAIFSTVFGGVSGALSHVGEPMPQDAEQIAASCLYLTNCVILDCQQAFEHRSFFCVWNSFINSLREEDFISDREKDMLIAPSYSSNLSIIQWPPFLLASKVPAAVHMAMNSKEGDEHELIEKVKLDRDRYNAVIECYESLMIILNSLLLDSNDQNIVNDIDRKVTYSMRNKTFLEDFEMAEIGKKSEPINDVEERKIVNALQDFMEITTRDFMKDGQSILKDENERKQRFMNLNINMIKEDSWREKFVRLHLLLTMKDSAMDVPTNLDARRRITFFANSLFMKMPRAPCVHDMISFSVLTPYYNEEVLYSSHELNRKNEDGISILFYLQKIYPDEWKNFLERIGVEPDNEVSIKGHMDDIRLWASYRGQTLARTVRGMMYYRRALELQCYEDMINDQGYGLADLDRAKAVRSKAIADIKFTYVVSCQLYGVHKASKDSREKGLYENILNLMLTYPALRIAYIDEKEVQLQNGKIEKQYYSVLVKGDDEEIYRIRLPGKPTEVGEGKPNNQNHAIIFTRGEALQAIDMNQDNYLEEAFKMRNLLEEFLLTHGKSEPTILGVREHIFTGSQETSFVTIGQRVLANPLKVRFHYGHPDVFDRLFHLTRGGISKASKVINLSEDIFAGFNSTLRQGNVTHHEYIQLGKGRDVGMNQISNFEAKVANGNGEQTLCRDIYRLGHRFDFYRMLSLYFTTVGFYFNSMVAVLTVYVFLYGRLYLVLSGLEKSILQDPNIQNIKPFENALATQSVFQLGMLLVLPMMMEVGLEKGFGRALAEFVIMQLQLAPVFFTFHLGTKTHYYGRTILHGGAKYRATGRGFVVRHAKFAENYRMYSRSHFVKALELLILLVVYLAYGSSYRSSSLYLYVTVSIWFLVFCWLFAPFIFNPSCFEWHKTVDDWIDWWKWMGNRGGIGLAPEQSWEAWWVSEHDHLRNATIRSLLLEFILSLRFLIYQYGIVYHLHIVHVALVSLKVVSLGREKFVTRFQLVFRILKGIVFLVLIGLLVLLFVGFDLAVADVGASILAFIPTGWFILLEMARMYEYTMGLLIFLPIAVLSWFPFVSEFQTRLLFNQAFSRGLQISRILAGQNGSGTRSD

SEQ ID NO: 16736 - DNA, 201 bp, Sorghum bicolor
  misc_feature: Ceres ANNOT ID no. 8665846
  misc_feature: Encodes the peptide sequence at SEQ ID NO 16737
atggccaaacagttgcatgacatggttgatgaaaactattttcaaccaccaccagggtttgaggaagagggatcatttctgaaaaatgtcgttgaacctatctttaaggttctgcaaaaagaagcacacaaaggtagagggggtacagtaggccactcagcttggagaaattatgacgacctgaatgaaatattttggtaa

SEQ ID NO: 16737 - protein, 66 aa, Sorghum bicolor
  misc_feature: Useful for making plants with altered cell wall content and/or composition
  misc_feature: Functional homolog of the protein sequence given in SEQ ID NO 14417
  misc_feature: Ceres ANNOT ID no. 8665846
MAKQLHDMVDENYFQPPPGFEEEGSFLKNVVEPIFKVLQKEAHKGRGGTVGHSAWRNYDDLNEIFW

SEQ ID NO: 16738 - DNA, 777 bp, Sorghum bicolor
  misc_feature: Ceres ANNOT ID no. 8665960
  misc_feature: Encodes the peptide sequence at SEQ ID NO 16739
atggacaagaacaagacggcgatcatccctgcttctacgtgggtgaagcagctggctttcaagatccgcaagagagggttcgtcgcctacaacgacacgagccttctcatcagcaactcccttggcatatggtcctgccgccgccgccggtacgtcaagaagaggcgtttccaccgtttcactcagctcaagccccaggccttgccggtggagaggcggtacgccgagctgcggaagctcggcatgcactcgtggcccgagtacgacgagcaggtcgcgttgttgaggagcaggctggtggacatatactgggacgccgcgccaacgtggtacagagaggatgtcgtcgactactaccacgcggcgaggcgccggcggatgcaggactcctgggtcatgcgcttcatcttcgcccctatcggcctagtcacgcttgccgtgacaagctttctattagtcaagaaggcgttcttggcagaccgagtagacatgctactcttcacagtcttctatatacttcaggccaggatgttctccggcgactggacgccgccgtgcggcagctgctgcaccaagaagtacgcgagcctcgtgcagatcccatggagggtgttctgcaagaaggggtgcaacgcggacggcgacacctgggacgagtgcataggaaaatgtactgaaatatgctacaaagatccggtgttagaagatcgccagtggagatctccagggcaggatagttattttagggctgttagcagcgcattgaatgatatctaa

SEQ ID NO: 16739 - protein, 258 aa, Sorghum bicolor
  misc_feature: Useful for making plants with modulated nitrogen use efficiency
  misc_feature: Functional homolog of the protein sequence given in SEQ ID NO 14299
  misc_feature: Ceres ANNOT ID no. 8665960
MDKNKTAIIPASTWVKQLAFKIRKRGFVAYNDTSLLISNSLGIWSCRRRRYVKKRRFHRFTQLKPQALPVERRYAELRKLGMHSWPEYDEQVALLRSRLVDIYWDAAPTWYREDVVDYYHAARRRRMQDSWVMRFIFAPIGLVTLAVTSFLLVKKAFLADRVDMLLFTVFYILQARMFSGDWTPPCGSCCTKKYASLVQIPWRVFCKKGCNADGDTWDECIGKCTEICYKDPVLEDRQWRSPGQDSYFRAVSSALNDI

SEQ ID NO: 16740 - DNA, 906 bp, Sorghum bicolor
  misc_feature: Ceres ANNOT ID no. 8666018
  misc_feature: Encodes the peptide sequence at SEQ ID NO 16741
atggtggggggtggtggcggtggcggcggcggggcgctgcggcgggtgggcaagtacgaggtgggacgcaccatcggggaaggcaccttcgccaaggtcaagttcgcgcagaacaccgagaccggggagagcgtcgccatgaaggtgctcgaccgctcctccatcctcaagcacaagatggccgaacagattaagagagagatatccataatgaagcttgtcaggcatcccaatgtcgttaggctacacgaggttttggcaagccggaagaagatatttatcattctggagttcatcactggtggcgagctattcgataaaattattcgtcatgggagactcaatgaagcagatgcacgcagatactttcagcagcttattgatggtgttgatttttgtcacaagaaaggagtctaccatcgagacttaaagcccgaaaatctcctccttgattcccagggcaatcttaaaatttcagactttggactgagtgcatggcctgctcagggatcttctcttctacgtacgacctgtgggaccccgaactatgttgccccagaggttctcagtcataagggatataatggcgcgcttgctgatacatggtcatgtggagttattctatatgtattgttagcaggttatcttccatttgatgaagtggacttgactaccctttatggaaagattgagagtgcagaatattcattcccagcctggttttcaggtggtgcaaaatcactgattcgtagaattcttgacccaaatccagagaagcgaatcaggatagaagagatcagaaacgatgaatggtttcagaagaattatgaacctatcaaagaaatagaaaatgaggaagtcaatctcgatgatgtcaatgcagcttttgatgatcctgaggtatag

SEQ ID NO: 16741 - protein, 301 aa, Sorghum bicolor
  misc_feature: Useful for making plants with modulated salt sensitivity
  misc_feature: Functional homolog of the protein sequence given in SEQ ID NO 14255
  misc_feature: Useful for making plants with modulated biomass
  misc_feature: Functional homolog of the protein sequence given in SEQ ID NO 14256
  misc_feature: Ceres ANNOT ID no. 8666018
  misc_feature (13)..(300): SWISSPROT Homolog: EC 2.7.11.1 Non-specific serine/threonine protein kinase
  misc_feature (19)..(272): Pfam ID: Pkinase Pfam Description: Protein kinase domain
MVGGGGGGGGGALRRVGKYEVGRTIGEGTFAKVKFAQNTETGESVAMKVLDRSSILKHKMAEQIKREISIMKLVRHPNVVRLHEVLASRKKIFIILEFITGGELFDKIIRHGRLNEADARRYFQQLIDGVDFCHKKGVYHRDLKPENLLLDSQGNLKISDFGLSAWPAQGSSLLRTTCGTPNYVAPEVLSHKGYNGALADTWSCGVILYVLLAGYLPFDEVDLTTLYGKIESAEYSFPAWFSGGAKSLIRRILDPNPEKRIRIEEIRNDEWFQKNYEPIKEIENEEVNLDDVNAAFDDPEV

SEQ ID NO: 16742 - DNA, 588 bp, Sorghum bicolor
  misc_feature: Ceres ANNOT ID no. 8666020
  misc_feature: Encodes the peptide sequence at SEQ ID NO 16743
atgggcctgcattacacatactccaacaatagcaagggattgcaaaacttttgtagtggcaaatatttgattgacgatactgaggatgcttttgaagatgaagcaggtcctctgacacttaatgcatttgacctaatcattctttcgcaaggattgaatcttgcagcgctctttgatcgcagacaggactatgacaagcttcaaaatagattcttatcacgcaatccagcaaaggtcatcttgtcaagcatggaggttgttgcacaatcaatggggtttaagacacacattcgcaattataagatgagggtggaaggtctgagtgccgataagactagttatctctcagttatggttgaagtttttgaagttgctccatcaatcttcatggtagaactacaaagagcagcaggggatacttcagagtataacacgttcgtgaataactactgcagcaaattagatgatatcatctggaaatttccaactgaaaagggaaaatcaaggatgccccggttatcaaagtgcgaatttgtcctcaacattcatcatttgtattttcctcatacctgtatcattcatttctaa

SEQ ID NO: 16743 - protein, 195 aa, Sorghum bicolor
  misc_feature: Useful for making plants with modulated salt sensitivity
  misc_feature: Functional homolog of the protein sequence given in SEQ ID NO 14255
  misc_feature: Ceres ANNOT ID no. 8666020
  misc_feature (20)..(172): SWISSPROT Homolog: EC 2.7.11.1 Non-specific serine/threonine protein kinase
  misc_feature (36)..(97): Pfam ID: NAF Pfam Description: NAF domain
MGLHYTYSNNSKGLQNFCSGKYLIDDTEDAFEDEAGPLTLNAFDLIILSQGLNLAALFDRRQDYDKLQNRFLSRNPAKVILSSMEVVAQSMGFKTHIRNYKMRVEGLSADKTSYLSVMVEVFEVAPSIFMVELQRAAGDTSEYNTFVNNYCSKLDDIIWKFPTEKGKSRMPRLSKCEFVLNIHHLYFPHTCIIHF

SEQ ID NO: 16744 - DNA, 528 bp, Sorghum bicolor
  misc_feature: Ceres ANNOT ID no. 8666026
  misc_feature: Encodes the peptide sequence at SEQ ID NO 16745
atggcggcggcggacgatactgaggatgcttttgaagatgaagcaggtcctctgacacttaatgcatttgacctaatcattctttcgcaaggattgaatcttgcagcgctctttgatcgcagacaggactatgacaagcttcaaaatagattcttatcacgcaatccagcaaaggtcatcttgtcaagcatggaggttgttgcacaatcaatggggtttaagacacacattcgcaattataagatgagggtggaaggtctgagtgccgataagactagttatctctcagttatggttgaagtttttgaagttgctccatcaatcttcatggtagaactacaaagagcagcaggggatacttcagagtataacacgttcgtgaataactactgcagcaaattagatgatatcatctggaaatttccaactgaaaagggaaaatcaaggatgccccggttatcaaagtgcgaatttgtcctcaacattcatcatttgtattttcctcatacctgtatcattcatttctaa

SEQ ID NO: 16745 - protein, 175 aa, Sorghum bicolor
  misc_feature: Useful for making plants with modulated salt sensitivity
  misc_feature: Functional homolog of the protein sequence given in SEQ ID NO 14255
  misc_feature: Ceres ANNOT ID no. 8666026
  misc_feature (16)..(152): SWISSPROT Homolog: EC 2.7.11.1 Non-specific serine/threonine protein kinase
  misc_feature (16)..(77): Pfam ID: NAF Pfam Description: NAF domain
MAAADDTEDAFEDEAGPLTLNAFDLIILSQGLNLAALFDRRQDYDKLQNRFLSRNPAKVILSSMEVVAQSMGFKTHIRNYKMRVEGLSADKTSYLSVMVEVFEVAPSIFMVELQRAAGDTSEYNTFVNNYCSKLDDIIWKFPTEKGKSRMPRLSKCEFVLNIHHLYFPHTCIIHF

SEQ ID NO: 16746 - DNA, 1032 bp, Sorghum bicolor
  misc_feature: Ceres ANNOT ID no. 8666164
  misc_feature: Encodes the peptide sequence at SEQ ID NO 16747
atgaagaagggctcaatgatggccttgttggtccctctggctgttgcgctcctcttgtcaggtccatcgtcgttggcaacggcggcatccggcggcggcggccctgtggagtgggggaagctggacccgcacttctacgaccagtcgtgccctcacgcgcagcacatcgtggcgtccatcgtggggaaggcgcattaccaggacccgcgcatggccgcctccctcctccgcctccacttccacgactgcttcgtcaagggctgcgacgcgtcgctgctgctggacagcagcgggtccatcgtgagcgagaagcggtccaaccccaacaaggactccgccaggggcttcgaggtcatcgacgagatcaaggccgctctcgaggctgcctgcccgggaaccgtctcctgcgccgacatcctcgcgcttgctgcccgcgactccacagtcatgactggcgggcctggttggatcgtgccgctggggcggagggactcccgtggcgccagcgtgcagggctccaacaacgacatcccggctcccaacaacactctgcccaccatcatcaccaagttcaagctccagggcctcgacatcgtcgacctcgtcgcactcctcggtagccacaccatcggcgactcccggtgcaccagcttccggcagcgcctgtacaaccagacgggcaacggcctcccagacttcaccctagacgcgtcctacgcggcgacgctacgcccacgctgcccgcgctcggggggtgaccagaacctcttcttcctcgaccccatcacgccctttaagtttgacaaccagtactacaagaacatcctcgcctaccatggcctcctcagctccgatgaggtgctcctcaccggcagccccgctactgccgaccttgtcaagctctatgctgccaaccaggatatcttcttccagcacttcgcgcagtccatggtcaagatgggcaacatctcgccgctcacgggggccaatggcgagatcagaaagaactgcaggagggttaaccacagctga

SEQ ID NO: 16747 - protein, 343 aa, Sorghum bicolor
  misc_feature: Useful for making plants with altered cell wall content and/or composition
  misc_feature: Functional homolog of the protein sequence given in SEQ ID NO 13819
  misc_feature: Useful for making plants with altered carbohydrate content
  misc_feature: Functional homolog of the protein sequence given in SEQ ID NO 13815
  misc_feature: Useful for making plants with modulated nitrogen use efficiency
  misc_feature: Functional homolog of the protein sequence given in SEQ ID NO 13820
  misc_feature: Useful for making plants with modulated light quality response
  misc_feature: Functional homolog of the protein sequence given in SEQ ID NO 13816
  misc_feature: Ceres ANNOT ID no. 8666164
  misc_feature (39)..(343): SWISSPROT Homolog: EC 1.11.1.7 Peroxidase
  misc_feature (57)..(305): Pfam ID: peroxidase Pfam Description: Peroxidase
MKKGSMMALLVPLAVALLLSGPSSLATAASGGGGPVEWGKLDPHFYDQSCPHAQHIVASIVGKAHYQDPRMAASLLRLHFHDCFVKGCDASLLLDSSGSIVSEKRSNPNKDSARGFEVIDEIKAALEAACPGTVSCADILALAARDSTVMTGGPGWIVPLGRRDSRGASVQGSNNDIPAPNNTLPTIITKFKLQGLDIVDLVALLGSHTIGDSRCTSFRQRLYNQTGNGLPDFTLDASYAATLRPRCPRSGGDQNLFFLDPITPFKFDNQYYKNILAYHGLLSSDEVLLTGSPATADLVKLYAANQDIFFQHFAQSMVKMGNISPLTGANGEIRKNCRRVNHS

SEQ ID NO: 16748 - DNA, 1290 bp, Sorghum bicolor
  misc_feature: Ceres ANNOT ID no. 8666253
  misc_feature: Encodes the peptide sequence at SEQ ID NO 16749
atggtggcctcctgttcctattcttcgtctcgcgccgccgctgcccgccacctcgtgcgcctcctgctcgtcgggcttcttcttgccgccggctggggctgggccaccgcggcgaagaacgacacgcagacgttccggcccggcgacgagctccggcggtacaggaaggtgcaggcgctgctcaagaggctcaacaagccggcgctccggaccatccagagccccgacggcgacctcatcgactgcgtggcggcgcacctgcagccagccttcgaccacccaaggctgcgcgggcagaggccactggcggacccgccggcgaggcccaagggactccaccaccgcagccgcttccccagcaatgacaccaccgcggacgccggcgtccagctgtgggcgtcgtccggggaggcgtgcccggaggggtccgtgcccatcaggcgcgtcacggagaaggacgtgctccgcgccagctccgtcaggcggttcggcagggcgcccgcaggcagggtgcggcgcgactccgtctccggcggccacgagcacgcggtggggtacgtggccggcgacgagtactacggcgccaaggcgagcatcaacgtgtgggcgccgcaggtgagcacggcgtcggagttcagcctgtcgcagatctgggtcatcgcggggtccttcggcaacgacctcaacaccatcgaggcagggtggcaggtcagcccgcagctctacggggacaacgcgccaaggttcttcacgtactggacgacggacgcgtaccagaccacggggtgctacaacctcctctgctccggcttcatccagaccaacagccgcatcgccatgggcgccgccatctcgcccacctccgcctacaacgccggccagttcgacatcagcctgctcgtctggaaggacccgaaccacggcaactggtggctggagttcggctccggcgagctggtggggtactggccgtcgctgctgttcagccacctggcgtcgcacgcgagcatggtgcagttcggcggcgaggtggtgaacacgcgcgcgtcgggttcccacacggcgacgcagatgggcagcggccacttcgccggcgaaggcttcggcagggcgtcctacttccgcaacctggaggtggtggactgggacaacagcctgctgcctctcgccgccggcttccacgtcaccgccgaccacccaaactgctacgacatccagggcggcgtcaacgccgtctggggtaactacttctactacggcggccccggcaggaacgtcaggtgcacctag

SEQ ID NO: 16749 - protein, 429 aa, Sorghum bicolor
  misc_feature: Useful for biocontainment applications
  misc_feature: Functional homolog of the protein sequence given in SEQ ID NO 14085
  misc_feature: Ceres ANNOT ID no. 8666253
MVASCSYSSSRAAAARHLVRLLLVGLLLAAGWGWATAAKNDTQTFRPGDELRRYRKVQALLKRLNKPALRTIQSPDGDLIDCVAAHLQPAFDHPRLRGQRPLADPPARPKGLHHRSRFPSNDTTADAGVQLWASSGEACPEGSVPIRRVTEKDVLRASSVRRFGRAPAGRVRRDSVSGGHEHAVGYVAGDEYYGAKASINVWAPQVSTASEFSLSQIWVIAGSFGNDLNTIEAGWQVSPQLYGDNAPRFFTYWTTDAYQTTGCYNLLCSGFIQTNSRIAMGAAISPTSAYNAGQFDISLLVWKDPNHGNWWLEFGSGELVGYWPSLLFSHLASHASMVQFGGEVVNTRASGSHTATQMGSGHFAGEGFGRASYFRNLEVVDWDNSLLPLAAGFHVTADHPNCYDIQGGVNAVWGNYFYYGGPGRNVRCT

SEQ ID NO: 16750 - DNA, 1866 bp, Sorghum bicolor
  misc_feature: Ceres ANNOT ID no. 8666376
  misc_feature: Encodes the peptide sequence at SEQ ID NO 16751
atgagcaatgtccgtacagtatgcatatccatggatcaacaagctaaggaggtttacacagtaaaaagacagcaaaataatggaaggtcagatcaggtcctgcaggtgcaggagagggcagcatggggcgccagcgacggcggcggcaacctggtgcaggatgccgtcgactacaggggctgcccggcggacaagtccagcacgggcggctgggtggcggcggcgctcgccctcgggatcgagctgtgcgagcgcctctccaccatgggcatcgccgtcaacctggtcacctacctcacgggcaccatgcacctgcccagcgccgctgctgccaacgtggtcaccgacttcatgggcacctccttcctcctctgcttccttggtggattccttgccgactccttcctcggacgatacctcaccatcgccatcttcgccctcgtccaagccatcggcacggggctgctggcagtgtccacggaggtgaggcagctacggccgccgccgtgcggatccggcgcggctgggtcgtgcgagcaggccactgggctccagatgggcgtcctgtacgtgtgtctctacctcatcgcgctcggcaccggtgggctcaagtccagcgtctcgggcttcggcaccgaccagttcgacgagcgcgacgcacgcgagcgcgccgccatgggcctcttcttcaaccgcttcttgttcttcatcagcgtcggcacgctcctcgccgtcaccgtcttcgtctacgtccaggaccacgtcggccggagctgggcctatggcatctgcgccggcgccatgctcgtcgccatcgccgtcttcctgtcaggcaccaggcggtaccgctacaagcgcagctccgggagccccatcgtgcacatcctccaggtcctcgtcgctgccgcccggaagcggaacgtcgtcaagcagccgctcaccgcctccgcgctctacgaggaccgccccgagcacgcgcgcatcccccacaccgcccagttcccgtgcctggacagggcggcggtgatggccggcgacgacgacaacgaggtgggccgcgacgggcggccgacgcccaacccgtggaagctgtgcaacgtgtcccgcgtcgaggaggttaagatggtggcgcggctgatgccggtgtgggcgacgaccatcctgttctggaccatctacgcgcagatgatcaccttctccgtggagcaggcgacgaccatggaccggcgcatgggcggcttcgagatcccagccgcctcgctcaccgtcttcttcgtcggcgctatcatgctcaccctcgccttctacgaccgcgtcttcgttccgctctgccgcagcttcatgaccggccggcaggggttcacaaacttggagaagatcggcatcggcctggtcctctccatcgtcggcatggccgccgcggcaatctgcgagaagaaacgcctcgccgtcgctgccacgagtcgcggcgcagggcatgggtcgctgcccatcagcgtgttcatgctgacgccgcagttcctgctggtgggcgccggcgaggcgttcatctacacggggcagctggacttcttcatcacgcggtcgcccaagagcatgaagacgatgagcacgggcctcttcctcaccacgctctcgctcggcttcttcctcagcagcgcgctcgtctcgctcgtcaagagctgcacgcggtggctcggcgacaccatcaaccacagccgcctcgactacttctactggctgctggccgtgctcggcgttgtcaacctcgtcgcatacctcgtctgcgccatgtgggcaacagcaccggccagcaggcaggcggagcagccgcagtccgccatggccgccgacgagaaatgctag

SEQ ID NO: 16751 - protein, 621 aa, Sorghum bicolor
  misc_feature: Useful for making plants with modulated carbon-nitrogen partitioning
  misc_feature: Functional homolog of the protein sequence given in SEQ ID NO 14419
  misc_feature: Ceres ANNOT ID no. 8666376
  misc_feature (139)..(545): Pfam ID: PTR2 Pfam Description: POT family
MSNVRTVCISMDQQAKEVYTVKRQQNNGRSDQVLQVQERAAWGASDGGGNLVQDAVDYRGCPADKSSTGGWVAAALALGIELCERLSTMGIAVNLVTYLTGTMHLPSAAAANVVTDFMGTSFLLCFLGGFLADSFLGRYLTIAIFALVQAIGTGLLAVSTEVRQLRPPPCGSGAAGSCEQATGLQMGVLYVCLYLIALGTGGLKSSVSGFGTDQFDERDARERAAMGLFFNRFLFFISVGTLLAVTVFVYVQDHVGRSWAYGICAGAMLVAIAVFLSGTRRYRYKRSSGSPIVHILQVLVAAARKRNVVKQPLTASALYEDRPEHARIPHTAQFPCLDRAAVMAGDDDNEVGRDGRPTPNPWKLCNVSRVEEVKMVARLMPVWATTILFWTIYAQMITFSVEQATTMDRRMGGFEIPAASLTVFFVGAIMLTLAFYDRVFVPLCRSFMTGRQGFTNLEKIGIGLVLSIVGMAAAAICEKKRLAVAATSRGAGHGSLPISVFMLTPQFLLVGAGEAFIYTGQLDFFITRSPKSMKTMSTGLFLTTLSLGFFLSSALVSLVKSCTRWLGDTINHSRLDYFYWLLAVLGVVNLVAYLVCAMWATAPASRQAEQPQSAMAADEKC

SEQ ID NO: 16752 - DNA, 3210 bp, Sorghum bicolor
  misc_feature: Ceres ANNOT ID no. 8666520
  misc_feature: Encodes the peptide sequence at SEQ ID NO 16753
atgggagaggcgaaggacaacgaggtgtacgaggaggacctcgtcgactatgaggaagaggtggagaatgtcgtcgacggcgccgccaccaacggctccgcagatgtcgtcaagaaggggtacgtggggatccacagctcgggcttcagagacttcctgctcaagccggagcttctccgcgccattcaggactgcgggtttgagcatccttccgaagtgcaacatgagtgcatccctcaagctattcttggaatggatgtcatctgtcaagcaaaatctggaatgggtaagactgcagtttttgtcctctccactcttcagcagattgatcctgttgctggacaagtagcggcactcgtgttgtgccacacaagagagttagcttaccagatttgccatgaatttgagaggtttagcaaatacctgcctgaattaagagtggctgttttctatggtggtgttcacataaaaaaccacaaggatctgttgaagaatgaatgcccccatattgtggtcggcacgcctggaaggatactggctctagctagagataaggaccttccgttgaagaatgtgcggcatttcattcttgatgaatgtgacaagatgcttgaatcacttgacatgcgcagagatgtccaggagatcttcaaaatgactccccatgataagcaagtgatgatgttttcagcaacactcagcaaggagattcgacctgtttgcaagagattcatgcaagaccctatggaaatttatgttgatgatgaggctaaactgacccttcatggtctagttcagcactatatcaaattgagtgaggcagagaagaaccgaaaattgaatgaccttttagatgcgcttgacttcaaccaagttgtgatatttgttaaaagtgttagtagagctgcagaactcaacaaattgctctgcgagtgcaattttccctcaatctgcatacattctggaatgacacaggaagagaggttgacccggtacaagaacttcaaggaaggacacaagaggattcttgtggctactgatttggttggtaggggaattgatattgagcgtgtcaacattgttgtgaactacgacatgcccgattctgctgatacgtacttgcatagggttggtcgagctggacgttttggtaccaagggacttgcaataacatttgtttcttctgcatctgattctgatgttctcaatcaagtgcaggagaggtttgaggttgacataaaggagctgcctgagcagattgacacttcgacatacaatcaagccaaaccactggtgcttcggcaaaactgtctggacatcaagcgctgcgtgaggtggatgatgctgggtgcctatgtggtggttgaggcagcacgccagaatcttgcggatgccggggtgcgtagtagcggggagaggtggtgtgggggtgtcgtcggcggcacgccccactccgccacaagggaagagccgcccctgcctcctctcgatgcctatcgctcgcggctacgttcagatataaatccatggtacctctacagagggaggcaacatgagttcaaatattgcacatcaccacaaagcaagtctgtgttactaggagcaagatttggtagacatgttactaggagcgctgcttatctgctccaaaattccaggagcactacaacggcaagactacaaaagtcccagtttctgcaacctgtcttggactcttcaagaaattatttgactaggacattctacaatgcaagcttgaagaggagagttctgtcgagggttgagtgctttctgtcttcagatccaataaacaatggttggttgaaaccaaggaggtcagagaacttcactagtttggagagtgcatgtgtccagccagaatacaaactaccagtcagaaaacgtgctgactgtaaagcagagcagtatgaaattacaggatcacctttgagctcttcaaatgttcctgctgatgttccctggtggcaggagttcccaaggcgctggacgatcgttctcctctgcttctttgcgttccttctttgcaatatggaccgtgtcaatatgagcattgcaatccttccaatgtcgtcagagttcagctggaatccagcaaccgttggtctaatccaatcatctttcttttggggttacctcctcacacagattcttggaggtatttgggctgacaggtttggtggtaaggtcgtactaggatttggggttgtatggtggtcacttgcaacagttcttacaccccttgctgccaagattggacttccatgcttacttactggtgttgccatgcctgctatgaacaacatcctttccaaatggatcccagtctcagagagaagcagatctcttgccttggtgtacagcggaatgtaccttgggtcagtcactggcctgggtttctcacctctgttgattagcagatttggctggccttctgtcttttatgcatttggatcccttggaaccgtttggtttgcactatggcaaagcaaagcacacagctctccagatgatgatccggagataagtaaagctgaaaagaggcatatactgggtggcagtcccttaaaggagcctgtcacttccataccatggaggctgattctatcaaaggctccagtgtgggctctcataatatcacatttttgccataactggggaacattcattcttctaacatggatgcccacatactacaatcaggttctgaagttcaatctaaccgagtccggtcttctctgtgtcttgccatggctgacaatggctgtttttgcgaatattggtggatggattgctgatactcttgttcagagaggggtctctgtaacaaacgttcgtaagatcatgcaatcaattggtttccttggaccagccttgttcttgacactgctgagtaaagttcgtactccagccatggccgttttatgtatggcatgcagtcagggtagcgatgctttttcacagtctggcctgtattcaaatcaccaagacataggaccacgttatgcgggggtacttctcggactgtcaaacactgctggcgtgcttgcaggagtttttggtactgctgccactggctacattcttcagaaaggttcttgggatagtgtgtttaaggtgtctgttgtgctgtacatagtaggaacagtggtgtggaacgtctttgcaactggagagaaagttctcgaataa

SEQ ID NO: 16753 - protein, 1069 aa, Sorghum bicolor
  misc_feature: Useful for biocontainment applications
  misc_feature: Useful for making plants with modulated biomass
  misc_feature: Useful for making plants with modulated cold sensitivity
  misc_feature: Functional homolog of the protein sequence given in SEQ ID NO 14420
  misc_feature: Ceres ANNOT ID no. 8666520
  misc_feature (71)..(240): Pfam ID: DEAD Pfam Description: DEAD/DEAH box helicase
  misc_feature (675)..(1028): Pfam ID: MFS_1 Pfam Description: Major Facilitator Superfamily
  misc_feature (308)..(384): Pfam ID: Helicase_C Pfam Description: Helicase conserved C-terminal domain
MGEAKDNEVYEEDLVDYEEEVENVVDGAATNGSADVVKKGYVGIHSSGFRDFLLKPELLRAIQDCGFEHPSEVQHECIPQAILGMDVICQAKSGMGKTAVFVLSTLQQIDPVAGQVAALVLCHTRELAYQICHEFERFSKYLPELRVAVFYGGVHIKNHKDLLKNECPHIVVGTPGRILALARDKDLPLKNVRHFILDECDKMLESLDMRRDVQEIFKMTPHDKQVMMFSATLSKEIRPVCKRFMQDPMEIYVDDEAKLTLHGLVQHYIKLSEAEKNRKLNDLLDALDFNQVVIFVKSVSRAAELNKLLCECNFPSICIHSGMTQEERLTRYKNFKEGHKRILVATDLVGRGIDIERVNIVVNYDMPDSADTYLHRVGRAGRFGTKGLAITFVSSASDSDVLNQVQERFEVDIKELPEQIDTSTYNQAKPLVLRQNCLDIKRCVRWMMLGAYVVVEAARQNLADAGVRSSGERWCGGVVGGTPHSATREEPPLPPLDAYRSRLRSDINPWYLYRGRQHEFKYCTSPQSKSVLLGARFGRHVTRSAAYLLQNSRSTTTARLQKSQFLQPVLDSSRNYLTRTFYNASLKRRVLSRVECFLSSDPINNGWLKPRRSENFTSLESACVQPEYKLPVRKRADCKAEQYEITGSPLSSSNVPADVPWWQEFPRRWTIVLLCFFAFLLCNMDRVNMSIAILPMSSEFSWNPATVGLIQSSFFWGYLLTQILGGIWADRFGGKVVLGFGVVWWSLATVLTPLAAKIGLPCLLTGVAMPAMNNILSKWIPVSERSRSLALVYSGMYLGSVTGLGFSPLLISRFGWPSVFYAFGSLGTVWFALWQSKAHSSPDDDPEISKAEKRHILGGSPLKEPVTSIPWRLILSKAPVWALIISHFCHNWGTFILLTWMPTYYNQVLKFNLTESGLLCVLPWLTMAVFANIGGWIADTLVQRGVSVTNVRKIMQSIGFLGPALFLTLLSKVRTPAMAVLCMACSQGSDAFSQSGLYSNHQDIGPRYAGVLLGLSNTAGVLAGVFGTAATGYILQKGSWDSVFKVSVVLYIVGTVVWNVFATGEKVLE

SEQ ID NO: 16754 - DNA, 1311 bp, Sorghum bicolor
  misc_feature: Ceres ANNOT ID no. 8666534
  misc_feature: Encodes the peptide sequence at SEQ ID NO 16755
atgcggagctccgtcgcctcggctgcgctgttggccggcgctctcctgtgcctgctggcgtcgccggcgaggtcgacggggaggacaacgctgagcgtcctgtcgttcggagccgcggcggacggggtcaccgacgacgcggaggcacttgtagcagcatggcgagttgcatgccgagtcccacgcgccaccgtgctgctcccgtcagggcaccggttcctcctctccccggtcacgctccaaggcccctgcagcacaaaactcacccttcagatcgacggcaccgtgttagcgccaccagaaatgggatcctggccgaagcccaggaggccactccagtggctcaacttcaagtggctgcaagacttcagcatccttggagccggcacggtcgatggccagagcatcacgtcgctgcagagtgcctcatcaccagctaataatagtacttctcagacatctaccgggcactggcattcaccaggagtcaagcctacgctgataaggttttacaacagcttcaatgttacggtgcgcaacatccggatcaccaacagccctcagtgccacctcaagttcgacagctccggaggcatcaaggtgaaaaacatcaccatctcttctcccggagacagcccaaacaccgacggcatccatcttcagaacaccagggacgtcgagatcaagagctcaaccatcggctgcggggatgactgcgtgtcaatacaaactgggtgctcaaatgttcacatcaagaacgtagtctgcaatcccggacacggaatcagtctaggaggacttgggaaggattacagcttagcctgtgtctctgatgtagttgcggagaacatcattgtccagaacgctctgtacggggtcaggatcaagacgtggcagggtggcgtgggctcggtgcggaacatcaccttctccaacgtcagggtggcgaacgtggccacgcccatcgccatcgaccagttctactgcgacaggggcggcgcgcggtgcgccaaccgcaccggcgcggtggccatcaccggcgtggcgtaccggcgcgtggtcggcacctactcgttccagccggtgcgcctggcgtgcagcgacgcacggccctgcaccggcgtcaccatggtggatgtgcgcctgtctccggcggcgaccgcggccggcgggggcgccaccgtagcgccgctgtgctggaactcctacggcgaggcgcggggcacgatccagccgctcggcgtcgggtgcctgcagaggagcaacggatacgcgatgcctctcacccagccttttaactacacatgctga

SEQ ID NO: 16755 - protein, 436 aa, Sorghum bicolor
  misc_feature: Useful for making plants with altered cell wall content and/or composition
  misc_feature: Functional homolog of the protein sequence given in SEQ ID NO 14421
  misc_feature: Ceres ANNOT ID no. 8666534
  misc_feature (23)..(382): SWISSPROT Homolog: EC 3.2.1.15 Polygalacturonase
  misc_feature (58)..(399): Pfam ID: Glyco_hydro_28 Pfam Description: Glycosyl hydrolases family 28
MRSSVASAALLAGALLCLLASPARSTGRTTLSVLSFGAAADGVTDDAEALVAAWRVACRVPRATVLLPSGHRFLLSPVTLQGPCSTKLTLQIDGTVLAPPEMGSWPKPRRPLQWLNFKWLQDFSILGAGTVDGQSITSLQSASSPANNSTSQTSTGHWHSPGVKPTLIRFYNSFNVTVRNIRITNSPQCHLKFDSSGGIKVKNITISSPGDSPNTDGIHLQNTRDVEIKSSTIGCGDDCVSIQTGCSNVHIKNVVCNPGHGISLGGLGKDYSLACVSDVVAENIIVQNALYGVRIKTWQGGVGSVRNITFSNVRVANVATPIAIDQFYCDRGGARCANRTGAVAITGVAYRRVVGTYSFQPVRLACSDARPCTGVTMVDVRLSPAATAAGGGATVAPLCWNSYGEARGTIQPLGVGCLQRSNGYAMPLTQPFNYTC

SEQ ID NO: 16756 - DNA, 636 bp, Sorghum bicolor
  misc_feature: Ceres ANNOT ID no. 8666570
  misc_feature: Encodes the peptide sequence at SEQ ID NO 16757
atgccagaaatagcagattgttgggtgcgccgttcccgcgactacctcttcaagctgctcctcatcggggactcaggtgttgggaagtcttgcctgctgctgaggtttgcggatgattcatacctggagagctacatcagtactattggagttgattttaaaatccgcaccgttgagcaagatgggaagacaataaagctgcagatttgggatactgctggccaagagcgctttaggaccatcacaagcagctactatcgtggagctcatggcattattgtcgtgtatgatgtaactgaccaggagagctttaacaatgtcaagcagtggctgaatgaaattgacaggtatgccagtgaaaatgtgaacaagcttttggtggggaacaagtgtgatctggctgagaacagagtagtttcttatgaggctggcaaggcccttgctgatgagatcggaatacccttccttgagactagtgccaaggatgcaacaaatgtggagaaggcattcatgaccatggcaggggagataaagaacaggatggcaagtcaaccggctgcaagtggtgctagcaggcctgcaactgtgcaaatgcggggtcagcctgtttctcagcaaagcagctgctgctcttga

SEQ ID NO: 16757 - protein, 211 aa, Sorghum bicolor
  misc_feature: Useful for making plants with altered lignin content
  misc_feature: Functional homolog of the protein sequence given in SEQ ID NO 12946
  misc_feature: Useful for making plants with modulated oxidative stress sensitivity
  misc_feature: Functional homolog of the protein sequence given in SEQ ID NO 13074
  misc_feature: Useful for making plants with altered alkaloid content
  misc_feature: Functional homolog of the protein sequence given in SEQ ID NO 13220
  misc_feature: Ceres ANNOT ID no. 8666570
  misc_feature (18)..(137): SWISSPROT Homolog: EC 2.7.11.1 Non-specific serine/threonine protein kinase
  misc_feature (18)..(179): Pfam ID: Ras Pfam Description: Ras family
  misc_feature (18)..(132): Pfam ID: Miro Pfam Description: Miro-like protein
MPEIADCWVRRSRDYLFKLLLIGDSGVGKSCLLLRFADDSYLESYISTIGVDFKIRTVEQDGKTIKLQIWDTAGQERFRTITSSYYRGAHGIIVVYDVTDQESFNNVKQWLNEIDRYASENVNKLLVGNKCDLAENRVVSYEAGKALADEIGIPFLETSAKDATNVEKAFMTMAGEIKNRMASQPAASGASRPATVQMRGQPVSQQSSCCS

SEQ ID NO: 16758 - DNA, 999 bp, Sorghum bicolor
  misc_feature: Ceres ANNOT ID no. 8666551
  misc_feature: Encodes the peptide sequence at SEQ ID NO 16759
atggcctggcccaacgtggcgtctgcgtggcggtttacgtggcaaaaaaaatcctcatcggaaaaaaaaagctcgacgccgtggaacagggcgccgagctcgacgccgcagatcacggcgccgcacatcagcggggtggcattggcctccgtgctcgccaacctcaacctcctctttctcttggcttacatcctcttcaagggcgtccacaagcgcaccggcggcctcgcgctctcggccgagagcttccgcggctggggcgagctcgtcagcctcgcgctgccgagctgcgtcagcgtctggctcgattgctggtggtacgagatcatgatcctcctatgcggcctgctcgcgaacccgcaggcaacggtggccagcatgggcatcctcatccagacaacgtcactcatctacatcttcccttcctcgctcggcttcggcgtctcgacgcgcgtcagcaacgagctcggcgcgaaccggcccgaccacgccggccgcgcggccacagtcggcctcatgctcgggttcgcgttcggtggcgtggcgtccgcgttcgcgtacctcgtccgcggcgcgtgggcgaccatgttcacggccgacccggcgatcgtcgcgctcaccgcgtccgtgctgccgattctgggcgcttgcgagctcggcaactgcccgcagacgaccggctgcggcgtgctgcggggcagcgcgcggcccaaggacgccgccagcatcaacctccggtccttctatctggtgggcacgcccgtggcgctcgtcctcgccttctggtaccactacgacttccagggcctgtggctgggcctcctcgcggcgcatgcgacctgcgtggtgcgcatgctgctggtgatcgggcggacggattgggcagccgaggccaagcgcgcgcagcagctcaccggagcaggcacggtggagaccaaagagagcagcggcaagggcagtcatgccagtaaaggcaccgtgaacagctcggcgccgtga

SEQ ID NO: 16759 - protein, 332 aa, Sorghum bicolor
  misc_feature: Useful for biocontainment applications
  misc_feature: Useful for making plants with modulated biomass
  misc_feature: Functional homolog of the protein sequence given in SEQ ID NO 14422
  misc_feature: Ceres ANNOT ID no. 8666551
  misc_feature (95)..(258): Pfam ID: MatE Pfam Description: MatE
MAWPNVASAWRFTWQKKSSSEKKSSTPWNRAPSSTPQITAPHISGVALASVLANLNLLFLLAYILFKGVHKRTGGLALSAESFRGWGELVSLALPSCVSVWLDCWWYEIMILLCGLLANPQATVASMGILIQTTSLIYIFPSSLGFGVSTRVSNELGANRPDHAGRAATVGLMLGFAFGGVASAFAYLVRGAWATMFTADPAIVALTASVLPILGACELGNCPQTTGCGVLRGSARPKDAASINLRSFYLVGTPVALVLAFWYHYDFQGLWLGLLAAHATCVVRMLLVIGRTDWAAEAKRAQQLTGAGTVETKESSGKGSHASKGTVNSSAP

SEQ ID NO: 16760 - DNA, 1344 bp, Sorghum bicolor
  misc_feature: Ceres ANNOT ID no. 8666615
  misc_feature: Encodes the peptide sequence at SEQ ID NO 16761
atggccgccgcggcgccgcctctcctgctcgcgggcctcgccctcgccgtcgtcgccgccgccgtctggccgtccctagctgcggcgccggcggcgctgcaggacccggcggagctcctgcgcagggccaaggagccggcgttcgcggactggatggtcggggtgcggcggcggatccacgagaacccggagctgggatacgaggagttccagaccagcgagctcgtgcgccgggagctcgacgcactggggatcccctacaggcaccccttcgccgtcaccggcgtcgtggcaacagtcggcaccggcggcccgcccttcgtcgctctgcgcgcggacatggacgcgctgcccttgcaggaaagtgtggaatgggaacacaagagcaaagttcccgggaagatgcatggttgtggacatgatgcacatgttgctatgctgttgggatctgctaagattcttcaggagcatcgtgatgagttgaagggtacagtggttcttgttttccaaccagctgaggaaggtggcggtggggcccagaaaatgatagaagctggagctctggaaaacatagatgccatttttgggcttcatatagctgattctgtgcctattggtgtactggcatccaggccagggcctattatggctgggagtggattctttgaggccgtaataagtggaaagggagggcatgctgcacttcctcatcacactatagatccgatattggctgcctcaaatgttattgtgagccttcagcaacttgtttcccgagaagctgatcccttggactcacaggttgtaacagttggaaagtttcaaggaggtggagccttcaatgtgatccctgattcagttactataggcggcaccttccgagcctttctgaaagagagttttaatcaattgaagcagcgaattgaagaggtgattgtgtctcaagcatccgtgcagcgctgcagtgctagcgtggacttcctcacaaaggaccgtccattcttccccccaaccatcaacagccctgagctccatgatttcttcgtgaatgtggccagcgagatggttgggtcgaggaacgtgagggacagacaaccgctaatgggtgctgaggacttctcgttctatgccgaggcgatcccctcaacctactactactttgtgggcatgtacaatgagactcgtggaccgcaggcgccccatcactccccctacttcaccatcaacgaagatgccctcccctatggtgcagctgcacaagctgctttggcagctcgctatctactcgagcatcagcaacctgctgctaccactgataaggcaaaaccccatgatgaactgtag

SEQ ID NO: 16761 - protein, 447 aa, Sorghum bicolor
  misc_feature: Useful for making plants with modulated nitrogen use efficiency
  misc_feature: Functional homolog of the protein sequence given in SEQ ID NO 14076
  misc_feature: Ceres ANNOT ID no. 8666615
  misc_feature (55)..(386): SWISSPROT Homolog: EC 3.5.1.32 Hippurate hydrolase
  misc_feature (109)..(426): Pfam ID: Peptidase_M20 Pfam Description: Peptidase family M20/M25/M40
MAAAAPPLLLAGLALAVVAAAVWPSLAAAPAALQDPAELLRRAKEPAFADWMVGVRRRIHENPELGYEEFQTSELVRRELDALGIPYRHPFAVTGVVATVGTGGPPFVALRADMDALPLQESVEWEHKSKVPGKMHGCGHDAHVAMLLGSAKILQEHRDELKGTVVLVFQPAEEGGGGAQKMIEAGALENIDAIFGLHIADSVPIGVLASRPGPIMAGSGFFEAVISGKGGHAALPHHTIDPILAASNVIVSLQQLVSREADPLDSQVVTVGKFQGGGAFNVIPDSVTIGGTFRAFLKESFNQLKQRIEEVIVSQASVQRCSASVDFLTKDRPFFPPTINSPELHDFFVNVASEMVGSRNVRDRQPLMGAEDFSFYAEAIPSTYYYFVGMYNETRGPQAPHHSPYFTINEDALPYGAAAQAALAARYLLEHQQPAATTDKAKPHDEL

SEQ ID NO: 16762 - DNA, 1434 bp, Sorghum bicolor
  misc_feature: Ceres ANNOT ID no. 8666637
  misc_feature: Encodes the peptide sequence at SEQ ID NO 16763
atggatcataacttcagcgatatgatcctgcgcgagagcgcatggagcggcggcgtggtgggtgccggcgacggcggggccgtcttgctgccaccggtggaggtggtggggaacgtcgtcgaaggcggcagcggcatgacggtgctggagaggctggtgctcgacgaggcgctggcggcggcgatcctggagctgcagggcagcatcgtccacgtccagcagcaggcgcccgccgcctgctgcgccggcagcaaggcggtaccggcggccggtggtggcgtggttggtgaggaggccgctgtcgccttcccctcgatggcgatggcgacgccaacgcccgcctacgcggacgttgacgcggatgtcctgcagcgacagcagcatcaccatcgccatcacggcgcgatggggatatcgatgcctcccgactacgacctcacaccagcaacaacacccgctgtcgcggtaactgctgccgcgttcacagccaccgcggcggttgacagcggaggcaacaacagcctcgtcgtcggacgatcgccgccgccggtcttctccgccagctgcaacgagacaacagcgacggcggcggccgtgaccgcgacgacgagcctcagttgtgaacaaggcggcggcggaggcggtgccggtggtggcaaaaggcagcgccggcccaacaggaagaggaaggccgccgccgagcggtcacctgtggcggtggcggcagcggcggcacaagagagcaccctgtgcagcctcctggcgtccggtaccaccaccgcgggcgaaggcggcatccagatcgcgttcagcacgagcgccgccaagagatcagcgaagccgtcgtcgctgagcagcagcggctcgtcgagcatcagcttcgacggccggaacaaccccgcgggcaacggcggcggcgtggaggactccatgtacgagccagacacggaggcgctggcgcaggtgaaggagatgatctaccgcgcggcggcgatgcgcccggtctcgctgggctccgaggacgccggcgagcgcccgcgccgccgcaacgtgcgcatctcgtccgacccgcagacggtggcggcgcggcagcggcgggagcgcatcagcgagcgcctccgcgtgctgcagaagctcgtcccgggcggcgccaagatggacaccgcctccatgctggacgaggccgccaactacctccgcttcctcaagtctcaggtccgggagctgcaaaccctagaccgccggaactatggtgccactgcgaataatgccaacgacgccaccgccgccatggctgctgttgggtcgtcttcgtcactgatgagctataacaatggcaacggtgccatgcccttctccttcccggcagcaggcgaaaccctacgaggatcagtaggaggaggtcttgatcgaccagctgatttagtcatttag

SEQ ID NO: 16763 - protein, 477 aa, Sorghum bicolor
  misc_feature: The sequence is a functional homolog of SEQ ID NO 1938 in the 10/374,780 US patent application
  misc_feature: Ceres ANNOT ID no. 8666637
  misc_feature (356)..(403): Pfam ID: HLH Pfam Description: Helix-loop-helix DNA-binding domain
MDHNFSDMILRESAWSGGVVGAGDGGAVLLPPVEVVGNVVEGGSGMTVLERLVLDEALAAAILELQGSIVHVQQQAPAACCAGSKAVPAAGGGVVGEEAAVAFPSMAMATPTPAYADVDADVLQRQQHHHRHHGAMGISMPPDYDLTPATTPAVAVTAAAFTATAAVDSGGNNSLVVGRSPPPVFSASCNETTATAAAVTATTSLSCEQGGGGGGAGGGKRQRRPNRKRKAAAERSPVAVAAAAAQESTLCSLLASGTTTAGEGGIQIAFSTSAAKRSAKPSSLSSSGSSSISFDGRNNPAGNGGGVEDSMYEPDTEALAQVKEMIYRAAAMRPVSLGSEDAGERPRRRNVRISSDPQTVAARQRRERISERLRVLQKLVPGGAKMDTASMLDEAANYLRFLKSQVRELQTLDRRNYGATANNANDATAAMAAVGSSSSLMSYNNGNGAMPFSFPAAGETLRGSVGGGLDRPADLVI

SEQ ID NO: 16764 - DNA, 381 bp, Sorghum bicolor
  misc_feature: Ceres ANNOT ID no. 8666648
  misc_feature: Encodes the peptide sequence at SEQ ID NO 16765
atggaccggtccaagtcgtacgcgggcgggcgcatgcagatcgagccgtactacggcggcggcggcgcgcggccggacttccggtcctactcgtacagcgccggcgggggcgggatggggacgtcgtcctactcctcctcctcctactcgtaccagtacgagtacggcggccctgcggcgggggcggcggcgggggaggaggtgaagcggagcaagtcgaagcggcggtggctggcgctggcggacccggacatggatcgcaagcgccgggtggcggcgtacaaggcgtacggcgtggagggcaaggtgaagggctccttccgcaagagcttcaagtggatcaaggaccgctacctcaacctcgtctacggatggtcctga

SEQ ID NO: 16765 - protein, 126 aa, Sorghum bicolor
  misc_feature: Useful for making plants with modulated biomass
  misc_feature: Useful for making plants with modulated nitrogen use efficiency
  misc_feature: Functional homolog of the protein sequence given in SEQ ID NO 14058
  misc_feature: Ceres ANNOT ID no. 8666648
MDRSKSYAGGRMQIEPYYGGGGARPDFRSYSYSAGGGGMGTSSYSSSSYSYQYEYGGPAAGAAAGEEVKRSKSKRRWLALADPDMDRKRRVAAYKAYGVEGKVKGSFRKSFKWIKDRYLNLVYGWS

SEQ ID NO: 16766 - DNA, 1836 bp, Sorghum bicolor
  misc_feature: Ceres ANNOT ID no. 8666718
  misc_feature: Encodes the peptide sequence at SEQ ID NO 16767
atgagtacctgcctttccaatctattacaggctcccaaccctgggaagaagagaaaacgcactcagacagaacagaggaaggccaaaaagacgaaaaataaaagaatcaaccgggcactgcaacagatagctgatggagttagaagaccaaaacttactcgtgttataaagccaaaaaaaccttgctacttctatgaccatgggaagtgccagcagggcaataattgcaagtattcccatgattttacaccttcaacaaaatctaagccctgcacacattttgcatgtggttcttgtttgaaaggagaagggtgtccatatgaccatgagttgtcaaagtacgaatgccataactataaaaacaatggcatgtgtgccagaggtgataaatgcaaattctctcatgtggagttcctacaggcagaagctgcggccgcggcagatcgggagagcagcatgtccaacctcacctcctccgccaacgcggcgcctgctgctgctgctgtcccgccgccgccggccgctggcaacaacaagcgcaagcggagcctcccaggcaaccccgaccccgaggcggaggtggtggctctttctccggcgacgctgatggcgacgaaccgcttcgtgtgcgagatctgcgggaaagggttccagcgcgaccagaacctgcagctgcaccggcgcgggcacaacctcccctggaagctgaagcagcgcgggacggggaaggaggcgcagcggaagaaggtgtacgtgtgcccggaggcgtcgtgcgtgcaccacgacccggcgcgcgcgctgggcgacctcacggggatcaagaagcacttcttccgcaagcacggcgagaagaagtggaagtgcgacaagtgctccaagaagtacgccgtgcactccgactggaaggcgcactccaagatctgcggcaccagggagtacaagtgcgactgcggcacaatcttctccaggcgggacagcttcatcacgcaccgcgccttctgcgacgcgctcaccgaggagagcgccaaggccatcggcctcaacgccatggccgccgcgccggcgccagcgcacctccaccaccacccgctgctcttctcgccaccgcccgccgcgcacgtcatgcagcagcagcagcaggtggacgtcgctcttctccaggatcatcaccaccaccaccagcaccaggaggtcatgcagccgccgccgcagcagcactgcaactacgccatgaagacggagatgccgccgtggccgccggcgatggcctacgaccactcgctgatgctgcccgcagcgcagagctcggccacgtccgcgccaccgccgccgcagccgcagctgcccgcggcctctgcgcacctgtcggccacggcgctgctgcagaaggcggcgcagatgggcgccaccatcggcggcgcgggcacgggctacacccagatggcgggcgccgcgacgagcgcgcccggcaccgcctccagcttcggcctcggcctcccgggcctgcagaatgcccatcatcatcagcagcaggatggcgccggggtcatgtccgccgggctcgcgaggacagcctcctcccacggccgcagcggcgaggaaggcggcgccgacggcatgaccagggacttcctgggcctgcgcgccttctcccaccgcgacatcctcggcctcgccggcttggactcctcgtgcatgggcgccatcaccgccaacgccagcatgagctgctacgagccacagcagcaacacgcacagcctcaggctcatcaggcgcagcagcagcagcagcaaagcagcaacgaaccatggcacggcatgggcagccatagctag

SEQ ID NO: 16767 - protein, 611 aa, Sorghum bicolor
  misc_feature: The sequence is a functional homolog of SEQ ID NO 1087 in the 10/666,642 US patent application
  misc_feature: Useful for making plants with altered lignin content
  misc_feature: Functional homolog of the protein sequence given in SEQ ID NO 13275
  misc_feature: Ceres ANNOT ID no. 8666718
  misc_feature (208)..(230): Pfam ID: zf-C2H2 Pfam Description: Zinc finger, C2H2 type
  misc_feature (112)..(137): Pfam ID: zf-CCCH Pfam Description: Zinc finger C-x8-C-x5-C-x3-H type (and similar)
MSTCLSNLLQAPNPGKKRKRTQTEQRKAKKTKNKRINRALQQIADGVRRPKLTRVIKPKKPCYFYDHGKCQQGNNCKYSHDFTPSTKSKPCTHFACGSCLKGEGCPYDHELSKYECHNYKNNGMCARGDKCKFSHVEFLQAEAAAAADRESSMSNLTSSANAAPAAAAVPPPPAAGNNKRKRSLPGNPDPEAEVVALSPATLMATNRFVCEICGKGFQRDQNLQLHRRGHNLPWKLKQRGTGKEAQRKKVYVCPEASCVHHDPARALGDLTGIKKHFFRKHGEKKWKCDKCSKKYAVHSDWKAHSKICGTREYKCDCGTIFSRRDSFITHRAFCDALTEESAKAIGLNAMAAAPAPAHLHHHPLLFSPPPAAHVMQQQQQVDVALLQDHHHHHQHQEVMQPPPQQHCNYAMKTEMPPWPPAMAYDHSLMLPAAQSSATSAPPPPQPQLPAASAHLSATALLQKAAQMGATIGGAGTGYTQMAGAATSAPGTASSFGLGLPGLQNAHHHQQQDGAGVMSAGLARTASSHGRSGEEGGADGMTRDFLGLRAFSHRDILGLAGLDSSCMGAITANASMSCYEPQQQHAQPQAHQAQQQQQQSSNEPWHGMGSHS

SEQ ID NO: 16768 - DNA, 1077 bp, Sorghum bicolor
  misc_feature: Ceres ANNOT ID no. 8666698
  misc_feature: Encodes the peptide sequence at SEQ ID NO 16769
atggcgcggagcgtggccgtggcggcagtgaagctggagccgaagccggagccgtgggcggcgggcgcagaggaggcgtcgtcagtggtgccgcggtcgatggaggggccgccgctccctgcgccgttcgtgtcgaagacgtacgagatggtggcggacgcggccacggacgccgtggtgtcgtgggcgcccggcggcgcggggaacagcttcgtggtgtgggacccgcgggcgctcgccgccggcatcctcccgcgcttcttcaagcacgccaacttcgcgtccttcatcaggcagctcaacatctacggattcaggaaggtgaatccggatcgttgggagtttgcaaacgaatccttcttagcaggccagaagcatttgctgaaaaatatcaagaggaggcgtgcttccaagcctcagatggaagcaaagccaagaaactgtgctggtgcttgtctcggttcgccgaaggatcccagcgaggtcgagagtttgaaacgagaccgcgcagcgctcagggccgaagtcatcacgctaaggcagcagtacaacatctgcaaatcccaactcgtcgccttggaggagaggatcctgaacaacgagaggaaccagcagagggccatcgccttcttcgcaaaggtgctcagcaacccaggtttcgtgcagcaggtcctgctcaactatgccaaggagaaagaactacgtggcgcttccaaaagacagcggctgatggaaaacgaagaacatcggcacggcgatttgccactgaggagtggcaccgaagctgcgtttgcgacagtggcggctggcgttggcgtctctgcggggagcagccatggtggcacagccgcgaaacaggagcctgggcctgagttgaatggtcaggagatggacagtatttggtatgatgtgtgggacgagctggacgcgataccaggcgctgaaatggaccggcgagaagcagacaagggcgtggctggcttcgacgtcgaggatttcagtggacggccttgcggttgggatgatgactgctcgtatctcgcggagccgatgcagtttgtggagcactatgactag

SEQ ID NO: 16769 - protein, 358 aa, Sorghum bicolor
  misc_feature: Useful for making plants with modulated heat sensitivity
  misc_feature: Functional homolog of the protein sequence given in SEQ ID NO 13699
  misc_feature: The sequence is a functional homolog of SEQ ID NO 1687 in the 10/412,699 US patent application
  misc_feature: Ceres ANNOT ID no. 8666698
  misc_feature (40)..(210): Pfam ID: HSF_DNA-bind Pfam Description: HSF-type DNA-binding
MARSVAVAAVKLEPKPEPWAAGAEEASSVVPRSMEGPPLPAPFVSKTYEMVADAATDAVVSWAPGGAGNSFVVWDPRALAAGILPRFFKHANFASFIRQLNIYGFRKVNPDRWEFANESFLAGQKHLLKNIKRRRASKPQMEAKPRNCAGACLGSPKDPSEVESLKRDRAALRAEVITLRQQYNICKSQLVALEERILNNERNQQRAIAFFAKVLSNPGFVQQVLLNYAKEKELRGASKRQRLMENEEHRHGDLPLRSGTEAAFATVAAGVGVSAGSSHGGTAAKQEPGPELNGQEMDSIWYDVWDELDAIPGAEMDRREADKGVAGFDVEDFSGRPCGWDDDCSYLAEPMQFVEHYD

SEQ ID NO: 16770 - DNA, 900 bp, Sorghum bicolor
  misc_feature: Ceres ANNOT ID no. 8666814
  misc_feature: Encodes the peptide sequence at SEQ ID NO 16771
atggtgtggttccaatgcgaggactgtggcgagaacctcaagaagcccaagctcgccagccacttccgctgctgctccgcgtacaagctgtcatgcatcgattgcggcgagttcttcagccaggagaccgtgcaggggcacacccagtgcatctccgaggccgagaagtatggtcctaagggacagaacaagccatccaatggtgtacagggtaaggcagataagccaaagccaaatgcagatgttgatatcaatgttgggctgtcgacacggcctccttggttctgtagcctatgcaagaccactaccacaagcaagcaaactctcttactgcatgctgatgggaagaagcatagggcaaaggcgaaagccttccatgcttctcagaaacaaacaaatggtgcagaacaaactccagatgtgaaggaagccggagctgtacccacaaaagaatctgttcaagtaaatggtggtatgagtggtgatcgtgaaagaaatgatgataaagatgctgcgaaaagaaaacgaatggatgacatgaccatagaggagccagataacacaaaaaaacagcatttaacgcagtctagagatgagaagtcagaaaacaaagtgaagagtaaggcagatgaactaacaagtggtgccgactgcaaaagtgttcagaaacaaaagatcaaatggaagaagattattactaaagcactgaagacgaacgcagatggagttatgaaactaaagaagctacaaaagctagtctccaaggagcttcaggaatgtggtgtctctaaagacgagggtctccatgctaccttgatggataaaatagcttcaagctccagattttctgttgatggcaagcatgttagactggtggctaagaatgaagaagaatcttag

SEQ ID NO: 16771 - protein, 299 aa, Sorghum bicolor
  misc_feature: Useful for making plants with altered alkaloid content
  misc_feature: Functional homolog of the protein sequence given in SEQ ID NO 14423
  misc_feature: Ceres ANNOT ID no. 8666814
  misc_feature (30)..(57): Pfam ID: zf-LYAR Pfam Description: LYAR-type C2HC zinc finger
MVWFQCEDCGENLKKPKLASHFRCCSAYKLSCIDCGEFFSQETVQGHTQCISEAEKYGPKGQNKPSNGVQGKADKPKPNADVDINVGLSTRPPWFCSLCKTTTTSKQTLLLHADGKKHRAKAKAFHASQKQTNGAEQTPDVKEAGAVPTKESVQVNGGMSGDRERNDDKDAAKRKRMDDMTIEEPDNTKKQHLTQSRDEKSENKVKSKADELTSGADCKSVQKQKIKWKKIITKALKTNADGVMKLKKLQKLVSKELQECGVSKDEGLHATLMDKIASSSRFSVDGKHVRLVAKNEEES

SEQ ID NO: 16772 - DNA, 651 bp, Sorghum bicolor
  misc_feature: Ceres ANNOT ID no. 8666851
  misc_feature: Encodes the peptide sequence at SEQ ID NO 16773
atgtcgtcgtcctactcgtcactcctctcaccgagccgcgcccacgcggacgatcatcgggttcttctcggcggcgatgccgacgacgacgacatggcggccgtgtcaagctacctctcactcgacgacatcgtagatgatgtcgtcggcggggagtggtaccgcccgctggcggaggagtcgtcgtcggcggcggcggctgagttgcagccggagccactcttgtttgccacgctgcaagcggaggatggctactgcgtcagtggcagcggcggcgagcagagctcagcggcactagccaacgacaaccacgacaggatcgacctgacgcaggacggaggctcgaggaggctcctgaggagcgagcacggcaagatcgccttcaagacgcggtcggacgtggacgtgctggacgacgggtaccggtggcgcaagtacggcaagaagctggtcaagaacagcccaaacccgaggaactactaccggtgctccagcgaggggtgccgcgtgaagaagcgggtggagcgggaacgggacgacgcgcgcttcgtcatcaccacctacgacggcgtccacaaccacccggccgccgcgccgccacggtcgccggcctatcgcctcggggagccgccgcacgggcaccacgtctag

SEQ ID NO: 16773 - protein, 216 aa, Sorghum bicolor
  misc_feature: The sequence is a functional homolog of SEQ ID NO 206 in the 10/714,887 US patent application
  misc_feature: The sequence is a functional homolog of SEQ ID NO 206 in the 11/435,388 US patent application
  misc_feature: The sequence is a functional homolog of SEQ ID NO 146 in the 10/714,887 US patent application
  misc_feature: The sequence is a functional homolog of SEQ ID NO 146 in the 11/435,388 US patent application
  misc_feature: The sequence is a functional homolog of SEQ ID NO 202 in the 10/714,887 US patent application
  misc_feature: The sequence is a functional homolog of SEQ ID NO 202 in the 11/435,388 US patent application
  misc_feature: The sequence is a functional homolog of SEQ ID NO 204 in the 10/714,887 US patent application
  misc_feature: The sequence is a functional homolog of SEQ ID NO 204 in the 11/435,388 US patent application
  misc_feature: The sequence is a functional homolog of SEQ ID NO 208 in the 10/714,887 US patent application
  misc_feature: The sequence is a functional homolog of SEQ ID NO 208 in the 11/435,388 US patent application
  misc_feature: The sequence is a functional homolog of SEQ ID NO 194 in the 10/666,642 US patent application
  misc_feature: The sequence is a functional homolog of SEQ ID NO 6 in the 10/714,887 US patent application
  misc_feature: The sequence is a functional homolog of SEQ ID NO 6 in the 11/435,388 US patent application
  misc_feature: The sequence is a functional homolog of SEQ ID NO 806 in the 10/412,699 US patent application
  misc_feature: The sequence is a functional homolog of SEQ ID NO 22 in the 10/374,780 US patent application
  misc_feature: The sequence is a functional homolog of SEQ ID NO 231 in the 11/479,226 US patent application
  misc_feature: The sequence is a functional homolog of SEQ ID NO 858 in the 10/225,066 US patent application
  misc_feature: The sequence is a functional homolog of SEQ ID NO 88 in the 10/412,699 US patent application
  misc_feature: The sequence is a functional homolog of SEQ ID NO 1022 in the 10/225,066 US patent application
  misc_feature: The sequence is a functional homolog of SEQ ID NO 2778 in the 10/374,780 US patent application
  misc_feature: The sequence is a functional homolog of SEQ ID NO 86 in the 10/412,699 US patent application
  misc_feature: The sequence is a functional homolog of SEQ ID NO 114 in the 11/375,241 US patent application
  misc_feature: The sequence is a functional homolog of SEQ ID NO 146 in the 10/286,264 US patent application
  misc_feature: The sequence is a functional homolog of SEQ ID NO 2500 in the 10/374,780 US patent application
  misc_feature: The sequence is a functional homolog of SEQ ID NO 672 in the 10/412,699 US patent application
  misc_feature: Ceres ANNOT ID no. 8666851
  misc_feature (137)..(196): Pfam ID: WRKY Pfam Description: WRKY DNA -binding domain
MSSSYSSLLSPSRAHADDHRVLLGGDADDDDMAAVSSYLSLDDIVDDVVGGEWYRPLAEESSSAAAAELQPEPLLFATLQAEDGYCVSGSGGEQSSAALANDNHDRIDLTQDGGSRRLLRSEHGKIAFKTRSDVDVLDDGYRWRKYGKKLVKNSPNPRNYYRCSSEGCRVKKRVERERDDARFVITTYDGVHNHPAAAPPRSPAYRLGEPPHGHHV

SEQ ID NO: 16774 - DNA, 462 bp, Sorghum bicolor
  misc_feature: Ceres ANNOT ID no. 8666880
  misc_feature: Encodes the peptide sequence at SEQ ID NO 16775
atggcgcccaaggcggagaagaagccggcggcgaagaagcccgcggaggaggagcccgcggccgagaaggcggagaagaccccggcggggaagaagccgaaggcggagaagcgcctccccgcgggcaagtccagcgccggcaaggacggcgagggcaagaagggcaagaagaaggccaagaagagcgtggagacctacaagatctacatcttcaaggtgctcaagcaggtgcacccggacatcggcatctcctccaaggccatgtccatcatgaactccttcatcaacgacatcttcgagaagctcgccgccgagtccgccaagctcgcccgctacaacaagaagcccaccatcacgtcccgagagatccagacttccgtccgcctcgtcctccccggggagctcgccaagcacgccgtctccgagggcaccaaggccgtcaccaagttcacctcgtcttag

SEQ ID NO: 16775 - protein, 153 aa, Sorghum bicolor
  misc_feature: Useful for biocontainment applications
  misc_feature: Useful for making plants with modulated flowering time
  misc_feature: Functional homolog of the protein sequence given in SEQ ID NO 13102
  misc_feature: Ceres ANNOT ID no. 8666880
  misc_feature (60)..(130): Pfam ID: Histone Pfam Description: Core histone H2A/H2B/H3/H4
MAPKAEKKPAAKKPAEEEPAAEKAEKTPAGKKPKAEKRLPAGKSSAGKDGEGKKGKKKAKKSVETYKIYIFKVLKQVHPDIGISSKAMSIMNSFINDIFEKLAAESAKLARYNKKPTITSREIQTSVRLVLPGELAKHAVSEGTKAVTKFTSS

SEQ ID NO: 16776 - DNA, 1479 bp, Sorghum bicolor
  misc_feature: Ceres ANNOT ID no. 8666932
  misc_feature: Encodes the peptide sequence at SEQ ID NO 16777
atggggaagcagcagcaggaggggaagcggcgccgcggggagaaggacgggaagcggaaagggacggggaaggcggcggcggcggcggtggcggtggtgaaggtgccggaggacgcggcgccagtgaccgggtgctggatccgcttcccgcgcctgcgcctccgcggctgcatgtcgtcgcgcgccaaggtcgactcctccaccagcgcgcgtcgcggcggcggcggcggcggggaaaccaaaccagtgcctgatgatggttgccaggaccaatcagtcccaccagcctctggttccacaacaaccagtaacaccggaagtatctcaccttcttccatagttggagaggagctaaaactagctttccaactgcgtagatttacttttaatgaactgaagtgtgccacaagaaacttccgacctgagagtcttcttggtgagggaggttttggctgtgtctttaaaggatggattgaggagaatggaactgctcctgttaagccaggcactggattaactgttgctgtcaagacacttaaccatgatgggttgcaggggcataaagagtgggtggcagaagttgattttcttggaaaccttcagcatccacatctagtgaaattggttggctactgcattgaagatgaccaaaggttgcttgtgtatgaatttatgccccgtggaagtttggagaatcatctttttagaaagtcattgcctctcccatgggccattagaatgaaaattgctcttggtgctgccaaaggccttgcttttcttcatgaagaagctgaaagaccagtaatatatcgggacttcaaaacatccaatattcttttagatgcggactataatgcaaaactctctgattttggacttgctaaagatggacctgagggtgataaaacgcatgtgtcaactagggtcatgggaacatatggatatgctgcgcctgaatatgtaatgacaggtcacctgacatcaaagagtgatgtatatagctttggtgtggtactactagagatgatgactggtagaaggtcaatggacaagaacaggccaaatggagaacacaacctggttgaatgggcacgcccttatctgggagaaaggcgcagattctataagcttgtagatcctcgtttggatgggaacttctccataaaaggtgctcagaagacggctcagctggcccatgcctgcctcagccgtgaccccaaggctaggcctctgatgagccaagtggtggaggttctgaagcctctccagaacctcaaggacatggccagctcttcctacttcttccagtccatgcaacatgagcggcgcacaacccttgccaacccacatggcagtcaaagcatgaaagcgcagagtacctttgcgcggaacgggcagcagcccatgaggagcctctcgtatggccctcatgcttccccgtatcgccagtcgccaaggcttgacagcaagcggcaatga

SEQ ID NO: 16777 - protein, 492 aa, Sorghum bicolor
  misc_feature: Useful for making plants with modulated drought sensitivity
  misc_feature: Functional homolog of the protein sequence given in SEQ ID NO 14078
  misc_feature: Useful for making plants with modulated heat sensitivity
  misc_feature: Functional homolog of the protein sequence given in SEQ ID NO 14079
  misc_feature: Ceres ANNOT ID no. 8666932
  misc_feature (115)..(480): SWISSPROT Homolog: EC 2.7.11.1 Non-specific serine/threonine protein kinase
  misc_feature (139)..(419): Pfam ID: Pkinase Pfam Description: Protein kinase domain
MGKQQQEGKRRRGEKDGKRKGTGKAAAAAVAVVKVPEDAAPVTGCWIRFPRLRLRGCMSSRAKVDSSTSARRGGGGGGETKPVPDDGCQDQSVPPASGSTTTSNTGSISPSSIVGEELKLAFQLRRFTFNELKCATRNFRPESLLGEGGFGCVFKGWIEENGTAPVKPGTGLTVAVKTLNHDGLQGHKEWVAEVDFLGNLQHPHLVKLVGYCIEDDQRLLVYEFMPRGSLENHLFRKSLPLPWAIRMKIALGAAKGLAFLHEEAERPVIYRDFKTSNILLDADYNAKLSDFGLAKDGPEGDKTHVSTRVMGTYGYAAPEYVMTGHLTSKSDVYSFGVVLLEMMTGRRSMDKNRPNGEHNLVEWARPYLGERRRFYKLVDPRLDGNFSIKGAQKTAQLAHACLSRDPKARPLMSQVVEVLKPLQNLKDMASSSYFFQSMQHERRTTLANPHGSQSMKAQSTFARNGQQPMRSLSYGPHASPYRQSPRLDSKRQ

SEQ ID NO: 16778 - DNA, 792 bp, Sorghum bicolor
  misc_feature: Ceres ANNOT ID no. 8666953
  misc_feature: Encodes the peptide sequence at SEQ ID NO 16779
atggccgggctgttcaccgagcaggctgctgtgtacgccgcagcacgcccggcgtacccgaaggatctgtttgccaagctctcggcgctcaccgctcaccaccgccgcgcttgggacgtcggtactggcaatggccaggccgccatcggtgttgctgagcactacgacagcgtggtggccacggacgcgtccgtggagcagctgcggcacgccacgccacaccccagggtccggtacctgcacacctccgacgccttgccggaggacgacctcgtcgccatgctgggcggcgaggccagcgtggacctcatcacggtggctctggccgtgcactggttcgacctcccggcgttctatggcgtggcgtgccgcgtcctgcggcggcccggcggggtgatcgcggtctggggatacaactaccgcatgagccctgtggaggacatgatggcgcgcttcttcgacaccacgctgccctactgggacccccgagctcggtactgcactgacggataccgggacctgccgttccccttcgaggacatcgggctcgggaaggaaggagagccggcgagcctcgacatggagcaggagatgtcgttcgagggcctgatcggcgtgctgaggtcgtggtcggcggtgacaacggccaagcagcagcagggcgtggacctgttgggggagcgcgttgtgaaggagctggaggaagggtggggaggggcatcgctggtgaggaaggtcacctacaagggcttcctgctggcaggcaccccggggcccacggctgatgagtga

SEQ ID NO: 16779 - protein, 263 aa, Sorghum bicolor
  misc_feature: Useful for making plants with modulated nitrogen use efficiency
  misc_feature: Functional homolog of the protein sequence given in SEQ ID NO 14424
  misc_feature: Ceres ANNOT ID no. 8666953
  misc_feature (38)..(135): Pfam ID: Methyltransf_11 Pfam Description: Methyltransferase domain
MAGLFTEQAAVYAAARPAYPKDLFAKLSALTAHHRRAWDVGTGNGQAAIGVAEHYDSVVATDASVEQLRHATPHPRVRYLHTSDALPEDDLVAMLGGEASVDLITVALAVHWFDLPAFYGVACRVLRRPGGVIAVWGYNYRMSPVEDMMARFFDTTLPYWDPRARYCTDGYRDLPFPFEDIGLGKEGEPASLDMEQEMSFEGLIGVLRSWSAVTTAKQQQGVDLLGERVVKELEEGWGGASLVRKVTYKGFLLAGTPGPTADE

SEQ ID NO: 16780 - DNA, 1506 bp, Sorghum bicolor
  misc_feature: Ceres ANNOT ID no. 8666972
  misc_feature: Encodes the peptide sequence at SEQ ID NO 16781
atggcgactacgaacgggagcagcaaggtgttcgaggtgcccaaggtggaggtcaggttcaccaagctcttcatcgacggcaagttcgtcgacgccgtctccggcaagacgttcgagacccgggaccctcgcaccggcgaggtgatcgccaccgtcgccgagggagacaaggccgacgtcgacctcgccgtcaaggccgcccgggaggccttcgacaacgggccctggcccaggatgacgggctacgagcgtgggcggatcctgcacaagttcgcggacttgatcgacgagcacgtggaggagctggcgatgctggacacggtggacgccggcaagctcttcctcgtcggcaaggtccgtgacatccccggcgcggcgcacctgctgcggtactacgcgggcgccgccgacaagatccacggcgagacgctgaagatggcgcagcggatgcacgggtacacgctcaaggagcccgtgggcgtggtgggccacatcgtgccgtggaactaccccagcaccatgttcttcttcaaggtcggcccggcgctcgccgccgggtgcaccgtcgtcgtcaagcccgccgagcagacgccgctgtcggcgctcttctacgcgcacctcgcaagggaggccggcgtccccgacggcgtgctcaacgtcgtccccgggttcggtcccacggccggcgccgctgtcgcctcgcacatggacgtcgacaaggtcagcttcacgggttccacggaggtcggacgcgtcgtcatgaaggccgccgccgagagcaacctcaagcccgtctcgctcgagctcggtggcaagtctccggtcatcgtcttcgacgacgccgatctcgacatggccgtcaacctcgtcaacctcgccacctacaccaacaagggcgagatctgcgtcgccggcacacgcatctacgtgcaggaagggatctacgacgcgttcgtggagaaggccgccgagctcgccaagaaatcggtggtcggagacccgttcaacccgcgtgtcaatcaaggccctcaggttgacaaggaccagtaccagaaggttctcaagtacattgatatgggaaagcgcgaaggcgccacgctggtcaccggagggaagccctgcggcgacaagggatactacatcgagcctaccatcttcacggacgtcaaggacaacatgacgatcgcgcaagacgaaatctttgggccggtgatggcgctcatgaaattcaagacggttgaggaggtgattcagaaagcgaacaacacccggtacggcctagcagctggaattgtgaccaagaacatcgacatcgccaacacggtatcgcggtccatccgtgcaggtgccatctggatcaactgctacttcgcattcgaccccgacgcgccattcggggggtacaagatgagcggatttggcaaggacatgggcatggacgccctggagaagtacttgcagaccaagaccgtggtcactcctctatacaacacgccctggctctga

SEQ ID NO: 16781 - protein, 501 aa, Sorghum bicolor
  misc_feature: Useful for making plants with altered carbohydrate content
  misc_feature: Functional homolog of the protein sequence given in SEQ ID NO 13916
  misc_feature: Ceres ANNOT ID no. 8666972
  misc_feature (5)..(501): SWISSPROT Homolog: EC 1.2.1.3 Aldehyde dehydrogenase (NAD(+))
  misc_feature (29)..(491): Pfam ID: Aldedh Pfam Description: Aldehyde dehydrogenase family
MATTNGSSKVFEVPKVEVRFTKLFIDGKFVDAVSGKTFETRDPRTGEVIATVAEGDKADVDLAVKAAREAFDNGPWPRMTGYERGRILHKFADLIDEHVEELAMLDTVDAGKLFLVGKVRDIPGAAHLLRYYAGAADKIHGETLKMAQRMHGYTLKEPVGVVGHIVPWNYPSTMFFFKVGPALAAGCTVVVKPAEQTPLSALFYAHLAREAGVPDGVLNVVPGFGPTAGAAVASHMDVDKVSFTGSTEVGRVVMKAAAESNLKPVSLELGGKSPVIVFDDADLDMAVNLVNLATYTNKGEICVAGTRIYVQEGIYDAFVEKAAELAKKSVVGDPFNPRVNQGPQVDKDQYQKVLKYIDMGKREGATLVTGGKPCGDKGYYIEPTIFTDVKDNMTIAQDEIFGPVMALMKFKTVEEVIQKANNTRYGLAAGIVTKNIDIANTVSRSIRAGAIWINCYFAFDPDAPFGGYKMSGFGKDMGMDALEKYLQTKTVVTPLYNTPWL

SEQ ID NO: 16782 - DNA, 1431 bp, Sorghum bicolor
  misc_feature: Ceres ANNOT ID no. 8666978
  misc_feature: Encodes the peptide sequence at SEQ ID NO 16783
atgatgtcatgctcctcaaatgggggccgcaagacattcgagaccagggacccacggaccggcgacgtgctggcccacgtagcagaggcagacaaagctgacgtggacctggcggtcaagtccgcccgggacgccttcgagcacggcaagtggccccgcatgtcaggctacgagcgtggccggatcatgagcaagctggcggacctggtggagcagcacacggaggagctggcggcgctggacggcgcggacgccgggaagctggtgctgctgggcaagatcatcgacatcccggcggccacgcagatgcttcgctactacgcgggcgccgccgacaagatccacggcgaggtgctgcgcgtctccggcaagtaccaggggtacacgctcaaggagcccgtcggcgtcgtgggggtgatcatcccgtggaacttccccaccatgatgttcttcctcaaggtcagcccggcgctcgccgccgggtgcaccgtcgtcgtcaagcccgccgagcagacgccgctctccgcgctctactacgcgcacctcgccaagctggccggcgttccggacggagtcatcaacgtcgtccccgggttcggccccaccgccggcgccgcgctcacctcccacatggacgtcgacagcgtcgccttcaccggctccacagaggtcggtcgcctcatcatggagtccgccgcgcggagcaacctcaagatggtctccctggagctcggcggcaagtcgccgctcatcgtcttcgacgacgccgacgtcgacatggccgtcaacctctcgcgcctcgccatcttctacaacaagggagaggtttgcgtcgcgggatcgcgcgtgtacgtgcaggaagggatctatgacgagttcgtcaagaaggccgtggaggccgcgcagaactggaaggttggagacccgttcgatgtcaccaccaacatgggtcctcaggtcgacaaggaccaatttgagagggtgctaaagtacattgagcatggcaagagcgaaggagccaccctgctcaccggcggcaagcccgccgccgacaaagggtactacattgagcccaccatctttgtcgatgtcacggaggacatgaagatcgcgcaggaagagatcttcggccccgtcatgtccctcatgaagttcaggtcggttgatgaggtgatcgagaaggccaactgcaccaagtacgggctcgccgccggcatcgtgaccaagagcctggacatcgccaaccgggtgtcgcggtcggtgcgcgccggcaccgtgtgggtgaactgctactacgccttcgacccggacgcgcctttcggcgggtacaagatgagcggattcggccgggaccaggggctggcggccatggacaagtacctgcaggtcaagagcgtcatcaccgcgctcccggactcgccgtggtattga

SEQ ID NO: 16783 - protein, 476 aa, Sorghum bicolor
  misc_feature: Useful for making plants with altered carbohydrate content
  misc_feature: Functional homolog of the protein sequence given in SEQ ID NO 13916
  misc_feature: Ceres ANNOT ID no. 8666978
  misc_feature (11)..(475): SWISSPROT Homolog: EC 1.2.1.3 Aldehyde dehydrogenase (NAD(+))
  misc_feature (5)..(466): Pfam ID: Aldedh Pfam Description: Aldehyde dehydrogenase family
MMSCSSNGGRKTFETRDPRTGDVLAHVAEADKADVDLAVKSARDAFEHGKWPRMSGYERGRIMSKLADLVEQHTEELAALDGADAGKLVLLGKIIDIPAATQMLRYYAGAADKIHGEVLRVSGKYQGYTLKEPVGVVGVIIPWNFPTMMFFLKVSPALAAGCTVVVKPAEQTPLSALYYAHLAKLAGVPDGVINVVPGFGPTAGAALTSHMDVDSVAFTGSTEVGRLIMESAARSNLKMVSLELGGKSPLIVFDDADVDMAVNLSRLAIFYNKGEVCVAGSRVYVQEGIYDEFVKKAVEAAQNWKVGDPFDVTTNMGPQVDKDQFERVLKYIEHGKSEGATLLTGGKPAADKGYYIEPTIFVDVTEDMKIAQEEIFGPVMSLMKFRSVDEVIEKANCTKYGLAAGIVTKSLDIANRVSRSVRAGTVWVNCYYAFDPDAPFGGYKMSGFGRDQGLAAMDKYLQVKSVITALPDSPWY

SEQ ID NO: 16784 - DNA, 711 bp, Sorghum bicolor
  misc_feature: Ceres ANNOT ID no. 8667220
  misc_feature: Encodes the peptide sequence at SEQ ID NO 16785
atgcaggcgcagtgcccccgccccgaagaccgcgtcccaggaggcagcgcgaccgcagcagcgccacccgttcagccagcgaccgcgaccatgtccaccaccaacgcccggacgaagcgctcggcgtccatgcccctccacggcaccggcgccagcgccagcgccggggccggcaagggcagggacccctccccgacgccggggcccggcgggcgcgcgcggctccgcggcgagcagttgcgccagctccaggagctcttcctccgcttcgacctcgacggcgacgggagcctcacgaagctggagctggcggcgctgctccgctcgctgggcctccgcccggccgccggggacgagatccacgcgctcatcgccgccatggacgccgacggcaacggcaccgtggagttcgacgagctcgcctcctccctcgcgccgctgctcctggggccctgccgccccgccgtcgccgtcgaccacgcgcagctcgccgaggccttccgcgccttcgaccgcgacggcaacggattcatctccgccgccgagctcgcgcgctccatggcgctcatgggccaccccatctgctacgccgagctcaccgacatgatgaaagaggccgacaccgacggggacggcgtcatcagcttccaggagttcaccgccatcatggccaagtccgccgtcgacttcctaggcctcgctgccttgtga

SEQ ID NO: 16785 - protein, 236 aa, Sorghum bicolor
  misc_feature: Useful for making plants with modulated salt sensitivity
  misc_feature: Functional homolog of the protein sequence given in SEQ ID NO 13894
  misc_feature: Ceres ANNOT ID no. 8667220
  misc_feature (119)..(225): SWISSPROT Homolog: EC 2.7.11.1 Non-specific serine/threonine protein kinase
  misc_feature (198)..(226): Pfam ID: efhand Pfam Description: EF hand
  misc_feature (162)..(190): Pfam ID: efhand Pfam Description: EF hand
  misc_feature (82)..(110): Pfam ID: efhand Pfam Description: EF hand
  misc_feature (119)..(147): Pfam ID: efhand Pfam Description: EF hand
MQAQCPRPEDRVPGGSATAAAPPVQPATATMSTTNARTKRSASMPLHGTGASASAGAGKGRDPSPTPGPGGRARLRGEQLRQLQELFLRFDLDGDGSLTKLELAALLRSLGLRPAAGDEIHALIAAMDADGNGTVEFDELASSLAPLLLGPCRPAVAVDHAQLAEAFRAFDRDGNGFISAAELARSMALMGHPICYAELTDMMKEADTDGDGVISFQEFTAIMAKSAVDFLGLAAL

SEQ ID NO: 16786 - DNA, 465 bp, Sorghum bicolor
  misc_feature: Ceres ANNOT ID no. 8667397
  misc_feature: Encodes the peptide sequence at SEQ ID NO 16787
atgtcggaccctttcaacccgtactaccgcggagccttcgcgggcggctacagtgcgccgccgccgccgccgcgttactcggactttgaggtcgacctcatcgcgtcccgttacaccggcaccccatcgccttatccatcctctgccgacgtcggcgccttcgactcgtatgtcggcgcgagacgatctgcggaagttctctatcaccaatcttttatgggaagtcatagtactgttggccagattgaggctttatattcatcaaatactatggctaaacgccctaggcttgaaagcagccttcctatatatccacaacgaccggggcaaaaggactgtgccttctatatgagcacgggaacctgtaagtatggagatacctgcaaatttgaccatccacaatgggttccagagggtggggttccaaactggaaagaggtgactatctgtcattattatttgtag

SEQ ID NO: 16787 - protein, 154 aa, Sorghum bicolor
  misc_feature: Useful for making plants with modulated flowering time
  misc_feature: Functional homolog of the protein sequence given in SEQ ID NO 14425
  misc_feature: Ceres ANNOT ID no. 8667397
  misc_feature (108)..(134): Pfam ID: zf-CCCH Pfam Description: Zinc finger C-x8-C-x5-C-x3-H type (and similar)
MSDPFNPYYRGAFAGGYSAPPPPPRYSDFEVDLIASRYTGTPSPYPSSADVGAFDSYVGARRSAEVLYHQSFMGSHSTVGQIEALYSSNTMAKRPRLESSLPIYPQRPGQKDCAFYMSTGTCKYGDTCKFDHPQWVPEGGVPNWKEVTICHYYL

SEQ ID NO: 16788 - DNA, 2295 bp, Sorghum bicolor
  misc_feature: Ceres ANNOT ID no. 8667448
  misc_feature: Encodes the peptide sequence at SEQ ID NO 16789
atgagcgcgctccaagcctccctcctcctccgcccgctcccctccccacggcccccgcgccgccggctttcgctcccctccgcctccgcctcagcctcagcctctttcccccgcggcgcccacgcgccccgccgtgccccgctccgcctccgcgcattggtccccggcgcgccggagcccgacgcccccgagccgcccgcggctgcgtcctcggccgccgcggcggcggaggctgagcccgagccggaggcggaggcggattccacgacggtggcggcgcagcccgccgcgatgagcgggaaggggcagctggaggacctggtggacaaggctagggcctgggccgtggcggtcgcggccgcggtggtggccgcgttcaggaggttcgtcgactggctggcgtcgagggactggatgagctggtggcccttctggaggcccgaccgccggctgcagcagctgatcgacgaggcggacgccaaccccaacgacgccgccaagcagagcgcgctcctccacgagctcaacaagttcagccctgaagatgtcattaaaaggtttgagcagcgaagccatgctgtggatagcaggggggccgcagagtacctgcgggctcttattctcactaacagtatagctgactaccttccagacgaacaatctgggaggtctgcaagtctgccagccctgttgcaagagttgaagcaacgtgtatctgggaatgaggacaaacctttcatgaaccctgggatatcagaaaagcaacctttacatgttgtaatggttgaccccaaatctacaggtagatcaacacgttttgctcaagaaatcttctcaacggtcttgtttacaattgctgtcggtgtaatgtgggtgatgggtgctgctgcacttcaaaagtatattgggagcttaggtggaattggggcatctggtgttggttctagctcatcgtattctccaaaagagatgaataaggatatcatgccagagaagaatgtcaagacatttaaagatgtcaaaggttgtgatgatgcaaaaaaggaacttgaggaggtagttgagtatctcaaaaacccttcaaagttcactcgccttggtggaaagctacctaagggcatacttttgactggtgctccaggaactgggaagactctactagcaaaggccattgctggagaagctggcgtaccattcttttaccgagcaggttctgaatttgaggaaatgtttgttggtgttggtgctcggagagtgaggtcattgtttcaagctgcaaagaagaaggcgccatgcattgtcttcattgatgaaatagatgctgtgggttcaactagaaaacagtgggaagggcacacaaagaagacattgcatcaacttcttgttgagatggacgggtttgaacaaaatgagggaataattgtgatggctgcaacaaacttgccggacattcttgatcctgcactcacaagacctggtagatttgataggcatattgttgtcccaagtccagatgtgcggggtcgccaagagattctggagctctatttgcaagataagccagtggcaaatgatgtagatatcaatgcaattgcccgtagtacacctggctttaatggggctgacctagccaaccttgtaaacattgcagcgataaaggctgcagtcgaaggtgctgacaagttgactgctatgcagttggagtttgccaaagatcgtattatcatgggaactgagaggaaatcaattggacatgctattgttgcgctcaacacccagggtgctcaccccatacacaaggcaactatccttcctcgtgggtctgccctcggaatggtcacacaactcccctcacaggatgagacttctattagcaagaaacaactccttgcacgtcttgatgtttgcatgggtgggagggttgctgaagagctgatctttggggaagacaatgttacaactggggcgagaaatgaccttcacactgcaacagagcttgcacagtacatggtatcaaactgtgggatgagtgaagctatcggtcctgtgcatgtgaaagagcgaccaagtgtagagatgcaatcaaggatagatgccgaggtggtgaagctcctaagagaagcttatgggcgggtcaagcgattgcttaagaagcatgagaagcaattacatgctttggcaaatgcgctgctggagcgtgaaacacttacagcagatgagatcaacaaagtagttcacccctaccaagaagaaccccagttttccttccaagacgaggagtttgctctcacttaa

SEQ ID NO: 16789 - protein, 764 aa, Sorghum bicolor
  misc_feature: Useful for making plants with modulated heat sensitivity
  misc_feature: Functional homolog of the protein sequence given in SEQ ID NO 14426
  misc_feature: Ceres ANNOT ID no. 8667448
  misc_feature (372)..(587): SWISSPROT Homolog: EC 3.6.4.3 Microtubule-severing ATPase
  misc_feature (373)..(556): Pfam ID: AAA Pfam Description: ATPase family associated with various cellular activities (AAA)
  misc_feature (563)..(744): Pfam ID: Peptidase_M41 Pfam Description: Peptidase family M41
MSALQASLLLRPLPSPRPPRRRLSLPSASASASASFPRGAHAPRRAPLRLRALVPGAPEPDAPEPPAAASSAAAAAEAEPEPEAEADSTTVAAQPAAMSGKGQLEDLVDKARAWAVAVAAAVVAAFRRFVDWLASRDWMSWWPFWRPDRRLQQLIDEADANPNDAAKQSALLHELNKFSPEDVIKRFEQRSHAVDSRGAAEYLRALILTNSIADYLPDEQSGRSASLPALLQELKQRVSGNEDKPFMNPGISEKQPLHVVMVDPKSTGRSTRFAQEIFSTVLFTIAVGVMWVMGAAALQKYIGSLGGIGASGVGSSSSYSPKEMNKDIMPEKNVKTFKDVKGCDDAKKELEEVVEYLKNPSKFTRLGGKLPKGILLTGAPGTGKTLLAKAIAGEAGVPFFYRAGSEFEEMFVGVGARRVRSLFQAAKKKAPCIVFIDEIDAVGSTRKQWEGHTKKTLHQLLVEMDGFEQNEGIIVMAATNLPDILDPALTRPGRFDRHIVVPSPDVRGRQEILELYLQDKPVANDVDINAIARSTPGFNGADLANLVNIAAIKAAVEGADKLTAMQLEFAKDRIIMGTERKSIGHAIVALNTQGAHPIHKATILPRGSALGMVTQLPSQDETSISKKQLLARLDVCMGGRVAEELIFGEDNVTTGARNDLHTATELAQYMVSNCGMSEAIGPVHVKERPSVEMQSRIDAEVVKLLREAYGRVKRLLKKHEKQLHALANALLERETLTADEINKVVHPYQEEPQFSFQDEEFALT

SEQ ID NO: 16790 - DNA, 1344 bp, Sorghum bicolor
  misc_feature: Ceres ANNOT ID no. 8667450
  misc_feature: Encodes the peptide sequence at SEQ ID NO 16791
atggcgcggcggtgcccgtgcaggctgctgctagccgtcgtcgtgctcgtgctcgtgtccgctgcagcgcaggcgcaggcgcaggagacgtgctcgggggccgtgccggcgccgccgcggcgcggggcgcgggtgtccgtggccagcttcggcggcgcgggcgacgggcggacgctcaacacggcggcgttcgcgcgcgccgtcgccaccatcgagcgccgcgccgtgcccggcggggcggagctctacgtgccgccaggggtgtggctcacggggcccttcaaccttacctcgcgcatgacgctcttcctcgcgcgcggcgccgtcgtccgcgccacgcaggacacatcaagctggcctctgatcgaaccactgccctcatatgggagaggacgagagctgcccggcggaagatacatcagtttaatccatggcagtgggcttcaggatgttgtcatcacaggtgagaatggaactattgatggtcaaggcaccccatggtgggatatgtggaagaagggcacactgctctacacaaggcctcaccttcttgagctgatgagctcttctcatatcatcgtctccaatgttgtctttcaggattcaccattctggaacattcatcctgtttattgcagcaatgttgtgatcagaaatgtgactatcctagctccacatgactcccccaacacggatggaattgatccagattccagcagcaacatctgcattgaggattgctacatttcgacgggtgacgatgccattgccatcaagagtggctgggatgagtatggaatcgcttatggccgccccagctccgacatcaccgtccgccggatcacaggctcctccccttttgccggcttcgctgttggaagcgaaacatcaggtggcgtggagaacgtccttgcagagcacctgaacttcttcagctcagggttcgggatccacatcaagaccaacaccggcaggggaggcttcatccggaacgtcactgtctccgacgtgaccctggataacgtccgctacggcctgcggatcgtcggcgatgttggcaaccaccccgacgagcgctacaaccggagcgcgctcccaatcgttgacgccctgacgataaagaatgtccagggccagaacatcaaggaggctgggctgatcaagggcattgccaactcggccttctcccggatctgcctgtcgaacgtcaagctcactggaggtgcgcctgtccagccgtggaagtgcgaggctgtcagcggtggcgctctcgacgtgcagccgtcgccgtgcacagaactgacttccacgtccgggacgagcttctgtacaaattcactctag

SEQ ID NO: 16791 - protein, 447 aa, Sorghum bicolor
  misc_feature: Useful for making plants with altered carbohydrate content
  misc_feature: Functional homolog of the protein sequence given in SEQ ID NO 14427
  misc_feature: Useful for making plants with altered cell wall content and/or composition
  misc_feature: Functional homolog of the protein sequence given in SEQ ID NO 14428
  misc_feature: Ceres ANNOT ID no. 8667450
  misc_feature (184)..(390): SWISSPROT Homolog: EC 3.2.1.15 Polygalacturonase
  misc_feature (45)..(164): SWISSPROT Homolog: EC 3.2.1.82 Exo-poly-alpha-galacturonosidase
  misc_feature (75)..(432): Pfam ID: Glyco_hydro_28 Pfam Description: Glycosyl hydrolases family 28
MARRCPCRLLLAVVVLVLVSAAAQAQAQETCSGAVPAPPRRGARVSVASFGGAGDGRTLNTAAFARAVATIERRAVPGGAELYVPPGVWLTGPFNLTSRMTLFLARGAVVRATQDTSSWPLIEPLPSYGRGRELPGGRYISLIHGSGLQDVVITGENGTIDGQGTPWWDMWKKGTLLYTRPHLLELMSSSHIIVSNVVFQDSPFWNIHPVYCSNVVIRNVTILAPHDSPNTDGIDPDSSSNICIEDCYISTGDDAIAIKSGWDEYGIAYGRPSSDITVRRITGSSPFAGFAVGSETSGGVENVLAEHLNFFSSGFGIHIKTNTGRGGFIRNVTVSDVTLDNVRYGLRIVGDVGNHPDERYNRSALPIVDALTIKNVQGQNIKEAGLIKGIANSAFSRICLSNVKLTGGAPVQPWKCEAVSGGALDVQPSPCTELTSTSGTSFCTNSL

SEQ ID NO: 16792 - DNA, 1785 bp, Sorghum bicolor
  misc_feature: Ceres ANNOT ID no. 8667464
  misc_feature: Encodes the peptide sequence at SEQ ID NO 16793
atgcagaaacagttcacaaatttcacgcttaagcaaaagcaggtgttaagtagtgaagaaatcattgatgagtttgagttgctaacgcgtgatgctaaacgcgtgcagcaggatacattgagaaagattcttgaactgaatggtgatgctgagtatctgaatcgcttcaatcttggaaggagaacagattcaaagagctttaaatcctgcattcctctatgtgtgcatagtgacatagagtcctacatccagaggatagccgatggagatgactcactggtgctaactgggaagcccatcacttccctctccgtaagttctggtacgacgcagggaaaacccaagtttttgccattcaatgatgaattgcttgagagtacagttcaaatattccgaacctcatatgcttttagaaatcgtgaatatcctattggcaatggaaaagccttgcagtttgtttatgggagcaagcaagtcttcacccaagggggcattcttgctacaactgcgacaacaaatttgtacaggagtcggcgtttcaaggaagcaatgaaggatatcatgtctcagtgctgcagtcctgatgaagtcatctttggtcctgacttccatcagtctttgtactgccatctattatgcgggttaatctactcagatgaagttcagtttgttttctcgccatttgcacacagcctcgtccatgcatttcacaccctcgaggaggtatgggaagatctatgtgctgatataagagatggtgttctctcaaagagagtcaccacaccttctatccgccaagctgtttcaaaaatcttgaggccgaatcctgagcttgctagctcgatttacattaagtgccagaatctgagtaattggtatggggtaattccaacactatggccaaatgccaagtacatctatggcattatgacagggtccatggagccatacctaaagaaactgagacattatgctggtcacttaccactgatgagtgctgactatggtgcatctgaaggatgggttggttctaatgtaaacccaaccctgccgcctgaggaggtgacatatgctgttcttccgaatattgcttattttgagttcattcctctggaaaaaacgaaaggcgacgaaatggagaacagttcctctattcactacatagagtcagagcctgttggcctaactgaagttgaggttggcaaaatctacgaagttgtaataacaaattttgcaggtctataccgatacagactgggagatattgtggagatagcgggcttccataactcgacaccagagctccagttcatctgccgcagaagtctagtcctcagcatcaacatcgacaagaacacagagaaagacctgcagctagccgtcgaagaggcggagaagctcttggccgcggagaaggtggaggtggtggacttcacgagcctcgtggacagatcgagcgacccagggcactacgtcatcttctgggagctgagctccgacagcgccagcgaagatgtcctgatcggctgcgccaacagcatggacctggcctttgtggacgccgggtacgtcgggtcgaggaagatcaagaccatcggcgccctcgagctccgggtgctccggaagggaaccttcgggcaggtcatggaccactacctgagcctcggcggcgccgtcagccagttcaagacgccgcggttcgtgagccagtccaacagcaaggtgctgcagatactgagcaggaacgtcacccagtgctacttcagcactgcatatgggctctga

SEQ ID NO: 16793 - protein, 594 aa, Sorghum bicolor
  misc_feature: Useful for making plants with modulated light quality sensitivity
  misc_feature: Functional homolog of the protein sequence given in SEQ ID NO 13895
  misc_feature: Ceres ANNOT ID no. 8667464
  misc_feature (20)..(578): Pfam ID: GH3 Pfam Description: GH3 auxin-responsive promoter
MQKQFTNFTLKQKQVLSSEEIIDEFELLTRDAKRVQQDTLRKILELNGDAEYLNRFNLGRRTDSKSFKSCIPLCVHSDIESYIQRIADGDDSLVLTGKPITSLSVSSGTTQGKPKFLPFNDELLESTVQIFRTSYAFRNREYPIGNGKALQFVYGSKQVFTQGGILATTATTNLYRSRRFKEAMKDIMSQCCSPDEVIFGPDFHQSLYCHLLCGLIYSDEVQFVFSPFAHSLVHAFHTLEEVWEDLCADIRDGVLSKRVTTPSIRQAVSKILRPNPELASSIYIKCQNLSNWYGVIPTLWPNAKYIYGIMTGSMEPYLKKLRHYAGHLPLMSADYGASEGWVGSNVNPTLPPEEVTYAVLPNIAYFEFIPLEKTKGDEMENSSSIHYIESEPVGLTEVEVGKIYEVVITNFAGLYRYRLGDIVEIAGFHNSTPELQFICRRSLVLSINIDKNTEKDLQLAVEEAEKLLAAEKVEVVDFTSLVDRSSDPGHYVIFWELSSDSASEDVLIGCANSMDLAFVDAGYVGSRKIKTIGALELRVLRKGTFGQVMDHYLSLGGAVSQFKTPRFVSQSNSKVLQILSRNVTQCYFSTAYGL

SEQ ID NO: 16794 - DNA, 1257 bp, Sorghum bicolor
  misc_feature: Ceres ANNOT ID no. 8667481
  misc_feature: Encodes the peptide sequence at SEQ ID NO 16795
atggagctggaggcggcgccgcggcagcagcagcagcagctggaggaggaggtggaggtggtggggtgcccatgcggcggcgggtccgaggccgcggaccagttcgagcggctccacgacgcggtgctgctcgacgtcctcaaccgcatcggcgacgtcaaggcgctgggccgctgcgccctcgtctcgcgccgcttccacgcgctcgtgccgctcgtcaactccgtcttcgtccgcgtcgactgcgtcatccccgacgacccgacgccctccgccgccgccgccgcaccgggctccccgacgcaccaggccccggccccggccgcgcgcgggcgcggcggcgcgctcgcgcacatggcgcgcgtcctgctcggcggcatcgccaagcccatccacgcgctcgcccagatcctctcccccgccgcggcggccgtctcccggcgctccgacccaccactgcccgcttccccgcccgcacccgtcgcggacgtctcccaccactcgccctccgaggtgctccgctccttcagggagctgcggcgcctccacatcgagctgcccacgggcgagctcggcattgacgacggtgtgctccttaagtggaaggccgacttcggctccaccctcggcagctgcgtcatcctcggcgcctcgtcggtcttgtccaagccgcccacagggtcgaccacccaggcggaacctgctgcggccgacagcacggccgccgctccggataccagtagggagactgaagagccggggagcctgcctgattctctctacacaaatggaggcctcaagcttcgcgttgtctggaccatcagctccctgattgctgcgtcggcgaggcattactcgctgcacccgattatctgtaatcacgaaacgctggagagcttggacctgacagatgccgacggccaaggggtgctcaccatggacaagaggcagctgcaggaactgcgggtgcggcccgtctctccgtcagagagctcgcaccgcacactcatgccggcactcagtatgcgtctgcactatgcaccgctcattgagctgcctgggggaaccctgctgaagggcgcgacactggttgcgatcagaccaagcgaggatgccttgagcgagggccaaggggctggggctgcaggtcctgttggtacatgctggatttcagaggcccttgaggagccatatcggactgctgcaaaggtgcttctcaagagaagggcatattgccttgaaatgaactcgttctga

SEQ ID NO: 16795 - protein, 418 aa, Sorghum bicolor
  misc_feature: Useful for making plants with modulated low light sensitivity
  misc_feature: Useful for making plants with modulated nitrogen use efficiency
  misc_feature: Functional homolog of the protein sequence given in SEQ ID NO 13503
  misc_feature: Ceres ANNOT ID no. 8667481
MELEAAPRQQQQQLEEEVEVVGCPCGGGSEAADQFERLHDAVLLDVLNRIGDVKALGRCALVSRRFHALVPLVNSVFVRVDCVIPDDPTPSAAAAAPGSPTHQAPAPAARGRGGALAHMARVLLGGIAKPIHALAQILSPAAAAVSRRSDPPLPASPPAPVADVSHHSPSEVLRSFRELRRLHIELPTGELGIDDGVLLKWKADFGSTLGSCVILGASSVLSKPPTGSTTQAEPAAADSTAAAPDTSRETEEPGSLPDSLYTNGGLKLRVVWTISSLIAASARHYSLHPIICNHETLESLDLTDADGQGVLTMDKRQLQELRVRPVSPSESSHRTLMPALSMRLHYAPLIELPGGTLLKGATLVAIRPSEDALSEGQGAGAAGPVGTCWISEALEEPYRTAAKVLLKRRAYCLEMNSF

SEQ ID NO: 16796 - DNA, 1578 bp, Sorghum bicolor
  misc_feature: Ceres ANNOT ID no. 8667486
  misc_feature: Encodes the peptide sequence at SEQ ID NO 16797
atgggcaaccgtgcgtcgcgctacaaccgccccgccgccgagcagcagccggcctcgtcgaccccgcccaagccccagacccagccgccgccgacgcagcagcagtaccagcaggccccgccgccgcagcagccgcagccgaagccggcggcgggggcgggggcgagggcggtggggcgcgtgctgggacggcccatggaggacgtgcgcgcgacctacaccttcggccgcgagctcgggcggggccagttcggggtcacctacctcgtcacgcaccgggagaccgggcagcgcttcgcctgcaagtccatcgccacgcggaagctcgtccaccgagacgacatcgaggacgtgcgccgggaggtgcagatcatgcaccacctcacggggcaccgcaacatcgtcgagctccggggagcctacgaggacaggcactcggtcaacctcgtcatggagctctgcgagggcggggagctcttcgaccgcatcatcgccaagggccactacaccgagcgcgccgccgccgcgctctgccgcgagatcgtcgccgtcgtccacagctgccactccatgggcgtcttccaccgggatctcaagcccgagaacttcctgttcctcaataacaaggaggactccccgctcaaggccacggacttcggcctctccgtcttcttcaagcacggggagatgtttaaggatcttgtgggaagtgcgtattatgttgctcctgaggtactgaaacggcactatggggcagaggctgacatatggagtgctggggttattctttacatccttctgtctggtgttcctcctttttgggcagagaatgaggatggtatatttgatgccgttttgcgtggtcacattgacttcacttctgatccttggccttcaatatctaatggtgcaaaggatttggttaagaagatgctgcgaccagacccaaaagaacgcctgactgctgctgaaattttgaaccacccatggattagagaggatggagaggccccagataagccacttgacattactgtcattggtagaatgaaacagttcagggcaatgaacaagctcaagaaagttgcattgaaggttgtggctgagaacttatcagatgaagagattatgggcctaaaagaaatgttcagatccctggatacagataacagtgggacaattactcttgaagagctaagatctggtttaccaaaacttggtacaaaaatttctgaatcggaaatcaaacagttgatggaggcggctgatgttgatggaaatggtaccattgattatggggagtttatatctgccacaatgcacttgaatagattggagaaggaagaccacatactcaaagcttttgaatattttgataaggaccacagcggatacataacagtagatgagttggaagaagctctgaagaagtatgatatgggagatgacaaaacaataaaagaaatcattgctgaagtagattcagatcatgatggaagaattaattaccaagagtttgttgccatgatgagaaacaacagccctgagattgttccaaatcggaggcgcatgttctaa

SEQ ID NO: 16797 - protein, 525 aa, Sorghum bicolor
  misc_feature: The sequence is a functional homolog of SEQ ID NO 2 in US patent 7084323
  misc_feature: Ceres ANNOT ID no. 8667486
  misc_feature: Down-regulated in shoot tissues in response to methyl jasmonate treatment
  misc_feature: Down-regulated in shoot tissues in response to salicylic acid treatment
  misc_feature (65)..(511): SWISSPROT Homolog: EC 2.7.11.1 Non-specific serine/threonine protein kinase
  misc_feature (73)..(331): Pfam ID: Pkinase Pfam Description: Protein kinase domain
  misc_feature (485)..(513): Pfam ID: efhand Pfam Description: EF hand
  misc_feature (450)..(478): Pfam ID: efhand Pfam Description: EF hand
  misc_feature (378)..(406): Pfam ID: efhand Pfam Description: EF hand
  misc_feature (414)..(442): Pfam ID: efhand Pfam Description: EF hand
MGNRASRYNRPAAEQQPASSTPPKPQTQPPPTQQQYQQAPPPQQPQPKPAAGAGARAVGRVLGRPMEDVRATYTFGRELGRGQFGVTYLVTHRETGQRFACKSIATRKLVHRDDIEDVRREVQIMHHLTGHRNIVELRGAYEDRHSVNLVMELCEGGELFDRIIAKGHYTERAAAALCREIVAVVHSCHSMGVFHRDLKPENFLFLNNKEDSPLKATDFGLSVFFKHGEMFKDLVGSAYYVAPEVLKRHYGAEADIWSAGVILYILLSGVPPFWAENEDGIFDAVLRGHIDFTSDPWPSISNGAKDLVKKMLRPDPKERLTAAEILNHPWIREDGEAPDKPLDITVIGRMKQFRAMNKLKKVALKVVAENLSDEEIMGLKEMFRSLDTDNSGTITLEELRSGLPKLGTKISESEIKQLMEAADVDGNGTIDYGEFISATMHLNRLEKEDHILKAFEYFDKDHSGYITVDELEEALKKYDMGDDKTIKEIIAEVDSDHDGRINYQEFVAMMRNNSPEIVPNRRRMF

SEQ ID NO: 16798 - DNA, 1602 bp, Sorghum bicolor
  misc_feature: Ceres ANNOT ID no. 8667557
  misc_feature: Down-regulated in shoot tissues in response to methyl jasmonate treatment
  misc_feature: Down-regulated in shoot tissues in response to salicylic acid treatment
  misc_feature: Encodes the peptide sequence at SEQ ID NO 16799
atggacggagatggcgcggcggtgctccgggaggtctcgctctcgccgtggagcgtgctactaggcggggcggcggccgtgctgctcctgtggttggcggcgcaggtgctggagtgggcctggtgggcgccccggcgcatgaaccgtgccctgagagcgcagggcctgagaggcacccagtaccgcctcctctggggcgatctcatggaggaccagcgtctcatcgcggcggccaaaactaggcccgtctccgtggatcgaccacacgacatcctccctcgcgtcgcgcctctccttcaccacgccatccaggagcacggtaaggtctcgtttacatggttcgggccgaccccaagagttgtaatcaccgatcctgagcttgcccgggaagtgttgacaaataagtgtggcgacttcacgaaatcgatgctgtctcctctctcaaagttgctggttgctgggctcgtgatccttgacggtgaaaaatgggctaaacatcggaggattcttaatccggcattccatgcggagaagctaaagggaatgctgccggcattcttggcatgttgcaacgaactggttgacagatgggagaaacatatttcatcttctgttgaaccaaccgagctggatgtgtggccagagttccaaaatttatcaggagatgtaatctcaagagctgcattcggtgttggttatgaagaagggagaagaattttcctacttcaggccgagcaagctgaacgccttgttcaatctttcaggataaattacatccctggcttctctctcttgccgacagaaaacaatagaaggatgaatgcaatcgatagggaggtcaagacgatcctgaggcgcataatagagaagagacataaggctgttacggacggtgaagcaaccaaggacgacctgctgggattgctactggagtcgaacatgaattacagtgactcggatggcaaatccagcaaggggattaccgtggaagaggtgatcggcgagtgcaaggtgttctacttcgcaggcatggagactaccggtgtgctgctcacatggacaatggtactgctaagcatgcacccggagtggcaggatcgtgccagggaggaagtcctgcaagtctttggtgaaaacaaaccggatttcaatggcgtggcacgcctaaaagttgtgaccatggtgctgtacgaggtgttgcgtctgtaccctccggtggtggccatgaaccgccggacacaccgggcgacgaagctgggaggcgtcacgtacccggcgggagtcatgctcacgacgcccgtgatgttcctgcaccgggaccctgccctctgggggtccgacgccggcgagttcaatccggggaggttcgccgagggcgtgtccaaggcgtgcagcgacccggggggcttcgtccccttcagctgggggccgcgcgtctgcatcggccagaacttcgcgctcgtggaggccaagctggctctcagcatgatcctgcagcgcttcgcgttcgagctgtcgccggcgtacgtgcacgcgccctacaccgtcctcacgctgcacccgcagcacggcgttccgctcaggctgcggcgcaggctatga

SEQ ID NO: 16799 - protein, 533 aa, Sorghum bicolor
  misc_feature: Useful for making plants with modulated nitrogen use efficiency
  misc_feature: Functional homolog of the protein sequence given in SEQ ID NO 14191
  misc_feature: Useful for making plants with modulated cold sensitivity
  misc_feature: Functional homolog of the protein sequence given in SEQ ID NO 14189
  misc_feature: Useful for biocontainment applications
  misc_feature: Useful for making plants with modulated biomass
  misc_feature: Useful for making plants with modulated flowering time
  misc_feature: Functional homolog of the protein sequence given in SEQ ID NO 14190
  misc_feature: Ceres ANNOT ID no. 8667557
  misc_feature (44)..(524): SWISSPROT Homolog: EC 1.3.3.9 Secologanin synthase
  misc_feature (88)..(528): Pfam ID: p450 Pfam Description: Cytochrome P450
MDGDGAAVLREVSLSPWSVLLGGAAAVLLLWLAAQVLEWAWWAPRRMNRALRAQGLRGTQYRLLWGDLMEDQRLIAAAKTRPVSVDRPHDILPRVAPLLHHAIQEHGKVSFTWFGPTPRVVITDPELAREVLTNKCGDFTKSMLSPLSKLLVAGLVILDGEKWAKHRRILNPAFHAEKLKGMLPAFLACCNELVDRWEKHISSSVEPTELDVWPEFQNLSGDVISRAAFGVGYEEGRRIFLLQAEQAERLVQSFRINYIPGFSLLPTENNRRMNAIDREVKTILRRIIEKRHKAVTDGEATKDDLLGLLLESNMNYSDSDGKSSKGITVEEVIGECKVFYFAGMETTGVLLTWTMVLLSMHPEWQDRAREEVLQVFGENKPDFNGVARLKVVTMVLYEVLRLYPPVVAMNRRTHRATKLGGVTYPAGVMLTTPVMFLHRDPALWGSDAGEFNPGRFAEGVSKACSDPGGFVPFSWGPRVCIGQNFALVEAKLALSMILQRFAFELSPAYVHAPYTVLTLHPQHGVPLRLRRRL

SEQ ID NO: 16800 - DNA, 1590 bp, Sorghum bicolor
  misc_feature: Ceres ANNOT ID no. 8667555
  misc_feature: Encodes the peptide sequence at SEQ ID NO 16801
atggtcagctgcgtggtgctgctccacgagacctccccatggagcgtgctcggtggtgcggcggcaatgttggccctgtggtgggcaatgcaggcgctggagtgggcctggtggactcctcggcgaatagagcgaaccctcagggcgcagggcctaaggggcacccggtaccgcttcctgtggggcgacctcaaggaggagagccggctaacagcgacagccctggcgaagcccgtgcacacggaccggccccatgacatcttcccacgtgtttcccctctccttcatcgtgccgtcgaggagcatggcaaactctcgttcacgtggttcgggacgaccccaagaattgcaatcgccgaccctcagctggcccgggaagttatgtcgaacaaagatggctacttcgtgaaaacaaagataaccactcgtgtcacgaagcttctatttgctggggttgcgattcttgacgccgagaaatgggccaagcataggaagattctgaatccggcctttcatgctgagaagctcaaggggatgttgccggcgttctctgcagcttgcagcgatctaatttgtagatgggacaacttagttgctgattctgtcggaacaaaagagctggatgtatggcctgaattccaaaatttatcaggggatgtcatatcaagagctgttttcggtgttagctaccaagaaggcaggcgaattttccgacttcaagctgaacaagttgttcgcgttaccaatgctttcaagacaaatcacatcccaggattctctcttttaccgacagaaaacaacagaaggatgaaggctatcgattgggagatcaagacgatcctaaggggaataatagagaagagacatgaggccatgaagaacggtgaacccaacaaagatgacttgctcggcatgctattagagtcaaacatgaattatacagattcagacggaaaatccagccgtgggattaccctagaagaagtgatcgaagaatgcaagctgttctactttggaggaacggagagtaccgcggtcctgctgacatggacagtagtagtcctaagcatgcatcccgagtggcaagatcaagccagggatgaggttttggaagtctttgggcaaaacaacccagatttcagtggtgttagtcgtctaaaagttgtgaccatggtgctgtatgaggtgctacgcctttatcctccggcgttgtttattaaccgtcggacgcacaagcagacagagcttggaggcgtcacgtacccaccggatgtcatggttctggtgcccatcatgttcatccaccgggaccctgccctctgggggactgacgccggcgagttcaacccgaggaggttcgccgagggcgtgtccaaggcgtgcagcgacccgggcgccttcatccccttcagctggggaccgcgcatctgcatcgcccagaacttcgcgctgctggaggctaagttggccatcagcatgatcttgcagcgcttcgcatttgagctgtctccggcgtacgttcacgcgccctgcaacgtcctcacgctccacccacagcacgacgttctgattaggctacaccgactctaa

SEQ ID NO: 16801 - protein, 529 aa, Sorghum bicolor
  misc_feature: Useful for making plants with modulated nitrogen use efficiency
  misc_feature: Functional homolog of the protein sequence given in SEQ ID NO 14191
  misc_feature: Ceres ANNOT ID no. 8667555
  misc_feature (39)..(519): SWISSPROT Homolog: EC 1.3.3.9 Secologanin synthase
  misc_feature (84)..(525): Pfam ID: p450 Pfam Description: Cytochrome P450
MVSCVVLLHETSPWSVLGGAAAMLALWWAMQALEWAWWTPRRIERTLRAQGLRGTRYRFLWGDLKEESRLTATALAKPVHTDRPHDIFPRVSPLLHRAVEEHGKLSFTWFGTTPRIAIADPQLAREVMSNKDGYFVKTKITTRVTKLLFAGVAILDAEKWAKHRKILNPAFHAEKLKGMLPAFSAACSDLICRWDNLVADSVGTKELDVWPEFQNLSGDVISRAVFGVSYQEGRRIFRLQAEQVVRVTNAFKTNHIPGFSLLPTENNRRMKAIDWEIKTILRGIIEKRHEAMKNGEPNKDDLLGMLLESNMNYTDSDGKSSRGITLEEVIEECKLFYFGGTESTAVLLTWTVVVLSMHPEWQDQARDEVLEVFGQNNPDFSGVSRLKVVTMVLYEVLRLYPPALFINRRTHKQTELGGVTYPPDVMVLVPIMFIHRDPALWGTDAGEFNPRRFAEGVSKACSDPGAFIPFSWGPRICIAQNFALLEAKLAISMILQRFAFELSPAYVHAPCNVLTLHPQHDVLIRLHRL

SEQ ID NO: 16802 - DNA, 1530 bp, Sorghum bicolor
  misc_feature: Ceres ANNOT ID no. 8667566
  misc_feature: Encodes the peptide sequence at SEQ ID NO 16803
atggacgacgacgttgcagcagctgcgccgccatcgccatggagccttctccaggggctcctcgccctgctcatcgtgtggggagcctaccgtgccgcgcagacattctggctgcggccgcggcggctcgaccgggcgctccgggctcaggggctcaccggcacggagtactgcttccccgccggcgacctgaaggagaacgccaggctcaacgacgaggcgcggtcgaggcccatgccgccgtgccacgacgttgttccccgcgtgatgccgcatctcttcagcactatcaaggagcacgggaacatttgtgtcacctggttcggaccaattcccagggtggtcattacggaggcagagttagtcagagacatcctatcaaacaagtttggtcactttgagaagttcacaaacaagcgtctggggaaattgctcgcccttggacttgcgagttacgatggtgagaaatgggcaaaacacagaaggatcctgaaccccgcattccatcttgaaaagctcaagcgcatgctgccggagttctcgacgtgctgtaccgagcttatagatcgttgggagaacaagatcgctggttctgacggatcatatgaactggatatctggccggagtttcagaacctcacaggagacgtgatctcccgcacagcattcggcagcagcttcatggaagggcgaaggatcttccaacttcagggcgagcaagcagagcgattcttcccgacacagaacaatcggaggatgaaagaaatcaacagagaaattgaagggactctaaggggcatgattgagaagagggagcgcgcaatcgagaacggtgaaaccagcggcaacgacttgctcggcttgctgctgcagtcgaacatggatagcgggaaaggcagcctgagaatgagcaccgaggacgtgattgaggagtgcaagctcttctacttcgcagggatggaaaccacgtcggtgttgctcacgtggacgctcgtcattctaggcatgcaccctgagtggcaggaccgcgcgagggaggaggtcctcagcgtgttcggtagggacaagcagcccaattttgatggactaggtcgactcaaaacggtgacgatgatactatatgaggtgctcaggttgtacccaccggcagtgaccctaaaccgaagaacattcaaagacatgcagattggaggcatcacataccctgcaggggtaatccttgagcttcccataatcgccgtccaccacaatcctcacatctgggggaaggacgcacatgagttcaagccagagaggttcgctgaggggatctcaaaggcgaccaaggaccaacctgcgttcttcccgttcggatgggggccgcggatctgcattgggcagaactttgcgttgcttgaggccaagatagccttgagcatgatcctccaacgctttgaattccaactgtcgccttcatacacgcatgcaccctacacggtcattacgctgcatcctcagcatggtgcgccaattatattcaagaagatctga

SEQ ID NO: 16803 - protein, 509 aa, Sorghum bicolor
  misc_feature: Useful for making plants with modulated nitrogen use efficiency
  misc_feature: Functional homolog of the protein sequence given in SEQ ID NO 14191
  misc_feature: Useful for making plants with modulated cold sensitivity
  misc_feature: Functional homolog of the protein sequence given in SEQ ID NO 14189
  misc_feature: Ceres ANNOT ID no. 8667566
  misc_feature (244)..(509): SWISSPROT Homolog: EC 1.3.3.9 Secologanin synthase
  misc_feature (80)..(505): Pfam ID: p450 Pfam Description: Cytochrome P450
MDDDVAAAAPPSPWSLLQGLLALLIVWGAYRAAQTFWLRPRRLDRALRAQGLTGTEYCFPAGDLKENARLNDEARSRPMPPCHDVVPRVMPHLFSTIKEHGNICVTWFGPIPRVVITEAELVRDILSNKFGHFEKFTNKRLGKLLALGLASYDGEKWAKHRRILNPAFHLEKLKRMLPEFSTCCTELIDRWENKIAGSDGSYELDIWPEFQNLTGDVISRTAFGSSFMEGRRIFQLQGEQAERFFPTQNNRRMKEINREIEGTLRGMIEKRERAIENGETSGNDLLGLLLQSNMDSGKGSLRMSTEDVIEECKLFYFAGMETTSVLLTWTLVILGMHPEWQDRAREEVLSVFGRDKQPNFDGLGRLKTVTMILYEVLRLYPPAVTLNRRTFKDMQIGGITYPAGVILELPIIAVHHNPHIWGKDAHEFKPERFAEGISKATKDQPAFFPFGWGPRICIGQNFALLEAKIALSMILQRFEFQLSPSYTHAPYTVITLHPQHGAPIIFKKI

SEQ ID NO: 16804 - DNA, 1602 bp, Sorghum bicolor
  misc_feature: Ceres ANNOT ID no. 8667554
  misc_feature: Encodes the peptide sequence at SEQ ID NO 16805
atggttggcggcgtggcgctgctccgcgaggcctccccatccccatggagcgtgctcgccggggtggcggcggcgctggtcctgtggtgggcggcgcaggtgctggagtacgcctggtgggctccccggcgaatggagcgggccctcagggcgcagggcctgaggggcacccggtaccgcttcctgtggggtgacctcaaggaggaaagccggctaacggcggcagccctggccaggcccgtgcgcacggaccggccccacgacgtcttcccgcgtgtttcgcctctccttcaccgtgtcgtccaggagcatggcaaactctcgttcacgtggttcgggacgaccccaagaattacaatcactgaccctcagcttgccagggaagttatgtcgaacaaagatggatgcttcttgaaaacaaagataaccactcgtgtcacgaagcttctatttggtggggttgcgattcttgacgccgaaaaatgggccaagcataggaggattctgaatccggcctttcatacagagaagctcaaggggatgttgccagcgttcactgcagcttgcagcgatctaatttgcagatgggagaacttagttgctgattctgtcggatcaaaagagctggacatatggtctgaattccaaagtttatcaggggatgtaatatcaagagctgttttcggtgttagctaccaagaaggcagacgaattttccgacttcaagctgaacaagttgttcgcgttaccaatgctttcaagacaaatcacatcccaggattctctcttttaccaacagaaaacaacagaaggatgaaggctatcgatagggagaccaagacgatcctaaggggaataatagagaagagacatgaggccatgaagaacggtgaacccaccaccaccagagatgacttgctcggcatgctattagagtcaaatatgaattacacagattcagacggaaaatccagccgtgggattaccctagaagaagtgatcgaagaatgcaagctgttctactttgcaggaacagagactaccgctgtcctgctgacatggacaatagtagtcttaagcatgcatccggagtggcaagatcaagccagggatgaagttttggaagtctttgggcaaaacaacccagatttgagcggtgttagccgtctaaaagttgtgacgatggtgttgtatgaggtgctacgtctttatcctccggcgctgtttattaaccgccggacttacaagcagacagagcttggaggtgtcatgtacccaccggatgtcatggttatggtgcccatcatgttcatccatcgagaccctgacctctggggggatgacgccggcgagttcaacccgaggaggttcgccgacggcgtgtccaaggcgtgcagcgacccgggcgccttcattcccttcagctggggaccgcgcatctgcatcggccagaacttcgcgctgctggaggcaaagttggccatcagcatgatcttgcagcgcttcgcgtttgagctctctccggcgtatgttcacgcgccctacaacgtcctcacgctccacccgcagcacggcgttctggttcggctacgccaactctga

SEQ ID NO: 16805 - protein, 533 aa, Sorghum bicolor
  misc_feature: Useful for biocontainment applications
  misc_feature: Useful for making plants with modulated biomass
  misc_feature: Useful for making plants with modulated flowering time
  misc_feature: Functional homolog of the protein sequence given in SEQ ID NO 14190
  misc_feature: Useful for making plants with modulated nitrogen use efficiency
  misc_feature: Functional homolog of the protein sequence given in SEQ ID NO 14191
  misc_feature: Ceres ANNOT ID no. 8667554
  misc_feature (36)..(533): SWISSPROT Homolog: EC 1.3.3.9 Secologanin synthase
  misc_feature (86)..(529): Pfam ID: p450 Pfam Description: Cytochrome P450
MVGGVALLREASPSPWSVLAGVAAALVLWWAAQVLEYAWWAPRRMERALRAQGLRGTRYRFLWGDLKEESRLTAAALARPVRTDRPHDVFPRVSPLLHRVVQEHGKLSFTWFGTTPRITITDPQLAREVMSNKDGCFLKTKITTRVTKLLFGGVAILDAEKWAKHRRILNPAFHTEKLKGMLPAFTAACSDLICRWENLVADSVGSKELDIWSEFQSLSGDVISRAVFGVSYQEGRRIFRLQAEQVVRVTNAFKTNHIPGFSLLPTENNRRMKAIDRETKTILRGIIEKRHEAMKNGEPTTTRDDLLGMLLESNMNYTDSDGKSSRGITLEEVIEECKLFYFAGTETTAVLLTWTIVVLSMHPEWQDQARDEVLEVFGQNNPDLSGVSRLKVVTMVLYEVLRLYPPALFINRRTYKQTELGGVMYPPDVMVMVPIMFIHRDPDLWGDDAGEFNPRRFADGVSKACSDPGAFIPFSWGPRICIGQNFALLEAKLAISMILQRFAFELSPAYVHAPYNVLTLHPQHGVLVRLRQL

SEQ ID NO: 16806 - DNA, 1578 bp, Sorghum bicolor
  misc_feature: Ceres ANNOT ID no. 8667559
  misc_feature: Encodes the peptide sequence at SEQ ID NO 16807
atggcgacccgcgttctgctgatgcttcgcgaaacctctccgtgggcgctggccggcgcggcggcgtccgtggcgctgctgtggctggtggcctggacgctggagtgggcctggtggacgcctcggcggctcgaccgggccctgcgggcccagggcctcaagggcaccaggtaccgcctcttcaccggcgacctgagggagaccgcccgggttaaccgggaggcccgcaagaacccgctgccgctcggctgccacgacatcgccccccgcgtgcagcccatgcttcacagcgccatgaaggaatacgggaaattatctttcacttggttcggcccaacaccaagggtgatgattccagacccggagttagtcaaagaggtgttgtctaataagtttggccactttggcaaaccacggagcagccgcattgggaagttgctagccaatggggtagtaaatcatgatggtgaaaaatgggcaaagcacaggagaattcttaatcctgcctttcaccatgagaaaataaagcggatgctgccagtattttcgacctgttgtattgaaacgattattagatgggagaattcaatgccttctgagggatcttctgagatagatgtctggcctgagttccagaatcttactggagatgttatctcaagaaccgcttttggcagcaactatcaagaagggaggagaattttccagctgcaaggagaactagctgaacgccttattcagtctattcagacaatatttatcccaggctattggttcttgcccaccaaaaacaacagaaggatgaaagaaatcgatctagagatccgcaaaattctccgtgaaataattgggaaaagagagaaggctactagaaatggcgaaacaaataatgatgacttgctgggcttattactggagtcaaacacaaggcaatcaaatggaaatgcaagcctgggactgacaacagaagatgtgattgaggaatgcaagctattttactttgcaggtatggagacaacatcagtcctgcttacttggacacttattgtgctaagcatgcacccagaatggcaagagcgagcaagagaagaagtgttgagccactttgggagaaccagaccagattttgatagcttgagccgcctgaagattgtaaccatgattctacatgaggtcctcaggttatacccaccggcaacctttctaaccagaagaacttataaggaaatggagctcggtggaattaaatatcctgcaggagtgaaccttcttctgcccatcatcttcattcaccatgatcccgacatttggggaaaagacgcaagtgagttcaatccagagaggtttgccaatggcatctccaacgccaccaggcatcaggcggctttctttccgtttggaggggggcccaggatctgcatcggccagagctttgcgttgctggaagccaagatggcgctatgcaccatcctccagcgcttctcctttgagctctcgccatcctacacccacgcgccctacaccgtgataacactgcaccctcagcacggtgctcagataaggctgaaaaagctctga

SEQ ID NO: 16807 - protein, 525 aa, Sorghum bicolor
  misc_feature: Useful for making plants with modulated cold sensitivity
  misc_feature: Functional homolog of the protein sequence given in SEQ ID NO 14189
  misc_feature: Useful for making plants with modulated nitrogen use efficiency
  misc_feature: Functional homolog of the protein sequence given in SEQ ID NO 14191
  misc_feature: Useful for biocontainment applications
  misc_feature: Useful for making plants with modulated biomass
  misc_feature: Useful for making plants with modulated flowering time
  misc_feature: Functional homolog of the protein sequence given in SEQ ID NO 14190
  misc_feature: Ceres ANNOT ID no. 8667559
  misc_feature (40)..(525): SWISSPROT Homolog: EC 1.3.3.9 Secologanin synthase
  misc_feature (79)..(521): Pfam ID: p450 Pfam Description: Cytochrome P450
MATRVLLMLRETSPWALAGAAASVALLWLVAWTLEWAWWTPRRLDRALRAQGLKGTRYRLFTGDLRETARVNREARKNPLPLGCHDIAPRVQPMLHSAMKEYGKLSFTWFGPTPRVMIPDPELVKEVLSNKFGHFGKPRSSRIGKLLANGVVNHDGEKWAKHRRILNPAFHHEKIKRMLPVFSTCCIETIIRWENSMPSEGSSEIDVWPEFQNLTGDVISRTAFGSNYQEGRRIFQLQGELAERLIQSIQTIFIPGYWFLPTKNNRRMKEIDLEIRKILREIIGKREKATRNGETNNDDLLGLLLESNTRQSNGNASLGLTTEDVIEECKLFYFAGMETTSVLLTWTLIVLSMHPEWQERAREEVLSHFGRTRPDFDSLSRLKIVTMILHEVLRLYPPATFLTRRTYKEMELGGIKYPAGVNLLLPIIFIHHDPDIWGKDASEFNPERFANGISNATRHQAAFFPFGGGPRICIGQSFALLEAKMALCTILQRFSFELSPSYTHAPYTVITLHPQHGAQIRLKKL

SEQ ID NO: 16808 - DNA, 738 bp, Sorghum bicolor
  misc_feature: Ceres ANNOT ID no. 8667552
  misc_feature: Encodes the peptide sequence at SEQ ID NO 16809
atgcagagggatccaacatctttagctggaaattcctcctttgcttatggatatgaagcagataattgtatggcaaatggacttttgggtggtcagtgcaaccacagcgttcctgtttcacctgccttagcagtcccttcgggcatcacaagccctcacatccgaagcccacttgatgcatttgagctccaaccttccaaggtatgccccagaaatttcatcatctttgatcacactgatgaaaaaggatgcatcatgtatcatccagccttggtgaacaatctgaaccccgcaaacatcgatttgctccaatgccatggtgaggtggtttgtagaagttcaggccaagacaatggcaatcttgaagaacagtcctcatctttcaaggaggatacagaagaaatcgatgcactgctcagctctaatgatgacagcgatgaagatgatgttgtgagtaccgggcgtactccggatcccttggaaagtggtccttctgaatcatcttcactgcccagatttaagacaattagtcaagtttctggaaacagttcagtttgctctggatccttggaaaatgttactcatgagaagatcaggaacgtggccacagttcttaaggggataatccctggtggagatcaactggatacttcttctgtcctggaggaagctgttagatatctgaagttcctcaagatggagtcaaagaaacttggcatggaggactcgagtatttag

SEQ ID NO: 16809 - protein, 245 aa, Sorghum bicolor
  misc_feature: Useful for making plants with altered carbohydrate content
  misc_feature: Functional homolog of the protein sequence given in SEQ ID NO 14429
  misc_feature: Ceres ANNOT ID no. 8667552
MQRDPTSLAGNSSFAYGYEADNCMANGLLGGQCNHSVPVSPALAVPSGITSPHIRSPLDAFELQPSKVCPRNFIIFDHTDEKGCIMYHPALVNNLNPANIDLLQCHGEVVCRSSGQDNGNLEEQSSSFKEDTEEIDALLSSNDDSDEDDVVSTGRTPDPLESGPSESSSLPRFKTISQVSGNSSVCSGSLENVTHEKIRNVATVLKGIIPGGDQLDTSSVLEEAVRYLKFLKMESKKLGMEDSSI

SEQ ID NO: 16810 - DNA, 1578 bp, Sorghum bicolor
  misc_feature: Ceres ANNOT ID no. 8667558
  misc_feature: Encodes the peptide sequence at SEQ ID NO 16811
atggtgaccagcgttctgctgatactgcgggaaacctctccgtgggcgctggtcggcgcggcggcgtccgtggcgctgctgtggctggtcgcctggacactggagtgggcgtggtggacgccacggcggctagaccgagccctacgggcccagggcctcaagggcaccaagtaccgcctcctcaccggcgacgtgagggagaacgcccggctcaaccgagaagcccgcacgaagccgctggcgcttgggagtcacgacatcatcccccgcgtgctacccatgctccacaacgttgtaaaggaatatgggacaaattcattcacttggttcggcccggttccgagggtgataattccagatccggagttagtgagagaggttttgtctaacaagtttggccacttcggcaaaccacggtttagccgtcttggcaagttactagccaacgggctcgcaaatcatgaaggagagaaatgggcaaaacacaggagaattctcaatcctgcattccaccatgagaaaataaagcggatgctgcctgtatttgctacctgttgcactgatatgattaacagatgggaaaattcaatgtcttccgagggatcttctgagatagacgtctggcctgagttccaaaatcttaccggagatgttatctcaagaaccgcatttggtagcaactatcaggagggcaggaacattttccagctgcaaggagagcaggctgaacgccttatacaatcttttcaaacaatatttatccctggctactggttcttgcccaccaaaaataacagaaggatgaaagaaattgatcgggagatctgtaaagttctgcatggaataatcaggaaaagagagagggcttttatagatggtgaaggaagtaatgatgacttgctaggcttattggttgagtctaatatgagagaatcaaatgggaatgcgaaactgggaatgagtaccaaagatattatcgaggaatgcaagttgttttactttgcaggtatggagaccacatcagtcctgcttacatggacgttaattgtgctaagcatgcaccccgaatggcaagagcgggcaagagacgaagttttaaaccactttggaagaggtagaccagattttgatagcttgaaccgcctgaagattgtaaccatgattctatatgaggtgcttaggttgtacccaccagtgatcttactaaccagaagaacttacaaggaaatggagctaggtggcatcacatatccttcaggtgtgagccttctactgcctatcattttcattcaccatgatcctaacatctggggaaaagacgctagcgagttcaatccacagaggtttgaggatggcatttccaatgcgaccaagcatcaggctgctttctttccatttggatggggtcccaggatctgcataggccagaactttgcgttgctagaagcaaagatggcactgtgcaccatccttcaacgcttctcctttgagctctcgccatcctacactcatgcgccatacaccgtgataactttgcaccctcagcatggtgctcaaatcaggttgaagaagctttga

SEQ ID NO: 16811 - protein, 525 aa, Sorghum bicolor
  misc_feature: Useful for making plants with modulated cold sensitivity
  misc_feature: Functional homolog of the protein sequence given in SEQ ID NO 14189
  misc_feature: Useful for making plants with modulated nitrogen use efficiency
  misc_feature: Functional homolog of the protein sequence given in SEQ ID NO 14191
  misc_feature: Useful for biocontainment applications
  misc_feature: Useful for making plants with modulated biomass
  misc_feature: Useful for making plants with modulated flowering time
  misc_feature: Functional homolog of the protein sequence given in SEQ ID NO 14190
  misc_feature: Ceres ANNOT ID no. 8667558
  misc_feature (40)..(525): SWISSPROT Homolog: EC 1.3.3.9 Secologanin synthase
  misc_feature (73)..(521): Pfam ID: p450 Pfam Description: Cytochrome P450
MVTSVLLILRETSPWALVGAAASVALLWLVAWTLEWAWWTPRRLDRALRAQGLKGTKYRLLTGDVRENARLNREARTKPLALGSHDIIPRVLPMLHNVVKEYGTNSFTWFGPVPRVIIPDPELVREVLSNKFGHFGKPRFSRLGKLLANGLANHEGEKWAKHRRILNPAFHHEKIKRMLPVFATCCTDMINRWENSMSSEGSSEIDVWPEFQNLTGDVISRTAFGSNYQEGRNIFQLQGEQAERLIQSFQTIFIPGYWFLPTKNNRRMKEIDREICKVLHGIIRKRERAFIDGEGSNDDLLGLLVESNMRESNGNAKLGMSTKDIIEECKLFYFAGMETTSVLLTWTLIVLSMHPEWQERARDEVLNHFGRGRPDFDSLNRLKIVTMILYEVLRLYPPVILLTRRTYKEMELGGITYPSGVSLLLPIIFIHHDPNIWGKDASEFNPQRFEDGISNATKHQAAFFPFGWGPRICIGQNFALLEAKMALCTILQRFSFELSPSYTHAPYTVITLHPQHGAQIRLKKL

SEQ ID NO: 16812 - DNA, 1086 bp, Sorghum bicolor
  misc_feature: Ceres ANNOT ID no. 8667547
  misc_feature: Encodes the peptide sequence at SEQ ID NO 16813
atgtcttctggtggaggaggaagcagtggcggaggaggagatcaccatggcgtctaccaccagcatggccacggccacctcgcccgtgccgatgccggcgccgagtacgtgttccacagcaacgacatggagagcttcttcttcaatcagccggcggcgtcggcgggcgtcgatggatcaggcagcagaactactggcgccgccgacgagctcatgccgccctactccagcatcacggactacctgcaggggttcctgcaggacccctccgggctagctcggcacctcgacgcgccgtgtcttcccgcggaggacgccccgctcaagcacgagctgtctgtcgatgtgagccacgacagccagggcaccagcggcgcgcccggaggagaaggggcggcgatgcacacgccgaactcgtcggtgtctctctcgtcaagcgaccgggagggggagggcggccagcagcctcgtcggtgcaagaagggcaggcccaaggcggaggatgcggagggggatgagaaagagcaggaagatggggagaattcctccaaagcgaacaaatccaagaagaaggctgagaagaggcagaggcagcctcgcgttgccttcctcaccaagagcgaggtggatcaccttgaggacggctaccggtggcgcaaatacggccagaaggccgtcaagaacagtccttacccaaggagctactaccgttgcacgacgcccaagtgcggcgtgaagaagcgcgtggagcggtcgtaccaggacccatcgacggtgatcacgacgtacgaggggcagcacacgcaccacagccccgccagcctccgcgccggcggcgcgcatctcttcatgtcaaacgcgcacggcgggctgccgccgcacctgatgccgtccagcttcggccgcccggacctgatgagcatgatgcaccccgccatgggcgcaaaccctagcatgttcctgccaagtatgcctcctcctcacatgtcaacaccatctcctgctcctcctcttcagcagcaccacttcactgactacgccctcttgcaagacctgttcccttccacaatgcccaacaacccataa

SEQ ID NO: 16813 - protein, 361 aa, Sorghum bicolor
  misc_feature: The sequence is a functional homolog of SEQ ID NO 146 in the 10/714,887 US patent application
  misc_feature: The sequence is a functional homolog of SEQ ID NO 146 in the 11/435,388 US patent application
  misc_feature: The sequence is a functional homolog of SEQ ID NO 86 in the 10/412,699 US patent application
  misc_feature: The sequence is a functional homolog of SEQ ID NO 134 in the 10/714,887 US patent application
  misc_feature: The sequence is a functional homolog of SEQ ID NO 134 in the 11/435,388 US patent application
  misc_feature: The sequence is a functional homolog of SEQ ID NO 1533 in the 10/374,780 US patent application
  misc_feature: The sequence is a functional homolog of SEQ ID NO 1617 in the 10/412,699 US patent application
  misc_feature: The sequence is a functional homolog of SEQ ID NO 114 in the 11/375,241 US patent application
  misc_feature: The sequence is a functional homolog of SEQ ID NO 146 in the 10/286,264 US patent application
  misc_feature: The sequence is a functional homolog of SEQ ID NO 2500 in the 10/374,780 US patent application
  misc_feature: The sequence is a functional homolog of SEQ ID NO 672 in the 10/412,699 US patent application
  misc_feature: Ceres ANNOT ID no. 8667547
  misc_feature (212)..(271): Pfam ID: WRKY Pfam Description: WRKY DNA -binding domain
MSSGGGGSSGGGGDHHGVYHQHGHGHLARADAGAEYVFHSNDMESFFFNQPAASAGVDGSGSRTTGAADELMPPYSSITDYLQGFLQDPSGLARHLDAPCLPAEDAPLKHELSVDVSHDSQGTSGAPGGEGAAMHTPNSSVSLSSSDREGEGGQQPRRCKKGRPKAEDAEGDEKEQEDGENSSKANKSKKKAEKRQRQPRVAFLTKSEVDHLEDGYRWRKYGQKAVKNSPYPRSYYRCTTPKCGVKKRVERSYQDPSTVITTYEGQHTHHSPASLRAGGAHLFMSNAHGGLPPHLMPSSFGRPDLMSMMHPAMGANPSMFLPSMPPPHMSTPSPAPPLQQHHFTDYALLQDLFPSTMPNNP

SEQ ID NO: 16814 - DNA, 1599 bp, Sorghum bicolor
  misc_feature: Ceres ANNOT ID no. 8667563
  misc_feature: Encodes the peptide sequence at SEQ ID NO 16815
atggttcttggagcgttggcgactgcagtcgcctcgatgcaattgcaatggagcctcctcctcatctacggtctcctgggcggtctgctcctgtggaaggccggccggctgctcgagcggctgtggtgcgagccgcggcggctcgagcgggcgctgcgcgcgcagggcctccggggcacctcgtaccgcttcctcaccggtgacctcaaggagtaccgccggttcaacaaggaggccgccgcgtccaagcctttgccgctgcggtgccacgacatcgccggccatgtcgcgccgtttgtccacggcgccgtcctcgaacacggcaagacgtgcttctcgtggttcggcccgatccccagagtgaccgtcaccgacccggacctcgcaagggacgtgatgtccaacaagtttggccacttcgagaagcccaagttcccggcgttgagcaagctgttcgccgatggcgtagccaactacgagggcgagaagtgggtcaagcacaggaggatcctcaaccctgcgttccacctcgagaagctcaagctcatgctgccggcgttttctgcgtgttgtgaagagcttgtaggccgatgggttcagtcacttggttctgacggctcgtgcgagctgaacgtggacccggaacttcagaccctcaccggagatgtcatctctcgcaccgcattcggcagcagctaccttgaagggagaaagattttccagctacaggccgagcaagcagagcgcctcatgtccatcatggacaagtttgccgttccgggatacatgtccttgcctaccaaaaacaaccgaaggatgcgccaaattaagaacgagatcgagtcaattcttctgggtctaattagtaaaagaatgcaagctatgaaagaaggtgaaagcgccaaagatgacttgctgggcttactgctcgagtcaaacatgagagagacaggcgagaacggccagtccagccaaggaatgacgattgaagatgtcatggaggagtgtaagctgttctactttgcaggaatggagacgacatcagtgctgcttacatggacgatgatcctactaagcatgcacccagaatggcaggaccgtgcaagggaggaagtccttgccctgtttgggaagaaccaaccgggatacgacggcctcagtcgcctcaaaacagtgaccatgattctctacgaggttctccggctgtacccgccggccatcgcgttcagcaggaaaacatacaaggagatggtgatcggggatgtcacataccccgccggcgtgatcgtggagctccccgtgatgttcatccaccacgacgccgacatctggggaagcgatgtgcacgagttcaggccagagaggttcgccgaggggatcgccaaggcgtccaaggataggctagcgttcttcccgttcggctgggggccgcggatttgcatcggccagaactttgctcttctagaggctaagatggcgctgagcatgatcctgcagcgctttcagtttgagctcgcgccgacgtatactcatgcgccgcgccaagtcataatgctgcgcccgatgcacggtgctcagatcaagctcagagcaatatga

SEQ ID NO: 16815 - protein, 532 aa, Sorghum bicolor
  misc_feature: Useful for making plants with modulated cold sensitivity
  misc_feature: Functional homolog of the protein sequence given in SEQ ID NO 14189
  misc_feature: Useful for making plants with modulated nitrogen use efficiency
  misc_feature: Functional homolog of the protein sequence given in SEQ ID NO 14191
  misc_feature: Useful for biocontainment applications
  misc_feature: Useful for making plants with modulated biomass
  misc_feature: Useful for making plants with modulated flowering time
  misc_feature: Functional homolog of the protein sequence given in SEQ ID NO 14190
  misc_feature: Ceres ANNOT ID no. 8667563
  misc_feature (42)..(527): SWISSPROT Homolog: EC 1.3.3.9 Secologanin synthase
  misc_feature (84)..(529): Pfam ID: p450 Pfam Description: Cytochrome P450
MVLGALATAVASMQLQWSLLLIYGLLGGLLLWKAGRLLERLWCEPRRLERALRAQGLRGTSYRFLTGDLKEYRRFNKEAAASKPLPLRCHDIAGHVAPFVHGAVLEHGKTCFSWFGPIPRVTVTDPDLARDVMSNKFGHFEKPKFPALSKLFADGVANYEGEKWVKHRRILNPAFHLEKLKLMLPAFSACCEELVGRWVQSLGSDGSCELNVDPELQTLTGDVISRTAFGSSYLEGRKIFQLQAEQAERLMSIMDKFAVPGYMSLPTKNNRRMRQIKNEIESILLGLISKRMQAMKEGESAKDDLLGLLLESNMRETGENGQSSQGMTIEDVMEECKLFYFAGMETTSVLLTWTMILLSMHPEWQDRAREEVLALFGKNQPGYDGLSRLKTVTMILYEVLRLYPPAIAFSRKTYKEMVIGDVTYPAGVIVELPVMFIHHDADIWGSDVHEFRPERFAEGIAKASKDRLAFFPFGWGPRICIGQNFALLEAKMALSMILQRFQFELAPTYTHAPRQVIMLRPMHGAQIKLRAI

SEQ ID NO: 16816 - DNA, 1605 bp, Sorghum bicolor
  misc_feature: Ceres ANNOT ID no. 8667567
  misc_feature: Encodes the peptide sequence at SEQ ID NO 16817
atggacggcgacgttgtagcagctgcagcagctttgccatcaccgtggagcttgctccaggggctccttgccctgctgatcgcgtggggcagctaccaggccgcggagacattctggctgcggccccggcggctcaaccgggcgctccgggcacaggggctcagcggcactgagtacctcttcccagccggcgacctcaaggagaataacaggctcaacgacgaggcacgatcgaggtgtatgccgttgtcccatgacatagttccccgtgtgatgccgcatctcttcaacacagttaaggagcacggcaacatttctatcacctgggtcggaccaattcctaaggtgataatcacggaggcagagttaataagggacgtcctattaaacaagtctggccacttcaagaaggtcatcacgaacaagcgtcttataaaaatgctcgcccttgggattgcgagtcacgacggtgagaaatgggcaaaacacagaaggatcctaaaacccgcattccatcaagaaaagctcaagcgcatgctgccggcgttctcgacgtgctctaccgagcttatagatcgctgggagaaaaaactcgctggttctgacggatcatatgaactggatatctggccggagtttcagaacctcaccggagacgtgatctcccgaacggcatttggcagcagcttcatggaagggcgaaggatcttccaacttcagggcgagcaagcagagcggctattcaaggccttccagtatatgtacattccaggcttcatcttcttcccgacacagaacaatcggaggatgaaagaaatcaacagggaaattgaagggactctaaggggcatgatcgagaagagggagcgcgcaatcgagaatggcgaaaccagcggcaacgacttgctcggcttgctgctgcagtcaaacatggaaagcgggaaaggcaacctgaggatgagcaccgaggacatgattgaggagtgcaagctcttctacttcgcggggatggaaaccacggcagtgttgctcacatggacactcgtcatcctaggcatgcaccctgagtggcaggaccgcgcgagggaggaggtcctcagcgtgttcggcagggacaagcagcccaattttgatggcctaggtcgactcaaaacggcaagtgtttctttgcaataccatgtgacgatgatactatacgaggtgctcaggctgtacccatcggtagtgaccctaaatcgaagagtatccaaagacatgcatattggaggcatcacataccctgcaggggtaatcctcgagcttcccataatcgtcctccaccacaaccctgatgtctgggggaaggacgcacatgagttcaagccagagagattcgctgaggggatctcaaaggcgaccaaggaccaaccagcattcttccccttcggatgggggccgaggatctgcatcgggcagaactttgcgttgcttgaggccaagatggccttgagcatgatcctccaacgctttgagttccaactatcgccttcatacacgcatgcaccgtacacggtcgctacgctgcatcctcagcatggcgcgccaattatattcaagaagatctga

SEQ ID NO: 16817 - protein, 534 aa, Sorghum bicolor
  misc_feature: Useful for making plants with modulated nitrogen use efficiency
  misc_feature: Functional homolog of the protein sequence given in SEQ ID NO 14191
  misc_feature: Useful for making plants with modulated cold sensitivity
  misc_feature: Functional homolog of the protein sequence given in SEQ ID NO 14189
  misc_feature: Ceres ANNOT ID no. 8667567
  misc_feature (27)..(534): SWISSPROT Homolog: EC 1.3.3.9 Secologanin synthase
  misc_feature (82)..(530): Pfam ID: p450 Pfam Description: Cytochrome P450
MDGDVVAAAAALPSPWSLLQGLLALLIAWGSYQAAETFWLRPRRLNRALRAQGLSGTEYLFPAGDLKENNRLNDEARSRCMPLSHDIVPRVMPHLFNTVKEHGNISITWVGPIPKVIITEAELIRDVLLNKSGHFKKVITNKRLIKMLALGIASHDGEKWAKHRRILKPAFHQEKLKRMLPAFSTCSTELIDRWEKKLAGSDGSYELDIWPEFQNLTGDVISRTAFGSSFMEGRRIFQLQGEQAERLFKAFQYMYIPGFIFFPTQNNRRMKEINREIEGTLRGMIEKRERAIENGETSGNDLLGLLLQSNMESGKGNLRMSTEDMIEECKLFYFAGMETTAVLLTWTLVILGMHPEWQDRAREEVLSVFGRDKQPNFDGLGRLKTASVSLQYHVTMILYEVLRLYPSVVTLNRRVSKDMHIGGITYPAGVILELPIIVLHHNPDVWGKDAHEFKPERFAEGISKATKDQPAFFPFGWGPRICIGQNFALLEAKMALSMILQRFEFQLSPSYTHAPYTVATLHPQHGAPIIFKKI

SEQ ID NO: 16818 - DNA, 1557 bp, Sorghum bicolor
  misc_feature: Ceres ANNOT ID no. 8667573
  misc_feature: Encodes the peptide sequence at SEQ ID NO 16819
atggacggcgacgttgtagcagctgcagcagctttgccatcaccgtggagcttgctccaggggctccttgccctgctgatcgcgtggggcagctaccaggccgcggagacattctggctgcggccccggcggctcaaccgggcgctccgggcacaggggctcagcggcactgagtacctcttcccagccggcgacctcaaggagaatgacaggctcaacgacgaggcacgatcgaggtctatgccgttgtcccatgacatagttccccgtgtgatgccgcatctcttcaacaccgttaaggagcacggcaacatttctatcacctggttcggaccaattcctagggtgataatcacggaggcagagttaataagggatgtcctatcaaacaagtctggccacttcgagaagttcatctcgaacaagcgtcttataaaaatgctcgcccttgggattgcgagtcacgacggtgagaaatgggcaaaacacagaaggattctgaaccccgcattccatctcgaaaagctcaagcgcatgctgccggcgttctcgacgtgctctaccgagcttatagatcgctgggagaacaagctcgcttgttccgacggatcatatgaactggatatctggccggagtttcagaacctcactggagacgtgatctcccgtacggcatttggcagcagcttcatggaagggcgaaggatcttccaacttcagggcgagcaagcagagcgactaatcaaggccttccagttcttcccgacacagaacaaccggaggatgaacgagatcaacagggaaatcgaagggactctaaggggcatgatcaagaagagggagcgcgcaatcgagaacggcgaaaccagcggcaacgacttgctcggcttgcttttgcaatcgaacatggagagcgggaaaggtagcctgaggatgagcacggaggatgtgattgaggagtgcaagctcttctacttcgcagggatggaaaccacgtcggtgctgctcacatggacgctcgtcatcctcagcatgcaccctgagtggcaggaccgtgcgagggaggaggtcctcagcgtgttcggcagggacaagcagcccaatttcgatggcctaggtcgactcaaaacggtgaccatgatactatatgaggtgcttaggttgtacccgccggcagtgtcactaaaccgaagaacattcaaagacatgacgattggaggcatctcctaccctgcaggggttatcctcgagcttcccacaatcgttgtccaccacagtactgatgtctgggggaaggacgcacatgagttcaagccagagaggttcgctgaagggatctcaaaggcaaccaaggaccgaccagcgttctttccattcggatgggggccaaggatctgcatcgggcaaaactttgcactgcttgaggccaagatggctttgagcatgatcctccagcgctttgagttccaactgtcgccttcgtacacgcatgcaccgtacactgttcttacgctgcatcctcagcatggcgcgccaattatattcaagaggatatga

SEQ ID NO: 16819 - protein, 518 aa, Sorghum bicolor
  misc_feature: Useful for making plants with modulated nitrogen use efficiency
  misc_feature: Functional homolog of the protein sequence given in SEQ ID NO 14191
  misc_feature: Ceres ANNOT ID no. 8667573
  misc_feature (27)..(518): SWISSPROT Homolog: EC 1.3.3.9 Secologanin synthase
  misc_feature (82)..(514): Pfam ID: p450 Pfam Description: Cytochrome P450
MDGDVVAAAAALPSPWSLLQGLLALLIAWGSYQAAETFWLRPRRLNRALRAQGLSGTEYLFPAGDLKENDRLNDEARSRSMPLSHDIVPRVMPHLFNTVKEHGNISITWFGPIPRVIITEAELIRDVLSNKSGHFEKFISNKRLIKMLALGIASHDGEKWAKHRRILNPAFHLEKLKRMLPAFSTCSTELIDRWENKLACSDGSYELDIWPEFQNLTGDVISRTAFGSSFMEGRRIFQLQGEQAERLIKAFQFFPTQNNRRMNEINREIEGTLRGMIKKRERAIENGETSGNDLLGLLLQSNMESGKGSLRMSTEDVIEECKLFYFAGMETTSVLLTWTLVILSMHPEWQDRAREEVLSVFGRDKQPNFDGLGRLKTVTMILYEVLRLYPPAVSLNRRTFKDMTIGGISYPAGVILELPTIVVHHSTDVWGKDAHEFKPERFAEGISKATKDRPAFFPFGWGPRICIGQNFALLEAKMALSMILQRFEFQLSPSYTHAPYTVLTLHPQHGAPIIFKRI

SEQ ID NO: 16820 - DNA, 426 bp, Sorghum bicolor
  misc_feature: Ceres ANNOT ID no. 8667574
  misc_feature: Encodes the peptide sequence at SEQ ID NO 16821
atggctcagatccagaaaggatccacctacctcgccagaagccaccgccattgtgcttctctctggtgccatggagatcaccagagcaaggggagggaggcacagcttgtcgaaaagcctccgctcggtggcatggtggccggggtaatcctcgagcttcccataatcgttgtccaccacaatcctgatgtttgggggaacgatgcaaacaagttcaacctagagaggtttgctgagggcatctcaaaggcgaccaaggatgaccaaccgacgttcttcccctttgggtggggcctgaggatctgcatcggccagaactttgcgctgcttgagttccgactatcccctttgtacatgcatgcaccgtacactatccttatgatgcatcctcagcatggtgcaccaattatattcaacaagatctga

SEQ ID NO: 16821 - protein, 141 aa, Sorghum bicolor
  misc_feature: Useful for making plants with modulated cold sensitivity
  misc_feature: Functional homolog of the protein sequence given in SEQ ID NO 14189
  misc_feature: Useful for making plants with modulated nitrogen use efficiency
  misc_feature: Functional homolog of the protein sequence given in SEQ ID NO 14191
  misc_feature: Ceres ANNOT ID no. 8667574
  misc_feature (47)..(141): SWISSPROT Homolog: EC 1.3.3.9 Secologanin synthase
MAQIQKGSTYLARSHRHCASLWCHGDHQSKGREAQLVEKPPLGGMVAGVILELPIIVVHHNPDVWGNDANKFNLERFAEGISKATKDDQPTFFPFGWGLRICIGQNFALLEFRLSPLYMHAPYTILMMHPQHGAPIIFNKI

SEQ ID NO: 16822 - DNA, 1599 bp, Sorghum bicolor
  misc_feature: Ceres ANNOT ID no. 8667580
  misc_feature: Encodes the peptide sequence at SEQ ID NO 16823
atggttcttgaagcgtcgtttgccgctgcagcctcagtgccatggaccttccttctcggtggtctcacgggcctgctgctcctgtggcaggccggccggctgctgcaccagttctggtggcagcctcggcttctggagcttgcgctgcgtgcacagggcatccgcggcacgtcgtaccgcttccccgccggcgacctcaaggaatacggccgacttgccaaggaggcctggtctaagcccctgccgctgcgttgccacgacatcgcacaacgggtgacgccgttcgtgcatcagcttgtccgggagcacgggaagacgagcatgtcttggtttggccccagccccaaggtgaccatcgtcgatcctgagctggccagggacgtgctgtccaacaagttcggccactttgagaagctcaagttcccggcgctgtccaagatgctgggcgccggcgtggcgaaccacgagggtgagaaatgggtcaagcacaggaggatcctcaactctgctttccatcttgagaagctcaagcgcatgctgccagcgttttcttcgtgctgcgaagagctggtgagcagatgggcggagtccctcggctctgacagtgcgtgcgagctggatgtttggccggagctgcagaatctcactggagacgtcatttctcgcactgccttcagcagcagctaccacgaaggaagaaggattttccagctacaagccgagcaagcttcgcttgtcatgacgaacattcggaagattatgatgattcccggttacttgtccttgccaaccgcaaacaacagaaagatgagcagaaacaacaaagaggtggaatcaattctgcgagatataattgggaaaagaattcaatccatgaaacaaggcgagagcaccaaagatgacttgctgggtctattgctggagacaaacatgagagacacagacgggaataataatagccaacccaccggcacggcgatgacgatcgaagatgtcatcgaggagtgcaaggtgttctatttcgcgggaatggagaccacagcggtgctgctcacatggacaatgattgtactcagcatgcacccagagtggcaggaccgtgcgcgggaggaggtgacaggtttgtttggcaaaaacaagcctgaatacgaaggcctcagccgcctcaaaaccgtgaccatggtcctttacgaggttctccggctgtacccgccggccatttctttcgtccggagaacatacaaggagcaggagatgggcggcatcaggtaccccgctggcgtgatcttggagctgcccgtgctcctcatccaccacgacccagatatctggggaagcgacgcgcgcgagttcaggcccgacagattcgccgaggggatctccaaggcatgcaaggactcgggcgcgttcctcccgttcggctgggggccgcgcatctgcatcggccagaacttcgcgctgctcgaggccaagatggcgctgtgcatgatccttcagcggtttgagtttgagctcgcgccgtcgtatactcatgcgccgcataccgtgataacgatgcatcctatgcatggtgcgccgcttaagctcagagcaatatga

SEQ ID NO: 16823 - protein, 532 aa, Sorghum bicolor
  misc_feature: Useful for making plants with modulated cold sensitivity
  misc_feature: Functional homolog of the protein sequence given in SEQ ID NO 14189
  misc_feature: Useful for making plants with modulated nitrogen use efficiency
  misc_feature: Functional homolog of the protein sequence given in SEQ ID NO 14191
  misc_feature: Useful for biocontainment applications
  misc_feature: Useful for making plants with modulated biomass
  misc_feature: Useful for making plants with modulated flowering time
  misc_feature: Functional homolog of the protein sequence given in SEQ ID NO 14190
  misc_feature: Ceres ANNOT ID no. 8667580
  misc_feature (39)..(525): SWISSPROT Homolog: EC 1.3.3.9 Secologanin synthase
  misc_feature (80)..(531): Pfam ID: p450 Pfam Description: Cytochrome P450
MVLEASFAAAASVPWTFLLGGLTGLLLLWQAGRLLHQFWWQPRLLELALRAQGIRGTSYRFPAGDLKEYGRLAKEAWSKPLPLRCHDIAQRVTPFVHQLVREHGKTSMSWFGPSPKVTIVDPELARDVLSNKFGHFEKLKFPALSKMLGAGVANHEGEKWVKHRRILNSAFHLEKLKRMLPAFSSCCEELVSRWAESLGSDSACELDVWPELQNLTGDVISRTAFSSSYHEGRRIFQLQAEQASLVMTNIRKIMMIPGYLSLPTANNRKMSRNNKEVESILRDIIGKRIQSMKQGESTKDDLLGLLLETNMRDTDGNNNSQPTGTAMTIEDVIEECKVFYFAGMETTAVLLTWTMIVLSMHPEWQDRAREEVTGLFGKNKPEYEGLSRLKTVTMVLYEVLRLYPPAISFVRRTYKEQEMGGIRYPAGVILELPVLLIHHDPDIWGSDAREFRPDRFAEGISKACKDSGAFLPFGWGPRICIGQNFALLEAKMALCMILQRFEFELAPSYTHAPHTVITMHPMHGAPLKLRAI

SEQ ID NO: 16824 - DNA, 1608 bp, Sorghum bicolor
  misc_feature: Ceres ANNOT ID no. 8667581
  misc_feature: Encodes the peptide sequence at SEQ ID NO 16825
atgtttcttggagctctgttcgcagctgtacaggcctcagcaccacgcagcctcctgttctacggcgtccctggccttgtcctcctgctgtggcagggcggccggctgctgaacaagctatggtgggagcctcggcggctggagcgggctctgcgctcgcagggcctccgcggcacgtcctaccgcttcctcacgggcgacctcacggagttcggccgcctcaacaaggaagcctgggcggcaaggccgctgccgctggggtgccacgacgtcgtgccccgcgtcacgccgttcctccacaacaacgtccgggagcacggcaagacgtgcttctcctggttcgggccgattcccaacgtgaccatcaccgaccccgcgctggtcagggacgtgctctccaacaagttcggccacttggagaagccccagttcccggccctgacgaagctcatctccgacggactcaccagccatgagggcgagaaatgggtcaagcacaggaggatcctcaaccctgcattccatctcgagaagctcaagctcatgctgcctgcgttctctgcatgctgcgaagagcttgtgagcagatgggcgcagcagtcctttggttccgacggttggtgcgagctggacgtgtggccggagctccaggccctcacaggagatgtcatctcccgcaccgcatttggcagcagctaccttgaaggcagaaggattttcgagctccagtccgagcaagctgagcgcttcgtaggcgccgttcagaagattgcaattccagcacggtttttaccaaccaaaaacaacagaaggatgcgccaaatcaacaaggaggttaactcgattttacgagggctgattgggaaaagaatgcaagctatgaaagacgaagaaggtgaaagcaggaccagcgatgacgatctcctgggcttactgctggagtccaatacgaggcacgcagatgagaacggccaatccacccttggaatgacgatagaagatgtcatcgaggagtgcaagctgttctactttgcagggatggagacaacgtcggtgttgttgacatggacgatggtgctgttgagcatgcaccctgagtggcaagaccgtgcaagggaggaagtgattggcctgttcgggagaaacaaaccagactacgagggactgagccgcctgaaaacagtcaatatgatcatttacgagattctccgattatacccgccggccgttgtgttcagccggaaaacctacaaggagatgaaggtcggagacgtgacgttgccagccggtgcgttcattgagctccctgttctattcatgcaccatgaccctgacacctggggaaacgacgtgcacgatttcaagccggagaggttcgccgaggggatctccaaggcgtccaaggagccgggtgcgttcctcccgttcggctgggggcctcgcatctgcatcggccagaacttcgcgctgctcgaggccaagatggcgctgtgcatgatccttcagcgatttgagtttgagctcgcgccgtcgtatacccatgcgccgcataccgtgataacgatgcatcctatgcatggtgcacagattaagctcagggcgatctga

SEQ ID NO: 16825 - protein, 535 aa, Sorghum bicolor
  misc_feature: Useful for making plants with modulated cold sensitivity
  misc_feature: Functional homolog of the protein sequence given in SEQ ID NO 14189
  misc_feature: Useful for making plants with modulated nitrogen use efficiency
  misc_feature: Functional homolog of the protein sequence given in SEQ ID NO 14191
  misc_feature: Useful for biocontainment applications
  misc_feature: Useful for making plants with modulated biomass
  misc_feature: Useful for making plants with modulated flowering time
  misc_feature: Functional homolog of the protein sequence given in SEQ ID NO 14190
  misc_feature: Ceres ANNOT ID no. 8667581
  misc_feature (41)..(530): SWISSPROT Homolog: EC 1.3.3.9 Secologanin synthase
  misc_feature (83)..(532): Pfam ID: p450 Pfam Description: Cytochrome P450
MFLGALFAAVQASAPRSLLFYGVPGLVLLLWQGGRLLNKLWWEPRRLERALRSQGLRGTSYRFLTGDLTEFGRLNKEAWAARPLPLGCHDVVPRVTPFLHNNVREHGKTCFSWFGPIPNVTITDPALVRDVLSNKFGHLEKPQFPALTKLISDGLTSHEGEKWVKHRRILNPAFHLEKLKLMLPAFSACCEELVSRWAQQSFGSDGWCELDVWPELQALTGDVISRTAFGSSYLEGRRIFELQSEQAERFVGAVQKIAIPARFLPTKNNRRMRQINKEVNSILRGLIGKRMQAMKDEEGESRTSDDDLLGLLLESNTRHADENGQSTLGMTIEDVIEECKLFYFAGMETTSVLLTWTMVLLSMHPEWQDRAREEVIGLFGRNKPDYEGLSRLKTVNMIIYEILRLYPPAVVFSRKTYKEMKVGDVTLPAGAFIELPVLFMHHDPDTWGNDVHDFKPERFAEGISKASKEPGAFLPFGWGPRICIGQNFALLEAKMALCMILQRFEFELAPSYTHAPHTVITMHPMHGAQIKLRAI

SEQ ID NO: 16826 - DNA, 1842 bp, Sorghum bicolor
  misc_feature: Ceres ANNOT ID no. 8667599
  misc_feature: Encodes the peptide sequence at SEQ ID NO 16827
atgcagcacgatcaccgcaagaagagttcggtggaggcagagtttttcacagagtatggggatgcaagtcgatacaagattcaggaagtcattggtaaaggaagctacggggtggtgtgctccgctatagatgtccacactggagagaaagtagcgatcaagaagatacatgacatctttgagcacatatccgatgctgctcggattctccgtgagatcaagcttctgagactcctaagacatccagatattgttgagatcaaacatattatgttgcctccatcaagacgggacttcaaagatatttatgttgtttttgaacttatggagtctgatcttcaccaagttatcaaggctaatgatgacttgacaaaggaacactatcagttctttctctaccaactgctccgtgctctgaaatacatccatacagctaacgtttatcaccgggacctgaagccaaagaatatattagcaaattctaactgcaaactgaaaatttgtgattttggactagcacgagttgcattcaatgataccccaacaacaatcttctggacagattatgttgcaacaagatggtacagagctccagagctctgtggatccttcttttcaaagtatacaccggccattgacatttggagcattggatgcatctttgctgaggtgctaacagggaaacctttgtttcctggtaaaaatgttgtccatcagttagatttgatgactgaccttctaggcacgccatcaatggatacgatttctcgggtccggaatgagaaagcaaggaggtatctaagtagcatgagaaagaaagagacaatttcgttctcacagaagtttcccaatgcagatcctttagccttggatctcttgcaaaggcttttagcatttgatccgaaagaccgtccaactgcagaacaggcattggctcatccatactttaaagggctagccaaggttgagagagagccatcctgtcaaccaatcacaaagatcgagtttgagttcgaacggagaagagtgacaaaagaagacattagggagctgatattccgtgagatattggaatatcatccacaactgctcaaagactatatcaatggcaccgagaggacaacctttctgtacccaagtgctgtcgaccaatttaggaagcaatttgctcatcttgaagaaaatagtggaaacggacctgttattccaatggaaagaaaacatacttctcttcctaggtctactattgttcactcagctccaattccagtcaaggaacaaccccgtatcggcccatctagggaaaggccttcatctgatgagtcctacagaaatcctcgggagacagaaaaatattctggcaatctcccgagaacgtcacaggctccacaaagagtgccaacagcgagaccaggaagggttgttggtccagtaatgccttaccaaaatggagacaccaaagacccctatgacacacgaaggttggcaatgaactcaggatatcctccccaacaacaaatcccacaaacatttggttattatcagacacatggcaaaccagcttgctccgagccatcacaggctgaaaggtacacgctgcatcagcaggcctatgcctgtgcaaaccgtacagctgcatctgatgttgctctggacatgagagcacccccttttcatcatctatcggcagggcaaaaaggtgactcttctgataggctaacagccgagacaaacttgtacacgagatcactcaacggcattgctgctactgcagcaggagtggcagcaactactcacagaaaagtcggtgttgttccatttggcatgtcaagcatgtattag

SEQ ID NO: 16827 - protein, 613 aa, Sorghum bicolor
  misc_feature: Useful for making plants with altered cell wall content and/or composition
  misc_feature: Functional homolog of the protein sequence given in SEQ ID NO 14430
  misc_feature: Ceres ANNOT ID no. 8667599
  misc_feature (1)..(613): SWISSPROT Homolog: EC 2.7.11.24 Mitogen-activated protein kinase
  misc_feature (25)..(316): Pfam ID: Pkinase Pfam Description: Protein kinase domain
MQHDHRKKSSVEAEFFTEYGDASRYKIQEVIGKGSYGVVCSAIDVHTGEKVAIKKIHDIFEHISDAARILREIKLLRLLRHPDIVEIKHIMLPPSRRDFKDIYVVFELMESDLHQVIKANDDLTKEHYQFFLYQLLRALKYIHTANVYHRDLKPKNILANSNCKLKICDFGLARVAFNDTPTTIFWTDYVATRWYRAPELCGSFFSKYTPAIDIWSIGCIFAEVLTGKPLFPGKNVVHQLDLMTDLLGTPSMDTISRVRNEKARRYLSSMRKKETISFSQKFPNADPLALDLLQRLLAFDPKDRPTAEQALAHPYFKGLAKVEREPSCQPITKIEFEFERRRVTKEDIRELIFREILEYHPQLLKDYINGTERTTFLYPSAVDQFRKQFAHLEENSGNGPVIPMERKHTSLPRSTIVHSAPIPVKEQPRIGPSRERPSSDESYRNPRETEKYSGNLPRTSQAPQRVPTARPGRVVGPVMPYQNGDTKDPYDTRRLAMNSGYPPQQQIPQTFGYYQTHGKPACSEPSQAERYTLHQQAYACANRTAASDVALDMRAPPFHHLSAGQKGDSSDRLTAETNLYTRSLNGIAATAAGVAATTHRKVGVVPFGMSSMY

SEQ ID NO: 16828 - DNA, 1842 bp, Sorghum bicolor; identical to SEQ ID NO: 16826
  misc_feature: Ceres ANNOT ID no. 8667597
  misc_feature: Encodes the peptide sequence at SEQ ID NO 16829

SEQ ID NO: 16829 - protein, 613 aa, Sorghum bicolor; identical to SEQ ID NO: 16827
  misc_feature: Useful for making plants with altered cell wall content and/or composition
  misc_feature: Functional homolog of the protein sequence given in SEQ ID NO 14430
  misc_feature: Ceres ANNOT ID no. 8667597
  misc_feature (1)..(613): SWISSPROT Homolog: EC 2.7.11.24 Mitogen-activated protein kinase
  misc_feature (25)..(316): Pfam ID: Pkinase Pfam Description: Protein kinase domain

SEQ ID NO: 16830 - DNA, 1554 bp, Sorghum bicolor
  misc_feature: Ceres ANNOT ID no. 8667632
  misc_feature: Encodes the peptide sequence at SEQ ID NO 16831
atgcagttttcactagcatcggatgcgaactcaggtcctcacccaataagaagatcttgtgagggtggtgggattgacaggttggaacgattaagtattgggggcagcaagcaggagaaagctttgaggaataggtgctttggtggtagagttgctgcaactacacaatgtattcttacctcagatgcttgtcctgaaactcttcattttcaaacacagtcctctagaaaaagttatgctgatgcaaaccatgtatctgctatcattttgggtggaggcactggatctcagctctttcctctgacaagcacaagagctacgcctgctgttcctgttggaggatgttacaggcttatcgatatccctatgagtaactgcttcaacagtggtataaacaagatatttgtgatgactcagttcaattctacttcgcttaaccgccatattcatcgtacataccttggaggcgagatcaactttgctgatggatctgtacaggtattagcggatacacaaatgcccgaagagcctgatggatggttccagggtacagcagactctgtcagaaaatttatctgggtactcgaggattattacaatcacaaatctattgagcacattgtaatcttgagtggcgatcagctttatcagatgaattacatggaacttgtgcagaaacatgtcgaggacaatgctgacatcactgtatcatgtgctcctgttgatgagagccgagcttctaacaatgggctagtgaagtgtgatcatactggacgtgtacttcaattttttgagaaaccaaagggtgctgatttgaattcgatgagagttgataccaacttcctcagctatgctataggtgatgcacagaaatatcagtacatcgcatcaatgggcatttatgtcttcaagaaagatgcacttttagaccttctcaagtcaaaatatactcaattacatgacttcggatctgaaatcctcccaagagctgtactagagcataatgtgcagacatgcattttcatgggctattgggaggatgttggaacaatcaaatcattctttgatgcaaacttggccctcactgagcagccttccaagttcgatttttatgatccaaaaacacctttcttcactgcaccccggtacttgcctccgacacaattggacaagtgcaagatcaaagatgcatctatctcagatggttgcttactgagagaatgcagcatcgagcattctgtgattggagtctgctcacgtgtcagctatggatgtgaactcaaggactgtgtgatgatgggagcggacatctatgaaactgaagaagaagcttcaaagctactgttagctggggaggtcccagttggaataggaggaaacacaaagataaggaactgcatcattgacataaatgctaggattgggaagaacgtggtgatcacaaacagtaagggcatccaagaggctgatcaccctgaggaagggtactacataaagtctggaattgtggtgatcttgaagaatgcaaccatcaaggatgggtctgtcatataa

SEQ ID NO: 16831 - protein, 517 aa, Sorghum bicolor
  misc_feature: The sequence is a functional homolog of SEQ ID NO 38 in US patent 7312378
  misc_feature: The sequence is a functional homolog of SEQ ID NO 37 in US patent 7312378
  misc_feature: The sequence is a functional homolog of SEQ ID NO 39 in US patent 7312378
  misc_feature: Ceres ANNOT ID no. 8667632
  misc_feature (1)..(517): SWISSPROT Homolog: EC 2.7.7.27 Glucose-1-phosphate adenylyltransferase
  misc_feature (86)..(364): Pfam ID: NTP_transferase Pfam Description: Nucleotidyl transferase
MQFSLASDANSGPHPIRRSCEGGGIDRLERLSIGGSKQEKALRNRCFGGRVAATTQCILTSDACPETLHFQTQSSRKSYADANHVSAIILGGGTGSQLFPLTSTRATPAVPVGGCYRLIDIPMSNCFNSGINKIFVMTQFNSTSLNRHIHRTYLGGEINFADGSVQVLADTQMPEEPDGWFQGTADSVRKFIWVLEDYYNHKSIEHIVILSGDQLYQMNYMELVQKHVEDNADITVSCAPVDESRASNNGLVKCDHTGRVLQFFEKPKGADLNSMRVDTNFLSYAIGDAQKYQYIASMGIYVFKKDALLDLLKSKYTQLHDFGSEILPRAVLEHNVQTCIFMGYWEDVGTIKSFFDANLALTEQPSKFDFYDPKTPFFTAPRYLPPTQLDKCKIKDASISDGCLLRECSIEHSVIGVCSRVSYGCELKDCVMMGADIYETEEEASKLLLAGEVPVGIGGNTKIRNCIIDINARIGKNVVITNSKGIQEADHPEEGYYIKSGIVVILKNATIKDGSVI

SEQ ID NO: 16832 - DNA, 783 bp, Sorghum bicolor
  misc_feature: Ceres ANNOT ID no. 8667647
  misc_feature: Encodes the peptide sequence at SEQ ID NO 16833
atgctgacgacgggctcgcggtcgcggcagctcgtcctcctggtcgaccagtccggcaaaggcgaccataggaggatccaggacgcgatcgatgcggcaccggcgggtggctccggcagcggcggcggcggcgtcgtcatccggatcaagccgggagtttacaggcaagtagagaaagtggtggtggacaagccttgcataactctcgtgggcacgagcgccagctcgaccatcatcacctggaacgagtcctgggtggcctccgagagcccgacagtatccgtgctagcctccgacttcatcgccaagcgcttagcgttccagaacacgtttgggagtagcgggccggcagtcgccatgagggtcgccggagacagggcggcgttctacgggtgcaggttcgtgtcgttccaggacacgctcctggacgacacgggccgccattactaccgcggctgctacgtccaaggtgccaccgacttcatcttcggcaatggcaaggctctgttcgataagtgccacctccactccgtgtcggcggccggcggcgcgttcacggcgcataaacggtggtcggagtcggaggacaccgggttcagtttcgtggggtgcaagctgacggggctcggggccggcacgtccatcctggggcgaccctggggtccctactcccgccacggtgaggccccagggctgggacgactggaccgacggcgacaaacagaggcagaggacagcgttctacgggcagtaccagtgctacggggaaggctccaagactga

SEQ ID NO: 16833 - protein, 260 aa, Sorghum bicolor
  misc_feature: Useful for making plants with altered cell wall content and/or composition
  misc_feature: Functional homolog of the protein sequence given in SEQ ID NO 14431
  misc_feature: Ceres ANNOT ID no. 8667647
  misc_feature (13)..(225): SWISSPROT Homolog: EC 3.1.1.11 Pectinesterase
  misc_feature (15)..(257): Pfam ID: Pectinesterase Pfam Description: Pectinesterase
MLTTGSRSRQLVLLVDQSGKGDHRRIQDAIDAAPAGGSGSGGGGVVIRIKPGVYRQVEKVVVDKPCITLVGTSASSTIITWNESWVASESPTVSVLASDFIAKRLAFQNTFGSSGPAVAMRVAGDRAAFYGCRFVSFQDTLLDDTGRHYYRGCYVQGATDFIFGNGKALFDKCHLHSVSAAGGAFTAHKRWSESEDTGFSFVGCKLTGLGAGTSILGRPWGPYSRHGEAPGLGRLDRRRQTEAEDSVLRAVPVLRGRLQD

SEQ ID NO: 16834 - DNA, 1476 bp, Sorghum bicolor
  misc_feature: Ceres ANNOT ID no. 8667665
  misc_feature: Encodes the peptide sequence at SEQ ID NO 16835
atggccatcaaagatgagcagcagccgctgcacatcctcttcttaccgttccttgcaccggggcacctcatcccggtcgccgacatggccgcgctcttcgccgcccgaggcgtcaagtgcaccatcctcaccaccccggtgaacgcccaagtcatccgctcggcggtggaccacgccaacgacgcctcccgcggcaccgagggcgccctggccatcgacatcgccgtcgtgcctttccccgacgtcgggctgccccctggcgtcgagtgcggcccggcccttaattccatggaggaccgcgaaaagttcttccacgcggtgcagttactccgcgatccattcgtccggttcttggcggagaatcgccccgacgccgtggtgagcgacagcttcttcgtctggtccgccgacgccgccgcggagcacggcgtcccgcggatagcgttcctcggcagtagcttgttctcgcgggcctgcaacgacaccacggtgcgcaacaaccccgtggaggccgcccccgacgaccccgacgcgctcgtgctgcttccggggctgccgcaccgcgtcgtgctgaggcgcagccaaatgtttgagcccaagaagcggccggagcactgggcctccatgcagcgcggcaacgccgcggaccagaggagctacggcgaggtgttcaacagcttccacgagctggagccggactacttggagcactacaccacgacgctcgggcgccgcgcgtggctcgtcgggccggtcgcgctcgccagcaaggacgcggcgacgaggggcgccagcaacggtctctcgccggacgcgaacggctgcctgcagtggctcgacaccaagcaggagggctcggtcgtgtacgtgtccttcggcacgctgtcccatttctcgccgcctgagctgcgcgagctcgcacgcggcctcgacatgtccggcaagaacttcgtctgggtcatcggcggcggagcggacaccgaggagtcggaatggatgcccgacgggttcgcagagctgatggcgggcggtgaccgcggcttgatcatccggggctgggcgccgcagatgctgatcctgacccacccggcagtgggcgggttcgtgacgcactgtgggtggaactcgacgctagaggccatgagcgccggcgtgcctatggtgacgtggccgcgcttcgccgaccagttctacaacgaaaagctagtggtggagctgctcaaggtcggtgttggcgtggggtccacggactacgcgtcgaaggtggagacccgtcgcgtgatcggcggcgaggtgatcgcggaggcaatcgtgagagtgatgggcgacggcgaggacgcggtggcaatacgggagaaggccaaggagctcgcggagaaggccaggcgcgcggtggccaggggagggtcctcttacgatgatgtcggacgcttactggacgagctgatggctcgcaggagctccgtcaatgtctga

SEQ ID NO: 16835 - protein, 491 aa, Sorghum bicolor
  misc_feature: Useful for making plants with altered carbohydrate content
  misc_feature: Functional homolog of the protein sequence given in SEQ ID NO 14370
  misc_feature: Ceres ANNOT ID no. 8667665
  misc_feature (10)..(482): SWISSPROT Homolog: EC 2.4.1.238 Anthocyanin 3'-O-beta-glucosyltransferase
  misc_feature (21)..(486): Pfam ID: UDPGT Pfam Description: UDP-glucoronosyl and UDP-glucosyl transferase
MAIKDEQQPLHILFLPFLAPGHLIPVADMAALFAARGVKCTILTTPVNAQVIRSAVDHANDASRGTEGALAIDIAVVPFPDVGLPPGVECGPALNSMEDREKFFHAVQLLRDPFVRFLAENRPDAVVSDSFFVWSADAAAEHGVPRIAFLGSSLFSRACNDTTVRNNPVEAAPDDPDALVLLPGLPHRVVLRRSQMFEPKKRPEHWASMQRGNAADQRSYGEVFNSFHELEPDYLEHYTTTLGRRAWLVGPVALASKDAATRGASNGLSPDANGCLQWLDTKQEGSVVYVSFGTLSHFSPPELRELARGLDMSGKNFVWVIGGGADTEESEWMPDGFAELMAGGDRGLIIRGWAPQMLILTHPAVGGFVTHCGWNSTLEAMSAGVPMVTWPRFADQFYNEKLVVELLKVGVGVGSTDYASKVETRRVIGGEVIAEAIVRVMGDGEDAVAIREKAKELAEKARRAVARGGSSYDDVGRLLDELMARRSSVNV

SEQ ID NO: 16836 - DNA, 1476 bp, Sorghum bicolor
  misc_feature: Ceres ANNOT ID no. 8667668
  misc_feature: Encodes the peptide sequence at SEQ ID NO 16837
atggccatcaaagatgagctgcagccgttgcacatcctcttcttcccattcctcgcgccagggcacctcatcccgatcgccgacatggccgcgctcttcgctgcccgaggcgtcaagtgcaccatcctcaccaccccggtgaacgcccaagtcatccgctccgcggtggaccacgccaacgacgcctcccgcggcaccgatggcgccctggccatcgacatcgccgtcgtgcctttccctgacgtcgggctgccacccggcgtcgagagcggcccggcccttaattccatggaggaccgcgaaaagttctcccacgccgcccagttactccgcgacccgttcgaccggttcttggtggagaatcgccccgacgccgtggtgagcgacagcttcttcgactggtcagtcgacgccgccgcggagcacggcgtcccgcggatagcgttcctcggcatcagcttgttcgcgcggtcctgcagcgacaccatgttgcgcaacaacccagtggaggccgcccccgacgacccggacgcgcccgtgctgcttccgggcctgccgcaccgcgtcgagctgaagcggagccagatgatggagcccaagaagcggccggagcactgggccttcttccagcgcgtcaacgccgcggaccagaggagctacggcgaggtgttcaacagcttccacgagctggagccggactacttggagcactacaccacgacgctcgggcgccgcgcgtggctcgtcgggccggtcgcgctcgccagcaaggacgcggcgacgaggggcgccggcaacggtctctcgccggacgcggacggctgccagcagtggctcgacaccaagccggagggctcggtgctgtacgtgtccttcggcacgctgtcccatttctcgccgcccgagctgcgcgagctcgcacgcggcctcgacatgtccggcaagaacttcgtctgggtcatcaacggcggcgcggagacagaggaatcggaatggatgcccgatgggttcgcggagctgatggcgtgcggcgaccgtggcttcatcatccggggctgggcgccgcagatggtgatcctgacccacccggcagtgggcgggttcgtgacgcactgcgggtggaactcgacgctggaggccgtgagcgccggcgtgcctatggtgacgtggccacggtacgccgaccagttctacaacgagaagctggtggtggagctgctcaaggtcggtgtcggcgtggggtccacggactacgcgtcgaagctggagacgcggcgcgtgatcggcggcgaggtgatcgcggaggccatcggaagagtgatgggcgatggcgaggacgcggaggcaatacgggagaaggcccaggagctcggggggaaggccaggcgcgcggtggcgaagggtgggtcatcttatgatgatgtcggacggttagtggacgagctgatggctcgcaggagctccgtcaatgtctga

SEQ ID NO: 16837 - protein, 491 aa, Sorghum bicolor
  misc_feature: Useful for making plants with altered carbohydrate content
  misc_feature: Functional homolog of the protein sequence given in SEQ ID NO 14370
  misc_feature: Ceres ANNOT ID no. 8667668
  misc_feature (7)..(482): SWISSPROT Homolog: EC 2.4.1.238 Anthocyanin 3'-O-beta-glucosyltransferase
  misc_feature (21)..(486): Pfam ID: UDPGT Pfam Description: UDP-glucoronosyl and UDP-glucosyl transferase
MAIKDELQPLHILFFPFLAPGHLIPIADMAALFAARGVKCTILTTPVNAQVIRSAVDHANDASRGTDGALAIDIAVVPFPDVGLPPGVESGPALNSMEDREKFSHAAQLLRDPFDRFLVENRPDAVVSDSFFDWSVDAAAEHGVPRIAFLGISLFARSCSDTMLRNNPVEAAPDDPDAPVLLPGLPHRVELKRSQMMEPKKRPEHWAFFQRVNAADQRSYGEVFNSFHELEPDYLEHYTTTLGRRAWLVGPVALASKDAATRGAGNGLSPDADGCQQWLDTKPEGSVLYVSFGTLSHFSPPELRELARGLDMSGKNFVWVINGGAETEESEWMPDGFAELMACGDRGFIIRGWAPQMVILTHPAVGGFVTHCGWNSTLEAVSAGVPMVTWPRYADQFYNEKLVVELLKVGVGVGSTDYASKLETRRVIGGEVIAEAIGRVMGDGEDAEAIREKAQELGGKARRAVAKGGSSYDDVGRLVDELMARRSSVNV

SEQ ID NO: 16838 - DNA, 870 bp, Sorghum bicolor
  misc_feature: Ceres ANNOT ID no. 8667651
  misc_feature: Encodes the peptide sequence at SEQ ID NO 16839
atgtcgtccaactcgtcggcgtcgtcgtctgagtggacgaagccgcagcacaagctgttcgagcgcgccctggcggtgtacgacgcggacaccccggaccggtggcacaacgtggcgcgctacatgggcggcggcacgtccgtcgaggaggtgcgccgccactaccagcagctcgtcgtcgacgtcgcgcggatcgagtccgacggagtgcccttccactggaggttcaaattccgggctgtgctgattatacggcgaaggccgccggtcaaatgccacatgtgtggaaatggagttcttccatataggcaattccttaagatatccacctgtggtgttgaccgtgagacagtcgcagcaatagaaggtcaagacatgagtccgtgcacggtcgtgacttgggtggtcaccggcggcagtgctgggggcggtggcgcaggggagcaggggcggcgactagatatggcaaccgaacatgatacggaaggaaacagcggcaacggcagcggtggcagcgccttgcctagggcaggccaccaggtccccaatggcgccatcaagggtggtggtgccccttcgcgtcctcatggcaaaatacgacctggtcatcaactccatcaagtggcagagctccttggcctagatgaggcatacgatgcttctaacgagtggattggcaaggattatattttcccttgtcttgagcagtgcaaattcgaaggagtactggaggttgtcgatatacaaggtggtagccaattgtgcccatatcagagcctgtgtgagagtccatgtgtgcagcaagtagaagaggacatggtaccgatgcagttatgtcaagatggaaaatcaatcatggaggagccatga

SEQ ID NO: 16839 - protein, 289 aa, Sorghum bicolor
  misc_feature: Useful for making plants with altered lignin content
  misc_feature: Useful for making plants with modulated low light sensitivity
  misc_feature: Functional homolog of the protein sequence given in SEQ ID NO 12938
  misc_feature: Useful for making plants with modulated flowering time
  misc_feature: Functional homolog of the protein sequence given in SEQ ID NO 13566
  misc_feature: The sequence is a functional homolog of SEQ ID NO 976 in the 11/435,388 US patent application
  misc_feature: The sequence is a functional homolog of SEQ ID NO 510 in the 10/666,642 US patent application
  misc_feature: The sequence is a functional homolog of SEQ ID NO 2720 in the 10/374,780 US patent application
  misc_feature: The sequence is a functional homolog of SEQ ID NO 360 in the 10/225,066 US patent application
  misc_feature: The sequence is a functional homolog of SEQ ID NO 876 in the 11/435,388 US patent application
  misc_feature: Useful for making plants with modulated nitrogen use efficiency
  misc_feature: The sequence is a functional homolog of SEQ ID NO 1404 in the 11/479,226 US patent application
  misc_feature: The sequence is a functional homolog of SEQ ID NO 662 in the 10/412,699 US patent application
  misc_feature: The sequence is a functional homolog of SEQ ID NO 944 in the 11/435,388 US patent application
  misc_feature: Ceres ANNOT ID no. 8667651
  misc_feature (9)..(59): Pfam ID: Myb_DNA-binding Pfam Description: Myb-like DNA-binding domain
MSSNSSASSSEWTKPQHKLFERALAVYDADTPDRWHNVARYMGGGTSVEEVRRHYQQLVVDVARIESDGVPFHWRFKFRAVLIIRRRPPVKCHMCGNGVLPYRQFLKISTCGVDRETVAAIEGQDMSPCTVVTWVVTGGSAGGGGAGEQGRRLDMATEHDTEGNSGNGSGGSALPRAGHQVPNGAIKGGGAPSRPHGKIRPGHQLHQVAELLGLDEAYDASNEWIGKDYIFPCLEQCKFEGVLEVVDIQGGSQLCPYQSLCESPCVQQVEEDMVPMQLCQDGKSIMEEP

SEQ ID NO: 16840 - DNA, 1338 bp, Sorghum bicolor
  misc_feature: Ceres ANNOT ID no. 8667687
  misc_feature: Encodes the peptide sequence at SEQ ID NO 16841
atgccggaccgggccagaatccgcgccgcctccccagtcgcggcgcgcccttggctcgcctggcgtcggcgtcgcggatcccgaagtccgcatgcgccatgcgcacggcccaaatggacaccaaccagagaacaccgccgcacatcccgcggcgtttcctttcttcggatgccgtcgtactggaggatggcgccggaggtggcgctgcgctacgccaagaaggagatacggaacgccgagccggtggtcgacgaccccgacctttacgcgcctctgttcaagaacgtctcccagttcaagaggagctatgaactgatggaacggatactcaaagtttacatttaccaggacggccggaggcccatcttccacacgcctcccctcagcggcatctacgcctccgagggctggttcatgaagctcctcaaggagagccgccggcacgtcgtcgccgacgccggcaaggcgcacctcttctacctgccctacagctcccagcagctgaggctcacgctctaccaggccgactcccacaacctcaggccactggccgcgtatctcaggaacttcgtcagaggcctcgccaacaagtacccgttctggaaccgcaccagaggagccgaccatttccttgtcgcctgccatgattggggaccttacacgacggccgcgcaccgcgacctccgcaagaacgccatcaaggcgctgtgcaacgccgacagctcggagggtatcttcaccccagggaaggacgtctccctgcccgaaacgaccatcaggaacccgaggcggccgctccggtacgtcggcggcctgccggtgtcccgccggagcatcctggcgttcttcgccggcaacgtgcacggcagggtccggccggtgctcctcaggcactggggcgacgggcaggacgacgagatgcgggtgtacagcctgctgccgaaccgggtgtcccggcggatgaactacatccagcacatgaagaacagccggttctgcctctgccccatggggtacgaggtgaacagcccacgcatcgtggaggcgttctactacgagtgcgtgcccgtgatcatcgccgacaacttcgtgctgcccttgagcgaggtgctggactggagcgccttctcggtggtggtcgccgagaaggacataccggacctcaagaagatcctgcaggggatctcgccgcggaggtacgtggccatgcacagctgcgtcaagcgcctgcagcggcacttcctgtggcacgccaggccaatcaagtacgacctcttccacatgatcctgcactccatttggttgagcagagtgaaccaggttgagctcgagggttga

SEQ ID NO: 16841 - protein, 445 aa, Sorghum bicolor
  misc_feature: Useful for making plants with altered cell wall content and/or composition
  misc_feature: Functional homolog of the protein sequence given in SEQ ID NO 14432
  misc_feature: Ceres ANNOT ID no. 8667687
  misc_feature (327)..(418): SWISSPROT Homolog: EC 2.4.1.224 Glucuronosyl-N-acetylglucosaminyl-proteoglycan 4-alpha-N-acetylglucosaminyltransferase
  misc_feature (112)..(407): Pfam ID: Exostosin Pfam Description: Exostosin family
MPDRARIRAASPVAARPWLAWRRRRGSRSPHAPCARPKWTPTREHRRTSRGVSFLRMPSYWRMAPEVALRYAKKEIRNAEPVVDDPDLYAPLFKNVSQFKRSYELMERILKVYIYQDGRRPIFHTPPLSGIYASEGWFMKLLKESRRHVVADAGKAHLFYLPYSSQQLRLTLYQADSHNLRPLAAYLRNFVRGLANKYPFWNRTRGADHFLVACHDWGPYTTAAHRDLRKNAIKALCNADSSEGIFTPGKDVSLPETTIRNPRRPLRYVGGLPVSRRSILAFFAGNVHGRVRPVLLRHWGDGQDDEMRVYSLLPNRVSRRMNYIQHMKNSRFCLCPMGYEVNSPRIVEAFYYECVPVIIADNFVLPLSEVLDWSAFSVVVAEKDIPDLKKILQGISPRRYVAMHSCVKRLQRHFLWHARPIKYDLFHMILHSIWLSRVNQVELEG

SEQ ID NO: 16842 - DNA, 1476 bp, Sorghum bicolor
  misc_feature: Ceres ANNOT ID no. 8667669
  misc_feature: Encodes the peptide sequence at SEQ ID NO 16843
atggccatcaaagatgagcagaagccgctgcacatcctcttcttcccgttcctcgcgccggggcacctcatcccgatcgccgacatggccgcactcttcgccgcccgaggcgtcaagtgcaccatcctcaccacccctgtgaacgcccaagtcatccgctcggcggtggatcacgccaacgacgccttccgcggcactgagggcaccctggccatcgacatcgccgtcgtgccttttcccgacgtcgggctgcctcctggcgtcgagtgcggcccggcccttaattccgtggacgaccacgaaaagttcttccacgccgcccagttactccgcgagccgttcgaccggttcttggcggagaatcgccccgatgccgtcgtggccgacagtttcttcgagtgggcggccgacgccgccgcggagcacggcgtcccgcggatggcgttcctcggcagcagcttgttctcgcggacatgcatcgacagcatgctgcgctacaaccccgtggaggccgcccccgacgaccccgacgcgctcgtgctgcttccagggctgccgcaccgcgtcgagctgaggcgcagccagatgaaggagcccaaggagcagccggaggactgggccttcctccagcgcgtcaacgccgcggacctgaggagctacggcgaggtgttcaacagcttccacgacctggagcgggagtccttggagcactacaccacgacgctagggtgccgcgcgtggctcgtcgggccggtcgcgctcgccagcaagaaccacgcggcgaggggcgccggcgacgagccctcgccggacgcggacagctgccagcagtggctcgacaccaaggcggagggctcggtggtgtacgtgtccttcggcacgctgtcccatttctcgccgcccgagctgcgcgagctcgcaagcggcctggacatgtccggcaagaacttcgtctgggtcatcggcggcggcgcggacaccaaggagtcggaatggatgccccacgggttcgcggagctgatggcgcgcggcgaccgtggcttcatcatccggggctgggcgccgcagaggctgattctggctcacccggcaatgggcggcttcgtgacgcactgcggctggaactcgacgctggaggcggtgagcgccggcgtgcctatggtgacgtggccgcgcttcgccgaccagttctacaacgagaagctggtggtcgagctgctcaaggtcggtgtcagcgtggggtccacggactacgcgtcgaaacttgagacacggcgcgtgatcggcggcgaggtgattgcggaggccattgggagagtgatgggcgacggcgaggacgcagaggcaatacgagagaaggccaaggagctcggggagaaggccaggcgtgcggtggccaagggtgggtcctcttacgatgacgtcggacgcttaatggacgagctgatcgctcgtaggagctccgtcgatgtctga

SEQ ID NO: 16843 - protein, 491 aa, Sorghum bicolor
  misc_feature: Useful for making plants with altered carbohydrate content
  misc_feature: Functional homolog of the protein sequence given in SEQ ID NO 14370
  misc_feature: Ceres ANNOT ID no. 8667669
  misc_feature: Up-regulated in shoot tissues in response to methyl jasmonate treatment
  misc_feature: Up-regulated in root tissues in response to methyl jasmonate treatment
  misc_feature (10)..(482): SWISSPROT Homolog: EC 2.4.1.238 Anthocyanin 3'-O-beta-glucosyltransferase
  misc_feature (21)..(486): Pfam ID: UDPGT Pfam Description: UDP-glucoronosyl and UDP-glucosyl transferase
MAIKDEQKPLHILFFPFLAPGHLIPIADMAALFAARGVKCTILTTPVNAQVIRSAVDHANDAFRGTEGTLAIDIAVVPFPDVGLPPGVECGPALNSVDDHEKFFHAAQLLREPFDRFLAENRPDAVVADSFFEWAADAAAEHGVPRMAFLGSSLFSRTCIDSMLRYNPVEAAPDDPDALVLLPGLPHRVELRRSQMKEPKEQPEDWAFLQRVNAADLRSYGEVFNSFHDLERESLEHYTTTLGCRAWLVGPVALASKNHAARGAGDEPSPDADSCQQWLDTKAEGSVVYVSFGTLSHFSPPELRELASGLDMSGKNFVWVIGGGADTKESEWMPHGFAELMARGDRGFIIRGWAPQRLILAHPAMGGFVTHCGWNSTLEAVSAGVPMVTWPRFADQFYNEKLVVELLKVGVSVGSTDYASKLETRRVIGGEVIAEAIGRVMGDGEDAEAIREKAKELGEKARRAVAKGGSSYDDVGRLMDELIARRSSVDV

SEQ ID NO: 16844 - DNA, 1416 bp, Sorghum bicolor
  misc_feature: Ceres ANNOT ID no. 8667690
  misc_feature: Up-regulated in shoot tissues in response to methyl jasmonate treatment
  misc_feature: Up-regulated in root tissues in response to methyl jasmonate treatment
  misc_feature: Encodes the peptide sequence at SEQ ID NO 16845
atgacgatgaccgtctccttctgccgcgtcgcggcgctcgtgtccctcctcgcggcgggcgcggccacggcgctgctcaccttctccctaccttcttcccccggcgtgtccaccacgaggagaaccgacttcgccggagcgttgccagtcgcgaacgagacgccgccactgccgcacttgtcggcacccgccacgccgccccctgctccgctgctgcccccgcccgccgtcaggcctcgaaaacgagagccgtcgtactggaggatggcgccggaggtggcgctgcgctacgccaagaaggagatacggaacgccgagccggtggtcgacgaccccgacctttacgcgcctctgttcaagaacgtctcccagttcaagaggagctatgaactgatggaacggatactcaaagtttacatttaccaggacggccggaggcccatcttccacacgcctcccctcagcggcatctacgcctccgagggctggttcatgaagctcctcaaggagagccgccggcacgtcgtcgccgacgccggcaaggcgcacctcttctacctgccctacagctcccagcagctgaggctcacgctctaccaggccgactcccacaacctcaggccactggccgcgtatctcaggaacttcgtcagaggcctcgccaacaagtacccgttctggaaccgcaccagaggagccgaccatttccttgtcgcctgccatgattggggaccttacacgacggccgcgcaccgcgacctccgcaagaacgccatcaaggcgctgtgcaacgccgacagctcggagggtatcttcaccccagggaaggacgtctccctgcccgaaacgaccatcaggaacccgaggcggccgctccggtacgtcggcggcctgccggtgtcccgccggagcatcctggcgttcttcgccggcaacgtgcacggcagggtccggccggtgctcctcaggcactggggcgacgggcaggacgacgagatgcgggtgtacagcctgctgccgaaccgggtgtcccggcggatgaactacatccagcacatgaagaacagccggttctgcctctgccccatggggtacgaggtgaacagcccacgcatcgtggaggcgttctactacgagtgcgtgcccgtgatcatcgccgacaacttcgtgctgcccttgagcgaggtgctggactggagcgccttctcggtggtggtcgccgagaaggacataccggacctcaagaagatcctgcaggggatctcgccgcggaggtacgtggccatgcacagctgcgtcaagcgcctgcagcggcacttcctgtggcacgccaggccaatcaagtacgacctcttccacatgatcctgcactccatttggttgagcagagtgaaccaggttgagctcgagggttga

SEQ ID NO: 16845 - protein, 471 aa, Sorghum bicolor
  misc_feature: Useful for making plants with altered cell wall content and/or composition
  misc_feature: Functional homolog of the protein sequence given in SEQ ID NO 14432
  misc_feature: Ceres ANNOT ID no. 8667690
  misc_feature (353)..(444): SWISSPROT Homolog: EC 2.4.1.224 Glucuronosyl-N-acetylglucosaminyl-proteoglycan 4-alpha-N-acetylglucosaminyltransferase
  misc_feature (138)..(433): Pfam ID: Exostosin Pfam Description: Exostosin family
MTMTVSFCRVAALVSLLAAGAATALLTFSLPSSPGVSTTRRTDFAGALPVANETPPLPHLSAPATPPPAPLLPPPAVRPRKREPSYWRMAPEVALRYAKKEIRNAEPVVDDPDLYAPLFKNVSQFKRSYELMERILKVYIYQDGRRPIFHTPPLSGIYASEGWFMKLLKESRRHVVADAGKAHLFYLPYSSQQLRLTLYQADSHNLRPLAAYLRNFVRGLANKYPFWNRTRGADHFLVACHDWGPYTTAAHRDLRKNAIKALCNADSSEGIFTPGKDVSLPETTIRNPRRPLRYVGGLPVSRRSILAFFAGNVHGRVRPVLLRHWGDGQDDEMRVYSLLPNRVSRRMNYIQHMKNSRFCLCPMGYEVNSPRIVEAFYYECVPVIIADNFVLPLSEVLDWSAFSVVVAEKDIPDLKKILQGISPRRYVAMHSCVKRLQRHFLWHARPIKYDLFHMILHSIWLSRVNQVELEG

SEQ ID NO: 16846 - DNA, 666 bp, Sorghum bicolor
  misc_feature: Ceres ANNOT ID no. 8667712
  misc_feature: Encodes the peptide sequence at SEQ ID NO 16847
atggcggcctcctccgcctccctcctcgcccgccgcctcatcctgtcccgccgcttcctgtcatcccgactcagctccttctccaccaccacgacgcccagttcctcgaccccttcgttcaacggatccgatgcggagtccgaccctgagcacgagcactaccagccccgcgcggaccaggatcgtcagcagacgtcgaaccgcccgcgcccgcccgacaccacccgccctctcgagaacggcctcgatcctggcatctacaaggcgatactggtggggaaggtcgggcaggagccgatgcagaagcggctgcggaatgggaggaccgtcgtcctcttctcgctcggcaccggcggcatccgcaacaaccgccgcccgctggatcgcgaggagccgcaccagtacgccgacaggtgctccgtgcagtggcaccgcgtctgcgtctacccagagcgcctcggcaccctcgcgctcaaaaacgttaagactggcactgtcctctatttggaaggaaatcttgagaccaaagtgttctgtgatccaattactgggctggttagacgcataagagaaatagctgtgcgatcaactggtcgtctcttgtttctgggcaatgacaccaatgctccaaagttgggtgaagtcaagggcgtcggctacttctga

SEQ ID NO: 16847 - protein, 221 aa, Sorghum bicolor
  misc_feature: Useful for making plants with altered alkaloid content
  misc_feature: Useful for making plants with altered terpenoid content
  misc_feature: Functional homolog of the protein sequence given in SEQ ID NO 14433
  misc_feature: Ceres ANNOT ID no. 8667712
  misc_feature (86)..(203): Pfam ID: SSB Pfam Description: Single-strand binding protein family
MAASSASLLARRLILSRRFLSSRLSSFSTTTTPSSSTPSFNGSDAESDPEHEHYQPRADQDRQQTSNRPRPPDTTRPLENGLDPGIYKAILVGKVGQEPMQKRLRNGRTVVLFSLGTGGIRNNRRPLDREEPHQYADRCSVQWHRVCVYPERLGTLALKNVKTGTVLYLEGNLETKVFCDPITGLVRRIREIAVRSTGRLLFLGNDTNAPKLGEVKGVGYF

SEQ ID NO: 16848 - DNA, 1137 bp, Sorghum bicolor
  misc_feature: Ceres ANNOT ID no. 8667710
  misc_feature: Encodes the peptide sequence at SEQ ID NO 16849
atgtcgagactcatcgggactggggaggacacgctgggggctgaggagggcgtgccgaggtcagagatgcacatagagttgaattcgaacagaggagccgttttgctaaaggattatcaaaacggttacagctctaccgaaagaactatctgtggagtctcgctcgcagtatacaaagcttggctccatcctcctgcactcggagaccacggactggcaataccacactctcgcccacagctagcaaccatgaggaccatcatggcgaggagcccccacgagtcctccttctccttctcccggaggaacttcaagtggccggttcttgtcaagagcagcagccatggcggcacggccggcggcgaggagggcggctccggcagcaagggctcagaggccgacgacgaggacgagtcggccatggcgttctcctccagctgcgcgtccttccactcggaggacttcgtgtccccgccgcccaaggcggcgccacctccagctccaccgaagcagcgcggcaagaagtgccgcacggcggtctcccggctgcgcacggcgctcgccgcggccatcgccggccggcaccggcaggtcgggctcggcgcgcggctcacgggcacgctctacggccaccgccgcggccacgtccacctcgcgttccaggtggacccgcgcgcgtgccccgcgctgctgctcgagctcgccgcgcccacggcgtcgctggtgcgcgagatggcctcgggcctcgtccgcatcgcgctcgagtgcgaccgcgccaagggcgccgcctgcgccgcggccgcgaccaatggcggcggcggcggcggcaggaagctggtcgaggagaaggcgtggcgcgcgtactgcaacggcaagggctgcgggtacgcggtgcggcgcgagtgcggcgccgcggactggcgcgtgctgcgcgcgctggagcccgtgtctatgggcgcgggcgtcataccggcggcgtgcggcggcggcggcgagggcgacgtcatgtacatgcgcgctcgcttcgagcgcgtcgtgggctcccgcgactcggaggcattctacatgatgaacccggacagcagcaccggcggcaatggcggcccggagcttagcgtctacctccttagagtttga

SEQ ID NO: 16849 - protein, 378 aa, Sorghum bicolor
  misc_feature: Useful for biocontainment applications
  misc_feature: Functional homolog of the protein sequence given in SEQ ID NO 14434
  misc_feature: Ceres ANNOT ID no. 8667710
MSRLIGTGEDTLGAEEGVPRSEMHIELNSNRGAVLLKDYQNGYSSTERTICGVSLAVYKAWLHPPALGDHGLAIPHSRPQLATMRTIMARSPHESSFSFSRRNFKWPVLVKSSSHGGTAGGEEGGSGSKGSEADDEDESAMAFSSSCASFHSEDFVSPPPKAAPPPAPPKQRGKKCRTAVSRLRTALAAAIAGRHRQVGLGARLTGTLYGHRRGHVHLAFQVDPRACPALLLELAAPTASLVREMASGLVRIALECDRAKGAACAAAATNGGGGGGRKLVEEKAWRAYCNGKGCGYAVRRECGAADWRVLRALEPVSMGAGVIPAACGGGGEGDVMYMRARFERVVGSRDSEAFYMMNPDSSTGGNGGPELSVYLLRV

SEQ ID NO: 16850 - DNA, 693 bp, Sorghum bicolor
  misc_feature: Ceres ANNOT ID no. 8667717
  misc_feature: Encodes the peptide sequence at SEQ ID NO 16851
atggggtccacttctccttcaggcctggagctcaccatggctgtccccggcctcagctcctcctctggctcagaggggtttggatgcaacaacaacgggaacgggaacgggaacaacatgagggacctggacatgaaccagccggcgagcggcggcgaggaggaggagttcccaatgggaagcgtggaggaggaggaagacgagcgcggcggcgccggcgggcgcgggccgcaccgctccaagaagctccgcctctccaaggagcagtcccgcctgctggaggagagcttccgcttcaaccacacccccacaccgaagcaaaaagaggccttggctggcaagctccagctgcggcccaggcaggtggaggtctggttccagaaccgcagggctaggacgaagctgaagcagacggagctggagtgcgagtacctgaagcggtgcttcggctcgctgaccgaggagaaccggcggctgcagcgggaggtggaggagctgcgcgcgatgcgggtggccccgcccaccgtgctctccccgcactcccggcagccgctcccggcatccgcgctcaccatgtgcccgcgctgcgagcgcatcaccgccgcgaccgccgcgcgtacgcctcgcccggccgcagccgcagccgcgggcagcaaccccttccacccgcgccgcccgtccgcggcgttttag

SEQ ID NO: 16851 - protein, 230 aa, Sorghum bicolor
  misc_feature: The sequence is a functional homolog of SEQ ID NO 1674 in the 10/374,780 US patent application
  misc_feature: The sequence is a functional homolog of SEQ ID NO 10 in the 10/225,066 US patent application
  misc_feature: The sequence is a functional homolog of SEQ ID NO 136 in the 11/375,241 US patent application
  misc_feature: The sequence is a functional homolog of SEQ ID NO 1873 in the 11/479,226 US patent application
  misc_feature: The sequence is a functional homolog of SEQ ID NO 304 in the 10/374,780 US patent application
  misc_feature: The sequence is a functional homolog of SEQ ID NO 838 in the 10/225,066 US patent application
  misc_feature: The sequence is a functional homolog of SEQ ID NO 254 in the 10/412,699 US patent application
  misc_feature: The sequence is a functional homolog of SEQ ID NO 550 in the 11/479,226 US patent application
  misc_feature: Useful for biocontainment applications
  misc_feature: Useful for making plants with modulated biomass
  misc_feature: Useful for making plants with modulated flowering time
  misc_feature: Functional homolog of the protein sequence given in SEQ ID NO 13544
  misc_feature: The sequence is a functional homolog of SEQ ID NO 2326 in the 10/374,780 US patent application
  misc_feature: The sequence is a functional homolog of SEQ ID NO 252 in the 10/412,699 US patent application
  misc_feature: The sequence is a functional homolog of SEQ ID NO 546 in the 11/479,226 US patent application
  misc_feature: The sequence is a functional homolog of SEQ ID NO 8 in the 10/225,068 US patent application
  misc_feature: The sequence is a functional homolog of SEQ ID NO 2328 in the 10/374,780 US patent application
  misc_feature: The sequence is a functional homolog of SEQ ID NO 524 in the 10/225,066 US patent application
  misc_feature: The sequence is a functional homolog of SEQ ID NO 553 in the 11/479,226 US patent application
  misc_feature: The sequence is a functional homolog of SEQ ID NO 568 in the 11/479,226 US patent application
  misc_feature: The sequence is a functional homolog of SEQ ID NO 542 in the 11/479,226 US patent application
  misc_feature: Useful for making plants with altered lignin content
  misc_feature: Functional homolog of the protein sequence given in SEQ ID NO 12880
  misc_feature: Useful for making plants with altered alkaloid content
  misc_feature: Functional homolog of the protein sequence given in SEQ ID NO 13109
  misc_feature: Ceres ANNOT ID no. 8667717
  misc_feature (81)..(135): Pfam ID: Homeobox Pfam Description: Homeobox domain
  misc_feature (136)..(180): Pfam ID: HALZ Pfam Description: Homeobox associated leucine zipper
MGSTSPSGLELTMAVPGLSSSSGSEGFGCNNNGNGNGNNMRDLDMNQPASGGEEEEFPMGSVEEEEDERGGAGGRGPHRSKKLRLSKEQSRLLEESFRFNHTPTPKQKEALAGKLQLRPRQVEVWFQNRRARTKLKQTELECEYLKRCFGSLTEENRRLQREVEELRAMRVAPPTVLSPHSRQPLPASALTMCPRCERITAATAARTPRPAAAAAAGSNPFHPRRPSAAF

SEQ ID NO: 16852 - DNA, 2703 bp, Sorghum bicolor
  misc_feature: Ceres ANNOT ID no. 8667719
  misc_feature: Encodes the peptide sequence at SEQ ID NO 16853
atgatgcctcaggtgctcttgatctcccgcctgcgcctcgcccctctcctctacgacggccaccacctgcgacgctctctctccgacgctgctgccaaactatctgacgagttgcctcctggcgctccgccgccgacctccgactccaggctcttcggcgccgggttgtcgtggtccgtggacgagcgctccctcacggacgccttctgctccttcggcaccgtcaccgaagttcgaggtcagatggtgcacgggttaggtgttcggcaaaatgccgtggaggacgtaacacgtaagccaccccatcgcacccaggcccgcagcctgttcgacgaagttcctgttagggacgtggtcacctgctcggcggcaatctatcggcatgcgaggagtgggttattccatgagtcagctgggctgtttgtcagcatgatgagggcagttaagatcggctttgatttggatgtctcggcgcatgttggtgaagttataagtatctttgttcagatgagggcaaatggtatagttcctgacagggtagcaatgtcagcttatcaactggatgctatgagactgctaagtttgatctatgtgttcaacttcatgggtatagctacaagtcaggtttgtatctgtatagacctgtccctaatactctcatgggcagtttatgataagtgtggatatgccagtttagctcataaaatatttgatgacatgatttctcgagatgttgtctcgtggaatactctgatattatcctatggtataaatggccatggagagcaagcagtagcactttttaatgacatggaggaatctagtgaagagcaagacagtgtgatatacttgaacacaatgctggcatgcagccattctggacaagttgatgatgggttgatcatattcaagaaaatgaataatgaggagctcgtaaatttgtgcaaggagcacatcggatgcctagtggatatgttggcaaaagctggtcgcttgggtgaagcagcagaagtggctagcttgactagcaatgagggcgcaaatcattggaatgggaggagttatcaaaagaccttttgctttgcagttagaataatgtatgacaaaaactcaggaaggtcaagaggctttggatttgttcatttctcaaatgatcatgaagctaagtgtgccaaggatgctatggatgggaaggtaatgctagggcgtccattgcgaataagttttgctctaggaaaagtccatggtgcatcagttattgttcctcgacttgctataggctccggggaggccccgttcttcacggactacggcgaggccagcaggtacgaggtcaccgaggtggtcggcaagggcagctacggcgtggtcgccgccgccctcgacaccctcactggcgagcacgtcgccatcaagaagatcaacgatgtcttcgagcacatctccgacgccacccgcatcctccgcgagatcaagctgctccgcctcttgcgccacccggacatcgtccggatcaagcatatcatgctccccccatcgcgccgcgagttccgcgacatttacgtcgtcttcgagctcatggagtccgacctccaccaggtaatcaaggccaacgacgacctcacgcccgagcaccaccagttcttcttgtaccagctgctccgcggcatgaagtacatccacgccgccaatgtcttccaccgggacctcaagcccaagaacattctcgccaacggcgactgcaagctcaagatttgtgactttggccttgctcgggtgtctttcaacgatacaccttcagcaatattctggacggattatgtggcaacaagatggtatcgtgctccagaattatgcggctccttcttttcaaagtatactcctgctattgatatctggagcataggatgtatatttgctgaaatgcttacagggaagcctctctttcctggcaagaatgtggtacatcaattggatctcatgacagatctacttggcactccttcatcagagtcactttccaggattcgaaatgaaaaggctcgccgatacttgggtaacatgagaaaaaagcatccagttccttttacgcagaagtttcctggtatagatccaatggctcttcatttgcttgaacgtctacttgcttttgatccgaaggatcgaccaactgctgcagaggccttaacagatccgtactttactggattagcaaattctgaacgtgaaccgataacacagcctatctcaaaatttgagtttgagtttgaaagaaggaagctggccagagatgatgttcgggaattaatttacagagaggagtttcttggtggtggggataaggcgaactttgtgtacccaagtggggtggatcgtttcaagagacaattcgctcatctcgaagaaagtgctgctaagggtgagaagactagcccacagctgcggcagcatgcttccttaccaagggaaagagtaaatgacagcagcgacgacctagagaagccaagtgcagattactgcataagattgcatgtacgtgagccactctcaagtactcgtaactttctgaagagcgaaagcatcagtgcttcccagtgtgtggtcatcaaacaaaagcgagagaaagatgaggaatctatttctgagtatgtgaacgatccagttgatggtgtgccaaagaggattgctcaactcaaaacctga

SEQ ID NO: 16853 - protein, 900 aa, Sorghum bicolor
  misc_feature: Useful for making plants with altered cell wall content and/or composition
  misc_feature: Functional homolog of the protein sequence given in SEQ ID NO 14430
  misc_feature: Ceres ANNOT ID no. 8667719
  misc_feature (427)..(863): SWISSPROT Homolog: EC 2.7.11.24 Mitogen-activated protein kinase
  misc_feature (443)..(734): Pfam ID: Pkinase Pfam Description: Protein kinase domain
  misc_feature (246)..(280): Pfam ID: PPR Pfam Description: PPR repeat
MMPQVLLISRLRLAPLLYDGHHLRRSLSDAAAKLSDELPPGAPPPTSDSRLFGAGLSWSVDERSLTDAFCSFGTVTEVRGQMVHGLGVRQNAVEDVTRKPPHRTQARSLFDEVPVRDVVTCSAAIYRHARSGLFHESAGLFVSMMRAVKIGFDLDVSAHVGEVISIFVQMRANGIVPDRVAMSAYQLDAMRLLSLIYVFNFMGIATSQVCICIDLSLILSWAVYDKCGYASLAHKIFDDMISRDVVSWNTLILSYGINGHGEQAVALFNDMEESSEEQDSVIYLNTMLACSHSGQVDDGLIIFKKMNNEELVNLCKEHIGCLVDMLAKAGRLGEAAEVASLTSNEGANHWNGRSYQKTFCFAVRIMYDKNSGRSRGFGFVHFSNDHEAKCAKDAMDGKVMLGRPLRISFALGKVHGASVIVPRLAIGSGEAPFFTDYGEASRYEVTEVVGKGSYGVVAAALDTLTGEHVAIKKINDVFEHISDATRILREIKLLRLLRHPDIVRIKHIMLPPSRREFRDIYVVFELMESDLHQVIKANDDLTPEHHQFFLYQLLRGMKYIHAANVFHRDLKPKNILANGDCKLKICDFGLARVSFNDTPSAIFWTDYVATRWYRAPELCGSFFSKYTPAIDIWSIGCIFAEMLTGKPLFPGKNVVHQLDLMTDLLGTPSSESLSRIRNEKARRYLGNMRKKHPVPFTQKFPGIDPMALHLLERLLAFDPKDRPTAAEALTDPYFTGLANSEREPITQPISKFEFEFERRKLARDDVRELIYREEFLGGGDKANFVYPSGVDRFKRQFAHLEESAAKGEKTSPQLRQHASLPRERVNDSSDDLEKPSADYCIRLHVREPLSSTRNFLKSESISASQCVVIKQKREKDEESISEYVNDPVDGVPKRIAQLKT

SEQ ID NO: 16854 - DNA, 2625 bp, Sorghum bicolor
  misc_feature: Ceres ANNOT ID no. 8667773
  misc_feature: Encodes the peptide sequence at SEQ ID NO 16855
atggcagggtggggatcgtccagggtggcggcgtgcgggccgtggggccgcggcgcggcgctggagagggagctgtcgcgggacggcagccactacagcatctccagcggcatcctgccgtcgctcggcgcgcggagcaaccgccgcgtcaagctcaggcccttcatcgtctcgccctacgaccgccgatacagatgctgggagacttttctcataattcttgtggtgtattctgcatgggtttccccatttgagtttggcttcattcggaaaccgacgggcgccctagctgcagtggacaatgtcgtgaatgcgttcttcgcagtggacatcatcctgaccttctttgtagcttacttggatagaatgacatacctgcttgaagatgatccgaaaaggatagcttggcggtatactaccagttggtttgtccttgacgtggcctccaccatcccaagtgaatttgctcggaggatactaccaccaaacctcaggtcatatggatttttcaacatgcttcgtctatggcgtctccgtagagtcagctctctctttgctagattggagaaagatagacatttcaattacttctgggttcgatgtgcaaagctcatatgtgtcacactttttgctgtccactgttcggcatgcttctactatcttctcgctgataggtatcctgtcccaacggatacgtggattggcaattcgatgccagattttcatcagcggggtttatggattcgctatgtaatatcagtatattggtcaatcactactcttaccactgtgggttatggtgatttgcacgcggagaacacaagggagatgatattcaacattttctacatgctattcaaccttggattgactgcctatttgattggtaacatgaccaatctggttgtccatggcaccagccgtactcgaaaatatagagatacaattcaagcagcaaccagctttgcactaaggaatcagttaccaagtcggctccaagatcagatgatctcccatcttagcttgaagttcaggacagattcagaaggtcttcaacaacaagagaccctcgatgcgcttcctaaggctataagatccagcatttctcagtatctgtttttcaatcttgtccaaaaggtctacttgtttgaaggggtgtccaatgacctgatttttcaactggtttctgagatgaaagctgaatattttccacctagggaagatgtgattctgcagaatgaagcacccacagacttttatattttagttactggtagcgcgatagctggagtggctaaggcaggagatgttgttggagaaattggggttctttgctataggccccaactattcacagttcgaacaaaatcattatgccagcttctgcgtatgaatcgcactgcctttctcagccttgttcaatccaatgttgcagatggaacaataataatgaacaaccttatgcagttactgaaagagcagaaagacaacagtgtaatggcgggtgttctgaaggagattgagaacatgctagcgcggggtcgtctggatttgccagttaccctctgctttgcagtaaataaaggagatgattttatgttacatcaacttttgaagcgtggtttggatccaaatgaatcagataacaatgggcatacagcactgcatatagctgcttccaaaggagacgaacaatgcgtcaagcttcttctagactacggagctgatccaaatgctagagattccgaaggaaaagtgcctctatgggaggctttatgtgaaaagcataatgcagtaatagagctgttagtagagagtggtgcagagctatcatctggagacacagccttgtatgcttgcatcgctgttgaggaaaatgatgctgagttgcttgagaacattatccgctatggtggcaacataaacagctcaacgaaagatggaaccacaccgctgcatcgtgcagtctgtgatggaaatgttcagatggttgagttgttgctggaacacggagctgacatcaacaagcaggacaacaatggctggtcagcaagagatctagctgatcagcaaggccatgatgacattcaggttctctttaaatcacgaaaagcacataggcagcatgcctcaaatggcagagtggcacctatgctgatagggaggttcaacagtgaaccctcaatgccaaatatgaaccatgaagacgccgaagtacgcagcaaagttgttccacagaagctcctcagaaagagggtcagtttccaaaattctcttttcggtgtcatttcttcatcccaggcccgccaggacacaggtggtctgctctcgaaaggccttgctggaacaggtggcccaagttgccatcacgactccctcatcagggtgacaatcagctgccctgagaaagggaatgctgcagggaagcttgtgcgcctaccacggtcgatgactgagcttctcgaactaggtgcaaagaagttcgacttcaagcctaccaaggtcctgacagttgggggtgctgagattgatgaggtggagcttatcagagacggtgatcatattgttctcgtcagtagtgactgggtgccagatgttgcacaaattagacctaacgatcaatga

SEQ ID NO: 16855 - protein, 874 aa, Sorghum bicolor
  misc_feature: The sequence is a functional homolog of SEQ ID NO 1838 in the 10/374,780 US patent application
  misc_feature: Ceres ANNOT ID no. 8667773
  misc_feature (522)..(726): SWISSPROT Homolog: EC 2.7.11.1 Non-specific serine/threonine protein kinase
  misc_feature (99)..(298): Pfam ID: Ion_trans Pfam Description: Ion transport protein
  misc_feature (550)..(582): Pfam ID: Ank Pfam Description: Ankyrin repeat
  misc_feature (647)..(679): Pfam ID: Ank Pfam Description: Ankyrin repeat
  misc_feature (207)..(304): Pfam ID: Ion_trans_2 Pfam Description: Ion channel
  misc_feature (400)..(478): Pfam ID: cNMP_binding Pfam Description: Cyclic nucleotide-binding domain
MAGWGSSRVAACGPWGRGAALERELSRDGSHYSISSGILPSLGARSNRRVKLRPFIVSPYDRRYRCWETFLIILVVYSAWVSPFEFGFIRKPTGALAAVDNVVNAFFAVDIILTFFVAYLDRMTYLLEDDPKRIAWRYTTSWFVLDVASTIPSEFARRILPPNLRSYGFFNMLRLWRLRRVSSLFARLEKDRHFNYFWVRCAKLICVTLFAVHCSACFYYLLADRYPVPTDTWIGNSMPDFHQRGLWIRYVISVYWSITTLTTVGYGDLHAENTREMIFNIFYMLFNLGLTAYLIGNMTNLVVHGTSRTRKYRDTIQAATSFALRNQLPSRLQDQMISHLSLKFRTDSEGLQQQETLDALPKAIRSSISQYLFFNLVQKVYLFEGVSNDLIFQLVSEMKAEYFPPREDVILQNEAPTDFYILVTGSAIAGVAKAGDVVGEIGVLCYRPQLFTVRTKSLCQLLRMNRTAFLSLVQSNVADGTIIMNNLMQLLKEQKDNSVMAGVLKEIENMLARGRLDLPVTLCFAVNKGDDFMLHQLLKRGLDPNESDNNGHTALHIAASKGDEQCVKLLLDYGADPNARDSEGKVPLWEALCEKHNAVIELLVESGAELSSGDTALYACIAVEENDAELLENIIRYGGNINSSTKDGTTPLHRAVCDGNVQMVELLLEHGADINKQDNNGWSARDLADQQGHDDIQVLFKSRKAHRQHASNGRVAPMLIGRFNSEPSMPNMNHEDAEVRSKVVPQKLLRKRVSFQNSLFGVISSSQARQDTGGLLSKGLAGTGGPSCHHDSLIRVTISCPEKGNAAGKLVRLPRSMTELLELGAKKFDFKPTKVLTVGGAEIDEVELIRDGDHIVLVSSDWVPDVAQIRPNDQ

SEQ ID NO: 16856 - DNA, 846 bp, Sorghum bicolor
  misc_feature: Ceres ANNOT ID no. 8667785
  misc_feature: Encodes the peptide sequence at SEQ ID NO 16857
atgggtgttctgacattggtccttgtcagcttcgctgcttgtgctgaagctctaaagagagcagacttccctcaaggtcgggtgatagatttcagcaatgcagatgttgttgttgatcactactgtcggtataaggaagatgtggacttgattaaggacattggcatggatgcataccggttctctatctcatgctcacgtatctttacaaatggaactggtgaacctaatgaagaaggattgaattactataacagcctcatagatactctattagacaaaggtatacaactatatgtaacactctttcactgggaccttacgcaagcattagaagacagatatggtggatggttaaactcccaaatcgtggatgatttcatactatgccagtacttgcttcaaaaggaatttggagacagagtgaaacactggatcactttcaatgagccccataattttgcgattgatggctatgaccttggcattgaggcacctgggtgtctcatatattctgtagggagggaaaatcgtcaactgaacctagctcacaacatactcttagcgcatgctggtgcttttcatacttataagcagcatttcaagaaagaacaaggaggtctcattggcattgcacttgattcaaagtggtatgaaccattgtcagatgttgatgaggacacggaggcaggagcacgagcaatggactttgagcttggatggttcctggatcccttaatgtttggccactatcctccttccatgcagaaacatgtgggcttcgaagttattatcaggctcactagattttgtgggcataaaccactataccacattgtatgttag

SEQ ID NO: 16857 - protein, 281 aa, Sorghum bicolor
  misc_feature: Useful for making plants with altered cell wall content and/or composition
  misc_feature: Functional homolog of the protein sequence given in SEQ ID NO 14435
  misc_feature: Useful for making plants with altered carbohydrate content
  misc_feature: Functional homolog of the protein sequence given in SEQ ID NO 14124
  misc_feature: Ceres ANNOT ID no. 8667785
  misc_feature (23)..(259): SWISSPROT Homolog: EC 3.2.1.21 Beta-glucosidase
  misc_feature (19)..(280): Pfam ID: Glyco_hydro_1 Pfam Description: Glycosyl hydrolase family 1
MGVLTLVLVSFAACAEALKRADFPQGRVIDFSNADVVVDHYCRYKEDVDLIKDIGMDAYRFSISCSRIFTNGTGEPNEEGLNYYNSLIDTLLDKGIQLYVTLFHWDLTQALEDRYGGWLNSQIVDDFILCQYLLQKEFGDRVKHWITFNEPHNFAIDGYDLGIEAPGCLIYSVGRENRQLNLAHNILLAHAGAFHTYKQHFKKEQGGLIGIALDSKWYEPLSDVDEDTEAGARAMDFELGWFLDPLMFGHYPPSMQKHVGFEVIIRLTRFCGHKPLYHIVC

SEQ ID NO: 16858 - DNA, 1065 bp, Sorghum bicolor
  misc_feature: Ceres ANNOT ID no. 8667895
  misc_feature: Encodes the peptide sequence at SEQ ID NO 16859
atggggcatgatgaagctgtagttactcagaattcagtaaaagcaccgtcaccacccaaggatcagccagctatttatccatgccttgattggtctactatgcaggcatattatggccaaggggtcttaccaccagcattctttaaccctggaattgcacctggtcatgtccctccaccatatgtgtggtgtccacagaatatgccaccagctgcctttggaaaaccatatgctgcaatatatccacatgctggtggcttcctgcatcccttcatgcccctaatggtaaacccattgagtgcagagccagctaagtctgcgaacagcaaggataatagtttaaataagaaactgaaggaaattgatggaactgctgtttcaagtggtaacagtgaaaaaacaagtggggattacagcctagaaggatccagcgatggaaacaacccaaaggtgagcggaacgccaaagaaaaggagctttgatgataggactacatcaggagaatcaggaagattagcaactttgcccaatgtgcacattccagatgcaacgatgaaaccaagtgtgagcaccggtagtgacttcaaagttagtggtgcgacatcaaccgaatggccagctaaggacgacaaggaatcaaagcgtgaaaggaggaagcagtcaaatagggaatctgcccgacgctcaaggctgaggaagcaggctgagactgaagaactggctagaaaagtagagttactgaccgcagagaacacatcactccgaaacgaaatcagcaagctaacggatagctcccagaaactaaggatggagaatgcggctctgatggagaaactagcgggaggtacatcagaccaagcacaagaagcgtccgcaggccaccagacgacggccaccgcgccaccaccgtcggctcgcgtcgtcaagaacttcctctcgatgatggacgtcgaaggcccatcgagaggtggcggcagccggcgcacggagcacggtgcgcccaggctccgccagctcctgagctcaggaggccctctggcggctgacgccgtggccgcgagctga

SEQ ID NO: 16859 - protein, 354 aa, Sorghum bicolor
  misc_feature: The sequence is a functional homolog of SEQ ID NO 1225 in the 10/412,699 US patent application
  misc_feature: The sequence is a functional homolog of SEQ ID NO 922 in the 10/374,780 US patent application
  misc_feature: Ceres ANNOT ID no. 8667895
  misc_feature (1)..(152): Pfam ID: MFMR Pfam Description: G-box binding protein MFMR
  misc_feature (210)..(273): Pfam ID: bZIP_1 Pfam Description: bZIP transcription factor
MGHDEAVVTQNSVKAPSPPKDQPAIYPCLDWSTMQAYYGQGVLPPAFFNPGIAPGHVPPPYVWCPQNMPPAAFGKPYAAIYPHAGGFLHPFMPLMVNPLSAEPAKSANSKDNSLNKKLKEIDGTAVSSGNSEKTSGDYSLEGSSDGNNPKVSGTPKKRSFDDRTTSGESGRLATLPNVHIPDATMKPSVSTGSDFKVSGATSTEWPAKDDKESKRERRKQSNRESARRSRLRKQAETEELARKVELLTAENTSLRNEISKLTDSSQKLRMENAALMEKLAGGTSDQAQEASAGHQTTATAPPPSARVVKNFLSMMDVEGPSRGGGSRRTEHGAPRLRQLLSSGGPLAADAVAAS

SEQ ID NO: 16860 - DNA, 225 bp, Sorghum bicolor
  misc_feature: Ceres ANNOT ID no. 8667876
  misc_feature: Encodes the peptide sequence at SEQ ID NO 16861
atggcgccgatctccagatccacggcggttgtccttgtgatgatggctgtcgtcgtcgccgtgctcgccgccgcggctaacgcccaggcccccgccccagcacccgctaccagtgacggaacaagtgtagaccagggaatcgcctacgtcctgatgctggtggcgcttgtcctcacctacctcatccacccattggacgcctcctccgcctacaagctcttttaa

SEQ ID NO: 16861 - protein, 74 aa, Sorghum bicolor
  misc_feature: Useful for making plants with altered carbohydrate content
  misc_feature: Functional homolog of the protein sequence given in SEQ ID NO 14436
  misc_feature: Useful for making plants with altered cell wall content and/or composition
  misc_feature: Useful for making plants with modulated nitrogen use efficiency
  misc_feature: Useful for making plants with modulated salt sensitivity
  misc_feature: Functional homolog of the protein sequence given in SEQ ID NO 14437
  misc_feature: Ceres ANNOT ID no. 8667876
MAPISRSTAVVLVMMAVVVAVLAAAANAQAPAPAPATSDGTSVDQGIAYVLMLVALVLTYLIHPLDASSAYKLF

SEQ ID NO: 16862 - DNA, 1665 bp, Sorghum bicolor
  misc_feature: Ceres ANNOT ID no. 8667877
  misc_feature: Encodes the peptide sequence at SEQ ID NO 16863
atggcggcggagggcgggtcgaacctggcggtgctggacgcgctggactcggcgcgcacccagatgtaccacatgaaggccatcgtcatcgccggcatgggcttcttcaccgacgcctacgacctcttctgcatcaccaccgtctccaagctgctcggccgcatctactacccgaatgacaacctgtacctagacaagcccaagcctggcaccctacccgtgtccaccaacaacctggtcaccggcgtcgcgctcgtcggcacgctcatgggccagctcgtcttcggctacttcggcgacaagctggggcggaagcgcgtgtacggcatcacgctcgtgctcatggccgcctgcgccatcggctcgggcctctcgttcggcagcacgcggcacgccgtcatcggcacgctctgcttcttccgcttctggctcggcttcggcatcggcggggactacccgctgtccgcgaccatcatgtccgagtactccaacaagaagacgcggggcgccttcatcgccgccgtgttcgcgatgcagggcgtcggcatcatcttcgcggggctcgtgtccatggtcatctcggggatcctcctgcgctacaacccggcgccgtcgtggacagaggaccacgacagctcgttgggtgaccagttgccggcggcggactacatgtggcgcatcgtgctcatgctcggcgcgttcccggcgctggccaccttctactggcggatgaagatgcccgagacggcgaggtacacggcgctcatcgagggcaacgccaagcaggcggccaacgacatgcagaaggtgatggacgtggagatccagtcggagcaggacaagctcgccaggtacaaggcggccaacgactacccgctgctgtcgagggagttcgcacagcgccacggcctgcacctcatcggcacggccaccacgtggttccttctggacatagccttctacagccagaacctcacccagaaggacatcttcccggcgatcaagctgacgagccccgccggtgacataaacccactcaaggaggtgttcgagatttcaaaggccatgttcctcgtcgcactcctcggcaccttccccggctactgggtcaccgtcgccctcatcgacaaaatgggcaggtacctgatccagctcatcggtttcttcatgatgtccgtgttcatgctattgatgggcatcatgtacgatgatctcaagaacaaatacaccacgctcttcgccctcttctacgcgctcaccttcttcttcgccaacttcgggcccaacagcaccaccttcgtgctgccggccgagctgttcccgacacgcgtgcgctccacctgccacgccatcagcgccgcgtcaggcaaggccggcgccatcgtcgcggccttcggggtgcagagcctcacgctcaagggcgacatcgcgtccatcaagaaggcgctcatcatcctcgccgtcaccaacatgctcggcttcttcttcaccttcctcgtcccggagaccatggggcggtcgctcgaggagatctccggggaggacggcaacgccggaaacggtcccggtgttcccgccggcgcggccatgggcgctgcggacgtgagcaaggatgacaagatacctgtttccagtactgagtggcagagctccatgcaagcgtga

SEQ ID NO: 16863 - protein, 554 aa, Sorghum bicolor
  misc_feature: Useful for making plants with modulated phosphate use efficiency
  misc_feature: Functional homolog of the protein sequence given in SEQ ID NO 14438
  misc_feature: Useful for making plants with modulated carbohydrate content
  misc_feature: Functional homolog of the protein sequence given in SEQ ID NO 13407
  misc_feature: Ceres ANNOT ID no. 8667877
  misc_feature (26)..(515): Pfam ID: Sugar_tr Pfam Description: Sugar (and other) transporter
MAAEGGSNLAVLDALDSARTQMYHMKAIVIAGMGFFTDAYDLFCITTVSKLLGRIYYPNDNLYLDKPKPGTLPVSTNNLVTGVALVGTLMGQLVFGYFGDKLGRKRVYGITLVLMAACAIGSGLSFGSTRHAVIGTLCFFRFWLGFGIGGDYPLSATIMSEYSNKKTRGAFIAAVFAMQGVGIIFAGLVSMVISGILLRYNPAPSWTEDHDSSLGDQLPAADYMWRIVLMLGAFPALATFYWRMKMPETARYTALIEGNAKQAANDMQKVMDVEIQSEQDKLARYKAANDYPLLSREFAQRHGLHLIGTATTWFLLDIAFYSQNLTQKDIFPAIKLTSPAGDINPLKEVFEISKAMFLVALLGTFPGYWVTVALIDKMGRYLIQLIGFFMMSVFMLLMGIMYDDLKNKYTTLFALFYALTFFFANFGPNSTTFVLPAELFPTRVRSTCHAISAASGKAGAIVAAFGVQSLTLKGDIASIKKALIILAVTNMLGFFFTFLVPETMGRSLEEISGEDGNAGNGPGVPAGAAMGAADVSKDDKIPVSSTEWQSSMQA

SEQ ID NO: 16864 - DNA, 387 bp, Sorghum bicolor
  misc_feature: Ceres ANNOT ID no. 8667973
  misc_feature: Encodes the peptide sequence at SEQ ID NO 16865
atgaagacgaggtcgcagacggcgccgaagcctctcaagacggtggcgatggctcccagaccgagcagccccaagcggaagtcgaggcccaagccggcggggaagggcgaccgccgcgcacccaagaagccgcccaccgccttcttctacttcatgtatgttctggaggattttcggaaggtttataagcaagaaaaaccaagtgtaaaatcaatgcaggaaatagggaaggcatgcggcgaaaaatggaatacaatggcatttgaggaaaaggtcaagtattatgatatagctactgagaaacgtgcagaatttgagaaggcgatgattgaatataacaagaaaaagaaaaacggagaaatgtctgaggaatcagattacgactag

SEQ ID NO: 16865 - protein, 128 aa, Sorghum bicolor
  misc_feature: Useful for making plants with altered alkaloid content
  misc_feature: Functional homolog of the protein sequence given in SEQ ID NO 13223
  misc_feature: The sequence is a functional homolog of SEQ ID NO 586 in the 10/666,642 US patent application
  misc_feature: Ceres ANNOT ID no. 8667973
  misc_feature (41)..(113): Pfam ID: HMG_box Pfam Description: HMG (high mobility group) box
MKTRSQTAPKPLKTVAMAPRPSSPKRKSRPKPAGKGDRRAPKKPPTAFFYFMYVLEDFRKVYKQEKPSVKSMQEIGKACGEKWNTMAFEEKVKYYDIATEKRAEFEKAMIEYNKKKKNGEMSEESDYD

SEQ ID NO: 16866 - DNA, 1299 bp, Sorghum bicolor
  misc_feature: Ceres ANNOT ID no. 8667943
  misc_feature: Encodes the peptide sequence at SEQ ID NO 16867
atggggcttcgcggtcgcggagctcttgctctgcttttggtcctgttcgtccacggaggcggccagcaggcagcggaggccgccggcggcgatgcgttcgtgagggtccagggcacccgcttcgtgcacaacggcaagccgttcttcgccaacgggttcaacgcctactggctcatgaccctcggcgccgaccccgcgcagaggggcaaggtcacctcggcgctgagccaggccgccggcgccggcctctccgtggccaggacgtgggcgttcaacgacggcggcggcagcagcggtgcactacagtactctcccggccgctacaacgagaacaccttccaggggttggatttcgtgctagctgaggctaggaagtacgggattaagatgatactgagccttgtgaacaattacgatagctttggagggaggaagcagtacgtgcagtgggcgagggagcaggggcaggccattggatctgacgatgagttcttcactaaccctgttgccaagggcctctacaagaaccatatcaaggccgttctgacgagggtgaacacgatcaccggcgtggcgtacaaggacgacccaacgatcatggcgtgggagctgatgaacgagccgcgctgccagtccgacgtgtccggccacaccatccagtcgtggatcacggagatggcagcgcacgtgaagtccatcgacggcaaccacctgctggaggccgggctggagggcttctacggcgcctcgtcgccgccgtcccgccgcagctccgtgaacccgtcgggttaccaggtgggcaccgacttcatcgccaacaaccaggcgcccggggtcgacttcgccaccgtgcactcgtacccggaccagtggctgcccggcctggacgcgccgtcgcagctgcggttcctgggcgcctggctcgacgcccacatcgccgacgcgcaggccgtgctccggaagccgctgctggtggccgagttcggcaagtcgcgcagggaccccgggtacagcggcgacggccagcgcgacgccgtgttcgccgcggtgtacgccaaggtctacaactcggcgcgcgccggcgggcccgcggcgggcgcgctcttctggcagctcctcacggaggggatggactcgtacggggacggctacgaggtcgtcctccggcaggcgccgtccaccaccggagtcatcacgacgcagagccggaggctgcaggggctcgtcagggcgttcgtgcgcgcgcgtaaggtccagcgcgggaagaccggcaagggcgccaagggcggcggcaactga

SEQ ID NO: 16867 - protein, 432 aa, Sorghum bicolor
  misc_feature: The sequence is a functional homolog of SEQ ID NO 2 in US patent 7148399
  misc_feature: Ceres ANNOT ID no. 8667943
  misc_feature (33)..(419): SWISSPROT Homolog: EC 3.2.1.78 Mannan endo-1,4-beta-mannosidase
  misc_feature (39)..(380): Pfam ID: Cellulase Pfam Description: Cellulase (glycosyl hydrolase family 5)
MGLRGRGALALLLVLFVHGGGQQAAEAAGGDAFVRVQGTRFVHNGKPFFANGFNAYWLMTLGADPAQRGKVTSALSQAAGAGLSVARTWAFNDGGGSSGALQYSPGRYNENTFQGLDFVLAEARKYGIKMILSLVNNYDSFGGRKQYVQWAREQGQAIGSDDEFFTNPVAKGLYKNHIKAVLTRVNTITGVAYKDDPTIMAWELMNEPRCQSDVSGHTIQSWITEMAAHVKSIDGNHLLEAGLEGFYGASSPPSRRSSVNPSGYQVGTDFIANNQAPGVDFATVHSYPDQWLPGLDAPSQLRFLGAWLDAHIADAQAVLRKPLLVAEFGKSRRDPGYSGDGQRDAVFAAVYAKVYNSARAGGPAAGALFWQLLTEGMDSYGDGYEVVLRQAPSTTGVITTQSRRLQGLVRAFVRARKVQRGKTGKGAKGGGN

SEQ ID NO: 16868 - DNA, 1713 bp, Sorghum bicolor
  misc_feature: Ceres ANNOT ID no. 8667959
  misc_feature: Encodes the peptide sequence at SEQ ID NO 16869
atggacttcttcagtgaatacggtgatgctaacagatacaaaatccaagaggtcattggcaaaggaagttatggcgttgtttgctcagctattgaccaacataccggtgacaaggtggcaatcaagaaaatacacaatatcttcgagcacttatctgatgctgcccggatccttcgtgagatcaaactacttcggctattacgccatcctgatatagttgagatcaagcatataatgctgcctccatcaaggagggacttcaaagatatctatgttgtatttgagctgatggatacagacctccaccaagtcatcaaggcaaatgatgatttaaccagagagcatcatcagttctttctctatcagatgctccgtgcactgaaatacattcatactgctaatgtttatcatcgtgatttgaagccaaagaacatattggccaatgctaactgtaaacttaaaatatgtgattttggattggcaagagtggcgttcaatgacactcctacaacagtattctggacggattatgttgctacaagatggtatagggcccctgaactgtgtggatctttcttttctaagtattcaccagctattgacatatggagtatcggttgcatttttgcggagatcttaactgggaagcctttgtttcctggaaaaaatgtggtccaccagttggatttgatgaccgatctcttgggtactccatcacttgatacagtttccagaattcggaatgagaaggcaaggaggtatttgagtagcatgaggaaaaaacatccagtaccattttctgaaaggttccctaaagcagatcctgctgcactcaaacttttgcagaggcttttggcatttgatcccaaggataggccaactgctgaagaggcattggctgatccatattttaaaggcctcgcaaaagtagagagagaaccatcatgccagccaataacaaaaatggagtttgagtttgagcgaagaaaggtgaccaaagaggatgtcaaggaacttatattcagggagatattggagtatcatcctcaacttctcaaggattacatgaatggaactgagaaaacaaactttctataccctagtgctgttgacaatttccgaaggcaatttgctaacttggaggaaaatggaggaaagagtggggcacacacggcttcatcagacaggaagcatgtttcgctcccaaggacaaccacagttcattctaatccaatccctccaaatggaatctcccaagttcctcaaaagattcccacagctagaccaggaagagtggttggtccagtaataccatttgagaatgcaactgctgttgatccatacagccaacgtagggtggcgaggaatccagtacttcctccaaccaccacaaacctgtcagcatacgcctatcaccggaagtcagacaactcaaacagagagctccaacaggagctggaaaaggaccgtatgcagtaccagccagcacagcggttcatggatgccaaggtagtatcacagatgtcccctgacttgaggtcttcctactatataccaaaaggtgtcccgaaagctgatggcgcagatagagctgctttgcattctagcatgattcatggaatcgccccttttagtggcattgctgctgtaggaggtggaggtggctacaacaaggtcaatgcagttcaatatggagtttctaggatgtactag

SEQ ID NO: 16869 - protein, 570 aa, Sorghum bicolor
  misc_feature: Useful for making plants with altered cell wall content and/or composition
  misc_feature: Functional homolog of the protein sequence given in SEQ ID NO 14430
  misc_feature: Ceres ANNOT ID no. 8667959
  misc_feature (1)..(570): SWISSPROT Homolog: EC 2.7.11.24 Mitogen-activated protein kinase
  misc_feature (13)..(304): Pfam ID: Pkinase Pfam Description: Protein kinase domain
MDFFSEYGDANRYKIQEVIGKGSYGVVCSAIDQHTGDKVAIKKIHNIFEHLSDAARILREIKLLRLLRHPDIVEIKHIMLPPSRRDFKDIYVVFELMDTDLHQVIKANDDLTREHHQFFLYQMLRALKYIHTANVYHRDLKPKNILANANCKLKICDFGLARVAFNDTPTTVFWTDYVATRWYRAPELCGSFFSKYSPAIDIWSIGCIFAEILTGKPLFPGKNVVHQLDLMTDLLGTPSLDTVSRIRNEKARRYLSSMRKKHPVPFSERFPKADPAALKLLQRLLAFDPKDRPTAEEALADPYFKGLAKVEREPSCQPITKMEFEFERRKVTKEDVKELIFREILEYHPQLLKDYMNGTEKTNFLYPSAVDNFRRQFANLEENGGKSGAHTASSDRKHVSLPRTTTVHSNPIPPNGISQVPQKIPTARPGRVVGPVIPFENATAVDPYSQRRVARNPVLPPTTTNLSAYAYHRKSDNSNRELQQELEKDRMQYQPAQRFMDAKVVSQMSPDLRSSYYIPKGVPKADGADRAALHSSMIHGIAPFSGIAAVGGGGGYNKVNAVQYGVSRMY

SEQ ID NO: 16870 - DNA, 1113 bp, Sorghum bicolor
  misc_feature: Ceres ANNOT ID no. 8667983
  misc_feature: Encodes the peptide sequence at SEQ ID NO 16871
atggattcctctagaggcgccatccgcttcctcgtccaccgccgcgtgctgctcctgctgctgctcgtcgcgtcgtcgtccctcgtcggcacgtcgcgtggcagggaggcgcagccgctgcccgtggcggcggcggccacggtcctcggcagcaggcgcgcgccggagcggcacgggctggcgctggacttctacgccaagacgtgccccgcggtcgaccagatcgtcggcaacgtcaccgccgccaggtacagggacttccccgccgccggacccgccgtgctccgcctcttccaccacgactgcttcgtcgaagggtgtgacgcgtccgttttgatcgcgccgacggccgacgcggccgcgcgctcgccgcccagggtggagcgcgacgtggaggagaacaggaacctgccgcaggaggcgttcgacacggtggagcttgccaaggccgccgtggagagcaagtgccccggcatcgtctcctgcgccgacgtcctcgccctcgccgcccgagactacgtccagctggcaggtgggccgtattacgcggtgaagaagggccgtaaggacagcaaggtgtccctggcggggaaagtccggggcagcctcccgcgggccaactcgacggtggacgagctcctccgcgtgttcgcgggcaagggcctgggcgcggcggacctggtggcgctgtccggcgcgcacaccgtcggcttcgcgcactgcgtccacgtgctgggccgcatctacgacttccggggcacgcggcggccggacccgctgatggacggccgcctcgtgaaggcgctccggatgtcttgcccgtcgtcgggcggcagcgcccgcgtcgtggtgcccttcgacgtgagcacgccgttccagttcgaccacgcctactacggcaacctgcaggcgaggctcggcctgctggcttccgaccaggcgctgttcctggacgcgcggaccaggccgctcgtgcaggacctcgccggcaacaagacccgcttcttccaggcgttcgtggccagcatcgacaggatgggctccatccggatcaagaagggcaggaaaggggaggtcaggaaagtctgcagccagcacctgttgtcagcctga

SEQ ID NO: 16871 - protein, 370 aa, Sorghum bicolor
  misc_feature: Useful for making plants with altered carbohydrate content
  misc_feature: Functional homolog of the protein sequence given in SEQ ID NO 14439
  misc_feature: Useful for making plants with altered cell wall content and/or composition
  misc_feature: Functional homolog of the protein sequence given in SEQ ID NO 14440
  misc_feature: Ceres ANNOT ID no. 8667983
  misc_feature (54)..(363): SWISSPROT Homolog: EC 1.11.1.7 Peroxidase
  misc_feature (76)..(331): Pfam ID: peroxidase Pfam Description: Peroxidase
MDSSRGAIRFLVHRRVLLLLLLVASSSLVGTSRGREAQPLPVAAAATVLGSRRAPERHGLALDFYAKTCPAVDQIVGNVTAARYRDFPAAGPAVLRLFHHDCFVEGCDASVLIAPTADAAARSPPRVERDVEENRNLPQEAFDTVELAKAAVESKCPGIVSCADVLALAARDYVQLAGGPYYAVKKGRKDSKVSLAGKVRGSLPRANSTVDELLRVFAGKGLGAADLVALSGAHTVGFAHCVHVLGRIYDFRGTRRPDPLMDGRLVKALRMSCPSSGGSARVVVPFDVSTPFQFDHAYYGNLQARLGLLASDQALFLDARTRPLVQDLAGNKTRFFQAFVASIDRMGSIRIKKGRKGEVRKVCSQHLLSA

SEQ ID NO: 16872 - DNA, 1233 bp, Sorghum bicolor
  misc_feature: Ceres ANNOT ID no. 8667964
  misc_feature: Encodes the peptide sequence at SEQ ID NO 16873
atgtcgtcgggagacttccacttccacgacgagctggcgtcgctgttcgcgcagcggccggcggcgccgggagagatgatgatggcgcagcagcagcagcagcagcagcaggcgccggcgtcgtggttcgcggactacctgcacggcgcgggcgtcccagggatgggcgggatggactacgacctgctgtgccgcgcgctggacctgccgctgccgggggacgacgtcgtcaagagggagctgctggtggtggacacaggcgggggagggggaggcttaggcttcgccgcgcccacgcccagcgggggcggcacggcgccggtcacgcccaacacgacgtcgtccatgtcctcctcgtctagcgaggcggcgggtggcggcgccgccggaggaggaggaggaggaagctttggtggtgccggggaggaggactcgccgcatcaggggaggtgcaagaaggaggaaggggatggggaggagagcaaggcgctcgacaagggggaggaggacgctgacaagggcaagaaagggtcaccggcggcggcgaagggcaagggcaagggcgagaagcggcagcggcagccgcgcttcgccttcatgaccaagagcgaggtcgaccacctcgaggacggctaccggtggcgcaagtacggccagaaggccgtcaagaacagcccataccccaggagctactaccggtgcacgacgcagaagtgccccgtgaagaagcgggtggagcggtcgtaccaggacccggcggtggtgatcaccacgtacgagggcaagcacacgcacccgatcccggccacgctccgcggcagcacccacctcctcgccgcgcagttgcacggcggtcaccaccaccaccaccacctcggcggcgccttcccgccgccggccccgctcccgcagcagatggcgggcgcgccgttcgggcgggcaggcggcggaggcggaggcgtcatcgacatgctggggctcctgcccccgcgcaacaacaaccacgccgccatgccgccggcgataggcctcgcgtcgtcccgcggcatgagcggcggcggtccgatgagcaccgtggcaggcgcgacggcagcgacggccgccgccaccactacctcgtcgtcgtctcctccctcgctccagatgcagcacttcatggcgcaggacttcgggctcctgcaggacatgctgccgtccttcgtccacggcaatggcggcaacgtccagccctga

SEQ ID NO: 16873 - protein, 410 aa, Sorghum bicolor
  misc_feature: The sequence is a functional homolog of SEQ ID NO 86 in the 10/412,699 US patent application
  misc_feature: The sequence is a functional homolog of SEQ ID NO 114 in the 11/375,241 US patent application
  misc_feature: The sequence is a functional homolog of SEQ ID NO 146 in the 10/286,264 US patent application
  misc_feature: The sequence is a functional homolog of SEQ ID NO 2500 in the 10/374,780 US patent application
  misc_feature: The sequence is a functional homolog of SEQ ID NO 672 in the 10/412,699 US patent application
  misc_feature: Ceres ANNOT ID no. 8667964
  misc_feature (208)..(267): Pfam ID: WRKY Pfam Description: WRKY DNA -binding domain
MSSGDFHFHDELASLFAQRPAAPGEMMMAQQQQQQQQAPASWFADYLHGAGVPGMGGMDYDLLCRALDLPLPGDDVVKRELLVVDTGGGGGGLGFAAPTPSGGGTAPVTPNTTSSMSSSSSEAAGGGAAGGGGGGSFGGAGEEDSPHQGRCKKEEGDGEESKALDKGEEDADKGKKGSPAAAKGKGKGEKRQRQPRFAFMTKSEVDHLEDGYRWRKYGQKAVKNSPYPRSYYRCTTQKCPVKKRVERSYQDPAVVITTYEGKHTHPIPATLRGSTHLLAAQLHGGHHHHHHLGGAFPPPAPLPQQMAGAPFGRAGGGGGGVIDMLGLLPPRNNNHAAMPPAIGLASSRGMSGGGPMSTVAGATAATAAATTTSSSSPPSLQMQHFMAQDFGLLQDMLPSFVHGNGGNVQP

SEQ ID NO: 16874 - DNA, 984 bp, Sorghum bicolor
  misc_feature: Ceres ANNOT ID no. 8668000
  misc_feature: Encodes the peptide sequence at SEQ ID NO 16875
atgacatggtgcaacagcttcaacgacgtgcgtgccgtggagaacaacctggccaccgccgcggccgtggccgccgccaagaaacagcagcaggcctcctcccacgtcaacctcatcaggacctgcccctcctgcggccaccgcgcgcagtatgaacaggcggcggcgacgatccaggacctgccggggctgccggccggcgtgaagttcgatccgacggaccaggagctgctggagcacctggaagggaaggcgaggccggacgcccggaagctgcacccgctcatcgacgagttcatccccaccatcgagggcgagaacggcatctgctacacgcatccggagaggcttcctggtgtcggcaaggacggcctcatccggcacttcttccaccgcccgtccaaggcttacacgaccgggacgcggaagcggcggaaggtccacaccgacgagcagggcggcgagacgcggtggcacaagacgggcaagacccgtcccgtgttcaccaacggcaaactcaagggctacaagaagatcctggtgctctacaccaactacgggaagcagcggaagcccgagaagacgaactgggtgatgcaccagtaccacctcggctccgacgaggaggagaaggacggcgagctcgtcgtctccaaggtgttctaccagacgcagccgaggcagtgcggcagcggttcggcgacggccaaggacgtcgtcccgctcgctgccggcctagcgacgactgatcaccaccaccaccaccaccaccaccaccatgatgatgatgatggtggcaatggcggtagtaacaacagcatgctgaaggaggcaggcatcgtagatttctacagcccagcggcgctaatcggctacaaccaggcagtggctcctaccaacagggcggcggcggctgcttctgctcacctgatgcctaactttgaggtgcacactacagcggggacggctggctttggtccctga

SEQ ID NO: 16875 - protein, 327 aa, Sorghum bicolor
  misc_feature: Useful for making plants with altered carbohydrate content
  misc_feature: Functional homolog of the protein sequence given in SEQ ID NO 14394
  misc_feature: The sequence is a functional homolog of SEQ ID NO 210 in the 10/666,642 US patent application
  misc_feature: The sequence is a functional homolog of SEQ ID NO 562 in the 11/435,388 US patent application
  misc_feature: The sequence is a functional homolog of SEQ ID NO 542 in the 10/666,642 US patent application
  misc_feature: The sequence is a functional homolog of SEQ ID NO 1710 in the 10/374,780 US patent application
  misc_feature: The sequence is a functional homolog of SEQ ID NO 318 in the 10/374,780 US patent application
  misc_feature: The sequence is a functional homolog of SEQ ID NO 848 in the 10/225,066 US patent application
  misc_feature: The sequence is a functional homolog of SEQ ID NO 1713 in the 10/374,780 US patent application
  misc_feature: Ceres ANNOT ID no. 8668000
  misc_feature (64)..(205): Pfam ID: NAM Pfam Description: No apical meristem (NAM) protein
MTWCNSFNDVRAVENNLATAAAVAAAKKQQQASSHVNLIRTCPSCGHRAQYEQAAATIQDLPGLPAGVKFDPTDQELLEHLEGKARPDARKLHPLIDEFIPTIEGENGICYTHPERLPGVGKDGLIRHFFHRPSKAYTTGTRKRRKVHTDEQGGETRWHKTGKTRPVFTNGKLKGYKKILVLYTNYGKQRKPEKTNWVMHQYHLGSDEEEKDGELVVSKVFYQTQPRQCGSGSATAKDVVPLAAGLATTDHHHHHHHHHHDDDDGGNGGSNNSMLKEAGIVDFYSPAALIGYNQAVAPTNRAAAAASAHLMPNFEVHTTAGTAGFGP

SEQ ID NO: 16876 - DNA, 2076 bp, Sorghum bicolor
  misc_feature: Ceres ANNOT ID no. 8667998
  misc_feature: Encodes the peptide sequence at SEQ ID NO 16877
atggcgggcattgacctcaacaccgtggaggaggaggacgaggaggaggcggaggcggaggcgccgcctgtggccgccagggccggtggtggcgccgtgtgtctggagctgtggcacgcgtgcgcgggccccgtcgcgccgctgccgcgcaagggcagcgccgtcgtgtacctgccgcagggccacctcgagcacatcggcggcgacgctgacgcggcgggagcagcggtgccgccacacgtgctctgccgcgtcgtcgacgtcaccctccacgcggacggcgccaccgacgaggtgtacgcgcgggtgtcgctgctgcccgaggacgaggaggcggagaggcgggcgcgggcgcgggttcgggaggacgaggacgcggatcgcgacggcgaggacggggccgccatgaagccgctcgcacggacgccgcacatgttctgcaagacgctcacggcctctgacaccagcacgcacggcggcttctccgtgccgcgccgcgccgccgaggactgcttcccgccgctggactacagccagcagaggccgtctcaggagctcgtggccaaggatctacacggcacggagtggaagttccgacatatctaccgaggccagccacgaaggcatctcttaaccactggatggagtgcatttgttaataagaagaagcttgtttctggcgatgcagttctgttccttcgaggtgaagatggagtgcttcgactgggagtgcgccgagcagcccagctaaaaattgtaactcctattcctgcactgcataaccagtgctcaagccagaccactctgggaaatgttgcacaagctgtggccacgaggactgttttccacatttactacaatcccaggttaagtcaatctgaattcattgtaccctattggaagttcaccagaagcttgaatcaaccaatttctgttggaatgagatgcagaatgcgatatgaaagtgacgatgcttctgaaagaaggtgcactgggataataattggaagcagagaagctgagcctatttggtatggttcaaaatggaaatgcttggtggttagatgggatgatggtatagagtgccattggcccaatagggtatctccttgggagattgaggtcacaggatcagtttcaggatctcatatgtgcgctcccaattcaaaacgtctgaaaccatgcctccctcaagttaatccggagattgtgcttccaaatggaagcgtttcttcagattttgcgggatctgtcagattccacaaggtcttgcaaggtcaagaattgttgggtttgaaaacccatgacggtactgctatttctgcttttcaggcaactgaagcaagtaatttgcagtacagtgatgaacgtagtaacatgagtaacaatatcttagggatcccaaggctcggtgttagatctccaaatggaatccctggatttccctaccattgctcaggctttggggaatctcaaagattccaaaaggtcttgcaaggtcaagaagtgtttcgtcctttccgaggaggatgtttggctgatggccatataagaactgctggcatgtatcaacctaaatggcctgcaccacaagggtgtgattttccacagccagcaaaaccggtacttgtgttgcaagcatcctccccatcatctgtgctgatgtttccacaaactggttctaagataactccattggaatatgagtacagctgcctggataaggatgaggatggtagatttgataggactgtccctactcaagatatgggaagaaacaatcaaacattatctctttggcctcatcttgtttccggcgaagcaatagaagaatgtactggaactgagaatatgcactcttctgtcagtggtgcagagcatgaatcaaacaatgagagtacagttgaaaatggctgcaaaatctttggtatctcattggctgaaaagatccgatcatgtgatgaagcagactcttgtagtgcaaaacgtaattctgggctccagccttcgaggtcacaaatactaggcagctgttgggccacttttgcctgtaattttcaagaccgaatcttttga

SEQ ID NO: 16877 - protein, 691 aa, Sorghum bicolor
  misc_feature: The sequence is a functional homolog of SEQ ID NO 696 in the 11/479,226 US patent application
  misc_feature: Ceres ANNOT ID no. 8667998
  misc_feature: Down-regulated in shoot tissues in response to salicylic acid treatment
  misc_feature (272)..(353): Pfam ID: Auxin_resp Pfam Description: Auxin response factor
  misc_feature (145)..(250): Pfam ID: B3 Pfam Description: B3 DNA binding domain
MAGIDLNTVEEEDEEEAEAEAPPVAARAGGGAVCLELWHACAGPVAPLPRKGSAVVYLPQGHLEHIGGDADAAGAAVPPHVLCRVVDVTLHADGATDEVYARVSLLPEDEEAERRARARVREDEDADRDGEDGAAMKPLARTPHMFCKTLTASDTSTHGGFSVPRRAAEDCFPPLDYSQQRPSQELVAKDLHGTEWKFRHIYRGQPRRHLLTTGWSAFVNKKKLVSGDAVLFLRGEDGVLRLGVRRAAQLKIVTPIPALHNQCSSQTTLGNVAQAVATRTVFHIYYNPRLSQSEFIVPYWKFTRSLNQPISVGMRCRMRYESDDASERRCTGIIIGSREAEPIWYGSKWKCLVVRWDDGIECHWPNRVSPWEIEVTGSVSGSHMCAPNSKRLKPCLPQVNPEIVLPNGSVSSDFAGSVRFHKVLQGQELLGLKTHDGTAISAFQATEASNLQYSDERSNMSNNILGIPRLGVRSPNGIPGFPYHCSGFGESQRFQKVLQGQEVFRPFRGGCLADGHIRTAGMYQPKWPAPQGCDFPQPAKPVLVLQASSPSSVLMFPQTGSKITPLEYEYSCLDKDEDGRFDRTVPTQDMGRNNQTLSLWPHLVSGEAIEECTGTENMHSSVSGAEHESNNESTVENGCKIFGISLAEKIRSCDEADSCSAKRNSGLQPSRSQILGSCWATFACNFQDRIF

SEQ ID NO: 16878 - DNA, 747 bp, Sorghum bicolor
  misc_feature: Ceres ANNOT ID no. 8667991
  misc_feature: Down-regulated in shoot tissues in response to salicylic acid treatment
  misc_feature: Encodes the peptide sequence at SEQ ID NO 16879
atggcgaggcgcatcgccgtggcggcggccgcgttcctagcgctgtcggccgtggttccggcggcgctggcgcaggctccaggccccgcggcgacgccgagcgggccgccgaacgtgacggcggtcctggagaaaggcgggcagtacacgatgttcatgcggctgatgaaggagacgcagcaggacacgcagctcaacagccagctcaacagctcgttcgccagcaacggcggcgggtacacggtgttcgcgcccaccgacaacgccttcaacagcctcaagcccgggacgctcaactcgctgacgcagcagcagcaggtggcgctggtgcagggccacgtcctgccccagttctacagcatggactcgttccagaccgccagcaaccccgtccgcacccaggcctccggccgcgacgggccctacacgctcaacgtcacctccaccaccaacaaccagctcaacgtctccacgggcgtcgtcgaggtcaccgtcaacaacgcgctcagcgccgtcaagccgctcgccgtctactccgtcgacaaggtgctcctgcccttggagctgttcggggccaaggcgccagccgccgcgcctaccgcgtccaagcccaagaagggtgggtccgacgatgccgcctctggccccgcagggtctgacgacgccgcgcccacgggcgccgccagcgccagggccgtcggctggagcgtcgctggcctcgccgcccttcttggctacctgttgtga

SEQ ID NO: 16879 - protein, 248 aa, Sorghum bicolor
  misc_feature: Useful for making plants with altered carbohydrate content
  misc_feature: Functional homolog of the protein sequence given in SEQ ID NO 14441
  misc_feature: Useful for making plants with altered cell wall content and/or composition
  misc_feature: Functional homolog of the protein sequence given in SEQ ID NO 13937
  misc_feature: Ceres ANNOT ID no. 8667991
  misc_feature (48)..(186): Pfam ID: Fasciclin Pfam Description: Fasciclin domain
MARRIAVAAAAFLALSAVVPAALAQAPGPAATPSGPPNVTAVLEKGGQYTMFMRLMKETQQDTQLNSQLNSSFASNGGGYTVFAPTDNAFNSLKPGTLNSLTQQQQVALVQGHVLPQFYSMDSFQTASNPVRTQASGRDGPYTLNVTSTTNNQLNVSTGVVEVTVNNALSAVKPLAVYSVDKVLLPLELFGAKAPAAAPTASKPKKGGSDDAASGPAGSDDAAPTGAASARAVGWSVAGLAALLGYLL

SEQ ID NO: 16880 - DNA, 1527 bp, Sorghum bicolor
  misc_feature: Ceres ANNOT ID no. 8668077
  misc_feature: Encodes the peptide sequence at SEQ ID NO 16881
atggcggaagtggaggcgccgctcatcgccgaggtggagggggaggagggccttggtggcttccgcgggggctccgcgtccgccggagggggccgctctggcctcggcaacggcgtgcgcggcgcgaggcagtaccaccgccgctcggacgcgctcgcctacggcgaccggtaccagaaggcggcagcgctcgtcgacctcgtcgaagatggtgttggtatccctgaggatgtcttgaatgacacaaggtttgagagggccatgcggttttatttcgtgtatctccgattggattggctctggtcacttaacctatttgctttgattctattgaatttcctagagaagcctctctggtgccaaaaatacgccacacatacttgtgaccaaagggatctttactttcttgggcagctgccatacttaagcaaaacagaatcactcatatatgaggtgcttacccttgtcattcttgtcttggatatcttctacccactttcctatgaaggtttaaatatattctggaagaactccatgaacaaattgaaggttcttcttctcttcatcttagcatgcgacatacttgtgtttatgcttaatcctggacctttcagagtagctccgtacattcgtgttgtatttctaattatgacgatcagggaactgcgaatgtgtgctgttacgctggttggtattgttgggacataccttaatgttttggctctgtcactgttgttcctattatttgcaagctggctagcctatgtaacatttgaggacacgccacaaggaaagatcattttcacatcatacggtacaacgttatatcagatgtttgtcctgttcaccacatccaataatcctgatgtatgggtccctgcttacaagagctctcgttggaacgccctctttattgttatttatgtgctgttaggagtttacttcctaacaaatttaattcttgctgtcatttatgatagctttaaagagcagcttgcaaaacaagttgctcaaatggactctataaggaaaagtattctacagaaggcatttgatctcatcgacactaatggtcagggctaccttaacaaggaacaatgcatatcattacttgatgagctaaataagtacaggtcgttgcccaaaacctcaaaggaagattttgaactaatctttgccgagcttgatcggagtggtgatttcaaggttacctccgaggaatttgctgacctgtgcaatactattgcaataaaattccagaaagaaccaccaccttcatatctggagaagtacccatctttctaccattcaccacagtgtgaaaagttgaagtcctttgtacggagtcgcctgtttgagtatattgttgtctttgttcttctggtgaacctaattgctgtcattattgaaacaacggtacagtggtgcagcattatttcctttttccacatttcatatttgtctcaatttcaaatgaacagtcatattttcttaatgtttacttggctggataaaatgacaatttga

SEQ ID NO: 16881 - protein, 508 aa, Sorghum bicolor
  misc_feature: Useful for making plants with modulated drought sensitivity
  misc_feature: Functional homolog of the protein sequence given in SEQ ID NO 13367
  misc_feature: Ceres ANNOT ID no. 8668077
  misc_feature (150)..(324): Pfam ID: Ion_trans Pfam Description: Ion transport protein
MAEVEAPLIAEVEGEEGLGGFRGGSASAGGGRSGLGNGVRGARQYHRRSDALAYGDRYQKAAALVDLVEDGVGIPEDVLNDTRFERAMRFYFVYLRLDWLWSLNLFALILLNFLEKPLWCQKYATHTCDQRDLYFLGQLPYLSKTESLIYEVLTLVILVLDIFYPLSYEGLNIFWKNSMNKLKVLLLFILACDILVFMLNPGPFRVAPYIRVVFLIMTIRELRMCAVTLVGIVGTYLNVLALSLLFLLFASWLAYVTFEDTPQGKIIFTSYGTTLYQMFVLFTTSNNPDVWVPAYKSSRWNALFIVIYVLLGVYFLTNLILAVIYDSFKEQLAKQVAQMDSIRKSILQKAFDLIDTNGQGYLNKEQCISLLDELNKYRSLPKTSKEDFELIFAELDRSGDFKVTSEEFADLCNTIAIKFQKEPPPSYLEKYPSFYHSPQCEKLKSFVRSRLFEYIVVFVLLVNLIAVIIETTVQWCSIISFFHISYLSQFQMNSHIFLMFTWLDKMTI

SEQ ID NO: 16882 - DNA, 1116 bp, Sorghum bicolor
  misc_feature: Ceres ANNOT ID no. 8668193
  misc_feature: Encodes the peptide sequence at SEQ ID NO 16883
atgcccaacaagctttcgctctccgcttacctgctctgggccatgtccgtgctcgccgcggcggcctcagacgatgtcagaatcgccgtgtactggggccaggacgccagagagggctcgctcagggacgcatgcagcaccggcctctacgcgtacgttaacatcggcttcctctccacgttcggcgacggccgtgccccgatcctcgacctcgctgaccactgcgacccgccgtcgggtggctgcgcgtacctcgccaccgacatcgcctcctgccagtccacaggcatcaaggtgctcctcagcatcggcggcggcacgctcggcggctacaacctgtcctcgccgtcagacgcgcagggcgtggccgcgtacatctgggacaactttctcggtggcaccagcaccggcaccggcaccggcaccggcgcaccccgcccgctcggcgatgcggtgctcgacggcgtcgacttcgacatcgaggccccgtcccggtactacgacgacctcgcgcggaacctggcgtcgctgtacaggggcgacgcgcggggcaggacgtacatgctcaccgcggcgccgcagtgcccgttcccggacgcgtccctggcggtggcgctcggcacggggctgttcgaccacgtgtgggtgcagttctacaacaacccgccgtgccagtacgcccatggggacgccggtgcgctgcggagcgcgtggcagcagtggacgacgagcctgccgtccgcgaccgtgttcctgggcctgccggcgtcgccggagccggacgctgcggacggcgggttcgtggacgcggacacgctcgcctcgcaggtgctgccggcggtggaaggcgcgcccaactacggcggcatcatgctgtggagccgctcctacgacaaggacactggatttagcgtgaagctgcagggcatcttgcaaaaccggaactcagataagaaaaggagaatctatataatagtaggagcagctgtcgctggcgttttgctgctgttcctgcttatttgcgcctgtttcctctgccacaagaagtaccgtggcacgccacctcctgagggatcagaggcccctccagctccaaagatagagccacctcagtag

SEQ ID NO: 16883 - protein, 371 aa, Sorghum bicolor
  misc_feature: Useful for making plants with altered carbohydrate content
  misc_feature: Functional homolog of the protein sequence given in SEQ ID NO 14442
  misc_feature: Ceres ANNOT ID no. 8668193
  misc_feature (8)..(308): SWISSPROT Homolog: EC 3.2.1.14 Chitinase
  misc_feature (26)..(298): Pfam ID: Glyco_hydro_18 Pfam Description: Glycosyl hydrolases family 18
MPNKLSLSAYLLWAMSVLAAAASDDVRIAVYWGQDAREGSLRDACSTGLYAYVNIGFLSTFGDGRAPILDLADHCDPPSGGCAYLATDIASCQSTGIKVLLSIGGGTLGGYNLSSPSDAQGVAAYIWDNFLGGTSTGTGTGTGAPRPLGDAVLDGVDFDIEAPSRYYDDLARNLASLYRGDARGRTYMLTAAPQCPFPDASLAVALGTGLFDHVWVQFYNNPPCQYAHGDAGALRSAWQQWTTSLPSATVFLGLPASPEPDAADGGFVDADTLASQVLPAVEGAPNYGGIMLWSRSYDKDTGFSVKLQGILQNRNSDKKRRIYIIVGAAVAGVLLLFLLICACFLCHKKYRGTPPPEGSEAPPAPKIEPPQ

SEQ ID NO: 16884 - DNA, 1242 bp, Sorghum bicolor
  misc_feature: Ceres ANNOT ID no. 8668211
  misc_feature: Encodes the peptide sequence at SEQ ID NO 16885
atggacagcgccagcagcctcgtggacgacaccagcagcggcagcggaggcggtggcggcgcgtccacggacaagctaagggctttggccgtcgccgccgccgcctcgggcccgccgctggagcgcatgggcagcggcgccagcgcggtccttgacgcggccgagccgggcgccgaggcggactctgctgctgccgccgccccgggcgcggtgggcgtgggcgggaagctgccgtcgtccaggtacaagggcgtggtgccccagcccaacgggcggtggggcgcgcagatctacgagcgccaccaacgcgtgtggctcggcacgttcgcgggcgaggccgacgccgcgcgcgcctacgacgtcgccgcgcagcggttccgcggccgcgacgccgtcaccaacttccgcccgctcgcggacgccgacccggacgccgccgccgagctccggttcctcgcgtcacgctccaaggccgaggtcgtcgacatgctccgcaagcacacctacttcgacgagctcgcgcagaacaagcgcgccttcgccgccgccgccgccgccgccgcctcgtccgcggccaccaccaccgcctcgtcactagccaacaacaacaacaaccattcctccctcgcgtcgccctcccccgcgacggctcgggagcacctcttcgacaagacggtgaccccgagcgacgtgggcaagctgaaccggctggtgatcccgaagcagcacgccgagaagcacttcccgctgcagctcccgtccgccggcggcgagagcaagggcgtgctcctcaacctggaggacgccgcgggcaaggtgtggcggttccgctactcctactggaacagcagccagagctacgtgctcaccaagggctggagccgcttcgtcaaggagaagggcctccaggccggcgacgtcgtcggcttctaccgctcgtccgcggtcggcgccggcgccgacaccaagctcttcatcgactgcaagctgcgtcccaacagcgtcgccaccgcctcgacgacgacaggccccgccgtggggtcatcgcctccggctccggctccggcgccggtggcgacgaaggccgtgcgtctcttcggcgtcgacctgctgacggcgccggccgccaccgccgcggcgccagcggaggccatggccgccgggtgcaagagagcccgggacttggcctcgcccccgcaggcggcgttcaagaagcagctcgtggagctggcactagtgtag

SEQ ID NO: 16885 - protein, 413 aa, Sorghum bicolor
  misc_feature: The sequence is a functional homolog of SEQ ID NO 1186 in the 10/374,780 US patent application
  misc_feature: The sequence is a functional homolog of SEQ ID NO 38 in the 10/838,616 US patent application
  misc_feature: The sequence is a functional homolog of SEQ ID NO 740 in the 11/435,388 US patent application
  misc_feature: The sequence is a functional homolog of SEQ ID NO 1178 in the 10/374,780 US patent application
  misc_feature: The sequence is a functional homolog of SEQ ID NO 1374 in the 10/412,699 US patent application
  misc_feature: The sequence is a functional homolog of SEQ ID NO 53 in the 10/838,616 US patent application
  misc_feature: The sequence is a functional homolog of SEQ ID NO 36 in the 10/838,616 US patent application
  misc_feature: The sequence is a functional homolog of SEQ ID NO 738 in the 11/435,388 US patent application
  misc_feature: The sequence is a functional homolog of SEQ ID NO 1179 in the 10/374,780 US patent application
  misc_feature: The sequence is a functional homolog of SEQ ID NO 34 in the 10/838,616 US patent application
  misc_feature: The sequence is a functional homolog of SEQ ID NO 52 in the 10/838,616 US patent application
  misc_feature: The sequence is a functional homolog of SEQ ID NO 736 in the 11/435,388 US patent application
  misc_feature: The sequence is a functional homolog of SEQ ID NO 48 in the 10/838,616 US patent application
  misc_feature: The sequence is a functional homolog of SEQ ID NO 50 in the 10/838,616 US patent application
  misc_feature: Useful for making plants with modulated water use efficiency
  misc_feature: Functional homolog of the protein sequence given in SEQ ID NO 14443
  misc_feature: The sequence is a functional homolog of SEQ ID NO 1182 in the 10/374,780 US patent application
  misc_feature: The sequence is a functional homolog of SEQ ID NO 18 in the 10/838,616 US patent application
  misc_feature: The sequence is a functional homolog of SEQ ID NO 754 in the 11/435,388 US patent application
  misc_feature: Useful for making plants with altered alkaloid content
  misc_feature: Useful for making plants with altered lignin content
  misc_feature: Functional homolog of the protein sequence given in SEQ ID NO 13939
  misc_feature: The sequence is a functional homolog of SEQ ID NO 26 in the 10/838,616 US patent application
  misc_feature: The sequence is a functional homolog of SEQ ID NO 760 in the 11/435,388 US patent application
  misc_feature: The sequence is a functional homolog of SEQ ID NO 1184 in the 10/374,780 US patent application
  misc_feature: The sequence is a functional homolog of SEQ ID NO 24 in the 10/838,616 US patent application
  misc_feature: The sequence is a functional homolog of SEQ ID NO 758 in the 11/435,388 US patent application
  misc_feature: The sequence is a functional homolog of SEQ ID NO 42 in the 10/838,616 US patent application
  misc_feature: The sequence is a functional homolog of SEQ ID NO 1185 in the 10/374,780 US patent application
  misc_feature: The sequence is a functional homolog of SEQ ID NO 40 in the 10/838,616 US patent application
  misc_feature: The sequence is a functional homolog of SEQ ID NO 742 in the 11/435,388 US patent application
  misc_feature: The sequence is a functional homolog of SEQ ID NO 46 in the 10/838,616 US patent application
  misc_feature: The sequence is a functional homolog of SEQ ID NO 64 in the 10/838,616 US patent application
  misc_feature: Ceres ANNOT ID no. 8668211
  misc_feature (221)..(334): Pfam ID: B3 Pfam Description: B3 DNA binding domain
  misc_feature (80)..(129): Pfam ID: AP2 Pfam Description: AP2 domain
MDSASSLVDDTSSGSGGGGGASTDKLRALAVAAAASGPPLERMGSGASAVLDAAEPGAEADSAAAAAPGAVGVGGKLPSSRYKGVVPQPNGRWGAQIYERHQRVWLGTFAGEADAARAYDVAAQRFRGRDAVTNFRPLADADPDAAAELRFLASRSKAEVVDMLRKHTYFDELAQNKRAFAAAAAAAASSAATTTASSLANNNNNHSSLASPSPATAREHLFDKTVTPSDVGKLNRLVIPKQHAEKHFPLQLPSAGGESKGVLLNLEDAAGKVWRFRYSYWNSSQSYVLTKGWSRFVKEKGLQAGDVVGFYRSSAVGAGADTKLFIDCKLRPNSVATASTTTGPAVGSSPPAPAPAPVATKAVRLFGVDLLTAPAATAAAPAEAMAAGCKRARDLASPPQAAFKKQLVELALV

SEQ ID NO: 16886 - DNA, 267 bp, Sorghum bicolor
  misc_feature: Ceres ANNOT ID no. 8668293
  misc_feature: Encodes the peptide sequence at SEQ ID NO 16887
atgaccgttcgtttctccctgttgtacgccgatcagaccgtccgtccgtcgacggcgccggcgtcacatgcaaaaaaaaattcgcgtttgaagaacacgcacctgagggcgctccccggtgcggcagagaggctggcgctgtgcaaggccgacctgctcgactacgacgcgctgcggtcggccatcgccggctgccacggcatcttccacaccgcgtcgcccatcaccgacgatccggtacgtatatgtgtaacctatagtacttga

SEQ ID NO: 16887 - protein, 88 aa, Sorghum bicolor
  misc_feature: Useful for making plants with altered carbohydrate content
  misc_feature: Functional homolog of the protein sequence given in SEQ ID NO 14118
  misc_feature: Useful for making plants with altered cell wall content and/or composition
  misc_feature: Useful for making plants with altered lignin content
  misc_feature: Functional homolog of the protein sequence given in SEQ ID NO 13818
  misc_feature: Ceres ANNOT ID no. 8668293
  misc_feature (7)..(78): SWISSPROT Homolog: EC 1.1.1.219 Dihydrokaempferol 4-reductase
MTVRFSLLYADQTVRPSTAPASHAKKNSRLKNTHLRALPGAAERLALCKADLLDYDALRSAIAGCHGIFHTASPITDDPVRICVTYST

SEQ ID NO: 16888 - DNA, 972 bp, Sorghum bicolor
  misc_feature: Ceres ANNOT ID no. 8668304
  misc_feature: Encodes the peptide sequence at SEQ ID NO 16889
atgcggccgccttcctcctcctcctcctcctcctcttcctcttcttcttcgtcgtcggcgatggcggcgcctggaggcggccggatgtcggcgttcacgatgcgcgcggtggcgcggatgtcgagggcccggtggttcatcttcctgcgccgggtgtaccagtaccagaacgggcccaggtccgacctgggctccaaccccttcaactcgcccggctggctcgcgctcgagctcggcgtcatcgtcgcgcagatggtcctgaccaccgccgtcgtcgccacctcctccgccgagcgccccgcgtggccgctccgcctctgggtcgccgcctacaacgtcggcaacgtgctcagcctgcccctcctctattggcgccaccggcattcctccgccggcggccgaggcggcgacgcgctctccggcgacctcgagatgcgcggcgccaatgacgctctgagggacagcaggtcgtatctgatgaacaaggcgcgggcgttcctggagctcttcttcgcgatgtggttcgtgatgggcaacgtgtgggtgttcgacgcgcggctggggtcgctccagcgcgcgccgaggctgtacgcgctctgcatcagcctgctggcctggaacgccgtcgtctactcgctcccgttcctgctcttcctcctgctctgctgcttcgtgcccatggtcggctacgcgctcggctacaacatgaactccgcctccgtcggcaggggcgcctccgacgagcagctcgccgcgctgccccggtggcggttcaaggagcccgggcccgccgccgacgtcccaagggaccgggaccacgatgaccaggagtgctgcatctgcctagcgcagtacagggagaaggaggaggttcggcagctggcgtgcacgcacatgttccacctcaagtgcgtggacaggtggctcaggatcatctcctcttgccctctctgcaagcaagagctcaagtga

SEQ ID NO: 16889 - protein, 323 aa, Sorghum bicolor
  misc_feature: Useful for making plants with modulated biomass
  misc_feature: Functional homolog of the protein sequence given in SEQ ID NO 12933
  misc_feature: Ceres ANNOT ID no. 8668304
  misc_feature (278)..(318): Pfam ID: zf-C3HC4 Pfam Description: Zinc finger, C3HC4 type (RING finger)
MRPPSSSSSSSSSSSSSSSAMAAPGGGRMSAFTMRAVARMSRARWFIFLRRVYQYQNGPRSDLGSNPFNSPGWLALELGVIVAQMVLTTAVVATSSAERPAWPLRLWVAAYNVGNVLSLPLLYWRHRHSSAGGRGGDALSGDLEMRGANDALRDSRSYLMNKARAFLELFFAMWFVMGNVWVFDARLGSLQRAPRLYALCISLLAWNAVVYSLPFLLFLLLCCFVPMVGYALGYNMNSASVGRGASDEQLAALPRWRFKEPGPAADVPRDRDHDDQECCICLAQYREKEEVRQLACTHMFHLKCVDRWLRIISSCPLCKQELK

SEQ ID NO: 16890 - DNA, 1548 bp, Sorghum bicolor
  misc_feature: Ceres ANNOT ID no. 8668308
  misc_feature: Encodes the peptide sequence at SEQ ID NO 16891
atggcggaggcggagttgaagccctcggcgatgcaggtggaggctgccgaggcggcgtccaagccgcggttcaggatgccggtggactccgacaacaaggccaccgagttctggctcttctccttggcgaggccgcacatgagcgccttccacctctcgtggttctccttcttctgctgcttcctctccaccttcgcggcgccgccgctgctcccgctcatccgtgacacgctcgggctcacggccacggacatcggcaacgccgggatcgcctccgtgtccggcgcggtcttcgcgcgtgtcgccatgggcacggcgtgcgacctggtggggccccgcctggcgtccgcggccatcatactcctcaccacgcccgccgtgtactgctccgccatcatcgactcgccgtcgtccttcctgctcgtgcgcttcttcacgggattctcgctggcgtccttcgtgtccacgcagttctggatgagctccatgttctcgccgcccaaggtgggtctcgccaacggcgtcgccggcgggtggggcaacctcggcggcggcgccgtgcagctcatcatgccgctcgtgtacgaggccatccgcaagatcgggagcacgccgttcacggcgtggcgcgtcgccttcttcatcccgggccttctgcagacgctgtcggccatcgccgtgctggcgttcggccaggacatgcccgacggcaactaccggaagctgcacaagtccggcgacatgcacaaggacagcttcggcaacgtgctccgccacgccgtcaccaactaccgcgcctgggtcctggcgctcacctacggctactgcttcggcgtggagctcgccgtggacaacatcatcgcgcagtacttctacgaccgcttcggcgtcaagctcagcaccgccggcttcatcgccgccagcttcgggatggccaacatcatctcccgccccggcggcggcctcatgtcggactggctctccacccggttcggcatgcgcggcaggctgtggggcctgtgggtggtgcagaccatcgggggcgtcctctgcgtggtgctcggcgccgtcgactactccttcgccgcgtccgtggccgtcatgatactcttctccctcttcgtgcaggcggcctgcgggctcacctttggcatcgtgccgttcgtctcccggaggtcgctggggctcatctccggcatgaccggcggcggcggcaacgtgggcgccgtgctcacgcagctcatcttcttccacggatccaagtacaagacggagacggggatcaagtacatggggctcatgatcatcgcgtgcacgctgcccatcgcgctcatctacttcccgcagtggggcggcatgttcgtcgggccgcagcccggggcgacggcggaggactactacaacagggagtggacggcgcacgagcgcgagaagggcttcaacgccggcagcgtacgctttgcggagaacagcgtgcgggagggagggcggtcaggcagccagtccaagcacacagtccccgtcgagtcctcgccggccgacgtgtga

SEQ ID NO: 16891 - protein, 515 aa, Sorghum bicolor
  misc_feature: Useful for making plants with altered carbon content
  misc_feature: Useful for making plants with altered nitrogen content
  misc_feature: Useful for making plants with modulated carbon-nitrogen partitioning
  misc_feature: Functional homolog of the protein sequence given in SEQ ID NO 14444
  misc_feature: Ceres ANNOT ID no. 8668308
  misc_feature (53)..(413): Pfam ID: MFS_1 Pfam Description: Major Facilitator Superfamily
MAEAELKPSAMQVEAAEAASKPRFRMPVDSDNKATEFWLFSLARPHMSAFHLSWFSFFCCFLSTFAAPPLLPLIRDTLGLTATDIGNAGIASVSGAVFARVAMGTACDLVGPRLASAAIILLTTPAVYCSAIIDSPSSFLLVRFFTGFSLASFVSTQFWMSSMFSPPKVGLANGVAGGWGNLGGGAVQLIMPLVYEAIRKIGSTPFTAWRVAFFIPGLLQTLSAIAVLAFGQDMPDGNYRKLHKSGDMHKDSFGNVLRHAVTNYRAWVLALTYGYCFGVELAVDNIIAQYFYDRFGVKLSTAGFIAASFGMANIISRPGGGLMSDWLSTRFGMRGRLWGLWVVQTIGGVLCVVLGAVDYSFAASVAVMILFSLFVQAACGLTFGIVPFVSRRSLGLISGMTGGGGNVGAVLTQLIFFHGSKYKTETGIKYMGLMIIACTLPIALIYFPQWGGMFVGPQPGATAEDYYNREWTAHEREKGFNAGSVRFAENSVREGGRSGSQSKHTVPVESSPADV

SEQ ID NO: 16892 - DNA, 1638 bp, Sorghum bicolor
  misc_feature: Ceres ANNOT ID no. 8668292
  misc_feature: Encodes the peptide sequence at SEQ ID NO 16893
atggagatgggcacggttctgggtgccatggaggagtacaccttcaccttcctggccatggccgtggggttcctagtgcttgtgtatctgtacgagccgtactggaaggtgcgccacgtgcccgggcccgtgccgctgccgctcatcggccacctccacctgctggcgaagcacggcccagacgtcttccctgtgctcgccaagaagcacgggcctatcttcagatttcacgtgggaaggcagccattgatcatcgtggccgacgcagagctctgcaaggaggtgggcatcaagaagttcaagagcatgcctaaccggagcttgccttcgcccatcgccaattctcccatacatcggaaaggcctcttcgctacaagggattcgaggtggtcggcgatgcgaaacgttatcgtctcgatctaccagccgtcgcacctcgccgggctgatgccgaccatggagtcgtgcatcgagcgcgctgcgacgacgaacctcggcgatggcgaggaggtcgtcttctccaagctggcgctgagcctcgccaccgacatcatcgggcaagcggcgttcggcacagactttggcctctcgggaaagccggtggtgcctgacgatgacatgaagggtgtcgacgtcgtcgtcggagatgcagcgaaggcgaaggcgtcatcatcggaattcataaacatgcacatccactcgaccacgtcgctcaagatggacctgtcggggtcgctctccaccatcgttggcgcgctcgtgcccttcctgcagaatccgctgcggcaggtgctcttgagggtccccggctccgccgaccgggagatcaaccgtgtgaacggcgagctccgtaggatggtggacggcatcgtcgccgcccgcgcagcggagagggagcgtgcgccggcggcgacagcagcacagcagcacaaggacttcctctccgtggtgctggcggcgagggagagcgacgcgtccacgcgggagctgctctcgccggactacttgagcgcgttgacctacgagcacctcatcgctgggccggcgaccgcggcgttcacgctgtcctccgtggtctacctcgtcgccaagcacccggaagtggaggagaagctgcttagggagatggacgcgttcggccctcgcggcagtgtgcccacggcggatgatcttcagaccaagttcccctacctcgatcaggtggtgaaggagtcgatgaggctgttcatggtgtcgccattggtggcgcgagagacctccgagcgagtggagatcggtggctatgtgcttccaaagggcgcatgggtgtggatggcaccaggggtcctcgccaaggacgcccacaacttcccggacccggagctgttccgaccagagcggttcgacccagccggcgacgagcaaaagaagcgtcacccatacgcgttcatcccttttggaatcggccccagggtttgcatcggccagaagttcgccatccaggagatcaagctcgcgataatccacctctatcagcactatgtgttccggcattctcccagcatggagtcccctctagagtttcagtttgggattgtggtcaacttcaagcatggtgtcaagcttcacgtcatcaagaggcatgtggaaaataattaa

SEQ ID NO: 16893 - protein, 545 aa, Sorghum bicolor
  misc_feature: Useful for biocontainment applications
  misc_feature: Useful for making plants with modulated biomass
  misc_feature: Functional homolog of the protein sequence given in SEQ ID NO 14445
  misc_feature: Ceres ANNOT ID no. 8668292
  misc_feature (40)..(536): Pfam ID: p450 Pfam Description: Cytochrome P450
MEMGTVLGAMEEYTFTFLAMAVGFLVLVYLYEPYWKVRHVPGPVPLPLIGHLHLLAKHGPDVFPVLAKKHGPIFRFHVGRQPLIIVADAELCKEVGIKKFKSMPNRSLPSPIANSPIHRKGLFATRDSRWSAMRNVIVSIYQPSHLAGLMPTMESCIERAATTNLGDGEEVVFSKLALSLATDIIGQAAFGTDFGLSGKPVVPDDDMKGVDVVVGDAAKAKASSSEFINMHIHSTTSLKMDLSGSLSTIVGALVPFLQNPLRQVLLRVPGSADREINRVNGELRRMVDGIVAARAAERERAPAATAAQQHKDFLSVVLAARESDASTRELLSPDYLSALTYEHLIAGPATAAFTLSSVVYLVAKHPEVEEKLLREMDAFGPRGSVPTADDLQTKFPYLDQVVKESMRLFMVSPLVARETSERVEIGGYVLPKGAWVWMAPGVLAKDAHNFPDPELFRPERFDPAGDEQKKRHPYAFIPFGIGPRVCIGQKFAIQEIKLAIIHLYQHYVFRHSPSMESPLEFQFGIVVNFKHGVKLHVIKRHVENN

SEQ ID NO: 16894 - DNA, 1644 bp, Sorghum bicolor
  misc_feature: Ceres ANNOT ID no. 8668290
  misc_feature: Encodes the peptide sequence at SEQ ID NO 16895
atggggtggggagaaatcatctcgagccagctgctgatagagtcgtcgtcgtcgtccttgccggcggttcttttcaccgccgcggccttggccgccggcgcctttgcggtctacttctacataccatcatggcgcgtgcgaagggtccccgggcccgtcgcgctcccgctcgtcggacacctgccgttgttcgccaagcacggcccgggactgttccgcatgttggcgaaggaatacgggccaatctacaggttccacatgggtaggcagccactggttatggtggcagacgcggagctttgcaaggaggtgggtatcaagaagttcaagagcatccccaacagaagcatacccactccaattcgtggctcacctattcacaacaagggcctcttcttcaccagggactcgagatggcaatccatgaggaacgtcatcctcaccatctaccagccgtcgcacgtggcaagcctcatcccggccatccaaccatacgtcgagcgggcggggcgtctcctccaccccggcgaggagatcaccttctcggacctctccttaaagctcttcaatgacaccatcggccaggtcgccttcggcgtcgacttcggcctcaccaaggacgacaccaccgccgccacctcgccggcggcgcagcagcaacccgcccacggcggcgccaatgccaatcagagcgtcgacgacccggccaccgacttcatccggaagcacttccgcgccacgacgtcgctcaagatggacctgtctggcccgctgtccatcgtgctcggccagttcgtgccgttcctccaggagcccgtgcggcagctcatgctgcgcgtgccaggctccgccgaccggcgcctggaagaggccaactcggacatgagcggcctccttgacgagattgtggcggagcgggcggcgcaggcggacaggggccagcagaagaacttcctgtccgtgttgctcaacgccagagagagcacggaggccatgaagaagctgctcactccggactacgtgagcgcgctcacgtacgagcacctgctcgccgggtctgtcaccatgtcgttcacgctctccagcctggtctacctcgtcgcgatgcacccggaggtggaggagaagctgcttcgggagatcgacgcttttgggcccaaggacgtggtgcccagctccgacgaccttgagacaaagtttccctacgttgaacaggttgtgaaggaaacaatgagattctacactgcatctccactggttgcaaggcaagcatccgaggatgttgaggttggagggtacctcctgcccaagggcacatgggtgtggctggcgcccggcgtgctagcgaaagatcccaaggactttccagacccggacgtattccggccggagcgtttcgacccggagagtgaggagtgcaagcgaaggcatccctacgcgttcatccccttcggcatcggcccccgggcatgcatcggccagaagtttgccatgcagcagctgaagctagtcgtcatccacctctaccgcaactacatcttcaggcactcgcccaggatggagtttcccctgcagttccagtactccattttggtcaacttcaagtatggtgtcaaggtgcaggtcatcgagaggaaaaactga

SEQ ID NO: 16895 - protein, 547 aa, Sorghum bicolor
  misc_feature: Useful for biocontainment applications
  misc_feature: Useful for making plants with modulated biomass
  misc_feature: Functional homolog of the protein sequence given in SEQ ID NO 14445
  misc_feature: Ceres ANNOT ID no. 8668290
  misc_feature (326)..(545): SWISSPROT Homolog: EC 5.3.99.5 Thromboxane-A synthase
  misc_feature (49)..(542): Pfam ID: p450 Pfam Description: Cytochrome P450
MGWGEIISSQLLIESSSSSLPAVLFTAAALAAGAFAVYFYIPSWRVRRVPGPVALPLVGHLPLFAKHGPGLFRMLAKEYGPIYRFHMGRQPLVMVADAELCKEVGIKKFKSIPNRSIPTPIRGSPIHNKGLFFTRDSRWQSMRNVILTIYQPSHVASLIPAIQPYVERAGRLLHPGEEITFSDLSLKLFNDTIGQVAFGVDFGLTKDDTTAATSPAAQQQPAHGGANANQSVDDPATDFIRKHFRATTSLKMDLSGPLSIVLGQFVPFLQEPVRQLMLRVPGSADRRLEEANSDMSGLLDEIVAERAAQADRGQQKNFLSVLLNARESTEAMKKLLTPDYVSALTYEHLLAGSVTMSFTLSSLVYLVAMHPEVEEKLLREIDAFGPKDVVPSSDDLETKFPYVEQVVKETMRFYTASPLVARQASEDVEVGGYLLPKGTWVWLAPGVLAKDPKDFPDPDVFRPERFDPESEECKRRHPYAFIPFGIGPRACIGQKFAMQQLKLVVIHLYRNYIFRHSPRMEFPLQFQYSILVNFKYGVKVQVIERKN

SEQ ID NO: 16896 - DNA, 1302 bp, Sorghum bicolor
  misc_feature: Ceres ANNOT ID no. 8668347
  misc_feature: Encodes the peptide sequence at SEQ ID NO 16897
atggccgcccccaacagcaacgacgccgccagcgccagtggcaccggcccggctggcgaggaggacatctccatcgaggcgttggcgcggcgcgtgcaggagcacatgaccctcaactccaaccccgccgctcgccgccacaagttctgggagacgcagcccgtcggccagttccgcgacgccgccgacacgtcgctaccggacggccccatcgagccgcccacgccactctccgaggtgcgcgctgacccctacccgctgcctgccgccttcgagtggctcacctgcgacctcgatgacgacgcgctcctcgccgacctctactcgctgctcgcccacaactacgtcgaggacgacgagaacatgttccgcttcaactactccccggccttcctccgctgggcgctcaagccgccgtccttcttccgggcctggcatatcggtgtccgcgccaaggagtccaagaagctcgtcgccttcatctcgggcgtcccggcacgcatccgcgcccgcgacgacgtcgtccgcatggccgagatcaacttcctctgcgtccacaagaagctccgatccaagcgcctggcacccgtgctcatccgggaggtcacccgccgcgtccaccaggagaacatctggcaggctgcatacaccgcgggggtcgtcctcccaacccccatcaccacctgccgctactggcaccgatccctcaaccccaagaagcttatcgatgttgggttctctcgtctcggtccgcgcatgacaatgagccgcacggtccggctatacaagcttcctgatgcaccgctcacccctgggttccgcagaatggagctgcgggatgttgctgcggtcacacggctgttgagggcttaccttgcgaggtttgtggtggcaccagattttgatgaggtagatgtggagcactggctgctgccccaagaggatgtggtggacagctaccttgtggagagccctgagacgcatgaggtcacagatttctgcagcttttacacgctgccctcgtcagtgctgaacaatgctaactatgcgacactcaaagcggcatactcgtattacaacgtttccaccaaaactccgttgcagcagctgatgaatgatgctctgattgttgccaagcagaagaattatgatgtgttcaatgctctcgatgtcatggagaatgagtcattcctcaaggaactcaagtttggtcctggagatgggcagctccactattatctctacaactaccgtattcgcaacggcatcaagccctctgagcttggtcttgtgctgctatag

SEQ ID NO: 16897 - protein, 433 aa, Sorghum bicolor
  misc_feature: Useful for making plants with altered alkaloid content
  misc_feature: Functional homolog of the protein sequence given in SEQ ID NO 14446
  misc_feature: Ceres ANNOT ID no. 8668347
  misc_feature (17)..(433): SWISSPROT Homolog: EC 2.3.1.97 Glycylpeptide N-tetradecanoyltransferase
  misc_feature (68)..(229): Pfam ID: NMT Pfam Description: Myristoyl-CoA:protein N-myristoyltransferase, N-terminal domain
  misc_feature (243)..(432): Pfam ID: NMT_C Pfam Description: Myristoyl-CoA:protein N-myristoyltransferase, C-terminal domain
MAAPNSNDAASASGTGPAGEEDISIEALARRVQEHMTLNSNPAARRHKFWETQPVGQFRDAADTSLPDGPIEPPTPLSEVRADPYPLPAAFEWLTCDLDDDALLADLYSLLAHNYVEDDENMFRFNYSPAFLRWALKPPSFFRAWHIGVRAKESKKLVAFISGVPARIRARDDVVRMAEINFLCVHKKLRSKRLAPVLIREVTRRVHQENIWQAAYTAGVVLPTPITTCRYWHRSLNPKKLIDVGFSRLGPRMTMSRTVRLYKLPDAPLTPGFRRMELRDVAAVTRLLRAYLARFVVAPDFDEVDVEHWLLPQEDVVDSYLVESPETHEVTDFCSFYTLPSSVLNNANYATLKAAYSYYNVSTKTPLQQLMNDALIVAKQKNYDVFNALDVMENESFLKELKFGPGDGQLHYYLYNYRIRNGIKPSELGLVLL

SEQ ID NO: 16898 - DNA, 1479 bp, Sorghum bicolor
  misc_feature: Ceres ANNOT ID no. 8668350
  misc_feature: Encodes the peptide sequence at SEQ ID NO 16899
atggagccgagggttgggaacaagttccggcttggccgcaagatcgggagcggctctttcggggagatctacctcggcaccaatatccagacgaacgaggaggttgcgattaagctggaaaatgtgaagacaaagcatcctcagttgctctatgaatcaaagatttataggattctgcaaggaggaactggaataccgaacgtcagatggtttggtgtagaaggagactacaatgtcttggttatggatttacttggaccaagccttgaggatctattcaatttctgcagcaggaaattgtctctgaagactgtacttatgctcgctgatcagatgataaatcgagtggaatttgttcattccaagtcttttctgcatcgagatattaagcctgataatttcctcatgggtcttggcagacgagctaatcaggtctacgttatagactttggccttgctaaaaaatacagggatacctcgacgcatcagcacatcccatacagggagaacaagaacttgacaggaactgcaagatatgctagtgtcaacacccatcttggcattgaacaaagccgaagagatgacttggaatctcttggatatgtgcttatgtacttcctgaggggcagccttccttggcaaggtcttaaagcaggaacaaagaagcaaaagtatgagaaaattagtgagaagaaagttgcaacatcaattgaggctctatgccgtgggtatcctactgagtttgcatcatatttccattattgccgctcactacggtttgatgacaagcctgactattcatacctcaagcgattattccgtgaccttttcattcgcgaaggttttcagtttgactatgtatttgactggacaatactgaagtaccaacaatctcaaatagccactgctccaccccgtgtggtagtgaacttctccaacgctccctccttgagttacccaccaaacatgcacatatgtgaactatctggccatggcgcggggccttctgggttggcacctgcattacagaatgacaggcaatcaggccctgaggaagcaaggactagtggttggtcatcaatggaccggcgtcgtgccccactaccaattacaagcgtggggacattatctaagcagaaagcaccagtagggaatgatgctactgtttctagagatgctgtgatatctggaccaaactttctgggaaggtcaagtggatcttcaaggaggcctgttatttcaactagccgtgatgtggtggccactgatagttctgagccttcacgagcacgtacaactgatgcaagccctggggcattccgcagagcctcaggtccccagagaagctcacctgtccattctgcagaacaaaagcgctcatcctcaggccggcatccatctaatgtgaagaactatgattctgctctcaaaggcattgaaggtcttaattttgatggtgacgagagggttcagtactag

SEQ ID NO: 16899 - protein, 492 aa, Sorghum bicolor
  misc_feature: The sequence is a functional homolog of SEQ ID NO 32 in US patent 7179962
  misc_feature: Ceres ANNOT ID no. 8668350
  misc_feature (1)..(413): SWISSPROT Homolog: EC 2.7.11.1 Non-specific serine/threonine protein kinase
  misc_feature (9)..(278): Pfam ID: Pkinase Pfam Description: Protein kinase domain
MEPRVGNKFRLGRKIGSGSFGEIYLGTNIQTNEEVAIKLENVKTKHPQLLYESKIYRILQGGTGIPNVRWFGVEGDYNVLVMDLLGPSLEDLFNFCSRKLSLKTVLMLADQMINRVEFVHSKSFLHRDIKPDNFLMGLGRRANQVYVIDFGLAKKYRDTSTHQHIPYRENKNLTGTARYASVNTHLGIEQSRRDDLESLGYVLMYFLRGSLPWQGLKAGTKKQKYEKISEKKVATSIEALCRGYPTEFASYFHYCRSLRFDDKPDYSYLKRLFRDLFIREGFQFDYVFDWTILKYQQSQIATAPPRVVVNFSNAPSLSYPPNMHICELSGHGAGPSGLAPALQNDRQSGPEEARTSGWSSMDRRRAPLPITSVGTLSKQKAPVGNDATVSRDAVISGPNFLGRSSGSSRRPVISTSRDVVATDSSEPSRARTTDASPGAFRRASGPQRSSPVHSAEQKRSSSGRHPSNVKNYDSALKGIEGLNFDGDERVQY

SEQ ID NO: 16900 - DNA, 672 bp, Sorghum bicolor
  misc_feature: Ceres ANNOT ID no. 8668391
  misc_feature: Encodes the peptide sequence at SEQ ID NO 16901
atggcgctgtcgtcccgcagctcgttcgccgccgccgacgtcctcctcccagcagccatggcgtatcgtcagccgtgcagcggcggcggcggcggccctgctacctccagctacttcggttctcggcccgcggccccttttttcccgttcggtacggcggcgcagctggacgtcttcgagtgcctgtcggacgaaggcggcgccgtcccggcaccaccggcagctgtacctggtgcgttcgcgacgccgccgccgccgctgccgcttatgccggccgagcgcgtcgtcccggacgctgctgcaggctatagtagtcatgctaggagtgcggcggcggcggcggcgggtgaggggccgccgaggaggacggacagaattgcgttccgggtgaggtcggacgacgaggaggtactcgatgacggctacaaatggaggaagtacggcaagaagtccgtcaagaacagcccgaatccgaggaactactaccggtgctcgacggagggctgcagcgtcaagaaaagggtagagcgagacaaggacgaccagagatatgtggtgaccatgtacgagggagtgcacaaccatgtgagtcctggtaccatctattacgccacccaggacgccgcctccggacgcttcttcgtcgccgggatgcatcagccaggccactga

SEQ ID NO: 16901 - protein, 223 aa, Sorghum bicolor
  misc_feature: The sequence is a functional homolog of SEQ ID NO 136 in the 10/714,887 US patent application
  misc_feature: The sequence is a functional homolog of SEQ ID NO 136 in the 11/435,388 US patent application
  misc_feature: The sequence is a functional homolog of SEQ ID NO 142 in the 10/714,887 US patent application
  misc_feature: The sequence is a functional homolog of SEQ ID NO 142 in the 11/435,388 US patent application
  misc_feature: The sequence is a functional homolog of SEQ ID NO 1610 in the 10/412,699 US patent application
  misc_feature: The sequence is a functional homolog of SEQ ID NO 970 in the 10/666,642 US patent application
  misc_feature: The sequence is a functional homolog of SEQ ID NO 134 in the 10/714,887 US patent application
  misc_feature: The sequence is a functional homolog of SEQ ID NO 134 in the 11/435,388 US patent application
  misc_feature: The sequence is a functional homolog of SEQ ID NO 1533 in the 10/374,780 US patent application
  misc_feature: The sequence is a functional homolog of SEQ ID NO 1617 in the 10/412,699 US patent application
  misc_feature: The sequence is a functional homolog of SEQ ID NO 114 in the 11/375,241 US patent application
  misc_feature: The sequence is a functional homolog of SEQ ID NO 146 in the 10/286,264 US patent application
  misc_feature: The sequence is a functional homolog of SEQ ID NO 2500 in the 10/374,780 US patent application
  misc_feature: The sequence is a functional homolog of SEQ ID NO 672 in the 10/412,699 US patent application
  misc_feature: Ceres ANNOT ID no. 8668391
  misc_feature (138)..(197): Pfam ID: WRKY Pfam Description: WRKY DNA -binding domain
MALSSRSSFAAADVLLPAAMAYRQPCSGGGGGPATSSYFGSRPAAPFFPFGTAAQLDVFECLSDEGGAVPAPPAAVPGAFATPPPPLPLMPAERVVPDAAAGYSSHARSAAAAAAGEGPPRRTDRIAFRVRSDDEEVLDDGYKWRKYGKKSVKNSPNPRNYYRCSTEGCSVKKRVERDKDDQRYVVTMYEGVHNHVSPGTIYYATQDAASGRFFVAGMHQPGH

SEQ ID NO: 16902 - DNA, 798 bp, Sorghum bicolor
  misc_feature: Ceres ANNOT ID no. 8668373
  misc_feature: Encodes the peptide sequence at SEQ ID NO 16903
atggactccttccgctcctcgaattctctagcgtcgaggagctccctgacgctgggggagttagcctgcgcggcgctgttcccggtgctcgccgtggtcgatgcggtcctgcacgcggccttgcggtgcttccagaagacctcgcccagtctgctgcctgtgctcgacatatgcgcgcgccaccgagccggcagacgcctcaccttccgtgagctagccgagctcgctgacgagtcccgctgcttttcggtgaacgaggtggaggcgctgtacgagctgtacaagaagatcagctgctccatcgtcgacgacggtctgatccataaggaggagctgcagttggcattattcaagacaccatctgggaaaaatctttttctagatagagtttttgatctttttgatgaaaaaaaaaattctgttattgaatttgaagagtttgtccatgcaataagtgtgtttcatccaaatgctcctcttgaagacaaaattgatttttccttcagattgtatgacttgaggcaaactggtttcatcgagcgtgaagaggtgaaacaaatggtagttgctactctgatggagtcacagtttgagctgtctgacgatctcgtggaaaccataatagacaagacatttgaggacgctgatactgataaggacaacaggattagcagagaggagtggagagcttttgtattgctgcacccttctgttataaagaagatgacactgccacacttgaaggacacgaccgcggctttccccagcttcgttttcaatacacaagtcgaagactag

SEQ ID NO: 16903 - protein, 265 aa, Sorghum bicolor
  misc_feature: Useful for making plants with modulated drought sensitivity
  misc_feature: Functional homolog of the protein sequence given in SEQ ID NO 13665
  misc_feature: Useful for making plants with modulated water use efficiency
  misc_feature: Functional homolog of the protein sequence given in SEQ ID NO 13666
  misc_feature: The sequence is a functional homolog of SEQ ID NO 2 in US patent 7250555
  misc_feature: Useful for making plants with modulated salt sensitivity
  misc_feature: Functional homolog of the protein sequence given in SEQ ID NO 13664
  misc_feature: Ceres ANNOT ID no. 8668373
  misc_feature (86)..(248): SWISSPROT Homolog: EC 2.7.11.17 Calcium/calmodulin-dependent protein kinase
  misc_feature (207)..(235): Pfam ID: efhand Pfam Description: EF hand
  misc_feature (126)..(154): Pfam ID: efhand Pfam Description: EF hand
MDSFRSSNSLASRSSLTLGELACAALFPVLAVVDAVLHAALRCFQKTSPSLLPVLDICARHRAGRRLTFRELAELADESRCFSVNEVEALYELYKKISCSIVDDGLIHKEELQLALFKTPSGKNLFLDRVFDLFDEKKNSVIEFEEFVHAISVFHPNAPLEDKIDFSFRLYDLRQTGFIEREEVKQMVVATLMESQFELSDDLVETIIDKTFEDADTDKDNRISREEWRAFVLLHPSVIKKMTLPHLKDTTAAFPSFVFNTQVED

SEQ ID NO: 16904 - DNA, 2352 bp, Sorghum bicolor
  misc_feature: Ceres ANNOT ID no. 8668473
  misc_feature: Encodes the peptide sequence at SEQ ID NO 16905
atggagccgtcccgtggcgctgctggcggcgggcggcggtggggggacgcggaggcggaggcggagggcgatgcggcggatgaagggagacgaggggaggacgggggcgaggtgagcctgcgggagtggctggaccggccgggccgcgcggtggaggcggcggagtgcgtgcacgtgttcaggcaggtggcggaggctgtggccgtcgcgcacgcgcagggggtggccgtgggcagcgcgcggccgtcgtgcttcgtcgtgtcgccgcccttcgcgcgcgtcgccttcatcgagtccgcctccggctccgacgcctccggttcgtgctcgggctctgacgcctccgaggacgccgaccgggacgcctcgcctccgcggcgacgcgacggcgcaggccgcggtgaggagcgcgccgggaagtcgttcccgctcaagagcgtgctggccatggagctcaactggtacaccagccccgaggaggcggacgacagcgccgctaccttcgcctctgacgtttacagactgggtgtgctcttgttcgagctgttctgtacattcgaaaccatggaagacaagatgcgggcaatggcgaatctgcggcaccgggtgttgccaccacagttgctgctcaaatggcccaaggaagcatccttctgccagttgctaatgcaccctgtgccagaaaccagaccgaagatgagtgaggtgttgcagagtgagttccttaatcagtcaaggaatagcctggaagagcgtgaagcagcacttaggttacgcgaagagattgaagaacaagaattattgctggattttcttcagcagttgcagaaaagaaagcaggatatagcagacagtttgcaggacactgttgctttcctttcttctgacatcaatgaggtactccaccagcaatctgcacttggccactgtgtgaacttctcaactgatttggacaaagaggtgtgctctggaactgttgaagatcagagtgattgcggatccaggaagcgattcagacctgagctgcaaggtgttgacatggaggaaaataatcgtactgtggaagaatgttcaagaacagttccatcctctgagttaatccaggaaagtgttctgtcaaaaagctccaggttgatgaagaacttcaaaaaacttgaaacagcttattttctaacaaggtccaagttggcgaagcaagctggcaaccaaataagtaatcatcaaattgttaagagggctactggttcagctattgggactgagggaagttcaatagatgatttttctttggaaaggcaatatggtagaaggcaaagaggctgggtgaactcttttcttgaggggttgtgcaagtacttgtcattcagtaagttgaaagttcgggcagaactgaagcattgtgatttgctgaactcatcaaacttagtatgctccgtagggtttgaccgggatagagagttttttgcaactgctggtgtaaataagaagataaaagtgtttgattataatatgattgtaaatgaacaccgtgatattcactatcccgtggtagagatgtctaatagatcaaaactgagctgtatttgttggaacagttatatgaagagccatatagcatctagtgattttgagggtatagtacaggtttgggatgttactaggagtcaggtttttgttgagatgagggagcatgagcgacgtgtgtggtcggtggacttctcaattgtggacccaacaaaattggtcagtgggagtgatgatggatctgtgaagctgtgggatatgaatcaggctgggagtattggtactattaggacaagggcaaacgtgtgttctgtgcaatttcaacctgatacttctcgctccattgccatcggctctgcagaccacaaaatttactgctatgatcttcgtaacatacgagctccttattgtacactagttgggcacacaaagactgtaagctatgttaagtatttggatgcatcaacaatagtatctgcgtctactgacaactcattgaagctttgggacctgtcgatgagtcgaggaaggataattgacagtccaattcaaacatttacggggcacacaaacacaaagaactttgttggcctttccatatctgatggttacatcgctactggctctgaaacaaatgaggtttttgtctaccacaaagaatttcccatgccagtgttggcatataagttcagcgtgacagaccctatctcaggccaggagattgatgatcagtcacagttcatttcctgcgtatgctggagagggcagtcttcaacgcttctttctgcaaactccagcggcaacattaagattttagaaatggactga

SEQ ID NO: 16905 - protein, 783 aa, Sorghum bicolor
  misc_feature: The sequence is a functional homolog of SEQ ID NO 1841 in the 11/479,226 US patent application
  misc_feature: Useful for making plants with modulated light quality sensitivity
  misc_feature: Ceres ANNOT ID no. 8668473
  misc_feature (489)..(680): SWISSPROT Homolog: EC 2.3.1.48 Histone acetyltransferase
  misc_feature (155)..(247): SWISSPROT Homolog: EC 2.7.11.1 Non-specific serine/threonine protein kinase
  misc_feature (555)..(594): Pfam ID: WD40 Pfam Description: WD domain, G-beta repeat
  misc_feature (641)..(678): Pfam ID: WD40 Pfam Description: WD domain, G-beta repeat
MEPSRGAAGGGRRWGDAEAEAEGDAADEGRRGEDGGEVSLREWLDRPGRAVEAAECVHVFRQVAEAVAVAHAQGVAVGSARPSCFVVSPPFARVAFIESASGSDASGSCSGSDASEDADRDASPPRRRDGAGRGEERAGKSFPLKSVLAMELNWYTSPEEADDSAATFASDVYRLGVLLFELFCTFETMEDKMRAMANLRHRVLPPQLLLKWPKEASFCQLLMHPVPETRPKMSEVLQSEFLNQSRNSLEEREAALRLREEIEEQELLLDFLQQLQKRKQDIADSLQDTVAFLSSDINEVLHQQSALGHCVNFSTDLDKEVCSGTVEDQSDCGSRKRFRPELQGVDMEENNRTVEECSRTVPSSELIQESVLSKSSRLMKNFKKLETAYFLTRSKLAKQAGNQISNHQIVKRATGSAIGTEGSSIDDFSLERQYGRRQRGWVNSFLEGLCKYLSFSKLKVRAELKHCDLLNSSNLVCSVGFDRDREFFATAGVNKKIKVFDYNMIVNEHRDIHYPVVEMSNRSKLSCICWNSYMKSHIASSDFEGIVQVWDVTRSQVFVEMREHERRVWSVDFSIVDPTKLVSGSDDGSVKLWDMNQAGSIGTIRTRANVCSVQFQPDTSRSIAIGSADHKIYCYDLRNIRAPYCTLVGHTKTVSYVKYLDASTIVSASTDNSLKLWDLSMSRGRIIDSPIQTFTGHTNTKNFVGLSISDGYIATGSETNEVFVYHKEFPMPVLAYKFSVTDPISGQEIDDQSQFISCVCWRGQSSTLLSANSSGNIKILEMD

SEQ ID NO: 16906 - DNA, 1095 bp, Sorghum bicolor
  misc_feature: Ceres ANNOT ID no. 8668493
  misc_feature: Encodes the peptide sequence at SEQ ID NO 16907
atggaggtgaggcggctgctgtgcgtggtggcggtggtggtgagctgttgggcgctggcggcgccggtggcgcggtgcgacccgcaggtgccgtgctacttcatcttcggcgactcgctggtggacaacggcaacaacaactacatcgtgtcgctggcgcgagcaaactacccgccctacggcatcgacttcgccggcgggccgtcggggcgcttcaccaacgggctcaccaccgttgatgtcatcgctcaacttctggggttcgacaacttcatcccgccgttcgccgcaacgagcggggaccagctcctcggcggcgccaacttcgcctccgccgccgccggcatccgcgccgagaccggccagcagctgggcgggcggatcccgttcgcggggcaggtgcagaactaccagacggcggtgcagacgctggtgagcatcctgggcgaccaggacacggcgtcggaccacctgagccggtgcatcttcagcatcggcatgggcagcaacgactacctcaacaactacttcatgccggccttctacaacacgggcagccggtacacgcccgagcagtacgccgactcgctcatcgccgactaccgccgctacctgcagacgctctacagctacggcgcgcgcaaggtggtcatgatcggcgtcggccaggtcgggtgcgcccccaacgagctcgcgcgctacagcgccgacggcgtcacctgcgtcgaccgcatcgacgacgccatccagatgttcaaccgccgcctcgtcggcctcgtcgacgagttcaacgcgctgcctggagcacacttcaccttcatcaacgcatacaacatcttcgacgacatcctcgccaacgccgcctcctacgggttcacggtgaccaacgccgggtgctgcggggtgggcaggaacaacgggcaggtgacgtgcctgccgtaccaggcgccgtgcgccaacagggaccagcacatcttctgggacgcgttccacccgtcggaggcggccaacatcatcgtcggacgccggtcgtaccgcgccgagtcacccaacgacgtctacccgatggacatcagcacgctcgcctccatctga

SEQ ID NO: 16907 - protein, 364 aa, Sorghum bicolor
  misc_feature: Useful for making plants with modulated phosphate use efficiency
  misc_feature: Functional homolog of the protein sequence given in SEQ ID NO 14406
  misc_feature: Ceres ANNOT ID no. 8668493
  misc_feature (31)..(303): SWISSPROT Homolog: EC 3.2.1.51 Alpha-L-fucosidase
  misc_feature (33)..(344): Pfam ID: Lipase_GDSL Pfam Description: GDSL-like Lipase/Acylhydrolase
MEVRRLLCVVAVVVSCWALAAPVARCDPQVPCYFIFGDSLVDNGNNNYIVSLARANYPPYGIDFAGGPSGRFTNGLTTVDVIAQLLGFDNFIPPFAATSGDQLLGGANFASAAAGIRAETGQQLGGRIPFAGQVQNYQTAVQTLVSILGDQDTASDHLSRCIFSIGMGSNDYLNNYFMPAFYNTGSRYTPEQYADSLIADYRRYLQTLYSYGARKVVMIGVGQVGCAPNELARYSADGVTCVDRIDDAIQMFNRRLVGLVDEFNALPGAHFTFINAYNIFDDILANAASYGFTVTNAGCCGVGRNNGQVTCLPYQAPCANRDQHIFWDAFHPSEAANIIVGRRSYRAESPNDVYPMDISTLASI

SEQ ID NO: 16908 - DNA, 2676 bp, Sorghum bicolor
  misc_feature: Ceres ANNOT ID no. 8668512
  misc_feature: Encodes the peptide sequence at SEQ ID NO 16909
atgttctcgcgatcctacaccaatctagtcgatctcgccaatggcaacctctccgccctcgactacggcggcggcggcggggcttggggcgacggcgggggcgggggcgggggcgggggtgggggcggggccggaggcgggggccgcccgccgcgggcgaggcggatgcagcggacgatgacgacgcccgggacgctcgtggagctcgacgacgaggaccaagcgggcagcgtcgcctccgacgtgccgtcgtcgttcgccagcgaccgcctcatcgtcgtcgccaacacgctccccgtgcgcgtcgagcgcgggcccgacggccgcgggtggagcttctcctgggatgaggactcgctcctcttccacctccgcgacggcctccccgaagacatggaggtcctctacgtcggctccctccgcgccgacgtgccggccgtcgagcaggacgaggtcgcgcaggcgctcctcgacagtttccgctgcgtcccggccttcctccccaaggacctctgcgaccgattctaccacggcttctgtaagcagacgctctggccgctcttccactacatgctccccttctccccagaccacggcggacgcttcgaccgctcccactgggaggcctacgtcctcgccaacaagctcttctcccagcgggtcatcgaggtcctcaacccggaggatgactacgtctggatccacgactaccacctcctagccctcccctccttcctgcgccgccgattcaaccgcctccgcatcggcttcttcctgcacagccccttcccttcgtcggagctctaccgttctctccccgtccgtgatgagatcctcaagtcgctgctcaactgcgatctgattgggttccacaccttcgattacgcccggcatttcctgtcctgctgcagccgcatgctcgggatcgagtaccaatccaagaggggatacattggtcttgattactttggacgcacggtggggataaagatcatgcctgttgggattaacatggtgcagctgcagtcacttctccagcagcctgatctggagcggcaggtcactgagctccggcatcaattcaatcggaagactgtcttgctcggtgtggatgatatggacatttttaaggggattgatctgaagattcttgcgtttgaacagatgctgaagacgcatccaaaatggcagggccgagcagtgttggtgcagattgcaaacccaaaaggcggcagcgggaaagaccttgaggggctacagactgagattgaagacagttgcaggaggatcaatgagcagtttggacggactggatatagccctgttgtacttgtcaataggacactgtcaagtgttgagaggatggcttattacaccattgcagagtgtgtcgttgtcactgcagtcagggatgggatgaatcttacaccatatgaatacattgtgtgtaggcagggaattccaggtttggctggttctgtggatgataaaccaagggggaaaagtatgctagttgtatcagaattcattggctgctcaccatcgttgagtggagcaattcgggtaaacccgtggaacattgagtcaacagcagaggccatgaatgaatccatcgctttctcagatactgagaagcaactgcgacatgagaagcactatcggtatgtcagctcacacgatgttgcctattggtctaagagctatattcatgattttgagagaagctgtagggaccattttaggaggagatgctggggtattggactaggatttggatttagagtggttgctcttgaccgcaatttcaaaaagcttaatgtggattctattgttgcggattacaagaagtcaaagagcaggatcatactactggactacgatggaaccctagtaccacaaactacaatgaacaagactccaagtgaaactgttgttaacatgatgaataccctgtgtgctgataagaagaatgttatttttattgtaagtggaagaggaagggatagccttgaaaaatggttttacccttgcccagagcttggcattgctgctgaacatggctactttatgaggtggaccagagatgaacagtggcaaatacaacatcagacatcagattttggatggatgcatatggctgagccggtaatgaaactgtacacagaggcaactgatggatcatatattgaaaccaaagagagtgctttggtctggcatcaccaagatgctgaccctggttttggatctgcgcaagcgaaagaaatgctagatcatttggaaagtgtcctggccaatgagccagtctctgtaaagagtggccagcatattgtagaggttaagcctcaggctgtcagcaaaggttttgtggccgagaagatactttcaactctcatggacaagggaaggcaagcagacttcgttctgtgcattggtgatgatagatcggatgaggatatgtttgaacagattgctgatagtatgaggaggagcatggttgatcctgaaacctcgctgtatgcctgcacggtcgggcagaaaccaagcaaggccatttactatttggatgacgctaatgaggtcttaaacatgcttgaagcacttgccgatgcatcggaggaggctggttctggttcaccggaagccacggatggaccatctacactggaggaagcatga

SEQ ID NO: 16909 - protein, 891 aa, Sorghum bicolor
  misc_feature: Useful for making plants with altered carbohydrate content
  misc_feature: Functional homolog of the protein sequence given in SEQ ID NO 13884
  misc_feature: Ceres ANNOT ID no. 8668512
  misc_feature (84)..(571): SWISSPROT Homolog: EC 2.4.1.15 Alpha,alpha-trehalose-phosphate synthase (UDP-forming)
  misc_feature (89)..(574): Pfam ID: Glyco_transf_20 Pfam Description: Glycosyltransferase family 20
  misc_feature (623)..(858): Pfam ID: Trehalose_PPase Pfam Description: Trehalose-phosphatase
MFSRSYTNLVDLANGNLSALDYGGGGGAWGDGGGGGGGGGGGGAGGGGRPPRARRMQRTMTTPGTLVELDDEDQAGSVASDVPSSFASDRLIVVANTLPVRVERGPDGRGWSFSWDEDSLLFHLRDGLPEDMEVLYVGSLRADVPAVEQDEVAQALLDSFRCVPAFLPKDLCDRFYHGFCKQTLWPLFHYMLPFSPDHGGRFDRSHWEAYVLANKLFSQRVIEVLNPEDDYVWIHDYHLLALPSFLRRRFNRLRIGFFLHSPFPSSELYRSLPVRDEILKSLLNCDLIGFHTFDYARHFLSCCSRMLGIEYQSKRGYIGLDYFGRTVGIKIMPVGINMVQLQSLLQQPDLERQVTELRHQFNRKTVLLGVDDMDIFKGIDLKILAFEQMLKTHPKWQGRAVLVQIANPKGGSGKDLEGLQTEIEDSCRRINEQFGRTGYSPVVLVNRTLSSVERMAYYTIAECVVVTAVRDGMNLTPYEYIVCRQGIPGLAGSVDDKPRGKSMLVVSEFIGCSPSLSGAIRVNPWNIESTAEAMNESIAFSDTEKQLRHEKHYRYVSSHDVAYWSKSYIHDFERSCRDHFRRRCWGIGLGFGFRVVALDRNFKKLNVDSIVADYKKSKSRIILLDYDGTLVPQTTMNKTPSETVVNMMNTLCADKKNVIFIVSGRGRDSLEKWFYPCPELGIAAEHGYFMRWTRDEQWQIQHQTSDFGWMHMAEPVMKLYTEATDGSYIETKESALVWHHQDADPGFGSAQAKEMLDHLESVLANEPVSVKSGQHIVEVKPQAVSKGFVAEKILSTLMDKGRQADFVLCIGDDRSDEDMFEQIADSMRRSMVDPETSLYACTVGQKPSKAIYYLDDANEVLNMLEALADASEEAGSGSPEATDGPSTLEEA

SEQ ID NO: 16910 - DNA, 1395 bp, Sorghum bicolor
  misc_feature: Ceres ANNOT ID no. 8668554
  misc_feature: Encodes the peptide sequence at SEQ ID NO 16911
atgaacaagaagagcgtggttctgtacccgggcctcggcgtcggccacctgacgccgatgatcgagctggccaagctgttcacccagcacggcgtcgccgtcacggtcgcgctcgtcgagccgcccgccaagtcccctgacttctccacggcggtcgcccgcgccgcggcctccaatccgcgcgtcaccttccacgtcctgccgccgcctgaccccgccgattccagctcggatggtggcacgccgtcgcaccacgtcgaccagatgttcagctacctcaaggccatgaacgcgccgctgcgcgacctcctccgctcgctgccggccgtcgacgcgctcgtcgtcgacatgttctgccgcgacgcgctcggcgtcgctgccgagctcaacctgcccgtctactacttctacgcctcgggcgccagcgcgctggccgtcttcctcaacctgcctcgcatgacgaccacgggtttcctgcaggccgccgccggcgactccgtcctctcgttgcccggcgctcctccgttcagagcttcggaactgccagaactgatccggaacggcagcgcgacaggagagaccatcttccgcatgctccacgcgatcccagaggccaacgggatcctcgtcaacaccttcgagtcgctggagccgcgggccgtgcgcgctctcagggacggcctgtgcgtccccgaccgttccacgccgccggtgtactgcatcgggccgctggtttcgggaggcggcggggacaaggaggagcacgagtgcctccggtggctggacatgcagccagaccagagcgtcgtgttcctctcctttgggagcctgggcaggttccccaagaagcaactagaggagatggccattgggctcgagaagtcagggcagaggtttctatgggtagtgcggagccccgcaaacaacggtgaggacgtgttggggcagccactcccggagccggacctggaggcccttcttccagaggggttcttggagaggaccagggacagagggcttgtgctcaagtcctgggcaccacaagtggatgtgctagggcatagagccaccggcgcatttgttacgcactgtgggtggaactcgacgctggagggcatcatggcagggttgccactgctgtgctggccactgtatgcggagcagaggatgaacaaggtgtttattgtggaagagatgaagctcggggtggaaatgaatggctacgatgaaggaatggtgaaggcagaggaggtggagacgaaggttaagtgggtgatggagtctcaaggtgggcgagcactcagagatagaatggtggaggtaaaagatagagcggtcaaggcactcaaagaaggcggctcatctcatgatgcttttgttgaattcttgaagtga

SEQ ID NO: 16911 - protein, 464 aa, Sorghum bicolor
  misc_feature: Useful for making plants with altered carbohydrate content
  misc_feature: Functional homolog of the protein sequence given in SEQ ID NO 14447
  misc_feature: Ceres ANNOT ID no. 8668554
  misc_feature: Up-regulated in root tissues in response to methyl jasmonate treatment
  misc_feature: Up-regulated in shoot tissues in response to methyl jasmonate treatment
  misc_feature: Up-regulated in root tissues in response to salicylic acid treatment
  misc_feature: Up-regulated in shoot tissues in response to salicylic acid treatment
  misc_feature (6)..(461): SWISSPROT Homolog: EC 2.4.1.218 Hydroquinone glucosyltransferase
  misc_feature (5)..(464): Pfam ID: UDPGT Pfam Description: UDP-glucoronosyl and UDP-glucosyl transferase
MNKKSVVLYPGLGVGHLTPMIELAKLFTQHGVAVTVALVEPPAKSPDFSTAVARAAASNPRVTFHVLPPPDPADSSSDGGTPSHHVDQMFSYLKAMNAPLRDLLRSLPAVDALVVDMFCRDALGVAAELNLPVYYFYASGASALAVFLNLPRMTTTGFLQAAAGDSVLSLPGAPPFRASELPELIRNGSATGETIFRMLHAIPEANGILVNTFESLEPRAVRALRDGLCVPDRSTPPVYCIGPLVSGGGGDKEEHECLRWLDMQPDQSVVFLSFGSLGRFPKKQLEEMAIGLEKSGQRFLWVVRSPANNGEDVLGQPLPEPDLEALLPEGFLERTRDRGLVLKSWAPQVDVLGHRATGAFVTHCGWNSTLEGIMAGLPLLCWPLYAEQRMNKVFIVEEMKLGVEMNGYDEGMVKAEEVETKVKWVMESQGGRALRDRMVEVKDRAVKALKEGGSSHDAFVEFLK

SEQ ID NO: 16912 - DNA, 783 bp, Sorghum bicolor
  misc_feature: Ceres ANNOT ID no. 8668546
  misc_feature: Up-regulated in root tissues in response to methyl jasmonate treatment
  misc_feature: Up-regulated in shoot tissues in response to methyl jasmonate treatment
  misc_feature: Up-regulated in root tissues in response to salicylic acid treatment
  misc_feature: Up-regulated in shoot tissues in response to salicylic acid treatment
  misc_feature: Encodes the peptide sequence at SEQ ID NO 16913
atgggcagcgagtgcaaggaccaccttcagcttcacgccgccggctacggcgtcggcgtcgccagcccgcaggaggaggaggaggaggagcaggcgggcgccatcgcaccgttcgtggcgaagacgttccacatggtgagcgacccggccacggacgccgtcgtgcgctggggcggcgccagcaacaccttcctcgtcctcgacccggccaccttctccgactacctgctgccctcctacttcaagcaccgcaacttcgccagcttcgtccggcagctcaacacctacgggttcaggaaggtggacacggaccggtgggagttcgcgcacgagtcgttcctccggggccaggcgcacctgctgccgctggtcgtgcgcaagaagaagaagaagaaggcggccggcggctgccgggagcagctgtgcgaggagggggaggaggtgcgcgggaccatccgggccgtgcagcgcctgcgggatcagcagcgcgggatggaggaggagctgcaggccatggaccgccgcctgcgcgccgccgagagccgcccgggccagatgatggcgttcctcgccaagctcgcggacgaaccgggcgtcgtgctgcgcgctatgctcgccaagaaggaggagctggccctggccggtaaggggtcgacgacgccggcgcccggcaaaaggcggcggatcggggccgaggccggcgtgggcgacgtcgcggacatggcgcagagcaggggcgccgtgccgttcccgttctctgttctcggccaagtgttctactag

SEQ ID NO: 16913 - protein, 260 aa, Sorghum bicolor
  misc_feature: Useful for making plants with modulated heat sensitivity
  misc_feature: Functional homolog of the protein sequence given in SEQ ID NO 13734
  misc_feature: The sequence is a functional homolog of SEQ ID NO 1233 in the 11/479,226 US patent application
  misc_feature: The sequence is a functional homolog of SEQ ID NO 144 in the 10/666,642 US patent application
  misc_feature: Ceres ANNOT ID no. 8668546
  misc_feature (36)..(190): Pfam ID: HSF_DNA-bind Pfam Description: HSF-type DNA-binding
MGSECKDHLQLHAAGYGVGVASPQEEEEEEQAGAIAPFVAKTFHMVSDPATDAVVRWGGASNTFLVLDPATFSDYLLPSYFKHRNFASFVRQLNTYGFRKVDTDRWEFAHESFLRGQAHLLPLVVRKKKKKKAAGGCREQLCEEGEEVRGTIRAVQRLRDQQRGMEEELQAMDRRLRAAESRPGQMMAFLAKLADEPGVVLRAMLAKKEELALAGKGSTTPAPGKRRRIGAEAGVGDVADMAQSRGAVPFPFSVLGQVFY

SEQ ID NO: 16914 - DNA, 1449 bp, Sorghum bicolor
  misc_feature: Ceres ANNOT ID no. 8668556
  misc_feature: Encodes the peptide sequence at SEQ ID NO 16915
atggacagcgtagtagtatccgcgaagcagaccgtcgttctgtaccccggcggcggcgccgggcacgtcgggccgatgacgcagctcgccaaggtcttcctccaccacggctacgacgtcaccatggtgctcctggagccgcctgtcaagtcgatcgcctccagctctggcttcatcgagggcctcgccgccgccaacccgtccatcaccttccacctcctcccgccggtcccgccccctgacttcgccagcgccaccaagcactctttcctcttcatgatggagctgctgggccagtacaacgacaagctcgagagcttcctccgctccatcccgcgggagcgcctgcactccctcgtcatcgacatgttctgcaccgacgccatcgacgtggccgcaaaggtgggcgtccccgtctacacgttcttcgcggcgagcgccggagctctgtccgtcctaacccagacggcggcgctgcttgccggtcggaaaacgggcctgaaggagctcggggacacgcccatcgagttcctcggcgtcccgccgatgccggcgtcccatatcctcagggacatgctcgaggacccggaggacgaggtgtgcaaggccatggcggagatctggaagcgcaacaccgacacccggggcgtcctgatcaacaccttctactcactggagtccccggccctgcaggcgttcagcgacccgctgtgcgtccccggcaaagtgttgcctcctgtctactccatcgggccgttggttggcgagggcgggacgcacggaggcgaaggagagaggcacgagtgcctcgcctggctcgacgcacagccggagcgcagcgtcgtgttcctctgctgggggagcaggggcttgctctccggggaacagctcaaggatatcgccgctggcctagacaagtccgggcaacggttcctgtgggtggtgcgcacgccggccagcgacccgaaacgacgctttgagccacggccggagccggaccttggcgccctcctgccggaggggttcttggagcggaccagggaccgcggcctcgtgctcaagtcgtgggcaccgcaggtggatgtgctccacaacccagctattggcgcgtttgtcacccactgcgggtggaactcggcgcttgaggccatcacagcgggggtgccgatgctgtgctggccactggacgcagagcagaagaccaacaaggtactcatgacggaggccatgggcatcgggctggagctggaggggtacaacacaggtttcatcaaggctgaggagattgagacgaaggtgaggcttatgctggagtccgaggaggggagggagattaggacgcgagcggcagagctcaagaaagaagcacacgaggcgttggaggatgggggatcgtcacaggcggcatttctccagttcttatctgatgttaagaatattagtgagtag

SEQ ID NO: 16915 - protein, 482 aa, Sorghum bicolor
  misc_feature: Useful for making plants with altered carbohydrate content
  misc_feature: Functional homolog of the protein sequence given in SEQ ID NO 14187
  misc_feature: Ceres ANNOT ID no. 8668556
  misc_feature (12)..(479): SWISSPROT Homolog: EC 2.4.1.218 Hydroquinone glucosyltransferase
  misc_feature (10)..(481): Pfam ID: UDPGT Pfam Description: UDP-glucoronosyl and UDP-glucosyl transferase
MDSVVVSAKQTVVLYPGGGAGHVGPMTQLAKVFLHHGYDVTMVLLEPPVKSIASSSGFIEGLAAANPSITFHLLPPVPPPDFASATKHSFLFMMELLGQYNDKLESFLRSIPRERLHSLVIDMFCTDAIDVAAKVGVPVYTFFAASAGALSVLTQTAALLAGRKTGLKELGDTPIEFLGVPPMPASHILRDMLEDPEDEVCKAMAEIWKRNTDTRGVLINTFYSLESPALQAFSDPLCVPGKVLPPVYSIGPLVGEGGTHGGEGERHECLAWLDAQPERSVVFLCWGSRGLLSGEQLKDIAAGLDKSGQRFLWVVRTPASDPKRRFEPRPEPDLGALLPEGFLERTRDRGLVLKSWAPQVDVLHNPAIGAFVTHCGWNSALEAITAGVPMLCWPLDAEQKTNKVLMTEAMGIGLELEGYNTGFIKAEEIETKVRLMLESEEGREIRTRAAELKKEAHEALEDGGSSQAAFLQFLSDVKNISE

SEQ ID NO: 16916 - DNA, 1392 bp, Sorghum bicolor
  misc_feature: Ceres ANNOT ID no. 8668562
  misc_feature: Encodes the peptide sequence at SEQ ID NO 16917
atgacggagaagacggtggtgctgtacccctccctgggcgtgggccatctgaaccccatggcgcagctggccaaggccatcctccgccacggcggcgtcgccgtcaccatcgccgtcgtcgacccgcccgagaagcacgccgtgctggctgctgcgctggcccgcctggccgtggtcagtccctccatcacggtccacctcctccccatcccgccctgcgccagcagcaaccagcattcccaccccattaagcccatcctggatgcgctccgcgccgcgaaccccgcgctgcgggcgttcctcgcgtcgcgggtccccgccgtcgacgccctcgtggtcgacatgttctgcaccgacgcgctcgacgtcgccgcggagctcgggatccccgcctacttcttctacccgtccgcggccggcgacctcgcggtgtacctccagattccagatctcttccgcgccgtgccgccctcgcccaaggacatgggcaaggcggtgctgaacttcgccggcgtgccggcagtccgcgctctcgacatgcctgacaccatgcaggactgggagagcgacgtgggcagcgtacgcctgcggcagctcgcccggatgcccgaagctgcaggcgttctggtgaacagcttcgagtggctggagtcgagggcactgaaagcgctgcgtgacggcgactgcctgcccggccgctcgacgccgaaaatctactgcgtcggtcccctggtcgacggtggcgacgccgagggaaacggcgagaggcacgcgtgcctcgagtggatggacgggcagcccaggcagagcgtggtgttcctctgcttcggaagcctgggcgccttcccggcggcgcagctgaaggagacggcgcgcgggctagagcgttgcggacacaggttcctgtgggccgtgcgaagtcgggagcagagctctcgcgagcctgatctggaagcgctgcttccggacgggttcttggagagaaccagaggcagaggactggtgctgaagaactgggcgccacagacacaggtgctgcggcacgaggccgtgggagccttcgtcactcactgcgggtggaactcggtgctggaggctgtcatgtccggcgtgccgatgatctgctggccgctgtacgcggagcagagactgaacaaggtgcacgtggtggaggagatgaagcttggggtggtgatggaaggctatgaggaggagacggtgacggccgacgaggtggaggccaaggtacggctggtgatggagtcggaggaagggaagaagctcagagagaggacggcgatggccaaggaaatggctgccgatgccatgaaagaaagcgggtcgtctcacgtcgaacttggtgagtttctaaggggtttaggatccaagtga

SEQ ID NO: 16917 - protein, 463 aa, Sorghum bicolor
  misc_feature: Useful for making plants with altered carbohydrate content
  misc_feature: Functional homolog of the protein sequence given in SEQ ID NO 14447
  misc_feature: Ceres ANNOT ID no. 8668562
  misc_feature (6)..(455): SWISSPROT Homolog: EC 2.4.1.218 Hydroquinone glucosyltransferase
  misc_feature (5)..(463): Pfam ID: UDPGT Pfam Description: UDP-glucoronosyl and UDP-glucosyl transferase
MTEKTVVLYPSLGVGHLNPMAQLAKAILRHGGVAVTIAVVDPPEKHAVLAAALARLAVVSPSITVHLLPIPPCASSNQHSHPIKPILDALRAANPALRAFLASRVPAVDALVVDMFCTDALDVAAELGIPAYFFYPSAAGDLAVYLQIPDLFRAVPPSPKDMGKAVLNFAGVPAVRALDMPDTMQDWESDVGSVRLRQLARMPEAAGVLVNSFEWLESRALKALRDGDCLPGRSTPKIYCVGPLVDGGDAEGNGERHACLEWMDGQPRQSVVFLCFGSLGAFPAAQLKETARGLERCGHRFLWAVRSREQSSREPDLEALLPDGFLERTRGRGLVLKNWAPQTQVLRHEAVGAFVTHCGWNSVLEAVMSGVPMICWPLYAEQRLNKVHVVEEMKLGVVMEGYEEETVTADEVEAKVRLVMESEEGKKLRERTAMAKEMAADAMKESGSSHVELGEFLRGLGSK

SEQ ID NO: 16918 - DNA, 1422 bp, Sorghum bicolor
  misc_feature: Ceres ANNOT ID no. 8668560
  misc_feature: Encodes the peptide sequence at SEQ ID NO 16919
atggcgcagaagaccgtgatcctctacccttcgctgggagtcggccatctgaaccccatggtggagctggccaaggtcttcctccgccgtggcctagccgtcatcatcgccgtcgtcgacatgcccgacaaggactccgtgtcggccgaggcgctggaccgcctcgccgccgccaacccggacatcgcgttccgcctcctccctgtcccgtcctgcggcacgagaccttactctcacccggtcatgcgcgccatcgacgtgctccgcgtcgccaaccccgtgctcctgggcttcctgcgcgcgctccccgctgtcgacgccatcgtgctcgacatgttctgcacggacgcgctcgacgtcgccgccgagctcaacaccccggcgtacttcttcttctcctccgcgctagccgacctcgccatcatgctccacatgccgtactactaccccaccgcgccgtcctcgttcaaggacatgcccgacaccgtgctgcacttccctggcgtgccaccgatccgcgcgctcgacatgggcgcgacgatgcaggaccgggacagcgacgtcgccaaggcacgcctctcccagtgcgcgcgcatgctcgaagcgaggggcattctcgtgaacagcttcgactggctggaggcacgggccctggaagcgctcagccgtggcctctgcacgccggggcgctcggctccaccagtccactgcatcgggccgctggtccttcccggaaacaggggaggggccagcgagaggcacgcgtgtctggaatggctggacgcccagccggaccagagcgttgttttcctcagcttcggcagcctggggacgttctcagcgccgcagctgagagagatagcgcgtgggctggagagctccgggcagaggttcctgtgggtcgttcggaacccgcctgagcaccggagcaactccggcgagccggacctggtcctggagccgtcgttgctccccgagggtttcttggagcgtactagggaaaggggcttcgtggtgaagaactgggcgccgcagagcgaggtgctgcggcaccggtccatcggcgcgttcgtgacgcattgcgggtggaactcggtgctagagggcatcgcgtctggcgtgccgatgatctgctggccgctatacgcggagcagaagatgaataaggtgcacatggtggaggagattaaggttggcgtggtgatggaggggtacgaggaggagctggtaaaggcggaggaggtggaagcaaaggtgaggctggtcatgtccggcgacggggaggagcttaggcagaggctcttgacggccaaggagatgactgtagaggttctcaaggaaggtggctcatctgacgtggcgtttgacaagttcttgacggacttgatgaagaacacctgtacggagaatagtgccttgtga

SEQ ID NO: 16919 - protein, 473 aa, Sorghum bicolor
  misc_feature: Useful for making plants with altered carbohydrate content
  misc_feature: Functional homolog of the protein sequence given in SEQ ID NO 14447
  misc_feature: Ceres ANNOT ID no. 8668560
  misc_feature (6)..(454): SWISSPROT Homolog: EC 2.4.1.218 Hydroquinone glucosyltransferase
  misc_feature (5)..(466): Pfam ID: UDPGT Pfam Description: UDP-glucoronosyl and UDP-glucosyl transferase
MAQKTVILYPSLGVGHLNPMVELAKVFLRRGLAVIIAVVDMPDKDSVSAEALDRLAAANPDIAFRLLPVPSCGTRPYSHPVMRAIDVLRVANPVLLGFLRALPAVDAIVLDMFCTDALDVAAELNTPAYFFFSSALADLAIMLHMPYYYPTAPSSFKDMPDTVLHFPGVPPIRALDMGATMQDRDSDVAKARLSQCARMLEARGILVNSFDWLEARALEALSRGLCTPGRSAPPVHCIGPLVLPGNRGGASERHACLEWLDAQPDQSVVFLSFGSLGTFSAPQLREIARGLESSGQRFLWVVRNPPEHRSNSGEPDLVLEPSLLPEGFLERTRERGFVVKNWAPQSEVLRHRSIGAFVTHCGWNSVLEGIASGVPMICWPLYAEQKMNKVHMVEEIKVGVVMEGYEEELVKAEEVEAKVRLVMSGDGEELRQRLLTAKEMTVEVLKEGGSSDVAFDKFLTDLMKNTCTENSAL

SEQ ID NO: 16920 - DNA, 741 bp, Sorghum bicolor
  misc_feature: Ceres ANNOT ID no. 8668552
  misc_feature: Encodes the peptide sequence at SEQ ID NO 16921
atggagaaccagcatctccaaggagacgagtcgtcgtcgtcgcacgcgctccccagcttcccctacttcgccgtgccgtcgccgccgtatgcgccgccgccgccatcggaggaccagcacagtaccctcatcacagcgctccagcagcaaccgtcgtcgtcggcgtgcaataacgacgaccttcctcctctgggtctggggcctgatcagctagcggcggtggcggcgccgatgattctcccgccaatggtggactggtcggcgctgctccagcaggccagcttgatggggccccagctcgtgccgggactactgcagcaagtaccgcccctggagccgttggaccagagcggggagaacgacggcggcgacgcagggagtagcagtagtagcaaggagaaggtggtggcgaagggcggcggcggcgcggggaggtctgggaagaagaaggcgagcaggccgcggttcgcgttccagacgaggagcgtcaacgacatcctggacgacggctaccggtggaggaagtacgggcagaaggccgtcaagaacagcgagcaccccaggagctactaccggtgcacccaccatacgtgcaatgtgaagaaacaggtgcagcgcctggccaaggacacgagcatcgtggtcactacttacgagggcgtccataaccacccctgcgagaagctcatggaagcgctcagccccatcctcaagcagctccagttcctctcgcagttctaa

SEQ ID NO: 16921 - protein, 246 aa, Sorghum bicolor
  misc_feature: The sequence is a functional homolog of SEQ ID NO 114 in the 11/375,241 US patent application
  misc_feature: The sequence is a functional homolog of SEQ ID NO 146 in the 10/286,264 US patent application
  misc_feature: The sequence is a functional homolog of SEQ ID NO 2500 in the 10/374,780 US patent application
  misc_feature: The sequence is a functional homolog of SEQ ID NO 672 in the 10/412,699 US patent application
  misc_feature: The sequence is a functional homolog of SEQ ID NO 86 in the 10/412,699 US patent application
  misc_feature: Ceres ANNOT ID no. 8668552
  misc_feature (167)..(226): Pfam ID: WRKY Pfam Description: WRKY DNA -binding domain
MENQHLQGDESSSSHALPSFPYFAVPSPPYAPPPPSEDQHSTLITALQQQPSSSACNNDDLPPLGLGPDQLAAVAAPMILPPMVDWSALLQQASLMGPQLVPGLLQQVPPLEPLDQSGENDGGDAGSSSSSKEKVVAKGGGGAGRSGKKKASRPRFAFQTRSVNDILDDGYRWRKYGQKAVKNSEHPRSYYRCTHHTCNVKKQVQRLAKDTSIVVTTYEGVHNHPCEKLMEALSPILKQLQFLSQF

SEQ ID NO: 16922 - DNA, 1392 bp, Sorghum bicolor
  misc_feature: Ceres ANNOT ID no. 8668606
  misc_feature: Encodes the peptide sequence at SEQ ID NO 16923
atggagaagcagatgaagaccgtggtcctctacccttcgctgggcgtgggccatcttaaccccatggttgagctgggcaaggtcttcctgcgcagtcgcttgtctgtcatcatcgccgtcgtcgactcgcccgacgccatgggccgcctcgccaccgccaacccggacatcacgttccgtcacctcccagtccctcccaccggcaaggacaagtactcgcaccctatcatgcgtaccatcgacgtgcttcgcgtcgccaaccccgcgctccggagcttcctgcgcacgctcccggccatcgacgccgtcgtggtcgacatgttctgcaccgacgccctcgacgtcgcggccgagctcgacatccccgcctacttcttcttcacatccccgctcggccacctcgccgtcaacgtccacctcccgtacaacttccccgcggtctcactgaaagacatgcccgagaccatgctgcacttccccggggtgccgccgatccgcgcgatggacatggtgaccacggtgcaggacagggagagcgacatcaccagagcacggctgcgccagtgcgcgcgcatgcctgaagtgagaggctttctcgtgaacagcttcgactggttggaagcacgggcgctgaaagcgctcaggtctgggctctgcacgcccggccgctcaacgccgcctgtctactgcattgggccgctggtaccgcccgggaacacgggaggaagcagggagaggcacgcctgcctcgagtggctggacacgcagccgaaccggagcgtggtgttgctcagcttcggcagcatgggcatcttctcggagccgcagttgagagagatggcacgcgggctagagagttcggggcacaggttcctgtgggtcgtgcggaacccacctgagcaccagagcagcaaatcaatcgagccggatctggaggcgttgcttccggatggtttcttggagcggactagggagaagggcttggtggtgaagaactgggcgccgcagatggaggtgctgcggcacgacgccgtcggcgcgttcatcacgcattgcgggtggaactcggcgttggaggggatcgtgtccggcgtgccgatgatctgctggccgctgtactcggagcagaggatgaacaaggtgcacatggtcgaggagatgaaggttggagtggcggttcaaggctacgagaaggaactggtggaggcagaccaagtggaagcaaaggtgaggctggtcatggagtccgatgaagggaagaagcttaggaagaggctcgcgatggcaaagaagatggccgctgacgctctcaaggaaggtgggtcgtcatacatggggctcgagaagttcttggaaggcctgaagaagagcagcccggagctgaaggcataa

SEQ ID NO: 16923 - protein, 463 aa, Sorghum bicolor
  misc_feature: Useful for making plants with altered carbohydrate content
  misc_feature: Functional homolog of the protein sequence given in SEQ ID NO 14447
  misc_feature: Ceres ANNOT ID no. 8668606
  misc_feature (8)..(447): SWISSPROT Homolog: EC 2.4.1.218 Hydroquinone glucosyltransferase
  misc_feature (7)..(458): Pfam ID: UDPGT Pfam Description: UDP-glucoronosyl and UDP-glucosyl transferase
MEKQMKTVVLYPSLGVGHLNPMVELGKVFLRSRLSVIIAVVDSPDAMGRLATANPDITFRHLPVPPTGKDKYSHPIMRTIDVLRVANPALRSFLRTLPAIDAVVVDMFCTDALDVAAELDIPAYFFFTSPLGHLAVNVHLPYNFPAVSLKDMPETMLHFPGVPPIRAMDMVTTVQDRESDITRARLRQCARMPEVRGFLVNSFDWLEARALKALRSGLCTPGRSTPPVYCIGPLVPPGNTGGSRERHACLEWLDTQPNRSVVLLSFGSMGIFSEPQLREMARGLESSGHRFLWVVRNPPEHQSSKSIEPDLEALLPDGFLERTREKGLVVKNWAPQMEVLRHDAVGAFITHCGWNSALEGIVSGVPMICWPLYSEQRMNKVHMVEEMKVGVAVQGYEKELVEADQVEAKVRLVMESDEGKKLRKRLAMAKKMAADALKEGGSSYMGLEKFLEGLKKSSPELKA

SEQ ID NO: 16924 - DNA, 1365 bp, Sorghum bicolor
  misc_feature: Ceres ANNOT ID no. 8668584
  misc_feature: Encodes the peptide sequence at SEQ ID NO 16925
atgccgcagcacaaagctcgcaaccgaaaccgcaggccgctgcagcactcgagagcgcagccaagcggcggcgccgcgcctccgactccgccccaggccgctgcgtccatggacccctcccagcagtcggcacctcccaccggggacgacccggcggcggcggatcccgagctcccgaggctcacggtgacgcaggtggagcagatgaaggtggaggccagggttggcgacatctaccgcgccctctccggggccgcgcccaacacgaaatccatcatgctagaactgtggcgtgatcaacatatcgagtatctgacgcgtgggttgaggcatctcgggccagcctttcatgttctagatgccaatcgcccttggctgtgctactggatggttcatccacttgctttgctggatgaagcacttgatgataaccttgaggatgatatcatagacttcttggctcgatgtcaggataaagatggtggatatagtggtggacctggacagttgcctcacctagctacgacttatgctgccgtcaatacacttgtgacaatagggagtgaaagagcactgtcatcaatcaataggggcaacctgtacaagtttatgcttcggatgaaagatgtatcaggtgctttcagaatgcatgatggtggtgaaattgatgtccgtgcttcctacactgctatatcggttgccagccttgtgaatattcttgatgttgaactggcaaaaggcgttggcgactacatagcaagttgccaaacttatgaaggcggtattgctggggagccttatgccgaagcacatggagtggaatgcggatttcaaggacgaactaataaattggttgacggttgttactccttttggcagggagctgccattgctttaacacaaaagttacttacgattgttgataagcaattgaagtcctcgtattcctgcaaaaggccatcaggaggggatgcctgcagcaccagttcatatgggtgcactgccaaaaacttttcctctgctgtagattatgcaaaggttggatttgattttatacaacagagcaaccaaattggcccgctcttccataacattgccctgcaacaatacatcctactttgttctcaggtactagagggaggcttcagggataagcctggaaagaacagagatcactatcattcatgctactgcctcagtggtctctcagtttgccagtacagtgccctgactgatgcggattcgtgcccattacctcagcatgtgcttggaccctactctaatttgctggagccaatccatccactctacaatgttgtcctggataaataccatacagcctatgacttcttttcaaaagagtga

SEQ ID NO: 16925 - protein, 454 aa, Sorghum bicolor
  misc_feature: The sequence is a functional homolog of SEQ ID NO 12 in US patent 7109391
  misc_feature: Ceres ANNOT ID no. 8668584
  misc_feature (272)..(453): SWISSPROT Homolog: EC 2.5.1.58 Protein farnesyltransferase
  misc_feature (82)..(274): SWISSPROT Homolog: EC 2.5.1.60 Protein geranylgeranyltransferase type II
  misc_feature (144)..(187): Pfam ID: Prenyltrans Pfam Description: Prenyltransferase and squalene oxidase repeat
  misc_feature (362)..(406): Pfam ID: Prenyltrans Pfam Description: Prenyltransferase and squalene oxidase repeat
  misc_feature (243)..(301): Pfam ID: Prenyltrans Pfam Description: Prenyltransferase and squalene oxidase repeat
  misc_feature (195)..(238): Pfam ID: Prenyltrans Pfam Description: Prenyltransferase and squalene oxidase repeat
MPQHKARNRNRRPLQHSRAQPSGGAAPPTPPQAAASMDPSQQSAPPTGDDPAAADPELPRLTVTQVEQMKVEARVGDIYRALSGAAPNTKSIMLELWRDQHIEYLTRGLRHLGPAFHVLDANRPWLCYWMVHPLALLDEALDDNLEDDIIDFLARCQDKDGGYSGGPGQLPHLATTYAAVNTLVTIGSERALSSINRGNLYKFMLRMKDVSGAFRMHDGGEIDVRASYTAISVASLVNILDVELAKGVGDYIASCQTYEGGIAGEPYAEAHGVECGFQGRTNKLVDGCYSFWQGAAIALTQKLLTIVDKQLKSSYSCKRPSGGDACSTSSYGCTAKNFSSAVDYAKVGFDFIQQSNQIGPLFHNIALQQYILLCSQVLEGGFRDKPGKNRDHYHSCYCLSGLSVCQYSALTDADSCPLPQHVLGPYSNLLEPIHPLYNVVLDKYHTAYDFFSKE

SEQ ID NO: 16926 - DNA, 1542 bp, Sorghum bicolor
  misc_feature: Ceres ANNOT ID no. 8668602
  misc_feature: Encodes the peptide sequence at SEQ ID NO 16927
atggcggggcggcttatgctggcggcgctccctattctcctcttcttattgctcgtcgggcaatgccacggcggcaagattggcgtctgctacggccgcaacgccgacgacctgccggcgccggacaaggtggcgcagctaatccagcagcaatccatcaagtacgtgcgcatctacgacaccaacatcgacgtcatcaaggccttcgccaacaccggcgtcgagctcatggtcggcgtccccaactccgacctcctcgccttcgcgcagtaccagtccaacgtcgacacatggctcaagaacagcattctcccctactacccggccaccatgatcacctacatcaccgtcggcgccgaggtcaccgagagccccaccaacgtctccgccctcgtcgtgcctgccatgcgcaatgtgcacaccgcactcaagaaggccggcctgcacaagaagatcaccatctccagcacccactcgctcgggatactgtcacggtcgttcccgccgtctgctggggcgttcaacagcagctacgcctacttcttgaagcctatgctcgagttccttgtggagaatcaggcgccgttcatggtggatttatacccctactatgcgtaccagaactcaccgagcaatgtgtccctcaactacgccctgttctcgccacagtctcaggatgtgattgacccaaacactggactggtttacactaacatgtttgatgcccaggttgattccatcttctttgcgctcatggctctgaacttcaaaactctgaagatcatgatcactgagtcagggtggccaaacaaaggggcggccaaggagactggagccactccagacaatgctcagacttacaataccaatttgatacgccatgttgttaatgacagtggcacgcctgcgaaaccaggggaagaaattgatgtctacatattttcattgttcaatgagaacaggaaacctggcattgagtcggagaggaactggggactgttttttcctgataagagctctatctacagccttgattggacgggccgaggcaatgtggatgttatgactggagcaaacattacaagtgcaaatggtacctggtgtattgcttcagctaatgcatcagaaacagatctgcagaatgccctcaactgggcatgtggtccaggcaacgtagattgctctgccattcaaccaagccaaccctgctaccagccggacactttagcttcccatgcttcatatgcattcaatagctactaccagcaaaatggagccaacgttgtggcctgtgacttcagtggtgcgggaatacgaacgacgaaagatccaagtaagaatcccatccttgttactgttttgatgatcatgatgctatgcatggtttcatttgatgacatccatgtgcatatattcaagttgtggagcatgtctttagttgatgttgcagttatatacataagctgctcatataatctgatggttgtagcatttactagtattccatccattccaaattgtaagatgctttggctttactag

SEQ ID NO: 16927 - protein, 513 aa, Sorghum bicolor
  misc_feature: Useful for making plants with altered cell wall content and/or composition
  misc_feature: Functional homolog of the protein sequence given in SEQ ID NO 14448
  misc_feature: Useful for making plants with modulated drought sensitivity
  misc_feature: Useful for making plants with modulated water use efficiency
  misc_feature: Functional homolog of the protein sequence given in SEQ ID NO 13472
  misc_feature: Ceres ANNOT ID no. 8668602
  misc_feature (27)..(445): SWISSPROT Homolog: EC 3.2.1.39 Glucan endo-1,3-beta-D-glucosidase
  misc_feature (27)..(346): Pfam ID: Glyco_hydro_17 Pfam Description: Glycosyl hydrolases family 17
  misc_feature (366)..(448): Pfam ID: X8 Pfam Description: X8 domain
MAGRLMLAALPILLFLLLVGQCHGGKIGVCYGRNADDLPAPDKVAQLIQQQSIKYVRIYDTNIDVIKAFANTGVELMVGVPNSDLLAFAQYQSNVDTWLKNSILPYYPATMITYITVGAEVTESPTNVSALVVPAMRNVHTALKKAGLHKKITISSTHSLGILSRSFPPSAGAFNSSYAYFLKPMLEFLVENQAPFMVDLYPYYAYQNSPSNVSLNYALFSPQSQDVIDPNTGLVYTNMFDAQVDSIFFALMALNFKTLKIMITESGWPNKGAAKETGATPDNAQTYNTNLIRHVVNDSGTPAKPGEEIDVYIFSLFNENRKPGIESERNWGLFFPDKSSIYSLDWTGRGNVDVMTGANITSANGTWCIASANASETDLQNALNWACGPGNVDCSAIQPSQPCYQPDTLASHASYAFNSYYQQNGANVVACDFSGAGIRTTKDPSKNPILVTVLMIMMLCMVSFDDIHVHIFKLWSMSLVDVAVIYISCSYNLMVVAFTSIPSIPNCKMLWLY

SEQ ID NO: 16928 - DNA, 1185 bp, Sorghum bicolor
  misc_feature: Ceres ANNOT ID no. 8668633
  misc_feature: Encodes the peptide sequence at SEQ ID NO 16929
atgggcatgcgacgagcacgattcttggcctgcattgccatggcggccatcgtgctcctcgcgccgccgtcgacgtgcggagtggcggggcactcgcgggggctgcggcctgggcgcagcgccggcgccggtggcgcgggggatccgccgccgctgttcccggtgaacgcgacgcgcgcggagatgatcgagcggcagttcatggagtgggtgcggtacatgggcggcctccggcacagcacgttccagcacgcgctggcccgcgcgttcccctcctactcgctcgtcgtcgacaagaacccggcgttcggcgacttcacgaccatccaggccgccatcgactcgctcccggtcatcaacctcgtccgcgtcgtcatcagggtcaacgccggcacctacacggagaaggtgagcatctcggcgatgcgcgcgttcatcaccctggagggcgccggcgcggacagcacgatcgtgcagtggggcgacaccgcggactcgccgacggggcccaagggacggcccctcggcacgttcaactccgcgaccttcgccgtgaacgcgcagtacttcctcgcaaggaacatcacgttcaagaacacgtcgccggtgccgaagccgggggcgacggggaagcaggcggtggcgctgcgggtgtcggcggacaacgcggcgttcgtggggtgcaagttcctgggcgcgcaggacacgctgtatgaccactcgggtcgccactactacaaggagtgctacatcgaagggtccgtggacttcatcttcggcaacgcgctgtcgctgtacgaggactgccacgtgcacgcgatcgcgcgggactacggggcgctgacggcgcagaaccggcagagcatgctggaggacacggggttctccttcgtcaactgccgggtgacggggtccggcgcgctctacctgggccgcgcctggggcaccttctcccgcgtcgtcttcgcctacacctacatggacaacatcatcatccccaacgggtggtacaactggggcgaccccaaccgcgagctgacggtgttctacgggcagtacaagtgcacgggccccggcgcgagctacgccggccgggtggcgtggtcgcacgagctcactgacgacgaggccaagcccttcatctcgctgagcttcatcgacggcaccgagtggatcaggctgtaa

SEQ ID NO: 16929 - protein, 394 aa, Sorghum bicolor
  misc_feature: Useful for making plants with altered carbohydrate content
  misc_feature: Functional homolog of the protein sequence given in SEQ ID NO 14449
  misc_feature: Useful for making plants with altered cell wall content and/or composition
  misc_feature: Functional homolog of the protein sequence given in SEQ ID NO 14450
  misc_feature: Ceres ANNOT ID no. 8668633
  misc_feature (86)..(392): SWISSPROT Homolog: EC 3.1.1.11 Pectinesterase
  misc_feature (94)..(389): Pfam ID: Pectinesterase Pfam Description: Pectinesterase
MGMRRARFLACIAMAAIVLLAPPSTCGVAGHSRGLRPGRSAGAGGAGDPPPLFPVNATRAEMIERQFMEWVRYMGGLRHSTFQHALARAFPSYSLVVDKNPAFGDFTTIQAAIDSLPVINLVRVVIRVNAGTYTEKVSISAMRAFITLEGAGADSTIVQWGDTADSPTGPKGRPLGTFNSATFAVNAQYFLARNITFKNTSPVPKPGATGKQAVALRVSADNAAFVGCKFLGAQDTLYDHSGRHYYKECYIEGSVDFIFGNALSLYEDCHVHAIARDYGALTAQNRQSMLEDTGFSFVNCRVTGSGALYLGRAWGTFSRVVFAYTYMDNIIIPNGWYNWGDPNRELTVFYGQYKCTGPGASYAGRVAWSHELTDDEAKPFISLSFIDGTEWIRL

SEQ ID NO: 16930 - DNA, 1239 bp, Sorghum bicolor
  misc_feature: Ceres ANNOT ID no. 8668650
  misc_feature: Encodes the peptide sequence at SEQ ID NO 16931
atggaggcggcagcgtcgtcagccgagtacgggtactacggcggaggcgcggcgggcccacgcgagaggaagacgaccgcggcggcggggtgcggggaccacttcgtcgtggacgacctcctcgcgctgccgtacgacgacgacgacgaggaggaaggcggcggggaggcggcgccggcaggcgacggcggcgaggccccgccgccgtgcctgcagcctgctgtcgacgcccgccacggagtcgtaggcctcgtcaaggaggagcgcggcggcggcggcctcgggaatttctccgccgactcgtccaccgtcacggccctggacagctgcagcaactccttctctgggctagccgacggcgacttcccgggggaattctgcgagccgtacgatcaattggcggagctggaatggctatccaactacatgggtgagggcgaggaaagtttcgccgcggaggacctcgagaagctgaagctcatttccggcgggttctccccggctctgccaccagctcacgtggccccagcggccgcagcttcagccgccgccgcctcggcggcacagcccggtatgttcctcccggaggcgccggtccccgcaaaggcccgtagcaagcgctcccgcgcggctccgggcaactggtcgtcgcggttgctcgtgctcccgccgaccccggcctcaccaccgtccccggcgtccatggccgccatctcgccggcggagtccggcatctcggcgcaggcgttccccgccaggaagccgtcgaagaagaaagacgcggtgccagcaccgccctcgagcgtgtccgcggtggcacagcccggcggctcggccgcgtcgacagaagggcgacggtgcctgcactgcgagacggacaggacgccgcagtggaggacggggccgatgggccccaagacgctgtgcaacgcgtgcggggtgcggtacaagtcagggcggctggtgccggagtaccggcccgcggcgagccccaccttcgtgatgtccaagcactccaactcgcaccggaaggtgctggagctgcgccgccagaaggaggtggtgcagcagccgcacccgcacgtgatcgccggcggcgggggccctgctggcgggctgatgcgcatgcagagcacgatgctgttcgacgggccgtcggcgccccccattgtcgctgccggcgacgactttttgatccaccaccacttagggacagcagactaccggcagctcatctag

SEQ ID NO: 16931 - protein, 412 aa, Sorghum bicolor
  misc_feature: The sequence is a functional homolog of SEQ ID NO 1657 in the 10/374,780 US patent application
  misc_feature: The sequence is a functional homolog of SEQ ID NO 1655 in the 10/374,780 US patent application
  misc_feature: Ceres ANNOT ID no. 8668650
  misc_feature (287)..(322): Pfam ID: GATA Pfam Description: GATA zinc finger
MEAAASSAEYGYYGGGAAGPRERKTTAAAGCGDHFVVDDLLALPYDDDDEEEGGGEAAPAGDGGEAPPPCLQPAVDARHGVVGLVKEERGGGGLGNFSADSSTVTALDSCSNSFSGLADGDFPGEFCEPYDQLAELEWLSNYMGEGEESFAAEDLEKLKLISGGFSPALPPAHVAPAAAASAAAASAAQPGMFLPEAPVPAKARSKRSRAAPGNWSSRLLVLPPTPASPPSPASMAAISPAESGISAQAFPARKPSKKKDAVPAPPSSVSAVAQPGGSAASTEGRRCLHCETDRTPQWRTGPMGPKTLCNACGVRYKSGRLVPEYRPAASPTFVMSKHSNSHRKVLELRRQKEVVQQPHPHVIAGGGGPAGGLMRMQSTMLFDGPSAPPIVAAGDDFLIHHHLGTADYRQLI

SEQ ID NO: 16932 - DNA, 2082 bp, Sorghum bicolor
  misc_feature: Ceres ANNOT ID no. 8668655
  misc_feature: Encodes the peptide sequence at SEQ ID NO 16933
atggcgcggttcttgtcaaagaatggcatatatgaattctggaactggtttgatgaccgaacatggtatcctcttgggcgtgttattggcggcactgtttatcctggtttgacacttactgctggtacaatatggtggctgctgaattccctgaacatcccattgtcagtggagactgtctgtgtcttcactgctccaattttctcagtcaatgcgtcctgggcaacttacctattaaccaaggaaacaaaggaccctggggctggtttgatggcagcaactattctagcaatggtcccatcatacatctcaagatctgttgctggcagctacgataatgaagctgtagctatatttgctttaatattcacgttctatctatatgtaaagacactaaacactggatcactcttttatgcgacgcttaatgctctctcgtacttctacatggtttgttcttggggaggctacacattcatcatcaatcttatcccgatgcatgttctcttgtgtattgtgactggtcgttactcttcacgactttatattgcttatgctccccttattgtgcttggaacacttctagcagcattggtacctgttgttggttttaatgcagtaatgacgtcagagcactttgcatcatttctggtgtttataatcctccatgtggttgctctgggttattacatcaaaggacttttaactcctcgactgttcaaagtggccatgacatttgttattacagttggattggctgtttgttttgctgttgcagcaatactcgttgcattgattgcatctagcccaacaaaaggctggagtggtcgcagtttgagtctgctggatccaacctatgcaagcaagtacatccctataattgctagtgtgagcgaacaccaaccaccaacctggccttcttattttatggatatcaatgtgctggccttcttagttcctgctgggatcatatcatgcttcttaccgttatctgatgcaagctcatttttggtcctgtacttggtaacctcagtgtatttctctggagtaatggttcgacttatgctggtccttgctcctgctgcatgcattttgtctgggattgctctgtctgaagcttttggtgtccttacaagatcaatgaaatttcagcgtccaacactggacgatggatcttctacagcaggggatgggagttctgatactcctaccaactcagaaatggtttcgaaggaaaaaccatccaagaaaaatcggaagaaagacagagactcagagggaagttcacctgttgatcatagaactgaagaaaagcttttagtactgccttgtgggccatctgctgtgggcataatgctgctgatcatactttctggtttttacgtagtccattgtgtgtgggctgctgcagaagcatattccgcaccttcaattgtgctaacatctcgttcacatgatgggtttcatgtttttgatgatttccgtgaagcttatggatggctgcgccataacacagatgtagatgataaggttgcatcttggtgggactatggttatcagacaactgcaatggcaaacagaactgttattgtggacaataatacatggaataacacacacatagcaacagttgggactgcaatggcatccccagaaaaagcagcatgggagatcttcaattccttagatgtcaaatatgtgctcgttatctttggagggcttattggctacccaagtgatgatattaataagttcctctggatggttcgaatcggaggtggtgtattccctcaaataaaggaagcagattaccttaaggatggcaactaccgcgttgatgctcatggcaccccaaccatgttgaattccctcatgtacaagctttgctattacaggttcgttgaaactgatggtaagggctatgatagagtgagaagatatgaaatagggaagaagcattttaaactcacacattttgaggaggttttcacaacccatcattggatggttcggatttacaaactgaaacctcagaagaacagagtcagagggaaactgaaatttaaatctgaacctgattga

SEQ ID NO: 16933 - protein, 693 aa, Sorghum bicolor
  misc_feature: Useful for making plants with altered carbohydrate content
  misc_feature: Functional homolog of the protein sequence given in SEQ ID NO 13886
  misc_feature: Ceres ANNOT ID no. 8668655
  misc_feature (3)..(386): SWISSPROT Homolog: EC 2.4.1.119 Dolichyl-diphosphooligosaccharide--protein glycotransferase
  misc_feature (1)..(638): Pfam ID: STT3 Pfam Description: Oligosaccharyl transferase STT3 subunit
MARFLSKNGIYEFWNWFDDRTWYPLGRVIGGTVYPGLTLTAGTIWWLLNSLNIPLSVETVCVFTAPIFSVNASWATYLLTKETKDPGAGLMAATILAMVPSYISRSVAGSYDNEAVAIFALIFTFYLYVKTLNTGSLFYATLNALSYFYMVCSWGGYTFIINLIPMHVLLCIVTGRYSSRLYIAYAPLIVLGTLLAALVPVVGFNAVMTSEHFASFLVFIILHVVALGYYIKGLLTPRLFKVAMTFVITVGLAVCFAVAAILVALIASSPTKGWSGRSLSLLDPTYASKYIPIIASVSEHQPPTWPSYFMDINVLAFLVPAGIISCFLPLSDASSFLVLYLVTSVYFSGVMVRLMLVLAPAACILSGIALSEAFGVLTRSMKFQRPTLDDGSSTAGDGSSDTPTNSEMVSKEKPSKKNRKKDRDSEGSSPVDHRTEEKLLVLPCGPSAVGIMLLIILSGFYVVHCVWAAAEAYSAPSIVLTSRSHDGFHVFDDFREAYGWLRHNTDVDDKVASWWDYGYQTTAMANRTVIVDNNTWNNTHIATVGTAMASPEKAAWEIFNSLDVKYVLVIFGGLIGYPSDDINKFLWMVRIGGGVFPQIKEADYLKDGNYRVDAHGTPTMLNSLMYKLCYYRFVETDGKGYDRVRRYEIGKKHFKLTHFEEVFTTHHWMVRIYKLKPQKNRVRGKLKFKSEPD

SEQ ID NO: 16934 - DNA, 2748 bp, Sorghum bicolor
  misc_feature: Ceres ANNOT ID no. 8668656
  misc_feature: Encodes the peptide sequence at SEQ ID NO 16935
atgaatcctaacaagttcacgcacaagacgaatgaggcgctggccttggcgcacaatatcgcctcagaggccgggcacgcccagatcacgccgctgcatctcgcggcggcgctgatcgcagacaggcccggcgtcctccgccaagccatcgcccacgcgtccggcggcaacgacgtcgctgctgccgattccttcgagcgcgtcctggcttccacgctcaagaggctgccctcgcagtcgcctccgccggatactgtcccggcttccaccgcgcttgtcaaggtcatccgccgcgcgcagtccgcgcagaaggtgcgcggggactcccacctcgccgtggaccagttgctggtaggcctcctcgaggatccccaggtctgggatgcactcaaggaggctggcgttgttgcggcgcgggtgaaggccgaggtcgacaagctccgcggcggcgacaaccgccgtgtggagtctgcatctggggacaccagcttccaggcggtcaagacgtacggccgcgacctcgtcgaggtggcgggcaagctcgaccctgtcattggccgcgacgaagagatccgccgcgttgtgcgtatcctgtcgcggcgcacgaagaacaatcccgtactcatcggcgaacccggcgtaggcaagaccgccgtcgtggaggggctcgctcagcggatcgtgcgcggcgatgtcccgagcaacctcctcgacgtgcgcctcgtcgcgctcgacatgggtgccctcgttgccggtgccaaataccgcggcgagttcgaggagcggctcaaggccgtgctcaaggaggtggaagagtcagatgggaaggtgattctattcatcgacgagatacacctcgtcctcggcgctgggaggacggatgggtccatggatgcggccaacctgttcaagccaatgctcgcgagggggcaactcaggtgcattggtgcgacgacgctggaggagtaccggaagtatgttgagaaggatgccgcgttcgagaggcggttccagcaggtgtacgtggccgagcccagcgtttccgacactgtcagtatcctgagaggcctcaaggagaagtatgagggacaccatggtgtcagaatccaggaccgtgcgctcgtcattgccgcgcagctctcgtcaaggtatatcatgggtcgacatctgcctgacaaagctatcgatttggttgacgaggcctgcgcaaatgtgagggtgcagctcgacagccagccggaagagatcgacaatcttgagaggaagaggattcaactcgaagtcgagctccacgccctcgagaaggagaaggacaaggccagcaaagctcggctagttgaggtgaggaaagaattggacaatttgagggacaaactgcagccgctgcaaatgaggtaccgcaaggagaaagagaggatagatgagatcaggaagctgaagcatcgtcgtgaagaacttctgttcagcctccaagaggctgagcggcggatggatttggctcgtgtggctgacatcagatatggtgctctccaggagattgatgctgccattgccaagctagagggtgagactggagagaacttgatgcttactgagactgttggcccagagcagatagctgaggtggtgagccgctggactggcattccagtgactaggcttggacagaatgataaggagaggctggttggactggccgataggcttcatcgaagggtcattggacagcatgaagccgtcaatgctattgcagaggctgttctgaggtccagggctggtcttgggcggacacagcagcctactggctcattcctcttccttggaccgactggtgtaggcaagactgaacttgccaaggctcttgctgagcagctgtttgatgatgagaagttgcttgttcgccttgatatgtctgaatatatggagaaacattcagtttctcgactaattggtgcaccacctggctatgttggccatgaggaaggagggcaacttactgaacaagtgaggaggaggccgtacagtgttattctctttgatgaggttgagaaggcacatgtggcagtgtttaacactctgctccaggttctagatgatggaaggttgactgacggtcaaggcaggacggtcgacttcaggaacactgtgattatcatgacctcaaacattggcgctaagcacctccttgccgggatggtgggcaataactcgatgaaggctgctcgcgatctggttatgctagaggtgaggaagcatttccgtcccgagctgctgaatcgtctggatgagatcgtgatcttcgatcccttgtcccatgaacaattgaggatggtcgctcggctgcaggtgaaagaggtggcctaccgtcttgccgaaaggggtgttgccttggctgtgactgatgctgcattggacttgatcttgtcactctcttatgatccggtctatggtgccaggcccatcaggagatggattgagaagaaagtagtgacggagttgtccaagatgttgatcaaggaagagatagatgagaactccacggtgtccatagacgcttctcccagcaaagatgaactgatttacaaggttgacatgaacggaggactggtgaatgcgcagacagggcacaagtctgacatcctgatccaggttcctaatggaggtatcaacggtggggcagcacacactgtgaagaagatgaggttgatggaggatgaccaggacgatgatgacatggaagaagagtga

SEQ ID NO: 16935 - protein, 915 aa, Sorghum bicolor
  misc_feature: Useful for making plants with modulated heat sensitivity
  misc_feature: Functional homolog of the protein sequence given in SEQ ID NO 14451
  misc_feature: Ceres ANNOT ID no. 8668656
  misc_feature (372)..(793): SWISSPROT Homolog: EC 3.4.21.53 Endopeptidase La
  misc_feature (599)..(764): Pfam ID: AAA_2 Pfam Description: ATPase family associated with various cellular activities (AAA)
  misc_feature (99)..(149): Pfam ID: Clp_N Pfam Description: Clp amino terminal domain
  misc_feature (17)..(70): Pfam ID: Clp_N Pfam Description: Clp amino terminal domain
  misc_feature (205)..(399): Pfam ID: AAA Pfam Description: ATPase family associated with various cellular activities (AAA)
MNPNKFTHKTNEALALAHNIASEAGHAQITPLHLAAALIADRPGVLRQAIAHASGGNDVAAADSFERVLASTLKRLPSQSPPPDTVPASTALVKVIRRAQSAQKVRGDSHLAVDQLLVGLLEDPQVWDALKEAGVVAARVKAEVDKLRGGDNRRVESASGDTSFQAVKTYGRDLVEVAGKLDPVIGRDEEIRRVVRILSRRTKNNPVLIGEPGVGKTAVVEGLAQRIVRGDVPSNLLDVRLVALDMGALVAGAKYRGEFEERLKAVLKEVEESDGKVILFIDEIHLVLGAGRTDGSMDAANLFKPMLARGQLRCIGATTLEEYRKYVEKDAAFERRFQQVYVAEPSVSDTVSILRGLKEKYEGHHGVRIQDRALVIAAQLSSRYIMGRHLPDKAIDLVDEACANVRVQLDSQPEEIDNLERKRIQLEVELHALEKEKDKASKARLVEVRKELDNLRDKLQPLQMRYRKEKERIDEIRKLKHRREELLFSLQEAERRMDLARVADIRYGALQEIDAAIAKLEGETGENLMLTETVGPEQIAEVVSRWTGIPVTRLGQNDKERLVGLADRLHRRVIGQHEAVNAIAEAVLRSRAGLGRTQQPTGSFLFLGPTGVGKTELAKALAEQLFDDEKLLVRLDMSEYMEKHSVSRLIGAPPGYVGHEEGGQLTEQVRRRPYSVILFDEVEKAHVAVFNTLLQVLDDGRLTDGQGRTVDFRNTVIIMTSNIGAKHLLAGMVGNNSMKAARDLVMLEVRKHFRPELLNRLDEIVIFDPLSHEQLRMVARLQVKEVAYRLAERGVALAVTDAALDLILSLSYDPVYGARPIRRWIEKKVVTELSKMLIKEEIDENSTVSIDASPSKDELIYKVDMNGGLVNAQTGHKSDILIQVPNGGINGGAAHTVKKMRLMEDDQDDDDMEEE

SEQ ID NO: 16936 - DNA, 1728 bp, Sorghum bicolor
  misc_feature: Ceres ANNOT ID no. 8668657
  misc_feature: Encodes the peptide sequence at SEQ ID NO 16937
atggcttcgtcgctctgcgtgtttgcagcgatgtctggcgccaccggcaggccgtcgtcgaccggtggctcggtggtgccgccgggccgtctgtccagtactgcacaggggaccaagggaaagagggccgtggtgcagcctctcgcggctagcgtcgtgacggacacgccgacgccgacgccggccatagctccggcggccccgccagctcggccagtcgtcgacgccccgcgccgccgtgggggccgcggcaccggcgagcacgcggcgtggaagagcgtccggcaggagaggtgggagggggcgctggagctggagggagagctgccgctctggctggatggcacgtacctgaggaacggcccgggcctgtggaacctgggcgactacggcttccggcacctgttcgacggctacgcgacgctggtccgcgtctcgttccgcaacgggcacgcggtgggcgcgcaccggcagatcgagtcggaggcgtacaaggcggcgcgcgcgaacggcaaggtgtgctaccgcgagttctcggaggtgcccaaggcggacagcttcctctcccacgtgggccagctcgccaccctcttctcgggctcctcgctcaccgacaactccaacacgggcgtggtcaggctcggcgacggccgcgtgctgtgcctgacggagaccatcaagggctccatcgtggtcgacccggacacgctggacaccctcggcaagttcgagtacacggacaagctgggcggcctcatccactcggcgcaccccatcgtgacggacaccgagttctggacgctgatcccggacctcatccgcccgggctactcggtggtgcggatggacgccgggaccaacgagcggcggttcgtcggcagggtggactgccgcggcgggccggcgcccgggtgggtgcactcgttccccatcacggaccactacgtggtcgtgccggagatgccgctccggtactgcgccaggaacctcctccgcgcggagcccaccccgctgtacaagttcgagtggcacctcgagtccggcagctacatgcacgtcatgtgcaaggccagcggcagggtcgtggccagcgtggaggtgccgcccttcgtcaccttccacttcatcaacgcgtacgaggagaaggacgaggagggccgcgtcacggcgatcgtcgccgactgctgcgagcacaacgccaacaccaccatcctcgacaagctccggctccagaacctccgctcttccaccgggcaggacgtcctcccggacgccagggtgggccggttcaggatcccgctggacgggagcccgttcggcgagctggagtcggcgctggacccggaccagcacggccgcgggatggacatgtgcagcatcaacccggcccacgtcggcaagaagtaccggtacgcctacgcctgcggcgcccagcggccgtgcaacttcccaaacaccctcaccaagatcgacctggtggagaagacggccaagaactggtacgaggagggcgccgtgccgtcagagcccttcttcgtgccgcgcccgggcgccgtggaggaggacgacggcgttgcgatttcgatggtgagcgccaaggacggatcggcgtacgcgctagtgctggacgccaagacgttccaggagatcgcgcgggccaagttcccgtacgcgatgccctacggtttgcactgctgctgggtgcctaggaccacctcagacgcgtag

SEQ ID NO: 16937 - protein, 575 aa, Sorghum bicolor
  misc_feature: Useful for making plants with modulated biomass
  misc_feature: Functional homolog of the protein sequence given in SEQ ID NO 14452
  misc_feature: Ceres ANNOT ID no. 8668657
  misc_feature (346)..(569): SWISSPROT Homolog: EC 1.14.99.36 Beta-carotene 15,15'-monooxygenase
  misc_feature (65)..(570): Pfam ID: RPE65 Pfam Description: Retinal pigment epithelial membrane protein
MASSLCVFAAMSGATGRPSSTGGSVVPPGRLSSTAQGTKGKRAVVQPLAASVVTDTPTPTPAIAPAAPPARPVVDAPRRRGGRGTGEHAAWKSVRQERWEGALELEGELPLWLDGTYLRNGPGLWNLGDYGFRHLFDGYATLVRVSFRNGHAVGAHRQIESEAYKAARANGKVCYREFSEVPKADSFLSHVGQLATLFSGSSLTDNSNTGVVRLGDGRVLCLTETIKGSIVVDPDTLDTLGKFEYTDKLGGLIHSAHPIVTDTEFWTLIPDLIRPGYSVVRMDAGTNERRFVGRVDCRGGPAPGWVHSFPITDHYVVVPEMPLRYCARNLLRAEPTPLYKFEWHLESGSYMHVMCKASGRVVASVEVPPFVTFHFINAYEEKDEEGRVTAIVADCCEHNANTTILDKLRLQNLRSSTGQDVLPDARVGRFRIPLDGSPFGELESALDPDQHGRGMDMCSINPAHVGKKYRYAYACGAQRPCNFPNTLTKIDLVEKTAKNWYEEGAVPSEPFFVPRPGAVEEDDGVAISMVSAKDGSAYALVLDAKTFQEIARAKFPYAMPYGLHCCWVPRTTSDA

SEQ ID NO: 16938 - DNA, 1455 bp, Sorghum bicolor
  misc_feature: Ceres ANNOT ID no. 8668659
  misc_feature: Encodes the peptide sequence at SEQ ID NO 16939
atggacaacgtagtatcctcgaagcagaccgtcgttctgtaccccggcggcggcgccgggcacgtcgggccgatgacgcagctcgccaaggtcttcctccaccacggctacgacgtcaccatggtgctcctggagccacccgtcaagtcaaccgcctccggcgccagcttcgtcgagagcctcgccgcctccaacccgtccgtcgtattccacgccctcccgccgatcccgctccctgactttgccagctccaccaagcaccctttcctcctcctgcaggagctgctggcccagtacaacgacaagctcgagaacttcctccgctcaatcccgcgggagcgcctgcactccctcgtcatcgacatgttctgcaccgacgccatcgacgtggccgcaaaggtgggcgtccccgtctacacgttcttctcggcgaacgccggagctctggccgtcctaacccagacggcggcgctgcttgccggtcggcaaacggggctgaaggagcttggagacacgcccatcgagttcctcggcgtcccgccgatgccggcgtcccatatcatcagggagatgctcgaggacccggaggacaaggtgtgcagggccatggcggagatctggaagcgcgacacggacacccggggcgtcctgatcaacaccttctactcactggaggcctcggccctggaggcgttcagggacccactgtgcgtccccggcaaagtgttgcctcctgtttactccatcgggccgttggttggcgagggcggcacggagacagaggaagcggggaagaggcacgagtgcctcacctggctcgacgcacagccggagcgcagcgtcgtgttcctctgctgggggagcaagggattgctgtccggggagcagcttaaggagatcgccgttggactagagaagtccgggcagcggttcctgtgggtggtgcgcacgccggcggccagcgacccgaaacgactctgggagacacgcccggagccggaccttgacaccctcctgccggaggggttcttggagcggaccagggaccgtggcctcgtcatcaagtcgtgggtaccgcaggtggatgtgctcaacaacccagctattggcgcgtttgtcacccactgcgggtggaactcgacgctggaggccatcgcagcgggggtgccgatgctgtgctggccactgggcgcagagcagaagatcaacaaggtacttatggtcgaggccatgggcatcgggctggagctggaggggtacaacacaggtttcatcaaggctgaggaggtagagacgaaggtgaggcttgtgttggagtccgagttgcggagggagattaggatgcgagcagcagagctgaagaaagaggcacacgaggcgttggaggacgggggatcgtcacaggcggcatttctccaattcttgtcagatgttaagaatattactagtgcgtaa

SEQ ID NO: 16939 - protein, 484 aa, Sorghum bicolor
  misc_feature: Useful for making plants with altered carbohydrate content
  misc_feature: Functional homolog of the protein sequence given in SEQ ID NO 14187
  misc_feature: Ceres ANNOT ID no. 8668659
  misc_feature (11)..(484): SWISSPROT Homolog: EC 2.4.1.218 Hydroquinone glucosyltransferase
  misc_feature (9)..(482): Pfam ID: UDPGT Pfam Description: UDP-glucoronosyl and UDP-glucosyl transferase
MDNVVSSKQTVVLYPGGGAGHVGPMTQLAKVFLHHGYDVTMVLLEPPVKSTASGASFVESLAASNPSVVFHALPPIPLPDFASSTKHPFLLLQELLAQYNDKLENFLRSIPRERLHSLVIDMFCTDAIDVAAKVGVPVYTFFSANAGALAVLTQTAALLAGRQTGLKELGDTPIEFLGVPPMPASHIIREMLEDPEDKVCRAMAEIWKRDTDTRGVLINTFYSLEASALEAFRDPLCVPGKVLPPVYSIGPLVGEGGTETEEAGKRHECLTWLDAQPERSVVFLCWGSKGLLSGEQLKEIAVGLEKSGQRFLWVVRTPAASDPKRLWETRPEPDLDTLLPEGFLERTRDRGLVIKSWVPQVDVLNNPAIGAFVTHCGWNSTLEAIAAGVPMLCWPLGAEQKINKVLMVEAMGIGLELEGYNTGFIKAEEVETKVRLVLESELRREIRMRAAELKKEAHEALEDGGSSQAAFLQFLSDVKNITSA

SEQ ID NO: 16940 - DNA, 1098 bp, Sorghum bicolor
  misc_feature: Ceres ANNOT ID no. 8668681
  misc_feature: Encodes the peptide sequence at SEQ ID NO 16941
atgcggtggccgcagccggcgctgatgctcctcgtcgtggccgcgcggctggccaccgtcgccgtcgtcgtggtgcggggcgagccccaggtgccatgctacttcgtgttcggggactcgctcgtggacaacgggaacaacaacgacatcgcgtcgctggcgcgggccaactacccgccctacggcatcgacttcgccggcggcgccaccggccgcttcagcaacggcctcaccaccgtcgacgctatctctcggcttctgggcttcgacgattacatccccgcgtacgccggcgcgagcggcgatcagctcctcaccggcgtcaacttcgcctccgccgcagccgggatccgtgacgagaccggccagcagctggggcaacggatcagcttcggcgggcagctgcagaactaccaggcggcggtgcagcagctggtgagcatcctgggcgacgaggactcggcggccaaccacctgagccagtgcatcttcacggtgggcatgggcagcaacgactacctcaacaactacttcatgccggcggtgtactccaccagccagcagtacacgccggcgcagtacgccgacgtgctcatcgaccagtactcgcagcaggtccggacgctgtacaactacggggccaggaaggtggcgctgatgggcgtggggcaggtcgggtgcagccccaacgagctggcgcagcacagcgccgacggcgccacctgcgtgccggagatcaacggcgccatcgacatcttcaaccggaagctcgtcgcgctcgtcgaccagttcaacgcgctgccgggggcgcacttcacctacatcaacgtgtacgggatcttcgaggacatcctgagagcaccagggtcgcacggtctgacggtcaccaaccgagggtgctgcggcgtcgggcggaacaacgggcaggtgacgtgcctgccgttccagacgccgtgcgccaacaggaacgagtacctcttctgggacgccttccaccccacggaggcggccaacgtcctcgtcggccggagggcgtacagcgcggcgcagccgtccgacgtccaccccgtcgatctgcgcacgctcgctcagctctag

SEQ ID NO: 16941 - protein, 365 aa, Sorghum bicolor
  misc_feature: Useful for making plants with modulated phosphate use efficiency
  misc_feature: Functional homolog of the protein sequence given in SEQ ID NO 14406
  misc_feature: Ceres ANNOT ID no. 8668681
  misc_feature (32)..(292): SWISSPROT Homolog: EC 3.2.1.51 Alpha-L-fucosidase
  misc_feature (34)..(345): Pfam ID: Lipase_GDSL Pfam Description: GDSL-like Lipase/Acylhydrolase
MRWPQPALMLLVVAARLATVAVVVVRGEPQVPCYFVFGDSLVDNGNNNDIASLARANYPPYGIDFAGGATGRFSNGLTTVDAISRLLGFDDYIPAYAGASGDQLLTGVNFASAAAGIRDETGQQLGQRISFGGQLQNYQAAVQQLVSILGDEDSAANHLSQCIFTVGMGSNDYLNNYFMPAVYSTSQQYTPAQYADVLIDQYSQQVRTLYNYGARKVALMGVGQVGCSPNELAQHSADGATCVPEINGAIDIFNRKLVALVDQFNALPGAHFTYINVYGIFEDILRAPGSHGLTVTNRGCCGVGRNNGQVTCLPFQTPCANRNEYLFWDAFHPTEAANVLVGRRAYSAAQPSDVHPVDLRTLAQL

SEQ ID NO: 16942 - DNA, 2730 bp, Sorghum bicolor
  misc_feature: Ceres ANNOT ID no. 8668693
  misc_feature: Encodes the peptide sequence at SEQ ID NO 16943
atgtcgcggtcgtataccaacctgctcgacctcgcggagggcaacttcgcggcgctgggcccggccggcggcagcgggcggcagaggcagggatcgttcgggatgaggcggatgtcccgggtgatgacggtgccggggacgctgtcggagctcgacggcgaggacgagtcggagccggcggcgaccaacagcgttgcctccgacgcgccctcgtcgctggcagcggaccgcgtcatagtggtctcgaaccagttgcccatcgtcgcgcgtcgaaggcccgacggccgaggatggtccttctcatgggacgacgactcgcttctgctccagctccgcgacggcattcccgacgagatggaagtgctgttcgtcggttccctccgagccgatgtccccgtagcggagcaggacgaggtgtcgcaggcgctgctcgaccgattccgctgcgcaccggtgttcctacctgaccacctcaacgaccggttctaccacggcttctgcaagcgccaactctggcctctgtttcactacatgctccccttctcatcatccgcgtctgccgccaccacctcttcctccgtcgccccttcgtcaccaggcaacggtcgcttcgaccgcagcgcttgggaggcgtatgttctcgccaacaagttcttcttcgagaaggtcgtggaggtaatcaacccggaggaggactacgtctgggttcatgactaccatctcatggcgctgcctaccttcctccgccgccgcttcaaccgcctccgcatcggattcttcctccacagcccctttccctcgtccgagatctaccgcaccctccctgttcgcgaggagatattgaaggctctgctcaattgcgacctcattgggttccacactttcgattacgccaggcacttcctctcgtgctgcagtaggatgctgggaattgaataccagtccaagcgtgggtacattggattggattactttggccgcactgttgggatcaaaatcatgccagtgggaattcatatgggtcaattagagtcaggtctgcgcttgcctgatagagaatggagactttctgagcttcaacagcagttcgaggggagaactgtcttgcttggtgtggatgatatggatatctttaaggggatcaatttgaagcttcttgcctttgagaacatgttgaggacacatcccaagtggcaagggcgagcagtgttagtgcagattgctaacccggcccgtggaaggggtaaggatctggaagccatccaggctgagattgaggagagctgccgaaggatcaatggagactttggccagtcagggtatagcccggttgttttcatcgatcgtgatgtgtcaagtgttgagaagattgcctattatacgatagcggaatgtgtggtggtgactgctgtgagggatgggatgaacttgacaccatatgagtacattgtcagtaggcagggtgcaccaggatctgagtcagtatcagaggtgagtgggccaaagaagagcatgctggttgtgtcagagtttattggctgctcaccgtcactgagtggtgctattagggttaacccatggaatatagaggcaactgcagaggcgatgaatgaggccatttcaatgccagaacaggaaaaacagttgaggcatgagaagcattaccgttatgtcagcagccatgatgttgctttttggtcaaggagcttcatcctagacttgcaaagggcttgtcaggaccactttaagaggacttgttggggcatagggttgggttttggtttcagggtggtggccttggaccctcatttcacaaagctcaacatggatttgattgttaatgcttatgagatttcagagagcagggctatattgcttgattatgatggaactctggttcctcaaacttccatcaacaaggaacctagtccagaggttttgagcatcatcaataccctttgctctgatagtagaaacaccgtttttcttgtcagtggtcgagacaaagatacgttgggaaagtggttctcctcatgtccaaaattgggtattgcagctgaacatggttacttcttgaggtggtctagagaagaagagtggcaaacatgcactcaggccttggacttcggatggatgcaaatggcaaggcctgtgatgaatttgtatacagaagcaactgatggatcctacattgagacgaaggaaagtgccttggtgtggcaccatcaggatgctgacccaggctttggatcctcacaggcaaaggagatgcttgatcacctggaaagtgtattagcaaatgaaccagtctctgtcaagagtggccagttcattgtcgaagtcaaaccacagggagtaaccaagggaatagttgccgagaggatacttgcatcagtgaaggagagaggaaagcaggctgatttcgtattgtgcatcggcgatgataggtccgatgaggacatgtttgaaaatattgctgatatcattaataggaatgtggttgatccaagaacatcgctgtttgcgtgcactgtgggacaaaaaccaagcaaagccaaattctacctggacgatacattcgaagtggtcactatgctgagcgcacttgcagatgccacaggacctgaactggagactgattcggctgatgaattggccgcatctatctcttcacttgatattggtgacgaacaatcagaatccagtgatagaccaattggagggtcttag

SEQ ID NO: 16943 - protein, 909 aa, Sorghum bicolor
  misc_feature: Useful for making plants with altered carbohydrate content
  misc_feature: Functional homolog of the protein sequence given in SEQ ID NO 13884
  misc_feature: Ceres ANNOT ID no. 8668693
  misc_feature: Down-regulated in shoot tissues in response to aminocyclopropane carboxylic treatment
  misc_feature: Down-regulated in shoot tissues in response to salicylic acid treatment
  misc_feature (204)..(576): SWISSPROT Homolog: EC 2.4.1.15 Alpha,alpha-trehalose-phosphate synthase (UDP-forming)
  misc_feature (76)..(576): Pfam ID: Glyco_transf_20 Pfam Description: Glycosyltransferase family 20
  misc_feature (625)..(860): Pfam ID: Trehalose_PPase Pfam Description: Trehalose-phosphatase
MSRSYTNLLDLAEGNFAALGPAGGSGRQRQGSFGMRRMSRVMTVPGTLSELDGEDESEPAATNSVASDAPSSLAADRVIVVSNQLPIVARRRPDGRGWSFSWDDDSLLLQLRDGIPDEMEVLFVGSLRADVPVAEQDEVSQALLDRFRCAPVFLPDHLNDRFYHGFCKRQLWPLFHYMLPFSSSASAATTSSSVAPSSPGNGRFDRSAWEAYVLANKFFFEKVVEVINPEEDYVWVHDYHLMALPTFLRRRFNRLRIGFFLHSPFPSSEIYRTLPVREEILKALLNCDLIGFHTFDYARHFLSCCSRMLGIEYQSKRGYIGLDYFGRTVGIKIMPVGIHMGQLESGLRLPDREWRLSELQQQFEGRTVLLGVDDMDIFKGINLKLLAFENMLRTHPKWQGRAVLVQIANPARGRGKDLEAIQAEIEESCRRINGDFGQSGYSPVVFIDRDVSSVEKIAYYTIAECVVVTAVRDGMNLTPYEYIVSRQGAPGSESVSEVSGPKKSMLVVSEFIGCSPSLSGAIRVNPWNIEATAEAMNEAISMPEQEKQLRHEKHYRYVSSHDVAFWSRSFILDLQRACQDHFKRTCWGIGLGFGFRVVALDPHFTKLNMDLIVNAYEISESRAILLDYDGTLVPQTSINKEPSPEVLSIINTLCSDSRNTVFLVSGRDKDTLGKWFSSCPKLGIAAEHGYFLRWSREEEWQTCTQALDFGWMQMARPVMNLYTEATDGSYIETKESALVWHHQDADPGFGSSQAKEMLDHLESVLANEPVSVKSGQFIVEVKPQGVTKGIVAERILASVKERGKQADFVLCIGDDRSDEDMFENIADIINRNVVDPRTSLFACTVGQKPSKAKFYLDDTFEVVTMLSALADATGPELETDSADELAASISSLDIGDEQSESSDRPIGGS

SEQ ID NO: 16944 - DNA, 2943 bp, Sorghum bicolor
  misc_feature: Ceres ANNOT ID no. 8668701
  misc_feature: Down-regulated in shoot tissues in response to aminocyclopropane carboxylic treatment
  misc_feature: Down-regulated in shoot tissues in response to salicylic acid treatment
  misc_feature: Encodes the peptide sequence at SEQ ID NO 16945
atggagtcggcggcggcccaggcctgcgccgcgtgcggggacgacgcgcgcgccgcctgccgcgcgtgcagctacgcgctctgtagggcgtgcctcgacgaggacgccgccgagggccgcaccacatgcgcgcgctgcggcggggactacgccgcgatcgactcagcacacggcaacgagggaaccgaggcagaggaggtggagaacaaccacgccgctggtggcctgcgtgagagggtcaccatgggcagccacctcactgatcgccaggatgaagtaagccatgccaggaccatgagcagcttgtcgggaattggtagtgaattgaatgatgaatctggcaagcccatctggaagaacagggtggagagttggaaggaaaagaagaatgagaagaaagcttcggccaaaaaggctgcagtaaaagcacaggctccacctgtcgaagaacagatcatggatgaaaaggacttgacagatgcatatgagccactctctcgggtcatcccaatatcaaagaacaagctcacaccttacagagcagtcatcattatgcggttaatagttctcggtctcttctttcactaccgtatcaccaatcctgttaacagtgcctttggtctctggatgacctcagtaatatgtgagatctggtttggtttctcctggatcttggatcaattccccaagtggtatcctatcaatcgagagacttacgttgataggctgactgcaagatacggagatagtgaagagtctggattagcacctgtagatttctttgtcagtacagtggatccattaaaagagcctccactaatcactgcaaacactgtgctgtctattcttgctgtggactatcctgtcgagaagatctcatgctacgtatctgatgatggttctgctatgctcacatttgaatcgcttgcagagactgcagaatttgctagaaaatgggtgccattttgcaagaagtacaccattgagccacgagctcctgagttctacttctcgcagaaaattgactacttgaaggacaagatacacccgtcttttgtcaaggagcgtagggctatgaagagggactatgaagagtacaaggtgaggataaatgctttggtagccaaggctcagaagacacctgaggaaggctggatcatgcaagacggtacaccatggcctgggaacaatcctcgtgaccaccctggcatgatccaggttttccttggtgagactggtgcacgggacttcgatggaaatgaacttcctcggttagtgtatgtgtcaagagagaaaagacctggttaccaacaccacaagaaggcaggggctatgaatgctctggtccgagtgtccgctgttctgacaaatgctccttacattcttaatcttgactgtgatcactatgttaacaacagcaaagccgtccgtgaagcaatgtgtttcatgatggaccctactgttggcagagatgtctgctatgtacaattcccccagaggttcgatggcattgatcgcagtgatcgatatgccaataggaacgttgtgttctttgatgttaatatgaaaggacttgatggcatccaaggcccagtttatgtcggaactggttgttgtttctataggcaggcactttatggttatggacctccatctctgcccgcacttccgaagtcttcactttgttcgtggtgttgctgctgctgtcccaagaaaaaggttgaaagaagtgagagggaaatcaacagagactctcggcgagaagaccttgagtctgccatttttaaccttcgcgaaattgacaactatgatgagtatgagaggtccatgctgatatctcagatgagcttcgagaaatcttttgggcagtcctcagtctttattgagtctactcttatggagaatgggggcgtccctgaatctgtaaacccagctaccctaattaaagaagccattcatgtcattagctgcggatatgaagagaaaactgaatggggaaaagagattggctggatctatggttcagttacagaggatattctgactgggtttaagatgcactgccgtggctggagatccatctactgcatgccggtgagacctgcattcaagggatcagcccctatcaatctttccgatcgtcttcaccaggttctccggtgggctcttggttctgtcgagatcttcctcagtcggcactgccctctgtggtacggttacggtggcggtcgtctgaaatggctccagaggctgtcctacatcaacaccatcgtgtacccgttcacttctcttcctctcgttgcctactgttgcctgcctgccatttgcctgctcacaggaaagttcattattcctacgctgtccaacgctgcgaccatatggtttcttggcctcttcatgtccatcatcttgacgagcgtgttggagctgcggtggagtggcatcgggattgaggactggtggcgcaacgagcagttctgggtcatcggaggcgtgtccgcccacctgttcgccgtgttccagggtattctcaagatgattgccgggctggacaccaacttcacggtcaccgcaaaggccacggacgacgccgagttcggggagctgtacgtgttcaagtggacgacggtgctgatcccgcccaccagcatcctggtgctcaacatggtgggcgtggtggctggcttctcggccgcgctcaacagcggctacgagtcctggggccctctctttggcaaggtgttcttcgccatgtgggtgatcatgcacctgtacccgttcctcaagggtctcatgggccgacagaaccgcacgcccaccatcgtggtgctctggtccgtcctcctcgcctccgtcttctccctcctctgggtcaagatcgacccattcgtcggaggaaccgagaccgtcaactccaacaactgcaacacagtcatctgctga

SEQ ID NO: 16945 - protein, 980 aa, Sorghum bicolor
  misc_feature: The sequence is a functional homolog of SEQ ID NO 2 in US patent 7049481
  misc_feature: Useful for making plants with modulated biomass
  misc_feature: Functional homolog of the protein sequence given in SEQ ID NO 14453
  misc_feature: Useful for making plants with altered cell wall content and/or composition
  misc_feature: Functional homolog of the protein sequence given in SEQ ID NO 14454
  misc_feature: The sequence is a functional homolog of SEQ ID NO 6 in US patent 7285702
  misc_feature: Useful for making plants with altered carbohydrate content
  misc_feature: Functional homolog of the protein sequence given in SEQ ID NO 13628
  misc_feature: Useful for making plants with modulated plant growth and development
  misc_feature: Functional homolog of the protein sequence given in SEQ ID NO 13629
  misc_feature: Ceres ANNOT ID no. 8668701
  misc_feature (32)..(980): SWISSPROT Homolog: EC 2.4.1.12 Cellulose synthase (UDP-forming)
  misc_feature (164)..(974): Pfam ID: Cellulose_synt Pfam Description: Cellulose synthase
MESAAAQACAACGDDARAACRACSYALCRACLDEDAAEGRTTCARCGGDYAAIDSAHGNEGTEAEEVENNHAAGGLRERVTMGSHLTDRQDEVSHARTMSSLSGIGSELNDESGKPIWKNRVESWKEKKNEKKASAKKAAVKAQAPPVEEQIMDEKDLTDAYEPLSRVIPISKNKLTPYRAVIIMRLIVLGLFFHYRITNPVNSAFGLWMTSVICEIWFGFSWILDQFPKWYPINRETYVDRLTARYGDSEESGLAPVDFFVSTVDPLKEPPLITANTVLSILAVDYPVEKISCYVSDDGSAMLTFESLAETAEFARKWVPFCKKYTIEPRAPEFYFSQKIDYLKDKIHPSFVKERRAMKRDYEEYKVRINALVAKAQKTPEEGWIMQDGTPWPGNNPRDHPGMIQVFLGETGARDFDGNELPRLVYVSREKRPGYQHHKKAGAMNALVRVSAVLTNAPYILNLDCDHYVNNSKAVREAMCFMMDPTVGRDVCYVQFPQRFDGIDRSDRYANRNVVFFDVNMKGLDGIQGPVYVGTGCCFYRQALYGYGPPSLPALPKSSLCSWCCCCCPKKKVERSEREINRDSRREDLESAIFNLREIDNYDEYERSMLISQMSFEKSFGQSSVFIESTLMENGGVPESVNPATLIKEAIHVISCGYEEKTEWGKEIGWIYGSVTEDILTGFKMHCRGWRSIYCMPVRPAFKGSAPINLSDRLHQVLRWALGSVEIFLSRHCPLWYGYGGGRLKWLQRLSYINTIVYPFTSLPLVAYCCLPAICLLTGKFIIPTLSNAATIWFLGLFMSIILTSVLELRWSGIGIEDWWRNEQFWVIGGVSAHLFAVFQGILKMIAGLDTNFTVTAKATDDAEFGELYVFKWTTVLIPPTSILVLNMVGVVAGFSAALNSGYESWGPLFGKVFFAMWVIMHLYPFLKGLMGRQNRTPTIVVLWSVLLASVFSLLWVKIDPFVGGTETVNSNNCNTVIC

SEQ ID NO: 16946 - DNA, 2049 bp, Sorghum bicolor
  misc_feature: Ceres ANNOT ID no. 8668727
  misc_feature: Encodes the peptide sequence at SEQ ID NO 16947
atgggaatcgatctcaacatggtgggcggcgagggccacgatcgccgcccgccgccgccggtgagccgggagctgtggcacgcgtgcgcggggcccgtggtcgcgctaccgcggcgggggagcctggtcgtgtacctgccgcagggccacctagccgcggcgggcggcggggacgtcgctgcggacctgccgccgcacgtggtgtgccgcgtcgcggatgtcgagctatgcgcggatgcggcgacggacgaggtgtacgcgcggctggcgctggttgcggaaggcgaggcatttgggagaaatctgcacggcggcggagctgaaggggacgatgacatggaggatttggatgctgaaaggaagtcccggatgttgcacatgttctgcaaaacgcttacagcctctgacacaagcacgcatggagggttctctgttcctcgccgtgctgctgaggactgtttcccgcctctggattataatcagctcaggccttctcaagagctggttgccaaggatttgcatggaactaaatggaagtttcgtcatatatataggggtcagcctcgtaggcatctcttgactactggatggagttcatttgtcaataaaaagaaactggtttcaggggatgctgtgttatttctccgaggtgatgatggtgaactaaggcttggtgtacggagagccattcagcttaaaaatgaggccctttttgaagatttcagtagtgacagtacaaagcggcatacattgtcggctgtagctgattccttgaagcacagaagtgtttttcacatttcttacaatccaagagctactgcttcagaatatattattccataccataagttcctgaagagcctcaatcatccagtctgtgttggagcaaggatcaactttcagtgccataatgaagatgttagtgaaaggcgatctggaatggttgttcgcattagtgaaatagatcccatgaaatggcctggctcgaagtggagaagcctgctggtaagatgggaggatggtgctgaatgtaacggccaagatagagtatctccatgggagatcgaggtagctggtggttctgtctctgttgctcattctctgtccgcatctagttctaaaagaaccaagttgtgtgctcagggaaatttggacgttccaacaatgtggaatggttgtactgactccgtggaaactggaaagttacccagggtcttgcaaggtcaagaattgatgggttttaggactcgtcatgttccgtgtgctcctcaaactgctgaggctgcaaaacttcaatcttctgatgctagtaggtttcttagtaatgcacgtgactgcgcattgagtgctccaacaagcagactcgcagtgcataactctggttttacctaccaatctgtaggcttcaatgaatctattggattctcagaggtcttgcaaggtcaagaaatttctcgggcagttcctatgttccaaggaatgatgtctgaggcttgttcactgaaaggcggatatgggctacatagttatatgcataccccagttgctgttaatggattatcagccccagctcaagaatgttgtctgacactatctactccgccaggagcacaagtgccctctctctaccctgataatatttttaaccgaactgtggttccgcagcttggactggcaagcaagtttggtggtggaggtacaaatggccagcagtctggcccatttgataggcggagggaaatttggaccaagccacagcatgaaacacctgatcaaatgaacttggatcagtttgagactagaagagcttcagcacctggagatgctggtaagcttgggtctggtggaggggaggttcgcaaaactagctgcagactttttggtttctccttgactgagaagatcttgccagcagatgatgatggcgtcaaggaagtgagctatgagcctgagtgccagaacccacggatgctggatctgtttgggtacaactgctcaaccccgagtgctgctcttccggctctgtgtgctgcccccattggaatgtga

SEQ ID NO: 16947 - protein, 682 aa, Sorghum bicolor
  misc_feature: The sequence is a functional homolog of SEQ ID NO 696 in the 11/479,226 US patent application
  misc_feature: Ceres ANNOT ID no. 8668727
  misc_feature (127)..(232): Pfam ID: B3 Pfam Description: B3 DNA binding domain
  misc_feature (254)..(335): Pfam ID: Auxin_resp Pfam Description: Auxin response factor
MGIDLNMVGGEGHDRRPPPPVSRELWHACAGPVVALPRRGSLVVYLPQGHLAAAGGGDVAADLPPHVVCRVADVELCADAATDEVYARLALVAEGEAFGRNLHGGGAEGDDDMEDLDAERKSRMLHMFCKTLTASDTSTHGGFSVPRRAAEDCFPPLDYNQLRPSQELVAKDLHGTKWKFRHIYRGQPRRHLLTTGWSSFVNKKKLVSGDAVLFLRGDDGELRLGVRRAIQLKNEALFEDFSSDSTKRHTLSAVADSLKHRSVFHISYNPRATASEYIIPYHKFLKSLNHPVCVGARINFQCHNEDVSERRSGMVVRISEIDPMKWPGSKWRSLLVRWEDGAECNGQDRVSPWEIEVAGGSVSVAHSLSASSSKRTKLCAQGNLDVPTMWNGCTDSVETGKLPRVLQGQELMGFRTRHVPCAPQTAEAAKLQSSDASRFLSNARDCALSAPTSRLAVHNSGFTYQSVGFNESIGFSEVLQGQEISRAVPMFQGMMSEACSLKGGYGLHSYMHTPVAVNGLSAPAQECCLTLSTPPGAQVPSLYPDNIFNRTVVPQLGLASKFGGGGTNGQQSGPFDRRREIWTKPQHETPDQMNLDQFETRRASAPGDAGKLGSGGGEVRKTSCRLFGFSLTEKILPADDDGVKEVSYEPECQNPRMLDLFGYNCSTPSAALPALCAAPIGM

SEQ ID NO: 16948 - DNA, 1533 bp, Sorghum bicolor
  misc_feature: Ceres ANNOT ID no. 8668753
  misc_feature: Encodes the peptide sequence at SEQ ID NO 16949
atggcagttattgatgatccgagtcaccgacctgcccagaaaggataccggatcaagggcagagcggtcccggtgccggcgtggttaacgggagggagggagggactgggagctagggccgggcgccgtgggaaaactgctattggccggcgtgccatcgcctcgtatcgtatgcgtctcccatggagccatgcatgcagcgcggcgggccgacctgccaccggtggatcgcgtccggacacgtcgcgccccggaccccgactgccctggctccatcggcaccgtgcacccaaagcgatcccacccccgatgcatccttttcgtctccctgtcagctgggtcccatccagccaggtgccgcctcgtcccttctcgcttcgctccgggcggggctctccctcgtcaaccgtagtacacaagcacacaccacctcgtctccacctcccctgttctcagcgtgcttgccctgtttcgacctcctctgctcatccgcctccctcgcccgccacgccccaccgtagtacaggccggcagacagccatggtggtgctcgccaacccgcctgtcgtcgaccagatcccgctgctgcggtccccggggcccagggacaccttctcgggcgtgccggtcgtcgacctgtccagccccgccgcggcgcgcgcgatcgtcgacgcctgcgagcgcttcggcttcttcaaggtcgtcaaccacggcgtgcccgcggccaccatgggcagggccgagtccgaggccgtcaggttcttcgcgcaggcgcaggccgacaaggaccgcgccggcccggcgtacccgttcggctacggcagcaagcggatcgggctcaatggcgacatggggtggctcgagtacctcctcctcgccgtcgactccgcgtcgctctccgacgcctgccccgtcccctccaccgccgccttccggagcgcgctgaacgagtacgtcgcggcggtgcggaaggtggcggtgcgcgtgctggaggcgatggcggaaggcctgggcattgcggacgcggccgcgctgagctcgatggtgaccggcgccggcggcgaccaggtgttccgcgtgaaccactacccgccgtgcccggcgctgcagggcctgggctgcagcgccacgggcttcggcgagcacaccgacccgcagctcatctccgtgctccgctccaacggcacgtccggcctgcagatcgcgctccgcgacggcgcgcagtgggtgtccgtgccctccgaccgcgacgccttcttcgttaacgtcggcgactcgttgcaggtgctgacgaacgggaggttcaagagcgtgaagcaccgggtggtgaccaacagcctcaagtctagggtttccttcatctacttcgcgggaccggcgctggagcagcggatcgtgccgctgccggagctgctggcggagggcgaggagagcctgtacaaggagttcacgtggggcgagtacaagaaggccgcgtacaagacgaggctcggggacaacaggctggcccagtttgagaagcgtagcatctag

SEQ ID NO: 16949 - protein, 510 aa, Sorghum bicolor
  misc_feature: The sequence is a functional homolog of SEQ ID NO 4 in US patent 7154028
  misc_feature: The sequence is a functional homolog of SEQ ID NO 2 in US patent 7262340
  misc_feature: Ceres ANNOT ID no. 8668753
  misc_feature (181)..(507): SWISSPROT Homolog: EC 1.14.11.13 Gibberellin 2-beta-dioxygenase
  misc_feature (354)..(459): Pfam ID: 2OG-FeII_Oxy Pfam Description: 2OG-Fe(II) oxygenase superfamily
MAVIDDPSHRPAQKGYRIKGRAVPVPAWLTGGREGLGARAGRRGKTAIGRRAIASYRMRLPWSHACSAAGRPATGGSRPDTSRPGPRLPWLHRHRAPKAIPPPMHPFRLPVSWVPSSQVPPRPFSLRSGRGSPSSTVVHKHTPPRLHLPCSQRACPVSTSSAHPPPSPATPHRSTGRQTAMVVLANPPVVDQIPLLRSPGPRDTFSGVPVVDLSSPAAARAIVDACERFGFFKVVNHGVPAATMGRAESEAVRFFAQAQADKDRAGPAYPFGYGSKRIGLNGDMGWLEYLLLAVDSASLSDACPVPSTAAFRSALNEYVAAVRKVAVRVLEAMAEGLGIADAAALSSMVTGAGGDQVFRVNHYPPCPALQGLGCSATGFGEHTDPQLISVLRSNGTSGLQIALRDGAQWVSVPSDRDAFFVNVGDSLQVLTNGRFKSVKHRVVTNSLKSRVSFIYFAGPALEQRIVPLPELLAEGEESLYKEFTWGEYKKAAYKTRLGDNRLAQFEKRSI

SEQ ID NO: 16950 - DNA, 1560 bp, Sorghum bicolor
  misc_feature: Ceres ANNOT ID no. 8668778
  misc_feature: Encodes the peptide sequence at SEQ ID NO 16951
atggccgccgtcacgccgccgccgcagtcggacccatcgcctaaggcggggcgcccggcctcgtccgccgccgccgccgccgcggccaagcgaggaggcggcggggcgggcgccgccgggggcctgctgatggggaagtacgagctggggcgcctcctggggcacggcaccttcgcgaaggtgtacctcgcgcggcacgtcggcaccggggacagcgttgccatcaaggtgctcgacaaggagaaggccgtcaagagcgggctcgtcccgcacatcaagcgcgagatcgccgtgctgcgccgcgtccgccacccgaacgtcgtgcacctgttcgaggtcatggccaccaagactaagatctacttcgtcatggagctcgtccgcggcggcgagctcttctcccgcgtctccaagggccgactcagggaggacaacgcgcgccgctacttccagcagctcgtctccgccgtgggcttctgccacgcccgcggcgtcttccaccgggacctcaagcccgagaacctcctcgtcgacgaccgtgggaacctcaaggtatccgactttggactctccgccgtcgccgaccagttccgtcccgacggcctgctccacaccttctgcggcacgccggcctatgtggcccccgaagtgctcggccgccgcgggtacgacggcgccaaggccgacgtgtggtcgtgcggtgtcatcctctttgtgctcatggccgggtatctccctttccatgacaagaacatcatggccatgtacaagaagatttacaagggcgagttccgctgtgcgaggtggttctccaaagaccttaccagcttgctgacgcgcattcttgacactaaccccaacactcggatcactctgccggagatcatggagtcccgctggttcaagaaaggattcaagcctgtcaagttctatatcgaggatgaccagctgcataacgttatagatgatgaggatggcctgttggatatgggacctgctggtactgttcctccaccattgccacctccaccaccacctctacctccgccaaaggttgatggtgatgaatcagggtctgactcagactcgtcgatctcatcctgccctgcttcagtgttatctggtgaaagccaaaggccccgtggctcgctcccacgtccagcaagccttaatgcatttgatatcatatcattctcaaggggatttaacttatcagggttatttgaggagaaaggggatgaagtgaggttcatctcggctgagcccatgtcggatatcataacaaaactggaggacattgcaaagctgaagagcttcaagttgcggaggaaggactggcggatctgcctggagggtacaagggaaggagttaaggggccattaacaattggtgccgaggtatttgaactcacacctccccttgtaatggtggaggtaaaaaagaaggctggggataacgaagagtacgaggacttctgcaacaaggaattgaagccagggatgcagcaccttgtccaccatatggtccgagctccaagtatgcttaccgatgctgagtag

SEQ ID NO: 16951 - protein, 519 aa, Sorghum bicolor
  misc_feature: Useful for making plants with modulated biomass
  misc_feature: Functional homolog of the protein sequence given in SEQ ID NO 14256
  misc_feature: Useful for making plants with modulated salt sensitivity
  misc_feature: Functional homolog of the protein sequence given in SEQ ID NO 14255
  misc_feature: Ceres ANNOT ID no. 8668778
  misc_feature (42)..(315): SWISSPROT Homolog: EC 2.7.11.1 Non-specific serine/threonine protein kinase
  misc_feature (47)..(301): Pfam ID: Pkinase Pfam Description: Protein kinase domain
  misc_feature (386)..(443): Pfam ID: NAF Pfam Description: NAF domain
MAAVTPPPQSDPSPKAGRPASSAAAAAAAKRGGGGAGAAGGLLMGKYELGRLLGHGTFAKVYLARHVGTGDSVAIKVLDKEKAVKSGLVPHIKREIAVLRRVRHPNVVHLFEVMATKTKIYFVMELVRGGELFSRVSKGRLREDNARRYFQQLVSAVGFCHARGVFHRDLKPENLLVDDRGNLKVSDFGLSAVADQFRPDGLLHTFCGTPAYVAPEVLGRRGYDGAKADVWSCGVILFVLMAGYLPFHDKNIMAMYKKIYKGEFRCARWFSKDLTSLLTRILDTNPNTRITLPEIMESRWFKKGFKPVKFYIEDDQLHNVIDDEDGLLDMGPAGTVPPPLPPPPPPLPPPKVDGDESGSDSDSSISSCPASVLSGESQRPRGSLPRPASLNAFDIISFSRGFNLSGLFEEKGDEVRFISAEPMSDIITKLEDIAKLKSFKLRRKDWRICLEGTREGVKGPLTIGAEVFELTPPLVMVEVKKKAGDNEEYEDFCNKELKPGMQHLVHHMVRAPSMLTDAE

SEQ ID NO: 16952 - DNA, 870 bp, Sorghum bicolor
  misc_feature: Ceres ANNOT ID no. 8668810
  misc_feature: Encodes the peptide sequence at SEQ ID NO 16953
atgataaggggcggcaacaaccaggaggcggcggacgtcgaggagctgctagcccaccaccagcagaacaagcagcacgccgccgtggcgacgtcgtcgcggcaatggtcggcgcagacggagtcgcgcatcgtgcgcgtctcccgcgtcttcggcggcaaggaccgccacagcaaggtgaagaccgtcaaggggctgcgcgaccgccgggtgcgcctctccgtgcccacggcgatccagctctacgacctgcaggaccgcctcggcctcaaccagcctagcaaggtcgtcgactggctgctcaacgccgcgcgccacgagatcgacaagctgccgccgctgcagttcccgcctcatcaggacctcatggtcggccacctcacgccccacatgccgctcgtgcacgaggagacgaagttcggacacatcgccgcggccgcggcgctggcgagcgacggcggcggcgccaaggtcagccagcagggcgacgtcgacgtcgatgtcgacgggaccggcggagcccaccacttggtggggaggttccccggcggcggctactaccaccggttcatggagctgaacagcgcgttgggcatggtcagtagcgcaatggcgccgtatagcaactacaccggagaggcatggaataacagcagcggcggcatgcatgacggcggcgcaggcggctcgccgcaggtcgtggcagcggctcaccactcgccgttcccgtcgttgctctccttggctccacgtccgcatcagctggcgttctactcctcggaaggtgatcagcagtttcaggtggagaaccttggctcgcaaagcctgtccttgagctcggcgagggcttaccatgatcaggctagctag

SEQ ID NO: 16953 - protein, 289 aa, Sorghum bicolor
  misc_feature: The sequence is a functional homolog of SEQ ID NO 1202 in the 10/666,642 US patent application
  misc_feature: Ceres ANNOT ID no. 8668810
  misc_feature (37)..(223): Pfam ID: TCP Pfam Description: TCP family transcription factor
MIRGGNNQEAADVEELLAHHQQNKQHAAVATSSRQWSAQTESRIVRVSRVFGGKDRHSKVKTVKGLRDRRVRLSVPTAIQLYDLQDRLGLNQPSKVVDWLLNAARHEIDKLPPLQFPPHQDLMVGHLTPHMPLVHEETKFGHIAAAAALASDGGGAKVSQQGDVDVDVDGTGGAHHLVGRFPGGGYYHRFMELNSALGMVSSAMAPYSNYTGEAWNNSSGGMHDGGAGGSPQVVAAAHHSPFPSLLSLAPRPHQLAFYSSEGDQQFQVENLGSQSLSLSSARAYHDQAS

SEQ ID NO: 16954 - DNA, 1560 bp, Sorghum bicolor; identical to SEQ ID NO: 16950
  misc_feature: Ceres ANNOT ID no. 8668781
  misc_feature: Encodes the peptide sequence at SEQ ID NO 16955

SEQ ID NO: 16955 - protein, 519 aa, Sorghum bicolor; identical to SEQ ID NO: 16951
  misc_feature: Useful for making plants with modulated biomass
  misc_feature: Functional homolog of the protein sequence given in SEQ ID NO 14256
  misc_feature: Useful for making plants with modulated salt sensitivity
  misc_feature: Functional homolog of the protein sequence given in SEQ ID NO 14255
  misc_feature: Ceres ANNOT ID no. 8668781
  misc_feature (42)..(315): SWISSPROT Homolog: EC 2.7.11.1 Non-specific serine/threonine protein kinase
  misc_feature (47)..(301): Pfam ID: Pkinase Pfam Description: Protein kinase domain
  misc_feature (386)..(443): Pfam ID: NAF Pfam Description: NAF domain

SEQ ID NO: 16956 - DNA, 1455 bp, Sorghum bicolor
  misc_feature: Ceres ANNOT ID no. 8668776
  misc_feature: Encodes the peptide sequence at SEQ ID NO 16957
atggagaagaaccaagactcccagttgatcatgggccggtacaggctgggccgcctcctcggctgcggcacctttgccaaggtgtacaaggcccataaggtggccaccggcgaggccgtggccgtcaaggtgctggacaaggatgccgtccaccgctccggcatggcggagaaagtgaagaccgaggtggacgtgatgcggcgcgtgcgccaccccaacgtcgtccgactccacgaggtgatggccacgcggtccaggatctacttcgtcatggagtacgccagcggcggcgagctcttcgcgcgcctatcccagagcgcgcggtttccagagcccgtggcgcgccggtacttccagcagctgatcacggccgtcgagttctgccacagccgcggcgtctaccaccgcgacctcaagcccgagaacctcctccttgacgcgcgcggcgacctcaaggtctccgactttgggctcagcgcgctgcagcaggacagcggcgcccgcttccgcggcgacggcctcctgcacacggcgtgcggcacgccggcgtacgtcgcccccgaggtcctcttgaagagtggctacgacggcgcgaaggcggacatctggtcgtgcggcgtgatcctgtttgtgctcctggcaggctacctcccgttcagcgacaccaacctgatgctgttgtaccggaagatcacgcagagcaactacatgtgcccgccgtggttctccgtcgaagcgcgcaagctccttgccaggatgctagaccccaaccccaggaccaggatcaccatcgccaagatcacggctaatccctggttccagaaaggactctgccctcgcactaccggcaagtccgacgtctcgagcgagacctccgaggcgctgggcaaggaagcctgcaagtgccaccaccagcgtgaggacggcgacgacgacgacgacgacgacgacgaggacacccggaagaggaagcggtccaaggtgacggtgtcttcgccgaccgtcgccgtgaggccttcaagtatgaacgcctttgacatcatctcacgatcgagtgggttggacctgtccaagatgttcgatgaggagcacaggttggaggcacggttctcttctagagaaaccacggcggcgatcgtgtccaagctggaggagatcgctgagacgcggaagctcagcgtcaagctgaacaaagggggcagagtcgagatggagggcagacaggactgtcggagaggtgcactcgccctcgaggcagagatcttcgaggtggcgccgtcggtgcacgtggtggagatgaggaagaccggcggtgactcgctcgagttccgcgaattctacagggaggaactgaagccgtcgttaggtgacattgtgtggtcgtggcagggcggtgattcgccgcctccggctcccgtgctcgtaccgaggcatgctaccaatcaacgttcctga

SEQ ID NO: 16957 - protein, 484 aa, Sorghum bicolor
  misc_feature: Useful for making plants with modulated biomass
  misc_feature: Functional homolog of the protein sequence given in SEQ ID NO 14256
  misc_feature: Useful for making plants with modulated salt sensitivity
  misc_feature: Functional homolog of the protein sequence given in SEQ ID NO 14255
  misc_feature: Ceres ANNOT ID no. 8668776
  misc_feature (23)..(279): SWISSPROT Homolog: EC 2.7.11.1 Non-specific serine/threonine protein kinase
  misc_feature (14)..(273): Pfam ID: Pkinase Pfam Description: Protein kinase domain
  misc_feature (338)..(396): Pfam ID: NAF Pfam Description: NAF domain
MEKNQDSQLIMGRYRLGRLLGCGTFAKVYKAHKVATGEAVAVKVLDKDAVHRSGMAEKVKTEVDVMRRVRHPNVVRLHEVMATRSRIYFVMEYASGGELFARLSQSARFPEPVARRYFQQLITAVEFCHSRGVYHRDLKPENLLLDARGDLKVSDFGLSALQQDSGARFRGDGLLHTACGTPAYVAPEVLLKSGYDGAKADIWSCGVILFVLLAGYLPFSDTNLMLLYRKITQSNYMCPPWFSVEARKLLARMLDPNPRTRITIAKITANPWFQKGLCPRTTGKSDVSSETSEALGKEACKCHHQREDGDDDDDDDDEDTRKRKRSKVTVSSPTVAVRPSSMNAFDIISRSSGLDLSKMFDEEHRLEARFSSRETTAAIVSKLEEIAETRKLSVKLNKGGRVEMEGRQDCRRGALALEAEIFEVAPSVHVVEMRKTGGDSLEFREFYREELKPSLGDIVWSWQGGDSPPPAPVLVPRHATNQRS

SEQ ID NO: 16958 - DNA, 570 bp, Sorghum bicolor
  misc_feature: Ceres ANNOT ID no. 8668848
  misc_feature: Encodes the peptide sequence at SEQ ID NO 16959
atgtcgcggcagcagataggtggcggtggcagcgccacgccgatgtgcgccgcgggctgcggtttctttgggagcccggcgaccctcggcatgtgctccgtctgctacaagaagcactgctgcaccattacggacggtccaggcgcctcctacgccgcaacggcgatcgatcccgtcgtcacccgatccaccgctaccgcggtgacccccgggcccggcgccgccgcggctaagccaacggtggtggccgcgcgcacgcccgccgcgagcgtctgtttgttggctcctgctgctaaaggcgccgtagcggaggccgccgccgtgtcgccgccccacgctcccgaggcggcggcgaagaagaagaaggcgccgccaccgggccggtgcgcggcgtgctgcaagaaggtggggctcacggggttcgtgtgccgatgcgggaacacgttctgcgggagccaccggtacgcggaggagcacggctgcagcttcgacttcaagggcgccagccgtgacgccatcgcccgcgccaacccggtcatcaaggcggagaagctgaccggcaagatctga

SEQ ID NO: 16959 - protein, 189 aa, Sorghum bicolor
  misc_feature: Useful for making plants with altered alkaloid content
  misc_feature: Useful for making plants with altered lignin content
  misc_feature: Functional homolog of the protein sequence given in SEQ ID NO 14455
  misc_feature: Ceres ANNOT ID no. 8668848
  misc_feature (129)..(169): Pfam ID: zf-AN1 Pfam Description: AN1-like Zinc finger
  misc_feature (13)..(37): Pfam ID: zf-A20 Pfam Description: A20-like zinc finger
MSRQQIGGGGSATPMCAAGCGFFGSPATLGMCSVCYKKHCCTITDGPGASYAATAIDPVVTRSTATAVTPGPGAAAAKPTVVAARTPAASVCLLAPAAKGAVAEAAAVSPPHAPEAAAKKKKAPPPGRCAACCKKVGLTGFVCRCGNTFCGSHRYAEEHGCSFDFKGASRDAIARANPVIKAEKLTGKI

SEQ ID NO: 16960 - DNA, 1866 bp, Sorghum bicolor
  misc_feature: Ceres ANNOT ID no. 8668861
  misc_feature: Encodes the peptide sequence at SEQ ID NO 16961
atggagccgtcgtcgtccatcacgtttgcgtcgtcgtcgtcgtacctgtccaacggctccagcccctgttccgtcgcgatgccgccaccggggccgccccaggctccccccttggctggcggcgaggggtggggtggtggagtcgctaccgcagggagcggaagcagcgtggaggcggtgagcctgaaccgcctcagcaaaaacctcgagcggctgctcctcgatcgggacctcgactgcagcgacgccgacgtcgaggtgcccgacggcgggccgcccgtacccatccaccgctgcatacttgccgcgcgcagcgacttcttctacgacctcttcgccgcgcgcggccgcggaggggcactgcgcggtgatgcgaccgccggcgccggaggagctgcggagggggctgccagtggaaggccgcggtacaagatggaggagctcgtccccgggggtcgcgtggggcgcgaggccttccaggcgtttctggggtacatgtacaccggcaagctccggccgtcaccggtcgacgtggtttcttgtgctgacccagtgtgcccgcacgattcgtgcccgccggccatcaggtccgctgtcgagctcatgtacgcggcgtgtaccttcaagatccccgagctcacctcgctcttccagcggcgtcttcttaactttgtagacaagacccttgtggaggatgtcattcctattttgaaagttgcttcccactcagggctgactcaagtgatcgacaaatgtattcaaaggattgctagatcagatcttgacgatatatctttggataaggagctccctccagaagctgttgaggagataaaaaatttgcgcaagaagtcacaaactgctgatggcgatggcgatgcattcatttcggaccctgtgcatgagaaaagagtcagaagaatccacagggcactcgactctgatgatgttgagcttgtgaagttgcttcttaatgagtctgatatcacattagatgacgccaatgcattacactatgctgcttcttactgtgataataaagttgtctcagagctattagatttggcgctggctaacttaaatttgaagaatagccgtggatacacagcactccacttggctgctatgaggagagaaccagctatcattatgtgtctccttaacaaaggggcaaatgtatcacaactgacagctgatggcaggagcgcaattggtatttgtcggaggttaacaagattaaaagactacaatacaaagatggagcagggtcaagaatcaaataaagataggctgtgtatagatattctagagagggagatgatgcgaaatcctatggcggtggaagatgctgtcacctcacctttattggcagatgatcttcacatgaagcttctctacctggaaaacagagttgcatttgctagattgttctttcctgctgaagccaaggtcgctatgcaaattgcacaagcagacaccacagaagaattcggcggtatagttgcagcaagtacttctggtaaactgagggaggtcgaccttaatgagacgccagtcacacaaaacaaaagactccgttcaagggtagatgcactgatgaaaacagtggagctgggccgtcggtacttcccgaactgctcgcaggtgctggacaaattcctggaggacgacctgccggacgggcttgaccagttctacctccagaggggcactgctgacgagcagaaggtgaagaggatgcgcttctgtgagctgaaggaggacgtgctgaaggcttttagcaaggacaaggcggacagcagcatgctctcgggcctgtcttcgtcctcgtcgtgctcgccaccccagaaatcggccaagaggtga

SEQ ID NO: 16961 - protein, 621 aa, Sorghum bicolor
  misc_feature: The sequence is a functional homolog of SEQ ID NO 1466 in the 10/374,780 US patent application
  misc_feature: The sequence is a functional homolog of SEQ ID NO 872 in the 10/666,642 US patent application
  misc_feature: The sequence is a functional homolog of SEQ ID NO 10 in US patent 7148398
  misc_feature: The sequence is a functional homolog of SEQ ID NO 10 in US patent 7294757
  misc_feature: The sequence is a functional homolog of SEQ ID NO 4 in US patent 7030293
  misc_feature: The sequence is a functional homolog of SEQ ID NO 146 in the 10/666,642 US patent application
  misc_feature: The sequence is a functional homolog of SEQ ID NO 2062 in the 10/374,780 US patent application
  misc_feature: The sequence is a functional homolog of SEQ ID NO 1430 in the 10/666,642 US patent application
  misc_feature: The sequence is a functional homolog of SEQ ID NO 1586 in the 11/479,226 US patent application
  misc_feature: The sequence is a functional homolog of SEQ ID NO 170 in the 10/225,068 US patent application
  misc_feature: The sequence is a functional homolog of SEQ ID NO 240 in the 10/374,780 US patent application
  misc_feature: Ceres ANNOT ID no. 8668861
  misc_feature: Up-regulated in shoot tissues in response to salicylic acid treatment
  misc_feature: Up-regulated in root tissues in response to salicylic acid treatment
  misc_feature (366)..(398): Pfam ID: Ank Pfam Description: Ankyrin repeat
  misc_feature (332)..(365): Pfam ID: Ank Pfam Description: Ankyrin repeat
  misc_feature (74)..(225): Pfam ID: BTB Pfam Description: BTB/POZ domain
MEPSSSITFASSSSYLSNGSSPCSVAMPPPGPPQAPPLAGGEGWGGGVATAGSGSSVEAVSLNRLSKNLERLLLDRDLDCSDADVEVPDGGPPVPIHRCILAARSDFFYDLFAARGRGGALRGDATAGAGGAAEGAASGRPRYKMEELVPGGRVGREAFQAFLGYMYTGKLRPSPVDVVSCADPVCPHDSCPPAIRSAVELMYAACTFKIPELTSLFQRRLLNFVDKTLVEDVIPILKVASHSGLTQVIDKCIQRIARSDLDDISLDKELPPEAVEEIKNLRKKSQTADGDGDAFISDPVHEKRVRRIHRALDSDDVELVKLLLNESDITLDDANALHYAASYCDNKVVSELLDLALANLNLKNSRGYTALHLAAMRREPAIIMCLLNKGANVSQLTADGRSAIGICRRLTRLKDYNTKMEQGQESNKDRLCIDILEREMMRNPMAVEDAVTSPLLADDLHMKLLYLENRVAFARLFFPAEAKVAMQIAQADTTEEFGGIVAASTSGKLREVDLNETPVTQNKRLRSRVDALMKTVELGRRYFPNCSQVLDKFLEDDLPDGLDQFYLQRGTADEQKVKRMRFCELKEDVLKAFSKDKADSSMLSGLSSSSSCSPPQKSAKR

SEQ ID NO: 16962 - DNA, 1257 bp, Sorghum bicolor
  misc_feature: Ceres ANNOT ID no. 8668878
  misc_feature: Up-regulated in shoot tissues in response to salicylic acid treatment
  misc_feature: Up-regulated in root tissues in response to salicylic acid treatment
  misc_feature: Encodes the peptide sequence at SEQ ID NO 16963
atggagctggaggcggcgccgcggcagcagcagcagctggaggaggaggaggaggaggtggtggggtgcacatgcggcggcggggccgaggccgcggaccagttcgagcggctccacgacgcggtgctgctcgacgtcctcaaccgcatcggcgacgtcaaggcgctgggccgctgcgccctcgtctcgcgccgcttccacgcgctcgtgccgctcgtcgactccgtcttcgtccgcgtcgactgcgtcatccccgacgacccgacgccctccgccgccgccgccgcaccgggctccgcgccgcaccaggccccggccacggccgcgcgcgggcgcggcggcgcgctcgcgcacatggcgcgcgtcctgctcggcggcatcgccaggcccatccacgcgctcggccagatcctctcccccgccgcggcggccgtctcccggcgctccgacccaccactgcccgcttccccgcccgcgcccgtcgcggacgtctcccaccactcgccctccgaggtgctccgctccttcagggagctgcggcgcctccacatcgagctgcccacgggcgagctcggcattgacgacggcgtgctccttaagtggaaggccgacttcggctccaccctcggcagctgcgtcatcctcggcgcctcgtcggtcttgtccaagccgcccacagggtcgaccacccaggcggaacctgctgcggccgacagcacggccgccgctctggataccagtagggagactgaagagccggggagcctgcctgattctctctacacaaatggagggctcaagcttcgcgttgtctggaccatcagctccctgattgctgcgtcggcgaggcattacttgctgcacccgattatctgtaatcacgaaacgctggagagcttggacctgacagatgccgacggccaaggggtgctcaccatggacaagaggcagctgcaggaactgcgggtgcggcccgtctctccgtcggggagctcgcaccgcacactcatgccggcactcagtatgcgtctgcactatgcaccgctcattgagctgcctgggggaacgctgctgaagggcgcgacactggttgcgatcagaccaagcgaggatgccttgagggagggccaaggggctggggctgcaggtcctgttggtacatgctggatttcagaggcctttgaggagccatatcggactgcggcaaaggtgcttctcaagagaagggcatattgccttgaaatgaactcgttctga

SEQ ID NO: 16963 - protein, 418 aa, Sorghum bicolor
  misc_feature: Useful for making plants with modulated low light sensitivity
  misc_feature: Useful for making plants with modulated nitrogen use efficiency
  misc_feature: Functional homolog of the protein sequence given in SEQ ID NO 13503
  misc_feature: Ceres ANNOT ID no. 8668878
MELEAAPRQQQQLEEEEEEVVGCTCGGGAEAADQFERLHDAVLLDVLNRIGDVKALGRCALVSRRFHALVPLVDSVFVRVDCVIPDDPTPSAAAAAPGSAPHQAPATAARGRGGALAHMARVLLGGIARPIHALGQILSPAAAAVSRRSDPPLPASPPAPVADVSHHSPSEVLRSFRELRRLHIELPTGELGIDDGVLLKWKADFGSTLGSCVILGASSVLSKPPTGSTTQAEPAAADSTAAALDTSRETEEPGSLPDSLYTNGGLKLRVVWTISSLIAASARHYLLHPIICNHETLESLDLTDADGQGVLTMDKRQLQELRVRPVSPSGSSHRTLMPALSMRLHYAPLIELPGGTLLKGATLVAIRPSEDALREGQGAGAAGPVGTCWISEAFEEPYRTAAKVLLKRRAYCLEMNSF

SEQ ID NO: 16964 - DNA, 672 bp, Sorghum bicolor
  misc_feature: Ceres ANNOT ID no. 8668899
  misc_feature: Encodes the peptide sequence at SEQ ID NO 16965
atgtcgcgcgcgacgcagtcgcccagcaagcgcgcgaacgccgcgtccgtcgcggcggtggcagcggcaggcccggcccacgcgcagggcgaggaggcgtcgtcgctctggggggccggggcgccgtgcggcgcgtgcaagttcctgcggcggcgatgcgtgccggggtgcgtcttcgcgccgcactttggcggcagcggcgggggcggggccggcgcggcgcagttcgcggccgtgcacaaggtgttcggcgccagcaatgtggcgaagatgctgtcgcgggtgcccgtggcgctgcgccgggacgcggccagcaccgtctgctacgaggcgcaggcgcgcatcgccgatcccgtctacggctgcgtcggcaccatccttgcgctccagcaccaggtagcactcgtccaagccgagctctccattgcgcaaaccgagctactcaaccacaggctggccttggcaacggtgcatccggcgtacaccgttgcgtcgcccacgagccaaatggtgaactgtagctctctctcacaggccgtggatttcatagacactgagccaaaatgcttcccgccgcctctcctaccattaccatcgcagcaacagcgggaacaagaacgggagaggggcagtccaacggatgttttcgcgcacaacacccccgggaaatag

SEQ ID NO: 16965 - protein, 223 aa, Sorghum bicolor
  misc_feature: Useful for making plants with modulated biomass
  misc_feature: Useful for making plants with modulated low light sensitivity
  misc_feature: Functional homolog of the protein sequence given in SEQ ID NO 13882
  misc_feature: Ceres ANNOT ID no. 8668899
MSRATQSPSKRANAASVAAVAAAGPAHAQGEEASSLWGAGAPCGACKFLRRRCVPGCVFAPHFGGSGGGGAGAAQFAAVHKVFGASNVAKMLSRVPVALRRDAASTVCYEAQARIADPVYGCVGTILALQHQVALVQAELSIAQTELLNHRLALATVHPAYTVASPTSQMVNCSSLSQAVDFIDTEPKCFPPPLLPLPSQQQREQERERGSPTDVFAHNTPGK

SEQ ID NO: 16966 - DNA, 3711 bp, Sorghum bicolor
  misc_feature: Ceres ANNOT ID no. 8668979
  misc_feature: Encodes the peptide sequence at SEQ ID NO 16967
atggcggaggaaccggcggtcggttacgatggcttcgaggccgccggcgatgctggcgccggtggcgcggaggacaacctgtcgatgcccctcggcgacttcatggcgttcctcgagactgagcccgcgccaccagaggagggcggggaggaggaggaggagcaggagcagctgcagcctgggaccttgagagtggccactatcaaggtcaatcaaggttgtttcgagatgcctgccaacactgatggttctgaagatttactccaaagccatgaagaaatgtttgagaatgcagatctttggtcaaactactcccatgtggacacttcagagtgccatatggagctcagcggaggagaacaaatgattgatcacacagaggctagcccttatgaattttttagcaacgatctgcagaaccaatcaagaacttccaacttggacaatgaacattttccaagggatgcatcaaaccatgctaatgttgaagaagttgctggacctccatatgaagatctctcaaatggtttgtaccttcgacagcaaactctatactctggccaaacacaattccaagtggagaacaacacagaaggcatggagacacaaatgaacacttatttctcaggtggtatatccacagagcactcagatttgatgcttggtagtactggtcaggatggtgaccatttcacttcgatgggcatgttttctcttacccataaaacagatgttcctgatatttcttgcaccgagttcaacatgggcgagggaactgaaagcattcgcaatggcaacagtagttgccttactatgcaggaagcagaatgtggaggatatcctcatccagattgtatatctgttgatatggttgatgaaagatcactgcatgatttgccccatgggttttcacaaaacaatgagcaatatgagatggagcagttcccacagagtatatgtgaaagcggttctatgcagatgggctctccggaccaatattgtgatgatacatctttatcagatttttacatggatgtatcctccccagagtcaatatcctgtgagcagaaccagtctgaagatatttgtttcaagagcgagtctagcactgactcttctccaataccctctagcagaaattccaccacagaggatgctgataaatacttaggtcaaacatcaaaacaattgctggactccaaaattgttcctttcagcaaccagcacacatttaagaacatgggatatcagaaacctctggcattgcataaacaatatgcatatagaagtgacaactcttctattcacaattcatcaagaggttgcttcaatagagatggggacggggcttctgatttatgtgtgctcgagggtaataggaatcctgctcctgatcaccgattgccttaccagggaaagttccatcataattttcagcaacacatgtatagcaattccatgattcctgcatttggtggtatgagatacaagccacatgatgaaagaatcactctgcgcctcgcattgcaggatatttcacagccaaaatctgaggctaacccacctgatggggttttagcagttcctttattgaggcatcagaaaattgccttgtcatggatggtgcaaaaggagacaagtagctcacattgctctggtggaattcttgcagatgatcagggcctgggtaaaactgtatcagccatatcactaattcttactgaacgctcaccagttccacagtcatctactattaaaaatgagccatgtgaagctgtaactctagatgacgacgatgaggatgactctgttgaacctcatccaaaaaagctgatgcagacatgtagctctaaagtgacaactaacacagtgaagcaagaaaatccttttgtagcgattaagacaaggccagctgctggtactttggttgtttgcccaacaagtgttttgcgacagtgggcaggagaactgaagaacaaagttacaagtaaagctaatttgtcttttctgatctatcatggtagcaatcgcaccaaggatcctaatgaactcaccaaatatgatgttgtgcttactacatattccatagtaagcatggaggtaccaaaacaatcaaatcctgatagtgatgatgaagagaaagggaagcctgaccgatatggtgcacctgtgtcctcttcaggcagcaaaaagagaaaggccccttctaagaaaacaaaatgtaaaagtgctgcagagagttgcttgcctgaaaaacctcttgcgaaagttgcttggtttagggttattcttgatgaagcacaaagtattaagaattaccgaactcaggttgccagggcttgctggggtttgagagccaaaagaagatggtgtttgtctgggacgcctatacagaatgctgttgaggatctctatagctatttcaggtttctcagatacgatccctatgctgtatataagcagttttgcactatgataaagattccaatcagtaggaacccaactaatggttacaagaagcttcaagttgttttgaagacggtaatgctacgccggactaaagcaaccatgcttgatgggaaaccaatcatatccttaccgcccaagactgtttcacttaagacagtggacttcactggcgaagagcgtgctttttacaacactttagaagttgaatcacgagaacagttcaaggaatatgcagctgctggtactgtaaagcaaaattatgtcaacattctattgatgcttttacggctaagacaggcatgcgatcaccctcacctagttagaggctataactcctcttctagttggatgtcttcgttggagatggatgcgccagaagatcctgttgtcactatatgtggtcatgttttttgcaaccagtgcatactggagcaactcactggtgacgatagcgtatgcccagtgtctaattgcagagtccgactaaatacaacctcactattctccagaggcacccttgaatgctctctgagtagattgacctgtgatttcaagtctgatgatgatacctgtatggaaatgatacatgctgaaaagcgccctgggatagattcatcctacgcttcttcaaaagtgagagctgcactagatattcttctctcgttgcccagaatagatcccacccaaatgactgatagcaaatgttcaatcgggcttgaatctgagaagtttgatggaaggggtacttcagaacaaattgacaccaagttgacagagaaggccattgttttctctcagtggactagaatgctagacttgcttgaagtccatttgaaagcttctcatgtgacatatcgaaggcttgatggaacaatgtctgttgccgcacgggataaagccgtgaaagacttcaatacggttccagaggttactgttatgattatgtcactcaaagctgcaagtctcggcttgaacatggttgctgcttgccatgtacttatgctagatctttggtggaacccgaccactgaggaccaagccgttgatagagcacaccgtattggccaaacacgacctgtcacagtatcacgattaactataaaagacaccgtggaagatcggattctggctctccaggagaaaaagcgggagatggttgcttctgcgtttggggaagacaaatctggttcccgacagactcgattgactgttgaagacctgaactatctgtttatggtgtag

SEQ ID NO: 16967 - protein, 1236 aa, Sorghum bicolor
  misc_feature: The sequence is a functional homolog of SEQ ID NO 148 in the 10/666,642 US patent application
  misc_feature: Ceres ANNOT ID no. 8668979
  misc_feature (533)..(930): Pfam ID: SNF2_N Pfam Description: SNF2 family N-terminal domain
  misc_feature (1100)..(1178): Pfam ID: Helicase_C Pfam Description: Helicase conserved C-terminal domain
MAEEPAVGYDGFEAAGDAGAGGAEDNLSMPLGDFMAFLETEPAPPEEGGEEEEEQEQLQPGTLRVATIKVNQGCFEMPANTDGSEDLLQSHEEMFENADLWSNYSHVDTSECHMELSGGEQMIDHTEASPYEFFSNDLQNQSRTSNLDNEHFPRDASNHANVEEVAGPPYEDLSNGLYLRQQTLYSGQTQFQVENNTEGMETQMNTYFSGGISTEHSDLMLGSTGQDGDHFTSMGMFSLTHKTDVPDISCTEFNMGEGTESIRNGNSSCLTMQEAECGGYPHPDCISVDMVDERSLHDLPHGFSQNNEQYEMEQFPQSICESGSMQMGSPDQYCDDTSLSDFYMDVSSPESISCEQNQSEDICFKSESSTDSSPIPSSRNSTTEDADKYLGQTSKQLLDSKIVPFSNQHTFKNMGYQKPLALHKQYAYRSDNSSIHNSSRGCFNRDGDGASDLCVLEGNRNPAPDHRLPYQGKFHHNFQQHMYSNSMIPAFGGMRYKPHDERITLRLALQDISQPKSEANPPDGVLAVPLLRHQKIALSWMVQKETSSSHCSGGILADDQGLGKTVSAISLILTERSPVPQSSTIKNEPCEAVTLDDDDEDDSVEPHPKKLMQTCSSKVTTNTVKQENPFVAIKTRPAAGTLVVCPTSVLRQWAGELKNKVTSKANLSFLIYHGSNRTKDPNELTKYDVVLTTYSIVSMEVPKQSNPDSDDEEKGKPDRYGAPVSSSGSKKRKAPSKKTKCKSAAESCLPEKPLAKVAWFRVILDEAQSIKNYRTQVARACWGLRAKRRWCLSGTPIQNAVEDLYSYFRFLRYDPYAVYKQFCTMIKIPISRNPTNGYKKLQVVLKTVMLRRTKATMLDGKPIISLPPKTVSLKTVDFTGEERAFYNTLEVESREQFKEYAAAGTVKQNYVNILLMLLRLRQACDHPHLVRGYNSSSSWMSSLEMDAPEDPVVTICGHVFCNQCILEQLTGDDSVCPVSNCRVRLNTTSLFSRGTLECSLSRLTCDFKSDDDTCMEMIHAEKRPGIDSSYASSKVRAALDILLSLPRIDPTQMTDSKCSIGLESEKFDGRGTSEQIDTKLTEKAIVFSQWTRMLDLLEVHLKASHVTYRRLDGTMSVAARDKAVKDFNTVPEVTVMIMSLKAASLGLNMVAACHVLMLDLWWNPTTEDQAVDRAHRIGQTRPVTVSRLTIKDTVEDRILALQEKKREMVASAFGEDKSGSRQTRLTVEDLNYLFMV

SEQ ID NO: 16968 - DNA, 438 bp, Sorghum bicolor
  misc_feature: Ceres ANNOT ID no. 8668986
  misc_feature: Encodes the peptide sequence at SEQ ID NO 16969
atggcggggaggtacgaccgcaacccgttcgaggaggacgacgtcaacccctttgcgggtggaagtgtacctcctgcttctaattctcggatgccacctcttcctcatgaaccagcaggcttctacaatgatcgtgttgcgacagtggacatacctcttgattcaactaaggaccttagtaaaaaggagaaagaactgcaggcaagggaagctgagctaaacaaacgggaaagggaactgaaaaggaaggaggaagctgcagccagagctggtattgtcattgaagataagaattggccaccctttatgcccattattcatcatgacattgcaaacgagataccaattcacctacaaaggatgcagtacctggcgttttcttcactgttgggtaagtgtcaattacttgttgccctcctatcgtgggaaataatttga

SEQ ID NO: 16969 - protein, 145 aa, Sorghum bicolor
  misc_feature: Useful for biocontainment applications
  misc_feature: Functional homolog of the protein sequence given in SEQ ID NO 13043
  misc_feature: Ceres ANNOT ID no. 8668986
MAGRYDRNPFEEDDVNPFAGGSVPPASNSRMPPLPHEPAGFYNDRVATVDIPLDSTKDLSKKEKELQAREAELNKRERELKRKEEAAARAGIVIEDKNWPPFMPIIHHDIANEIPIHLQRMQYLAFSSLLGKCQLLVALLSWEII

SEQ ID NO: 16970 - DNA, 2892 bp, Sorghum bicolor
  misc_feature: Ceres ANNOT ID no. 8669033
  misc_feature: Encodes the peptide sequence at SEQ ID NO 16971
atgacggcgcgcacgctctccctcctcctcttgctcgccgccgccgccagttccttcaccccgtcgacatccaccgataccatttaccggaacacgtcgctcaccggcaaccagacgctcgtctcggccggcggcatctacgagctgggcttcttcagcccggccggcgccaacggcaggacgtacctcggaatctggtacgccagcatcccgggcgcgacgaccgtcgtgtgggtcgccaaccgcagggacccggtgaccaactccccggccgctctccagctctccgccggcggccgcctcgtcatccttgacggcaacaacgacaccgtgtggtcctccccggcgcccaccgtcgggaacgtcacggcgcgcgccgccgcgcagctcctggacaccggcaacttcgtcctcagcggcgacggcagcggctccgggccgagcgtggcgtggcagagcttcgactacccgacggacacgctgctcccgggtatgaagctcggggtggacaccagggccagcatcacccggaacatcacggcgtggcgcagcgcgtccgacccgtcgccgggcgacgtcacgttcaagctcgtcatcggcggcctgccgcagttcttcctcctccggggcagcacgagggtgtacacgagcggaccgtggaacggcgacatactcaccggcgtgccgtacctcaaggcgcaggccttcaccttcgaggtggtgtacagcgccgacgagacgtactacagctacttcatccgcgagccgtctctgctgtcgcggctcgtcgtggacggcgcggcgacgcagctgaagcgcttctcgctcaacaacggcgcgtggaacagcttctggtactacccgaccgaccagtgcgactactacgccaagtgcgggccgttcgggtactgcgacaccgaccgctccccgccgtgcagctgcctgccggggttcgtgccgcgctcgccggaccagtggaaccagaaggagtggtccggcggctgtgtcaggagcacgaacctgacctgcgacggcggcggcggcgacgggttctgggtggtgaaccggatgaagctgccgcaggccacggacgcgacggtgtacgccggcatgacgctggaccagtgcaggcaggcgtgcctcggcaactgcagttgcggggcgtacgccgccgcgaacaacagcggcgggatcggcgtcgggtgcgtcatctggaccgtcgacctgctggacatgcggcagtacccgatcgtcgtgcaggacgtgtacatacggctcgcgcagtcggacattgacgccctcaaggctgcagcagcagataaccatcagcgttcacacaagagcaagctgatcatcatcgtcgtcgcgacgatttccggtgtgctttttctgctagcagcggctggctgctgctgtttgtggatgaagaataaggtgagcaagaaaggtgaaggtgaggacatggcgtcgtccatgcctccgagtactgcagagttcgcgcttccgtacaggatcaggagccagccttcgttgagcccagtacgggatcacaaacagcttcttgatgtctcggacgaaacgagatactccggcaatgatgttgaccttccgttgtttgagctggaggtcattctggccgccacggacaacttcgcggaccacaaaaggattggtgcaggtggatttggccctgtttatatgggagttcttgaggatgggcagcaaatagctgtgaagaggctgagccagggatcaactcagggggtgagggagttcatgaacgaggtgaaactgattgcaaagttgcagcacagaaaccttgttaggctcttcggctgttgcatcgaaaacgatgagaggatgcttgtgtacgagtacatgcacaaccagagcttggacacatttatatttgacgaagcaaagcgcaggctgctgagatggcagaaacggttcgagatcattcaggggattgcacggggtctacagtatctgcacgaggactcaaggttcaggatcatccacagggacctgaaggctagcaacgtgttgctggacagaaacatggtccccaagatctctgattttggcatcgcaagaatgtttggaggtgaccagaccagtgcatacacccgaaaggtcgtcggaacatatggctacatggctccagaatacgccatggacggccagatctcgataaaatccgacgtcttcagcttcggcgtgctggtgctggagatcatcgccggcaggaggaaccgaggctcctacgaacccgacctcgatgtcaatctcctaggatatgcatggatgctgtggagagaagggcggagcatggagttactgctggacgaggcgttgggcggcagcttccaccacagcagggtgctgcggtgcatccaggtggcgctgctgtgcgtcgaagcgcagccgaggaaccggccgctcatgtcgtcggtggtcaccatgctggccagcgacaacgccgtgctccccgagcccaacgagcccggggtgaacccagggatgagcacgtcgtcggacacggagtcgtctcggacacggagcgcgaccgccaactacgtgacggtcaccagattagaggcgagccgcagcgtcgcaccgccgccgcgcccgcttccgcctgctcgccgcgaccagcgccagtctaggcccgcctcgcgtaccgcttgggtccagcgccccgcgatcgcggcaagtcgcggcccgcgccccgcgtccccggcgctcgccggtggccgtgcgtggtcggggccgcctgcctcggctccctccggcctcggcccgtgctcggcccgtgcccgtgcgctgccccctacctcggccgctccaagccgacgtgaaggtatttttttttctaaattttttatttaa

SEQ ID NO: 16971 - protein, 963 aa, Sorghum bicolor
  misc_feature: Useful for making plants with altered cell wall content and/or composition
  misc_feature: Functional homolog of the protein sequence given in SEQ ID NO 14140
  misc_feature: Ceres ANNOT ID no. 8669033
  misc_feature (539)..(824): SWISSPROT Homolog: EC 2.7.11.1 Non-specific serine/threonine protein kinase
  misc_feature (551)..(823): Pfam ID: Pkinase Pfam Description: Protein kinase domain
  misc_feature (203)..(326): Pfam ID: S_locus_glycop Pfam Description: S-locus glycoprotein family
  misc_feature (73)..(189): Pfam ID: B_lectin Pfam Description: D-mannose binding lectin
  misc_feature (343)..(412): Pfam ID: PAN_2 Pfam Description: PAN-like domain
MTARTLSLLLLLAAAASSFTPSTSTDTIYRNTSLTGNQTLVSAGGIYELGFFSPAGANGRTYLGIWYASIPGATTVVWVANRRDPVTNSPAALQLSAGGRLVILDGNNDTVWSSPAPTVGNVTARAAAQLLDTGNFVLSGDGSGSGPSVAWQSFDYPTDTLLPGMKLGVDTRASITRNITAWRSASDPSPGDVTFKLVIGGLPQFFLLRGSTRVYTSGPWNGDILTGVPYLKAQAFTFEVVYSADETYYSYFIREPSLLSRLVVDGAATQLKRFSLNNGAWNSFWYYPTDQCDYYAKCGPFGYCDTDRSPPCSCLPGFVPRSPDQWNQKEWSGGCVRSTNLTCDGGGGDGFWVVNRMKLPQATDATVYAGMTLDQCRQACLGNCSCGAYAAANNSGGIGVGCVIWTVDLLDMRQYPIVVQDVYIRLAQSDIDALKAAAADNHQRSHKSKLIIIVVATISGVLFLLAAAGCCCLWMKNKVSKKGEGEDMASSMPPSTAEFALPYRIRSQPSLSPVRDHKQLLDVSDETRYSGNDVDLPLFELEVILAATDNFADHKRIGAGGFGPVYMGVLEDGQQIAVKRLSQGSTQGVREFMNEVKLIAKLQHRNLVRLFGCCIENDERMLVYEYMHNQSLDTFIFDEAKRRLLRWQKRFEIIQGIARGLQYLHEDSRFRIIHRDLKASNVLLDRNMVPKISDFGIARMFGGDQTSAYTRKVVGTYGYMAPEYAMDGQISIKSDVFSFGVLVLEIIAGRRNRGSYEPDLDVNLLGYAWMLWREGRSMELLLDEALGGSFHHSRVLRCIQVALLCVEAQPRNRPLMSSVVTMLASDNAVLPEPNEPGVNPGMSTSSDTESSRTRSATANYVTVTRLEASRSVAPPPRPLPPARRDQRQSRPASRTAWVQRPAIAASRGPRPASPALAGGRAWSGPPASAPSGLGPCSARARALPPTSAAPSRREGIFFSKFFI

SEQ ID NO: 16972 - DNA, 2541 bp, Sorghum bicolor
  misc_feature: Ceres ANNOT ID no. 8669039
  misc_feature: Encodes the peptide sequence at SEQ ID NO 16973
atggcgtccccactcctgtgcgtcctcctctacctactccgccaccttgcggcctgccatgccgcaaccgcaagggacaccatcacgccgggcaccccgctggcggccaacgagacgctggtctcgggcggcgagggcaacttcgcgctgggcttcttcaccccgccgggcgccaacagcacctacctcggcgtgtggtacaacaaggtctccctccgcaccgtcgtgtgggtcgccaaccgcgaggccccgatcgcgggcgccgtcggggacaacccgggcgccacgctctccgtctccgccggcggcacgctcgccattgccgcggggaacaagaccgtcgtttggtccgtccagccggcgtccaagctggcgaccccgaccgcccagatcctcgacaacggcaacctggtgctggccgacggcgtcggcggcgccgtggcgtgggaagggttcgactacccgacggacacgatgctcccggagatgaaggtggggatcgactacgtgaagaagaagaaccggacgctgacgtcgtggaagagcgcgtcggacccctccccgggccccgtcgccatggtgatggacaccaacggcgacccccaggtgttcatctggaacggcggcgagaaagtctggcgctccgggccctgggacggcgtccagttcaccggcgtgccggacaccgccacctactccggcttcaccttcagcttcataaacagtgcgcaggaagtaacctacagcttccaggtgcacaacgcgtcgatcatctcgcacctgggcgtcgtgagcacgggcaactacggcttgctgcagcgctcgacgtgggtggaggcggccaaggcgtggaacctgtactggtacgcgcccaaggaccagtgcgacgcggtgtctccgtgcgggcccaacggcgtgtgcgacaccaacaacatgcccgtctgctcctgcctccacggcttcaccccgaagacccccgcggcgtgggcgctgagggacggccgggacgggtgcgtgcggtccacgccgctggactgccgcaacggcaccgacggcttcatcacggtgcgccacgccaaggtgcccgacaccgagcggagcgccgtggactggagcctcacgctggagcagtgccggcaggcgtgcctccggaactgctcctgcaccgcgtacgccagcgccaacgtcagcgtcggcgccggcgggggacgcggcaacggcgcaggatcggggtgcgtcatgtggaccacggggctcaccgacctgcgcgtgtaccccgacttcggccaggacctcttcgtccgcctcgccgccgcggatctcgatgtactagaagctaaatcaagggaggcacggattaaaatcggagttggtgtcggcgtctcggtgctggcgcttcttctagcagttgctggtctcctcatctggtcaagaaggagaaagctaacaagaacagccggatcaagtaaatggagtggcgcctcacgcagcaccggccgtcggtacgagggaagcagtcatgatgatgacctggagctgccaatatttgatctggggacaattgcggctgctacggatggtttctccatcaacaacaagcttggcgaaggtggctttggaccagtgtataagggtaagctcgaggatggaatggaaatcgcagtgaaaacactttcgaaaacatctgcacaaggtcttgatgagttcaagaatgaggtcttgttgatagccaaactccagcatcggaatcttgttcggcttcttggatgcagcattagtggacaagaaaggatgcttgtttatgagtacatggcaaacaagagcctggactatttcctatttgaaaaagacaatgttgtacttgattggcaagtgcggtatcgcataatagaaggcattactcgaggtttactctatctccaccaggactcgagatacagaatcatccatagagatctaaaggcagctaacgttcttctagacacggagatgactcccaaaatttcagactttggaatggcaagaatatttggcaatgaagagacagaaattaatacccgaaaagtggttggcacatatggttacatgtctccggagtatgcaatggatggaatcttctctgtcaagtcagatgtattcagttatggagtattattgctggaaattgttagtggtagaagaaacagaggagtatattcctgttcaaacaaccaaagccttctaggccatgcatggagcttatggaacgaggagaagagcatagagttagcagatgaaagaatgaatggatcattcaactcagacgaagtacagaagtgcatcagagttggactcttgtgtgtgcaggagaatccagacgaccgtccactgatgtctcaggtgcttctgatgttagctagtcctgatgccacctcactgccaactcctaagcagcctggctttgcagctaggagagttctaatggaaacagacacatcatcaaccaagccagactgcagcatatttgacagtgcaacgatcaccatgcttgaaggtcgatag

SEQ ID NO: 16973 - protein, 846 aa, Sorghum bicolor
  misc_feature: Useful for making plants with modulated biomass
  misc_feature: Functional homolog of the protein sequence given in SEQ ID NO 14141
  misc_feature: Useful for making plants with altered cell wall content and/or composition
  misc_feature: Functional homolog of the protein sequence given in SEQ ID NO 14140
  misc_feature: Ceres ANNOT ID no. 8669039
  misc_feature (512)..(798): SWISSPROT Homolog: EC 2.7.11.1 Non-specific serine/threonine protein kinase
  misc_feature (201)..(329): Pfam ID: S_locus_glycop Pfam Description: S-locus glycoprotein family
  misc_feature (528)..(798): Pfam ID: Pkinase Pfam Description: Protein kinase domain
  misc_feature (346)..(422): Pfam ID: PAN_2 Pfam Description: PAN-like domain
  misc_feature (72)..(187): Pfam ID: B_lectin Pfam Description: D-mannose binding lectin
MASPLLCVLLYLLRHLAACHAATARDTITPGTPLAANETLVSGGEGNFALGFFTPPGANSTYLGVWYNKVSLRTVVWVANREAPIAGAVGDNPGATLSVSAGGTLAIAAGNKTVVWSVQPASKLATPTAQILDNGNLVLADGVGGAVAWEGFDYPTDTMLPEMKVGIDYVKKKNRTLTSWKSASDPSPGPVAMVMDTNGDPQVFIWNGGEKVWRSGPWDGVQFTGVPDTATYSGFTFSFINSAQEVTYSFQVHNASIISHLGVVSTGNYGLLQRSTWVEAAKAWNLYWYAPKDQCDAVSPCGPNGVCDTNNMPVCSCLHGFTPKTPAAWALRDGRDGCVRSTPLDCRNGTDGFITVRHAKVPDTERSAVDWSLTLEQCRQACLRNCSCTAYASANVSVGAGGGRGNGAGSGCVMWTTGLTDLRVYPDFGQDLFVRLAAADLDVLEAKSREARIKIGVGVGVSVLALLLAVAGLLIWSRRRKLTRTAGSSKWSGASRSTGRRYEGSSHDDDLELPIFDLGTIAAATDGFSINNKLGEGGFGPVYKGKLEDGMEIAVKTLSKTSAQGLDEFKNEVLLIAKLQHRNLVRLLGCSISGQERMLVYEYMANKSLDYFLFEKDNVVLDWQVRYRIIEGITRGLLYLHQDSRYRIIHRDLKAANVLLDTEMTPKISDFGMARIFGNEETEINTRKVVGTYGYMSPEYAMDGIFSVKSDVFSYGVLLLEIVSGRRNRGVYSCSNNQSLLGHAWSLWNEEKSIELADERMNGSFNSDEVQKCIRVGLLCVQENPDDRPLMSQVLLMLASPDATSLPTPKQPGFAARRVLMETDTSSTKPDCSIFDSATITMLEGR

SEQ ID NO: 16974 - DNA, 1833 bp, Sorghum bicolor
  misc_feature: Ceres ANNOT ID no. 8669048
  misc_feature: Encodes the peptide sequence at SEQ ID NO 16975
atgccggaagcaccgaccaccaagacaaccctgccggccggcggctttggccccggggcgcaccgcgaggcgctcgagttcatcgagcatgtcacggcgaacgccgggaaggtgcagcggcgcgtcctcgctgagatactgacgcagaacgcgccggccgagtacctgcgccgctacggcgtcccgggaggatccgccgacgccgtcgaagccttccgccgcgtcgtcccgctcgtcacctacgagggcctccagccggacatactccgcattgccagcggcgatacctcgccgatcctctcaggcaaacccatctccgagttcctcacgagctctggaacatccggaggggagaggaagctgatgccgaccatcgccgacgagctggacaggaggtcgttgctgtatagcctgcagatgccggtgatgagccagtcggtgccggggctggacaagggcaaggcgatgtacctgctattcgtgaaggcggagtcgcgcacacccggcgggctggtggcgcggccggtgctaacgagctactaccggagccggcagttcctggagcggccgcacgacccctacaccgagtacacgagccccaacgaggccatcctgtgcgtggactcgtaccagagcatgtacacgcagctgctgtgcggcctcgtccaccgcgccgacgtgctgcgcgtcggcgccgtgttcgcctcgggcttcctccgcgccgtccgcttcctcgagaagcactggccgcgtctgtgccgcgacatccgcacgggcacgctcgacccggagatcacggaccgcgccgtgcgcgacgccgtcgtcggcagggtacttcgcggcgccaacccggcgcttgccgacgagatcgaggccgagtgcgcgggaccgtcatgggagggcatcatccggcgcctgtggccccgcaccaagtacatcgatgtgatcgtgaccggggctatgtcgcagtacatcccgacgctggagttctacggcggggggctgcctctggcgtgcaccatgtacgcctcttccgagtgctacttcggcctcaacctgaagcccatgtgcaagccaggcgacgtggcatacacgctcatccccaccatgtgctacttcgagttccttcctctccagtgcagcgacggcaaggcggagccgagccaccgcgacctggttggcctcgtggatgtgaagctcggtcacgagtatgagctcgtggtcaccacctactccgggttgtatcggtaccgcgtgggcgacgtgctgagggttgccggcttcaagaacgaggcgccgatgttcaagttcatcaggcggcagaacgtggcgctgagcatcgactcggacaagacggacgagacggagctgcacgcggccgtgagcggcgcggtgcagcacctggcgccgttcggcgcgtcgctggtggagtacaccagctacgccgacgcggcgaccatcccgggccactacgtgctgttctgggagctgcgcgcgggcagcacggcggtgccggcgtccgtgttcgaggactgctgcctgtcggtagaggaggcgctcaacagcgtgtaccggcagtgccgggcctgcgacaagtccatcgggcccctggagatacgcgtcgtgtccgagggcaccttcgacaagctcatggactacgccatcagccgcggcgcgtccatcaaccagtacaaggcgccgcggtgcgtgcgcccggggcccgtcgtggagctgctcgacgcaagggtgcaggccaagtacttcagccccaagtgccccaagtggagtccagggaacaagcaatggaacgccgccagcaacggggacgcctga

SEQ ID NO: 16975 - protein, 610 aa, Sorghum bicolor
  misc_feature: Useful for making plants with modulated biomass
  misc_feature: Useful for making plants with modulated light quality response
  misc_feature: Useful for making plants with modulated low light sensitivity
  misc_feature: Functional homolog of the protein sequence given in SEQ ID NO 14293
  misc_feature: Ceres ANNOT ID no. 8669048
  misc_feature (23)..(578): Pfam ID: GH3 Pfam Description: GH3 auxin-responsive promoter
MPEAPTTKTTLPAGGFGPGAHREALEFIEHVTANAGKVQRRVLAEILTQNAPAEYLRRYGVPGGSADAVEAFRRVVPLVTYEGLQPDILRIASGDTSPILSGKPISEFLTSSGTSGGERKLMPTIADELDRRSLLYSLQMPVMSQSVPGLDKGKAMYLLFVKAESRTPGGLVARPVLTSYYRSRQFLERPHDPYTEYTSPNEAILCVDSYQSMYTQLLCGLVHRADVLRVGAVFASGFLRAVRFLEKHWPRLCRDIRTGTLDPEITDRAVRDAVVGRVLRGANPALADEIEAECAGPSWEGIIRRLWPRTKYIDVIVTGAMSQYIPTLEFYGGGLPLACTMYASSECYFGLNLKPMCKPGDVAYTLIPTMCYFEFLPLQCSDGKAEPSHRDLVGLVDVKLGHEYELVVTTYSGLYRYRVGDVLRVAGFKNEAPMFKFIRRQNVALSIDSDKTDETELHAAVSGAVQHLAPFGASLVEYTSYADAATIPGHYVLFWELRAGSTAVPASVFEDCCLSVEEALNSVYRQCRACDKSIGPLEIRVVSEGTFDKLMDYAISRGASINQYKAPRCVRPGPVVELLDARVQAKYFSPKCPKWSPGNKQWNAASNGDA

SEQ ID NO: 16976 - DNA, 1047 bp, Sorghum bicolor
  misc_feature: Ceres ANNOT ID no. 8669060
  misc_feature: Encodes the peptide sequence at SEQ ID NO 16977
atggcattgaggcagcagcagcagcagctgctggtggtggtggtcgtggcggccgtcgtcgtcgcgagctgccggccgggccgcgcggacccggccgcgatgagcgtgctgccgggcctccccgtcgccggcctcgcggtggggttctacaacgagtcgtgcccgcaggtcgaggacctggtgctcgccgagatgcagagcctcgtcggcaaggacaagaccatcgggccggcgctgctgcggttcatgttccacgactgcctcgtccggggctgcgacgcgtcgatcatgctcatctcccggaacaagaccggggagcgggacgccatcccgagctacggcctccgcggctacgacgagatcgagcacatcaaggccaaggtggaggacgcgtgcccgctgaccgtgtcgtgcgcggacatcatcatcatggcggcccgggacgccgtgtacctgagcaacgggccgcggtatgctgtggagaccggccgccgcgacggcaaggtgtcgttggactgcgacgccaacaacgacctcccgccgccgtcctccgcaatcgtcgacctcaagacctacttcagcttcaagggattgggctggaaggacctggtggtgctgtcaggaagccacacgatcgggagggcgcagtgctcgacgttcgcgtcggacaggctgtacaactacagcgggcgcgtggcgcaggacccgtcgctgaacaagacgtacgcggcgcacctgcgggagctgtgcgagccgggcgtcgccaacgacgccgccatggtggagatggacccgagcagcccctacacgttcgacctgagctactaccgcgccgtgcgcggcaacacggggctcttcacgtcggaccaggccctcctcgacgacccgtggaccagggcgtacgtggagcggatggccgccgcgggggcgtccaccgacgagttcttcgccgactacgcggccgccatgaccaacatgggccggatcgaggtgctcacgggggacaacggggagatcaggaaggtctgcgccgcgcacgttgactag

SEQ ID NO: 16977 - protein, 348 aa, Sorghum bicolor
  misc_feature: Useful for making plants with altered carbohydrate content
  misc_feature: Functional homolog of the protein sequence given in SEQ ID NO 13757
  misc_feature: Ceres ANNOT ID no. 8669060
  misc_feature (49)..(343): SWISSPROT Homolog: EC 1.11.1.7 Peroxidase
  misc_feature (61)..(308): Pfam ID: peroxidase Pfam Description: Peroxidase
MALRQQQQQLLVVVVVAAVVVASCRPGRADPAAMSVLPGLPVAGLAVGFYNESCPQVEDLVLAEMQSLVGKDKTIGPALLRFMFHDCLVRGCDASIMLISRNKTGERDAIPSYGLRGYDEIEHIKAKVEDACPLTVSCADIIIMAARDAVYLSNGPRYAVETGRRDGKVSLDCDANNDLPPPSSAIVDLKTYFSFKGLGWKDLVVLSGSHTIGRAQCSTFASDRLYNYSGRVAQDPSLNKTYAAHLRELCEPGVANDAAMVEMDPSSPYTFDLSYYRAVRGNTGLFTSDQALLDDPWTRAYVERMAAAGASTDEFFADYAAAMTNMGRIEVLTGDNGEIRKVCAAHVD

SEQ ID NO: 16978 - DNA, 1572 bp, Sorghum bicolor
  misc_feature: Ceres ANNOT ID no. 8669054
  misc_feature: Encodes the peptide sequence at SEQ ID NO 16979
atgggcgagcggaggaggcgcgcgagcgctgcttccttcggtggcggcggtggcggtggcggcggtggtagtgtggtgcccgcgcgtgccgaggagggcaaggccgcggcgccagggaaggcgccgcctccgacagtgtggttcgcgctcaagcggtcgctgcactgccgctccgagccgtcggaggtccacgtgccgcgcgccaaggccgccggacccgtcgccgccggaggcgcggccgtcggcggcggcggccacctgtcgtcgattgtcaccaccaagcgcgccacgcggtcggggtgctcgcgctccatcgccaacctccgcgacgtgatccacgggagcaagcgccacccggggcagccgcccagcagctgcagcccgcggtcgatcggcagcagcgagttcctcaaccccatcgcgcacgaggtcgtgctcagcaccaactcccgctgcgagctcaagatcaccggcttcggcgccggctgcggggggctggcggccgtcggggtcggaggcgggaccggcgccggcgcaggcgcaggcggcgcgcacgacgcggattccggcggcgtcgtgtcgtcgttcgtcggcacgctccgccccggcacgccgggccccgcgtgggccggagccggaggacacggcctgccgtacagcggctccgtgcggggcggcggcggcgtgcgctgcacgccgccgaggtccccgaacgtgctgctcgagaggaacggctccgtggtgaacgggaacggacaccgcgtctcctgcgacgaaaccggcaccaagcacggcgccggcaagggctccggcgggctcagctgccacaggtgcggcgagcagttcagcaagtgggaggcgctggaggcgcaccacctctccaagcatgcagtgacggagctgttggaaggagactcgtcgcggaagatcgtggagatcatctgccggacgagcctgctcaagtcggagagcagctgcgtccggatcgagcgggtgttcaaggtgcacaacacgcagcggacgctgtcccgcttcgaggagtaccgcgaggccgtgaagctcaaggcgagcaagctgcccaagaagcacccgcgctgcctcgccgacggcaacgagctgctgcgcttccacggcgccacgctctcgtgcgcgctcggcggtgccggctccggcaactccagcctctgcgcctccgacaagtgcgccgtgtgccgcatcatccggcacggcttctccgccaagaaggaaggcaaggccggcgtgggcgtgttcaccacgtccaccagcggccgcgcgttcgagtccatcgaggcggcccccggccccggcgccggggacgacggagcggaccagctgcagctgggcaccacgaccacgcgtaaggcgctgctggtgtgcagggtcatcgccgggcgcgtgcacaagccgctggacaacctcaaggagttcgtggggcagacgggcttcgactcgctcgccggcaaggtcggcccttactccaacatcgaggagctgtacctgctgaacccgagggcgctgctcccgtgcttcgtggtcatctgcaaaccgtag

SEQ ID NO: 16979 - protein, 523 aa, Sorghum bicolor
  misc_feature: The sequence is a functional homolog of SEQ ID NO 1546 in the 10/666,642 US patent application
  misc_feature: The sequence is a functional homolog of SEQ ID NO 652 in the 10/666,642 US patent application
  misc_feature: Ceres ANNOT ID no. 8669054
MGERRRRASAASFGGGGGGGGGGSVVPARAEEGKAAAPGKAPPPTVWFALKRSLHCRSEPSEVHVPRAKAAGPVAAGGAAVGGGGHLSSIVTTKRATRSGCSRSIANLRDVIHGSKRHPGQPPSSCSPRSIGSSEFLNPIAHEVVLSTNSRCELKITGFGAGCGGLAAVGVGGGTGAGAGAGGAHDADSGGVVSSFVGTLRPGTPGPAWAGAGGHGLPYSGSVRGGGGVRCTPPRSPNVLLERNGSVVNGNGHRVSCDETGTKHGAGKGSGGLSCHRCGEQFSKWEALEAHHLSKHAVTELLEGDSSRKIVEIICRTSLLKSESSCVRIERVFKVHNTQRTLSRFEEYREAVKLKASKLPKKHPRCLADGNELLRFHGATLSCALGGAGSGNSSLCASDKCAVCRIIRHGFSAKKEGKAGVGVFTTSTSGRAFESIEAAPGPGAGDDGADQLQLGTTTTRKALLVCRVIAGRVHKPLDNLKEFVGQTGFDSLAGKVGPYSNIEELYLLNPRALLPCFVVICKP

SEQ ID NO: 16980 - DNA, 2025 bp, Sorghum bicolor
  misc_feature: Ceres ANNOT ID no. 8669078
  misc_feature: Encodes the peptide sequence at SEQ ID NO 16981
atggcaagagttcagaaatactgcagaataatcccacaagcattctcctttgcaaaggacaaacagatcaatgtcaggaaagccttcatcactggcaatgtcactgacctattcaatttaccattatcagaaatagcattccagcaagcccaagtgatgcaacaacagatgcaaatgcacaacagaaatgagctagagaaagatgtatggacctactcagcacaaaactctagctacagagctcaaactacatacaaattaatgatgggccaccagccggccagaaagaatcagtgcatcacctgttctgggaatgcacatatgcgcaacaatgctgggaaactcttgatctacaaatattacaagatggcgacaattctcaccggaacggacaacgaagagcactcagcactttgccaaatttggctcgcgccttccaaacccacgtccagaaaaagaacgcgattcccgtccacagactcggccctcgtcaatgtagaagtatccccaagaaatcgggccaccctcttcgcgcggatcgacccgagggtgcgccccgcccactctcgcgtcggtcccgcgatgggcctcttctcatcggccgctaagagatgcagcaacggcaagaagttcctccgcagcgcgggcgcgtgctgctgctcgccgtccgcctccgcccctgcaggtggtgtgcgcggcaaggaagaggcgtcgacgtcggcgccggcttccgcgccagcagatagcaagaagaaaaggtggcggaagaggaagttctggaggaagaagaagaaggccaagaaggagagcggcgatggcagcggcgagctcgccgacctcgtcaataacatttcggccaactcggacgtgtgcaagaacgtgaatgcggcggaggagatcctacggggcagcaaccagaacatgcccagcagggcgctgacgttcagccagctgagcgccgcgaccgacgggttcagcgagcagaacctgctcggcgaaggcggcttcggccgggtgtacaaagggctcctcgaggacaccaaagaggtgatcgccgtgaagcagctggacaggaacgggttccagggcaaccgcgagttcctcgtggaggtgctgatgctgagcctcctgcaccacccgaacctggtcaagctgctgggctacagcaccgactccgaccagcggatcctggtgtacgagtacatgcccaagggctcgctggaggaccacctcctggacctgcccccgaactggaagcccctgccgtggcacacgcggatgcagatcgcggtgggcgcggccaagggcatcgagtacctgcacgaggtggccaacccgccggtgatctaccgcgacctcaaggcgtccaacatcctcctggacagggacttcaacgccaagctctccgacttcgggctcgccaagctgggccccatgggcgaccagagccacgtcagcaccagggtcatgggcacgtacggctactgcgcccccgagtacgccatgaccggcaagctcaccaagatgtccgacatctacagcttcggcgtcgtgctgctcgagctcatcaccggccgccgcgccatcgacgtcgccaggccgtccgaggagcaggtcctcgttcactgggaaattgtgaaatcgattgcggttaccggccgaacgatcgatccgccgagaataatgcatgtatacgatttcttgcaggcgtcgcctctgctgagagacaagaggaggttcatgaagctggctgatccgttgctgtgcaggaggtaccccgtgaaggggctgtaccaggcgctggccgtcgcgtccatgtgcttgcaggaggacgctgccagccggccggggatcagcgacgtcgtcgcggcgctctcgttcctcgccgacccgcaaaactaccctcccgaaggcatgcaagctgagcactacaagagcccagatcgagggtcagacaaggatagcagtcccagtcctcctaaagccgacatgatcagggcagacgacgaaatgaagcatagatga

SEQ ID NO: 16981 - protein, 674 aa, Sorghum bicolor
  misc_feature: Useful for making plants with modulated drought sensitivity
  misc_feature: Functional homolog of the protein sequence given in SEQ ID NO 14078
  misc_feature: Useful for making plants with modulated heat sensitivity
  misc_feature: Functional homolog of the protein sequence given in SEQ ID NO 14079
  misc_feature: Ceres ANNOT ID no. 8669078
  misc_feature (293)..(543): SWISSPROT Homolog: EC 2.7.11.1 Non-specific serine/threonine protein kinase
  misc_feature (325)..(625): Pfam ID: Pkinase Pfam Description: Protein kinase domain
MARVQKYCRIIPQAFSFAKDKQINVRKAFITGNVTDLFNLPLSEIAFQQAQVMQQQMQMHNRNELEKDVWTYSAQNSSYRAQTTYKLMMGHQPARKNQCITCSGNAHMRNNAGKLLIYKYYKMATILTGTDNEEHSALCQIWLAPSKPTSRKRTRFPSTDSALVNVEVSPRNRATLFARIDPRVRPAHSRVGPAMGLFSSAAKRCSNGKKFLRSAGACCCSPSASAPAGGVRGKEEASTSAPASAPADSKKKRWRKRKFWRKKKKAKKESGDGSGELADLVNNISANSDVCKNVNAAEEILRGSNQNMPSRALTFSQLSAATDGFSEQNLLGEGGFGRVYKGLLEDTKEVIAVKQLDRNGFQGNREFLVEVLMLSLLHHPNLVKLLGYSTDSDQRILVYEYMPKGSLEDHLLDLPPNWKPLPWHTRMQIAVGAAKGIEYLHEVANPPVIYRDLKASNILLDRDFNAKLSDFGLAKLGPMGDQSHVSTRVMGTYGYCAPEYAMTGKLTKMSDIYSFGVVLLELITGRRAIDVARPSEEQVLVHWEIVKSIAVTGRTIDPPRIMHVYDFLQASPLLRDKRRFMKLADPLLCRRYPVKGLYQALAVASMCLQEDAASRPGISDVVAALSFLADPQNYPPEGMQAEHYKSPDRGSDKDSSPSPPKADMIRADDEMKHR

SEQ ID NO: 16982 - DNA, 2262 bp, Sorghum bicolor
  misc_feature: Ceres ANNOT ID no. 8669067
  misc_feature: Encodes the peptide sequence at SEQ ID NO 16983
atggcgctggggccgtgtgtgacaggtctagcatgcagaggcactgggggtttttggaggggacgacaatggtctgagccagcgacgacatcgctagtggcatcgtgttccttcttagaggcatcattttggaagattatgcttggtcagtctactacacccgccagcgtcgtggtgaggaaggtggaggtattgtttgagaattcaagtctgcagtgtaacgacgaaagaaggcggataggaggagagcgttggtgtagcaattggacgtcctcatatctgttgacaatgaaccatgaatttggcgaggaggccgacataggaggcgctcacaaagttggcaaggaggccgacacagtttggagttgccgagatgacctgcatgatatgagggcagacggtctcgcattgtggtggttgtttttggaaagtgctagggacatgtccttctataagaacaactgtttcaccaacccctctattcaaatttcaaagaccatgtgctattggttgaaaaccatgtgcccgatctcatcctccctctttgtcatctgcctatacctcagctgcggtgtctcttcactagccagtacactagtcaccatgcttagcagcaatgagcctctcctctcctcgccctaccaaagaaacgcttctccatgcaggaggcccgtcttgctgatcacgctgtcatcggccgctctgctttgcgccggagcagcgttcctcctcctcaacctccccactccggacctctgcgccagctccccggacccaacctcgtgccacgccatcgtggccgacgccgtgcttgcgtctccacgagcgcaccttacccgccccggccccgctcaggtcctccgcgcgatcgttgccaggtctctcgtgcagcatgacgcggccgccgccgcggtgtccggcatgctccggcacaccggtagcgatagcgacccgaggcagcgcgcggcgctcgcggactgcgtccagctcatggacctcgcgcgggaccgcctcgccgacgcctccccggccgtggccgcggccgcagcggacgacgcgcggacgtggctcagcgccgcgctcacctactacgcgacgtgcacggacggcgtcgtcgtcgacgggccgctgcgcgacgccgtggtggcgcggctggaaccgctcaagtcccttgcgagcgcgtcgctcgccgtgctaagcgccgtcgtcgacgactcgggctcccgggacgccgggctcgccgacactacgtacacgttcccctcgtgggtgccggcgcgagaccgcgctctccttgaagcgggcgccgccatcgaggccgacgtcgtggtggcccaggacgggagcggcaagttcaggacggtgaaagaggcggtagacgcggcgcccgacggcggcaagagcaggtacgtgatctacgtgaagaaaggggtgtacaaggagaacgttgaggtggggaagaagaagcgcgagctgatgatcgtgggcgacggcatggatgcgacggtgatcaccgggagccgcaacgtggtcgacggcgccacgactttcaactcggccaccctagccgtggcgggagacgggatcatcctgcaggacctgcgggtggagaacacggcggggccagcgaagcaccaggcggtggcgctgcgcgtgagcgccgaccgcgccgtcgcctaccgctgccgcgtcgacgggtaccaggacaccctgtacgcgcacgcgctccgccacctgtaccgcgagtgcttcgtgtccggcaccgtcgacttcgtcttcggcaacgcggccgccgtgctgcagggctgcgcgctggcggcgcgcctgcccctgcggggccagcagaacgcggtcaccgcgcagggccgggaggaccccaaccagaacacgggcacgtccctccacaggtgccgcgtcgtgccggcgcccgacctggcgcccgtggccgggacggacttcccgacgttcctgggccggccgtggaaggcctactcgcggacggtcgtcatgctgtcgtacctggacgcgcacgtcgacgccagggggtggctcgagtgggacggggacttcgcgctcaagacgctcttctacggggagtaccagaacgaggggcccggcgccgccaccgccggccgggtcaactggcccggctaccacgtcatcacggacaggagcgtggccgtgcagttcaccgtcggccagttcattcagggtggcaactggctcaacggcaccggcgtgccctacatcgagggtctctga

SEQ ID NO: 16983 - protein, 753 aa, Sorghum bicolor
  misc_feature: Useful for making plants with altered carbohydrate content
  misc_feature: Functional homolog of the protein sequence given in SEQ ID NO 14456
  misc_feature: Useful for making plants with altered cell wall content and/or composition
  misc_feature: Functional homolog of the protein sequence given in SEQ ID NO 14382
  misc_feature: Ceres ANNOT ID no. 8669067
  misc_feature (251)..(753): SWISSPROT Homolog: EC 3.1.1.11 Pectinesterase
  misc_feature (441)..(740): Pfam ID: Pectinesterase Pfam Description: Pectinesterase
  misc_feature (238)..(398): Pfam ID: PMEI Pfam Description: Plant invertase/pectin methylesterase inhibitor
MALGPCVTGLACRGTGGFWRGRQWSEPATTSLVASCSFLEASFWKIMLGQSTTPASVVVRKVEVLFENSSLQCNDERRRIGGERWCSNWTSSYLLTMNHEFGEEADIGGAHKVGKEADTVWSCRDDLHDMRADGLALWWLFLESARDMSFYKNNCFTNPSIQISKTMCYWLKTMCPISSSLFVICLYLSCGVSSLASTLVTMLSSNEPLLSSPYQRNASPCRRPVLLITLSSAALLCAGAAFLLLNLPTPDLCASSPDPTSCHAIVADAVLASPRAHLTRPGPAQVLRAIVARSLVQHDAAAAAVSGMLRHTGSDSDPRQRAALADCVQLMDLARDRLADASPAVAAAAADDARTWLSAALTYYATCTDGVVVDGPLRDAVVARLEPLKSLASASLAVLSAVVDDSGSRDAGLADTTYTFPSWVPARDRALLEAGAAIEADVVVAQDGSGKFRTVKEAVDAAPDGGKSRYVIYVKKGVYKENVEVGKKKRELMIVGDGMDATVITGSRNVVDGATTFNSATLAVAGDGIILQDLRVENTAGPAKHQAVALRVSADRAVAYRCRVDGYQDTLYAHALRHLYRECFVSGTVDFVFGNAAAVLQGCALAARLPLRGQQNAVTAQGREDPNQNTGTSLHRCRVVPAPDLAPVAGTDFPTFLGRPWKAYSRTVVMLSYLDAHVDARGWLEWDGDFALKTLFYGEYQNEGPGAATAGRVNWPGYHVITDRSVAVQFTVGQFIQGGNWLNGTGVPYIEGL

SEQ ID NO: 16984 - DNA, 1122 bp, Sorghum bicolor
  misc_feature: Ceres ANNOT ID no. 8669086
  misc_feature: Encodes the peptide sequence at SEQ ID NO 16985
atggcctccaaagaattcatcgtcgtcttccttttaatcctccatgccgcactgacgacggtccacggccaaaacatcatcgaccggtgctggcgccgccagcgcaactgggccgcgaaccggcagcggctggccgtgtgctcggtgggcttcgccgggaagatgcggcagaaccgcggggccggtgtcatccgctacacggtcaccgaccccggcgacgacccggtgcggccgcgcccgggcacgctgcggtacggcgcgacggtgctggccgggaaggtgtggatcaccttcgcgaggagcatgcacatcaggctggcgcagccgctgttcgtgaagagcttcacggccatcgacgggcgcggcgccgacgtgcacatcgcgggcggcgcgggcatcgtgctgtaccaggtgcgcagcgtcatcgtgcacgggctgcacatccacgactgccgcgcgcagcccgagggcccggcggtcaggcccggcggcgccgtgcagccggccggcggcatggacggcgacgccatccggctggtgtcgagcaccaaggtgtggatcgaccacaactccctgtcgcagtgcgaggacgggctggtggacgtgacggtcggctccaccgacgtgaccatctccaacaactggttcttcaaccacgacaaggtcatgctgctcggccacgacgacggccacgccgccgacagccggatgcgcgtcaccgtcgcgttcaaccggttcggaccaaacgtcaaccagcggatgccaaggattaggcatggctacgctcacgtcgtgaacaatttgtacatgggatggaaagactacgccatcggagggagcatgggaccaagcgtcaagagccagggcaacctgttcatggcctccggcccagcagataacaagaaggtgacgagaaggatgccggtggcggggagggatggaggggactgggcctccattggggactccttcgagaacggcgctttcttcaagcagacgggcagcagggtgcgcccgaattacaacaagcatcaggccttcgcggcagccagctccaacgaagtaaggtcgctgaccaaggacgccggcgttctcaggtgctctgtcggcgccgcgtgctga

SEQ ID NO: 16985 - protein, 373 aa, Sorghum bicolor
  misc_feature: Useful for making plants with altered cell wall content and/or composition
  misc_feature: Functional homolog of the protein sequence given in SEQ ID NO 14457
  misc_feature: Ceres ANNOT ID no. 8669086
  misc_feature (25)..(373): SWISSPROT Homolog: EC 4.2.2.2 Pectate lyase
  misc_feature (107)..(292): Pfam ID: Pec_lyase_C Pfam Description: Pectate lyase
MASKEFIVVFLLILHAALTTVHGQNIIDRCWRRQRNWAANRQRLAVCSVGFAGKMRQNRGAGVIRYTVTDPGDDPVRPRPGTLRYGATVLAGKVWITFARSMHIRLAQPLFVKSFTAIDGRGADVHIAGGAGIVLYQVRSVIVHGLHIHDCRAQPEGPAVRPGGAVQPAGGMDGDAIRLVSSTKVWIDHNSLSQCEDGLVDVTVGSTDVTISNNWFFNHDKVMLLGHDDGHAADSRMRVTVAFNRFGPNVNQRMPRIRHGYAHVVNNLYMGWKDYAIGGSMGPSVKSQGNLFMASGPADNKKVTRRMPVAGRDGGDWASIGDSFENGAFFKQTGSRVRPNYNKHQAFAAASSNEVRSLTKDAGVLRCSVGAAC

SEQ ID NO: 16986 - DNA, 327 bp, Sorghum bicolor
  misc_feature: Ceres ANNOT ID no. 8669096
  misc_feature: Encodes the peptide sequence at SEQ ID NO 16987
atgtccaggtggctgctatggtcctgtgaggcaaatgctgaggactccagtgctggtgctggatcaaaggactatgtgcacgtgcgaattcagcagcgcaacggaagaaagagtctgacaactgttcagggcttgaagaaagagtacagctacaacaagatcctcaaggatctcaaaaaagagttctgctgcaatggtactgtagtccaggatccagagctaggccaggtcattcaactgcaaggtgatcagcgtaaaaatgttgcaacttttctagttgaggctggaatagtgaagaaagagagcatcaagattcacggtttttag

SEQ ID NO: 16987 - protein, 108 aa, Sorghum bicolor
  misc_feature: Useful for making plants with modulated biomass
  misc_feature: Useful for making plants with modulated flowering time
  misc_feature: Functional homolog of the protein sequence given in SEQ ID NO 13160
  misc_feature: Ceres ANNOT ID no. 8669096
  misc_feature (20)..(101): Pfam ID: SUI1 Pfam Description: Translation initiation factor SUI1
MSRWLLWSCEANAEDSSAGAGSKDYVHVRIQQRNGRKSLTTVQGLKKEYSYNKILKDLKKEFCCNGTVVQDPELGQVIQLQGDQRKNVATFLVEAGIVKKESIKIHGF

SEQ ID NO: 16988 - DNA, 948 bp, Sorghum bicolor
  misc_feature: Ceres ANNOT ID no. 8669120
  misc_feature: Encodes the peptide sequence at SEQ ID NO 16989
atggcaatgggaaggaacaggacgtcaaaactggactgtagagcggccgcttttgcttcggtgcgcaggtcgcgtcaacgggagcgccgtatcgcaccgtgtaccgcccttccccttccgatacggcctatccatcgccagtcttcggctctccgccatgggcatgggcaggtcccttttgccttgatgagcggcgatacgacgcacacccacccgctgtgcggttgtggtcccacccccaagcgcgcccgtgctgtcccccaccccacgacacgcttcctcccacgtgaacctgcggccaacggatccgtgacacgtcggggcgccggcgccttgaccttagggcaagaccaaacaccacgcacgttgcagtacccacaaggctctagtacacctcccagctctcgatccaagatggatcccacgctacgggcagtgctgggccacggcggaggcgacggcggggcgagaggaggaggaggaggaggaggcgccgagcgcttccggggcgtgaggaagcggccgtggggcaggtacgcggccgagatccgcgacccgtggaagaagacgcgggtgtggctgggcacgttcgacacccccgcggaggccgccctcgcgtacgaccgcgccgcgcgcacgctccgcggcgccaaggccaagaccaacttccccgaccacgccggccatctggcgccgcttctgcgactgcgtcaacccccgccgcagcccgtctcgttcggaggcgtcaacaacgtcgactgccctactactccgtggcaattcgtctacctccagaccccgacaacggccgcggctccgcttcccccgacgactgcagcgatgccgccgctggtgacaaccgagccaccgtcaacggcgctggagctgggcaggggacagaggtgtggcggcctccccttcgacctcaacgaggcgccgtcatgctga

SEQ ID NO: 16989 - protein, 315 aa, Sorghum bicolor
  misc_feature: Useful for making plants with altered lignin content
  misc_feature: Functional homolog of the protein sequence given in SEQ ID NO 13219
  misc_feature: The sequence is a functional homolog of SEQ ID NO 18 in the 10/903,236 US patent application
  misc_feature: The sequence is a functional homolog of SEQ ID NO 2211 in the 10/666,642 US patent application
  misc_feature: The sequence is a functional homolog of SEQ ID NO 78 in the 10/714,887 US patent application
  misc_feature: The sequence is a functional homolog of SEQ ID NO 78 in the 11/435,388 US patent application
  misc_feature: Ceres ANNOT ID no. 8669120
  misc_feature (166)..(217): Pfam ID: AP2 Pfam Description: AP2 domain
MAMGRNRTSKLDCRAAAFASVRRSRQRERRIAPCTALPLPIRPIHRQSSALRHGHGQVPFALMSGDTTHTHPLCGCGPTPKRARAVPHPTTRFLPREPAANGSVTRRGAGALTLGQDQTPRTLQYPQGSSTPPSSRSKMDPTLRAVLGHGGGDGGARGGGGGGGAERFRGVRKRPWGRYAAEIRDPWKKTRVWLGTFDTPAEAALAYDRAARTLRGAKAKTNFPDHAGHLAPLLRLRQPPPQPVSFGGVNNVDCPTTPWQFVYLQTPTTAAAPLPPTTAAMPPLVTTEPPSTALELGRGQRCGGLPFDLNEAPSC

SEQ ID NO: 16990 - DNA, 1506 bp, Sorghum bicolor
  misc_feature: Ceres ANNOT ID no. 8669146
  misc_feature: Encodes the peptide sequence at SEQ ID NO 16991
atgccgctgctgctgcgcggcgcctcccttctccgcctctaccagtgtacctgtgggcttcgaagtgcgaatttcagttcaagagtacctgcactagtgaatctcatcaccacgagggacagaatgcgggctacatattcgcgtagagctgcctctaagaacagtgaggtcaacaaagatgagcagccagtcatagagaaggaagatgctgctgaaagtgatttggagatagagagtgtgaggagcaaccctagccagctccaatcaatgactgtcaaggagctcagggagctcacgaggaggatgggtgtttctgtgaaaggtaccaagaaagatttagtatcagccttgatgaattctctgggcgtggaagcaaatggtgacgagggaaagtcatccattgagctggttagcccctcggagatacctttaaaaagaaaaagtggtgcttctgttgtgattgaacaaaaactagaaagttctgagattatttctgaaacacctagcaagaaaagaagtagaacaaaacaaaagtcaagcaagagtaccacccttgaggagaattctgtgactaatgtcaagctaagtaagactattgtccagaaggaaacatttgtcgtccaaggtgctgttcctaatgacgattcagagccttggactgtactcgtgcataagaaaccacaagctggctggattccatacaaccctaagactatgaggcctccacctcttagcaaggatacacgtgctctgaagattatgtcatggaatgtcaatggattgaaagcattgctcaaatcaagaggcttctctgtgcagcaattagcacagagggaggactttgatgagaaggatgttgaagttattaaagacactttgcttgatggctacacaaatagtttctttacttgcagtgtgtcaaagcttggctattctggcactgcaataatttcaagagtcaaaccactctcgatcaagtatgggcttggtataccagaccatgatactgaagggagggttgtgactgtagagttcgatgacttctacctgttaactgcttatgtaccaaactctggtgatggtctaaaaagattgacttacagggtcacagagtgggatccatcccttggtaactacatgaaagaattggagaaatcgaagcctgtcatactaaccggtgaccttaattgtgcgcaccaggagattgatatacatgaccctgccggaaaccgtaaaagtgcaggcttcacaaacgaggaaagagaatcatttgagaccaattttttgtccaaagggtttgttgatacgtttcggaaacagcatcctagtgttgttgcctatagttactgggggtacaggcataatgcccggaagacaaacaaaggttggcgtctggattactttcttgtgtcggaatcaatcgctgaaaaagtgcatgattcatacattcttccggacatctctgccagtgatcacagcccccttggcctcgtactgaagctgtag

SEQ ID NO: 16991 - protein, 501 aa, Sorghum bicolor
  misc_feature: Useful for making plants with altered lignin content
  misc_feature: Functional homolog of the protein sequence given in SEQ ID NO 13303
  misc_feature: Ceres ANNOT ID no. 8669146
  misc_feature (185)..(501): SWISSPROT Homolog: EC 4.2.99.18 DNA-(apurinic or apyrimidinic site) lyase
  misc_feature (251)..(499): Pfam ID: Exo_endo_phos Pfam Description: Endonuclease/Exonuclease/phosphatase family
  misc_feature (87)..(121): Pfam ID: SAP Pfam Description: SAP domain
MPLLLRGASLLRLYQCTCGLRSANFSSRVPALVNLITTRDRMRATYSRRAASKNSEVNKDEQPVIEKEDAAESDLEIESVRSNPSQLQSMTVKELRELTRRMGVSVKGTKKDLVSALMNSLGVEANGDEGKSSIELVSPSEIPLKRKSGASVVIEQKLESSEIISETPSKKRSRTKQKSSKSTTLEENSVTNVKLSKTIVQKETFVVQGAVPNDDSEPWTVLVHKKPQAGWIPYNPKTMRPPPLSKDTRALKIMSWNVNGLKALLKSRGFSVQQLAQREDFDEKDVEVIKDTLLDGYTNSFFTCSVSKLGYSGTAIISRVKPLSIKYGLGIPDHDTEGRVVTVEFDDFYLLTAYVPNSGDGLKRLTYRVTEWDPSLGNYMKELEKSKPVILTGDLNCAHQEIDIHDPAGNRKSAGFTNEERESFETNFLSKGFVDTFRKQHPSVVAYSYWGYRHNARKTNKGWRLDYFLVSESIAEKVHDSYILPDISASDHSPLGLVLKL

SEQ ID NO: 16992 - DNA, 1506 bp, Sorghum bicolor; identical to SEQ ID NO: 16990
  misc_feature: Ceres ANNOT ID no. 8669149
  misc_feature: Encodes the peptide sequence at SEQ ID NO 16993

SEQ ID NO: 16993 - protein, 501 aa, Sorghum bicolor; identical to SEQ ID NO: 16991
  misc_feature: Useful for making plants with altered lignin content
  misc_feature: Functional homolog of the protein sequence given in SEQ ID NO 13303
  misc_feature: Ceres ANNOT ID no. 8669149
  misc_feature (185)..(501): SWISSPROT Homolog: EC 4.2.99.18 DNA-(apurinic or apyrimidinic site) lyase
  misc_feature (251)..(499): Pfam ID: Exo_endo_phos Pfam Description: Endonuclease/Exonuclease/phosphatase family
  misc_feature (87)..(121): Pfam ID: SAP Pfam Description: SAP domain

SEQ ID NO: 16994 - DNA, 1116 bp, Sorghum bicolor
  misc_feature: Ceres ANNOT ID no. 8669150
  misc_feature: Encodes the peptide sequence at SEQ ID NO 16995
atgaccatgagcatgcgcgccgcaggcctgagcatgttccgtggcagccatctcgccgcgctgccctgtctgcaacgtctgggcggcgccgccgcctttgcccgcggcctcgccactgatgccacctatggacggttgggattttatctatggggttgtgtttggtcaattgggaacccgaggtctgcggcgaacatgggatccacatcttctcagcgtggttaccctgcccggaagtctgagccctggactcgccttacccaccaagagagacgaccgcaatgggttgcttataatccaaggacaatgagacctccgccacttggcactgataccaattgtatgaagattctgtcctggaacgttaatggacttcaaactattgtgcagtcagggttttctgcagatgaattggttggcagagagaactttgacgtcttgtgtcttcaagagacacacttgcaggagcgcaatgttgacctttttaagaacctggtacctgaatatgattacacctattggtcatgcagtgttgcaaggcttggttattcaggaactgctgtgatatcacgggtacaaccaatctcagtccaatacgggcttggtgtaccagagcatgatcaggagggcaggcttattaccttggagtttgatgatttttacttggtcaatgcttatgtcccaaattctggccgtggtttacgtagactgaattacagggtcaatgagtgggatccatgctttagcgacttcataaagaaactggaatcttccaaaccagtaattgttgctggggatctaaactgtgctcgcgaaagtattgacattcacaatcctcaagcaaaaaccgaggctgcaggtttcacagttgaagagagggagtcatttgaggagaacttctctagcgaaggtcttattgatacattccgtaaacaacacccgaatgctgtggcctacactttctggggtgaaaaccagcgcattaccaacaaaggctggagactggattactttcttgcgtcagagtctattgccgacaaggtccatgattcctacactctgccagatgtatcgctcagcgatcacagtccaattggccttgtgcttaagttgtag

SEQ ID NO: 16995 - protein, 371 aa, Sorghum bicolor
  misc_feature: Useful for making plants with altered lignin content
  misc_feature: Functional homolog of the protein sequence given in SEQ ID NO 13303
  misc_feature: Ceres ANNOT ID no. 8669150
  misc_feature (79)..(371): SWISSPROT Homolog: EC 4.2.99.18 DNA-(apurinic or apyrimidinic site) lyase
  misc_feature (115)..(369): Pfam ID: Exo_endo_phos Pfam Description: Endonuclease/Exonuclease/phosphatase family
MTMSMRAAGLSMFRGSHLAALPCLQRLGGAAAFARGLATDATYGRLGFYLWGCVWSIGNPRSAANMGSTSSQRGYPARKSEPWTRLTHQERRPQWVAYNPRTMRPPPLGTDTNCMKILSWNVNGLQTIVQSGFSADELVGRENFDVLCLQETHLQERNVDLFKNLVPEYDYTYWSCSVARLGYSGTAVISRVQPISVQYGLGVPEHDQEGRLITLEFDDFYLVNAYVPNSGRGLRRLNYRVNEWDPCFSDFIKKLESSKPVIVAGDLNCARESIDIHNPQAKTEAAGFTVEERESFEENFSSEGLIDTFRKQHPNAVAYTFWGENQRITNKGWRLDYFLASESIADKVHDSYTLPDVSLSDHSPIGLVLKL

SEQ ID NO: 16996 - DNA, 1542 bp, Sorghum bicolor
  misc_feature: Ceres ANNOT ID no. 8669170
  misc_feature: Encodes the peptide sequence at SEQ ID NO 16997
atggagacggcctccttcctctcggtggcgctggccctggcggccctcgtccccgtctcgctgctcctcctgaaccggctcctctacggcaagctgcccccggggccgcggcggcggcccgtggtgggcaacctgttcgacgtgcggccggtgcggtgccggtgctaccaggagtgggcgcgccggtacgggcccatcatgacggtgtggctcggcaccacgcccacggtggtggtgtccacgtcggagctggcaaaggaggtgctcaagacccacgaccagcacctcgccgaccgctgccgggaccgctcgtcggagaggttcagccgcggcggccaggacctcatctgggccgactacggcccgcactacatcaaggtgcgcaagctctgcaacctcgagctcttcacgcagcgccgcctcgaggcgctcagacccatccgcgaggacgaggtcaccgccatggtcgagtccgtctacaaggccgccaccgcgccgggcaatgaagggaagcccttggtggtgaagaaccacctgtcgatggtggccttcaacaacatcacgcggctggccttcgggaagcggttcgtgaacgcggccggcgagctggacgagcaagggcgcgagttcaaggcgatcgttcacaacggcatcaaggtcggcgcgtccctctccatcgcgcagcacatcccgtggctgcggtggctggccccggtcgacgagcaggccttcaaagcccacggcgaccgccgcgaccgcctcaccgtgaagatcatggaggagcaagccaaggccctcaagcagcacggcgcccagcagcatttcgtcgacgcgctcttcactctcagggacaagtacgacctcagcgacgacaccgtcattggcctcctctgggacatgatcaccgccggcactgacacgacggtgatctcggtggagtgggcaatggcggagctgctgaggaaccccagggtgcaggagaagctgcaggaggagctggacgatgtcgtcggccgcgaccgtgtcctgtcggagacggacttcccgaacctgccgtacctgcaggccgtcgtcaaggagtccctccgcctgcacccgccgacgccgctgatgctgccccacagggccagcgccagcgtcaagatcgccggctacgacatccccaagggcgccaacgtcgtcgtcaacgtgtgggcggtggcgcgggaccccgcggtgtgggacgacccgctcgagttccggccggagcggttcctccgggagaacatcgacatcaagggcgccgacttccgcgtgctgccgttcggcgccggccggcgggtgtgccccggcgcgcagctcgggatcaacctcgtggcgtccatgatcggccacatggttcaccacttcaggtggacgctgccggaggggacacggcccgaggacgtgaggatggtggagtcccccgggctcgtcaccttcatggacacgccgctgcaggccgtcgccacgccgcgcctggacaaggaggagctgtaccggcgtgtcccttcggagatctga

SEQ ID NO: 16997 - protein, 513 aa, Sorghum bicolor
  misc_feature: Useful for making plants with altered carbohydrate content
  misc_feature: Functional homolog of the protein sequence given in SEQ ID NO 14458
  misc_feature: Useful for making plants with altered lignin content
  misc_feature: Functional homolog of the protein sequence given in SEQ ID NO 14459
  misc_feature: The sequence is a functional homolog of SEQ ID NO 6 in US patent 7071376
  misc_feature: The sequence is a functional homolog of SEQ ID NO 4 in US patent 7071376
  misc_feature: Useful for making plants with altered cell wall content and/or composition
  misc_feature: Functional homolog of the protein sequence given in SEQ ID NO 14460
  misc_feature: Ceres ANNOT ID no. 8669170
  misc_feature (44)..(503): SWISSPROT Homolog: EC 1.14.13.21 Flavonoid 3'-monooxygenase
  misc_feature (33)..(487): Pfam ID: p450 Pfam Description: Cytochrome P450
METASFLSVALALAALVPVSLLLLNRLLYGKLPPGPRRRPVVGNLFDVRPVRCRCYQEWARRYGPIMTVWLGTTPTVVVSTSELAKEVLKTHDQHLADRCRDRSSERFSRGGQDLIWADYGPHYIKVRKLCNLELFTQRRLEALRPIREDEVTAMVESVYKAATAPGNEGKPLVVKNHLSMVAFNNITRLAFGKRFVNAAGELDEQGREFKAIVHNGIKVGASLSIAQHIPWLRWLAPVDEQAFKAHGDRRDRLTVKIMEEQAKALKQHGAQQHFVDALFTLRDKYDLSDDTVIGLLWDMITAGTDTTVISVEWAMAELLRNPRVQEKLQEELDDVVGRDRVLSETDFPNLPYLQAVVKESLRLHPPTPLMLPHRASASVKIAGYDIPKGANVVVNVWAVARDPAVWDDPLEFRPERFLRENIDIKGADFRVLPFGAGRRVCPGAQLGINLVASMIGHMVHHFRWTLPEGTRPEDVRMVESPGLVTFMDTPLQAVATPRLDKEELYRRVPSEI

SEQ ID NO: 16998 - DNA, 1344 bp, Sorghum bicolor
  misc_feature: Ceres ANNOT ID no. 8669184
  misc_feature: Encodes the peptide sequence at SEQ ID NO 16999
atgagagagatcttgcacatccagggaggccaatgtggcaaccagatcggtgccaagttctgggaggtggtgtgtgatgaacatggcattgaccctactggccgctacactggcacttctgaccttcagttagagcgtgtcaatgtctactacaatgaggcctcctgtggccgctttgtgccccgtgctgttctcatggaccttgagcctgggacaatggacagtgtccgcactggaccctatgggcagatcttccgccctgacaactttgtgttcgggcaatctggtgctggtaacaactgggctaagggtcattacactgagggtgctgagctcattgactctgttcttgatgttgtgaggaaggaagctgagaactgtgactgcttgcaaggattccaagtatgccactcccttggtggtggtactggatctggtatgggtacactgttgatctcaaagatcagggaggagtaccctgaccgcatgatgctgacattctcagttttcccctcaccgaaagtatctgataccgtggttgagccatacaatgctaccctttctgttcatcagttggttgagaatgccgatgagtgtatggttcttgacaacgaggccctctatgacatttgcttcaggactcttaagctcaccactcctagctttggggatttgaaccatttgatctctgcaaccatgagtggagtcacctgctgcctaaggttccctggtcagctgaactctgacctcaggaagctggcagtgaacctgatcccctttccccgtctccacttcttcatggttggctttgcgcctttgacgtcccgtggctcccagcagtacagggccctcactgtccctgagctcacacaacagatgtgggacgccaagaacatgatgtgcgctgccgaccctcgccatgggcgttacctcaccgcctcggccatgttccgtgggaagatgagcaccaaggaggttgacgagcagatgataaatgtccagaacaagaactcgtcctacttcgtggagtggatccccaacaacgtgaagtccagcgtgtgtgacatccccccgaggggcctgtccatggcgtctaccttcatcggcaactcgacttccatccaggagatgttccggagggtgagcgagcagttcactgccatgttcaggaggaaggctttcttgcactggtacactggtgagggcatggacgagatggagttcaccgaggccgagagcaacatgaatgacctcgtgtcggagtaccagcagtaccaggatgcgactgccgatgatgagggcgagtacgaggacgaggaggacgtgcaaggagatgaaatgtga

SEQ ID NO: 16999 - protein, 447 aa, Sorghum bicolor
  misc_feature: Useful for making plants with modulated flowering time
  misc_feature: Functional homolog of the protein sequence given in SEQ ID NO 14090
  misc_feature: Ceres ANNOT ID no. 8669184
  misc_feature (45)..(244): Pfam ID: Tubulin Pfam Description: Tubulin/FtsZ family, GTPase domain
  misc_feature (246)..(383): Pfam ID: Tubulin_C Pfam Description: Tubulin/FtsZ family, C-terminal domain
MREILHIQGGQCGNQIGAKFWEVVCDEHGIDPTGRYTGTSDLQLERVNVYYNEASCGRFVPRAVLMDLEPGTMDSVRTGPYGQIFRPDNFVFGQSGAGNNWAKGHYTEGAELIDSVLDVVRKEAENCDCLQGFQVCHSLGGGTGSGMGTLLISKIREEYPDRMMLTFSVFPSPKVSDTVVEPYNATLSVHQLVENADECMVLDNEALYDICFRTLKLTTPSFGDLNHLISATMSGVTCCLRFPGQLNSDLRKLAVNLIPFPRLHFFMVGFAPLTSRGSQQYRALTVPELTQQMWDAKNMMCAADPRHGRYLTASAMFRGKMSTKEVDEQMINVQNKNSSYFVEWIPNNVKSSVCDIPPRGLSMASTFIGNSTSIQEMFRRVSEQFTAMFRRKAFLHWYTGEGMDEMEFTEAESNMNDLVSEYQQYQDATADDEGEYEDEEDVQGDEM

SEQ ID NO: 17000 - DNA, 396 bp, Sorghum bicolor
  misc_feature: Ceres ANNOT ID no. 8669206
  misc_feature: Encodes the peptide sequence at SEQ ID NO 17001
atgccgccctcccgcctcgtccacctcatcctcctcgccacgctctcgctcctcctcgcgcaaaccctagccacctcttcccccacgcccgccgccgcgtcggcggcggcggaggcggagtccggcgacccctgcgcggccgccgtcgcggacggggacggagacgtcccgctgtgcccggtgcggtgcttccgcccggacccggtctgcggcgccgacggggtcacgtactggtgcggctgccccgaggcgacctgcgcgggggcccgcgtggcgcgccgcggctactgcgaggtcggcgccggctccgcgcccgtctcgggccaggcgctgctgctcgtccacatcgtctggctcttcgtgctcggcgccgccgtcctcctcggcttcctctga

SEQ ID NO: 17001 - protein, 131 aa, Sorghum bicolor
  misc_feature: Useful for making plants with modulated drought sensitivity
  misc_feature: Functional homolog of the protein sequence given in SEQ ID NO 14461
  misc_feature: Ceres ANNOT ID no. 8669206
MPPSRLVHLILLATLSLLLAQTLATSSPTPAAASAAAEAESGDPCAAAVADGDGDVPLCPVRCFRPDPVCGADGVTYWCGCPEATCAGARVARRGYCEVGAGSAPVSGQALLLVHIVWLFVLGAAVLLGFL

SEQ ID NO: 17002 - DNA, 1155 bp, Sorghum bicolor
  misc_feature: Ceres ANNOT ID no. 8669228
  misc_feature: Encodes the peptide sequence at SEQ ID NO 17003
atgacgaagccgcattccccttcctcttgggccgcctcctcgctctcctgcgtttcctcctcctcggcctcctgcgacgtgccgccgccgtggtcgccgaagcgcagcagcaagaagcagaggagcagccgtaggagggccaagaatggcgccgcggtgaccccgaggaggaccagctccatctacaggggcgtcaccaggcacaggggaacgggcaagtacgaggcgcacctgtgggacaagaacgcttggagccggaccaagaacaagaagggccggcaaggagcatttgacaatgaggaggcagcggcccgtacttatgatctcgcagcactcaagtactggggctcagacagcactctcaacttccctcgcatgacaagggaggcgtatctagccactctgcggcgcaagagtagctgcttctcgaggggcgcctccgggtacaggggagtggccaagcaccaccataatggcaggtgggaggccaggatcggctacgcttgcggcaagaaatacctctacctggggacgttcgggagccaagaggaggcagcccgagcatacgaccttgcagctctggaattgcgggggcacgccgcggtcaccaacttcgacaccagcaactacacgcacaaggacgaccagcggcggcctgaaccggcggtccagcggaagccggctctgaagcccaaggacgagccggtggacgaggcaccgccgctgcccaaggctcatcatccggttccgacgccgccgctcctgacgccgaaggccgagccggggtacgagctgggcgagcccctggcgctgccgcccggccccgtgctccgcgacgccgacgacgtggaccacgccatcgccgagatcctgccggcgctgtgcatggaccccgccgacttcgaggcccggtaccccgcccgccgcgcccgcgcgctcggcggctgcccgcccgacgaccagctgctgcgcggcctggcgctgccggacagcgtgcgcttcgaggacgacatcgagacgctgttcgacgcgcccggcggcggcacgggcgaggtccaggtgcagctccacgccgtcgtgactgacgtttctggagtcgacgccgacgcggccgccaccatcagctcgctggcgtccgcgcgctggtggccatga

SEQ ID NO: 17003 - protein, 384 aa, Sorghum bicolor
  misc_feature: The sequence is a functional homolog of SEQ ID NO 1310 in the 10/374,780 US patent application
  misc_feature: The sequence is a functional homolog of SEQ ID NO 1312 in the 10/374,780 US patent application
  misc_feature: The sequence is a functional homolog of SEQ ID NO 1455 in the 10/412,699 US patent application
  misc_feature: The sequence is a functional homolog of SEQ ID NO 1457 in the 10/412,699 US patent application
  misc_feature: The sequence is a functional homolog of SEQ ID NO 1070 in the 10/225,066 US patent application
  misc_feature: The sequence is a functional homolog of SEQ ID NO 140 in the 11/375,241 US patent application
  misc_feature: The sequence is a functional homolog of SEQ ID NO 1904 in the 10/412,699 US patent application
  misc_feature: The sequence is a functional homolog of SEQ ID NO 2164 in the 10/374,780 US patent application
  misc_feature: The sequence is a functional homolog of SEQ ID NO 458 in the 11/435,388 US patent application
  misc_feature: Useful for making plants with altered lignin content
  misc_feature: Useful for making plants with modulated drought sensitivity
  misc_feature: Functional homolog of the protein sequence given in SEQ ID NO 14199
  misc_feature: The sequence is a functional homolog of SEQ ID NO 320 in US patent 7157621
  misc_feature: Useful for biocontainment applications
  misc_feature: Functional homolog of the protein sequence given in SEQ ID NO 13650
  misc_feature: Ceres ANNOT ID no. 8669228
  misc_feature (147)..(199): Pfam ID: AP2 Pfam Description: AP2 domain
  misc_feature (60)..(117): Pfam ID: AP2 Pfam Description: AP2 domain
MTKPHSPSSWAASSLSCVSSSSASCDVPPPWSPKRSSKKQRSSRRRAKNGAAVTPRRTSSIYRGVTRHRGTGKYEAHLWDKNAWSRTKNKKGRQGAFDNEEAAARTYDLAALKYWGSDSTLNFPRMTREAYLATLRRKSSCFSRGASGYRGVAKHHHNGRWEARIGYACGKKYLYLGTFGSQEEAARAYDLAALELRGHAAVTNFDTSNYTHKDDQRRPEPAVQRKPALKPKDEPVDEAPPLPKAHHPVPTPPLLTPKAEPGYELGEPLALPPGPVLRDADDVDHAIAEILPALCMDPADFEARYPARRARALGGCPPDDQLLRGLALPDSVRFEDDIETLFDAPGGGTGEVQVQLHAVVTDVSGVDADAAATISSLASARWWP

SEQ ID NO: 17004 - DNA, 1494 bp, Sorghum bicolor
  misc_feature: Ceres ANNOT ID no. 8669232
  misc_feature: Encodes the peptide sequence at SEQ ID NO 17005
atggctgccgcctttaccgtcatctctctcctgctatcggtctgcgtccagggcgcggctcccgttctcagcttcacaaggagcgacttccctgaagatttcgtcttcggatccgccacctcggcttatcagtatgagggtgctgttgctgaggatggtaggagcccaagcatctgggataccttcacccacgcaggaaacatgccggacaaaagcaatggtgatatagccgccgacgggtacaacaagtacaaggacgatgttaagctcgtaattgacagtaacctggaggcatatagattctctatctcctggtccaggcttataccaaatggacgaggtgctattaatccaaaagggttagagtactataacaatctcatagatgagctagctacacatggtgtccaagtccatgttatgattagccagctcgatccccctcagatcctggaagacgaatatggtggatggttaagcccaaagattgtggaggatttcacggcatatgcagatgtgtgcttcagggagtttggtgacagggtttcacactggaccactctggatgaagtcaatgtggctgcacttgggtcctatgatattgggcaaattgcaccaggaagatgttctgatccgtttggatttggaacaaaaaaatgtacagtggggaactcaagtgtggaaccatatatagcagctcataacatgctactggcacatgcgtcagctaccagactgtacagagaaaaataccaagctgtacaaaaaggagttgttggcataaatatatatacaatgtgggcatacccactaacaaactccactgccgatttagaagcatctcaaagatttctggacttctattgcggctggatactagaaccattggtgtttggagattatccaagtgtagtgaagaagaatgttggttctcgccttccgtcattcagaaaagttcaatctgaagccattcgtggcactatagatttcattggaataaaccactatctttctgtctatgtgaatgaccaccctttagaaaaaggcatccgtgacttcgtactggacgtcgctgctgactatagagtttcgagaacggatccgccagtaggtcagcatgccccaacatctattccggctgatcccagaggattgcaacttatggtagagtacctgagtgaagcttatgggaaccttcccatttatatccaagagacaggaaaggttgattacatgaagaaccacataaacagcacattgactgctctaaggaatggggccaatgtgaaaggctacttcgcgtggtgcttcctggacgtcttcgagtacctgacagggttcagttcgcaatacggcctgtaccgtgttgattttgaggacgaggcgctaccaaggcaagcaaggctatctgctcgctggtactctaaattcctcaagaaggggatccgtgtagaggatgagctcgacgatgcgggatcacatgttgagcaataa

SEQ ID NO: 17005 - protein, 497 aa, Sorghum bicolor
  misc_feature: Useful for making plants with altered carbohydrate content
  misc_feature: Functional homolog of the protein sequence given in SEQ ID NO 14462
  misc_feature: Useful for making plants with altered cell wall content and/or composition
  misc_feature: Functional homolog of the protein sequence given in SEQ ID NO 14337
  misc_feature: Ceres ANNOT ID no. 8669232
  misc_feature (3)..(345): SWISSPROT Homolog: EC 3.2.1.21 Beta-glucosidase
  misc_feature (26)..(482): Pfam ID: Glyco_hydro_1 Pfam Description: Glycosyl hydrolase family 1
MAAAFTVISLLLSVCVQGAAPVLSFTRSDFPEDFVFGSATSAYQYEGAVAEDGRSPSIWDTFTHAGNMPDKSNGDIAADGYNKYKDDVKLVIDSNLEAYRFSISWSRLIPNGRGAINPKGLEYYNNLIDELATHGVQVHVMISQLDPPQILEDEYGGWLSPKIVEDFTAYADVCFREFGDRVSHWTTLDEVNVAALGSYDIGQIAPGRCSDPFGFGTKKCTVGNSSVEPYIAAHNMLLAHASATRLYREKYQAVQKGVVGINIYTMWAYPLTNSTADLEASQRFLDFYCGWILEPLVFGDYPSVVKKNVGSRLPSFRKVQSEAIRGTIDFIGINHYLSVYVNDHPLEKGIRDFVLDVAADYRVSRTDPPVGQHAPTSIPADPRGLQLMVEYLSEAYGNLPIYIQETGKVDYMKNHINSTLTALRNGANVKGYFAWCFLDVFEYLTGFSSQYGLYRVDFEDEALPRQARLSARWYSKFLKKGIRVEDELDDAGSHVEQ

SEQ ID NO: 17006 - DNA, 1425 bp, Sorghum bicolor
  misc_feature: Ceres ANNOT ID no. 8669227
  misc_feature: Encodes the peptide sequence at SEQ ID NO 17007
atggcatcacaggctgggggaggtggtggaggcgtgggtggcagtggcggtgccggcgcagcgcaacgtgggcagatgcagagcctggcaagacaagggtctctgtataatctcacccttgatgaggtgcagagtcatttgggagaaccccttcacagcatgaaccttgaggagctgctgaagagtgtctttcctgatggcttggaccctgatggtggcaccaccagccagtatgagcagagttcgggcctctatcgacaggggagcatcacaatgccgcctgagctcagcaagaggactgtggacgaggtgtggaagggcatccaggatgcaccaaagagaaatgttggggagggtggtcggcggaggcgggagcggcagccgacgcttggggagatgacgcttgaggatttcttggtgaaagctggggttgtcaccgaaggatatctgaaggacttgaatgacgtcggcaatgtggagcaggtcggtagtgctggggctgcaggtttgactgctggggcacactggttagaccactatcagcagcggattacagctatcgagccccatcagcacgggcaacatagtttgccaggtgcttacatgccgggccagttagcccttcagcctctgaatgttgggccaggtgctattctggagtcatactctgatggccacattacttcaccaatgatgggtgcactttctgattctccaacgcctggtacaaagcgtggttccccaggagatgtggcagacaagttgatggagagaaggcagaagaggatgatcaagaatagggagtcagctgctcgttcaagggctaggaagcaggcctacactaatgaactggaaaacaaggtatctcgattagaagaggagaatgagaagctaaagaagcaaaagttaccctcaaaaggccaccaaatgttattatacacattcaaagtaatcatatatggagttggaaaagatacttttctctgcgcctcttccggaacccaagtaccaactcaggagaacaggctcggcgactttctgattgtatccagaatatcttgtttcgtagtttttaagtcctgtggcttttttgacaaaattattcggaaggagatcccatctcaggtggtttatgaggatgagaaggttctttcatttagagacgtatcaccacaagctcctacacatattataatcattgcgaaggttaacgatgggctgtctaggctgtcgaaggcagaagaaaggcatgtcgaagttctgggcagtctcctgtatgctgcaaagattgtagcaaagcaggaagggcttgatgatggcttcagaattgtcatcaacgatggacccaaaggaacgcaatgggtctaccaccacctgcacgttcatcttctcggtggacggcagatgaattggccaccgggatga

SEQ ID NO: 17007 - protein, 474 aa, Sorghum bicolor
  misc_feature: The sequence is a functional homolog of SEQ ID NO 1539 in the 10/412,699 US patent application
  misc_feature: The sequence is a functional homolog of SEQ ID NO 1541 in the 10/412,699 US patent application
  misc_feature: The sequence is a functional homolog of SEQ ID NO 1538 in the 10/412,699 US patent application
  misc_feature: Ceres ANNOT ID no. 8669227
  misc_feature (369)..(469): Pfam ID: HIT Pfam Description: HIT domain
  misc_feature (254)..(309): Pfam ID: bZIP_2 Pfam Description: Basic region leucine zipper
MASQAGGGGGGVGGSGGAGAAQRGQMQSLARQGSLYNLTLDEVQSHLGEPLHSMNLEELLKSVFPDGLDPDGGTTSQYEQSSGLYRQGSITMPPELSKRTVDEVWKGIQDAPKRNVGEGGRRRRERQPTLGEMTLEDFLVKAGVVTEGYLKDLNDVGNVEQVGSAGAAGLTAGAHWLDHYQQRITAIEPHQHGQHSLPGAYMPGQLALQPLNVGPGAILESYSDGHITSPMMGALSDSPTPGTKRGSPGDVADKLMERRQKRMIKNRESAARSRARKQAYTNELENKVSRLEEENEKLKKQKLPSKGHQMLLYTFKVIIYGVGKDTFLCASSGTQVPTQENRLGDFLIVSRISCFVVFKSCGFFDKIIRKEIPSQVVYEDEKVLSFRDVSPQAPTHIIIIAKVNDGLSRLSKAEERHVEVLGSLLYAAKIVAKQEGLDDGFRIVINDGPKGTQWVYHHLHVHLLGGRQMNWPPG

SEQ ID NO: 17008 - DNA, 297 bp, Sorghum bicolor
  misc_feature: Ceres ANNOT ID no. 8669246
  misc_feature: Encodes the peptide sequence at SEQ ID NO 17009
atggagttcacctctaagcagaaggctgtgcttctcctctgcttcttcatgctctcctgccttcttcttcttccccgggcttcctctgctgcgcctctttccagaagcctgtcgctgacgaaccgccagctgcccacgaagaaccctgctctggaggtgcctgcccagcaggatcagggtgcggtggaagatggaaacctcggcgaggtggcggcgaggatggacatcgaggtgaacgactaccctggatccggtgccaacaaccgccatgaacctaggagccctgggagaccatga

SEQ ID NO: 17009 - protein, 98 aa, Sorghum bicolor
  misc_feature: Useful for making plants with modulated flowering time
  misc_feature: Functional homolog of the protein sequence given in SEQ ID NO 14463
  misc_feature: Ceres ANNOT ID no. 8669246
MEFTSKQKAVLLLCFFMLSCLLLLPRASSAAPLSRSLSLTNRQLPTKNPALEVPAQQDQGAVEDGNLGEVAARMDIEVNDYPGSGANNRHEPRSPGRP

SEQ ID NO: 17010 - DNA, 951 bp, Sorghum bicolor
  misc_feature: Ceres ANNOT ID no. 8669253
  misc_feature: Encodes the peptide sequence at SEQ ID NO 17011
atggcaatggtggcggcggcggcggaggggagcgggcggagggacgccgaggcggagctcaacctgccgccggggttccggttccacccaaccgacgaggagctcgtggtgtactacctctgcaggaaggtggcgcggcagcagctgcccgtgcccatcatcgccgaggtcgacctttacaagttcgatccgtgggatctgcccgagaaggcgctgttcggccgcaaggagtggtacttcttcacgccgcgggaccgcaagtacccaaacggctcgcgccccaaccgcgccgccgggagggggtactggaaggcgacgggggcggacaagccgatcgcgcccaagggcagcggcagggcggcggggatcaagaaggcgctcgtgttctactccggcaaggcgcccaggggcatcaagacggactggatcatgcacgagtaccgcctcgccgacgcggaccgcgcaccgggcaagaagggctcgcagaagttggatgagtgggtgctgtgccggctgtacaacaagaagaacaactgggagaaggtgaaggtggagccggagccggaggcggcggcgcaccataaccggcagagcgcggcggaggattccatgtcagacagcttccagacgcacgactcggacatcgacaacgcctccggcatgcagcagcagcagcagcagcagcagagcttcttcggtgacatggtgcaggggcaggccatgaacatgaggaacaacggcattggcaccgtgacggtgaaggaggacaacgactggttcaccgacctgaatctggacgacctgcaggcgtcctacaacatggcccatatggtgaatccgaacccggtggtccagacggtgaacctggtggctgggcaaggccatggctacttgcagtccatgagctcgccgtcgatgaagatgtggcagacaatcctgccaccgttctga

SEQ ID NO: 17011 - protein, 316 aa, Sorghum bicolor
  misc_feature: The sequence is a functional homolog of SEQ ID NO 853 in the 10/374,780 US patent application
  misc_feature: The sequence is a functional homolog of SEQ ID NO 891 in the 10/374,780 US patent application
  misc_feature: The sequence is a functional homolog of SEQ ID NO 2012 in the 10/374,780 US patent application
  misc_feature: The sequence is a functional homolog of SEQ ID NO 312 in the 10/412,699 US patent application
  misc_feature: The sequence is a functional homolog of SEQ ID NO 731 in the 11/479,226 US patent application
  misc_feature: The sequence is a functional homolog of SEQ ID NO 2060 in the 10/374,780 US patent application
  misc_feature: The sequence is a functional homolog of SEQ ID NO 516 in the 10/412,699 US patent application
  misc_feature: The sequence is a functional homolog of SEQ ID NO 102 in the 10/374,780 US patent application
  misc_feature: The sequence is a functional homolog of SEQ ID NO 886 in the 10/225,066 US patent application
  misc_feature: The sequence is a functional homolog of SEQ ID NO 1036 in the 10/225,066 US patent application
  misc_feature: The sequence is a functional homolog of SEQ ID NO 216 in the 10/666,642 US patent application
  misc_feature: The sequence is a functional homolog of SEQ ID NO 2608 in the 10/374,780 US patent application
  misc_feature: The sequence is a functional homolog of SEQ ID NO 658 in the 11/435,388 US patent application
  misc_feature: The sequence is a functional homolog of SEQ ID NO 880 in the 10/412,699 US patent application
  misc_feature: Useful for making plants with modulated water use efficiency
  misc_feature: Useful for making plants with altered terpenoid content
  misc_feature: Functional homolog of the protein sequence given in SEQ ID NO 13966
  misc_feature: The sequence is a functional homolog of SEQ ID NO 1157 in the 11/479,226 US patent application
  misc_feature: The sequence is a functional homolog of SEQ ID NO 1416 in the 10/666,642 US patent application
  misc_feature: The sequence is a functional homolog of SEQ ID NO 30 in the 10/286,264 US patent application
  misc_feature: The sequence is a functional homolog of SEQ ID NO 430 in the 11/435,388 US patent application
  misc_feature: The sequence is a functional homolog of SEQ ID NO 518 in the 10/412,699 US patent application
  misc_feature: Useful for making plants with modulated light quality response
  misc_feature: Functional homolog of the protein sequence given in SEQ ID NO 13870
  misc_feature: Useful for making plants with modulated oxidative stress sensitivity
  misc_feature: Functional homolog of the protein sequence given in SEQ ID NO 13621
  misc_feature: The sequence is a functional homolog of SEQ ID NO 316 in the 10/412,699 US patent application
  misc_feature: The sequence is a functional homolog of SEQ ID NO 738 in the 11/479,226 US patent application
  misc_feature: The sequence is a functional homolog of SEQ ID NO 2592 in the 10/374,780 US patent application
  misc_feature: The sequence is a functional homolog of SEQ ID NO 288 in the 10/225,066 US patent application
  misc_feature: The sequence is a functional homolog of SEQ ID NO 476 in the 10/666,642 US patent application
  misc_feature: Useful for making plants with altered carbohydrate content
  misc_feature: Functional homolog of the protein sequence given in SEQ ID NO 13685
  misc_feature: The sequence is a functional homolog of SEQ ID NO 852 in the 10/374,780 US patent application
  misc_feature: Useful for making plants with modulated light quality sensitivity
  misc_feature: Functional homolog of the protein sequence given in SEQ ID NO 13618
  misc_feature: The sequence is a functional homolog of SEQ ID NO 106 in the 10/225,068 US patent application
  misc_feature: The sequence is a functional homolog of SEQ ID NO 2348 in the 10/374,780 US patent application
  misc_feature: The sequence is a functional homolog of SEQ ID NO 340 in the 10/412,699 US patent application
  misc_feature: The sequence is a functional homolog of SEQ ID NO 778 in the 11/479,226 US patent application
  misc_feature: Useful for making plants with altered lignin content
  misc_feature: Functional homolog of the protein sequence given in SEQ ID NO 13619
  misc_feature: The sequence is a functional homolog of SEQ ID NO 326 in the 10/412,699 US patent application
  misc_feature: The sequence is a functional homolog of SEQ ID NO 760 in the 11/479,226 US patent application
  misc_feature: The sequence is a functional homolog of SEQ ID NO 26 in the 10/286,264 US patent application
  misc_feature: The sequence is a functional homolog of SEQ ID NO 336 in the 10/412,699 US patent application
  misc_feature: The sequence is a functional homolog of SEQ ID NO 770 in the 11/479,226 US patent application
  misc_feature: Ceres ANNOT ID no. 8669253
  misc_feature (22)..(150): Pfam ID: NAM Pfam Description: No apical meristem (NAM) protein
MAMVAAAAEGSGRRDAEAELNLPPGFRFHPTDEELVVYYLCRKVARQQLPVPIIAEVDLYKFDPWDLPEKALFGRKEWYFFTPRDRKYPNGSRPNRAAGRGYWKATGADKPIAPKGSGRAAGIKKALVFYSGKAPRGIKTDWIMHEYRLADADRAPGKKGSQKLDEWVLCRLYNKKNNWEKVKVEPEPEAAAHHNRQSAAEDSMSDSFQTHDSDIDNASGMQQQQQQQQSFFGDMVQGQAMNMRNNGIGTVTVKEDNDWFTDLNLDDLQASYNMAHMVNPNPVVQTVNLVAGQGHGYLQSMSSPSMKMWQTILPPF

SEQ ID NO: 17012 - DNA, 1518 bp, Sorghum bicolor
  misc_feature: Ceres ANNOT ID no. 8669295
  misc_feature: Encodes the peptide sequence at SEQ ID NO 17013
atggaccttctcttcgtggagaagctcctggtcggcctcttcgcgtccgtcgtggtcgccatcgcggtgtccaagatgcgtggccgcaagctccggctgcctcccggccccgtccccgtgcccatcttcggcaactggctgcaggtcggcgacgacctcaaccaccgcaacctggccgcgctggcccgaaaattcggcgacatcttcctcctccggatggggcagcgcaacctggtggtggtgtcctcgccgccgctggcgcgggaggtgctccacacgcagggcgtggagttcggctcccgcacccgcaacgtggtgttcgacatcttcacgggggaagggcaggacatggtgttcaccgtgtacggcgaccactggcgcaagatgcggcgcatcatgaccgtgcctttcttcaccaacaaggtggtgcagcagtaccggcacggctgggaggccgaggcggccgccgtcgtcgacgacgtgcgcgccgacccggcggcggccaccgagggcgtcgtgctccgccgccgcctgcagctcatgatgtacaacaacatgtaccgcatcatgttcgaccggcgcttcgagagcatggacgacccgctcttcctccgcctcagggcgctcaacggcgagcgcagccgcctcgcgcagagcttcgagtacaactacggcgacttcatccccatcctccgccccttcctccgcggctacctcaggatctgcaaggaggtcaaggagacacgcctcaagctcttcaaggacttcttcctcgaggagaggaagaagctggcgagcaccaaggccgtcgacagcaacgggctcaagtgcgccattgatcacatcctggaggcacagcagaagggtgagataaacgaggacaatgtgctctacatcgtcgagaacattaacgttgcagcgatcgagacaacactgtggtcgatcgagtgggcgatcgcggagctggtgaaccacccggagatccagcagaagctgcggcaggagctggacacggtgctggcgccaggccagcagatcacggagccggacacgcacaacctcccctacctgcaggcggtgatcaaggagacgctgcggctgcggatggccatcccgctgctggtgccgcacatgaacctccacgacgccaagctcggcggctacgacatccccgccgagagcaagatcctcgtcaacgcctggtacctcgccaacaaccccgagagctggaagcggcccgaggagttccggcccgagcgcttcctggaggaggagaagcacgtggaggccaacggcaacgacttcaggtacctgcccttcggcgtcggccgcaggagctgccccggcatcatcctcgcgctgcccatcctcggcatcaccatcggccgcctcgtccagaacttcgagctgctaccgccgcccgggcaggacaagctcgacaccaccgagaagggaggccagttcagtctccacatcttgaagcattccaacatcgtgtgcaagccaagaacgttctaa

SEQ ID NO: 17013 - protein, 505 aa, Sorghum bicolor
  misc_feature: The sequence is a functional homolog of SEQ ID NO 8 in US patent 7148406
  misc_feature: Useful for biocontainment applications
  misc_feature: Useful for making plants with altered cell wall content and/or composition
  misc_feature: Useful for making plants with modulated biomass
  misc_feature: Useful for making plants with modulated flowering time
  misc_feature: Functional homolog of the protein sequence given in SEQ ID NO 14291
  misc_feature: Useful for making plants with altered carbohydrate content
  misc_feature: Functional homolog of the protein sequence given in SEQ ID NO 14290
  misc_feature: Useful for making plants with altered lignin content
  misc_feature: Functional homolog of the protein sequence given in SEQ ID NO 14292
  misc_feature: Ceres ANNOT ID no. 8669295
  misc_feature (1)..(505): SWISSPROT Homolog: EC 1.14.13.11 Trans-cinnamate 4-monooxygenase
  misc_feature (34)..(499): Pfam ID: p450 Pfam Description: Cytochrome P450
MDLLFVEKLLVGLFASVVVAIAVSKMRGRKLRLPPGPVPVPIFGNWLQVGDDLNHRNLAALARKFGDIFLLRMGQRNLVVVSSPPLAREVLHTQGVEFGSRTRNVVFDIFTGEGQDMVFTVYGDHWRKMRRIMTVPFFTNKVVQQYRHGWEAEAAAVVDDVRADPAAATEGVVLRRRLQLMMYNNMYRIMFDRRFESMDDPLFLRLRALNGERSRLAQSFEYNYGDFIPILRPFLRGYLRICKEVKETRLKLFKDFFLEERKKLASTKAVDSNGLKCAIDHILEAQQKGEINEDNVLYIVENINVAAIETTLWSIEWAIAELVNHPEIQQKLRQELDTVLAPGQQITEPDTHNLPYLQAVIKETLRLRMAIPLLVPHMNLHDAKLGGYDIPAESKILVNAWYLANNPESWKRPEEFRPERFLEEEKHVEANGNDFRYLPFGVGRRSCPGIILALPILGITIGRLVQNFELLPPPGQDKLDTTEKGGQFSLHILKHSNIVCKPRTF

SEQ ID NO: 17014 - DNA, 759 bp, Sorghum bicolor
  misc_feature: Ceres ANNOT ID no. 8669312
  misc_feature: Encodes the peptide sequence at SEQ ID NO 17015
atggcagcagctgccaacgtcctgctcctcctgctctgctcaaccttctgcttccttgcccaccgggcggccggcgactatggcggctggcagagcgcccacgccacgttctacggcggcggcgacgcgtccggcacaatgggcggcgcgtgtgggtacgggaacatgtacagcacggggtacggcacgaacacggcggcgctgagcacggcgctgttcaacgacggcgcggcgtgcgggtcctgctacgagctgcgctgcgacaacgacgggcagtcgtgcctgccgggcaccatcaccgtgacggccaccaacttctgcccgcccaactacggcctccccagcgacgacggcggctggtgcaacccgccgcgcccgcacttcgacatggcgcagccggccttcctccagatcgcgcagtaccgcgccggcatcgtgcccgtcgcctacaggagggtgccgtgcgtgaagaagggcgggatccggttcaccatcaacggccactcctacttcaacctggtgctggtgaccaacgtggccggcgccggggacgtgcagtccgtctccatcaagggctccagcaccgggtggcagcccatgtcccggaactggggccagaactggcagagcaactcgctcctcgacggccagagcctctccttccaggtcaccgccagcgacggccgcaccgtcaccagcaacggcgtcgcgccggcgggctggcagttcggccagaccttcgagggcgcccagttctag

SEQ ID NO: 17015 - protein, 252 aa, Sorghum bicolor
  misc_feature: Useful for making plants with altered carbohydrate content
  misc_feature: Functional homolog of the protein sequence given in SEQ ID NO 14464
  misc_feature: Useful for making plants with altered cell wall content and/or composition
  misc_feature: Functional homolog of the protein sequence given in SEQ ID NO 14001
  misc_feature: Useful for making plants with altered lignin content
  misc_feature: Functional homolog of the protein sequence given in SEQ ID NO 12888
  misc_feature: Ceres ANNOT ID no. 8669312
  misc_feature (161)..(238): Pfam ID: Pollen_allerg_1 Pfam Description: Pollen allergen
  misc_feature (65)..(150): Pfam ID: DPBB_1 Pfam Description: Rare lipoprotein A (RlpA)-like double-psi beta-barrel
MAAAANVLLLLLCSTFCFLAHRAAGDYGGWQSAHATFYGGGDASGTMGGACGYGNMYSTGYGTNTAALSTALFNDGAACGSCYELRCDNDGQSCLPGTITVTATNFCPPNYGLPSDDGGWCNPPRPHFDMAQPAFLQIAQYRAGIVPVAYRRVPCVKKGGIRFTINGHSYFNLVLVTNVAGAGDVQSVSIKGSSTGWQPMSRNWGQNWQSNSLLDGQSLSFQVTASDGRTVTSNGVAPAGWQFGQTFEGAQF

SEQ ID NO: 17016 - DNA, 1671 bp, Sorghum bicolor
  misc_feature: Ceres ANNOT ID no. 8669353
  misc_feature: Encodes the peptide sequence at SEQ ID NO 17017
atgaccacctcgtcgtcagggagcatcgaagcaccggcggcgagctcgaggcccggctcgttctcgttcgcgagcacgagcttcacggacatgctgggaggatccgcggatgcggcggccggcggggcgtcgaggtacaaggccatgaccccgccgtccctgccgctgacgccgtcgtccttcttcagcaacatccccggcggcctcaaccccgccgacttcctcgactcgccggccctcttgagctccagtatcttcccctcgccgacgacgaacgcattcgcgtcgcagcagttcagctggctgacgacgccgggcgcggagcaaggcgtcaaggaggagcagaggcagtcctacccggacttctcgttccagacagcgccgacgacccaagaggccgtgcggacgacgacgaccttccagccaccgattccagcggccccactgggtgaagaggcgtatagaagtcagcagcagcagcagcagccatggggctaccagcagcagcagcagcagcctgcaggcatggacgcgggatccagccaggctgcctacggcggggcgttccaggcaggctcgtcggacgccggcgcgatggcgccgcacgtgccggcgagcggcgggtacagccaccaggcgcagaggcggtcgtcggacgacgggtacaactggcgcaagtacgggcagaagcaggtgaaggggagcgagaacccgcgcagctactacaagtgcaccttcccgagctgccccaccaagaagaaggtggagcggtcgctggacggccagatcaccgagatcgtgtacaagggcacgcacaaccacgccaagccgcagaacacgcgcaggaactccggcgccgccgcgcagctgctgcagggcggcgacgcgtccgagcactcgttcggcggcacgcccgtcgccacgcccgagaactcctcggcgtcgttcggggacgacgaggtcggcgtgggctcgccgcgcgccgccaacgccgccggcgacgagttcgacgaggacgagccggattccaagagatggaggaaagacggtgacggcgagggtatctccatggccggcaaccggacggtgcgtgagccgagggtcgttgtccagaccatgagcgacatcgacatcctcgatgacggctatcggtggaggaagtacgggcagaaggtggtgaagggaaatccaaacccaaggagctactacaagtgcacgacggccgggtgcccggtgcgcaagcatgtggagcgcgcgtcgcacgacctgcgcgccgtgatcaccacgtacgagggcaagcacaaccacgacgtgcccgcggcgcgtggcagcgccgcactctaccggcccgcgcctccgccgccgccgtccgcggacaacgccggccactacctcgcggcgcagccgggcatggcgtaccagacggggcagcagcagtacgggttcggcggtcagggctcgttcggcctcagcggcggcgccggcgcgccggcgcagagcagcggcagcttcgcgttctcctccgccgggttcgacaacccgatgggttcgtacatgagccagcaccagcagcagcagaggcagaacgacgccatgcacgcgtcgagggccaaggaggagccccgtgacgacatgtcgtttttcccgcagtcgatgctctacactgactga

SEQ ID NO: 17017 - protein, 556 aa, Sorghum bicolor
  misc_feature: The sequence is a functional homolog of SEQ ID NO 223 in the 11/479,226 US patent application
  misc_feature: The sequence is a functional homolog of SEQ ID NO 84 in the 10/412,699 US patent application
  misc_feature: The sequence is a functional homolog of SEQ ID NO 1112 in the 10/225,066 US patent application
  misc_feature: The sequence is a functional homolog of SEQ ID NO 2440 in the 10/374,780 US patent application
  misc_feature: The sequence is a functional homolog of SEQ ID NO 586 in the 10/412,699 US patent application
  misc_feature: The sequence is a functional homolog of SEQ ID NO 612 in the 10/225,066 US patent application
  misc_feature: The sequence is a functional homolog of SEQ ID NO 202 in the 10/714,887 US patent application
  misc_feature: The sequence is a functional homolog of SEQ ID NO 202 in the 11/435,388 US patent application
  misc_feature: The sequence is a functional homolog of SEQ ID NO 86 in the 10/412,699 US patent application
  misc_feature: The sequence is a functional homolog of SEQ ID NO 114 in the 11/375,241 US patent application
  misc_feature: The sequence is a functional homolog of SEQ ID NO 146 in the 10/286,264 US patent application
  misc_feature: The sequence is a functional homolog of SEQ ID NO 2500 in the 10/374,780 US patent application
  misc_feature: The sequence is a functional homolog of SEQ ID NO 672 in the 10/412,699 US patent application
  misc_feature: Ceres ANNOT ID no. 8669353
  misc_feature (379)..(438): Pfam ID: WRKY Pfam Description: WRKY DNA -binding domain
  misc_feature (218)..(276): Pfam ID: WRKY Pfam Description: WRKY DNA -binding domain
MTTSSSGSIEAPAASSRPGSFSFASTSFTDMLGGSADAAAGGASRYKAMTPPSLPLTPSSFFSNIPGGLNPADFLDSPALLSSSIFPSPTTNAFASQQFSWLTTPGAEQGVKEEQRQSYPDFSFQTAPTTQEAVRTTTTFQPPIPAAPLGEEAYRSQQQQQQPWGYQQQQQQPAGMDAGSSQAAYGGAFQAGSSDAGAMAPHVPASGGYSHQAQRRSSDDGYNWRKYGQKQVKGSENPRSYYKCTFPSCPTKKKVERSLDGQITEIVYKGTHNHAKPQNTRRNSGAAAQLLQGGDASEHSFGGTPVATPENSSASFGDDEVGVGSPRAANAAGDEFDEDEPDSKRWRKDGDGEGISMAGNRTVREPRVVVQTMSDIDILDDGYRWRKYGQKVVKGNPNPRSYYKCTTAGCPVRKHVERASHDLRAVITTYEGKHNHDVPAARGSAALYRPAPPPPPSADNAGHYLAAQPGMAYQTGQQQYGFGGQGSFGLSGGAGAPAQSSGSFAFSSAGFDNPMGSYMSQHQQQQRQNDAMHASRAKEEPRDDMSFFPQSMLYTD

SEQ ID NO: 17018 - DNA, 1707 bp, Sorghum bicolor
  misc_feature: Ceres ANNOT ID no. 8669358
  misc_feature: Encodes the peptide sequence at SEQ ID NO 17019
atggcgtcgctgtcgtcgacctggctgctccttctcctctcctgcctcgcgcttgcgctgctcgcggcggacgccgaagtgcaccaccatgagttcgttgtccaagagacgccggtgaagaggctgtgcaagacacacaacatcatcacggtgaacggacagtttccggggccgatgctggaggtcagggagggcgacacgctcgtgatcaacgtcgtcaaccgggcgcagtacaatgtcaccatccactggcacggcatccggcagatgaggactgggtgggcggacgggcctgagttcgtgacgcagtgccccatcaagcccggcggcagctacaagtaccggttcaccatcgaggggcaggagggcacgctgtggtggcacgcgcacagctcctggctcagggccaccgtctacggcgggctcatcatccgccccagggagaacaagacctaccctttcgccaagccctcccgcgaagtccccctcatcctcggggagtggtgggatgcgaacccgatcgatgtcatccgggaggctcagaagacgggcggcggtcccaacgtctccgacgccttcaccatcaacggccagcccggtgacctgttcaaatgctcccagaaagagacgacggccattccggtgaaggccggcgagacggcgcttctacggttcatcaacgcggcgctcaaccacgagctgttcgtcaccatcgcgcagcacaagatgacggtggtcgccaccgacgcgtcctacaccaagcccttcaccacctcggtgctcatgatcgcgccgggccagaccaccgacgtgctcgtcaccatggaccaggcgcccacccggtactacgtcgccgcgcgcgcctacgtctccggccagaacgtggccttcgacaacaccaccaccacggccgtcctcgagtacgactgcggctgcgcctccgacttcggccccaagatacagccggcgttcccggcgctgccggccttcaacgacaccagcgccgccaccgccttcgccgcggggatcaagagccccaacagggtcaagatccacgagaacgtcgacgaatacctcttcttcaccgtcggcctcgggctgttcaactgcaagccgggccagctctgcaagggtcccaacaacaacacccgcttcacggccagcatgaacaacgtctccttcgtcttccccaagtccgactccctcctccacgcgcactactacaaggtccccggcgtcttcaccaccgacttcccggcgtacccgccggtgcagttcgactacacgggaaacgtcagccaggcactgtggcagccggtccccgggaccaagctgtacccgctcaggttcggttccgtggtgcaggtcgtcctgcaggacaccagcatcgtcacgccggagaaccaccccatccacatccatggctacgatttcttcatcctcgccgagggcttcggcaacttcgaccccaagaaggacgtcgagaagttcaactacgtcgacccgccgcagcggaacaccgtggcggtgcccgtcaacggctgggcggtcatccagttcgtcgccgacaacccaggtgtgtggctcatgcattgccatctggacgtgcacatcacctggggcctggcaatggctttcctagtggaggacgggtatggcgaactgcagtccctggagccgcccccagttgatcttcccatgtgctaa

SEQ ID NO: 17019 - protein, 568 aa, Sorghum bicolor
  misc_feature: Useful for making plants with altered carbohydrate content
  misc_feature: Functional homolog of the protein sequence given in SEQ ID NO 14465
  misc_feature: Useful for making plants with altered cell wall content and/or composition
  misc_feature: Functional homolog of the protein sequence given in SEQ ID NO 14203
  misc_feature: Useful for biocontainment applications
  misc_feature: Useful for making plants with modulated biomass
  misc_feature: Useful for making plants with modulated flowering time
  misc_feature: Useful for making plants with modulated low light sensitivity
  misc_feature: Functional homolog of the protein sequence given in SEQ ID NO 14204
  misc_feature: Ceres ANNOT ID no. 8669358
  misc_feature (26)..(568): SWISSPROT Homolog: EC 1.10.3.2 Laccase
  misc_feature (33)..(149): Pfam ID: Cu-oxidase_3 Pfam Description: Multicopper oxidase
  misc_feature (159)..(311): Pfam ID: Cu-oxidase Pfam Description: Multicopper oxidase
  misc_feature (417)..(552): Pfam ID: Cu-oxidase_2 Pfam Description: Multicopper oxidase
MASLSSTWLLLLLSCLALALLAADAEVHHHEFVVQETPVKRLCKTHNIITVNGQFPGPMLEVREGDTLVINVVNRAQYNVTIHWHGIRQMRTGWADGPEFVTQCPIKPGGSYKYRFTIEGQEGTLWWHAHSSWLRATVYGGLIIRPRENKTYPFAKPSREVPLILGEWWDANPIDVIREAQKTGGGPNVSDAFTINGQPGDLFKCSQKETTAIPVKAGETALLRFINAALNHELFVTIAQHKMTVVATDASYTKPFTTSVLMIAPGQTTDVLVTMDQAPTRYYVAARAYVSGQNVAFDNTTTTAVLEYDCGCASDFGPKIQPAFPALPAFNDTSAATAFAAGIKSPNRVKIHENVDEYLFFTVGLGLFNCKPGQLCKGPNNNTRFTASMNNVSFVFPKSDSLLHAHYYKVPGVFTTDFPAYPPVQFDYTGNVSQALWQPVPGTKLYPLRFGSVVQVVLQDTSIVTPENHPIHIHGYDFFILAEGFGNFDPKKDVEKFNYVDPPQRNTVAVPVNGWAVIQFVADNPGVWLMHCHLDVHITWGLAMAFLVEDGYGELQSLEPPPVDLPMC

SEQ ID NO: 17020 - DNA, 2070 bp, Sorghum bicolor
  misc_feature: Ceres ANNOT ID no. 8669370
  misc_feature: Encodes the peptide sequence at SEQ ID NO 17021
atggccatctcctccttcctctccgttcgcgggcgcccaatcgtcgtcgtcgtcgccgtcaccctcttcattttcctgtcctctctcttcctcttcttcagccccggaccgtcggcgctcccatttttctcctcctcatcctcacacgtctcctctcaagtctcaattcccgactcctctaccgcatcttcacccgaaaccccaacccctattgccggcagcagcagcacttctgttgatcgcgtctctgctgacgcatctccgcccgtaaccggaaccgccatcgcgtctgatgcggtcagcaacagcaccgcggacccgcttcggccagatgtcaccgccgctgcgggcgctggtgacgcggaggctggcgtgccccaaccagatcacggcatgccctctgccgccactgaagcgatagcgagtggatcggctggcaacggtgatacagccgcgggagtctcgagcgagcgagatgaggaggggcaaggcggcgccggcgccgttgaggagccggtggagctgccgtcgtgggagctgtgcaaggtggggaagggggtggaggccgcggactacatcccctgcctcgacaacgtgaaggcgatcaacgcactcatgtcgcggcggcacatggagcaccgggagaggcactgcccgacggagccgagaccgaggtgcctcgtgcctctgcccgagagataccggcgtccggtgccctggccgcgcagccgtgacatgatttggtataacaatgttcctcacccaaagttagtggaatacaagaaggaccagaactgggtccggaagtctggtaactattttgttttccctggaggtgggactcaattcaaaaatggcgtgaccgcatacattcgattcattgaacagattttaccaaacattcaatggggaatccatacaagaactgtcctggatgttggatgtggtgttgccagctttggcggatacttgcttgatcggaatgtcattaccatgtcctttgcacccaaagatgagcatgaagctcagattcagtttgcactggagcgtgggattccagcgtttttggcagtgattggaacacaaaagctccctttccctgataattcatttgatgtcatccactgtgcaaggtgtagggtccactggtatgctgatggtggaaaaccattgttggagctcaatagaatactcaggcctggaggatattacatttggtctgcaacacctgtctatcgcaaagacccaagagatatagatgattggaatgcggtggttgctctgaccaaatcgatctgctggaggacagtggtaaggtctcgagatatcaacaagatcggagttgttatataccaaaagccgacatcaaattcatgctacattgagagaaaaaataatgaaccgcctctgtataaacctctcgatagttgcctatttccctcagttccaagttcaggtggaggaaatagttggcccatcccatggcctgaaagacttaatatgaagcactcgactacatctaacaattcttccattcagtttcctcaagaaaaaattgattctgatacaaattattggaagggccttgtttcagaagtatatctcaatgaatttgcagttaattggtctagtgttcgcaatgttatggacatgaatgcgggttttggaggatttgcagcatcaataattgatcgaccgttgtgggttatgaatgttgtacctgttgatcagccagatacattgcacatcattttcaacagaggtctgattggggtatatcatgactggtgtgaatcgtttaatacatacccacggacttatgatcttcttcacatgagtcatctcttagggcctcttacgaaaaggtgccacatcattgaaattgcggctgaaattgacagaatacttagacctggtagatggtttgtgctgcaagacactatagacgtgataagaaagatggaccctgttctcaggtctttgcattacaagactcaaattgtcaaacatcaatttcttcttgccaccaagggtttctggcgtcctggcagtacagattctaagtcatga

SEQ ID NO: 17021 - protein, 689 aa, Sorghum bicolor
  misc_feature: The sequence is a functional homolog of SEQ ID NO 198 in the 10/666,642 US patent application
  misc_feature: The sequence is a functional homolog of SEQ ID NO 626 in the 11/435,388 US patent application
  misc_feature: The sequence is a functional homolog of SEQ ID NO 508 in the 11/435,388 US patent application
  misc_feature: The sequence is a functional homolog of SEQ ID NO 562 in the 10/412,699 US patent application
  misc_feature: Ceres ANNOT ID no. 8669370
  misc_feature (309)..(404): SWISSPROT Homolog: EC 2.1.1.41 Sterol 24-C-methyltransferase
  misc_feature (311)..(406): Pfam ID: Methyltransf_11 Pfam Description: Methyltransferase domain
MAISSFLSVRGRPIVVVVAVTLFIFLSSLFLFFSPGPSALPFFSSSSSHVSSQVSIPDSSTASSPETPTPIAGSSSTSVDRVSADASPPVTGTAIASDAVSNSTADPLRPDVTAAAGAGDAEAGVPQPDHGMPSAATEAIASGSAGNGDTAAGVSSERDEEGQGGAGAVEEPVELPSWELCKVGKGVEAADYIPCLDNVKAINALMSRRHMEHRERHCPTEPRPRCLVPLPERYRRPVPWPRSRDMIWYNNVPHPKLVEYKKDQNWVRKSGNYFVFPGGGTQFKNGVTAYIRFIEQILPNIQWGIHTRTVLDVGCGVASFGGYLLDRNVITMSFAPKDEHEAQIQFALERGIPAFLAVIGTQKLPFPDNSFDVIHCARCRVHWYADGGKPLLELNRILRPGGYYIWSATPVYRKDPRDIDDWNAVVALTKSICWRTVVRSRDINKIGVVIYQKPTSNSCYIERKNNEPPLYKPLDSCLFPSVPSSGGGNSWPIPWPERLNMKHSTTSNNSSIQFPQEKIDSDTNYWKGLVSEVYLNEFAVNWSSVRNVMDMNAGFGGFAASIIDRPLWVMNVVPVDQPDTLHIIFNRGLIGVYHDWCESFNTYPRTYDLLHMSHLLGPLTKRCHIIEIAAEIDRILRPGRWFVLQDTIDVIRKMDPVLRSLHYKTQIVKHQFLLATKGFWRPGSTDSKS

SEQ ID NO: 17022 - DNA, 648 bp, Sorghum bicolor
  misc_feature: Ceres ANNOT ID no. 8669372
  misc_feature: Encodes the peptide sequence at SEQ ID NO 17023
atggatccctccgggcctggcccgtcgtcggtcatgggggcagcaggcggcggcgaggcaccggccgtggcgccgccgcgtccggcgcagctgagcaggtacgagtcgcagaagcggagggactggaacacgttcctgcagtacctgcgaaaccaccggccgccgctgacgctggcgcggtgcagcggcgcgcacgtgatcgagttcctccggtacctggaccagttcggcaagaccaaggtgcacgccgccgggtgcgcctactacggccagccggcaccgccggggccctgcccgtgcccgctgcgccaggcgtggggctccctcgacgcgctcatcggccgcctgcgcgcggcgtacgaggagagcggcggcacgcccgagtccaaccccttcgccgcgcgcgccgtgcggatctacctccgcgaggtgcgcgactcgcaggccaaggcgcgcggcatcccctacgagaagaagaagcgcaagcgcgcgcagcagcagcaggccgccgccgccgcggatcctgcttcgacgagctcgtccgctgctgctgccggcgggagcgggactagcggcagggctgctgctgcagctgccgcgtccgccgctcaggccggagggagtagcgctgcaccgagcaccacttga

SEQ ID NO: 17023 - protein, 215 aa, Sorghum bicolor
  misc_feature: Useful for making plants with modulated low light sensitivity
  misc_feature: Useful for making plants with modulated nitrogen use efficiency
  misc_feature: Functional homolog of the protein sequence given in SEQ ID NO 13437
  misc_feature: Useful for making plants with modulated flowering time
  misc_feature: Functional homolog of the protein sequence given in SEQ ID NO 13982
  misc_feature: Useful for making plants with modulated biomass
  misc_feature: Functional homolog of the protein sequence given in SEQ ID NO 13338
  misc_feature: Useful for biocontainment applications
  misc_feature: Functional homolog of the protein sequence given in SEQ ID NO 13983
  misc_feature: Ceres ANNOT ID no. 8669372
MDPSGPGPSSVMGAAGGGEAPAVAPPRPAQLSRYESQKRRDWNTFLQYLRNHRPPLTLARCSGAHVIEFLRYLDQFGKTKVHAAGCAYYGQPAPPGPCPCPLRQAWGSLDALIGRLRAAYEESGGTPESNPFAARAVRIYLREVRDSQAKARGIPYEKKKRKRAQQQQAAAAADPASTSSSAAAAGGSGTSGRAAAAAAASAAQAGGSSAAPSTT

SEQ ID NO: 17024 - DNA, 699 bp, Sorghum bicolor
  misc_feature: Ceres ANNOT ID no. 8669388
  misc_feature: Encodes the peptide sequence at SEQ ID NO 17025
atggatccatatcactaccagactatgtatgacccacgcggcttccccatcatccacccgcagccgccgtacctccaccacccggtggcggtggccggcgccctcagcgacagcagggtgcgcggcggcggcggaggcggtggcgtgcggcggcgtcctggtgccaagctctccacggacccgcagagcgtggcggcgcgcgagcggcggcaccgcatcagcgaccgcttccgcgtgctgcgcagcctcgtccccggcggcagcaagatggacacggtgtccatgctcgagcaggccatccattacgtcaagtttctgaaggcgcagatcagcctgcaccaggccgcgctgatgcagcacgaggaagggtgccatgctgagctagccgccgcctactccgcggcggcggcggcggtggctggtgacgacgaggtgacgctcgcgtcccacggtcgtaccggcgcatgcgatgaggtgatgcagctccagcttcaggtgccgggggaggaagctttgagttatggtgttgttgctgcccatcagccgtacgggctcgatcccaggcatcagctgagtggtgggcacgagctgcctccgttgcctgcttcttgcatcttcgtcgaggagcctgcagacgcatgctactctgtgtgtgacctcgacgacggggagactggtctgcccgccggctcttactag

SEQ ID NO: 17025 - protein, 232 aa, Sorghum bicolor
  misc_feature: Useful for making plants with modulated biomass
  misc_feature: Functional homolog of the protein sequence given in SEQ ID NO 14466
  misc_feature: The sequence is a functional homolog of SEQ ID NO 1208 in the 10/666,642 US patent application
  misc_feature: Ceres ANNOT ID no. 8669388
  misc_feature (60)..(107): Pfam ID: HLH Pfam Description: Helix-loop-helix DNA-binding domain
MDPYHYQTMYDPRGFPIIHPQPPYLHHPVAVAGALSDSRVRGGGGGGGVRRRPGAKLSTDPQSVAARERRHRISDRFRVLRSLVPGGSKMDTVSMLEQAIHYVKFLKAQISLHQAALMQHEEGCHAELAAAYSAAAAAVAGDDEVTLASHGRTGACDEVMQLQLQVPGEEALSYGVVAAHQPYGLDPRHQLSGGHELPPLPASCIFVEEPADACYSVCDLDDGETGLPAGSY

SEQ ID NO: 17026 - DNA, 516 bp, Sorghum bicolor
  misc_feature: Ceres ANNOT ID no. 8669404
  misc_feature: Encodes the peptide sequence at SEQ ID NO 17027
atggacaggtctctcgacagaaactcctccatcaaggacgtcacttatagctgcgggtactgcggctacgcgctgaacctgagctcctcggcgcgggacacggagggcatcgggtgctccaagtaccgcaagcagatcaagaagggcgtcgtcgccttcgtcgcggtggacgagacccggttcacgctcgccgacgaggtcacctgcatgccctacttccgctccgcccgctcctggggcctcttcaggaggcgggcgcgcctgctctgccgcaagtgcggcggacgcatcggcaacgcctacgaggaggaggacgacgccagggactactccagctccagcctcttcgacggcgacggcgacggctcctcggatgacatgcgccggagctccggcttgggctcgggccgcagcagcatcgtgtcgtcgagccagaagaactacgtgatcaagatcagcgcgctgcagccgtcgtcagatgattctgctgctgttgttcccttcacacatcgatga

SEQ ID NO: 17027 - protein, 171 aa, Sorghum bicolor
  misc_feature: Useful for making plants with modulated light quality response
  misc_feature: Useful for making plants with modulated light quality sensitivity
  misc_feature: Functional homolog of the protein sequence given in SEQ ID NO 13506
  misc_feature: Ceres ANNOT ID no. 8669404
MDRSLDRNSSIKDVTYSCGYCGYALNLSSSARDTEGIGCSKYRKQIKKGVVAFVAVDETRFTLADEVTCMPYFRSARSWGLFRRRARLLCRKCGGRIGNAYEEEDDARDYSSSSLFDGDGDGSSDDMRRSSGLGSGRSSIVSSSQKNYVIKISALQPSSDDSAAVVPFTHR

SEQ ID NO: 17028 - DNA, 744 bp, Sorghum bicolor
  misc_feature: Ceres ANNOT ID no. 8669392
  misc_feature: Encodes the peptide sequence at SEQ ID NO 17029
atggccgccgcaatctcgctggaggccggcgggggcctggcccacgacctagggtccgcagccgtcaccgctggtgtcgccctcgcgctcctcaaattcttcgaggagatcgcgaagcgcggcgtcttcgagcagaaactcagcaggaaacttgttcatataagcgtgggcctggtgttcttgcttttttggcctctttttagctctggatggtatgctcctttccttgctgcgctagcaccaggggtcaacgttataaggatgcttctactggggctgggacttatgaaaaatgaggctatggttaaatcaataagccgctctggagattacagggaacttctcaagggcccactgtattatgctactactataacttttgccacgtctgtattatggagaacctcaccagttgctatagcacttatatgcaacttatgtgctggggatggtatagctgatgttgttgggagacgcctaggtaaagaaaagcttccatacaatcccaacaaatcatatgctggaagcatagcaatggcggtggctggttttctggcctcagttgggtatatgcattacttccacacttttggttttattgaggaaacatggtacatggctttaggcttccttgtggtatctgtagctgcaacactcgttgaatcacaccccatcagcacagaactggatgacaatttgactgttcctttaacatcattcctagttggtagcctcatcttttga

SEQ ID NO: 17029 - protein, 247 aa, Sorghum bicolor
  misc_feature: Useful for making plants with modulated nitrogen use efficiency
  misc_feature: Functional homolog of the protein sequence given in SEQ ID NO 13064
  misc_feature: Ceres ANNOT ID no. 8669392
  misc_feature (47)..(247): Pfam ID: CTP_transf_1 Pfam Description: Cytidylyltransferase family
MAAAISLEAGGGLAHDLGSAAVTAGVALALLKFFEEIAKRGVFEQKLSRKLVHISVGLVFLLFWPLFSSGWYAPFLAALAPGVNVIRMLLLGLGLMKNEAMVKSISRSGDYRELLKGPLYYATTITFATSVLWRTSPVAIALICNLCAGDGIADVVGRRLGKEKLPYNPNKSYAGSIAMAVAGFLASVGYMHYFHTFGFIEETWYMALGFLVVSVAATLVESHPISTELDDNLTVPLTSFLVGSLIF

SEQ ID NO: 17030 - DNA, 1638 bp, Sorghum bicolor
  misc_feature: Ceres ANNOT ID no. 8669395
  misc_feature: Encodes the peptide sequence at SEQ ID NO 17031
atgggcaactgctgccgctcgccggccgccgtcgcgagggaggacgtcagctcctcgcacttccccgcatccaacgcgaagaagaagccgcaccaagcgcggaacggcgccggcggaggaggaggaggaggaggaggcggcggcggcgggcagaagcggctctcggtgctgggcgacgaggggtgcgaggtcgtcgggatcgacgacaagtacgtcctggacagggagctcggccgcggggagttcggggtgacgtacctgtgcatggatcgggacaccaaggagctgctcgcctgcaagtccatctccaagcgcaagctgcggacggccgtcgacgtcgaggacgtgcgccgggaggtggccatcatgcgccacctacccaagagccccagcatcgtgtccctgcgggaggcgtgcgaggacgagggcgccgtccacctcgtcatggagctctgcgagggcggcgagctcttcgaccgcatcgtcgcgcggggacactacaccgagcgcgccgccgccaatgtcacccgcaccatagtcgaggtcgtccagctctgccaccgccacggcgtgatccaccgcgacctcaagccggagaacttcctcttcgccaataagaaggagaactcgccgctcaaggccatcgacttcggcctctccatcttcttcaagcctggtgaaaagttttcagaaattgtgggaagcccctattacatggctcctgaagtattgaagagaaactatgggccagaaatagacatatggagtgcgggagttatcctgtatattttattatgtggagttcctccattttgggctgagactgaacaaggggtggcacaggctattcttcgtggaaatatcgattttaagcgggaaccctggcctaatgtttcagaaaatgcaaaagatttagttcgacgcatgttggagcctgatccaaagctcaggttaactgcaaagcaggttcttgaacatcattggcttcaaaatgcgaagaaggctcctaacgtccctcttggagatattgtaaagtcaaggctcaaacaattttctaggatgaatagattcaaaagaagggctctaagggtcattgctgatcatttgtctgctgaggaagttgaggacataaaggagatgttcaagactatggatactgacaatgatgggattgtatcttatgaagaactgaagaccggaatagcgaaacttggttcccatcttgcggaatcagaagtacagatgctcattgaagctgtggatacaaatggtaggggggcactagattatggggaatttttggctgtttctcttcatttgcaaaggatggcaaatgatgagcatcttcgccgggccttcctattttttgacaaggatggcaatggtttcattgagcccgaggaacttcgggaggctctagtggatgatggagcagctgatagcatggaagtggtgaatgacatattgcaagaagttgacactgataaggatggcaagattagctatgacgaatttgtagcaatgatgaagaccggtacagattggagaaaggcatcccgacactattcaagaggaagattcaacagccttagcatgaagcttataaaggatgggtcggtaaaattgggtgttgagtga

SEQ ID NO: 17031 - protein, 545 aa, Sorghum bicolor
  misc_feature: The sequence is a functional homolog of SEQ ID NO 2 in US patent 7084323
  misc_feature: Ceres ANNOT ID no. 8669395
  misc_feature (67)..(542): SWISSPROT Homolog: EC 2.7.11.1 Non-specific serine/threonine protein kinase
  misc_feature (71)..(329): Pfam ID: Pkinase Pfam Description: Protein kinase domain
  misc_feature (484)..(512): Pfam ID: efhand Pfam Description: EF hand
  misc_feature (376)..(404): Pfam ID: efhand Pfam Description: EF hand
  misc_feature (448)..(476): Pfam ID: efhand Pfam Description: EF hand
MGNCCRSPAAVAREDVSSSHFPASNAKKKPHQARNGAGGGGGGGGGGGGGQKRLSVLGDEGCEVVGIDDKYVLDRELGRGEFGVTYLCMDRDTKELLACKSISKRKLRTAVDVEDVRREVAIMRHLPKSPSIVSLREACEDEGAVHLVMELCEGGELFDRIVARGHYTERAAANVTRTIVEVVQLCHRHGVIHRDLKPENFLFANKKENSPLKAIDFGLSIFFKPGEKFSEIVGSPYYMAPEVLKRNYGPEIDIWSAGVILYILLCGVPPFWAETEQGVAQAILRGNIDFKREPWPNVSENAKDLVRRMLEPDPKLRLTAKQVLEHHWLQNAKKAPNVPLGDIVKSRLKQFSRMNRFKRRALRVIADHLSAEEVEDIKEMFKTMDTDNDGIVSYEELKTGIAKLGSHLAESEVQMLIEAVDTNGRGALDYGEFLAVSLHLQRMANDEHLRRAFLFFDKDGNGFIEPEELREALVDDGAADSMEVVNDILQEVDTDKDGKISYDEFVAMMKTGTDWRKASRHYSRGRFNSLSMKLIKDGSVKLGVE

SEQ ID NO: 17032 - DNA, 414 bp, Sorghum bicolor
  misc_feature: Ceres ANNOT ID no. 8669470
  misc_feature: Encodes the peptide sequence at SEQ ID NO 17033
atggcgcccaaggccgagaagaagcccgcggagaagaagccggcggaggagaaggccgagaagaagcccagggcggagaaacgcgtccccggcaaggagggcggcgagaagaaggggaagaagaaggccaagaagagcgtcgagacgtacaagatctacatcttcaaggtgctcaagcaggtgcacccggacattggtatctcctccaaggccatgtccatcatgaactccttcatcaacgacatcttcgagaagctcgccgccgaggccgccaagctcgcccgctacaacaagaagcccaccatcacctcccgggagatccagacgtcggtgcgcctcgtccttcccggcgagctcgccaagcacgccgtctccgagggcaccaaggctgttaccaagtttacttcctcttag

SEQ ID NO: 17033 - protein, 137 aa, Sorghum bicolor
  misc_feature: Useful for biocontainment applications
  misc_feature: Useful for making plants with modulated flowering time
  misc_feature: Functional homolog of the protein sequence given in SEQ ID NO 13102
  misc_feature: Ceres ANNOT ID no. 8669470
  misc_feature (44)..(114): Pfam ID: Histone Pfam Description: Core histone H2A/H2B/H3/H4
MAPKAEKKPAEKKPAEEKAEKKPRAEKRVPGKEGGEKKGKKKAKKSVETYKIYIFKVLKQVHPDIGISSKAMSIMNSFINDIFEKLAAEAAKLARYNKKPTITSREIQTSVRLVLPGELAKHAVSEGTKAVTKFTSS

SEQ ID NO: 17034 - DNA, 1947 bp, Sorghum bicolor
  misc_feature: Ceres ANNOT ID no. 8669482
  misc_feature: Encodes the peptide sequence at SEQ ID NO 17035
atggcgaagagcgagggtccggcgatcgggatcgatctcggcaccacctactcgtgcgtcggcgtgtggcagcacgaccgggtggagatcatcgccaacgaccagggcaaccgcaccacgccgtcctatgtcgccttcaccgacaccgagcggctcatcggcgacgccgccaagaaccaggtcgccatgaatcccaccaacaccgtcttcgatgccaagcggttgatcggcaggaggttctctgacccttcagttcagagtgacatgaagctgtggccattcaaggtcatcccaggccctggtgacaagcccatgattgtagtcaactacaagggtgaggagaagcagttcgctgctgaagagatctcctccatggtgctcatcaagatgagggagattgctgaagcctacctcggctctacgatcaagaacgcagtggtgaccgtgccggcctacttcaacgactcgcagaggcaggccaccaaggacgccggtgtcattgcgggcctcaatgtgatgcgtatcatcaacgagcccactgccgctgctattgcctacggtcttgacaagaaggccaccagtgctggcgagaagaacgtgctcatcttcgaccttggcggtggcacgtttgatgtgtcgctgctcaccatcgaggagggcatcttcgaggtgaaggccactgcgggtgacactcaccttggaggcgaggacttcgacaatcgcatggtgaaccacttcgtccaagagttcaagcgcaagcacaagaaggacctcagcggcaacccccgtgcactgcgccggctgcgcacggcgtgcgagcgcgccaagcgcacgctgtcatcgaccgcccagacgaccatcgagatcgactccctgttcgagggcatcgacttctactccacgatcaccagggctcgcttcgaggagctcaacatggacctgttccgcaagtgcatggaacctgtggagaagtgtctgcgcgacgccaagatggacaagagcagcgtgcacgacgtcgtgctcgtcggtggctccacccgcatccccaaggtgcagcagctgctgcaggacttcttcaacggcaaagagctgtgcaagagcatcaaccccgacgaggccgtggcctacggcgcggctgtccaggccgccatcctcagcggcgagggcaacgagaaggtgcaagacctgctcctgctcgacgtcacgccactgtcactcggtctggagactgcaggtggtgtcatgacggtgctcatcccgaggaacaccaccatcccgaccaagaaggagcaggtcttctccacgtactccgacaaccagccgggcgtcctgatccaggtgtacgagggtgagcgcgcgaggaccaaggacaacaacctcctcggcaagttcgagctctcgggcatccctcctgctccccgcggcgtgcctcagatcacggtcaccttcgacatcgacgccaacggcatcctcaacgtctctgccgaggacaagaccaccggccagaagaacaagatcacgatcaccaacgacaagggcaggcttagcaaggaggagattgagaagatggtgcaggaggctgagaagtacaaggctgaggacgaggaggtcaagaagaaggtggacgccaagaacacgctcgagaactacgcctacaacatgaggaacaccatcaaggatgacaagatcgcctccaagctcccggcagaggacaagaagaagattgaggacgccgtcgatagtgccatcagctggctggacagcaaccagctggctgaggtggacgagtttgaagacaagatgaaggagcttgaggggatctgcaaccccatcatcgcgaagatgtaccagggcgctggcgcgggcatgggcgatgctgctggcatggatgaggacgccccgtctggtgggagcggtgctggtcctaagatcgaggaggtcgattaa

SEQ ID NO: 17035 - protein, 648 aa, Sorghum bicolor
  misc_feature: Useful for making plants with modulated drought sensitivity
  misc_feature: Useful for making plants with modulated heat sensitivity
  misc_feature: Functional homolog of the protein sequence given in SEQ ID NO 14080
  misc_feature: Ceres ANNOT ID no. 8669482
  misc_feature: Down-regulated in shoot tissues in response to aminocyclopropane carboxylic treatment
  misc_feature: Down-regulated in root tissues in response to methyl jasmonate treatment
  misc_feature: Down-regulated in shoot tissues in response to methyl jasmonate treatment
  misc_feature: Up-regulated in shoot tissues in response to salicylic acid treatment
  misc_feature: Up-regulated in root tissues in response to salicylic acid treatment
  misc_feature (8)..(617): Pfam ID: HSP70 Pfam Description: Hsp70 protein
MAKSEGPAIGIDLGTTYSCVGVWQHDRVEIIANDQGNRTTPSYVAFTDTERLIGDAAKNQVAMNPTNTVFDAKRLIGRRFSDPSVQSDMKLWPFKVIPGPGDKPMIVVNYKGEEKQFAAEEISSMVLIKMREIAEAYLGSTIKNAVVTVPAYFNDSQRQATKDAGVIAGLNVMRIINEPTAAAIAYGLDKKATSAGEKNVLIFDLGGGTFDVSLLTIEEGIFEVKATAGDTHLGGEDFDNRMVNHFVQEFKRKHKKDLSGNPRALRRLRTACERAKRTLSSTAQTTIEIDSLFEGIDFYSTITRARFEELNMDLFRKCMEPVEKCLRDAKMDKSSVHDVVLVGGSTRIPKVQQLLQDFFNGKELCKSINPDEAVAYGAAVQAAILSGEGNEKVQDLLLLDVTPLSLGLETAGGVMTVLIPRNTTIPTKKEQVFSTYSDNQPGVLIQVYEGERARTKDNNLLGKFELSGIPPAPRGVPQITVTFDIDANGILNVSAEDKTTGQKNKITITNDKGRLSKEEIEKMVQEAEKYKAEDEEVKKKVDAKNTLENYAYNMRNTIKDDKIASKLPAEDKKKIEDAVDSAISWLDSNQLAEVDEFEDKMKELEGICNPIIAKMYQGAGAGMGDAAGMDEDAPSGGSGAGPKIEEVD

SEQ ID NO: 17036 - DNA, 771 bp, Sorghum bicolor
  misc_feature: Ceres ANNOT ID no. 8669502
  misc_feature: Down-regulated in shoot tissues in response to aminocyclopropane carboxylic treatment
  misc_feature: Down-regulated in root tissues in response to methyl jasmonate treatment
  misc_feature: Down-regulated in shoot tissues in response to methyl jasmonate treatment
  misc_feature: Up-regulated in shoot tissues in response to salicylic acid treatment
  misc_feature: Up-regulated in root tissues in response to salicylic acid treatment
  misc_feature: Encodes the peptide sequence at SEQ ID NO 17037
atggcttccaggaagttcttcgtgggcggcaactggaaatgcaacggcaccggcgaggacgtgaagaagatcgtcaccgtcctcaacgaagccgaggtgcccactgaggacgtcgtcgaggtggtggtgagcccgcctttcgtttttctgcagcaggtcaaggggctgctgcggctggacttcgctgtcgcagcgcagaactgctgggtgcgcaagggcggcgccttcaccggcgagatcagtgctgagatgctggtgaacctgcaggtgccctgggtcattttggggcattctgagcgcagagctctgttgggtgaatccagtgattttgttgctgataaagttgcatatgcactcacccaaggtctcaaggtaattgcttgcattggtgagacccttgagcagagagaggcaggaacgacaatggatgttgttgctgcacaaacaaaggctatttctgaaaaaatatcagattggacaaatgttgtgttggcgtatgaaccagtttgggctattgggaccggcaaggttgcaacccctgctcaggctcaggaggttcatgatggtctaagaaagtggcttcactccaatgttagcccagcagttgctgaatcgaccaggataatttatggagggtctgtaaatggagctaactgcaaagaacttgcagctcaagcagatgttgatgggttccttgttggtggagcctcattgaagcctgagttcgtggacatcatcaagtctgccactgtcaaatcttcatgtgcctag

SEQ ID NO: 17037 - protein, 256 aa, Sorghum bicolor
  misc_feature: Useful for making plants with modulated biomass
  misc_feature: Functional homolog of the protein sequence given in SEQ ID NO 14343
  misc_feature: Ceres ANNOT ID no. 8669502
  misc_feature (4)..(254): SWISSPROT Homolog: EC 5.3.1.1 Triose-phosphate isomerase
  misc_feature (6)..(246): Pfam ID: TIM Pfam Description: Triosephosphate isomerase
MASRKFFVGGNWKCNGTGEDVKKIVTVLNEAEVPTEDVVEVVVSPPFVFLQQVKGLLRLDFAVAAQNCWVRKGGAFTGEISAEMLVNLQVPWVILGHSERRALLGESSDFVADKVAYALTQGLKVIACIGETLEQREAGTTMDVVAAQTKAISEKISDWTNVVLAYEPVWAIGTGKVATPAQAQEVHDGLRKWLHSNVSPAVAESTRIIYGGSVNGANCKELAAQADVDGFLVGGASLKPEFVDIIKSATVKSSCA

SEQ ID NO: 17038 - DNA, 1683 bp, Sorghum bicolor
  misc_feature: Ceres ANNOT ID no. 8669501
  misc_feature: Encodes the peptide sequence at SEQ ID NO 17039
atggcggaggtcgtgcaggaggggtgcgtggagaatcggcagcccctggcggcttcgagctcttccgtgtcggatggcagcagctgtggtggtggagggcgagcggggacgtcgccgcccgtgtcaagctctgggaattccatctccgttctgaggcgaacaagtggaccgataagaagagctaagggtggctggacgccggaagaggatgaaacactgcggaaggcagttgaagctttcaagggtagaaattggaaaaaaatagctgaattctttcaggacaggactgaggttcaatgtttgcatcgctggcagaaggttcttaatccggagcttatcaaaggcccttggactcaagaggaagatgaaaaaatcattgaccttgtgggcaagtatggaccaacaaaatggtctatcatcgcgaaatcattgcctggccgcataggcaagcaatgccgagagaggtggcataatcatctgaatccagaaataaggaaagatgcttggactcctgaggaggaaagggcacttattaatgctcataaagtgtttgggaataaatgggcagaaatagcaaaagctcttcctggaaggaccgataattccataaagaatcattggaacagttctttgagaaagaagttagaagcctatagtaacagcagcgttctttcagctccgaagctgtttgttcatgatgatttcaaggacaaaatgaagcccgtgggtactgacagccatcttgatctgaaccaaatgccaagcattggttcaaaagatgtccctggaagagcttatcgttccattttgagcccaccttcacaggcatacaatttggactcctcaggcttcctttctctttctataccaactgtgcagcctctaactaaatatgaaatgccatcactagttgatggttctgctgttactttggctgtacaaggtctggaaagtgattctgtccgtgacaagggcctagaaattgacgctgttcatgagaagggtgttgaggttagctcaactcctgatcctgttggggttgaattagaatctgcaccagccaaaagaggtgcagtattatcttcaaagaacgagttgcattctacccttggtcctctttgttatcagattccaaacatggaatatgtggccccaatccgtaccccgctccgttctgaatgtaatggttcacatcaaacacaacatttcatgtcacccaatggttatacttctccttctccaacgattggaaaagtatcaagtcagctaactgttgattcaattttgaggattgctgctgacagctttccaggtactccttctatactaaggaaaagaaaacgtgataaagcaacacctgcttcaggtaatgagttgaagacgggtggagtaagcaatgatagcttttacactcctaatggaactaatgggaaggacactactccacgatcatttaaaactgctgcatcctttttgtcgctgggttctgttgatgggttattgacttctgtaaggagctttgattcttcaccaccctatcagaaaaggtcaaaaagaatggctatcatcaaatcagttgagaaacagctggatttttcagcagatggactggatacttctggttctgagatgaagaactctccttgccataattcccaaggcgcaaattctaacaggacgtaa

SEQ ID NO: 17039 - protein, 560 aa, Sorghum bicolor
  misc_feature: Useful for making plants with modulated water use efficiency
  misc_feature: Functional homolog of the protein sequence given in SEQ ID NO 13678
  misc_feature: The sequence is a functional homolog of SEQ ID NO 2684 in the 10/374,780 US patent application
  misc_feature: The sequence is a functional homolog of SEQ ID NO 844 in the 10/225,066 US patent application
  misc_feature: Ceres ANNOT ID no. 8669501
  misc_feature (62)..(108): Pfam ID: Myb_DNA-binding Pfam Description: Myb-like DNA-binding domain
  misc_feature (114)..(160): Pfam ID: Myb_DNA-binding Pfam Description: Myb-like DNA-binding domain
  misc_feature (166)..(211): Pfam ID: Myb_DNA-binding Pfam Description: Myb-like DNA-binding domain
MAEVVQEGCVENRQPLAASSSSVSDGSSCGGGGRAGTSPPVSSSGNSISVLRRTSGPIRRAKGGWTPEEDETLRKAVEAFKGRNWKKIAEFFQDRTEVQCLHRWQKVLNPELIKGPWTQEEDEKIIDLVGKYGPTKWSIIAKSLPGRIGKQCRERWHNHLNPEIRKDAWTPEEERALINAHKVFGNKWAEIAKALPGRTDNSIKNHWNSSLRKKLEAYSNSSVLSAPKLFVHDDFKDKMKPVGTDSHLDLNQMPSIGSKDVPGRAYRSILSPPSQAYNLDSSGFLSLSIPTVQPLTKYEMPSLVDGSAVTLAVQGLESDSVRDKGLEIDAVHEKGVEVSSTPDPVGVELESAPAKRGAVLSSKNELHSTLGPLCYQIPNMEYVAPIRTPLRSECNGSHQTQHFMSPNGYTSPSPTIGKVSSQLTVDSILRIAADSFPGTPSILRKRKRDKATPASGNELKTGGVSNDSFYTPNGTNGKDTTPRSFKTAASFLSLGSVDGLLTSVRSFDSSPPYQKRSKRMAIIKSVEKQLDFSADGLDTSGSEMKNSPCHNSQGANSNRT

SEQ ID NO: 17040 - DNA, 1740 bp, Sorghum bicolor
  misc_feature: Ceres ANNOT ID no. 8669508
  misc_feature: Encodes the peptide sequence at SEQ ID NO 17041
atggctacctcctatctgctgccttgctatgtcctcatcactgtgctcgtgctcttcttctccgtcgacgttacggaaggggccatcagggagtaccagttcgatgtgcaaatgacgaatgtgacgcggctgtgcagcagcaagagcatcgtgacggtgaacggtcagttcccggggccgccggtgttcgctagggagggcgacttcgtcgtcatccgcgtcgtcaaccacgtcccctacaacatgagcatccactggcacggcgtccggcagctgcggagcgggtgggcggacgggccggcgtacatcacgcaatgcccgatccagagcgggcagagctacgtgtacaagttcaccatcacggggcagcgcggcacgctgtggtggcacgcgcacatctcctggctgcgcgccaccgtctacggcgccatcgtcatcctgcccaagcccggcgtcccttacccgttcccggcgccctacaaggaggtccccgtcatcttcggcgagtggtggacggcggacacggaggcggtgatcagccaggcgctccagaccggcggaggacccaacgtctccgacgccttcaccatcaacgggctgcctggcccgctctacaactgctctgcaaaagacacgttcaagctgaaggtgaagcccgggaagacgtacatgctccgcatcatcaacgctgcgctcaatgacgagctcttcttctccatcgccggccacccactcaccgtcgtcgacgtcgacgcggtctacatcaagcccatcaccgtcgacaccatcctcatcacccccgggcagaccaccaacgtgctcctcaccaccaagccgtcctaccccggcgccacctactacatgctggccgcgccctactccaccgccaggccgggcaccttcgacaacaccaccgtggccggcatcctcgagtacgaggaccccacgtcccctcccccgcacgcggccttcaacaagaacctcccggcgctgaagccgacgctgccgcagatcaacgacacgagcttcgtcgccaactacacggccaagctccgcagcctcgccaccgcggagtaccccgccgccgtgccgcaggaggtggaccggcggttcttcttcacggtcgggctgggcacgcacccgtgcgccgtgaacgggacgtgccagggccccaccaacagcagccggttcgcggcgtccgtgaacaacgtctccttcgtgctcccgacgacggcgctgctgcagtcgcacttcgccggaaagtccaagggggtgtactcgtccaacttccccgccgcgccgctcgtcccgttcaactacacggggacgccgcccaacaacaccaacgtggccaacggcaccaagctggtggtgctgccgtacggcgccagcgtggagctggtgttgcagggcaccagcatcctcggcgccgagagccacccgctgcacctccacggcttcaacttcttcgtggtcggccaagggttcggcaacttcgaccccgccaaggacccggccaagtacaacctcgtcgaccccgtcgagcggaacaccgtcggcgtgccggcggccggctgggtggccatccggttccgcgcagacaatccaggggtatggtttatgcattgccacttggaggttcacgtcagctggggcctgaaaatggcatggctggtgctggacggagaccgccccaacgagaagctgctgcctccgccgtctgatctccccaggtgctga

SEQ ID NO: 17041 - protein, 579 aa, Sorghum bicolor
  misc_feature: Useful for making plants with altered carbohydrate content
  misc_feature: Functional homolog of the protein sequence given in SEQ ID NO 14467
  misc_feature: Useful for making plants with altered cell wall content and/or composition
  misc_feature: Functional homolog of the protein sequence given in SEQ ID NO 14217
  misc_feature: Useful for biocontainment applications
  misc_feature: Useful for making plants with modulated biomass
  misc_feature: Useful for making plants with modulated flowering time
  misc_feature: Useful for making plants with modulated low light sensitivity
  misc_feature: Functional homolog of the protein sequence given in SEQ ID NO 14204
  misc_feature: Ceres ANNOT ID no. 8669508
  misc_feature (2)..(579): SWISSPROT Homolog: EC 1.10.3.2 Laccase
  misc_feature (35)..(151): Pfam ID: Cu-oxidase_3 Pfam Description: Multicopper oxidase
  misc_feature (161)..(315): Pfam ID: Cu-oxidase Pfam Description: Multicopper oxidase
  misc_feature (429)..(563): Pfam ID: Cu-oxidase_2 Pfam Description: Multicopper oxidase
MATSYLLPCYVLITVLVLFFSVDVTEGAIREYQFDVQMTNVTRLCSSKSIVTVNGQFPGPPVFAREGDFVVIRVVNHVPYNMSIHWHGVRQLRSGWADGPAYITQCPIQSGQSYVYKFTITGQRGTLWWHAHISWLRATVYGAIVILPKPGVPYPFPAPYKEVPVIFGEWWTADTEAVISQALQTGGGPNVSDAFTINGLPGPLYNCSAKDTFKLKVKPGKTYMLRIINAALNDELFFSIAGHPLTVVDVDAVYIKPITVDTILITPGQTTNVLLTTKPSYPGATYYMLAAPYSTARPGTFDNTTVAGILEYEDPTSPPPHAAFNKNLPALKPTLPQINDTSFVANYTAKLRSLATAEYPAAVPQEVDRRFFFTVGLGTHPCAVNGTCQGPTNSSRFAASVNNVSFVLPTTALLQSHFAGKSKGVYSSNFPAAPLVPFNYTGTPPNNTNVANGTKLVVLPYGASVELVLQGTSILGAESHPLHLHGFNFFVVGQGFGNFDPAKDPAKYNLVDPVERNTVGVPAAGWVAIRFRADNPGVWFMHCHLEVHVSWGLKMAWLVLDGDRPNEKLLPPPSDLPRC

SEQ ID NO: 17042 - DNA, 1740 bp, Sorghum bicolor
  misc_feature: Ceres ANNOT ID no. 8669507
  misc_feature: Encodes the peptide sequence at SEQ ID NO 17043
atggcaatctcctctgctcttccctgctccctcctcatggcggccctgatgctcctcgcctctgccgtcgaagtgcaaggcatcacgaggcactacgacttcaatgtgacaatggcgaacgtgacacggctgtgcgccagcaagagcatcatcacggtgaacgggcagttccccggccccaagatcgtcgcgagggaaggcgaccgcctcgtcatccgcgtgaccaaccacgcccagcacaacatctcgctgcactggcacggcatccggcagctgcgcacggggtgggcggacgggccggcgtacatcacgcagtgcccgatccagacggggcagagctacgtgtacaactacaccatcgtcgggcagcgcggcacgctgtggtggcacgcgcacatctcctggctgcgcgccaccgtctacgggcccctcgtcgtcctgcccaagctcggcgtcccctacccgttcccggcgccgtacaaggaggtccccgtcatcttcggtgagtggtggctggcggacacggaggtggtgatccagcaggcgcttcagctcggcgctggtccgaatgtctctgacgcccacaccatcaacggcctaccaggaccgctctacaactgctctgccaaagacacgttcaagctgaaggtgaagccagggaagacgtacatgctccgcctcatcaacgcggcgctcaacgacgagctctttttctccatcgccaaccactcgctcaccgtcgttgaggtcgacgccgtctacgtcaagcccttcaccgtcgacaccctggtgatcgccccgggccagaccaccaacgtgctcctcgccgcgaagccgttctacccggccgccaactactacatgaccgccaggacctactccaccggccggccggccaccttcgacaacaccaccgtcgccggcatcctcgagtacgagtaccccgacgcgccctccgccgcggcgagcttcaacaaggccctgccgctctacaggccggcgctgccgcagctcaacgacaccagcttcgtcggcaacttcacggccaagctcctcagcctcgcgacgccggagtacccggcggcggtgccgcagacggtggacaagcggttcttcttcacggtggggctgggcacgcacccgtgcccggccaacaccacgtgccagggccccaccaacacgacgcagttcgcggcgtccgtgaacaacgtctccttcgtgctcccgaccaaggcgctgctgcactcgcacttcgccggcctgtccagcggcgtctacgagtcggacttccccgtggcgccgctggcgccgttcaactacacggggacgccgcccaacaacaccaacgtggccaacgggaccaagctgatggtcatcccgtacggcaccaacgtggagctggtgatgcagggcaccagcatcctcggcatcgagagccacccgctgcacctgcacggattcaacttcttcgtcgtcggccaaggctacggcaactacgacccggtgaacgacccgcccaagttcaacctcgtcgaccccgtcgagcgcaacaccgtcggcgtgccggccggcggctgggtggccatacgcttccttgccgacaaccccggggtatggttcatgcattgccatttggaggtgcacacaacatggggcctcaggatggcatggttggtgcttgacggcagcctcccgcaccagaagctgctcccgccgccgtccgatcttcccaaatgctga

SEQ ID NO: 17043 - protein, 579 aa, Sorghum bicolor
  misc_feature: Useful for making plants with altered carbohydrate content
  misc_feature: Functional homolog of the protein sequence given in SEQ ID NO 14467
  misc_feature: Useful for making plants with altered cell wall content and/or composition
  misc_feature: Functional homolog of the protein sequence given in SEQ ID NO 14217
  misc_feature: Useful for biocontainment applications
  misc_feature: Useful for making plants with modulated biomass
  misc_feature: Useful for making plants with modulated flowering time
  misc_feature: Useful for making plants with modulated low light sensitivity
  misc_feature: Functional homolog of the protein sequence given in SEQ ID NO 14204
  misc_feature: Ceres ANNOT ID no. 8669507
  misc_feature (23)..(579): SWISSPROT Homolog: EC 1.10.3.2 Laccase
  misc_feature (35)..(151): Pfam ID: Cu-oxidase_3 Pfam Description: Multicopper oxidase
  misc_feature (161)..(315): Pfam ID: Cu-oxidase Pfam Description: Multicopper oxidase
  misc_feature (429)..(563): Pfam ID: Cu-oxidase_2 Pfam Description: Multicopper oxidase
MAISSALPCSLLMAALMLLASAVEVQGITRHYDFNVTMANVTRLCASKSIITVNGQFPGPKIVAREGDRLVIRVTNHAQHNISLHWHGIRQLRTGWADGPAYITQCPIQTGQSYVYNYTIVGQRGTLWWHAHISWLRATVYGPLVVLPKLGVPYPFPAPYKEVPVIFGEWWLADTEVVIQQALQLGAGPNVSDAHTINGLPGPLYNCSAKDTFKLKVKPGKTYMLRLINAALNDELFFSIANHSLTVVEVDAVYVKPFTVDTLVIAPGQTTNVLLAAKPFYPAANYYMTARTYSTGRPATFDNTTVAGILEYEYPDAPSAAASFNKALPLYRPALPQLNDTSFVGNFTAKLLSLATPEYPAAVPQTVDKRFFFTVGLGTHPCPANTTCQGPTNTTQFAASVNNVSFVLPTKALLHSHFAGLSSGVYESDFPVAPLAPFNYTGTPPNNTNVANGTKLMVIPYGTNVELVMQGTSILGIESHPLHLHGFNFFVVGQGYGNYDPVNDPPKFNLVDPVERNTVGVPAGGWVAIRFLADNPGVWFMHCHLEVHTTWGLRMAWLVLDGSLPHQKLLPPPSDLPKC

SEQ ID NO: 17044 - DNA, 1740 bp, Sorghum bicolor
  misc_feature: Ceres ANNOT ID no. 8669515
  misc_feature: Encodes the peptide sequence at SEQ ID NO 17045
atgggctcgcgtcatggcctccggcgaggcggccaagccgctgccgtcttctccgcatgtcccttcctcgccttcgccgtcctcctcgccttgccgggcctcgcagccggcgacacccattactacacgttcaacgtgcaaatgacgaacgtgacacggctgtgcgtgaccaagagcatcccgacggtgaacgggcagttcccggggccgaagctggtcgtgcgggaaggcgaccgtctcgtggtcaaggttcacaaccacatcaactacaatgtctcgttccactggcacggcgtccggcagctgcgcaacgggtgggcggacgggccggcgtacatcacgcagtgcccgatccagggcgggcagagctacgtgtacgacttcaccatcacggggcagcgcgggacgctgtggtggcacgcgcacttctcctggctgcgcgtgcacctctacggcccgctcgtcatcctccccaagcgcggcgagggctacccgttcccgcgcccctacaaggaggtgcccatcctcttcggtgaatggttcaatgcggacaccgaggccgtcatcaaccaggccctgcaaactggcggcggcccaaacgtctccgatgcctacaccttcaatgggcttccaggcccgacatataactgctcctctaaagacacgtacaagctgaaggtaaagcccgggaggacgtacatgctccggctcatcaactccgcgctcaacgacgagctcttcttcggcatcgcaaaccacacgctcaccgtcgtcgaggcggacgccaactacgtcaagccattcaccgtgaacacgctcgtcatctcgccggggcagaccatgaacgtgctcctgacgacgcctccaaacccggcctccccggcctacgccatggcgatcgcgccctacaccaacacgcagggcacgttcgacaacaccaccgcggccgccgtcctcgagtacgccccgacgacgacgacgctgccgcccttgcccctgccggccctgccgctgtacaacgacaccggcgcggtgaccaacttctcgcgcaacttccgcagcctgaacagcgcgcagtacccggcgcaagtgccggcggcggtggaccggcacctgctcttcaccgtggggctcggcacggacccgtgcccgtccaaccagacgtgccagggccccaacggcaccaagttcgcggcgtccatcaacaacaactccttcttccggccccggaccgcgctcctcgaggcgcactaccagcgccgctacgccggcgtgctcctcgccgacttccccaccaccccgccgcaccccttcaactacacggggaccccgcccaacaacacgttcgtgcagcacggcacccgggtggtgccgctcaggttcaacacctccgtggagctggtgctgcagggcaccagcatccagggcgccgagagccacccgctgcacttgcacggctacgacttcttcgtcgtcggacaggggttcggcaacttcgacccggtgaacgacccgcccaactacaacctcgccgaccccgtggagcggaacaccatcagcgtgcccaccgccggctgggtcgccgtccgcttcctcgccgacaacccgggggtgtggctgatgcattgccacttcgacgtgcacctgagctggggcctgtccatggcgtggcttgtcaacgacggcccgctgccgaatcagaagatgttgcccccgccatccgatcttccaaaatgctga

SEQ ID NO: 17045 - protein, 579 aa, Sorghum bicolor
  misc_feature: Useful for making plants with altered carbohydrate content
  misc_feature: Functional homolog of the protein sequence given in SEQ ID NO 14467
  misc_feature: Useful for making plants with altered cell wall content and/or composition
  misc_feature: Functional homolog of the protein sequence given in SEQ ID NO 14468
  misc_feature: Useful for biocontainment applications
  misc_feature: Useful for making plants with modulated biomass
  misc_feature: Useful for making plants with modulated flowering time
  misc_feature: Useful for making plants with modulated low light sensitivity
  misc_feature: Functional homolog of the protein sequence given in SEQ ID NO 14204
  misc_feature: Ceres ANNOT ID no. 8669515
  misc_feature (39)..(579): SWISSPROT Homolog: EC 1.10.3.2 Laccase
  misc_feature (45)..(161): Pfam ID: Cu-oxidase_3 Pfam Description: Multicopper oxidase
  misc_feature (171)..(324): Pfam ID: Cu-oxidase Pfam Description: Multicopper oxidase
  misc_feature (429)..(563): Pfam ID: Cu-oxidase_2 Pfam Description: Multicopper oxidase
MGSRHGLRRGGQAAAVFSACPFLAFAVLLALPGLAAGDTHYYTFNVQMTNVTRLCVTKSIPTVNGQFPGPKLVVREGDRLVVKVHNHINYNVSFHWHGVRQLRNGWADGPAYITQCPIQGGQSYVYDFTITGQRGTLWWHAHFSWLRVHLYGPLVILPKRGEGYPFPRPYKEVPILFGEWFNADTEAVINQALQTGGGPNVSDAYTFNGLPGPTYNCSSKDTYKLKVKPGRTYMLRLINSALNDELFFGIANHTLTVVEADANYVKPFTVNTLVISPGQTMNVLLTTPPNPASPAYAMAIAPYTNTQGTFDNTTAAAVLEYAPTTTTLPPLPLPALPLYNDTGAVTNFSRNFRSLNSAQYPAQVPAAVDRHLLFTVGLGTDPCPSNQTCQGPNGTKFAASINNNSFFRPRTALLEAHYQRRYAGVLLADFPTTPPHPFNYTGTPPNNTFVQHGTRVVPLRFNTSVELVLQGTSIQGAESHPLHLHGYDFFVVGQGFGNFDPVNDPPNYNLADPVERNTISVPTAGWVAVRFLADNPGVWLMHCHFDVHLSWGLSMAWLVNDGPLPNQKMLPPPSDLPKC

SEQ ID NO: 17046 - DNA, 825 bp, Sorghum bicolor
  misc_feature: Ceres ANNOT ID no. 8669523
  misc_feature: Encodes the peptide sequence at SEQ ID NO 17047
atgttatcccctcgcggcggccggccccacgaccccacggcgcgctccgccctgccctcatcctcgtcaacccgccacacggacatggaagacgacgacgacgccggcgccggcgccggcgcgtgcggccgcgtgctcgagtgggagcacggcctgcccacggaggaggagctgacgccgctctcgcacccgctcgtccctccggcgctcgccgccgcgttccggatcgacgtcaggggcaccggcaccgccttcccctcctcccccgccttcgactgccccgtcgtcttcgcgcacaactcccccacctctcacctgtccttccgctgcgaggacgaggacgaggacgaggacgatgagggggagggggagagggaggaggagggggaggacgccacctccggaatcggcggctcgtgcggaggcgggagggccgggaagaaggcgcggatggtgtggacgccggagctgcaccaccggttcgtcgaggcggtggcgcacctcggcgacaagggtgccgtacccaaggccatcgtgcgcctcatgaacgtcgagggcctcacccgcgagaacgtcgccagccacctccagaagtaccgcatctacctcaagcgcacgcgcagccccggaaagccgcagcagcctcctccggccttcccgccggagtacggctcccacttcaggacccaacagctctctgacacctccagccggagcgattacagcgcgttctccacttctgccgccacagcgagaagctcgaacgcgacaaagcactccaggctgtgggatgaaaacgggccagacaagcgtaacacattctga

SEQ ID NO: 17047 - protein, 274 aa, Sorghum bicolor
  misc_feature: The sequence is a functional homolog of SEQ ID NO 1999 in the 11/479,226 US patent application
  misc_feature: The sequence is a functional homolog of SEQ ID NO 2000 in the 11/479,226 US patent application
  misc_feature: The sequence is a functional homolog of SEQ ID NO 1995 in the 11/479,226 US patent application
  misc_feature: The sequence is a functional homolog of SEQ ID NO 1996 in the 11/479,226 US patent application
  misc_feature: The sequence is a functional homolog of SEQ ID NO 1997 in the 11/479,226 US patent application
  misc_feature: The sequence is a functional homolog of SEQ ID NO 1998 in the 11/479,226 US patent application
  misc_feature: The sequence is a functional homolog of SEQ ID NO 2001 in the 11/479,226 US patent application
  misc_feature: Ceres ANNOT ID no. 8669523
  misc_feature (150)..(200): Pfam ID: Myb_DNA-binding Pfam Description: Myb-like DNA-binding domain
MLSPRGGRPHDPTARSALPSSSSTRHTDMEDDDDAGAGAGACGRVLEWEHGLPTEEELTPLSHPLVPPALAAAFRIDVRGTGTAFPSSPAFDCPVVFAHNSPTSHLSFRCEDEDEDEDDEGEGEREEEGEDATSGIGGSCGGGRAGKKARMVWTPELHHRFVEAVAHLGDKGAVPKAIVRLMNVEGLTRENVASHLQKYRIYLKRTRSPGKPQQPPPAFPPEYGSHFRTQQLSDTSSRSDYSAFSTSAATARSSNATKHSRLWDENGPDKRNTF

SEQ ID NO: 17048 - DNA, 1698 bp, Sorghum bicolor
  misc_feature: Ceres ANNOT ID no. 8669581
  misc_feature: Encodes the peptide sequence at SEQ ID NO 17049
atgccgcgctcttggatgatcctactgttagctgtgtgttctgctgcagcccttgctcaagctgctactgtggagcataccttcaatgtggctacattatcctggccgtgcatctgccaaccggggaatataagcatcaccgccgtggacggagtacccggtcccgtgatccaagccaacgaaggtgacaccgtggtggtccacgtcatcaacgactctccacacgacatcacagtccactggcacggcgtcttccagcgaggcacgccgtgggcggacggcccgtcgatggtgacgcagtgccccatctgcccgggccaccgctacacgtacaggttcaacatcaccgggcaggagggcacgctgtggtggcacgcgcacagctccttcctccgcgccaccgtgtacggcgccctcatcatccgcccgaggagcggcaactcctaccccttcccggcgccggccgaggagaagaccgtccttcttggcgagtggtggaacgccgagaccgtcgctgccaacgcatcagtcgccgacgcgtacaccatcaatggaaggcccggggattcctacagctgcgagacggcggcgaagcgaatcgaaaagttcgaggtgcgtggcaactccacctacttgctgcggatcatcaacgccgcgctcaacacggcgttcttcttcagggtggccgggcacacgttcaccgtcgtcgcggcggacgccagctacaccacgcggtacgagacggacgtgatcgtcgtcgcgccggggcagaccgtcgacgcgctcatggcggccgacgcgtcccccggccgctactacatggcaatctcctcgtaccagagcgcggttcccctgcgcccagggagttacaacagcaacatcaccacggccgtcgtggagtacatcggagcggcgtcgggcgggaagcagcagcaggcgctgcccgagatgccggagcagaacgacacggccacggccaaccggttctacaccagcttgacggcgctcgtccgcccaggcaggcggaccgtcccgctcgccgtcgacacccgcatgttcgtcacggtcgggctcggtttctcctcctgtgaccaggcttcgtgcccggttgtcgcgagcatgaacaaccagtctttcaagctcccagacccagaggccatgtcgatgctcgacgcgcggtaccggaacacgccgggcggcgtgtacacaagggacttccccgaccagccacccgtggcattcgactacacgaacgagacgaaccggttgctgctgggcggcgtcgccgcggcgctgctgttccccggggaggcgtcgacgaaggtgaggacgctggcgtacaacgcaacggtggagatggtgctgcagaacacggcgctggtggggcgcgagagccacccgatgcacctgcacgggttcaacttcttcgtgctcgcgcaggggttcggcaactacgacgacggcggaacggccggggagcgtcagttcaacctcgtgaacccgcaggagcggaacaccatcgcggtgccgaccggcgggtgggccgtgatccgcttcgtcgctgataacccaggaatgtggttcatgcactgccacatcgacgctcaccttacgatcggcctggcgatggtgttcgaggtggaggacgggcccagcacaaagttgcctgcgccgccgccggacctcccgcagtgctga

SEQ ID NO: 17049 - protein, 565 aa, Sorghum bicolor
  misc_feature: Useful for making plants with altered cell wall content and/or composition
  misc_feature: Functional homolog of the protein sequence given in SEQ ID NO 14469
  misc_feature: Ceres ANNOT ID no. 8669581
  misc_feature (1)..(565): SWISSPROT Homolog: EC 1.10.3.2 Laccase
  misc_feature (38)..(146): Pfam ID: Cu-oxidase_3 Pfam Description: Multicopper oxidase
  misc_feature (405)..(551): Pfam ID: Cu-oxidase_2 Pfam Description: Multicopper oxidase
  misc_feature (156)..(304): Pfam ID: Cu-oxidase Pfam Description: Multicopper oxidase
MPRSWMILLLAVCSAAALAQAATVEHTFNVATLSWPCICQPGNISITAVDGVPGPVIQANEGDTVVVHVINDSPHDITVHWHGVFQRGTPWADGPSMVTQCPICPGHRYTYRFNITGQEGTLWWHAHSSFLRATVYGALIIRPRSGNSYPFPAPAEEKTVLLGEWWNAETVAANASVADAYTINGRPGDSYSCETAAKRIEKFEVRGNSTYLLRIINAALNTAFFFRVAGHTFTVVAADASYTTRYETDVIVVAPGQTVDALMAADASPGRYYMAISSYQSAVPLRPGSYNSNITTAVVEYIGAASGGKQQQALPEMPEQNDTATANRFYTSLTALVRPGRRTVPLAVDTRMFVTVGLGFSSCDQASCPVVASMNNQSFKLPDPEAMSMLDARYRNTPGGVYTRDFPDQPPVAFDYTNETNRLLLGGVAAALLFPGEASTKVRTLAYNATVEMVLQNTALVGRESHPMHLHGFNFFVLAQGFGNYDDGGTAGERQFNLVNPQERNTIAVPTGGWAVIRFVADNPGMWFMHCHIDAHLTIGLAMVFEVEDGPSTKLPAPPPDLPQC

SEQ ID NO: 17050 - DNA, 477 bp, Sorghum bicolor
  misc_feature: Ceres ANNOT ID no. 8669564
  misc_feature: Encodes the peptide sequence at SEQ ID NO 17051
atgcacaagtgcgtttttctcttttatctgaggcagatagaggggaagactgtcaaggcacagatatgggacacggctgggcaggagaggtaccgcgatatcactagcccttacgtctacagggacgcagttggagcgcttctagtctacgacatcacaaagaagcaaaccttcgacaatgttcagagatggctccaagagctccgggatcacgcagacgcaaacatcgtcgttacgatggttggtgacaagtcggatctgaaccacctatggtcgagaaggaagggcctgtccttcctcgagacatctgctctggaggcgataaacgtcgagaaggcgttccacgccgtctcaagcgagattcatcagacggtgagcaagaaggcgctcaccgcgcaggagtctgcatccagcaatgggcgctcgatttttttagataatagatataaaatccggccactgatgtatcaccattaa

SEQ ID NO: 17051 - protein, 158 aa, Sorghum bicolor
  misc_feature: Useful for making plants with altered lignin content
  misc_feature: Functional homolog of the protein sequence given in SEQ ID NO 14470
  misc_feature: Useful for making plants with altered alkaloid content
  misc_feature: Functional homolog of the protein sequence given in SEQ ID NO 13220
  misc_feature: Useful for making plants with altered terpenoid content
  misc_feature: Functional homolog of the protein sequence given in SEQ ID NO 13157
  misc_feature: Ceres ANNOT ID no. 8669564
  misc_feature (3)..(123): Pfam ID: Ras Pfam Description: Ras family
MHKCVFLFYLRQIEGKTVKAQIWDTAGQERYRDITSPYVYRDAVGALLVYDITKKQTFDNVQRWLQELRDHADANIVVTMVGDKSDLNHLWSRRKGLSFLETSALEAINVEKAFHAVSSEIHQTVSKKALTAQESASSNGRSIFLDNRYKIRPLMYHH

SEQ ID NO: 17052 - DNA, 1674 bp, Sorghum bicolor
  misc_feature: Ceres ANNOT ID no. 8669583
  misc_feature: Encodes the peptide sequence at SEQ ID NO 17053
atggcgcgggcagccaagctgctggcgctgctcattgcggcgttgtgcacggcggcgacgatggcgaacgcggcggtcgtggagcacaccttcaatgtgggcggcatgagcatctcgcagctgtgcatgaacagcgtgatatacacggtgaaccagcagatgccgggaccgaccatcgaggttaacgaaggcgacactctcgtcgtccacgtcgtcaacgggtcgccgtacccagtgtcggtccattggcacggcatctttcagctgcggagcgggtgggcggacggcgccaacatgatcacgcagtgcccgatacagccttccgccaagttcacctacgcgttcaacatcaccgggcaggagggcacgctgtggtggcacgcgcacgcctccatgctccgggccaccatctacggcgcgctcatcatcaagcccaggaacggccccaggggctacccgttccccaagccctacgccgagatccccatcctgctaggcgagtggtggaacaaaaatgtggacgacgtggagaaggatgggctcttgaccggccttggcccggcgatgtccgacgccttcaccatcaacggcttcacgggcgagcagccgtcttgcagaggcgccggcgcgtaccaagtggaggtggagtccggcaagacgtacctgctccgcatcatcaacgccgcggtcgattccgagctgttcttcaaggtggccggccacgccttcaccgtggtggccgccgacgccagctacaccaacccttaccccaccgacgtgatcgtcatcgcgccgggccagaccgtggacgcgctcatgaccgcctccgccgcgccggggcgctacctcatggcggcgcacgcgttcgagagcaagaccgcggccaacccgccgccgttcgacaacaccacggccacggccgtcgtcaggtacaagggcgtgcccgactacgcccccgccgccatgccggcgctgccggcgcacaccgacgtcgtcaccgccggcaggttctactggtccatgacgggactcgtccggcggggcgatcccgtcgtgccgaggaacgtcgaccacagcatggtcgtcgcgttcgggctcgaccaggtgccgtgcgctccggagcagaccaagtgccaggggttcgcggtcgtcgcgtccatgaacaggtactccttccggttcccggacaaggtgtcgctcctcgaggcgttcttcaggggcgtccccaacgtgtactctgaggacttcccgggcgcgccgccgccggtgccggcgcccaggaaggtcacgtcggtgaggaaggtgaacttcaacgacgtcgtcgaggtggtgctgcagagccaagagtacagcagcgccctcggcaccgagaaccacccgatccacctgcacgggttcaacttcttcgtgctggcgcaggggctcgggcgattcgacgcttccatgaagagcaagtacaatctcgtgaacccgcaggtgcgcaacaccatagccgtgccggccggcggctgggcagtcatccgtttcacggcggacaatccaggtatgtggttcatgcactgtcacttcgacatgcacctgccgttggggctggcaatggtcttcgaggtgctcgatggtccggcgccgaatctgcttcctccacctcccgcgggctttcccaagtgtcactga

SEQ ID NO: 17053 - protein, 557 aa, Sorghum bicolor
  misc_feature: Useful for making plants with altered cell wall content and/or composition
  misc_feature: Functional homolog of the protein sequence given in SEQ ID NO 14469
  misc_feature: Ceres ANNOT ID no. 8669583
  misc_feature (26)..(557): SWISSPROT Homolog: EC 1.10.3.2 Laccase
  misc_feature (32)..(148): Pfam ID: Cu-oxidase_3 Pfam Description: Multicopper oxidase
  misc_feature (159)..(314): Pfam ID: Cu-oxidase Pfam Description: Multicopper oxidase
  misc_feature (393)..(541): Pfam ID: Cu-oxidase_2 Pfam Description: Multicopper oxidase
MARAAKLLALLIAALCTAATMANAAVVEHTFNVGGMSISQLCMNSVIYTVNQQMPGPTIEVNEGDTLVVHVVNGSPYPVSVHWHGIFQLRSGWADGANMITQCPIQPSAKFTYAFNITGQEGTLWWHAHASMLRATIYGALIIKPRNGPRGYPFPKPYAEIPILLGEWWNKNVDDVEKDGLLTGLGPAMSDAFTINGFTGEQPSCRGAGAYQVEVESGKTYLLRIINAAVDSELFFKVAGHAFTVVAADASYTNPYPTDVIVIAPGQTVDALMTASAAPGRYLMAAHAFESKTAANPPPFDNTTATAVVRYKGVPDYAPAAMPALPAHTDVVTAGRFYWSMTGLVRRGDPVVPRNVDHSMVVAFGLDQVPCAPEQTKCQGFAVVASMNRYSFRFPDKVSLLEAFFRGVPNVYSEDFPGAPPPVPAPRKVTSVRKVNFNDVVEVVLQSQEYSSALGTENHPIHLHGFNFFVLAQGLGRFDASMKSKYNLVNPQVRNTIAVPAGGWAVIRFTADNPGMWFMHCHFDMHLPLGLAMVFEVLDGPAPNLLPPPPAGFPKCH

SEQ ID NO: 17054 - DNA, 876 bp, Sorghum bicolor
  misc_feature: Ceres ANNOT ID no. 8669612
  misc_feature: Encodes the peptide sequence at SEQ ID NO 17055
atggcggaggcagcgtggacgccggtgctgtttccgccgacggtgccctgtttctggcagcctgacacgcacccggttttttggcggagaggagacgcgtggacggcggaggagaacaagaagttcgagaaggcgctggcgctgatcgaccggaacgcgcccgaccggtgggagaaggtggcggagctgctgcccaggaagacggccgacgacgtgaggaaccactaccacgacctcgagaacgacgtcggctacatcgaggccgggctcgtgccgttcccgcactacagcagctcggtcccgtcgtccgggttcaccctcgaggactgggacgcgtacggcggcggcggcggcgggttcaggcgcggcggctactgcctcaagcgctcgcgcgggtcggaccaggagcggaagaagggtgtcccctggacggaggaggagcacaagcttttcttgatgggactgaagaagtacgggagaggggactggcggaacatctcgcgcaagtacgtgacgacccggacgccgacgcaggtggccagccacgcgcagaagtacttcatccggctcaactctggcggcaaggacaagcgccggtccagcatccacgacatcaccaccgtgaacctccccgacgaagaccgcggcaacgccacgccgccctcgccgccgtccgcggtcaccgccgccaacccctccgtcgccgccctggtggacgtgaagcccttcatggcgccgctcccagctggcgcgctcggcggcgtgacgcacccctacgtcaacgtgaagctggagcccaagagctcgctcgtggccggcctcggcctgggcttcgacgactccgtcttcctgcagatgcattgcgggcagttgtga

SEQ ID NO: 17055 - protein, 291 aa, Sorghum bicolor
  misc_feature: The sequence is a functional homolog of SEQ ID NO 120 in the 11/375,241 US patent application
  misc_feature: The sequence is a functional homolog of SEQ ID NO 2680 in the 10/374,780 US patent application
  misc_feature: The sequence is a functional homolog of SEQ ID NO 654 in the 10/225,066 US patent application
  misc_feature: The sequence is a functional homolog of SEQ ID NO 1897 in the 11/479,226 US patent application
  misc_feature: The sequence is a functional homolog of SEQ ID NO 22 in the 10/225,066 US patent application
  misc_feature: The sequence is a functional homolog of SEQ ID NO 2870 in the 10/374,780 US patent application
  misc_feature: The sequence is a functional homolog of SEQ ID NO 886 in the 11/435,388 US patent application
  misc_feature: The sequence is a functional homolog of SEQ ID NO 1000 in the 10/225,066 US patent application
  misc_feature: The sequence is a functional homolog of SEQ ID NO 1885 in the 11/479,226 US patent application
  misc_feature: The sequence is a functional homolog of SEQ ID NO 274 in the 10/714,887 US patent application
  misc_feature: The sequence is a functional homolog of SEQ ID NO 274 in the 11/435,388 US patent application
  misc_feature: The sequence is a functional homolog of SEQ ID NO 306 in the 10/374,780 US patent application
  misc_feature: The sequence is a functional homolog of SEQ ID NO 50 in the 10/286,264 US patent application
  misc_feature: The sequence is a functional homolog of SEQ ID NO 928 in the 10/412,699 US patent application
  misc_feature: The sequence is a functional homolog of SEQ ID NO 1930 in the 10/412,699 US patent application
  misc_feature: The sequence is a functional homolog of SEQ ID NO 246 in the 10/714,887 US patent application
  misc_feature: The sequence is a functional homolog of SEQ ID NO 246 in the 11/435,388 US patent application
  misc_feature: The sequence is a functional homolog of SEQ ID NO 452 in the 10/374,780 US patent application
  misc_feature: The sequence is a functional homolog of SEQ ID NO 88 in the 10/225,068 US patent application
  misc_feature: The sequence is a functional homolog of SEQ ID NO 984 in the 10/225,066 US patent application
  misc_feature: Useful for making plants with altered alkaloid content
  misc_feature: Functional homolog of the protein sequence given in SEQ ID NO 13278
  misc_feature: The sequence is a functional homolog of SEQ ID NO 36 in the 10/286,264 US patent application
  misc_feature: The sequence is a functional homolog of SEQ ID NO 864 in the 10/412,699 US patent application
  misc_feature: The sequence is a functional homolog of SEQ ID NO 1893 in the 11/479,226 US patent application
  misc_feature: The sequence is a functional homolog of SEQ ID NO 2678 in the 10/374,780 US patent application
  misc_feature: The sequence is a functional homolog of SEQ ID NO 340 in the 10/225,066 US patent application
  misc_feature: Ceres ANNOT ID no. 8669612
  misc_feature (140)..(187): Pfam ID: Myb_DNA-binding Pfam Description: Myb-like DNA-binding domain
  misc_feature (31)..(80): Pfam ID: Myb_DNA-binding Pfam Description: Myb-like DNA-binding domain
MAEAAWTPVLFPPTVPCFWQPDTHPVFWRRGDAWTAEENKKFEKALALIDRNAPDRWEKVAELLPRKTADDVRNHYHDLENDVGYIEAGLVPFPHYSSSVPSSGFTLEDWDAYGGGGGGFRRGGYCLKRSRGSDQERKKGVPWTEEEHKLFLMGLKKYGRGDWRNISRKYVTTRTPTQVASHAQKYFIRLNSGGKDKRRSSIHDITTVNLPDEDRGNATPPSPPSAVTAANPSVAALVDVKPFMAPLPAGALGGVTHPYVNVKLEPKSSLVAGLGLGFDDSVFLQMHCGQL

SEQ ID NO: 17056 - DNA, 1281 bp, Sorghum bicolor
  misc_feature: Ceres ANNOT ID no. 8669625
  misc_feature: Encodes the peptide sequence at SEQ ID NO 17057
atgcggcaccaccaagcctgcagccgcgctcaccaggtgggcgctctgctcctcgtcgctgccaccttcctcctcacccgcctcttcgaccgcctcctcctcgacacatcttcctccgccgccataaaccccggcaggccctcctctcccgctgacctccgcatctacgtctacgctgaggacgagatccagggccttcgcgctctgctccggggacgcgacggcaccatcaccgccgccacatgcctcaagggccaatggggcacccaggtcaagatccaccagtttcttctaaagtcaaggttcaggacattcaacaaggatcaagcaaatctcttctttgttccaagctatgtcaagtgtgttcgcatgacaggggcactaagtgacaaggaaatcaatcagacctatgtcaaggttctgagtcagatgccatatttccgtagatcaggtgggcgtgaccacatttttgtcttcccaagtggtgcaggagctcatctgtttcgctcgtgggcaacatttctgaatcgatctattatccttactccagagggcgaccggactgataaacgcggtacgagtgcatttaatacatggaaagatattattatacctgggaacgtggatgattctatggtgaagtctgatgctcgtgctgtccaaccaatcccactaacaaaaaggaagtacttggccaacttccttggacgtgcccaggggaaagcagggcgccttcaactggtagagcttgcaaagcagtatcctgacaagctggaatctcctgtactcaagttatctggccccaacaaattgggaaggatcgagtacttcaagcacctgagaaatgcaaagttctgcttggctccacgtggagagtcatcttggacacttcggttctatgagtccttctttgtggaatgtgtgccggtgattttgtcagatgaagttgagcttcctttccagaatgtgatcgactacggtgaaatctcgataaagtggccatcgtccaggattggacctgaactccttgagtaccttgaatcaatatcagatgaaaggatcgaggaaatgattggtcatgggcgtcagatgagatgcttgtgggtgtatgcagctgatactgagccgtgctctgccatgagcggtatcctgacagagctgcagaagaaagttcggcggttccatcaatcgcctgaaacgttctggctgcacaacagatcgattgtgaatagggatctgattgagttccacagctggaggacgcctgttccgttgccatga

SEQ ID NO: 17057 - protein, 426 aa, Sorghum bicolor
  misc_feature: Useful for making plants with altered cell wall content and/or composition
  misc_feature: Functional homolog of the protein sequence given in SEQ ID NO 13749
  misc_feature: Useful for making plants with altered carbohydrate content
  misc_feature: Functional homolog of the protein sequence given in SEQ ID NO 13750
  misc_feature: Ceres ANNOT ID no. 8669625
  misc_feature (267)..(402): SWISSPROT Homolog: EC 2.4.1.224 Glucuronosyl-N-acetylglucosaminyl-proteoglycan 4-alpha-N-acetylglucosaminyltransferase
  misc_feature (55)..(361): Pfam ID: Exostosin Pfam Description: Exostosin family
MRHHQACSRAHQVGALLLVAATFLLTRLFDRLLLDTSSSAAINPGRPSSPADLRIYVYAEDEIQGLRALLRGRDGTITAATCLKGQWGTQVKIHQFLLKSRFRTFNKDQANLFFVPSYVKCVRMTGALSDKEINQTYVKVLSQMPYFRRSGGRDHIFVFPSGAGAHLFRSWATFLNRSIILTPEGDRTDKRGTSAFNTWKDIIIPGNVDDSMVKSDARAVQPIPLTKRKYLANFLGRAQGKAGRLQLVELAKQYPDKLESPVLKLSGPNKLGRIEYFKHLRNAKFCLAPRGESSWTLRFYESFFVECVPVILSDEVELPFQNVIDYGEISIKWPSSRIGPELLEYLESISDERIEEMIGHGRQMRCLWVYAADTEPCSAMSGILTELQKKVRRFHQSPETFWLHNRSIVNRDLIEFHSWRTPVPLP

SEQ ID NO: 17058 - DNA, 1890 bp, Sorghum bicolor
  misc_feature: Ceres ANNOT ID no. 8669628
  misc_feature: Encodes the peptide sequence at SEQ ID NO 17059
atgaccggcggcgtacggaagaggacggggttcagtaagctgctggtggtcttgctgttctttgtgtgcgccatcgtcatcgtggcgctgcttgtccgcggcaacggctgctgcgtcgtcgtccaagtggcagtactgccacggataacttcagttggatcctcttgggatgcttctcctactgctacaactcaaagtggcaaaaccatcatccctgcaacgtctacgaggggagcatcatcaccagctcatgatcttcaggaggactcagaggcagtatcagcctcggaggaagaggaggcccctgcagctgcagctgccccgtacgcggcagacagcaggtggaacatccagtgggagagcgtcgccagtgtcctttcatcattcagcagtaatggcactgggcggcgtggcatcgccagagtgggcttgctcaacttcaactcgtcggaggttgctcgctggacgagcacgttgcctgccgccgacgttcgggcggtgagcctggcgccggccgcggacgctgtcacctggcaagccctctacccgaactggatcgacgaggagagcaacagaagcagctgccccaccctccccaatccggatgccgcccctcatcatcacaattttgacctcgtcgccgtcaagcttccctgccgcggacaagactggtccagggacgtgcgcaggctccacctccagctcgccgccgccaagctcactctccatggcagcagcagcagcagcagtaaggctggcatggtgttgatcctgagcgagtcagggtgtctccccctgcccaacctcttcccctgcaagcacctcttcgcgcgccgcggccacgcctttctctaccgccccgaggccacctacctccgccaccgcctcaacctgcccgtcgggtcctgccagctcgccgttccttttctccggccttcgcctactaaactaccaagtgcaacgccgccaggtacaagcaggaccagcaggcaggcctacgccaccgtgctgcactccgccgacgcctacgtctgcggcgccatcgcgctggcgcagagcatccggcagtcagggtccacgcgcgacctggtggccctggtggacgcgcacaatgtgggcgccgagcaccgcgccgccctcgccgcggcaggctggcaagtccgcctagcgccgcgcatccgcaacccgcacgcggaggccaacgcctataacgagtggaactacagcaagttccggctgtggcagctgaccgactacgagaaggtggtgttcctggacgccgacctgctggtgctgcgcaacatggacttcctgttcgaggaggcgccggagctgagcgcgacggtcaacagcggcgcgcgcttcaactcgggggtgatggtgctggaaccgtgcagctgcaccttcgacctgctcatgtcgggcatccacgacatcgaatcctacaacggcggcgaccaggggtacctgaacgaggttttcacgtggtggcaccgcctgccgcgccacgtcaacttcctcaagtacgtctgggccgaaggggaccgggcggcacaggcgcggatgcttaccgcggagccggcggaggtgcacgccgtgcactacctgggcatgaagccgtggctgtgctatcgtgactacgactgcaactggaacgtggcggagctccggcggttcgcgagcgacgaggcgcacgcgcggtggtgggcggtgcacgaccggatagagcccgcggaactgagggacaggttttgcgcgctgccgacgagccacatggaggtgctggagcagcaaaggagggaggcggcgacggtcaacgcgccagacggccactggaaccgcaccatcaccgacccgcgccgccgcatcaaagcccattaccaccactag

SEQ ID NO: 17059 - protein, 629 aa, Sorghum bicolor
  misc_feature: Useful for making plants with altered carbohydrate content
  misc_feature: Functional homolog of the protein sequence given in SEQ ID NO 13653
  misc_feature: Useful for making plants with altered cell wall content and/or composition
  misc_feature: Functional homolog of the protein sequence given in SEQ ID NO 13752
  misc_feature: Ceres ANNOT ID no. 8669628
  misc_feature (304)..(572): SWISSPROT Homolog: EC 2.4.1.186 Glycogenin glucosyltransferase
  misc_feature (334)..(545): Pfam ID: Glyco_transf_8 Pfam Description: Glycosyl transferase family 8
MTGGVRKRTGFSKLLVVLLFFVCAIVIVALLVRGNGCCVVVQVAVLPRITSVGSSWDASPTATTQSGKTIIPATSTRGASSPAHDLQEDSEAVSASEEEEAPAAAAAPYAADSRWNIQWESVASVLSSFSSNGTGRRGIARVGLLNFNSSEVARWTSTLPAADVRAVSLAPAADAVTWQALYPNWIDEESNRSSCPTLPNPDAAPHHHNFDLVAVKLPCRGQDWSRDVRRLHLQLAAAKLTLHGSSSSSSKAGMVLILSESGCLPLPNLFPCKHLFARRGHAFLYRPEATYLRHRLNLPVGSCQLAVPFLRPSPTKLPSATPPGTSRTSRQAYATVLHSADAYVCGAIALAQSIRQSGSTRDLVALVDAHNVGAEHRAALAAAGWQVRLAPRIRNPHAEANAYNEWNYSKFRLWQLTDYEKVVFLDADLLVLRNMDFLFEEAPELSATVNSGARFNSGVMVLEPCSCTFDLLMSGIHDIESYNGGDQGYLNEVFTWWHRLPRHVNFLKYVWAEGDRAAQARMLTAEPAEVHAVHYLGMKPWLCYRDYDCNWNVAELRRFASDEAHARWWAVHDRIEPAELRDRFCALPTSHMEVLEQQRREAATVNAPDGHWNRTITDPRRRIKAHYHH

SEQ ID NO: 17060 - DNA, 1551 bp, Sorghum bicolor
  misc_feature: Ceres ANNOT ID no. 8669685
  misc_feature: Encodes the peptide sequence at SEQ ID NO 17061
atggtgcacggcgaggagagttcttggaggatggagagggcagcgctgcctctcaaccaggcgttcgcgtatggagcccaagcccacgccgccgccgcaccgccgacctgcttcctggacttccagcctgcggcggcagccgctgcctacttcgggttcggggagctggaggaggccctcatccatggcggcggcggcgctggcaacgcccacggcgtcgatcccggcgtgatcatcaagaacgacgtcgcgcaggcaaagtcggcggcagcggcaggatatctcgcgggcgctggcaggccccccacgctggagatcttcccttcgtggcctgaggggaattcgcagtcagtagggagcaccactgactcgagctcagctcagaacacaatgtctcagatggagttggtgtccccagcctcctctgcgccgaggcaggaggtcatgatggtgaccactgatgattacagctacaagccaggcctcgccgctgcgcccgctgctgctgccgccccgccaccgagctttcagcagcaccacccgctcccgctgcagctgcacggaggagacggaggaggaggagggggagaccatgacaagaggaagcatggatccacaagaaaagatggcaagttggtagatgccaagacggaacggcggctggcgcagaacagagaggctgcgaggaagagcaggctgaggaagaagcagctcgagactagcaggatcaggcttcagcaggtcgagcatgagctccagagagcacggtcacagggcctgttcgttggagggtgcagcgccgccggggacatgagctctggcgccgccatgttcgacatggagtacgcgcggtggctggacgacgacagcaagcggctggcggagctccgagctgggctgcaggcgcagctgctggacggcaacctggggctcatcgtggaggagtgcatgcagcactacgacgagctgttccagctcaaggcggcgctcgcgcgctccgatgtcttccacctcctcaccggcgcctgggccaccgccgccgagcgctgcttcttctggatgggcggcttccgcccgtctgagctgctcaagctggacccgctgacggagcagcagctgctggggatctgcaacctgcagcagtcgtcggagcaggcggaggaggcgctcgcccagggcctgcaccagctgcaccagtccctggccgacacagtcgccaccggcacgctcaacgacggcgccgccacccccaactacatgaacatcatggccgtcgcaattgataagctcgcctgcctagaaaacttctatcaacaggccgacaatctaaggcagcagacgttgcatcagatgcgccggatcctgaccactcggcaggctgcacggtgcttcctctccattggggagtactacagccgcctcagagctctcagcaacctctgggcttcccgtccccgcgacaacttcatcgggacagagagcctcagccccacagcaacggaactgcaagccctgcaccaccagcagcagaaccagttcactggattttga

SEQ ID NO: 17061 - protein, 516 aa, Sorghum bicolor
  misc_feature: Useful for making plants with modulated biomass
  misc_feature: Functional homolog of the protein sequence given in SEQ ID NO 13416
  misc_feature: The sequence is a functional homolog of SEQ ID NO 1498 in the 10/374,780 US patent application
  misc_feature: The sequence is a functional homolog of SEQ ID NO 1568 in the 10/412,699 US patent application
  misc_feature: The sequence is a functional homolog of SEQ ID NO 242 in the 10/374,780 US patent application
  misc_feature: The sequence is a functional homolog of SEQ ID NO 764 in the 10/412,699 US patent application
  misc_feature: The sequence is a functional homolog of SEQ ID NO 826 in the 10/225,066 US patent application
  misc_feature: The sequence is a functional homolog of SEQ ID NO 950 in the 11/435,388 US patent application
  misc_feature: The sequence is a functional homolog of SEQ ID NO 96 in the 11/375,241 US patent application
  misc_feature: The sequence is a functional homolog of SEQ ID NO 1492 in the 10/374,780 US patent application
  misc_feature: The sequence is a functional homolog of SEQ ID NO 1562 in the 10/412,699 US patent application
  misc_feature: The sequence is a functional homolog of SEQ ID NO 1496 in the 10/374,780 US patent application
  misc_feature: The sequence is a functional homolog of SEQ ID NO 1566 in the 10/412,699 US patent application
  misc_feature: The sequence is a functional homolog of SEQ ID NO 1792 in the 10/412,699 US patent application
  misc_feature: The sequence is a functional homolog of SEQ ID NO 2030 in the 10/374,780 US patent application
  misc_feature: The sequence is a functional homolog of SEQ ID NO 206 in the 10/225,068 US patent application
  misc_feature: The sequence is a functional homolog of SEQ ID NO 356 in the 10/412,699 US patent application
  misc_feature: The sequence is a functional homolog of SEQ ID NO 831 in the 11/479,226 US patent application
  misc_feature: The sequence is a functional homolog of SEQ ID NO 934 in the 11/435,388 US patent application
  misc_feature: The sequence is a functional homolog of SEQ ID NO 114 in the 10/666,642 US patent application
  misc_feature: The sequence is a functional homolog of SEQ ID NO 2362 in the 10/374,780 US patent application
  misc_feature: The sequence is a functional homolog of SEQ ID NO 376 in the 10/412,699 US patent application
  misc_feature: The sequence is a functional homolog of SEQ ID NO 608 in the 10/225,066 US patent application
  misc_feature: The sequence is a functional homolog of SEQ ID NO 848 in the 11/435,388 US patent application
  misc_feature: The sequence is a functional homolog of SEQ ID NO 871 in the 11/479,226 US patent application
  misc_feature: The sequence is a functional homolog of SEQ ID NO 1794 in the 10/412,699 US patent application
  misc_feature: The sequence is a functional homolog of SEQ ID NO 2032 in the 10/374,780 US patent application
  misc_feature: The sequence is a functional homolog of SEQ ID NO 380 in the 10/412,699 US patent application
  misc_feature: The sequence is a functional homolog of SEQ ID NO 534 in the 10/225,066 US patent application
  misc_feature: The sequence is a functional homolog of SEQ ID NO 936 in the 11/435,388 US patent application
  misc_feature: The sequence is a functional homolog of SEQ ID NO 1878 in the 10/412,699 US patent application
  misc_feature: The sequence is a functional homolog of SEQ ID NO 2138 in the 10/374,780 US patent application
  misc_feature: The sequence is a functional homolog of SEQ ID NO 372 in the 10/225,066 US patent application
  misc_feature: The sequence is a functional homolog of SEQ ID NO 878 in the 11/435,388 US patent application
  misc_feature: The sequence is a functional homolog of SEQ ID NO 1788 in the 10/412,699 US patent application
  misc_feature: The sequence is a functional homolog of SEQ ID NO 2026 in the 10/374,780 US patent application
  misc_feature: The sequence is a functional homolog of SEQ ID NO 354 in the 10/412,699 US patent application
  misc_feature: The sequence is a functional homolog of SEQ ID NO 823 in the 11/479,226 US patent application
  misc_feature: The sequence is a functional homolog of SEQ ID NO 930 in the 11/435,388 US patent application
  misc_feature: Useful for making plants with modulated flowering time
  misc_feature: Functional homolog of the protein sequence given in SEQ ID NO 13559
  misc_feature: Useful for making plants with altered lignin content
  misc_feature: Functional homolog of the protein sequence given in SEQ ID NO 13093
  misc_feature: The sequence is a functional homolog of SEQ ID NO 1798 in the 10/412,699 US patent application
  misc_feature: The sequence is a functional homolog of SEQ ID NO 2044 in the 10/374,780 US patent application
  misc_feature: The sequence is a functional homolog of SEQ ID NO 408 in the 10/412,699 US patent application
  misc_feature: The sequence is a functional homolog of SEQ ID NO 48 in the 10/286,264 US patent application
  misc_feature: The sequence is a functional homolog of SEQ ID NO 938 in the 11/435,388 US patent application
  misc_feature: The sequence is a functional homolog of SEQ ID NO 957 in the 11/479,226 US patent application
  misc_feature: The sequence is a functional homolog of SEQ ID NO 1495 in the 10/374,780 US patent application
  misc_feature: The sequence is a functional homolog of SEQ ID NO 1565 in the 10/412,699 US patent application
  misc_feature: The sequence is a functional homolog of SEQ ID NO 1786 in the 10/412,699 US patent application
  misc_feature: The sequence is a functional homolog of SEQ ID NO 2024 in the 10/374,780 US patent application
  misc_feature: The sequence is a functional homolog of SEQ ID NO 352 in the 10/412,699 US patent application
  misc_feature: The sequence is a functional homolog of SEQ ID NO 819 in the 11/479,226 US patent application
  misc_feature: The sequence is a functional homolog of SEQ ID NO 928 in the 11/435,388 US patent application
  misc_feature: The sequence is a functional homolog of SEQ ID NO 1494 in the 10/374,780 US patent application
  misc_feature: The sequence is a functional homolog of SEQ ID NO 1564 in the 10/412,699 US patent application
  misc_feature: Ceres ANNOT ID no. 8669685
MVHGEESSWRMERAALPLNQAFAYGAQAHAAAAPPTCFLDFQPAAAAAAYFGFGELEEALIHGGGGAGNAHGVDPGVIIKNDVAQAKSAAAAGYLAGAGRPPTLEIFPSWPEGNSQSVGSTTDSSSAQNTMSQMELVSPASSAPRQEVMMVTTDDYSYKPGLAAAPAAAAAPPPSFQQHHPLPLQLHGGDGGGGGGDHDKRKHGSTRKDGKLVDAKTERRLAQNREAARKSRLRKKQLETSRIRLQQVEHELQRARSQGLFVGGCSAAGDMSSGAAMFDMEYARWLDDDSKRLAELRAGLQAQLLDGNLGLIVEECMQHYDELFQLKAALARSDVFHLLTGAWATAAERCFFWMGGFRPSELLKLDPLTEQQLLGICNLQQSSEQAEEALAQGLHQLHQSLADTVATGTLNDGAATPNYMNIMAVAIDKLACLENFYQQADNLRQQTLHQMRRILTTRQAARCFLSIGEYYSRLRALSNLWASRPRDNFIGTESLSPTATELQALHHQQQNQFTGF

SEQ ID NO: 17062 - DNA, 903 bp, Sorghum bicolor
  misc_feature: Ceres ANNOT ID no. 8669690
  misc_feature: Encodes the peptide sequence at SEQ ID NO 17063
atggcaggccgagctctcactcacactcacttccagctcattgccgccatcctggtggcgctcgtcgccacatgccacgccggcagcatcgccgtgtactggggtcagaacgacggcgagtcgtccctgtccgctacgtgcgcgtccgggaactacaagttcgtcatcctcgccttcgtctacaagttcggcaagggccagacgccggacctgaacctcgccgggcactgcgagcccgcgtcgggcggctgcaagtttctgagcaaggacatccagtcgtgccagcgccgcggtgtcaaggtcctcctctccatcggcggcggcgagggcagctacggcctgtcgtcagaacaggacgcccgcgaagtggccgcctacctctggaacacttacctgggcggcacctcgtcgtcccgccccctcggcgacgccgtcctcgacggcgtcgacttcgacatcgagaaaggcggcgccaagttctgggacagcctcgccagggacctcaagaacttgggcaagaagaagggcagcaagggggtgcttctgagcgcggcgccgcagtgcccgttcccggacgagtgggacaacggcgcgatcgacacggggctgttcgactacgtgtgggtgcagttctacaacaacgagccgtgccaggtgagcgctggccgcggcgcgttcctggcggcgtggaagaggtggcagtcggtgccggcggggaagatcttcctgggcctgcccgccgccaagagcgcggcgggcaccgggttcgtgcccgccgcccagctcacgtcgcaggtgctgccgctcatcaagggctcgcccaagtacggcggcgtcatgctctggtcaaagtactacgacgaccgcacgggctacagcaacgccatcaagaaacatgtctga

SEQ ID NO: 17063 - protein, 300 aa, Sorghum bicolor
  misc_feature: Useful for making plants with altered carbohydrate content
  misc_feature: Functional homolog of the protein sequence given in SEQ ID NO 13911
  misc_feature: Useful for making plants with altered cell wall content and/or composition
  misc_feature: Functional homolog of the protein sequence given in SEQ ID NO 13912
  misc_feature: Ceres ANNOT ID no. 8669690
  misc_feature (27)..(300): SWISSPROT Homolog: EC 3.2.1.14 Chitinase
  misc_feature (28)..(287): Pfam ID: Glyco_hydro_18 Pfam Description: Glycosyl hydrolases family 18
MAGRALTHTHFQLIAAILVALVATCHAGSIAVYWGQNDGESSLSATCASGNYKFVILAFVYKFGKGQTPDLNLAGHCEPASGGCKFLSKDIQSCQRRGVKVLLSIGGGEGSYGLSSEQDAREVAAYLWNTYLGGTSSSRPLGDAVLDGVDFDIEKGGAKFWDSLARDLKNLGKKKGSKGVLLSAAPQCPFPDEWDNGAIDTGLFDYVWVQFYNNEPCQVSAGRGAFLAAWKRWQSVPAGKIFLGLPAAKSAAGTGFVPAAQLTSQVLPLIKGSPKYGGVMLWSKYYDDRTGYSNAIKKHV

SEQ ID NO: 17064 - DNA, 900 bp, Sorghum bicolor
  misc_feature: Ceres ANNOT ID no. 8669693
  misc_feature: Encodes the peptide sequence at SEQ ID NO 17065
atggcgaaccgagctcaagctccatccctgctcgtggccaccctcttggcggctctcctcgccacatgccatgccggtggcatcgccgtctactggggccagaacgacggcgaggcgtccctatccgacacgtgtgcgtcagggaactacaagttcgtcatcctcgccttcgtctacaagttcggcaagggccagacgccggagctggacctcgctagccactgcgacccctcatcgggcggctgcacggggctgagtgacgacatacgttcgtgccagagcagcggcgtcaaggtcctgctgtcgatcggcggcggtgacggcagctacggcctgtcgtcccagggagacgcgcgggacgtggccgcctacctctggaacaattacctgggcggctcgtcgtcgtcgcgccccctcggcgacgccgtccttgacggcattgacttcgacatcgagctcggcggctccaagtactgggacagcttggccagggacctcaagaacatgggcaagaacaaggtgggcggcaagggggtgctcctgagcgcggcgccgcagtgcccgttcccggacgagtgggacaacggcgcgatcgacacggggctgttcgactacgtgtgggtgcagttctacaacaacccaccgtgccaggtgagcgctggccgcggcgcgttcctggcggcgtggaagaggtggcagtcggtgccggcggggcagatcttcctaggcctgcccgcctccaaggacgccgccggcaccgggttcgtgcccgccgacgatctcaactccaacgtgctgccgctcatcaggggatcgtccaagtacggcggcgtcatgctctggtccaagtactacgacgaccgcgcaggctacagtgacgccatcaagagccacgtgtga

SEQ ID NO: 17065 - protein, 299 aa, Sorghum bicolor
  misc_feature: Useful for making plants with altered carbohydrate content
  misc_feature: Functional homolog of the protein sequence given in SEQ ID NO 13911
  misc_feature: Useful for making plants with altered cell wall content and/or composition
  misc_feature: Functional homolog of the protein sequence given in SEQ ID NO 13912
  misc_feature: Ceres ANNOT ID no. 8669693
  misc_feature (25)..(299): SWISSPROT Homolog: EC 3.2.1.14 Chitinase
  misc_feature (26)..(286): Pfam ID: Glyco_hydro_18 Pfam Description: Glycosyl hydrolases family 18
MANRAQAPSLLVATLLAALLATCHAGGIAVYWGQNDGEASLSDTCASGNYKFVILAFVYKFGKGQTPELDLASHCDPSSGGCTGLSDDIRSCQSSGVKVLLSIGGGDGSYGLSSQGDARDVAAYLWNNYLGGSSSSRPLGDAVLDGIDFDIELGGSKYWDSLARDLKNMGKNKVGGKGVLLSAAPQCPFPDEWDNGAIDTGLFDYVWVQFYNNPPCQVSAGRGAFLAAWKRWQSVPAGQIFLGLPASKDAAGTGFVPADDLNSNVLPLIRGSSKYGGVMLWSKYYDDRAGYSDAIKSHV

SEQ ID NO: 17066 - DNA, 900 bp, Sorghum bicolor
  misc_feature: Ceres ANNOT ID no. 8669692
  misc_feature: Encodes the peptide sequence at SEQ ID NO 17067
atggcgaaccgagctcaagctccatccctgctcgtggccaccctcttggcggctctcctcgccacatgccatgccggtggcatcgccgtctactggggccagaacgacggcgaggcgtccctttccgacacgtgtgcgtcagggaactacaagttcgtcatcctcgccttcgtctacaagttcggcaagggccagacgccggagctggacctcgccagccactgcgacccctcatcgggcggctgcacggggttgagtgacgacatacgttcgtgccagagcagcggcgtcaaggtcctgctctcgatcggcggcggtgacggcagctacggcctgtcgtcccagggagacgcgcgggacgtggccgcctacctctggaacaattacctgggcggctcgtcgtcgtcgcgccccctcggcgacgccgtccttgacggcattgacttcgacatcgagctcggcggctccaagtactgggacagcttggccagggacctcaagaacatgggcaagaacaaggtgggcggcaagggggtgctcctgagcgcggcgccgcagtgcccgttcccggacgagtgggacaacggcgcgatcgacacggggctgttcgactacgtgtgggtgcagttctacaacaacccaccgtgccaggtgaacgcgggccgcggcgcgttcctggacgcgtggaaacagtgggagtcggttccggcggggaagatcttcctaggcctgcccgcctccaaggacgccgccggcaccgggttcgtgcccgccgacgatctcaactccaacgtgctgccgctcatcaggggatcgtccaagtacggcggcgtcatgctctggtccaagtactacgacgaccgcgcaggctacagtgacgccatcaagagccacgtgtga

SEQ ID NO: 17067 - protein, 299 aa, Sorghum bicolor
  misc_feature: Useful for making plants with altered carbohydrate content
  misc_feature: Functional homolog of the protein sequence given in SEQ ID NO 13911
  misc_feature: Useful for making plants with altered cell wall content and/or composition
  misc_feature: Functional homolog of the protein sequence given in SEQ ID NO 13912
  misc_feature: Ceres ANNOT ID no. 8669692
  misc_feature (25)..(299): SWISSPROT Homolog: EC 3.2.1.14 Chitinase
  misc_feature (26)..(286): Pfam ID: Glyco_hydro_18 Pfam Description: Glycosyl hydrolases family 18
MANRAQAPSLLVATLLAALLATCHAGGIAVYWGQNDGEASLSDTCASGNYKFVILAFVYKFGKGQTPELDLASHCDPSSGGCTGLSDDIRSCQSSGVKVLLSIGGGDGSYGLSSQGDARDVAAYLWNNYLGGSSSSRPLGDAVLDGIDFDIELGGSKYWDSLARDLKNMGKNKVGGKGVLLSAAPQCPFPDEWDNGAIDTGLFDYVWVQFYNNPPCQVNAGRGAFLDAWKQWESVPAGKIFLGLPASKDAAGTGFVPADDLNSNVLPLIRGSSKYGGVMLWSKYYDDRAGYSDAIKSHV

SEQ ID NO: 17068 - DNA, 1227 bp, Sorghum bicolor
  misc_feature: Ceres ANNOT ID no. 8669699
  misc_feature: Encodes the peptide sequence at SEQ ID NO 17069
atggggctccgcgtccgcgcctcatcgcttctgctatccctggctctcgagctcgtggtcgcgctcgtctcagtgtcggcgcagcaaaagttcgggatcaactacgggcagatcgcgaacaacctgccggagccgacgcaggtggcgagtctcctccagtcgatgaacgtgaacaaggtgaagctctacgacgcggacccgcgagtgctgacggcgttcgccaacaccggcgtcgagttcatcatcgccgtgggcaacgagaacctgcagaccatggcggccagccccgccgcggcgcgccagtgggtggcgacgaacgtgcagccgtacctcccggccacgcgcatcacctgcgtcaccgtcggcaacgaggtcttctccagcaacgacacgtccatgatggccagcctcctccccgccatgaaggccgtgtacgccgcgctgggaggtctgggcctcggcagccaggtcaccgtgtcgtcggcgcactccgtgaacgtgctcgccaccagcttcccgccgtcgtcgggcgcgttccgggaggacctcgcggagtacatcaagcccatcctcgacttccacggccagtcggggtcgccgttcctcatcaacgcgtacccgttcttcgcctacaaggcgagccccgggagcgtgtcgctgccgtacgtgctgttcgagcccaacccgggcgtgcgcgaccccaacacgggcctcacctacgacaacatgctctacgcccagatcgacgccgtgtacgccgccatgaaggccatggggcacacggacgtgggcgtgaggatctcggagaccgggtggccgtccaagggcgacgaggacgagaccggcgccacggtgcagaacgcggcggcgtacaatggcaacctgatgcagaggatcgccatgaaccaggggacgccgctcaagcccaacgtgcccgtcgacgtgtacgtgttcgcgctcttcaacgaggacatgaagccaggacccgcgtcggagaggaactacgggctgttctaccccaacggctcgccggtgtacgcgctcaactccgccggctccggcggcggttcgagtcccggcgggtcgctcaacccgtactacacgtccatgttctcctcctcgtccagatcggcggtgagcgcaacctttttgacagagagagtgatactattactgctgctgcaagcgattgtaatactgcgacaatcatattcattgtactgttag

SEQ ID NO: 17069 - protein, 408 aa, Sorghum bicolor
  misc_feature: Useful for making plants with altered carbohydrate content
  misc_feature: Functional homolog of the protein sequence given in SEQ ID NO 14471
  misc_feature: Useful for making plants with altered cell wall content and/or composition
  misc_feature: Functional homolog of the protein sequence given in SEQ ID NO 14472
  misc_feature: Useful for making plants with altered lignin content
  misc_feature: Functional homolog of the protein sequence given in SEQ ID NO 14156
  misc_feature: Ceres ANNOT ID no. 8669699
  misc_feature (32)..(346): SWISSPROT Homolog: EC 3.2.1.39 Glucan endo-1,3-beta-D-glucosidase
  misc_feature (31)..(350): Pfam ID: Glyco_hydro_17 Pfam Description: Glycosyl hydrolases family 17
MGLRVRASSLLLSLALELVVALVSVSAQQKFGINYGQIANNLPEPTQVASLLQSMNVNKVKLYDADPRVLTAFANTGVEFIIAVGNENLQTMAASPAAARQWVATNVQPYLPATRITCVTVGNEVFSSNDTSMMASLLPAMKAVYAALGGLGLGSQVTVSSAHSVNVLATSFPPSSGAFREDLAEYIKPILDFHGQSGSPFLINAYPFFAYKASPGSVSLPYVLFEPNPGVRDPNTGLTYDNMLYAQIDAVYAAMKAMGHTDVGVRISETGWPSKGDEDETGATVQNAAAYNGNLMQRIAMNQGTPLKPNVPVDVYVFALFNEDMKPGPASERNYGLFYPNGSPVYALNSAGSGGGSSPGGSLNPYYTSMFSSSSRSAVSATFLTERVILLLLLQAIVILRQSYSLYC

SEQ ID NO: 17070 - DNA, 894 bp, Sorghum bicolor
  misc_feature: Ceres ANNOT ID no. 8669694
  misc_feature: Encodes the peptide sequence at SEQ ID NO 17071
atggcaggccgacctctcactcccttccaactcattgccatcctcttgctggcgcttctcgttacgagccacgccggcggaatcgccatatactggggccagaacacgggagaagcaaccctgtccgcgacgtgcgcgtcccgcaagtaccagttcgtcatcctcgccttcgttttccagttcggccagggccgggcgccgcagctggacctgtccggccactgcgacgcctcgtcaggccgctgctccgtcctgagcaatgacatccgctcgtgccagcgccgtggcgtcaaggtcctgctctccatcggcggcggcgttggcaactacggcctgtcgtcagccgcggacgcgcggctggtggccgcgtacctctggaatagctacctcggcggcaagtcgtcgtcacgtccgctcggcgatgccgtccttgatggcatcgacttcgacatcgagctcggcagcgccaagttctgggacaatctcgccagggacctcaaggacatgggcaagagtggcaacaaggcggtgctgctgagcgcggcgccgcagtgcccgttcccggacgagtgggacgacggcgcgatcaagacggggctgttcgacttcgtttgggtgcagttctacaacaacccggagtgccagttcagctcggggcgcaaggccttcctggacgcatggaaacagtgggagtcggtgccggcggggaagctctacctcggactgccagcctccaaggacgcggcaggcaccgggttcgtgcccgcggcccagctcacgtcgcaggtgctgccgctcatcaagggctcgcgcaagtacggcggcgtcatgctctggtccaagttctacgacgaccgcacgggatacagctccgccatcaagagccacgtctga

SEQ ID NO: 17071 - protein, 297 aa, Sorghum bicolor
  misc_feature: Useful for making plants with altered carbohydrate content
  misc_feature: Functional homolog of the protein sequence given in SEQ ID NO 13911
  misc_feature: Useful for making plants with altered cell wall content and/or composition
  misc_feature: Functional homolog of the protein sequence given in SEQ ID NO 13912
  misc_feature: Ceres ANNOT ID no. 8669694
  misc_feature (25)..(297): SWISSPROT Homolog: EC 3.2.1.14 Chitinase
  misc_feature (26)..(284): Pfam ID: Glyco_hydro_18 Pfam Description: Glycosyl hydrolases family 18
MAGRPLTPFQLIAILLLALLVTSHAGGIAIYWGQNTGEATLSATCASRKYQFVILAFVFQFGQGRAPQLDLSGHCDASSGRCSVLSNDIRSCQRRGVKVLLSIGGGVGNYGLSSAADARLVAAYLWNSYLGGKSSSRPLGDAVLDGIDFDIELGSAKFWDNLARDLKDMGKSGNKAVLLSAAPQCPFPDEWDDGAIKTGLFDFVWVQFYNNPECQFSSGRKAFLDAWKQWESVPAGKLYLGLPASKDAAGTGFVPAAQLTSQVLPLIKGSRKYGGVMLWSKFYDDRTGYSSAIKSHV

SEQ ID NO: 17072 - DNA, 912 bp, Sorghum bicolor
  misc_feature: Ceres ANNOT ID no. 8669695
  misc_feature: Encodes the peptide sequence at SEQ ID NO 17073
atggctagaataagcaacatcccgtcgtctctgccactgctattggccacggcgtttgcattggccggggtcaccgccggagcgcgcaccggcggcatcgccatctactggggccagaacggcaacgaggggacgctggcgcagacctgcgccacgggcaactacaagttcgtcaacgtggcgttcctccccacgttcggcaagggccagacgccggtgctgaacctggccggccactgcgacccggcgagcaacgggtgcacgggcgtgggcgcggacatcattgcgtgccagcggatgggcatcaaggtcctgctctccatcggcggcggagtcggcagctacgggctctcgtcccgggacgacgcgaggaccgtcgcggcgtacctctggaacaactacctcggcggccggtccaagtccaggcccctcggcgacgccgtcctcgacggcatcgacttcgacatcgagagcggcgggagcatgtactgggacgacctggccaggttcctcaagtcctactcccggcacgggcggaaggtgtacctggccgcggcgccgcagtgcccgttcccggacgcgtcgctgggcacggcgctcggcacggggctgttcgactacgtgtgggtgcagttctacaacaacccgccgtgccagtacagcgcgagcgccggcgtgggcggcctggcgagcgcgtgggcgcagtggacgcccatcagggccggccgggtgttcctcggcctcccggccgcgccacaggccgcgggcagcgggttcgtgccggcgagcgacctcgtggcgcaggtgctgccggtggtcaagaactccaccaagtacgggggaatcatgctctggtccaggtactacgacgggctcacggggtacagcgacgcggtcaagtcccaagtgtga

SEQ ID NO: 17073 - protein, 303 aa, Sorghum bicolor
  misc_feature: Useful for making plants with altered carbohydrate content
  misc_feature: Functional homolog of the protein sequence given in SEQ ID NO 13911
  misc_feature: Useful for making plants with altered cell wall content and/or composition
  misc_feature: Functional homolog of the protein sequence given in SEQ ID NO 13912
  misc_feature: Ceres ANNOT ID no. 8669695
  misc_feature (31)..(303): SWISSPROT Homolog: EC 3.2.1.14 Chitinase
  misc_feature (31)..(290): Pfam ID: Glyco_hydro_18 Pfam Description: Glycosyl hydrolases family 18
MARISNIPSSLPLLLATAFALAGVTAGARTGGIAIYWGQNGNEGTLAQTCATGNYKFVNVAFLPTFGKGQTPVLNLAGHCDPASNGCTGVGADIIACQRMGIKVLLSIGGGVGSYGLSSRDDARTVAAYLWNNYLGGRSKSRPLGDAVLDGIDFDIESGGSMYWDDLARFLKSYSRHGRKVYLAAAPQCPFPDASLGTALGTGLFDYVWVQFYNNPPCQYSASAGVGGLASAWAQWTPIRAGRVFLGLPAAPQAAGSGFVPASDLVAQVLPVVKNSTKYGGIMLWSRYYDGLTGYSDAVKSQV

SEQ ID NO: 17074 - DNA, 1365 bp, Sorghum bicolor
  misc_feature: Ceres ANNOT ID no. 8669750
  misc_feature: Encodes the peptide sequence at SEQ ID NO 17075
atggttgttgagatgaaggagaacggcggcgtggcgttggcggcgggcgagaaggcgccgcagctgagcgtgaagcgcggcgagccgacgctggtggcgccggcggaggcgacgccgacgggcgagcagtactacctgtccaacctggaccagaacatcgcggtgatcgtgcagacggtgtactgctacaagccctcgcccaccagcgccgacggcggcggcggcggcaaggacgtcgacgtggcggccgcgctccgcgacgcgctggcgcgcgtgctggtgcactaccacccgctggcggggcggctggggatcagcccggagatgaagctgaccgtggagctcaccggcgagggcgtcgtgttcgtggaggccgacgccgcctgcgacctcgccgtcgttggcgacctcaccaagcccgaccccgccgcgctcggccagctcgtctattccgtccccggcgccaagcacatcctcgagatgccccccatgaccgcgcagcagcagttcaaatgtgggggcttcgcgcttgttctggccatgaaccactgcatgtccgatggcatgggcgccatggagttcgtcaactcgtgggccgagacggcgcgcggcgtcgctgacctcaccgtgccgccgttcctcgaccgcagcgtcctgaaggcgcgcgacccgcccgtgcacaccttcccgcaccacgagttcgccgagatccccgacgtctccgacacggcggcgctctacggcgcgcaggagctgctgtaccgctccttctgcttcgacccggaccggctggagcgcgtccgcgcgctggcgcttgccgacggcgccctgggccgctgcaccaccttcgaggcgctgtcggggctcgtgtggcgcgcgcgcaccaaggcgctcgggctggcacccgagcagcgcaccaagctgctgttcgccgtggacgggcggcgccggttctcgccgccgctcccgcggggctacttcgggaacggcatcgtgctgaccaacgccctggccaccgccggcgagctgctgtccgcgcccgtgtcgcgcgcggccgggctggtgcaggaggccgtgcggatggtgaccgacgactacatgcggtcggcggtggactacttcgaggcgacgcgggcccggccgtcgctggcgtccacgctgctcatcaccacgtggtctcggctcgagttccacggcgccgacttcgggtggggcgagccggtcatgtcgggcccagtcacgctgccggagaaggaggtcatcctcttcctcgcgcacggaaaggagaggaagagcatcaacgtgctgctcggcctgccggccaccgcgatggacgccttccaagagctcatggacgagatatga

SEQ ID NO: 17075 - protein, 454 aa, Sorghum bicolor
  misc_feature: Useful for biocontainment applications
  misc_feature: Functional homolog of the protein sequence given in SEQ ID NO 14111
  misc_feature: Ceres ANNOT ID no. 8669750
  misc_feature (22)..(411): SWISSPROT Homolog: EC 2.3.1.144 Anthranilate N-benzoyltransferase
  misc_feature (22)..(454): Pfam ID: Transferase Pfam Description: Transferase family
MVVEMKENGGVALAAGEKAPQLSVKRGEPTLVAPAEATPTGEQYYLSNLDQNIAVIVQTVYCYKPSPTSADGGGGGKDVDVAAALRDALARVLVHYHPLAGRLGISPEMKLTVELTGEGVVFVEADAACDLAVVGDLTKPDPAALGQLVYSVPGAKHILEMPPMTAQQQFKCGGFALVLAMNHCMSDGMGAMEFVNSWAETARGVADLTVPPFLDRSVLKARDPPVHTFPHHEFAEIPDVSDTAALYGAQELLYRSFCFDPDRLERVRALALADGALGRCTTFEALSGLVWRARTKALGLAPEQRTKLLFAVDGRRRFSPPLPRGYFGNGIVLTNALATAGELLSAPVSRAAGLVQEAVRMVTDDYMRSAVDYFEATRARPSLASTLLITTWSRLEFHGADFGWGEPVMSGPVTLPEKEVILFLAHGKERKSINVLLGLPATAMDAFQELMDEI

SEQ ID NO: 17076 - DNA, 1443 bp, Sorghum bicolor
  misc_feature: Ceres ANNOT ID no. 8669749
  misc_feature: Encodes the peptide sequence at SEQ ID NO 17077
atgtcttttcgtagcatagtccgtgatgttagggatggtttcggcagcttgtcgagaagaagctttgaggtgaccctcgcaagcatctatggccttactgggcatcacaaagggaagacccagagctcattgcatgagctcgatgactcaccttccataattcgtgaaagccgctgggcgaatctacctcctgaactcatccgtgatatcatacggaggctggaggctgatgagagcacctggccagcacggaagcatgttgtttgttttgcagctgtttgtaggacatggagggagatgtgtaaagagattgtgttgagcccggagttatgtgggaagctcaccttccctgtgtctctaaaacagcctggccctcgagatggaaatacaatgattcagtgttttataaagaggaataaatcaaaatccacttactatctctacctgtgccttagcaatgttgttacttcagaaagtgggaaattcctcttgtcggctaaaagacaccggaaaaccacatgcacagagtacactatatcaatggattctggcaacatctcaagatcaagcagaacctacattggaaaaataaggtcgaatttccttggcacaagatttttaatttatgatacacaaccaccctataatggggctgtagttcctccttccggaaggaccagcagaaggttcaactccacaaaagtctctccaaagttgccttctgttagttacaacatcgctcaggtgtcgtatgagctgaatgtccttggcacgagaggtcctaggcggatgcgttgcatcatgcactccatacccgcctcatcagtggagccaggtggcattgtgcctggacagccagagcagattgtacctcgagctctggaggattcattccgcagcacagcttccttctcgcagtccttccgtagcaccacctcattgtccaagtccatcatggactcatccatggatttcaatagcgctcgcttctctgatattggtggcagcagcgctcgcttcacgggcattcctggcagcagtgctcgcttcacgggcattcctggcagcagtgctcgcttctcgggcattgctgaaggcagattggacaacgatgaggagagtgaaaccaaggagaggccattggtgcttcgcaataagccgcctaggtggcatgaacagctgcagtgctggtgcctcaacttccggggccgtgtgacaattgcctcggtgaagaacttccagctgattgccgcgacaaccccgccacctgcaggtgctccaaccccctcccagcctgctccatcagatccagacaaggtgattctgcagtttggaaaagtggcaagggatatgttcacaatggactatcgctaccctctctcggctttccaggcatttgccatttgtctgagcagcttcgatacaaaactggcctgtgaataa

SEQ ID NO: 17077 - protein, 480 aa, Sorghum bicolor
  misc_feature: The sequence is a functional homolog of SEQ ID NO 130 in the 10/225,068 US patent application
  misc_feature: The sequence is a functional homolog of SEQ ID NO 2896 in the 10/374,780 US patent application
  misc_feature: The sequence is a functional homolog of SEQ ID NO 458 in the 10/666,642 US patent application
  misc_feature: Ceres ANNOT ID no. 8669749
  misc_feature (123)..(474): Pfam ID: Tub Pfam Description: Tub family
  misc_feature (57)..(112): Pfam ID: F-box Pfam Description: F-box domain
MSFRSIVRDVRDGFGSLSRRSFEVTLASIYGLTGHHKGKTQSSLHELDDSPSIIRESRWANLPPELIRDIIRRLEADESTWPARKHVVCFAAVCRTWREMCKEIVLSPELCGKLTFPVSLKQPGPRDGNTMIQCFIKRNKSKSTYYLYLCLSNVVTSESGKFLLSAKRHRKTTCTEYTISMDSGNISRSSRTYIGKIRSNFLGTRFLIYDTQPPYNGAVVPPSGRTSRRFNSTKVSPKLPSVSYNIAQVSYELNVLGTRGPRRMRCIMHSIPASSVEPGGIVPGQPEQIVPRALEDSFRSTASFSQSFRSTTSLSKSIMDSSMDFNSARFSDIGGSSARFTGIPGSSARFTGIPGSSARFSGIAEGRLDNDEESETKERPLVLRNKPPRWHEQLQCWCLNFRGRVTIASVKNFQLIAATTPPPAGAPTPSQPAPSDPDKVILQFGKVARDMFTMDYRYPLSAFQAFAICLSSFDTKLACE

SEQ ID NO: 17078 - DNA, 807 bp, Sorghum bicolor
  misc_feature: Ceres ANNOT ID no. 8669782
  misc_feature: Encodes the peptide sequence at SEQ ID NO 17079
atggcgcagtccatgctcatgtcgaccagcgtcaacggcggccgcgcgctgccgtcgctgcaggctggcaggccggcgccatacccgcggctaccgctgccgtcgtcgtcgtcgggctacaggcactccaagtccgtctccgtgaagaccctcgccctgttcggcaaatccaaggtcaagaccgcgccgtcgaagaaggctgctgcgcccaagcccaagcccaaggttgaggatggtatcttcggcacgtccggcgggatcggtttcaccaaggagaacgagctgttcgtcggccgtgttgccatgcttggttttgccgcatcgctgcttggagaggccatcaccgggaagggcatccttgcccagctgaacctggagacgggcatccccatctacgaggcggagcccctcctcctgttcttcatcctcttcaccctccttggcgccattggcgctctcggtgaccgtggtcgcttcgtcgacgaggaggtcaccggcctcgacaaggccgtcatccaacccggcaagggcttccgcggcgccctcggcctcagcgagggagggccgctgtttgggttcaccaagtcgaacgagctgttcgtggggcggctggcgcagctgggcgtggccttctccatcatcggcgagatcatcacggggaagggcgcgctggcgcagctcaacatcgagacaggggtgcccatcaacgagatcgagccgctcgtcatcttcaacgtcctcttcttcttcgtcgccgccatcaaccctggcaacggcaggttcatcatcggcgaggacgaagagtag

SEQ ID NO: 17079 - protein, 268 aa, Sorghum bicolor
  misc_feature: Useful for making plants with modulated light quality response
  misc_feature: Useful for making plants with modulated nitrogen use efficiency
  misc_feature: Functional homolog of the protein sequence given in SEQ ID NO 14473
  misc_feature: Ceres ANNOT ID no. 8669782
  misc_feature (69)..(217): Pfam ID: Chloroa_b-bind Pfam Description: Chlorophyll A-B binding protein
MAQSMLMSTSVNGGRALPSLQAGRPAPYPRLPLPSSSSGYRHSKSVSVKTLALFGKSKVKTAPSKKAAAPKPKPKVEDGIFGTSGGIGFTKENELFVGRVAMLGFAASLLGEAITGKGILAQLNLETGIPIYEAEPLLLFFILFTLLGAIGALGDRGRFVDEEVTGLDKAVIQPGKGFRGALGLSEGGPLFGFTKSNELFVGRLAQLGVAFSIIGEIITGKGALAQLNIETGVPINEIEPLVIFNVLFFFVAAINPGNGRFIIGEDEE

SEQ ID NO: 17080 - DNA, 1086 bp, Sorghum bicolor
  misc_feature: Ceres ANNOT ID no. 8669783
  misc_feature: Encodes the peptide sequence at SEQ ID NO 17081
atggacaagtacgaggcggtgcgggacatcgggtcggggaactttggggtggcccggctgatgcgcaaccgcgagacccgagagctcgtcgccgtcaagtgcatcgagcgcggccaccggattgacgagaatgtgtacagggagatcatcaaccaccgctcgctgcgccatcccaacattattcgcttcaaggaggtgatacttacaccaacgcatcttatgattgtgatggagtttgcagcaggtggagagctttttgatcggatctgtgatcgtgggcggtttagtgaggatgaggcacggtatttctttcagcagctgatctgtggtgtgagctattgccattacatgcaaatatgccatagagatctgaagctggagaatgttctcttggatggcagcccagctccacggcttaagatatgcgattttggctattccaagtcatcagtgttgcattcaagacccaaatcagcagtgggaacgccagcatatattgcacctgaggtgctatcccgtcgcgagtatgatggaaagcttgcagacgtatggtcctgtggggtgactctttacgtcatgcttgtgggagcatacccatttgaagaccccgatgaccccaagaatatacgcaagaccattcagcaaataatgcaagtgcaatacaagataccagattatgtccacatatctacggaatgccagcaacttcttgcccgtatctttgttgccaatccaatgaggagaatcacaatgaaggaaataaagagccatccatggtttttgaagaacctaccacgggaactcacggagactgcacaaggcatgtactacaggagggataacagggtgccttcttactcagaccaatcgtcggaagaaatcatgaagatagttcaagatgcaaggaccatgccgaaatcatccagatcaggctatgggtggagcactgagtattcggatgaagaagaagagaaggaagaggaacacaggccagaggagcatgaggaacaggaagatgaatacgataggagggtgaaggaagtccatgcaagcggagaactccgtttggacgctcttcacatatga

SEQ ID NO: 17081 - protein, 361 aa, Sorghum bicolor
  misc_feature: Useful for biocontainment applications
  misc_feature: Useful for making plants with modulated biomass
  misc_feature: Useful for making plants with modulated time to senescence
  misc_feature: Functional homolog of the protein sequence given in SEQ ID NO 14093
  misc_feature: Useful for making plants with modulated water use efficiency
  misc_feature: Functional homolog of the protein sequence given in SEQ ID NO 14094
  misc_feature: Ceres ANNOT ID no. 8669783
  misc_feature (1)..(361): SWISSPROT Homolog: EC 2.7.11.1 Non-specific serine/threonine protein kinase
  misc_feature (4)..(260): Pfam ID: Pkinase Pfam Description: Protein kinase domain
MDKYEAVRDIGSGNFGVARLMRNRETRELVAVKCIERGHRIDENVYREIINHRSLRHPNIIRFKEVILTPTHLMIVMEFAAGGELFDRICDRGRFSEDEARYFFQQLICGVSYCHYMQICHRDLKLENVLLDGSPAPRLKICDFGYSKSSVLHSRPKSAVGTPAYIAPEVLSRREYDGKLADVWSCGVTLYVMLVGAYPFEDPDDPKNIRKTIQQIMQVQYKIPDYVHISTECQQLLARIFVANPMRRITMKEIKSHPWFLKNLPRELTETAQGMYYRRDNRVPSYSDQSSEEIMKIVQDARTMPKSSRSGYGWSTEYSDEEEEKEEEHRPEEHEEQEDEYDRRVKEVHASGELRLDALHI

SEQ ID NO: 17082 - DNA, 1155 bp, Sorghum bicolor
  misc_feature: Ceres ANNOT ID no. 8669795
  misc_feature: Encodes the peptide sequence at SEQ ID NO 17083
atggcgctgcggcaggccggcgtgccggtgatcggtctagccgtgggggagccagacttcgacacgccgcccgcgatcgcggaggctgggatgaatgcaattagggatggttatacaaggtacactcctaatgctgggactttggagctgaggaaggctatttgtgctaaactccagggggaaaacgggatatcctacctcccagatcaggtgctggtaagcaatggagctaagcagtgcatcacacaagctgtgcttgcagtttgctcacctggtgatgaggttttgattccagccccatactgggtcagttatcctgagatggctagactggctgatgcaactccagtgattcttcctacaaacatatcagagaatttcttgttaagcacagagttgcttgccgagaagatcaatgagaaatcgaggctcttaattctatgctctccatctaatccaacaggatcagtatatccaaaggagctgcttgaaaaaatagctgatatagtcaagaagcatcctaggcttctggttttatctgatgaaatttatgagcatattatttatcagcctgcaaaacacacaagctttgcttcactgcctggaatgtgggaaagaacattaactgtaaatggtttttctaaggcttttgctatgacgggttggcgtcttggttaccttgcagcccctaaacattttgttgcagcatgtggaaagatccaaagccagttcacctcaggtgccagcagcatatcacagatggcagggcttgcagctctgaaccttggctatgctggtggtgaagcagtatcaaatatggtcaaagcatttcaggaacgccgtgactatcttgtgaaaaacttcaaggaactgcctggtgtgaaaatatcagaacctcagggtgccttttatttgttcattgacttcagcgcttactatgggtctgaagtacaggggtttggcactatcaagaattccgagtccctttgcatcttcctattagagaaagcacaggttgcccttgtccctggtgacgcatttggagatgacaagtgcattcgtatctcatatgctgcatccctaactacacttcaaactgcgatggcaaaaataaaggaagctgttgctctgctcaagccctgtgttgctgcttag

SEQ ID NO: 17083 - protein, 384 aa, Sorghum bicolor
  misc_feature: Useful for making plants with modulated nitrogen use efficiency
  misc_feature: Functional homolog of the protein sequence given in SEQ ID NO 13831
  misc_feature: Ceres ANNOT ID no. 8669795
  misc_feature (1)..(374): SWISSPROT Homolog: EC 2.6.1.1 Aspartate transaminase
  misc_feature (8)..(371): Pfam ID: Aminotran_1_2 Pfam Description: Aminotransferase class I and II
MALRQAGVPVIGLAVGEPDFDTPPAIAEAGMNAIRDGYTRYTPNAGTLELRKAICAKLQGENGISYLPDQVLVSNGAKQCITQAVLAVCSPGDEVLIPAPYWVSYPEMARLADATPVILPTNISENFLLSTELLAEKINEKSRLLILCSPSNPTGSVYPKELLEKIADIVKKHPRLLVLSDEIYEHIIYQPAKHTSFASLPGMWERTLTVNGFSKAFAMTGWRLGYLAAPKHFVAACGKIQSQFTSGASSISQMAGLAALNLGYAGGEAVSNMVKAFQERRDYLVKNFKELPGVKISEPQGAFYLFIDFSAYYGSEVQGFGTIKNSESLCIFLLEKAQVALVPGDAFGDDKCIRISYAASLTTLQTAMAKIKEAVALLKPCVAA

SEQ ID NO: 17084 - DNA, 414 bp, Sorghum bicolor
  misc_feature: Ceres ANNOT ID no. 8669847
  misc_feature: Encodes the peptide sequence at SEQ ID NO 17085
atggccgccgccgcggcctccttctcggcccttccgttccttctgctgttgctgctggtgccgtcgctagacgccgcctccaatgtgacgtacgaccaccgctccctcatcatctccggccgccgccgcctcatcatctccacctccatccactacccccgcagcgtccccgagatgtggcccaagctggtggctgaagccaaggacggcggcgccgactgcatcgaaacctacgtcttctggaacggccatgagatcgccccaggccagtactacttcgaggaccggttcgacctggtgcggttcgtgaaggtcgttaaagacgctgggctgctcttgatcctgcgcatcggtccctttgtcgccgccgagtggaattttgggtcagcttttctttgttcactactaggttaa

SEQ ID NO: 17085 - protein, 137 aa, Sorghum bicolor
  misc_feature: Useful for making plants with altered cell wall content and/or composition
  misc_feature: Functional homolog of the protein sequence given in SEQ ID NO 14474
  misc_feature: Useful for making plants with altered carbohydrate content
  misc_feature: Functional homolog of the protein sequence given in SEQ ID NO 13634
  misc_feature: Ceres ANNOT ID no. 8669847
  misc_feature (28)..(128): SWISSPROT Homolog: EC 3.2.1.23 Beta-galactosidase
  misc_feature (35)..(137): Pfam ID: Glyco_hydro_35 Pfam Description: Glycosyl hydrolases family 35
MAAAAASFSALPFLLLLLLVPSLDAASNVTYDHRSLIISGRRRLIISTSIHYPRSVPEMWPKLVAEAKDGGADCIETYVFWNGHEIAPGQYYFEDRFDLVRFVKVVKDAGLLLILRIGPFVAAEWNFGSAFLCSLLG

SEQ ID NO: 17086 - DNA, 1782 bp, Sorghum bicolor
  misc_feature: Ceres ANNOT ID no. 8669842
  misc_feature: Encodes the peptide sequence at SEQ ID NO 17087
atggatctctcgcggcccgcatcgtcggacctctcgctcgggctccactctcacggtcacgcccgcggccacgcccacgccgctcgcgtgcacgcggtagccgcgccgctgcgcctgttcgacggcgcggaggacgcgaagccggagcgcgtcgtggcaggggaggccgacgcggagagggatgacgaggacgggggcgaccagcacttctccctcctcgggcactccctctgcgtcaagcgcccgcgtcgcgtcgtcaacggcggtgggtgcgggggcggagacacgtcatcctgctcgtccacgtccgcggcgctgcgccccgccaagcggcaggcgacgggggagggcagcggcgcggatctggagacccgccgcgccgcggtccgcgcctggggcaaccagtcgctggcggaggccgacccggctgtgcacgcgctgatggagcaggagcttgaccgccaggtgcgaggcatcgagctcatagcctcggagaacttcgtctgccgcgcggtgctcgacgcgctcggcagccacctcaccaacaagtactccgagggggccccgggtgctcgctactacggcgggaatcagcacatcgacgccatcgagcggctctgccatgagcgagccctcattgccttcggtctcgaccctgcctgctggggcgtcaacgtgcagccctactcgtgcacgtctgccaatttggctgtctacactgggctccttcaacccaaggaccgcatcatggggctggagccaccgtcgggtggccatgttagccatggttactacacgcccagtggtaagaaggtgtcaggtgcctctattttcttcgagagcatgtcgtacaaggtgaacccacagactgggtatattgattacgacaagctcgaggagagagcaatggatttccacccgaaaattctcatctgtggtgggagctcttaccccagagagtgggactttgcacggatgagattgattgctgataaatgtggtgcagtgcttctttgcgacatggcacatatcagtgggcttgtcgcagcaaaggaatgccgtagcccttttgactactgtgatgttgttacgtcaactactcacaagaatcttaggggccctagaggtggtataatattcttcaggaaagggaaaaatttaaggaaacgagctggatctttttctcaaggagatgacaatgaatatgactttgaggataggataaattttggtgtttttccttcaatgcaaggaggaccccataataatcatattgctgccttggctataactctcaagcaggtagcaactcctgaatataaagcatacattcaacaagtcaagaaaaatgctcaggctttggcatcagctttgctcagaagaaaatgtagattggttactgggggcacagataatcacttagtactttgggacctcagaactcttggcttgacaggcaagatcttcgagaaggtttgcgaggcatgccacatatctatcaacaagacaccaatttatggggataacggctcgatatcgcctggtggtgtgcggattggaacacctgcaatgactactagaggttgcttagaagaggactttgacgtgattgcagacttcctcataagggctactcatattgctagcaatgttctgaaagaacatgggaaagtgcaaaaggagtttctaagaggcctacagaacaatagggatattatagaactccgaaatcaggttgaggcatttgcgtcacagtttgcgatgccaggttttgatgtatga

SEQ ID NO: 17087 - protein, 593 aa, Sorghum bicolor
  misc_feature: Useful for making plants with modulated nitrogen use efficiency
  misc_feature: Functional homolog of the protein sequence given in SEQ ID NO 13702
  misc_feature: Ceres ANNOT ID no. 8669842
  misc_feature (105)..(592): SWISSPROT Homolog: EC 2.1.2.1 Glycine hydroxymethyltransferase
  misc_feature (137)..(541): Pfam ID: SHMT Pfam Description: Serine hydroxymethyltransferase
MDLSRPASSDLSLGLHSHGHARGHAHAARVHAVAAPLRLFDGAEDAKPERVVAGEADAERDDEDGGDQHFSLLGHSLCVKRPRRVVNGGGCGGGDTSSCSSTSAALRPAKRQATGEGSGADLETRRAAVRAWGNQSLAEADPAVHALMEQELDRQVRGIELIASENFVCRAVLDALGSHLTNKYSEGAPGARYYGGNQHIDAIERLCHERALIAFGLDPACWGVNVQPYSCTSANLAVYTGLLQPKDRIMGLEPPSGGHVSHGYYTPSGKKVSGASIFFESMSYKVNPQTGYIDYDKLEERAMDFHPKILICGGSSYPREWDFARMRLIADKCGAVLLCDMAHISGLVAAKECRSPFDYCDVVTSTTHKNLRGPRGGIIFFRKGKNLRKRAGSFSQGDDNEYDFEDRINFGVFPSMQGGPHNNHIAALAITLKQVATPEYKAYIQQVKKNAQALASALLRRKCRLVTGGTDNHLVLWDLRTLGLTGKIFEKVCEACHISINKTPIYGDNGSISPGGVRIGTPAMTTRGCLEEDFDVIADFLIRATHIASNVLKEHGKVQKEFLRGLQNNRDIIELRNQVEAFASQFAMPGFDV

SEQ ID NO: 17088 - DNA, 1245 bp, Sorghum bicolor
  misc_feature: Ceres ANNOT ID no. 8669862
  misc_feature: Encodes the peptide sequence at SEQ ID NO 17089
atggctccccgaaccgaaccctcccgcggtgcactgacggagcggcagccgcagctggagaagaagccgccgagggggaaggcgccgctgtcggggaaggctgtcgtggcgctgtgcgtgacgagcttcgttgtggggctgctgctcagcggcaatgtgtcgctcatgtcggcctcggcgtcggtgtcctcgagcagggacagtgccgagaacgagaagagcattcgtgtttccggctgcgacaacaagcgtaaactcggagagaaccaccccaacgatctcctgaacgaggtgtcgaggactcatgaagcaatccagtcgctggacaaggcagtgtccaccctggagatggagatggccgtggagcgcgcgaggagcggcggcggcagcggcgcggccgtggcatccggcggcaggactccccagaaggccttcgtcgtggtcggcatcaacacggccttcaccagcaagaagcggcgcgactcgctccgcgacacctgggtgcccagaggggataagctgaggaagctggagcaggagaaggggatcgtgatccggttcgtgatcgggcacagcggcacgcccggcggcggcgcgctggaccgcgccctggacgcggaggaggccgagaccagggacttcctgcggctggaccacgccgagggctaccacgagctgtcgtccaagaccaggacctacttcaccaccgccgtcgccacctgggacgccgacttctacgtcaaggtcgacgacgacatccacctcaacctcgggatgctgtcgagcaggctggccaaacacagaacgcggccgagggtgtacgtcggctgcatgaagtccgggcctgtcctgtcacagaaaggagtgaagtaccacgagccagagtactggaagttcggtgacgagggcaacaagtacttccgccacgccaccggccagatctacgccatctccaaggatctcgccgcctacatctccatcaaccagcccatcctgcacaggttcgcgaacgaggacgtctcgctgggcgcgtggctgatcgggctcgaggtcgagcacgtcgacgaccggagcatgtgctgcgcgacgcctccagactgcgagtggaagaagcgagctgggaacgtgtgcgtggcgtccttcgactggtcgtgcagcggcgtctgcaagtcggtggacaggatgcggcacatccacaaggcgtgcggcgaaggcgaaggggccgtctggaacgccgccacatga

SEQ ID NO: 17089 - protein, 414 aa, Sorghum bicolor
  misc_feature: Useful for making plants with altered carbohydrate content
  misc_feature: Functional homolog of the protein sequence given in SEQ ID NO 13658
  misc_feature: Ceres ANNOT ID no. 8669862
  misc_feature (143)..(375): SWISSPROT Homolog: EC 2.4.1.134 Galactosylxylosylprotein 3-beta-galactosyltransferase
  misc_feature (158)..(357): Pfam ID: Galactosyl_T Pfam Description: Galactosyltransferase
MAPRTEPSRGALTERQPQLEKKPPRGKAPLSGKAVVALCVTSFVVGLLLSGNVSLMSASASVSSSRDSAENEKSIRVSGCDNKRKLGENHPNDLLNEVSRTHEAIQSLDKAVSTLEMEMAVERARSGGGSGAAVASGGRTPQKAFVVVGINTAFTSKKRRDSLRDTWVPRGDKLRKLEQEKGIVIRFVIGHSGTPGGGALDRALDAEEAETRDFLRLDHAEGYHELSSKTRTYFTTAVATWDADFYVKVDDDIHLNLGMLSSRLAKHRTRPRVYVGCMKSGPVLSQKGVKYHEPEYWKFGDEGNKYFRHATGQIYAISKDLAAYISINQPILHRFANEDVSLGAWLIGLEVEHVDDRSMCCATPPDCEWKKRAGNVCVASFDWSCSGVCKSVDRMRHIHKACGEGEGAVWNAAT

SEQ ID NO: 17090 - DNA, 2004 bp, Sorghum bicolor
  misc_feature: Ceres ANNOT ID no. 8669903
  misc_feature: Encodes the peptide sequence at SEQ ID NO 17091
atggcggctcgaggagggtggacgaagttgctgtttgcgctgctggtcgccgggctgcttcccgtcgtggctccgacgaggacctacgcagcagcggccgctgaaggaggaggtgctcgcggcaccgtgatcggcatcgacctgggcaccacctactcgtgcgtcggcgtctaccggaacggccgcgtcgagatcatcgccaacgaccagggcaaccggatcacgccctcatgggtcgccttcaccgacggcggcgagcgcctcatcggcgaggccgccaagaaccaggcggcggccaacccagagcgcaccatctacgacgccaagcggcttatcggtcgccagttcgacgacgccgtggtgcagcgggacatgaagctgctctcctacgacgtcgtcgagaggaacgggaagccgcacgtgcgggtccaggtgagggaaggcgacgtgcgcgagttgagccccgaggaggtcagcgccatggtgctcaccaagatgaaggagacggccgaggcctacctcggcgagaaggtcacggacgccgtcgtcaccgtcccggcctacttcgacgacgcgcagcgccaggccaccaaggacgctggcaccatcgccgggctcaacgtgcgccgcataatcaacgagcccaccgcggcagccatcgcctacggcatcgacgacaagggcccggagaagaaggtgctcgtgttcgacctcggcggcggcacgttcgacgtcagcatccttgccatcgacaacggcgtcttcgaggtgctcgccaccaacggcgacacccacctcggaggcgaggacttcgaccagcgcgtcatggattacttcatcaagctcatcaagcgcaggcacggccgggatatctccggcgacgcccgcgcgctagggaagctccggcgcgagtgcgagcgcgccaagcgcgcgctcagcaaccagcaccaggtgcgcgtggagatcgaggcgctcttcgacggcgtcgacatctcggagcagctcaccagggcgcgcttcgaggagctcaacagcgacctgttccggaagacgatggtgccggtgaagaaggccatggcggacgcccggctgcagaagagcgacatcgacgagatcgtgctcgtcggcggtagcaccaggatccccaaggtccagcagctgctcaaggactatttcaacggcaaggagcccagtaggggaatcaaccccgacgaggccgtcgcgtacggcgccgccgtccagggtggtatcctcagtgggcacggcgaaagtatgcttgtcatcgacgttacgccactgactctgggcatagagaccgtgggtggggtgatgaccaagctgatcccgaggaacacggtgattccgacgaagaagacgcaggtgttcaccacgtaccaggacaggcagaccacagtgagcatcatggtgttccagggcgagcgcagcatgaccaaggacaacgagctgctcggcaagtttgacctgtctgggatcccaccggcgccaaagggcacgccgcagatcgaggtgaccttcgaggtggacgtgaacggcatcctccacgtgaaggcggcggacaagggcaccggcaggtcggagaaggtcaccatcacgagcgacgcccgccgggtcagccaggaggagatggaccggatggtgcacgaggcggaggagttcgcggaggaggaccggaaggcgagggagcgggtcgacgcgcgcaacaagctggagacgtacgtctaccaggtgaagagcgcggtggtggacgacagcaacatggccgacaagatgaacgccgacgagaaggagaaggtggaggaggcagtcagggaggccaacgagtggatcgaagtgaactcggatgccgacaaggaggactacgaggagaagctcaaggagctagaggacgtgtgcagccctgtcatctcggcggtgtaccagaggtccggcggtggtgcaccggcagacgacacttacgatgaggatgaccatgatgagctttag

SEQ ID NO: 17091 - protein, 667 aa, Sorghum bicolor
  misc_feature: Useful for making plants with modulated heat sensitivity
  misc_feature: Functional homolog of the protein sequence given in SEQ ID NO 13726
  misc_feature: Useful for making plants with modulated drought sensitivity
  misc_feature: Functional homolog of the protein sequence given in SEQ ID NO 14080
  misc_feature: Ceres ANNOT ID no. 8669903
  misc_feature (43)..(647): Pfam ID: HSP70 Pfam Description: Hsp70 protein
MAARGGWTKLLFALLVAGLLPVVAPTRTYAAAAAEGGGARGTVIGIDLGTTYSCVGVYRNGRVEIIANDQGNRITPSWVAFTDGGERLIGEAAKNQAAANPERTIYDAKRLIGRQFDDAVVQRDMKLLSYDVVERNGKPHVRVQVREGDVRELSPEEVSAMVLTKMKETAEAYLGEKVTDAVVTVPAYFDDAQRQATKDAGTIAGLNVRRIINEPTAAAIAYGIDDKGPEKKVLVFDLGGGTFDVSILAIDNGVFEVLATNGDTHLGGEDFDQRVMDYFIKLIKRRHGRDISGDARALGKLRRECERAKRALSNQHQVRVEIEALFDGVDISEQLTRARFEELNSDLFRKTMVPVKKAMADARLQKSDIDEIVLVGGSTRIPKVQQLLKDYFNGKEPSRGINPDEAVAYGAAVQGGILSGHGESMLVIDVTPLTLGIETVGGVMTKLIPRNTVIPTKKTQVFTTYQDRQTTVSIMVFQGERSMTKDNELLGKFDLSGIPPAPKGTPQIEVTFEVDVNGILHVKAADKGTGRSEKVTITSDARRVSQEEMDRMVHEAEEFAEEDRKARERVDARNKLETYVYQVKSAVVDDSNMADKMNADEKEKVEEAVREANEWIEVNSDADKEDYEEKLKELEDVCSPVISAVYQRSGGGAPADDTYDEDDHDEL

SEQ ID NO: 17092 - DNA, 1164 bp, Sorghum bicolor
  misc_feature: Ceres ANNOT ID no. 8669917
  misc_feature: Encodes the peptide sequence at SEQ ID NO 17093
atggacgccagcagcccggccccgccgctcctcctccgcgcccccactcccagtcccagcattgacctccccgctgccgctggcaaggccgcggccgtgttcgacctgcggcgggagcccaagatcccggcgccattcctgtggccgcacgaggaggcgcgcccgacctcggccgcggagctggaggttccggtggtggacgtgggcgtgctgcgcaatggcgaccgcgcggggctgcggcgcgccgcggcgcaggtggcctcggcgtgcgcgacgcacgggttcttccaggtgtgcgggcacggcgtggacgcggccctggggcgcgccgcgctggacggcgccagcgacttcttccggctgccgctggccgacaagcagcgcgcccggcgcgtccccggcaccgtgtccgggtacacgagcgcgcacgccgaccggttcgcgtccaagctcccctggaaggagaccctgtccttcggcttccacgacggcgccgcgtcgcccgtcgtcgtggactacttcaccggcaccctcggccaagatttcgagccaatggggcgggtgtaccagaggtactgcgagaagatgaaggagctgtcgctgacgatcatggagctgctggagctgagcctgggcgtggagcgcggctactaccgggagttcttcgaggacagccgctccatcatgcggtgcaactactacccgccgtgcccggagccggagcgcacgctgggcacgggcccgcactgcgaccctacggcgctgaccatcctcctgcaggacgacgtcggcgggctggaggtgctggtggacggcgagtggcgccccgtccggcccgtcccaggcgccatggtcatcaacatcggcgacaccttcatggcgctgtcgaacgggcggtacaagagctgcctgcaccgcgcggtggtgaaccagcggcaggagcggcggtcgctggccttcttcctgtgcccgcgcgaggaccgggtggtgcggccgccggccagcagcgccacgccgcggcagtacccggacttcacctgggccgacctcatgcgcttcacgcagcgccactaccgcgccgacacccgcacgctggacgccttcacccgctggctctcccacggcccagtcccagcccaggaggcggcggctccctgcacctag

SEQ ID NO: 17093 - protein, 387 aa, Sorghum bicolor
  misc_feature: Useful for making plants with modulated biotic stress sensitivity
  misc_feature: Useful for making plants with modulated flowering time
  misc_feature: Functional homolog of the protein sequence given in SEQ ID NO 14066
  misc_feature: Ceres ANNOT ID no. 8669917
  misc_feature (24)..(365): SWISSPROT Homolog: EC 1.14.11.15 Gibberellin 3-beta-dioxygenase
  misc_feature (225)..(324): Pfam ID: 2OG-FeII_Oxy Pfam Description: 2OG-Fe(II) oxygenase superfamily
MDASSPAPPLLLRAPTPSPSIDLPAAAGKAAAVFDLRREPKIPAPFLWPHEEARPTSAAELEVPVVDVGVLRNGDRAGLRRAAAQVASACATHGFFQVCGHGVDAALGRAALDGASDFFRLPLADKQRARRVPGTVSGYTSAHADRFASKLPWKETLSFGFHDGAASPVVVDYFTGTLGQDFEPMGRVYQRYCEKMKELSLTIMELLELSLGVERGYYREFFEDSRSIMRCNYYPPCPEPERTLGTGPHCDPTALTILLQDDVGGLEVLVDGEWRPVRPVPGAMVINIGDTFMALSNGRYKSCLHRAVVNQRQERRSLAFFLCPREDRVVRPPASSATPRQYPDFTWADLMRFTQRHYRADTRTLDAFTRWLSHGPVPAQEAAAPCT

SEQ ID NO: 17094 - DNA, 576 bp, Sorghum bicolor
  misc_feature: Ceres ANNOT ID no. 8669941
  misc_feature: Encodes the peptide sequence at SEQ ID NO 17095
atgatgaggcgcgcggagcccgtcggcgaggcggcggacgcggagcggcgggggcgcggtggctacaagggcgtgcggcggcggcggtgggggaagtgggtgtcggagatccgcgtgcccggcacgcgggagcgcctgtggctcggatcctacgccacgcccgaggccgccgccgtcgcgcacgacacggccgtctacttcctccgcggcggcaccggggccggggccgggaccggcgcgggcgtcgcaggaggcggcgacgtcgcggcgctcaacttccccgagcgcgcggcggccgcgtacggcaccggtgccggcgccggcgccgcggggcggctgtcgccgcggtccgtgcagcgcgtggcgtccgacgccggcatggcagctgacgctcaactcgtggcggcgcgggagagcgcgcccgcgcccgcgctggcgcacgcccatcgcaccggcattggcatcggcagcgcgcaagtcggtggcgccagcgcacacgcacgaccgggcgcgggaagggagcagcctgctgtctccggggaaattaacgttgatgacatggagattctgatgtaa

SEQ ID NO: 17095 - protein, 191 aa, Sorghum bicolor
  misc_feature: The sequence is a functional homolog of SEQ ID NO 505 in the 10/374,780 US patent application
  misc_feature: The sequence is a functional homolog of SEQ ID NO 703 in the 10/666,642 US patent application
  misc_feature: Ceres ANNOT ID no. 8669941
  misc_feature (20)..(71): Pfam ID: AP2 Pfam Description: AP2 domain
MMRRAEPVGEAADAERRGRGGYKGVRRRRWGKWVSEIRVPGTRERLWLGSYATPEAAAVAHDTAVYFLRGGTGAGAGTGAGVAGGGDVAALNFPERAAAAYGTGAGAGAAGRLSPRSVQRVASDAGMAADAQLVAARESAPAPALAHAHRTGIGIGSAQVGGASAHARPGAGREQPAVSGEINVDDMEILM

SEQ ID NO: 17096 - DNA, 1221 bp, Sorghum bicolor
  misc_feature: Ceres ANNOT ID no. 8669987
  misc_feature: Encodes the peptide sequence at SEQ ID NO 17097
atggccatggccaagcccgtcctgagcttgctcgtgcacctgcacgccgccctcctgttcctgcccgacccggccggcggcgcagtgtacaacgtgctgcgctacggcgcccgccccgacggcgcgacggacgcggcgggccctttcctccgcgcgtgggcggacgcctgccgctcgccccggccggccaccgtgtacgtgccgcccggcaggtacctggtgcggagcgccacgttcaccgggccgtgccacagcagcgccgtgacgttcgccatcgccggcacggtcgtcgcccccgcgcgctacggcgcgcgcggctcgtcggggcggtggatcacgttcgagaacatggacggcctcgtcgtctccggcggcggcacgctggacggccgcggtagggcgctctgggcctgcagacggcgcggcgggcagcgcgactgtccgaaccccacgtcgcgcatgcagtctctgacgatcgccaactcgaggaacgtggtggtagccggcgtgcggtcggtggacagcgagctgttccacgtggtggtgctgcagtgccacggcgtgacggtgcgcggggtgacggtggaggcgccggcggacagccccaacaccgacgggatccacatgcacatgtccagccatgtgtcggtgtacgacgccaggatcagcaccggcgacgactgcatttccatcggccccgggaactctcacctctggatcgagcgcgtcgcctgcggccccggccacggcatcagcattgggagcctgggcaagcagcagggcatggaggtggaggcggtgcagaacgtgacggtgaagacgacgtggttcaccggcaccatgaacgggctgcggatcaagacgtggggcggctccaagcgcggcttcgtcacgggcgtcaccttcgcggactccaccatgtccggcgtcgacaaccccatcatcatcgaccagaactactgccccgacagcagcggctgccccggcgccggcaggagctccagcatcaggatcagcgacgtgcggtacgtgggcatccggggctcgtcggcgacgccggtggccgtcaacttcgactgcagccggagcaacccctgcagcggcatcagcctgcaggacgtggcgctgacgtaccagaaccggcccgccgccgccaagtcctactgccggaacgtgcaggggaccacgctcggcctcgtgctgcccccgagctgcctctga

SEQ ID NO: 17097 - protein, 406 aa, Sorghum bicolor
  misc_feature: Useful for making plants with altered cell wall content and/or composition
  misc_feature: Functional homolog of the protein sequence given in SEQ ID NO 13915
  misc_feature: Ceres ANNOT ID no. 8669987
  misc_feature (25)..(406): SWISSPROT Homolog: EC 3.2.1.15 Polygalacturonase
  misc_feature (57)..(405): Pfam ID: Glyco_hydro_28 Pfam Description: Glycosyl hydrolases family 28
MAMAKPVLSLLVHLHAALLFLPDPAGGAVYNVLRYGARPDGATDAAGPFLRAWADACRSPRPATVYVPPGRYLVRSATFTGPCHSSAVTFAIAGTVVAPARYGARGSSGRWITFENMDGLVVSGGGTLDGRGRALWACRRRGGQRDCPNPTSRMQSLTIANSRNVVVAGVRSVDSELFHVVVLQCHGVTVRGVTVEAPADSPNTDGIHMHMSSHVSVYDARISTGDDCISIGPGNSHLWIERVACGPGHGISIGSLGKQQGMEVEAVQNVTVKTTWFTGTMNGLRIKTWGGSKRGFVTGVTFADSTMSGVDNPIIIDQNYCPDSSGCPGAGRSSSIRISDVRYVGIRGSSATPVAVNFDCSRSNPCSGISLQDVALTYQNRPAAAKSYCRNVQGTTLGLVLPPSCL

SEQ ID NO: 17098 - DNA, 1569 bp, Sorghum bicolor
  misc_feature: Ceres ANNOT ID no. 8669985
  misc_feature: Encodes the peptide sequence at SEQ ID NO 17099
atggcaccagctctgaggctgcttcttgcatttctggcgattggatcctgcatcgctgctgacaacatcgacttgtggccgatgccacagtcggtgtcccacggaacacagaagctctacatcaagaaagatatcacaatgtccatggtgggaagcacctattctgatgagaaatcaatcttgaaggacgccttccagaggatggttgatttgatcacactgaaccatgtcgttgatggaacaaacccaagttcttcggttctcacttgtgttaatatagttgtccatacacctgaagatgagcttagctttggggcagatgagtcatacaacttaactgttccaacaacaggagatccactgtatgcacagatccaggctcaaactgtttttggagcacttcaagccttgcagacatttagtcagttatgttactttgatttcacatcacggctcattggactcaactctgctccttggataattaccgacagacccagatttccttaccggggattgcttattgatactgcgagacattacctccctgttaagataatcaaaggagtgattgatgcaatggcttacagcaaattgaatgttctccattggcatatcgtggacgagcagtcatttcccattgaaataccttcataccccaaattgtggaacggttcatactcttattcagagagatatacaacgtctgatgctattgacattgtacggtatgctgaaaagcgaggtgtaaatgtgttggcggagattgatgttcctggccatgctcgctcatggggtgtcggttacccatcattatggccatcagaaagctgcagagaaccacttgatgtcagtaaaaactttacatttgaagtcatcaatggcattctttcaggtgattttagcaagatttttaagttcaaatttgtgcacttaggcggtgatgaagtcaatacaagctgctggaccacaacaccccatattgaaggatggttgaataataaccatatgaatgtatcagacgcatacagagattttgtattaagatctcaaaagatagcgatatcacatggctatgatatcataaactgggaagagacatttaacagttttggagacaaattggaccctagaaccgtggtgcataactggcttggagaagatgtagcacccaaagtggttgctgcggggcataggtgtatagtaagcaaccaggataagtggtacctggatcacttggatgcctcatgggaaggattttacatgaatgagcccctaaaaggtatcaatgatacaaagcagcatcaactggtcattggtggtgaggtttgcatgtggggtgaggaaattgatgcctcagacattcagcaaacaatttggccacgtgctgcagcagctgcagagagactgtggactccgattgagaagcttgcaaatgacacaagatttgtcacatcaagattggcacgcttcaggtgtttgctgaaccaaagaggagtagctgctgcaccattagcaggttatggtcgtgcatcaccatcagaacctggcccttgtgtaaggcaataa

SEQ ID NO: 17099 - protein, 522 aa, Sorghum bicolor
  misc_feature: Useful for making plants with altered carbohydrate content
  misc_feature: Functional homolog of the protein sequence given in SEQ ID NO 14475
  misc_feature: Ceres ANNOT ID no. 8669985
  misc_feature (25)..(508): SWISSPROT Homolog: EC 3.2.1.52 Beta-N-acetylhexosaminidase
  misc_feature (168)..(474): Pfam ID: Glyco_hydro_20 Pfam Description: Glycosyl hydrolase family 20, catalytic domain
  misc_feature (37)..(166): Pfam ID: Glyco_hydro_20b Pfam Description: Glycosyl hydrolase family 20, domain 2
MAPALRLLLAFLAIGSCIAADNIDLWPMPQSVSHGTQKLYIKKDITMSMVGSTYSDEKSILKDAFQRMVDLITLNHVVDGTNPSSSVLTCVNIVVHTPEDELSFGADESYNLTVPTTGDPLYAQIQAQTVFGALQALQTFSQLCYFDFTSRLIGLNSAPWIITDRPRFPYRGLLIDTARHYLPVKIIKGVIDAMAYSKLNVLHWHIVDEQSFPIEIPSYPKLWNGSYSYSERYTTSDAIDIVRYAEKRGVNVLAEIDVPGHARSWGVGYPSLWPSESCREPLDVSKNFTFEVINGILSGDFSKIFKFKFVHLGGDEVNTSCWTTTPHIEGWLNNNHMNVSDAYRDFVLRSQKIAISHGYDIINWEETFNSFGDKLDPRTVVHNWLGEDVAPKVVAAGHRCIVSNQDKWYLDHLDASWEGFYMNEPLKGINDTKQHQLVIGGEVCMWGEEIDASDIQQTIWPRAAAAAERLWTPIEKLANDTRFVTSRLARFRCLLNQRGVAAAPLAGYGRASPSEPGPCVRQ

SEQ ID NO: 17100 - DNA, 1329 bp, Sorghum bicolor
  misc_feature: Ceres ANNOT ID no. 8669961
  misc_feature: Encodes the peptide sequence at SEQ ID NO 17101
atgagcggcggcggcggcagcaggaacgagaacgggcacggcggcgccgcggctgccgcggcggcggcggcggtggtggcggcaggtggaggtggaggcggcgacgcgcacgaggacgacctggtgatgccggggttccggttccaccccacggaggaggagctcatcgagttctacctccgccggaaggtggagggcaagcgcttcaacgtcgagctcatcaccttcctcgacctctaccgctacgacccatgggagctccctgcaatggccgcgattggggagaaggagtggttcttctacgtgccgagggaccgcaagtaccggaacggggacaggcccaaccgggtgacggcgtcgggctactggaaggccacgggcgccgaccgcaccatcaaggccgacaacagcagccgccccatcggcctcaagaagacgctcgtcttctactccggcaaggcgcccaagggcgtccgaagcagctggatcatgaacgagtaccgcctcccgcaagaccacaccgaccgctaccacaagaccgaaatatccctctgccgcgtgtacaagcgcaccgggatcgacgacggccacgggcatcatcccgccacggcgcgctcgacgacgccctcccgcggcgccacggcggcacagcagcaagataacaagcaagcgtcgtcgtcgtcgacgccgacgccgcccacgaccccgtccaagatgatgcaccttctccacggcgagtgcacgtcgccgcccacggccatctgcaggaacaacaatcacgccgcggcggcacacagcgacaacaagacggcggcggagccacggcaacagcagctccccatcaagccgtactgcaacggctaccaccaccagctgtccacggcgagctctaccaccgccgccgcggcccgcgatcagcagcaggctgcaatgggaaccgcggcggtgtcgtcgtcgtcgtcgtacgagcagtcgtccaggaacgcgaactacgcgttcgccgcgtcgacctactccctgctcagcctggtgaacgcggcctccatgggcgggtccgggtctgccgcggccatcgacgagctcagcacgctggtggggcacgtgcacggccagccgacgtacttcaaccaccagcccggaggcggcggtcacggccacagcttcctccctggcctgacgacgccgtcgtcgcagcagccgccaatggcggcgctcgggacgctacccatgtccctggccgccatatctgacaagatgatctgggactggaacccgatcgtccccgacgcggcggctagagatttcagcaccggcggcggattcaagtga

SEQ ID NO: 17101 - protein, 442 aa, Sorghum bicolor
  misc_feature: The sequence is a functional homolog of SEQ ID NO 1036 in the 10/225,066 US patent application
  misc_feature: The sequence is a functional homolog of SEQ ID NO 216 in the 10/666,642 US patent application
  misc_feature: The sequence is a functional homolog of SEQ ID NO 2608 in the 10/374,780 US patent application
  misc_feature: The sequence is a functional homolog of SEQ ID NO 658 in the 11/435,388 US patent application
  misc_feature: The sequence is a functional homolog of SEQ ID NO 880 in the 10/412,699 US patent application
  misc_feature: Useful for making plants with modulated water use efficiency
  misc_feature: The sequence is a functional homolog of SEQ ID NO 745 in the 11/479,226 US patent application
  misc_feature: The sequence is a functional homolog of SEQ ID NO 104 in the 10/225,068 US patent application
  misc_feature: The sequence is a functional homolog of SEQ ID NO 2014 in the 10/374,780 US patent application
  misc_feature: The sequence is a functional homolog of SEQ ID NO 22 in the 10/286,264 US patent application
  misc_feature: The sequence is a functional homolog of SEQ ID NO 314 in the 10/412,699 US patent application
  misc_feature: The sequence is a functional homolog of SEQ ID NO 734 in the 11/479,226 US patent application
  misc_feature: The sequence is a functional homolog of SEQ ID NO 328 in the 10/374,780 US patent application
  misc_feature: The sequence is a functional homolog of SEQ ID NO 852 in the 10/225,066 US patent application
  misc_feature: Useful for making plants with altered cell wall content and/or composition
  misc_feature: Useful for making plants with altered lignin content
  misc_feature: Functional homolog of the protein sequence given in SEQ ID NO 13620
  misc_feature: The sequence is a functional homolog of SEQ ID NO 2060 in the 10/374,780 US patent application
  misc_feature: The sequence is a functional homolog of SEQ ID NO 516 in the 10/412,699 US patent application
  misc_feature: The sequence is a functional homolog of SEQ ID NO 890 in the 10/374,780 US patent application
  misc_feature: The sequence is a functional homolog of SEQ ID NO 853 in the 10/374,780 US patent application
  misc_feature: Useful for making plants with modulated oxidative stress sensitivity
  misc_feature: Functional homolog of the protein sequence given in SEQ ID NO 13621
  misc_feature: The sequence is a functional homolog of SEQ ID NO 476 in the 10/666,642 US patent application
  misc_feature: The sequence is a functional homolog of SEQ ID NO 316 in the 10/412,699 US patent application
  misc_feature: The sequence is a functional homolog of SEQ ID NO 738 in the 11/479,226 US patent application
  misc_feature: The sequence is a functional homolog of SEQ ID NO 344 in the 10/666,642 US patent application
  misc_feature: The sequence is a functional homolog of SEQ ID NO 1170 in the 10/666,642 US patent application
  misc_feature: Ceres ANNOT ID no. 8669961
  misc_feature (42)..(170): Pfam ID: NAM Pfam Description: No apical meristem (NAM) protein
MSGGGGSRNENGHGGAAAAAAAAAVVAAGGGGGGDAHEDDLVMPGFRFHPTEEELIEFYLRRKVEGKRFNVELITFLDLYRYDPWELPAMAAIGEKEWFFYVPRDRKYRNGDRPNRVTASGYWKATGADRTIKADNSSRPIGLKKTLVFYSGKAPKGVRSSWIMNEYRLPQDHTDRYHKTEISLCRVYKRTGIDDGHGHHPATARSTTPSRGATAAQQQDNKQASSSSTPTPPTTPSKMMHLLHGECTSPPTAICRNNNHAAAAHSDNKTAAEPRQQQLPIKPYCNGYHHQLSTASSTTAAAARDQQQAAMGTAAVSSSSSYEQSSRNANYAFAASTYSLLSLVNAASMGGSGSAAAIDELSTLVGHVHGQPTYFNHQPGGGGHGHSFLPGLTTPSSQQPPMAALGTLPMSLAAISDKMIWDWNPIVPDAAARDFSTGGGFK

SEQ ID NO: 17102 - DNA, 1407 bp, Sorghum bicolor
  misc_feature: Ceres ANNOT ID no. 8670051
  misc_feature: Encodes the peptide sequence at SEQ ID NO 17103
atggaacggacgaactgccacactggacacagcgctctcggatctgcctcgccggctcgccccatgctctcccgtctcgctcgcgtgacaccaccctccattggccgacagggacgacacgccgtcgtggctgctcacgtgttctcaccctgcgctctcgccggccgaggcaagcgccgagtgtgccgccttccgctccgagcaaacgccaacgtcaggcgccaacgccatttattaatcgacaccccccaccgcaaccccaaagcccacgcttccgaattcaccaactcctcctcctcgcctcgtcgagatcgctctcacgccttccatagttccgctccagcaactccaccactcagcccgcccgccggagcaatggggagcacggggcgcgacccggaggtgacccgcgccgacttccccgacggcttcgtcttcggcgtcgccacctccgcgtaccagattgagggagcgagaagggagggaggcaaaggagacagcatatgggatgtatttacagatgacaaagaacgtgtcttagacaaaagcaatgcagaaattgcagttgaccactaccatcgatacaaggaagacattgagctcatggcaagtctaggttttagcgcgtacagattttctatatcttgggcacgtatatttcctgatggcttgggggaaaaggtcaatgagcaaggagtcgccttctacaatgacctcatcaactttatgatttcgaaaggtattgagccttacgcaactctgtatcattgggatcttccaaacaatcttcaaaaaactctggggggctggatttctgacaagattgtggagtactttgcattgtatgcagaagcttgctttgcaaattttggagacagagtaaagcgttggataacaatcaatgagcctctccaaactgcaatcaatggttatggtattggaatatttgcacctggtggatgccaaggtgaaactgcaagatgttacttggctgcccatcaccaaatcttggctcatgctgctgctgttgatgtttatagaagaaaattcaaggctgcacaaggtggtgaagtaggcttcgttgtggactgtgaatgggcagagcctttttctgaaaaagcggaagaccaaattgctgcacaacggaggattgactttcaacttggatggtacctagatccgatatattttggtgattacccagaaagcatgcgtcaacgactgggcagtgatcttccaaccttctcagagaaagataaagaattcatcaggaacaaaattgattttattggactgaatcattatacttcgagactcattgctcatcaccaaaatccagatgatgtttatttctaccaagtgcaacaaatggagagaataggtatggtacttcatcatgaaggatag

SEQ ID NO: 17103 - protein, 468 aa, Sorghum bicolor
  misc_feature: Useful for making plants with altered cell wall content and/or composition
  misc_feature: Functional homolog of the protein sequence given in SEQ ID NO 14476
  misc_feature: Ceres ANNOT ID no. 8670051
  misc_feature (135)..(450): SWISSPROT Homolog: EC 3.2.1.21 Beta-glucosidase
  misc_feature (136)..(468): Pfam ID: Glyco_hydro_1 Pfam Description: Glycosyl hydrolase family 1
MERTNCHTGHSALGSASPARPMLSRLARVTPPSIGRQGRHAVVAAHVFSPCALAGRGKRRVCRLPLRANANVRRQRHLLIDTPHRNPKAHASEFTNSSSSPRRDRSHAFHSSAPATPPLSPPAGAMGSTGRDPEVTRADFPDGFVFGVATSAYQIEGARREGGKGDSIWDVFTDDKERVLDKSNAEIAVDHYHRYKEDIELMASLGFSAYRFSISWARIFPDGLGEKVNEQGVAFYNDLINFMISKGIEPYATLYHWDLPNNLQKTLGGWISDKIVEYFALYAEACFANFGDRVKRWITINEPLQTAINGYGIGIFAPGGCQGETARCYLAAHHQILAHAAAVDVYRRKFKAAQGGEVGFVVDCEWAEPFSEKAEDQIAAQRRIDFQLGWYLDPIYFGDYPESMRQRLGSDLPTFSEKDKEFIRNKIDFIGLNHYTSRLIAHHQNPDDVYFYQVQQMERIGMVLHHEG

SEQ ID NO: 17104 - DNA, 1476 bp, Sorghum bicolor
  misc_feature: Ceres ANNOT ID no. 8670072
  misc_feature: Encodes the peptide sequence at SEQ ID NO 17105
atgaagacccggagctcagcgagaggggagccgaggcggctcgggaatgcggctctcctggcgctcatgctctgctccgtcgtcgcgctctccctcatccgggggaggttcgccccaattgttaccaccgcaggagacgccatcaaatccgaggacgacgctgctgcagcggcggtggcggtcagcaaggcggctgctgtcaacgttgacaccggcgacggcgccgacgaggccgccgctgaagctgctgctgaggagaaagacaaggaggaggtccagccgaagccagccgccgacggttcccgcggcggcgcagccaagccggtgtgctacgagacgagccgccgctccgacacctgcgaggcggctggcgacgtgcgcgtgttggggagctcccagacggtgtacgtcgactcgctggaccgggagtggaagaccaagccgtactgccggaagcacgacaacttcgcgctcgcccacgtcaaggagtggtccctcaagccgctcccctccggcgctgcgccgcagtgcacggtgaacagctcggccaccgcgttcgtgctctccacgggcggcttcacgggcaacccgttccacgactacacggacgtgctgatcccggccttcatcacggcgcacccgctccgcggcgaggtccagttcctggtcagcagctacaagtcgtggtggatgaaccgctacatccagatcttccagcagatgagccggcacgaggtggtggacatcgacgccgacgacgaggtccgctgctaccggaacgtggtggtggggccgacgttccaccgtgagctcggcgtggacgcgtccaagtccccgtcgccggggtactccacggccgacttccgcaagatgctgcgcgacgcgttcgggctggagcgcgccacggccacgcccagcggcgaccggtgggacatccggcgccggccgcggctgctcatcatctcgcgccgcccgtcccgcgggcgcgccttcatgaacgagcgcgccatggcggacatggcggcgagcctcgggttcgacgtgcggatcggggagcccgacagcagcaccgacacgtccaagttcgcgcggctggtgaactcgtgcgacgtgatggtgggcgtccacggcgccgggctcaccaacatggtgttcctgccggccggcgccgtggtggtgcaggtggtgccgtacgggcggctggagtggctggcccggaacacgttcgcggagccgtcggcggggatggaggtccactacctggagtacgtggtgcagctggacgagacgacgctgagcgagcagtacccgagcgatcacccggtgctgagggaccccatggccatccacaagcaggggtggaacgcgctcaagaccacgtacctggacaagcagaacgtgcgcccgcacctgggccgcctcaagaacaccttcctacaggcgctcaagatgctgccgcacggccgggacgattga

SEQ ID NO: 17105 - protein, 491 aa, Sorghum bicolor
  misc_feature: Useful for making plants with altered carbohydrate content
  misc_feature: Functional homolog of the protein sequence given in SEQ ID NO 14477
  misc_feature: Ceres ANNOT ID no. 8670072
MKTRSSARGEPRRLGNAALLALMLCSVVALSLIRGRFAPIVTTAGDAIKSEDDAAAAAVAVSKAAAVNVDTGDGADEAAAEAAAEEKDKEEVQPKPAADGSRGGAAKPVCYETSRRSDTCEAAGDVRVLGSSQTVYVDSLDREWKTKPYCRKHDNFALAHVKEWSLKPLPSGAAPQCTVNSSATAFVLSTGGFTGNPFHDYTDVLIPAFITAHPLRGEVQFLVSSYKSWWMNRYIQIFQQMSRHEVVDIDADDEVRCYRNVVVGPTFHRELGVDASKSPSPGYSTADFRKMLRDAFGLERATATPSGDRWDIRRRPRLLIISRRPSRGRAFMNERAMADMAASLGFDVRIGEPDSSTDTSKFARLVNSCDVMVGVHGAGLTNMVFLPAGAVVVQVVPYGRLEWLARNTFAEPSAGMEVHYLEYVVQLDETTLSEQYPSDHPVLRDPMAIHKQGWNALKTTYLDKQNVRPHLGRLKNTFLQALKMLPHGRDD

SEQ ID NO: 17106 - DNA, 1857 bp, Sorghum bicolor
  misc_feature: Ceres ANNOT ID no. 8670071
  misc_feature: Encodes the peptide sequence at SEQ ID NO 17107
atggctactgtgaacaactggctcgctttctccctctccccgcaggagctgccgcccacccagacggactccaccctcatctctgccgccaccaccgacgatgtctccggcgatgtctgcttcaacatcccccaagattggagcatgaggggatccgagctttcggcgctcgtcgccgagccgaagctggaggacttcctcggcggaatctccttctccgacggcagcatcgggctgtccatgatcaagaactggctgcggagccaaccagctcccatgcagccgagggtggcggcggctgagagcgtgcaggggctctctttgtccatgaacatggcgggggcgacgcaaggcgccgctggcatgccacttcttgctggagagcgcggccgggcgcccgagagtgtctcgacgtcggcacagggtggagccgtcgtcacggctccaaaggaggatagcggtggcagcggtgttgccgccaccggcgccctagtagccgtgagcacggacacgggtggcagcggcgcgtcggctgacaacacggcaaggaagacggtggacacgttcgggcagcgcacgtcgatttaccgtggcgtgacaaggcatagatggactgggagatatgaagcacatctgtgggacaacagttgcagaagggaaggacaaactcgcaagggtcgtcaaggtggctatgataaagaggagaaagctgctagggcttatgatctggctgctcttaagtactggggtcccacgacaacaacaaattttccagtgaataactacgaaaaggagctggaggatatgaagcacatgacaaggcaggagtttgtagcgtctctgagaaggaagagcagtggtttctccagaggtgcatccatttacaggggagtgactaggcatcaccagcatggaagatggcaagcacggattggacgagttgcagggaacaaggatctctacttgggcaccttcagcacgcaggaggaggcagcggaggcatacgacattgcggcgatcaagttccgcggcctcaacgccgtcacaaacttcgacatgagccgctacgacgtcaagagcatcctggacagcagtgcgctccccatcggcagcgccgccaagcgtctcaaggaggccgaggccgccgcgtccgcacagcaccatgccggcgtggtgagctacgacgtcggccgcatagcctcacagctcggcgacggcggcgccctggcggcggcgtacggcgcgcactaccatggcgcctggccgaccatcgcgttccagccgagcgcggccacgggcctgtaccacccgtacgcgcagccgatgcgcgggtggtgcaagcaggagcaggaccacgcggtgatcgcggccgcgcacagcctgcaggagctccaccacctgaacctgggtgctgccgccggcgcgcacgacttcttctcggcggggcagcaggcggcgatgcacggcctgggtagcatggacaatgcatcactcgagcacagcaccggctccaactccgtcgtgtacaacggtgttggtgatagcaacggcagcaccgtcgtcggcagtggtggctacatgatgcctatgagcgctgccacggcgacggctaccacggcaatggtgagccacgagcaggtgcatgcacgggcacagggtgatcaccacgacgaagccaagcaggctgctcagatggggtacgagagctacctggtgaacgcagagaactatggcggcgggaggatgtctgcggcctgggcgactgtctcagcgccaccggcggcaagcagcaacgataacatggcggacgtcggccatggcggcgcacagctcttcagtgtctggaacgatacttaa

SEQ ID NO: 17107 - protein, 618 aa, Sorghum bicolor
  misc_feature: Useful for making plants with altered lignin content
  misc_feature: Useful for making plants with modulated drought sensitivity
  misc_feature: Functional homolog of the protein sequence given in SEQ ID NO 14199
  misc_feature: The sequence is a functional homolog of SEQ ID NO 320 in US patent 7157621
  misc_feature: The sequence is a functional homolog of SEQ ID NO 1314 in the 10/374,780 US patent application
  misc_feature: The sequence is a functional homolog of SEQ ID NO 1459 in the 10/412,699 US patent application
  misc_feature: The sequence is a functional homolog of SEQ ID NO 1313 in the 10/374,780 US patent application
  misc_feature: The sequence is a functional homolog of SEQ ID NO 1458 in the 10/412,699 US patent application
  misc_feature: The sequence is a functional homolog of SEQ ID NO 1070 in the 10/225,066 US patent application
  misc_feature: The sequence is a functional homolog of SEQ ID NO 140 in the 11/375,241 US patent application
  misc_feature: The sequence is a functional homolog of SEQ ID NO 1904 in the 10/412,699 US patent application
  misc_feature: The sequence is a functional homolog of SEQ ID NO 2164 in the 10/374,780 US patent application
  misc_feature: The sequence is a functional homolog of SEQ ID NO 458 in the 11/435,388 US patent application
  misc_feature: The sequence is a functional homolog of SEQ ID NO 1310 in the 10/374,780 US patent application
  misc_feature: The sequence is a functional homolog of SEQ ID NO 1312 in the 10/374,780 US patent application
  misc_feature: The sequence is a functional homolog of SEQ ID NO 1455 in the 10/412,699 US patent application
  misc_feature: The sequence is a functional homolog of SEQ ID NO 1457 in the 10/412,699 US patent application
  misc_feature: Useful for biocontainment applications
  misc_feature: Functional homolog of the protein sequence given in SEQ ID NO 13650
  misc_feature: Ceres ANNOT ID no. 8670071
  misc_feature (293)..(345): Pfam ID: AP2 Pfam Description: AP2 domain
  misc_feature (194)..(251): Pfam ID: AP2 Pfam Description: AP2 domain
MATVNNWLAFSLSPQELPPTQTDSTLISAATTDDVSGDVCFNIPQDWSMRGSELSALVAEPKLEDFLGGISFSDGSIGLSMIKNWLRSQPAPMQPRVAAAESVQGLSLSMNMAGATQGAAGMPLLAGERGRAPESVSTSAQGGAVVTAPKEDSGGSGVAATGALVAVSTDTGGSGASADNTARKTVDTFGQRTSIYRGVTRHRWTGRYEAHLWDNSCRREGQTRKGRQGGYDKEEKAARAYDLAALKYWGPTTTTNFPVNNYEKELEDMKHMTRQEFVASLRRKSSGFSRGASIYRGVTRHHQHGRWQARIGRVAGNKDLYLGTFSTQEEAAEAYDIAAIKFRGLNAVTNFDMSRYDVKSILDSSALPIGSAAKRLKEAEAAASAQHHAGVVSYDVGRIASQLGDGGALAAAYGAHYHGAWPTIAFQPSAATGLYHPYAQPMRGWCKQEQDHAVIAAAHSLQELHHLNLGAAAGAHDFFSAGQQAAMHGLGSMDNASLEHSTGSNSVVYNGVGDSNGSTVVGSGGYMMPMSAATATATTAMVSHEQVHARAQGDHHDEAKQAAQMGYESYLVNAENYGGGRMSAAWATVSAPPAASSNDNMADVGHGGAQLFSVWNDT

SEQ ID NO: 17108 - DNA, 1086 bp, Sorghum bicolor
  misc_feature: Ceres ANNOT ID no. 8670079
  misc_feature: Encodes the peptide sequence at SEQ ID NO 17109
atgaacctgaaccgcctgacgccggcgcaccacggggcgatgcgtccgccctccgtgcaggggcaagggctggcgcggtacggctccgcgccgggctcgctcctggccgccatcgccgagtccgtgacccgcggcgaccccgcgccgccgccgccgcccgtgagccggttctactccgccgagtcatcggggctcacctcctgcgagtccagctgccgcaccgacggcggcggcggcggacgtccgcctccgctcgagcgggcgtacggcggctccggcgagatccgcgtgcctccgccgccgcagcagcagcacccgctggcggcttccacgctgttccgccacagcagctcccccgccgggctgctctcccgcctcatggccgacccgcacggaatggccgcgaccggaggagggatggggagctacccgcaggtgggcagcgacgccgcgatgggccacggccacaggcagctcagctcgcagtggagcttctccaggcaggacctgccgcagatctccgagatggggatgatacccgacatcggggagagcatcgtcgccggcggatgcaacagctccagcgaaggcggcggtggcggcgcgacgcaggcgcagtcctcctcctacctctccaggaacttctccgtcagctcctgggacgacaccaactccatcatgttctcgtcccccagcaagaagcctaaggtggaccccgccgatgacatggtcaccagcttcagcaacatcgactcgcagttcggcttgtccaactcgtccttggagatgtccggcatggacgactacctgcagatgcagcaggactccgtcgcctgcagagtccgtgccaagcgtggctgcgcaactcacccgcggagcattgccgagagggaaagaagaacaaggattagcaagaggctgaagaagctgcaagatcttgtgcccaacatggacaagcaaacaaatacgtcagacatgttggatcttgctgtagattacatcaaagagctgaaggaccgagtagagaagctaaaacacgaccaagcaaactgttgttgcctaggagtagccaacaagggctgctga

SEQ ID NO: 17109 - protein, 361 aa, Sorghum bicolor
  misc_feature: The sequence is a functional homolog of SEQ ID NO 1257 in the 10/412,699 US patent application
  misc_feature: The sequence is a functional homolog of SEQ ID NO 176 in the 10/714,887 US patent application
  misc_feature: The sequence is a functional homolog of SEQ ID NO 176 in the 11/435,388 US patent application
  misc_feature: The sequence is a functional homolog of SEQ ID NO 196 in the 10/714,887 US patent application
  misc_feature: The sequence is a functional homolog of SEQ ID NO 196 in the 11/435,388 US patent application
  misc_feature: The sequence is a functional homolog of SEQ ID NO 168 in the 10/714,887 US patent application
  misc_feature: The sequence is a functional homolog of SEQ ID NO 168 in the 11/435,388 US patent application
  misc_feature: The sequence is a functional homolog of SEQ ID NO 178 in the 10/714,887 US patent application
  misc_feature: The sequence is a functional homolog of SEQ ID NO 178 in the 11/435,388 US patent application
  misc_feature: The sequence is a functional homolog of SEQ ID NO 174 in the 10/714,887 US patent application
  misc_feature: The sequence is a functional homolog of SEQ ID NO 174 in the 11/435,388 US patent application
  misc_feature: The sequence is a functional homolog of SEQ ID NO 186 in the 10/714,887 US patent application
  misc_feature: The sequence is a functional homolog of SEQ ID NO 186 in the 11/435,388 US patent application
  misc_feature: The sequence is a functional homolog of SEQ ID NO 1926 in the 10/412,699 US patent application
  misc_feature: The sequence is a functional homolog of SEQ ID NO 194 in the 10/225,068 US patent application
  misc_feature: The sequence is a functional homolog of SEQ ID NO 238 in the 10/225,066 US patent application
  misc_feature: The sequence is a functional homolog of SEQ ID NO 40 in the 10/714,887 US patent application
  misc_feature: The sequence is a functional homolog of SEQ ID NO 40 in the 11/435,388 US patent application
  misc_feature: The sequence is a functional homolog of SEQ ID NO 446 in the 10/374,780 US patent application
  misc_feature: The sequence is a functional homolog of SEQ ID NO 194 in the 10/714,887 US patent application
  misc_feature: The sequence is a functional homolog of SEQ ID NO 194 in the 11/435,388 US patent application
  misc_feature: Ceres ANNOT ID no. 8670079
  misc_feature: Up-regulated in root tissues in response to salicylic acid treatment
  misc_feature (290)..(338): Pfam ID: HLH Pfam Description: Helix-loop-helix DNA-binding domain
MNLNRLTPAHHGAMRPPSVQGQGLARYGSAPGSLLAAIAESVTRGDPAPPPPPVSRFYSAESSGLTSCESSCRTDGGGGGRPPPLERAYGGSGEIRVPPPPQQQHPLAASTLFRHSSSPAGLLSRLMADPHGMAATGGGMGSYPQVGSDAAMGHGHRQLSSQWSFSRQDLPQISEMGMIPDIGESIVAGGCNSSSEGGGGGATQAQSSSYLSRNFSVSSWDDTNSIMFSSPSKKPKVDPADDMVTSFSNIDSQFGLSNSSLEMSGMDDYLQMQQDSVACRVRAKRGCATHPRSIAERERRTRISKRLKKLQDLVPNMDKQTNTSDMLDLAVDYIKELKDRVEKLKHDQANCCCLGVANKGC

SEQ ID NO: 17110 - DNA, 2085 bp, Sorghum bicolor
  misc_feature: Ceres ANNOT ID no. 8670089
  misc_feature: Up-regulated in root tissues in response to salicylic acid treatment
  misc_feature: Encodes the peptide sequence at SEQ ID NO 17111
atggccgagccgtgcccgcccggtgggatcgacccgcgcagcggcttctgcgccgcgacgcggaccttccacagcctgcgcccgtccaccgagctcccgccggactcgctcccggccaccgcggccgcctacgccttctccagcctctcgtccccgctccccgaccgccccgccctcgtcgacgccgccaccggcattgccgtctcctacccctccttcctcgccgccgtccgctccctcgcggggggcctctggtccgtcctcggccttcgccccggggacgtcgccctcgtcgtctccccttcccgcatcgacgtccccgtcatagacttcgcgctcatgtccatcggcgctgtcgtctcgcctgccaacccggcgtccaccgccgacgagtacgcgcacatggtcgcgctctccagaccggtcgtcgcgctcgcggcccccgaggtggccgctaagctgccgaggaacctcaggtgtgtcgtcatcggctcggatgagtacaagggcctctcctccgccggcggcgcggcgcctcccccgccggtggcggtgaagcagtccgacacggcggccgtgctgtactcgtcgggcactacgggccgggtcaaggccgccgcggtctcgcaccgcaacctcatcgccctgctctgcgcgcacagggacatccgggctatggtggacaaggaggctgccgaggccggcgaggagccgcccccgcctacggtgacgctgttccctctcccgctcttccacgtgttcggcttcatgatgatgctgaggtccgtggccatgggggagaccgccgtcctcatggaccgcttcgacttcgtcgccgcgctgcgcgccatcgagcggtaccgagtcaccctgctgcccgcggcgcccccggtgctggtggccatgatcaagtccgaggaggcgcgccgccgcgacctctcctccctcatcgtcatcgggatcggcggcgcgccactcggccgcgaggtcgccgagcgcttcgccgccatcttccccaacatcgaactcgtccagggctacggtctgacggagtcatctggctccgtggcttcgacggtcgggccagatgagtgcaaagcgtacggttcggtcgggaagctggcatcgcacttggaggcgaagatcgtcgatccctccaccggcgaggcgctggggcctgggcagcgcggcgagctctgggtccggggaccagttgtcatgaaaggttatgtgggtgacgacgaggctactgcagcaacagttgattcagaaggctggttgaaaactggtgacctatgctacttcaatgaggatgggtttctctacattgttgatcggttgaaagagttgataaaatacaagggatatcaggtacctccagccgaactggagcatatcctgaattctcatcctgatatcatggatgcagcagttattccgtacccagacgaagatgtcgggcaactaccaatggcttttatagtgaggaaaccaggctcaaaccttaccaagcaacaagtcatggatttcgtggctaaacaggtcgcaccgtacaagaaagtccgtcgagtggcctttgtttctgcaattcccaaatcgcctgctgggaagatcttgcggcgggagcttgtagagcaggccgtgtccatgattgcttcgctaagagaatttcaaacttttgaggacaagaccagcgccattaaccatgttactggtgttaacgaacaacttgctaaaatgatctgggataacatcgttcctgatcagaagctagatgttggaagcctgaatataaagaaatcattgaagactgctgttaagtattgggtcaagatgatatttatctctatgaaatgttcgttttggctgcaaatttctgtgatcaagtgtttgctgtttattattgccatattggtgatgttcatctcaaatattgctgttcagattcagtcagcgttccttttggctctgttctttagttttccatgttctcttcttcaattcgttgctgccaataaccgggaacagatgggggtgggggggtggggggtggggggcttcctgcttatatacataggcgcctga

SEQ ID NO: 17111 - protein, 694 aa, Sorghum bicolor
  misc_feature: Useful for making plants with altered cell wall content and/or composition
  misc_feature: Functional homolog of the protein sequence given in SEQ ID NO 14478
  misc_feature: Ceres ANNOT ID no. 8670089
  misc_feature (189)..(543): SWISSPROT Homolog: EC 6.2.1.12 4-coumarate--CoA ligase
  misc_feature (69)..(478): Pfam ID: AMP-binding Pfam Description: AMP-binding enzyme
MAEPCPPGGIDPRSGFCAATRTFHSLRPSTELPPDSLPATAAAYAFSSLSSPLPDRPALVDAATGIAVSYPSFLAAVRSLAGGLWSVLGLRPGDVALVVSPSRIDVPVIDFALMSIGAVVSPANPASTADEYAHMVALSRPVVALAAPEVAAKLPRNLRCVVIGSDEYKGLSSAGGAAPPPPVAVKQSDTAAVLYSSGTTGRVKAAAVSHRNLIALLCAHRDIRAMVDKEAAEAGEEPPPPTVTLFPLPLFHVFGFMMMLRSVAMGETAVLMDRFDFVAALRAIERYRVTLLPAAPPVLVAMIKSEEARRRDLSSLIVIGIGGAPLGREVAERFAAIFPNIELVQGYGLTESSGSVASTVGPDECKAYGSVGKLASHLEAKIVDPSTGEALGPGQRGELWVRGPVVMKGYVGDDEATAATVDSEGWLKTGDLCYFNEDGFLYIVDRLKELIKYKGYQVPPAELEHILNSHPDIMDAAVIPYPDEDVGQLPMAFIVRKPGSNLTKQQVMDFVAKQVAPYKKVRRVAFVSAIPKSPAGKILRRELVEQAVSMIASLREFQTFEDKTSAINHVTGVNEQLAKMIWDNIVPDQKLDVGSLNIKKSLKTAVKYWVKMIFISMKCSFWLQISVIKCLLFIIAILVMFISNIAVQIQSAFLLALFFSFPCSLLQFVAANNREQMGVGGWGVGGFLLIYIGA

SEQ ID NO: 17112 - DNA, 1680 bp, Sorghum bicolor
  misc_feature: Ceres ANNOT ID no. 8670110
  misc_feature: Encodes the peptide sequence at SEQ ID NO 17113
atggagatggaggccgtggaatcaaatggctcacacggcgccgccgatcgccggacacccaagagggaccaccgcatcttctgggcctccgtcttcatcctcgcgaataactgcttccagtgcatcgcctacttcggcgtgtcgacgaacctagtgaactacctcaaggaccagctgcacgagggcagcaaggccgccgcgaacggcgtcaccaactggctgggcacgagctccatcacgccgctcgtcgccgccttcctcgccgacgccttcctcggcagatactggaccatcgcgctcttcatggtcatctccgtcgtggcctacgtggtgctgacggtgagcgcagcggtggcgctggagagcgcggccttctacgcggggctgtacctgctggcgctgggcggcgcgctgcagccggtgctgtcgtcgttcggcgcgaaccagttcgacgagtccgacgagggggagcgcgggcggcagagctccttcttcaactggttctacctctccatcaacgtcggctcgctggtcggcggcaccgtgctggtgtgggtgcagtccagcgtcagctgggggctcggctacggaatcccggcgctcttcagcgtgctggccgccgcggtgttcctggccggcacaaccgcgtaccggcgccaccagccgccggccggcagcccgctcaccagggtcgcgcaggttgtcgtcgccgcattcaggaagtgcggcgtcgaggtgcccgaagacgcgtcgacgctgcacgagtgcgaggacgtcgacggcatgtccgcgatacaggggagtcgccggctcgcgcacaccgatcagttcaggttcctggacaaggcagcggtggagacggcggccgacaaggcggcgcgtccgtcgagctcgtggcgtctgtgcacggtgacgcaggtggaggagctcaagtgcgtgctccgcctgcttcccgtgtgggcgagcggcatcatcttcgcggcggcgtacacgcagatgaccaccaccttcatcctgcagggggacacgctggacccgtacgtgggcggcttccgcgtccccgccgccgtgctctccgtcttcgacaccctcagcgtcatgctgtgggtgccgctctacgaccgcgtcgtggtcccgctggcgcgccgcgccacgggccacgaccgcgggttcacgcagctggcgcgcatgggcgtgggcctcgtcgtgctcacgctcgccatgctcgccgcgggggcgctcgaggtggcgcggcgcggcgtcatcgcgcgccacggcatgtacgacaccaacaccggcggaggaggggacgacgggcggtacctgccgctgtccatcttctggcaggtgccgcagtacgtggtggtgggcgcgtcggaggtgttcacgttcatcgggcagatggagttcttctacgaccaggcgcccgacgcgatgcggagcctctgctcgggcctctccatgacgtccttcgcgctcggcaactacgtcagctccgcgctcgtcaccgtcgtggcgcgcgccaccgcgcggggcggacgggacgggtggatccccgacgacatcaaccgggcgcacctcgactacttcttctggctgctcgccatgctctgcgtcggcaacttcggcgtctacctgctcatcgcgcgctggtacacgtacaagaagagtgttgggtga

SEQ ID NO: 17113 - protein, 559 aa, Sorghum bicolor
  misc_feature: Useful for making plants with altered carbon content
  misc_feature: Useful for making plants with altered nitrogen content
  misc_feature: Functional homolog of the protein sequence given in SEQ ID NO 14117
  misc_feature: Ceres ANNOT ID no. 8670110
  misc_feature (95)..(491): Pfam ID: PTR2 Pfam Description: POT family
MEMEAVESNGSHGAADRRTPKRDHRIFWASVFILANNCFQCIAYFGVSTNLVNYLKDQLHEGSKAAANGVTNWLGTSSITPLVAAFLADAFLGRYWTIALFMVISVVAYVVLTVSAAVALESAAFYAGLYLLALGGALQPVLSSFGANQFDESDEGERGRQSSFFNWFYLSINVGSLVGGTVLVWVQSSVSWGLGYGIPALFSVLAAAVFLAGTTAYRRHQPPAGSPLTRVAQVVVAAFRKCGVEVPEDASTLHECEDVDGMSAIQGSRRLAHTDQFRFLDKAAVETAADKAARPSSSWRLCTVTQVEELKCVLRLLPVWASGIIFAAAYTQMTTTFILQGDTLDPYVGGFRVPAAVLSVFDTLSVMLWVPLYDRVVVPLARRATGHDRGFTQLARMGVGLVVLTLAMLAAGALEVARRGVIARHGMYDTNTGGGGDDGRYLPLSIFWQVPQYVVVGASEVFTFIGQMEFFYDQAPDAMRSLCSGLSMTSFALGNYVSSALVTVVARATARGGRDGWIPDDINRAHLDYFFWLLAMLCVGNFGVYLLIARWYTYKKSVG

SEQ ID NO: 17114 - DNA, 750 bp, Sorghum bicolor
  misc_feature: Ceres ANNOT ID no. 8670142
  misc_feature: Encodes the peptide sequence at SEQ ID NO 17115
atggttgtgatcgagctggagcccgaggagccgacgcgcccctcgtcgccggcggcggaggagcaggcggccgccgcggccgccggggaggcggcgcgctcctcgtcttcaggggcgcccgaggaggtggccgccgccgccgccgctggcggggaggcgtcgagggcggcggaagaagaggaggaggcgttcgaggacgcgctcaccgacgagcagctgcgagagaaagctagaagccaagcaaatgatgcaaaagcagaaggaaacaagctttttggtggtggacaatatgaggaagcattatctcaatatgaaatggcattgcaaattgctgctgagctcgaatcttctgaggatatacgcgccgcatgccattcaaatcgtgctgtgtgcttcctgaaattgggaaaacatgatgagacgattaaagaatgcacaaaagcacttgaactcaacccaacatacctggaagcctgcttcggagggcagaagcacatgaaaagcttgaacactatgatgaagctattgctggttattgaaatggatccttcaaatcaacaagctacaaggtctcttttccgacttgagcccctggcagctgagaagagggaaaagatgaaggaagaaatgattggaaagctaaaagatctggggaactctgtgctggggcgcttcggaatgagtgttgacaatttcaaagccgttaaggacccaaacactggttcttacagcattcaattccagaagtaa

SEQ ID NO: 17115 - protein, 249 aa, Sorghum bicolor
  misc_feature: Useful for making plants with altered alkaloid content
  misc_feature: Useful for making plants with altered terpenoid content
  misc_feature: Functional homolog of the protein sequence given in SEQ ID NO 13192
  misc_feature: Ceres ANNOT ID no. 8670142
  misc_feature (70)..(196): SWISSPROT Homolog: EC 5.2.1.8 Peptidylprolyl isomerase
  misc_feature (122)..(155): Pfam ID: TPR_1 Pfam Description: Tetratricopeptide repeat
MVVIELEPEEPTRPSSPAAEEQAAAAAAGEAARSSSSGAPEEVAAAAAAGGEASRAAEEEEEAFEDALTDEQLREKARSQANDAKAEGNKLFGGGQYEEALSQYEMALQIAAELESSEDIRAACHSNRAVCFLKLGKHDETIKECTKALELNPTYLEACFGGQKHMKSLNTMMKLLLVIEMDPSNQQATRSLFRLEPLAAEKREKMKEEMIGKLKDLGNSVLGRFGMSVDNFKAVKDPNTGSYSIQFQK

SEQ ID NO: 17116 - DNA, 750 bp, Sorghum bicolor; identical to SEQ ID NO: 17114
  misc_feature: Ceres ANNOT ID no. 8670138
  misc_feature: Encodes the peptide sequence at SEQ ID NO 17117

SEQ ID NO: 17117 - protein, 249 aa, Sorghum bicolor; identical to SEQ ID NO: 17115
  misc_feature: Useful for making plants with altered alkaloid content
  misc_feature: Useful for making plants with altered terpenoid content
  misc_feature: Functional homolog of the protein sequence given in SEQ ID NO 13192
  misc_feature: Ceres ANNOT ID no. 8670138
  misc_feature (70)..(196): SWISSPROT Homolog: EC 5.2.1.8 Peptidylprolyl isomerase
  misc_feature (122)..(155): Pfam ID: TPR_1 Pfam Description: Tetratricopeptide repeat

SEQ ID NO: 17118 - DNA, 1674 bp, Sorghum bicolor
  misc_feature: Ceres ANNOT ID no. 8670216
  misc_feature: Encodes the peptide sequence at SEQ ID NO 17119
atgggtggctgctactccgtcatcgcggccaccaagctaaagatgctgcgccgcggaggccgtggtgccgccgccatcctccccgtcgacgccagccacgacgacgaagacccgtgctgctccccggaccacgacgacgtcgtcacatgcaaggagaggaagaaggagggcggtggcaggaagggcaggaagaagcagggctccatcctgggtgacgccggcaccgtcgacccggacttctcgcgacggtatcggctcggcgcggagctcgggcgcggcgagttcggcgtcacgcgacggtgcgaggacaccgccacgggggaggctctggcatgcaagacgctccggcggaagcggctgctcctgcggcgcgtcgggcccgacgcggacgacgtgcggcgcgaggtggagatcatgcggcgcatgtcggaggccggcgcgggcagggtggtgagcctgcgcgaggcgtgcgaggacgacgaaggtgtgcacctcgtcatggagctctgcgagggtggcgagctcttcgaccgcatcttcgagcgccagcattactctgaacgcgccgccgccaagctcgcccgcaccattgtcgaggtcgtgcagttgtgccacgagaacggagtgatgcacagggacctcaagccggagaacttcctgttcgtgaacaagtcggaggagtcgcctctaaaggccatcgacttcggcctctccgtgtacttcaagccgggggatcggttcaccgaagtggttggtagcgggtgttacatggctccagaggttctcaagagaagctatgggccagagatagacgtgtggagcgctggtgtcatcctgcacatccttctctgtgggttccctccgttttggggagactccgatgagaaaattgcacagtcgatactacggggagtaataaacttacagaaggatccatggcccaaggtctcccagagtgcaaaggatcttgtcaagaagatgcttgacccagatcctagtacacggttgacggcaaagcaagtccttgagcatccttggctcaagaatgctgataaggcttcaaatgtgtcactcggagaggttgttcggtcgaggctcaagcagttctcgtctatgaacaagtttaagaagaaggcacttggagtcgtcgccatgaatttaccgagggaagagattgacaaataccatcaaatgttccataccatggacaaggacaatgacggtaatttgtcacttgacgagctgaaggagggtttccggataaacggtcatcctgttccagaggaagagataaagatgctgttacaagcgggtgatatacatggaaatggcacgttagattgtgaggaatttgtaacagtcttacttcacattaaaaagatgagtaataacgactatctacctaaagctttcaagttcttcgacaaagacgggaatggttttattgaaatggctgagttgatggaggctctaggtgatggtgaactaaaatctaatgagcaagtggttaacgacattattcgtgaggttgacaaggacaaggatggacgtatcagctatccagagtttgaattgatgatgaagggtggatcggactggaggaatgcctctagaaggtactcaagagaaaatttcagtagcctcagtcgaaggctgtgcaaagatactttatga

SEQ ID NO: 17119 - protein, 557 aa, Sorghum bicolor
  misc_feature: The sequence is a functional homolog of SEQ ID NO 2 in US patent 7084323
  misc_feature: Ceres ANNOT ID no. 8670216
  misc_feature (81)..(555): SWISSPROT Homolog: EC 2.7.11.1 Non-specific serine/threonine protein kinase
  misc_feature (84)..(347): Pfam ID: Pkinase Pfam Description: Protein kinase domain
  misc_feature (502)..(530): Pfam ID: efhand Pfam Description: EF hand
  misc_feature (466)..(494): Pfam ID: efhand Pfam Description: EF hand
  misc_feature (394)..(422): Pfam ID: efhand Pfam Description: EF hand
MGGCYSVIAATKLKMLRRGGRGAAAILPVDASHDDEDPCCSPDHDDVVTCKERKKEGGGRKGRKKQGSILGDAGTVDPDFSRRYRLGAELGRGEFGVTRRCEDTATGEALACKTLRRKRLLLRRVGPDADDVRREVEIMRRMSEAGAGRVVSLREACEDDEGVHLVMELCEGGELFDRIFERQHYSERAAAKLARTIVEVVQLCHENGVMHRDLKPENFLFVNKSEESPLKAIDFGLSVYFKPGDRFTEVVGSGCYMAPEVLKRSYGPEIDVWSAGVILHILLCGFPPFWGDSDEKIAQSILRGVINLQKDPWPKVSQSAKDLVKKMLDPDPSTRLTAKQVLEHPWLKNADKASNVSLGEVVRSRLKQFSSMNKFKKKALGVVAMNLPREEIDKYHQMFHTMDKDNDGNLSLDELKEGFRINGHPVPEEEIKMLLQAGDIHGNGTLDCEEFVTVLLHIKKMSNNDYLPKAFKFFDKDGNGFIEMAELMEALGDGELKSNEQVVNDIIREVDKDKDGRISYPEFELMMKGGSDWRNASRRYSRENFSSLSRRLCKDTL

SEQ ID NO: 17120 - DNA, 444 bp, Sorghum bicolor
  misc_feature: Ceres ANNOT ID no. 8670225
  misc_feature: Encodes the peptide sequence at SEQ ID NO 17121
atggcggccttcaacaagcttggcagccttctaaggcacagtgctctggcgagcggtgtcgctgctagctcgtctcctgctgtgttcaatgctgctcggctcatgtccaccaagctattcgttggtggtctttcatggggtgttgatgacatgaaactgagagaggcgtttagtggctttggagatgttactgaagcgcgagtgatcacggacagggacactgggaagtcaagaggatttggctttgttaactacaccagcagtgatgctgccaatgcagctatatctggaatggatggcaaggaaattgatgggcggccggtacgtgtcaacattgctaacgacagacctgcagggaaccgcggtggaggtggctatggcggtggtggtttcggaggtggtggctatggtggtggcaaccaaagctatggtggtggctattaa

SEQ ID NO: 17121 - protein, 147 aa, Sorghum bicolor
  misc_feature: Useful for making plants with modulated biomass
  misc_feature: Functional homolog of the protein sequence given in SEQ ID NO 14026
  misc_feature: Useful for making plants with altered alkaloid content
  misc_feature: Functional homolog of the protein sequence given in SEQ ID NO 13848
  misc_feature: The sequence is a functional homolog of SEQ ID NO 1042 in the 10/374,780 US patent application
  misc_feature: The sequence is a functional homolog of SEQ ID NO 852 in the 10/666,642 US patent application
  misc_feature: Ceres ANNOT ID no. 8670225
  misc_feature (34)..(113): SWISSPROT Homolog: EC 5.2.1.8 Peptidylprolyl isomerase
  misc_feature (39)..(110): Pfam ID: RRM_1 Pfam Description: RNA recognition motif. (a.k.a. RRM, RBD, or RNP domain)
MAAFNKLGSLLRHSALASGVAASSSPAVFNAARLMSTKLFVGGLSWGVDDMKLREAFSGFGDVTEARVITDRDTGKSRGFGFVNYTSSDAANAAISGMDGKEIDGRPVRVNIANDRPAGNRGGGGYGGGGFGGGGYGGGNQSYGGGY

SEQ ID NO: 17122 - DNA, 3246 bp, Sorghum bicolor
  misc_feature: Ceres ANNOT ID no. 8670250
  misc_feature: Encodes the peptide sequence at SEQ ID NO 17123
atggcggggaacgagtggatcaatgggtacctggaggcgatcctcgacagccgcaccacggctgggggagggggaggaggaggcggcggcggcggcggcggggaccccaggtcgccggtggcgggggcgtcgccgacgaaggcggcgagcccccgcggcccgcacatgaacttcaacccctcgcactacttcgtcgaggaggtggtcaagggcgtcgacgagagcgacctccaccggacatggatcaaggtcgtcgccacacgcaacgcccgcgagcgcagcaccaggctcgagaacatgtgctggcggatctggcatctcgcgcgtaagaagaaacagctggagctggagggcatgcagagaatctcggcacgcaggaaggaacaggagcaggtgcgccgtgaggcgacggaggacctggctgaggatctggatgaaggcgagaaagcggacaccctcggcgagcttgcgccggttgagacagccaagaagaagttccagaggaacttctctgacctgaccgtctggtctgacgacaataaggagaagaagctttacattgtgctcatcagtgtgcatggtcttgttcgtggcgaaaacatggaactaggtcgtgattctgacaccggtggccaggtgaaatatgttgtcgaacttgcaagggcaatgtcaatgatgcctggagtgtacagggtggacctcttcactcgtcaagtgtcatctcctgacgtggactggagctatggtgagccaacggagatgttatgctccggttccaatgatggagaggggggcgagagtgccggagcctacattgtgcgcataccgtgtgggccacgcgataaatacctcaagaaggaagcgctgtggccttacctccaagaatttgtcgatggagctcttgcgcatatcctgaacatgtccaaggctctgggagagcaggttggaaatgggaagccagtactgccttacgtgatacatggacactatgccgatgctggagatgttgctgctctcctctccggtgcgctgaatgtgcccatggtgctcactggtcactcacttgggaggaacaagctggagcaactgctgaagcaagggcgcatgtctaaagcggagatagattcaacctacaagatcatgaggcgtatcgagggtgaggagctgtccctggatgcgtcagagcttgtcatcacgagcacaaggcaggagattgatgaacagtggggattatacgatggatttgacgtcaagcttgagaaagtgttgagagcccgggcgaggcgtggggttagctgccatggtcgtttcatgcctaggatggtggtgattcctccaggaatggacttcagcaatgttattcctgaagacattgatggggatggtgacagcaaagatgatatcgttggtttggaggttgcctcacccaagtcaatgcctccaatttgggctgaggtgatgcggttcctaaccaaccctcacaagccgatgatcctcgctttgtcaaggccagacccgaagaagaacatcactaccctcgtcaaagcgtttggagagtgccgcccactcagggaacttgcaaaccttactctgatcatggggaacagagatgacatcgacgaaatgtctgctgggaatgccagtgtcctcaccacagttctgaagctgattgacaagtatgatctgtatggaagtgtggccttccctaagcatcacaatcaggctgatgtcccagagatctaccgcctcgcggccaaaatgaagggcgtcttcatcaaccctgctctcgttgagccgttcggtctcaccctgatcgaggctgcggcacacggacttccaatagtcgctaccaagaatggtggtccagtcgacattacaactgcactgaacaatggactgctcgttgacccacacgaccagaacgccatcgctgatgcactgctgaagcttgtggcggataagaacctgtggcaggagtgccggagaaacgggctgcgcaacatccacctctactcatggccggagcactgccgcacttacctcaccagggtggctgggtgccggttaaggaacccgaggtggctgaaggacacaccggcagatgctggagctgatgatgaggagttcctggaggattccatggacgctcaggacctgtcactccgtctgtccatcgatggtgagaagagctccctgaacactaacgacccactgtcgtcggacccgcaggatcaggtgcagaagatcatgaacaagatcaagcagtcatcagcgcttccgccgtcgatgtcctcgggcggtgacggtgccaagaatgcagccgaggccacaggcggcaccatgaacaagtacccactcctgcgccggcgccggcgcctgttcgtcatagctgtggactgctacgaagacgatggccgtgctagcaagaagatgctgcaggtgatccaagaagttttcagagcagtccggtcggactcccagatgtccaagatctcagggttcgcgctgtcaactgcgatgccgttgtccgagacactccagcttctgaagctcggcaagatcccagcgaccgacttcgacgccctcatctgtggcagtggcagcgaggtgtactatcctggcacggtgaactgcatcgacgctgaaggaaagctgcgcccagaccaggactatctgatgcacatcagccaccgctggtcccatgacggcgcgaggcagaccatagcaaagctcatggccagtcaggacggttcagacgatgctgtcgagctggacgtggcgtccagcaatgcacactgcttcgcgttcctcatcaaagatcccaaaaaggtgaaaacggtcgatgagatgagagagaggctgaggatgcgtggtctccggtgccacatcatgtactgcaggaacgcgacaagacttcaggttgtccccctgctagcatcaaggtcacaggcactcaggtaccttttcgtgcgctggggcctatctgtggggaacatgtatctgatcactggggaacatggcgataccgatctagaggagatgctatctgggttacacaagactgtcatcgtccggggtgtcaccgagaagggttcggaagcgctgctgaggagctcgggaagttacaagagggacgacgtcgtcccgactgagacccccttggctgcgtacacgactggtgagctgaaggccgatgagatcatgcgggctctgaagcaggtctctaagacttccagcggcatgtga

SEQ ID NO: 17123 - protein, 1081 aa, Sorghum bicolor
  misc_feature: Useful for making plants with altered cell wall content and/or composition
  misc_feature: Functional homolog of the protein sequence given in SEQ ID NO 14479
  misc_feature: Useful for making plants with modulated biomass
  misc_feature: Useful for making plants with modulated carbohydrate content
  misc_feature: Functional homolog of the protein sequence given in SEQ ID NO 13827
  misc_feature: Useful for making plants with altered carbohydrate content
  misc_feature: Functional homolog of the protein sequence given in SEQ ID NO 13828
  misc_feature: Ceres ANNOT ID no. 8670250
  misc_feature (1)..(1081): SWISSPROT Homolog: EC 2.4.1.14 Sucrose-phosphate synthase
  misc_feature (484)..(667): Pfam ID: Glycos_transf_1 Pfam Description: Glycosyl transferases group 1
  misc_feature (790)..(1042): Pfam ID: S6PP Pfam Description: Sucrose-6F-phosphate phosphohydrolase
MAGNEWINGYLEAILDSRTTAGGGGGGGGGGGGGDPRSPVAGASPTKAASPRGPHMNFNPSHYFVEEVVKGVDESDLHRTWIKVVATRNARERSTRLENMCWRIWHLARKKKQLELEGMQRISARRKEQEQVRREATEDLAEDLDEGEKADTLGELAPVETAKKKFQRNFSDLTVWSDDNKEKKLYIVLISVHGLVRGENMELGRDSDTGGQVKYVVELARAMSMMPGVYRVDLFTRQVSSPDVDWSYGEPTEMLCSGSNDGEGGESAGAYIVRIPCGPRDKYLKKEALWPYLQEFVDGALAHILNMSKALGEQVGNGKPVLPYVIHGHYADAGDVAALLSGALNVPMVLTGHSLGRNKLEQLLKQGRMSKAEIDSTYKIMRRIEGEELSLDASELVITSTRQEIDEQWGLYDGFDVKLEKVLRARARRGVSCHGRFMPRMVVIPPGMDFSNVIPEDIDGDGDSKDDIVGLEVASPKSMPPIWAEVMRFLTNPHKPMILALSRPDPKKNITTLVKAFGECRPLRELANLTLIMGNRDDIDEMSAGNASVLTTVLKLIDKYDLYGSVAFPKHHNQADVPEIYRLAAKMKGVFINPALVEPFGLTLIEAAAHGLPIVATKNGGPVDITTALNNGLLVDPHDQNAIADALLKLVADKNLWQECRRNGLRNIHLYSWPEHCRTYLTRVAGCRLRNPRWLKDTPADAGADDEEFLEDSMDAQDLSLRLSIDGEKSSLNTNDPLSSDPQDQVQKIMNKIKQSSALPPSMSSGGDGAKNAAEATGGTMNKYPLLRRRRRLFVIAVDCYEDDGRASKKMLQVIQEVFRAVRSDSQMSKISGFALSTAMPLSETLQLLKLGKIPATDFDALICGSGSEVYYPGTVNCIDAEGKLRPDQDYLMHISHRWSHDGARQTIAKLMASQDGSDDAVELDVASSNAHCFAFLIKDPKKVKTVDEMRERLRMRGLRCHIMYCRNATRLQVVPLLASRSQALRYLFVRWGLSVGNMYLITGEHGDTDLEEMLSGLHKTVIVRGVTEKGSEALLRSSGSYKRDDVVPTETPLAAYTTGELKADEIMRALKQVSKTSSGM

SEQ ID NO: 17124 - DNA, 1419 bp, Sorghum bicolor
  misc_feature: Ceres ANNOT ID no. 8670231
  misc_feature: Encodes the peptide sequence at SEQ ID NO 17125
atggacgacgccggaagggcaccaccacccgctcccgcggcggtgaccgtatccgccaccgccgcacccgcgcctcccccgccctccgccacggccgctgccgacaagtcctcgcccgaccccgaagcgctctatgaagaggggatgtggcaacagatggccatgaacagcggtgccactatgcaacctgggtcatatcctgagcgaccaggtgaacctgactgcacttactacctcaggactggattgtgtcgatttggcatgagctgcaggttcaatcatcctccggataggaatctggctattgcctctgccagaatgaaaggagaatatcctgagagagtgggacagccagagtgtcagtattatctgaagactggaacatgcaagtttggccctacatgcaaatttcaccatcccagggaaaaggctggaattgcagggagggtgcagctaaacacattaggatatccactccgcccgaatgaaaaggagtgcgcatattatttaaaaacaggacaatgtaaatatgcaaatacttgtaaatttcaccatccggagcttttcaatgtggtgccttcgtcacgtggttctcctatttatacttccgtacattcctctgcaagcgctggtccacagtcctatactggaactatgccaagctgggcttttccacgagcttcttttataccaagccctaggtggcaaagtccttcaaattatgcaccaatgattgtacctcagggccttgttcaagtgccgagctggaattcatatcctggtcagctgcagtcacctggggctcaacaaacttatggaagttcacaacaaggtgagtctagtgcaggaaatcagggaatgctatcaccctacagatccagttcgtttcctgtgcctcaatatgcgttgcagagagataatgtatttcctgagagacctgatgaaccagaatgccaatattacatgaagacaggagattgtaaatttggtgcagtgtgcaagttccatcatccccgggtgagatcactgccccctccggattgtgtcttaagtccaatgggtcttccaatacgtccaggtgaagaattgtgcaaattctattctcgttatggcatctgcaagttcggcgccaactgtaaatttgaccatccaacaatggctgctccaatgggagtctatgcatatggtttctctgcgtctggttctcctgcatctgcttcaactaatgtacctatggcgcgacaaataccattttcacgcctgcacctatggttcctaacagttgatgaggtaggaaatcccctgaaggacctgaggcctgcaggtgtgcagttgaaattatatcattgcgtcagtttgtttggaacctgtattcagctcgtgttgaggcagatattgggatttctttttatctgttaa

SEQ ID NO: 17125 - protein, 472 aa, Sorghum bicolor
  misc_feature: Useful for making plants with modulated nitrogen use efficiency
  misc_feature: Functional homolog of the protein sequence given in SEQ ID NO 14480
  misc_feature: Useful for making plants with modulated low light sensitivity
  misc_feature: Functional homolog of the protein sequence given in SEQ ID NO 14481
  misc_feature: Ceres ANNOT ID no. 8670231
  misc_feature (359)..(385): Pfam ID: zf-CCCH Pfam Description: Zinc finger C-x8-C-x5-C-x3-H type (and similar)
  misc_feature (313)..(339): Pfam ID: zf-CCCH Pfam Description: Zinc finger C-x8-C-x5-C-x3-H type (and similar)
  misc_feature (70)..(96): Pfam ID: zf-CCCH Pfam Description: Zinc finger C-x8-C-x5-C-x3-H type (and similar)
  misc_feature (115)..(141): Pfam ID: zf-CCCH Pfam Description: Zinc finger C-x8-C-x5-C-x3-H type (and similar)
  misc_feature (161)..(187): Pfam ID: zf-CCCH Pfam Description: Zinc finger C-x8-C-x5-C-x3-H type (and similar)
MDDAGRAPPPAPAAVTVSATAAPAPPPPSATAAADKSSPDPEALYEEGMWQQMAMNSGATMQPGSYPERPGEPDCTYYLRTGLCRFGMSCRFNHPPDRNLAIASARMKGEYPERVGQPECQYYLKTGTCKFGPTCKFHHPREKAGIAGRVQLNTLGYPLRPNEKECAYYLKTGQCKYANTCKFHHPELFNVVPSSRGSPIYTSVHSSASAGPQSYTGTMPSWAFPRASFIPSPRWQSPSNYAPMIVPQGLVQVPSWNSYPGQLQSPGAQQTYGSSQQGESSAGNQGMLSPYRSSSFPVPQYALQRDNVFPERPDEPECQYYMKTGDCKFGAVCKFHHPRVRSLPPPDCVLSPMGLPIRPGEELCKFYSRYGICKFGANCKFDHPTMAAPMGVYAYGFSASGSPASASTNVPMARQIPFSRLHLWFLTVDEVGNPLKDLRPAGVQLKLYHCVSLFGTCIQLVLRQILGFLFIC

SEQ ID NO: 17126 - DNA, 1137 bp, Sorghum bicolor
  misc_feature: Ceres ANNOT ID no. 8670272
  misc_feature: Encodes the peptide sequence at SEQ ID NO 17127
atggagcccaacaagggttatctccgtcgtattgcgttctttatctttgagatgtggcttgcaaccatctttgctctcctcatcttatttgcgctcgcaagcatcggcaggtcgttggacatgctggagaagagctactacactgagatcggagtagcttctccggaagatagaatcaaatctcaagattttgctgagattgtatcagatatgtcggataggctgaatgccagaatggcgaaactgatggactgcatccttcctcagtatgaatttgcagatttagcccaggtgctgcccaaggtggccaccgacgacaggacggtgatcatcacgtcggtgaacgaagcgttcgcgcgtcccaactcactgctcggcctcttccgcgagagcttccaggtcggtgaagggatcggccacctcctgaacaacgtcctcgtcgtcgccgtcgacgccaaggcgttccgctactgcaaggccgtgcacccacactgctacctcctggaggtgaagaccatgaacctcagctccgccaacaactacatgaccgagtcctatattgagctcgtctggaccaagctctccctgcagcagcgcgtcctcgagctcggctacaacttcctcttcacggacgtggacatcgtgtggttccgcaacccgttccggcacatcagcgcgttcgcggacatgacgacgtcgagcgacgtgttctccggcgacgccgacagcctggacaactggcccaacacggggttcttctacatgaaggcgaccagccggacggtggagatgctgcggcggtggcgcgcggcgcgggcgcggttcccgccgaaccacgagcaggccatcttcaacgagatcaagcacgagctcgcccgggacctaggcgcgcgcgtccggttcctcgatacggcgcgcttcggcggcttttgccggatcttccacaccgacatggctgcggcgtgcaccatgcacgccaactgctgcttcgggctcgctaacaagctgcacgacctcagggacgtgctcggccagtggaagaactacacgggcctgacgccgcaggagaagaagagccagaagttcacgtggaaggatccggccaagtgtgggactccggacaaaagggacacatga

SEQ ID NO: 17127 - protein, 378 aa, Sorghum bicolor
  misc_feature: Useful for making plants with altered carbohydrate content
  misc_feature: Functional homolog of the protein sequence given in SEQ ID NO 14071
  misc_feature: Ceres ANNOT ID no. 8670272
MEPNKGYLRRIAFFIFEMWLATIFALLILFALASIGRSLDMLEKSYYTEIGVASPEDRIKSQDFAEIVSDMSDRLNARMAKLMDCILPQYEFADLAQVLPKVATDDRTVIITSVNEAFARPNSLLGLFRESFQVGEGIGHLLNNVLVVAVDAKAFRYCKAVHPHCYLLEVKTMNLSSANNYMTESYIELVWTKLSLQQRVLELGYNFLFTDVDIVWFRNPFRHISAFADMTTSSDVFSGDADSLDNWPNTGFFYMKATSRTVEMLRRWRAARARFPPNHEQAIFNEIKHELARDLGARVRFLDTARFGGFCRIFHTDMAAACTMHANCCFGLANKLHDLRDVLGQWKNYTGLTPQEKKSQKFTWKDPAKCGTPDKRDT

SEQ ID NO: 17128 - DNA, 1101 bp, Sorghum bicolor
  misc_feature: Ceres ANNOT ID no. 8670271
  misc_feature: Encodes the peptide sequence at SEQ ID NO 17129
atgggcagccagcagaacgtgcttcaccagctcgtgtccttcatcctcggggcgtccgccgccgccgtcctgctcttcttcctgacgacggcgacgaccggagcgcggttcaccgggatatcgacctgggccaatggaaccacgggcttcgacgatgcccccttccaggaggaggctcctgctaccacggcaagagtacctgctgctcctgcccacgccgatgcaaagcagcagggcacggcggcggcggagcaggaggacgagctggagcggctgctgcgcgcggtggcggacgaggaccggacggtgatcatgacgtcggtgaacgaggcgtgggcggcgcaggactcgctgctggacctgttcctggagagcttccgcagcggcgagcggatcgcgcacttcgtggaccacctcctggtggtggccctcgacggcggcgcgctggagcactgccgcgccgtgcacccgcactgctacctcctccccgccgccgccgcgcgcaacctctccggcgagaaggtgttcatgagcaaggactacattgacctggtctggagcaaggtccggcttcagcagaggatcctcgagctcggctacaacttcctcttcacggacgtggacattctgtggttcaggaacccgttcgagcggatgtcggtggcggcgcacatggtgacctcgtcggacttctacttcggcgacccgtacagcccgatgaacctgcccaacacggggttcctgtacgccaagtcgagccggcgcacggtgggcgcgttcgaggcgtggcacggcgcgcgggaggcgttcccggggaagcacgagcagcaggtgctgaacgagatcaaggtggagctggtggccacgcgcggcctgcgcatccagttcctggacacggagcacaacgccggcttctgcaacaacacccgcaacttcaacacgctctacaccatgcacgccaactgctgcgtcggcctgggcgccaagctgcacgacctcggcaacctgctgcaggagtggcgggcgtaccggcagatggacgaggaggaacgcgtgcgggggcccgtgcgctggaaggtgcccggcatatgcatccactga

SEQ ID NO: 17129 - protein, 366 aa, Sorghum bicolor
  misc_feature: Useful for making plants with altered carbohydrate content
  misc_feature: Functional homolog of the protein sequence given in SEQ ID NO 14482
  misc_feature: Ceres ANNOT ID no. 8670271
MGSQQNVLHQLVSFILGASAAAVLLFFLTTATTGARFTGISTWANGTTGFDDAPFQEEAPATTARVPAAPAHADAKQQGTAAAEQEDELERLLRAVADEDRTVIMTSVNEAWAAQDSLLDLFLESFRSGERIAHFVDHLLVVALDGGALEHCRAVHPHCYLLPAAAARNLSGEKVFMSKDYIDLVWSKVRLQQRILELGYNFLFTDVDILWFRNPFERMSVAAHMVTSSDFYFGDPYSPMNLPNTGFLYAKSSRRTVGAFEAWHGAREAFPGKHEQQVLNEIKVELVATRGLRIQFLDTEHNAGFCNNTRNFNTLYTMHANCCVGLGAKLHDLGNLLQEWRAYRQMDEEERVRGPVRWKVPGICIH

SEQ ID NO: 17130 - DNA, 417 bp, Sorghum bicolor
  misc_feature: Ceres ANNOT ID no. 8670309
  misc_feature: Encodes the peptide sequence at SEQ ID NO 17131
atggcggagggaggccgagaaggaggaagaagattcaccgcaccggaagaggagaggaaggagaggcgccaaatgagggagtcagaagattcggcttcggaagcagcagctgcgtccgtcatgaactacgcgggcatgaactacgcctacgcggacagaggaggcatgaacgccgcgggcagaagcagcatgtcgtcgccacggccgggcacggactggggccccatcatcgtggcggtgatcctcttcgtggtgctctcgccgggcctgctgttccagctcccctcgcggacgcgggtcgtcgagttcggcaacatggccaccagcgccatcgccatcctcgtccacgccgtcatcttcttctgcctcctcaccatcttcgtcgtcgccatcggcatccacgtctacgccgcctag

SEQ ID NO: 17131 - protein, 138 aa, Sorghum bicolor
  misc_feature: Useful for making plants with altered cell wall content and/or composition
  misc_feature: Functional homolog of the protein sequence given in SEQ ID NO 13690
  misc_feature: Ceres ANNOT ID no. 8670309
MAEGGREGGRRFTAPEEERKERRQMRESEDSASEAAAASVMNYAGMNYAYADRGGMNAAGRSSMSSPRPGTDWGPIIVAVILFVVLSPGLLFQLPSRTRVVEFGNMATSAIAILVHAVIFFCLLTIFVVAIGIHVYAA

SEQ ID NO: 17132 - DNA, 258 bp, Sorghum bicolor
  misc_feature: Ceres ANNOT ID no. 8670305
  misc_feature: Encodes the peptide sequence at SEQ ID NO 17133
atggcgcggcgcgggcgcgtggagctgcggcggatcgaggacaaggcgagccgacaggtgcgcttctccaagcgccgcgcggggctgttcaagaaggccttcgagctggccctgctctgcgacgccgaggtcgcgctcctcgtcttctcccccggcggcaagctctacgagtactcctccaccaggaagatcatgcttatctactatcttgttttaatttgtttagttttttatatgtttttaatcacaatctattag

SEQ ID NO: 17133 - protein, 85 aa, Sorghum bicolor
  misc_feature: The sequence is a functional homolog of SEQ ID NO 1364 in the 10/666,642 US patent application
  misc_feature: The sequence is a functional homolog of SEQ ID NO 1728 in the 10/412,699 US patent application
  misc_feature: The sequence is a functional homolog of SEQ ID NO 919 in the 10/666,642 US patent application
  misc_feature: The sequence is a functional homolog of SEQ ID NO 4 in US patent 7057087
  misc_feature: The sequence is a functional homolog of SEQ ID NO 428 in the 10/666,642 US patent application
  misc_feature: The sequence is a functional homolog of SEQ ID NO 892 in the 11/435,388 US patent application
  misc_feature: The sequence is a functional homolog of SEQ ID NO 30 in the 10/666,642 US patent application
  misc_feature: The sequence is a functional homolog of SEQ ID NO 707 in the 10/666,642 US patent application
  misc_feature: The sequence is a functional homolog of SEQ ID NO 203 in the 11/479,226 US patent application
  misc_feature: The sequence is a functional homolog of SEQ ID NO 40 in the 10/666,642 US patent application
  misc_feature: Useful for making plants with altered alkaloid content
  misc_feature: Useful for making plants with altered terpenoid content
  misc_feature: Useful for making plants with modulated flowering time
  misc_feature: Functional homolog of the protein sequence given in SEQ ID NO 13021
  misc_feature: Useful for making plants with modulated biomass
  misc_feature: Functional homolog of the protein sequence given in SEQ ID NO 13569
  misc_feature: The sequence is a functional homolog of SEQ ID NO 1362 in the 10/666,642 US patent application
  misc_feature: The sequence is a functional homolog of SEQ ID NO 199 in the 11/479,226 US patent application
  misc_feature: The sequence is a functional homolog of SEQ ID NO 34 in the 10/666,642 US patent application
  misc_feature: The sequence is a functional homolog of SEQ ID NO 58 in the 10/412,699 US patent application
  misc_feature: The sequence is a functional homolog of SEQ ID NO 36 in the 10/666,642 US patent application
  misc_feature: The sequence is a functional homolog of SEQ ID NO 60 in the 10/412,699 US patent application
  misc_feature: The sequence is a functional homolog of SEQ ID NO 122 in the 10/666,642 US patent application
  misc_feature: The sequence is a functional homolog of SEQ ID NO 406 in the 10/412,699 US patent application
  misc_feature: The sequence is a functional homolog of SEQ ID NO 731 in the 10/666,642 US patent application
  misc_feature: Useful for making plants with modulated phosphate use efficiency
  misc_feature: Functional homolog of the protein sequence given in SEQ ID NO 13166
  misc_feature: The sequence is a functional homolog of SEQ ID NO 2 in US patent 7273968
  misc_feature: The sequence is a functional homolog of SEQ ID NO 6 in US patent 7279615
  misc_feature: Useful for biocontainment applications
  misc_feature: Functional homolog of the protein sequence given in SEQ ID NO 13753
  misc_feature: The sequence is a functional homolog of SEQ ID NO 46 in the 10/666,642 US patent application
  misc_feature: The sequence is a functional homolog of SEQ ID NO 42 in the 10/666,642 US patent application
  misc_feature: The sequence is a functional homolog of SEQ ID NO 2189 in the 10/666,642 US patent application
  misc_feature: The sequence is a functional homolog of SEQ ID NO 1368 in the 10/666,642 US patent application
  misc_feature: The sequence is a functional homolog of SEQ ID NO 422 in the 11/435,388 US patent application
  misc_feature: The sequence is a functional homolog of SEQ ID NO 1360 in the 10/666,642 US patent application
  misc_feature: The sequence is a functional homolog of SEQ ID NO 22 in the 10/666,642 US patent application
  misc_feature: The sequence is a functional homolog of SEQ ID NO 28 in the 10/666,642 US patent application
  misc_feature: The sequence is a functional homolog of SEQ ID NO 2199 in the 10/666,642 US patent application
  misc_feature: The sequence is a functional homolog of SEQ ID NO 1470 in the 10/666,642 US patent application
  misc_feature: The sequence is a functional homolog of SEQ ID NO 284 in the 10/666,642 US patent application
  misc_feature: The sequence is a functional homolog of SEQ ID NO 1701 in the 10/412,699 US patent application
  misc_feature: The sequence is a functional homolog of SEQ ID NO 2197 in the 10/666,642 US patent application
  misc_feature: The sequence is a functional homolog of SEQ ID NO 2195 in the 10/666,642 US patent application
  misc_feature: The sequence is a functional homolog of SEQ ID NO 730 in the 10/666,642 US patent application
  misc_feature: The sequence is a functional homolog of SEQ ID NO 14 in the 10/666,642 US patent application
  misc_feature: The sequence is a functional homolog of SEQ ID NO 2191 in the 10/666,642 US patent application
  misc_feature: Useful for making plants with altered lignin content
  misc_feature: Functional homolog of the protein sequence given in SEQ ID NO 13528
  misc_feature: The sequence is a functional homolog of SEQ ID NO 1468 in the 10/666,642 US patent application
  misc_feature: The sequence is a functional homolog of SEQ ID NO 282 in the 10/666,642 US patent application
  misc_feature: The sequence is a functional homolog of SEQ ID NO 164 in the 10/666,642 US patent application
  misc_feature: The sequence is a functional homolog of SEQ ID NO 642 in the 11/435,388 US patent application
  misc_feature: The sequence is a functional homolog of SEQ ID NO 32 in the 10/666,642 US patent application
  misc_feature: The sequence is a functional homolog of SEQ ID NO 1460 in the 10/666,642 US patent application
  misc_feature: The sequence is a functional homolog of SEQ ID NO 938 in the 10/412,699 US patent application
  misc_feature: The sequence is a functional homolog of SEQ ID NO 1732 in the 10/412,699 US patent application
  misc_feature: The sequence is a functional homolog of SEQ ID NO 44 in the 10/666,642 US patent application
  misc_feature: The sequence is a functional homolog of SEQ ID NO 66 in the 10/412,699 US patent application
  misc_feature: The sequence is a functional homolog of SEQ ID NO 2193 in the 10/666,642 US patent application
  misc_feature: The sequence is a functional homolog of SEQ ID NO 2064 in the 10/374,780 US patent application
  misc_feature: The sequence is a functional homolog of SEQ ID NO 572 in the 10/412,699 US patent application
  misc_feature: The sequence is a functional homolog of SEQ ID NO 816 in the 10/225,066 US patent application
  misc_feature: The sequence is a functional homolog of SEQ ID NO 122 in the 10/225,066 US patent application
  misc_feature: The sequence is a functional homolog of SEQ ID NO 234 in the 10/374,780 US patent application
  misc_feature: The sequence is a functional homolog of SEQ ID NO 1243 in the 11/479,226 US patent application
  misc_feature: The sequence is a functional homolog of SEQ ID NO 1420 in the 10/666,642 US patent application
  misc_feature: The sequence is a functional homolog of SEQ ID NO 1814 in the 10/412,699 US patent application
  misc_feature: The sequence is a functional homolog of SEQ ID NO 570 in the 10/412,699 US patent application
  misc_feature: The sequence is a functional homolog of SEQ ID NO 729 in the 10/666,642 US patent application
  misc_feature: The sequence is a functional homolog of SEQ ID NO 1454 in the 10/374,780 US patent application
  misc_feature: The sequence is a functional homolog of SEQ ID NO 1453 in the 10/374,780 US patent application
  misc_feature: The sequence is a functional homolog of SEQ ID NO 1971 in the 10/412,699 US patent application
  misc_feature: The sequence is a functional homolog of SEQ ID NO 1702 in the 10/412,699 US patent application
  misc_feature: The sequence is a functional homolog of SEQ ID NO 715 in the 10/666,642 US patent application
  misc_feature: The sequence is a functional homolog of SEQ ID NO 1366 in the 10/666,642 US patent application
  misc_feature: The sequence is a functional homolog of SEQ ID NO 1730 in the 10/412,699 US patent application
  misc_feature: The sequence is a functional homolog of SEQ ID NO 207 in the 11/479,226 US patent application
  misc_feature: The sequence is a functional homolog of SEQ ID NO 64 in the 10/412,699 US patent application
  misc_feature: The sequence is a functional homolog of SEQ ID NO 2232 in the 10/374,780 US patent application
  misc_feature: The sequence is a functional homolog of SEQ ID NO 232 in the 10/225,068 US patent application
  misc_feature: The sequence is a functional homolog of SEQ ID NO 310 in the 10/225,066 US patent application
  misc_feature: The sequence is a functional homolog of SEQ ID NO 1973 in the 10/412,699 US patent application
  misc_feature: The sequence is a functional homolog of SEQ ID NO 14 in the 10/374,780 US patent application
  misc_feature: The sequence is a functional homolog of SEQ ID NO 328 in the 10/225,066 US patent application
  misc_feature: The sequence is a functional homolog of SEQ ID NO 34 in the 10/286,264 US patent application
  misc_feature: The sequence is a functional homolog of SEQ ID NO 468 in the 11/435,388 US patent application
  misc_feature: The sequence is a functional homolog of SEQ ID NO 68 in the 10/412,699 US patent application
  misc_feature: Useful for making plants with altered tocopherol content
  misc_feature: Functional homolog of the protein sequence given in SEQ ID NO 14261
  misc_feature: Useful for making plants with modulated nitrogen use efficiency
  misc_feature: Functional homolog of the protein sequence given in SEQ ID NO 13191
  misc_feature: The sequence is a functional homolog of SEQ ID NO 1957 in the 10/412,699 US patent application
  misc_feature: The sequence is a functional homolog of SEQ ID NO 1959 in the 10/412,699 US patent application
  misc_feature: The sequence is a functional homolog of SEQ ID NO 4 in US patent 7303918
  misc_feature: The sequence is a functional homolog of SEQ ID NO 1949 in the 10/412,699 US patent application
  misc_feature: The sequence is a functional homolog of SEQ ID NO 1110 in the 10/225,066 US patent application
  misc_feature: The sequence is a functional homolog of SEQ ID NO 166 in the 10/374,780 US patent application
  misc_feature: The sequence is a functional homolog of SEQ ID NO 1812 in the 10/412,699 US patent application
  misc_feature: The sequence is a functional homolog of SEQ ID NO 568 in the 10/412,699 US patent application
  misc_feature: The sequence is a functional homolog of SEQ ID NO 1945 in the 10/412,699 US patent application
  misc_feature: The sequence is a functional homolog of SEQ ID NO 1947 in the 10/412,699 US patent application
  misc_feature: The sequence is a functional homolog of SEQ ID NO 1056 in the 10/225,066 US patent application
  misc_feature: The sequence is a functional homolog of SEQ ID NO 1882 in the 10/412,699 US patent application
  misc_feature: The sequence is a functional homolog of SEQ ID NO 350 in the 10/374,780 US patent application
  misc_feature: The sequence is a functional homolog of SEQ ID NO 944 in the 10/412,699 US patent application
  misc_feature: The sequence is a functional homolog of SEQ ID NO 1955 in the 10/412,699 US patent application
  misc_feature: The sequence is a functional homolog of SEQ ID NO 1953 in the 10/412,699 US patent application
  misc_feature: The sequence is a functional homolog of SEQ ID NO 2238 in the 10/374,780 US patent application
  misc_feature: The sequence is a functional homolog of SEQ ID NO 656 in the 10/225,066 US patent application
  misc_feature: The sequence is a functional homolog of SEQ ID NO 215 in the 11/479,226 US patent application
  misc_feature: The sequence is a functional homolog of SEQ ID NO 470 in the 11/435,388 US patent application
  misc_feature: Ceres ANNOT ID no. 8670305
  misc_feature (10)..(60): Pfam ID: SRF-TF Pfam Description: SRF-type transcription factor (DNA-binding and dimerisation domain)
MARRGRVELRRIEDKASRQVRFSKRRAGLFKKAFELALLCDAEVALLVFSPGGKLYEYSSTRKIMLIYYLVLICLVFYMFLITIY

SEQ ID NO: 17134 - DNA, 570 bp, Sorghum bicolor
  misc_feature: Ceres ANNOT ID no. 8670319
  misc_feature: Encodes the peptide sequence at SEQ ID NO 17135
atggcctccatggcgttcgctctggcgggggccttcaagggcctctccctggcgcccaccaccacctccttcctgcgcggcgaccgcgtctcgctctccgtcggcggcggcagcggcgccgtgggcgtgtcggtgccggcgcggcggctcaccatccagatggcgcacaagaagggggccgggagcaccaagaacggacgagactccaagggacagcgcctcggggtcaagatatacggcgaccaggtcgccaagcccggggccatcatcatccggcagcgcggcaccagggtctatcctggaaataacgttggaatgggcaaggatcatacactcttttctttgattgatggactagtcaagtttgagaagtatggtccagacaagaaaaaggtaagtgtttacccatatgagaaagagcctgaaaacccaaacagttacagagcaaggaagagagagtacttccgcatgcggcgtgaacggaagaaggcaagagcggagggagctactgagcctcaattggtactagctgctgttgacaaaaactctgaggccagcgccgactgctga

SEQ ID NO: 17135 - protein, 189 aa, Sorghum bicolor
  misc_feature: Useful for making plants with modulated biomass
  misc_feature: Functional homolog of the protein sequence given in SEQ ID NO 13646
  misc_feature: Ceres ANNOT ID no. 8670319
  misc_feature (55)..(135): Pfam ID: Ribosomal_L27 Pfam Description: Ribosomal L27 protein
MASMAFALAGAFKGLSLAPTTTSFLRGDRVSLSVGGGSGAVGVSVPARRLTIQMAHKKGAGSTKNGRDSKGQRLGVKIYGDQVAKPGAIIIRQRGTRVYPGNNVGMGKDHTLFSLIDGLVKFEKYGPDKKKVSVYPYEKEPENPNSYRARKREYFRMRRERKKARAEGATEPQLVLAAVDKNSEASADC

SEQ ID NO: 17136 - DNA, 627 bp, Sorghum bicolor
  misc_feature: Ceres ANNOT ID no. 8670320
  misc_feature: Encodes the peptide sequence at SEQ ID NO 17137
atggtgaagcacaacaacgtcatccccaacgggcacttcaagaagcactggcagaactatgtcaagacatggttcaaccagcccgcccgcaagcagaggcgccgcatcgctcgtcaaaagaaggctgtgaagatattcccacgcccaactgctggccctcttcgccccattgttcaatgccagactctcaagtacaacatgaagtcaagggccgggagaggctttacccttgaggagctgaaggctgcgggcattccaaagaagcttgctccaaccattggcatttctgtggatcaccgccgcaagaacaaatccctcgagggactgcaggccaatgtccagaggcttaagacatacaaggccaagctggttatcttcccaaggcgtgctcgcaaggtcaaggctggtgactctactccagaggagcttgccaccgcaacccaggtccagggtgactacatgccaattactcgtggtgagaagcgctcagttgaggttgtgaaggttacagatgagatgaaggagtttgcagcctatggcaagctccgccttgagcggatgaacaagaaacacctcggtgcccgccagaagaaggcagctgaggcggagaaggaagataagaagtga

SEQ ID NO: 17137 - protein, 208 aa, Sorghum bicolor
  misc_feature: Useful for making plants with modulated nitrogen use efficiency
  misc_feature: Functional homolog of the protein sequence given in SEQ ID NO 14483
  misc_feature: Useful for making plants with modulated phosphate use efficiency
  misc_feature: Functional homolog of the protein sequence given in SEQ ID NO 14484
  misc_feature: Ceres ANNOT ID no. 8670320
  misc_feature (6)..(185): Pfam ID: Ribosomal_L13e Pfam Description: Ribosomal protein L13e
MVKHNNVIPNGHFKKHWQNYVKTWFNQPARKQRRRIARQKKAVKIFPRPTAGPLRPIVQCQTLKYNMKSRAGRGFTLEELKAAGIPKKLAPTIGISVDHRRKNKSLEGLQANVQRLKTYKAKLVIFPRRARKVKAGDSTPEELATATQVQGDYMPITRGEKRSVEVVKVTDEMKEFAAYGKLRLERMNKKHLGARQKKAAEAEKEDKK

SEQ ID NO: 17138 - DNA, 1248 bp, Sorghum bicolor
  misc_feature: Ceres ANNOT ID no. 8670354
  misc_feature: Encodes the peptide sequence at SEQ ID NO 17139
atggggccgtgcgtcgccgccgtggtcgctattctgctcgtcgccacctgcgtcgcggcggcgccgccgcagcagcagccgcgcaagcccggcaggatctcagggaacgcggtgggcgtgctggacgacgaccccgtggggaagctgaaggtgttcgtgtacgagatgccgcgcaagtacaacaagatgctgctggacaaggacagccgttgcctgcaccacatgttcgccgcggagatcttcatgcaccagttcctgctgtcgagcgcggtgcggacgctggaccccgaggaggccgactggttctacacgcccgtgtacacgacctgcgacctgacgccgcagggcttcccgctgccgttccgcgcgccgcggatcatgcggagcgcgatccggtacgtggcgacgacgtggccgttctggaaccggacggacggcgcggaccacttcttcctcaccccgcacgacttcggcgcgtgcttccactaccaggaggagcgcgccatggagcgcggcatcctgccgctgctccgtcgcgccacgctggtgcagacgttcgggcagcggaaccacgtgtgcctccaggacgggtccatcacggtgccaccctacgccgacccgcacaagatgcaggcgcacctcatcagccccggcacgccgcgctccatcttcgtctacttccgcggcctcttctacgacatgggcaacgaccccgaaggcgggtactacgccaggggcgcgcgcgcgtcggtgtgggagaacttcaaggacaacccgctgttcgacatctcgacggagcacccctacacgtactacgaggacatgcagcgggccatcttctgcctgtgcccgctggggtgggcgccgtggagccccaggctggtggaggcggtggtgttcgggtgcatccccgtcatcatcgccgacgacatcgtgctgccgttcgccgacgccatcccctgggaggacatcagcgtgttcgtggcggagcgggacgtgccgaggctcgactccatcctcacctccatcccgctcgccgacatcctgcggaggcagcgcctgctggccagggaatccgtcaagcaggcgctgctgttccaccagccggcaaggacaggggacgccttccaccaggtgctcaatgggctggcgcgcaagctgccgcacggcgacggcgtgttcctgcagcccggggagaaggtgctcgactgggacgccggactcgacagcgacctcaagccctggtag

SEQ ID NO: 17139 - protein, 415 aa, Sorghum bicolor
  misc_feature: Useful for making plants with altered carbohydrate content
  misc_feature: Functional homolog of the protein sequence given in SEQ ID NO 14485
  misc_feature: Useful for making plants with altered cell wall content and/or composition
  misc_feature: Functional homolog of the protein sequence given in SEQ ID NO 13864
  misc_feature: Ceres ANNOT ID no. 8670354
  misc_feature (51)..(355): Pfam ID: Exostosin Pfam Description: Exostosin family
MGPCVAAVVAILLVATCVAAAPPQQQPRKPGRISGNAVGVLDDDPVGKLKVFVYEMPRKYNKMLLDKDSRCLHHMFAAEIFMHQFLLSSAVRTLDPEEADWFYTPVYTTCDLTPQGFPLPFRAPRIMRSAIRYVATTWPFWNRTDGADHFFLTPHDFGACFHYQEERAMERGILPLLRRATLVQTFGQRNHVCLQDGSITVPPYADPHKMQAHLISPGTPRSIFVYFRGLFYDMGNDPEGGYYARGARASVWENFKDNPLFDISTEHPYTYYEDMQRAIFCLCPLGWAPWSPRLVEAVVFGCIPVIIADDIVLPFADAIPWEDISVFVAERDVPRLDSILTSIPLADILRRQRLLARESVKQALLFHQPARTGDAFHQVLNGLARKLPHGDGVFLQPGEKVLDWDAGLDSDLKPW

SEQ ID NO: 17140 - DNA, 1254 bp, Sorghum bicolor
  misc_feature: Ceres ANNOT ID no. 8670355
  misc_feature: Encodes the peptide sequence at SEQ ID NO 17141
atggggacggggagcgcgcgggcgatggccgccgcgctcgccgtcttgcttctcgcctgctctggcgccgtcgctgtcgccagggcgcaggacaccgagcggatcgaaggaagtgctggtgatgtgctcgaagatgatcctgttgggaggctcaaggtatatgtctacgagttgccaaccaagtacaacaagaagatggtggctaaagattctcggtgtctcagccacatgtttgctgcagagatcttcatgcaccgcttcctgttgtctagtgcgatccggactttaaatccagaagaagctgattggttctatactccagtatacacaacatgtgatctcacaccatggggtcatcccttgccctttaagtctccacgaataatgagaagcgcaattcagttcatttccaaccgttggccatactggaacaggacagagggagcagatcacttctttgttgtgccacatgactttggtgcatgcttccattatcaggaagagaaggctatcgagcgaggagtccttccattgcttcgccgtgctacactagtccagacttttgggcagaaggatcatgtctgcctaaaggaaggctccatcaccatcccgccatatgctcctcctcagaagatgaaaacccaccttgttcccccagggacccctaggtcaatctttgtctatttccgtgggttgttttatgacactgcaaatgatcctgagggtggttactatgcaaggggcgcccgtgcatcagtatgggagaacttcaagaacaacccgcttttcgacatctcaactgaccacccaccaacctactatgaggacatgcagcgtgccgtcttctgcctgtgcccactgggctgggccccatggagcccccgcttggtggaggcggtggtgttcggctgcatcccagtgatcatcgccgacgacatcgtccttccctttgcggacgcaatcccatgggaggagattggtgtctttgtggctgaggacgacgtcccgaagctggacaccatcctgacatccataccgatggaggtgatcctccggaagcagaggctcctcgcgaatccatccatgaagcaggccatgctgttcccgcagcccgcccagcctggggatgccttccaccagatcctgaacgggttggcacggaagctgccgcacggcgaggacgtgttcctgaagcccgggctgaaggtgctgaactggaccgagggcccccgtggcgacctgaagccatggtag

SEQ ID NO: 17141 - protein, 417 aa, Sorghum bicolor
  misc_feature: Useful for making plants with altered carbohydrate content
  misc_feature: Functional homolog of the protein sequence given in SEQ ID NO 13639
  misc_feature: Useful for making plants with altered cell wall content and/or composition
  misc_feature: Functional homolog of the protein sequence given in SEQ ID NO 13640
  misc_feature: Ceres ANNOT ID no. 8670355
  misc_feature (53)..(357): Pfam ID: Exostosin Pfam Description: Exostosin family
MGTGSARAMAAALAVLLLACSGAVAVARAQDTERIEGSAGDVLEDDPVGRLKVYVYELPTKYNKKMVAKDSRCLSHMFAAEIFMHRFLLSSAIRTLNPEEADWFYTPVYTTCDLTPWGHPLPFKSPRIMRSAIQFISNRWPYWNRTEGADHFFVVPHDFGACFHYQEEKAIERGVLPLLRRATLVQTFGQKDHVCLKEGSITIPPYAPPQKMKTHLVPPGTPRSIFVYFRGLFYDTANDPEGGYYARGARASVWENFKNNPLFDISTDHPPTYYEDMQRAVFCLCPLGWAPWSPRLVEAVVFGCIPVIIADDIVLPFADAIPWEEIGVFVAEDDVPKLDTILTSIPMEVILRKQRLLANPSMKQAMLFPQPAQPGDAFHQILNGLARKLPHGEDVFLKPGLKVLNWTEGPRGDLKPW

SEQ ID NO: 17142 - DNA, 1131 bp, Sorghum bicolor
  misc_feature: Ceres ANNOT ID no. 8670377
  misc_feature: Encodes the peptide sequence at SEQ ID NO 17143
atggacgactcggcggaggcgaagctggtggacgagatcgcgggaggaggggcggagggggactggggctacttgggctccgacgggatgggctccggctcctacccgggctaccccttccccagggacgtcctttccacgccgacctccgcgtcgctgctcctctccatggaccccgccgcgctcttcgacttcaacagcaccttcccgccctcctcctccgccgccgccaccgccggctccgcgttgcccgccttccacgacttcaactgcatcaaccccttcgacgacgccggccagttcctcggcggtcccccgccgctgccgccggcggtggcggcacagcagcaggggcagaaaggtgggttctttgcgccgccgccgggctcggacttcaacgacaccgggatgagctgggacgacgaggacgagatcgaccaaagcgtcgacgcctcctccatggccatctcggcctccatggagaatgctgcgggcgcggcggtggggggaagtggcgtcggcggtggcagcgggagaggcaagaagaaagggatgccggccaagaaccttatggccgagcgccgccgtcgcaagaagctcaatgaccgcctctacatgctgcgctcggtggtgcccaagatcagcaagatggatagggcttctatccttggtgatgcaattgagtatctgaaggagctcctgcagaggatcagcgagcttcacaatgaactcgagtcagcttcaagttcttcgtttgttggaccaacatcagctagcttcaacccatcaacaccaacattgcaggcatttcctggccaagtcaaggaagaactttgcccaggctcattccccagccctactggacaacaagccacggttgaagtcaggatgagggaagggcatgcagtcaatatccacatgttctgtgcgcgcaggccaggcatcctgctgtccacaatgacggccctcgacagcctaggcctcgacatcgagcaggcagtcatcagctgcttcaatggctttgcaatggatgtcttccgagctgagcagtgcgcggatggtcctggaatggtgcctgaagaaattaaggccgtgctgatgcacactgccggtctccacaacgcaatgtag

SEQ ID NO: 17143 - protein, 376 aa, Sorghum bicolor
  misc_feature: The sequence is a functional homolog of SEQ ID NO 1378 in the 10/374,780 US patent application
  misc_feature: The sequence is a functional homolog of SEQ ID NO 1499 in the 10/412,699 US patent application
  misc_feature: Useful for making plants with altered lignin content
  misc_feature: Functional homolog of the protein sequence given in SEQ ID NO 12905
  misc_feature: Ceres ANNOT ID no. 8670377
  misc_feature (187)..(234): Pfam ID: HLH Pfam Description: Helix-loop-helix DNA-binding domain
MDDSAEAKLVDEIAGGGAEGDWGYLGSDGMGSGSYPGYPFPRDVLSTPTSASLLLSMDPAALFDFNSTFPPSSSAAATAGSALPAFHDFNCINPFDDAGQFLGGPPPLPPAVAAQQQGQKGGFFAPPPGSDFNDTGMSWDDEDEIDQSVDASSMAISASMENAAGAAVGGSGVGGGSGRGKKKGMPAKNLMAERRRRKKLNDRLYMLRSVVPKISKMDRASILGDAIEYLKELLQRISELHNELESASSSSFVGPTSASFNPSTPTLQAFPGQVKEELCPGSFPSPTGQQATVEVRMREGHAVNIHMFCARRPGILLSTMTALDSLGLDIEQAVISCFNGFAMDVFRAEQCADGPGMVPEEIKAVLMHTAGLHNAM

SEQ ID NO: 17144 - DNA, 975 bp, Sorghum bicolor
  misc_feature: Ceres ANNOT ID no. 8670388
  misc_feature: Encodes the peptide sequence at SEQ ID NO 17145
atggggaagaaagggaaggaggcggcgcgggagcggcgcgagcagcgccgccgcgaggtcaccctcctccgggctctcccctacgagccccaccagcgatggtgggaccgcctggcgccgcgggccgtggcggtggtcacgggcgccaaccgcgggataggcttcgaggccgcccgccagctcgcgctccacggcctgcacgtcgtgctcgcctcccgcgacgccgccaagggccaggacgccgcggggaggatcctggcggaggctcccgatggcgcggtcgtcagcgtggagtcccggcagcttgacgtggcggacgccgcgtccgtggaggccttcgcggcctgggcggtggaaacccacggcggcatccatgtccttgttaacaatgcaggtgtaaacttcaacaaaggagcagataattctgttgagtttgctgagcaagttatcaagacaaattactatggcacaaagcggatgattgatactatgataccactaatgaaacactccccgtatggtgctcggatagtgaatgtcagctcaaggcttggtagagccaatggcagacggaatagaattggtgatgcgagtctaagagatcgtctgttgaaagatgattgtttatcagagcagctagttgatgagatgatcacgaaatttctcgaacaagtcaagcaaggtacttggtcctccaatgagtggccacagatgtacacggactattcgatctcaaagcttgctgttaatgtttatacacgactgatggcaaggaggctctcggatcgacctgaaggccaaaagatatacattaactgtttctgccctggctgggtaaatactgccatgactggttgggaagggaatatttctgccgaagaaggtgctgacacaggtgtatggctcgccttattacctcaggaaccacccacaaatgggaagttcttcgctgagagatgtgagataagcttctaa

SEQ ID NO: 17145 - protein, 324 aa, Sorghum bicolor
  misc_feature: Useful for making plants with modulated cold sensitivity
  misc_feature: Functional homolog of the protein sequence given in SEQ ID NO 14486
  misc_feature: Ceres ANNOT ID no. 8670388
  misc_feature (41)..(319): SWISSPROT Homolog: EC 1.1.1.184 Carbonyl reductase (NADPH)
  misc_feature (42)..(195): Pfam ID: adh_short Pfam Description: short chain dehydrogenase
MGKKGKEAARERREQRRREVTLLRALPYEPHQRWWDRLAPRAVAVVTGANRGIGFEAARQLALHGLHVVLASRDAAKGQDAAGRILAEAPDGAVVSVESRQLDVADAASVEAFAAWAVETHGGIHVLVNNAGVNFNKGADNSVEFAEQVIKTNYYGTKRMIDTMIPLMKHSPYGARIVNVSSRLGRANGRRNRIGDASLRDRLLKDDCLSEQLVDEMITKFLEQVKQGTWSSNEWPQMYTDYSISKLAVNVYTRLMARRLSDRPEGQKIYINCFCPGWVNTAMTGWEGNISAEEGADTGVWLALLPQEPPTNGKFFAERCEISF

SEQ ID NO: 17146 - DNA, 1686 bp, Sorghum bicolor
  misc_feature: Ceres ANNOT ID no. 8670448
  misc_feature: Encodes the peptide sequence at SEQ ID NO 17147
atgtcgggaggcagcagcagcctctcttctgtgagcaacacgcctagggaggtggaggagaagttcttgcagtaccacatccagccgctcctcggtggcccgatggagatgcaaaacggcggcggcggcggcgacctacagcacgtcatcggcggcccctcggagccgctgccgcctgcaccgccgccgccgactgtgaagaagaaaagaagccttccggggacaccagacccgagcgcggaggtgatcgcgctgtcgccgcggacgctgatggcgacgaaccggttcgtgtgcgagatctgccacaagggtttccagcgggaccagaacctgcagctgcaccggcgcgggcacaacctgccgtggaagctgcggcagcgcggcggagccggcgcggacggccctggaggcggtccgccgaggaagcgggtgtacgtgtgcccggaggcgtcgtgcgtgcaccacaacccggcgcgcgcgctgggggacctgacggggatcaagaagcactactgccggaagcacggcgagaagaagtggaagtgcgagcgctgcgccaagcgctacgccgtgcactccgactggaaggcgcacgccaaggtctgcggcacccgcgagtacaagtgcgactgcggcaccgtcttctccaggcgagacagcttcgtaacgcacagggcattctgcgacgccctagcccaggagaacaacaagctatcccagcccatgaacatggcgacggtggcctctgccctccagggtcaagccgcaccccaccacctggcgccgccatcgtcgtcgtcccagcccgaagacgacctcgacgccgccgccggcgaggacaacgacgacgacttcgccctcgacaccaagagcccgaagctgaggatgctccccaccatgtcagacgccgacgccaccgccgccaaccagctgctcctgccgccgctgagcatggccgggtgcatgctctccagcctgcagcacggcgccgcgaggcccgcgccgccgacaccgccgtcgccggcaaccttcttcagcggcgtaaaggcagggctcgacggtcccagcagcagctgcgaccccagcatgggcggcgccttctccccgccgggcgcctcggcgagcatgtcggccacggcgctgctgcagaaggccgcggagatgggcgctaccgcgggcgggtacggcgtgggcgcgggcttctccaccgtcggattcgggcccatgataggtgggcctcccgttatgggcccgtttgggcctctaaagactcctgcggtgctggagccgttcgatgggctgccgttcggccagacgcatctggtgggcctcgacgtgggcaggctcttgcccggccagcacttctacggcagcagccatggccatggccatggggtcggctccatgaccagggccatcggatcgctgatgcacggcggccagcagatggatcaccggcggccggacgacgtccgcgtcgtggattacctcggcgtcgacgaccagaggagctgcttcagtggtgtgagcccctttgggcccgacttaggcccatgtacgactatctatcctaaatgtgatcacaccctctatggtgtcttgatcaccaaaaccaaaaccctaagcaatacctttgccttgatctccatagggttttgtttttctctttcttcttttccaagttga

SEQ ID NO: 17147 - protein, 561 aa, Sorghum bicolor
  misc_feature: The sequence is a functional homolog of SEQ ID NO 1086 in the 10/666,642 US patent application
  misc_feature: The sequence is a functional homolog of SEQ ID NO 1087 in the 10/666,642 US patent application
  misc_feature: Useful for making plants with altered lignin content
  misc_feature: Functional homolog of the protein sequence given in SEQ ID NO 13275
  misc_feature: Ceres ANNOT ID no. 8670448
  misc_feature (96)..(118): Pfam ID: zf-C2H2 Pfam Description: Zinc finger, C2H2 type
MSGGSSSLSSVSNTPREVEEKFLQYHIQPLLGGPMEMQNGGGGGDLQHVIGGPSEPLPPAPPPPTVKKKRSLPGTPDPSAEVIALSPRTLMATNRFVCEICHKGFQRDQNLQLHRRGHNLPWKLRQRGGAGADGPGGGPPRKRVYVCPEASCVHHNPARALGDLTGIKKHYCRKHGEKKWKCERCAKRYAVHSDWKAHAKVCGTREYKCDCGTVFSRRDSFVTHRAFCDALAQENNKLSQPMNMATVASALQGQAAPHHLAPPSSSSQPEDDLDAAAGEDNDDDFALDTKSPKLRMLPTMSDADATAANQLLLPPLSMAGCMLSSLQHGAARPAPPTPPSPATFFSGVKAGLDGPSSSCDPSMGGAFSPPGASASMSATALLQKAAEMGATAGGYGVGAGFSTVGFGPMIGGPPVMGPFGPLKTPAVLEPFDGLPFGQTHLVGLDVGRLLPGQHFYGSSHGHGHGVGSMTRAIGSLMHGGQQMDHRRPDDVRVVDYLGVDDQRSCFSGVSPFGPDLGPCTTIYPKCDHTLYGVLITKTKTLSNTFALISIGFCFSLSSFPS

SEQ ID NO: 17148 - DNA, 1140 bp, Sorghum bicolor
  misc_feature: Ceres ANNOT ID no. 8670461
  misc_feature: Encodes the peptide sequence at SEQ ID NO 17149
atggcactcccaaccccggtggtagccggcattgcggccggcgccgccgcgctgctgctgaccgccgccctcgccgtggcgtggtggctcgtgaggcggcgccgtgaccggagctccgacaccggctcctcgtcggaggctcctcctcccacgctggcggagtggggccggtgcggccggacctcgtcggcgccggagttccacggcgccaggcagttctcgctggaggagctcgcgcacgccacccacaacttcgccgaggccaacctggtgggcgcgggcggcttcgggctggtgtacaagggcctgctgctcgacggcaccgtcgtcgccatcaagcgccgcgccggcgcgccgcggcaggacttctccgacgagattaggaggctatcggagatctggcaccgcaacgtggtgacgctgatcggctactgccaagacggcggtctacagatgctggtgttcgagtacctgcccaacggcagtgtcagcggccacttgtacgacactggcaaggagtcgatgacaaggctggagttcaagcagaggttgtcgatagccattggagcagctaaaggtctgaatcatctgcacagcctggcgccgccgttgatccacagggacttcaagacgagcaacgtcctcgtcgacgagaacttcatcgccaaggtgtccgacgccgggatcgacaggctgctgcgaggcttcaatggcgctgccactccggcggcgaacggcggtgtcttccaagacccagaggtacattcactggcgcagctttctgaaagcagcgacgtgtacagctttggtgtgttccttctggagctgatcactggcagggaagcagcggggctgattccgccggaatccaacgattctttcgctcaattgatggaggcgcgtttcagctcgaacgagctggtggacccgaggctgggagggagcttcacctcggagggcatggcggaggtggtgggcctggcgttccactgcctgagcacgtcggcgaggcggcggcccaggatgcggctggtggccgcggagctggaccggatcctggagaaggagatgaccctcaccaccgtcatgggcgacggcaccgccatcgtcacgctcggcagccagctcttcacgtcctga

SEQ ID NO: 17149 - protein, 379 aa, Sorghum bicolor
  misc_feature: Useful for making plants with altered cell wall content and/or composition
  misc_feature: Functional homolog of the protein sequence given in SEQ ID NO 14487
  misc_feature: Ceres ANNOT ID no. 8670461
  misc_feature (70)..(349): SWISSPROT Homolog: EC 2.7.11.1 Non-specific serine/threonine protein kinase
  misc_feature (85)..(349): Pfam ID: Pkinase_Tyr Pfam Description: Protein tyrosine kinase
MALPTPVVAGIAAGAAALLLTAALAVAWWLVRRRRDRSSDTGSSSEAPPPTLAEWGRCGRTSSAPEFHGARQFSLEELAHATHNFAEANLVGAGGFGLVYKGLLLDGTVVAIKRRAGAPRQDFSDEIRRLSEIWHRNVVTLIGYCQDGGLQMLVFEYLPNGSVSGHLYDTGKESMTRLEFKQRLSIAIGAAKGLNHLHSLAPPLIHRDFKTSNVLVDENFIAKVSDAGIDRLLRGFNGAATPAANGGVFQDPEVHSLAQLSESSDVYSFGVFLLELITGREAAGLIPPESNDSFAQLMEARFSSNELVDPRLGGSFTSEGMAEVVGLAFHCLSTSARRRPRMRLVAAELDRILEKEMTLTTVMGDGTAIVTLGSQLFTS

SEQ ID NO: 17150 - DNA, 999 bp, Sorghum bicolor
  misc_feature: Ceres ANNOT ID no. 8670510
  misc_feature: Encodes the peptide sequence at SEQ ID NO 17151
atggcgaggcagtgtatcgcttccatgcttgcactggcattgctcctcggagcatttgcagccattcctacaggagtgcaagccatcggggtgtgctacggcgtgaacggcgacaacctgccgtcggcgagcgacgtggtgaaactgtaccagtccaacggcatcaacctgatgcgcatctacttcgcggacaccaacgcgctcaacgcgctgagcggcagcaacatcggggtgatcatggacgtgcccaacacggacctctcctcgctggcctccgacccgagcgcggcggcgacgtgggtgaagagcaacgtgcaggcgttcccgggggtcaacttcaagtacatcgccgtcggcaacgaggtctccggcggggacaccaacaacatcctccccgccatgaagaacgtcaactcggcgctgtccaacgccgggctgggaaagatcaaggtgtccacggcggtgcagagcggcgtcacgcaggggtacccgccgtcgcagggcagcttctcgcagagctacatggcgcccatcgcgcagtacctgcagagcacgggggccccgctgctctgcaacgtctacccctacttctcctacacgggcaacgaggcccagatcgccctcagctacgcgctcttcacgtcgccggggaccgtcgtgcaggacggcagcaacgcgtaccagaacctcttcgacgcgctcgtcgacaccttcgtgtccgcgctcgagaacgccggcgccgggaacgtcggcgtcgtcgtgtccgagagcggctggccgtccgccggcggcgacgccgccacgccggggaacgcgcagacctacaaccagaacctcatcaaccatgtcgggaagggcacgcccaagcgccccggcgccatcgagacctacatcttcgccatgttcaacgaggacaagaagacgggagccgagacggagaggcacttcggactcttcaacccggacaaatcgccggcgtactccatcaatttctcctaa

SEQ ID NO: 17151 - protein, 332 aa, Sorghum bicolor
  misc_feature: Useful for making plants with altered carbohydrate content
  misc_feature: Functional homolog of the protein sequence given in SEQ ID NO 14488
  misc_feature: Useful for making plants with altered cell wall content and/or composition
  misc_feature: Functional homolog of the protein sequence given in SEQ ID NO 14489
  misc_feature: Ceres ANNOT ID no. 8670510
  misc_feature (1)..(332): SWISSPROT Homolog: EC 3.2.1.39 Glucan endo-1,3-beta-D-glucosidase
  misc_feature (29)..(331): Pfam ID: Glyco_hydro_17 Pfam Description: Glycosyl hydrolases family 17
MARQCIASMLALALLLGAFAAIPTGVQAIGVCYGVNGDNLPSASDVVKLYQSNGINLMRIYFADTNALNALSGSNIGVIMDVPNTDLSSLASDPSAAATWVKSNVQAFPGVNFKYIAVGNEVSGGDTNNILPAMKNVNSALSNAGLGKIKVSTAVQSGVTQGYPPSQGSFSQSYMAPIAQYLQSTGAPLLCNVYPYFSYTGNEAQIALSYALFTSPGTVVQDGSNAYQNLFDALVDTFVSALENAGAGNVGVVVSESGWPSAGGDAATPGNAQTYNQNLINHVGKGTPKRPGAIETYIFAMFNEDKKTGAETERHFGLFNPDKSPAYSINFS

SEQ ID NO: 17152 - DNA, 1035 bp, Sorghum bicolor
  misc_feature: Ceres ANNOT ID no. 8670509
  misc_feature: Encodes the peptide sequence at SEQ ID NO 17153
atgtcgaagcaggttgtcgcttccatgcttgcactggcattgcttcttgtagcttccatgcttgcactggcattgctgctccgagcatttccagccactcctacaggagtcaaatccatcggcgtgtgctacggcgtgaacggcgacaacctgccgccggcgagcgacgtggtgcagctctaccagtccaacggcatcaacctcatgcgcatctacttcccggacaccaacgcgctgaacgcgctgagcggcagcaacatcggcgtgatcatggacgtgcccaactcggacctctcctcgctggcctccgacccgagcgcggcggcgacgtgggtgcagaggaacttgcaggcgttcccgggggtcaacttcaagtacatcgccgtcggcaacgaggtctccggcggggacaccaacagcatcctccccgccatgcagaacgtcaactccgcgctcgccaacgccgggctcggaggcatcaaggtgtccacggcggtggagagcggcgtcacccagggcttcccgccgtcgcagggcagcttctcgcagggttacatggggcccatcgcgcagtacctgcagagcacgggggccccgctgctctgcaacgtctacccctacttctcctacacgggcaacgaggcccagatcgccctcagctacgcgctcttcacgtcgccggggaccgtcgtgcaggacgacgacggcaacgcgtaccagaacctcttcgacgcgctcgtcgacaccttcgtgtccgcgctcgagaacgccggcgccgggaacgtcggcgtcgtcgtgtccgagagcgggtggccgtcggacggcggcgacgccgccacaccagggaacgcgcagacctacaaccagaacctcatcaaccatgtcgggcagggcacgccgaagcgccccggcgccatcgagacctacatcttcgccatgttcaacgaggacaagaagacgggagcggagacggagaggcacttcggactcttcaacccggacaaatctccggcgtaccccatcaatttctcctaa

SEQ ID NO: 17153 - protein, 344 aa, Sorghum bicolor
  misc_feature: Useful for making plants with altered carbohydrate content
  misc_feature: Functional homolog of the protein sequence given in SEQ ID NO 14488
  misc_feature: Useful for making plants with altered cell wall content and/or composition
  misc_feature: Functional homolog of the protein sequence given in SEQ ID NO 14489
  misc_feature: Ceres ANNOT ID no. 8670509
  misc_feature (29)..(344): SWISSPROT Homolog: EC 3.2.1.39 Glucan endo-1,3-beta-D-glucosidase
  misc_feature (40)..(343): Pfam ID: Glyco_hydro_17 Pfam Description: Glycosyl hydrolases family 17
MSKQVVASMLALALLLVASMLALALLLRAFPATPTGVKSIGVCYGVNGDNLPPASDVVQLYQSNGINLMRIYFPDTNALNALSGSNIGVIMDVPNSDLSSLASDPSAAATWVQRNLQAFPGVNFKYIAVGNEVSGGDTNSILPAMQNVNSALANAGLGGIKVSTAVESGVTQGFPPSQGSFSQGYMGPIAQYLQSTGAPLLCNVYPYFSYTGNEAQIALSYALFTSPGTVVQDDDGNAYQNLFDALVDTFVSALENAGAGNVGVVVSESGWPSDGGDAATPGNAQTYNQNLINHVGQGTPKRPGAIETYIFAMFNEDKKTGAETERHFGLFNPDKSPAYPINFS

SEQ ID NO: 17154 - DNA, 1164 bp, Sorghum bicolor
  misc_feature: Ceres ANNOT ID no. 8670517
  misc_feature: Encodes the peptide sequence at SEQ ID NO 17155
atggcgattatgcaaggctcctttgctcatttggttgttggggcaattattgttggagtttttgcctctcttctttcaggtgcattctttgtatataggaatatatatacagggaaatctccaatctatacatctgtttcaaacgattatatagatatatatgttttattattaacgacaatgagccgtgttacacgtacggttgcaatgcatgcaggtgtgcattcctatggcgtgtgctacggcacggtagccgacgacctcccgccgccgagcgaagtggtgcagctctacaaatccaacggcatcagcaccatgcgcgtctacttccccgacagcaaggtgatggaggcgctgcgcggctcgggcatcggcctcgtcctcggcgtcgccaacgaggacatcgccaacctcgccgcgtgcgcgccgtgcgcggcgtcgtgggtgcagaccaacgtccggacctaccacccggacgtgagcgtcctgtacatcgccgtcggcaacgaggtcgacgcccccgccgccgcccagagcatcctcccggccatgcggaacctgcaggccgcgctggccgcggcggggctcgacggcgacatcaaggtgtccacctgcgtgaagctcgacgtggtcaccaacaccttcccgccctccagcggcgtgttcgcgcaggcctacatgacggacatcgcgcggttcctggctgccaccggcgcgccgctgctcgccaacgtgtacccctacttcgcctaccgtggcagcaacccgggagacatcagcctcagctacgcgctcttccagccgggcaccacggtgagggacggcggcagcgggctggtgtacacgaacctgctcgacgccatggtggactccgtgcacgccgcgctcgagaaggccggcgcgcccaccgtcagggtcgtcgtgtccgagaccggctggccgtccgccgggggcgcggcggccaccgtgcagaacgcgcagacgtacgtccagaacatgatcgatcatgccgggcagggcacgcccaagaagcctgggccgttggagacgtacgtgttcgccatgttcaacgaggaccagaagcccggggagctgacggagaggaactttgggctcttctaccctaacaaggctccggtttatcccgtcgttttccggcggtga

SEQ ID NO: 17155 - protein, 387 aa, Sorghum bicolor
  misc_feature: Useful for making plants with altered carbohydrate content
  misc_feature: Functional homolog of the protein sequence given in SEQ ID NO 14490
  misc_feature: Useful for making plants with altered cell wall content and/or composition
  misc_feature: Functional homolog of the protein sequence given in SEQ ID NO 14489
  misc_feature: Ceres ANNOT ID no. 8670517
  misc_feature (69)..(385): SWISSPROT Homolog: EC 3.2.1.39 Glucan endo-1,3-beta-D-glucosidase
  misc_feature (77)..(385): Pfam ID: Glyco_hydro_17 Pfam Description: Glycosyl hydrolases family 17
MAIMQGSFAHLVVGAIIVGVFASLLSGAFFVYRNIYTGKSPIYTSVSNDYIDIYVLLLTTMSRVTRTVAMHAGVHSYGVCYGTVADDLPPPSEVVQLYKSNGISTMRVYFPDSKVMEALRGSGIGLVLGVANEDIANLAACAPCAASWVQTNVRTYHPDVSVLYIAVGNEVDAPAAAQSILPAMRNLQAALAAAGLDGDIKVSTCVKLDVVTNTFPPSSGVFAQAYMTDIARFLAATGAPLLANVYPYFAYRGSNPGDISLSYALFQPGTTVRDGGSGLVYTNLLDAMVDSVHAALEKAGAPTVRVVVSETGWPSAGGAAATVQNAQTYVQNMIDHAGQGTPKKPGPLETYVFAMFNEDQKPGELTERNFGLFYPNKAPVYPVVFRR

SEQ ID NO: 17156 - DNA, 849 bp, Sorghum bicolor
  misc_feature: Ceres ANNOT ID no. 8670506
  misc_feature: Encodes the peptide sequence at SEQ ID NO 17157
atgcaggtcggaggaggagcggccgacagccccggcgcggcggcgggcgcggaggcgccccgcccgagccgctacgagtcgcagaagcggcgggactggcacacgttcgggcagtacctgcgcaaccaccggccgccgctggagctggcgcggtgcagcggcgcgcacgtgctcgagttcctgcgctacctggaccagttcggcaagaccaaggtccacgcgccggggtgccccttcttcggccacccgtcgccgccggccccgtgcccgtgcccgctgcgccaggcctggggcagcctcgacgcgctcgtcggccgcctgcgcgccgccttcgaggagcacgggggacggcctgaggccaaccccttcggcgcgcgcgccgtgcgcctatacctccgcgaggtccgcgacagccaggccaaggcgcgcggcatcgcctacgagaagaagcgccggaagcggccgtccgcttcgtcgtcccagtcgtcgccgcaggccgcgacgaccccgccgcagcaggctcctcccgtctcctcgccggccctgtcggacgtggtggccgagagggccgacgtgcgggcgcacgtgccggacgccgggcatcagcagcaccatcacctgcaccagcaccagcaccagcatcacttcttcatgccacacccgcagttcctgcacgggttcagcctgctgccgggcaaccccgaagcggtggctgccaatggcaacggcggcggcagcagcagcgctagcgtcgctgccggcaacggtgacgagatagcgctggcgatggcggcggcggcggaggcgcacgcggcggggtgcatgctgccgctgtcggtgttcaactag

SEQ ID NO: 17157 - protein, 282 aa, Sorghum bicolor
  misc_feature: Useful for making plants with modulated low light sensitivity
  misc_feature: Functional homolog of the protein sequence given in SEQ ID NO 14143
  misc_feature: Useful for making plants with modulated nitrogen use efficiency
  misc_feature: Functional homolog of the protein sequence given in SEQ ID NO 13437
  misc_feature: Useful for making plants with modulated flowering time
  misc_feature: Functional homolog of the protein sequence given in SEQ ID NO 13982
  misc_feature: Useful for making plants with modulated biomass
  misc_feature: Functional homolog of the protein sequence given in SEQ ID NO 13338
  misc_feature: Useful for biocontainment applications
  misc_feature: Functional homolog of the protein sequence given in SEQ ID NO 13983
  misc_feature: Ceres ANNOT ID no. 8670506
MQVGGGAADSPGAAAGAEAPRPSRYESQKRRDWHTFGQYLRNHRPPLELARCSGAHVLEFLRYLDQFGKTKVHAPGCPFFGHPSPPAPCPCPLRQAWGSLDALVGRLRAAFEEHGGRPEANPFGARAVRLYLREVRDSQAKARGIAYEKKRRKRPSASSSQSSPQAATTPPQQAPPVSSPALSDVVAERADVRAHVPDAGHQQHHHLHQHQHQHHFFMPHPQFLHGFSLLPGNPEAVAANGNGGGSSSASVAAGNGDEIALAMAAAAEAHAAGCMLPLSVFN

SEQ ID NO: 17158 - DNA, 1056 bp, Sorghum bicolor
  misc_feature: Ceres ANNOT ID no. 8670513
  misc_feature: Encodes the peptide sequence at SEQ ID NO 17159
atggcagcgcaaggtgcaggagcatcagcttctactctgtccggcttccacatggcgctgccgctgccgctgctcctcctcctcactatcttggcttccatgctcgcaagggcggcgtcggtgggcgtgtgctacggcacgagcggcgacaacctgccgccggcgagcgcggtggtgggcatgctccgggagaacggcttcacggtggtgcgtctctactggcccgacggcgaggcgctggcggcgctgggcgggagcggcatcaaggtggtggtgggcgcgcccaacgaggtcctgaccacgctggcgtccagcgcgtccgccgcggcggcgtgggtccgcgacaacatccaggcgcacccgacggtgtccttccgctacgtggtggtgggcaacgaggtccccgtggggcagacgcagttccttgtcccggccatggagaacgtgcacgcggcgctggccgccgccgggctgggccacgtgaaggtgacgacggccatctcgcagggcaccatcgccgtgcacctgccgccgtcggcgggcgtgttcacggaggaggcgctgtcgttcatgagctacgtggtggcgttcctggcgcggacacgcgcgccgctgctggcgaacctgtacccgtacttcgtctacacgctagctctgggccacatgagcatggacttcccgctgttcacggcgccggagacggtggtgcaggacggggagtacgggtaccagaacctgttcgacgcgacggtggacgcgctgtacgcggcggtggggaggctcggcgtccccgggggtgagcgcgtgagggtggtggtgtcggagaccgggtggccgacggcgggcggcgcggcggcgtcggtggagaacgcgaggacgtacaaccagaacctggtgacgcacgtgtggaagggcacgccgcggcggccaaggagggtggaggcctacgtgttcgccatgttcaacgaggaccagaaggaggccggcgtggagcagaactgggggctcttctacccaaacatggagagggtttaccccatcaccttcggagcctga

SEQ ID NO: 17159 - protein, 351 aa, Sorghum bicolor
  misc_feature: Useful for making plants with altered cell wall content and/or composition
  misc_feature: Functional homolog of the protein sequence given in SEQ ID NO 14489
  misc_feature: Ceres ANNOT ID no. 8670513
  misc_feature (40)..(349): SWISSPROT Homolog: EC 3.2.1.39 Glucan endo-1,3-beta-D-glucosidase
  misc_feature (41)..(349): Pfam ID: Glyco_hydro_17 Pfam Description: Glycosyl hydrolases family 17
MAAQGAGASASTLSGFHMALPLPLLLLLTILASMLARAASVGVCYGTSGDNLPPASAVVGMLRENGFTVVRLYWPDGEALAALGGSGIKVVVGAPNEVLTTLASSASAAAAWVRDNIQAHPTVSFRYVVVGNEVPVGQTQFLVPAMENVHAALAAAGLGHVKVTTAISQGTIAVHLPPSAGVFTEEALSFMSYVVAFLARTRAPLLANLYPYFVYTLALGHMSMDFPLFTAPETVVQDGEYGYQNLFDATVDALYAAVGRLGVPGGERVRVVVSETGWPTAGGAAASVENARTYNQNLVTHVWKGTPRRPRRVEAYVFAMFNEDQKEAGVEQNWGLFYPNMERVYPITFGA

SEQ ID NO: 17160 - DNA, 1014 bp, Sorghum bicolor
  misc_feature: Ceres ANNOT ID no. 8670514
  misc_feature: Encodes the peptide sequence at SEQ ID NO 17161
atggcgaggcaacaacaagttgcttccatgctcgcagctgctctgctcgttgcaacgtttgcgtccattcctacaagcgtgcactccatcggcgtctgctatggcatgctgggcaacaacctgccgtccagcagcgacgtggtgcagctctacaagtccaagggcatcaagggcatgcgcatctactcgccctcccagtccgcgctcaacgccctccgcaactccggcctcgccgtcatcgtcgacaccggcaacggcaacgagctcagccagctcgcgaggagcgcctcgtacgcggcgtcgtgggtgcagagcaacgtgaagccctactaccccgccgtcaacatcaagtacatcgccgtcggcaacgaggtgcagggcggcgccacgcagagcatcctcccggcgatccggaacctggacgccgccctggcgcgcgccgggctctcggccatcaagtgctccacgtcggtgcgcttcgacgtgatcgccaactcctacccgccctccagcggctcgttcgcgcaggggtacatggcggacgtcgcgcggtacctcgccggcaccggcgcgccgctgctcgtcaacgtgtacccgtacttctcgtaccgggacaacccgcgcgacatcagcctgggctacgccacgttccagccgggcaccaccgtcagggacaacggcaacgggctcacctacaccaacctgttcgacgccatggtggacgccgtcgtcgcggcgctggagaaggccggcgccggcggggtgaggatcgtcgtctccgagagcggctggccgtccgccggcgggtccggggcgagcgtggacaacgcgaggaagtacaaccaggggctcatcaaccacgtcgggcgcggcacgcccaagaggcgcggaacgctggagactttcatcttcgccatgttcaacgagaaccagaagaccggcgaccccacggagaagaacttcgggctgttctacggcaacaagcagcccgtgtacccgatcagcttcaactaa

SEQ ID NO: 17161 - protein, 337 aa, Sorghum bicolor
  misc_feature: Useful for making plants with altered carbohydrate content
  misc_feature: Functional homolog of the protein sequence given in SEQ ID NO 14491
  misc_feature: Useful for making plants with altered cell wall content and/or composition
  misc_feature: Functional homolog of the protein sequence given in SEQ ID NO 14489
  misc_feature: Ceres ANNOT ID no. 8670514
  misc_feature (20)..(336): SWISSPROT Homolog: EC 3.2.1.39 Glucan endo-1,3-beta-D-glucosidase
  misc_feature (30)..(336): Pfam ID: Glyco_hydro_17 Pfam Description: Glycosyl hydrolases family 17
MARQQQVASMLAAALLVATFASIPTSVHSIGVCYGMLGNNLPSSSDVVQLYKSKGIKGMRIYSPSQSALNALRNSGLAVIVDTGNGNELSQLARSASYAASWVQSNVKPYYPAVNIKYIAVGNEVQGGATQSILPAIRNLDAALARAGLSAIKCSTSVRFDVIANSYPPSSGSFAQGYMADVARYLAGTGAPLLVNVYPYFSYRDNPRDISLGYATFQPGTTVRDNGNGLTYTNLFDAMVDAVVAALEKAGAGGVRIVVSESGWPSAGGSGASVDNARKYNQGLINHVGRGTPKRRGTLETFIFAMFNENQKTGDPTEKNFGLFYGNKQPVYPISFN

SEQ ID NO: 17162 - DNA, 954 bp, Sorghum bicolor
  misc_feature: Ceres ANNOT ID no. 8670542
  misc_feature: Encodes the peptide sequence at SEQ ID NO 17163
atgggaggtgtgcacggtgtctgctacggcgtggtcggcgacaacctcccttcgcgtgcggacgtggtgcagctctgcaagtccaacaacatccagtccatgcgcatctacttcccggaccaggccgccctcgccgcgctccgcggcagcggcatcgccgtcatcctcgacgtgggcggcgtggacgccgtccgcgccctcgccggcagcgcctcggtcgccgcggactgggtccaggccaacgtgcaggcgtaccagcgcgacgtcctcatcaggtacatcgccgtcggcaacgaggtaggccccggcgacggcgccgcggcgctgctcctcccggccatgcggaacgtgcacgccgcgctggtgtccgcggggctcgacggcagcatcaaggtgtccacggcggtgaagatggacgcgttcgccgacacgttcccgccgtcccgcggcgcgttcgcgcaggggtacatggccgacgtcgcgcggttcctggccgacaccggcgcgccgctgctggccaacgtgtacccctacttcgcctacagggacgacccgcggaacatcagcctcgagttcgccagcttccgaccgggggcggccacggtgacggacggcggcaacgggctggcgtacacgaacctcctcgacgccatggtggacgccatctacgcggcgctggagaaggccggcgcgcccggcgtccaggtcgtcgtgtcggagagcgggtggccgtccgccggcgggttcgcggcgagcgtggacaacgcgcgccagtacaaccagggtgtgatcgaccatgtccggcagggcacgccccggaggcccgggttgctggagacgtacgtgttcgccatgttcaacgagaaccagaagactggggacgagatcgagaggcactttggcttgttcaacccggacaagacgcctgtttacccaatcaacttcccaaactga

SEQ ID NO: 17163 - protein, 317 aa, Sorghum bicolor
  misc_feature: Useful for making plants with altered carbohydrate content
  misc_feature: Functional homolog of the protein sequence given in SEQ ID NO 14490
  misc_feature: Useful for making plants with altered cell wall content and/or composition
  misc_feature: Functional homolog of the protein sequence given in SEQ ID NO 14489
  misc_feature: Ceres ANNOT ID no. 8670542
  misc_feature (14)..(317): SWISSPROT Homolog: EC 3.2.1.39 Glucan endo-1,3-beta-D-glucosidase
  misc_feature (5)..(315): Pfam ID: Glyco_hydro_17 Pfam Description: Glycosyl hydrolases family 17
MGGVHGVCYGVVGDNLPSRADVVQLCKSNNIQSMRIYFPDQAALAALRGSGIAVILDVGGVDAVRALAGSASVAADWVQANVQAYQRDVLIRYIAVGNEVGPGDGAAALLLPAMRNVHAALVSAGLDGSIKVSTAVKMDAFADTFPPSRGAFAQGYMADVARFLADTGAPLLANVYPYFAYRDDPRNISLEFASFRPGAATVTDGGNGLAYTNLLDAMVDAIYAALEKAGAPGVQVVVSESGWPSAGGFAASVDNARQYNQGVIDHVRQGTPRRPGLLETYVFAMFNENQKTGDEIERHFGLFNPDKTPVYPINFPN

SEQ ID NO: 17164 - DNA, 1083 bp, Sorghum bicolor
  misc_feature: Ceres ANNOT ID no. 8670534
  misc_feature: Encodes the peptide sequence at SEQ ID NO 17165
atggctacgaagcttgtggttctcggtatcccctgggatgttgacactgaagggttacgggagtacatggccaagtttggacccctagacgattgtgtcgtcatgaaggagcggtcttctgggcgatctcgcgggtttggctatgtaacattcgcctcagccgacgatgcaaagaatgttcttgattgcaaccatgttcttggcagccgtacgttagaagtgaagatagctactccaaaggaagaaatgaaatcacaaggaacaaagaaagctacaaggatattcgttgctcgaattccacaatcagttgacgaatcgatgtttcgtaggcattttgaagcttttggggaaattcttgatctttacatgccaaaggaacatggttcaaaagggcatcgtggaattgggtttatcacgtttcagagtgcagagtctgtggacagcatcatgcaagagtcacatgagcttgatggtacaacagtagttgttgatcgtgcgactccgaaggatgaagatgtcagataccccccaagtaggccatctcagggtggctatggtgcatataacgcatatatttcagctgctacaaggtatgcagctttgggtgcaccaacgctgtatgaccatcctggatcagcttatggaagaggatactatggatcctcccaagcagtgggcaagaagatatttgttggtagacttccacaagaagcaaacacagatgacctaaggcattactttggcagatttggtcgaatcgtagatgcatacattccgaaggaccccaaaagaagtggccaccgaggtttcggttttgtcaccttcgctgatgagggtgtggcagaacgggtagctcgtagaagccatgaaattctaggccatgaggttgcaatagacccagctgcaccacttgagaatgattcagctgctggtggttacattgatcccatggatctttacggagcttatggttcaatgcgatccttcggcaggttctgcggcggtctagattataattatggctatggccccagcagtggaagcagcagatcaagatcagattggcgataccgaccttactga

SEQ ID NO: 17165 - protein, 360 aa, Sorghum bicolor
  misc_feature: Useful for making plants with altered lignin content
  misc_feature: Functional homolog of the protein sequence given in SEQ ID NO 14492
  misc_feature: Useful for making plants with modulated biomass
  misc_feature: Functional homolog of the protein sequence given in SEQ ID NO 14493
  misc_feature: Ceres ANNOT ID no. 8670534
  misc_feature (88)..(180): SWISSPROT Homolog: EC 5.2.1.8 Peptidylprolyl isomerase
  misc_feature (229)..(298): Pfam ID: RRM_1 Pfam Description: RNA recognition motif. (a.k.a. RRM, RBD, or RNP domain)
  misc_feature (5)..(74): Pfam ID: RRM_1 Pfam Description: RNA recognition motif. (a.k.a. RRM, RBD, or RNP domain)
  misc_feature (94)..(163): Pfam ID: RRM_1 Pfam Description: RNA recognition motif. (a.k.a. RRM, RBD, or RNP domain)
MATKLVVLGIPWDVDTEGLREYMAKFGPLDDCVVMKERSSGRSRGFGYVTFASADDAKNVLDCNHVLGSRTLEVKIATPKEEMKSQGTKKATRIFVARIPQSVDESMFRRHFEAFGEILDLYMPKEHGSKGHRGIGFITFQSAESVDSIMQESHELDGTTVVVDRATPKDEDVRYPPSRPSQGGYGAYNAYISAATRYAALGAPTLYDHPGSAYGRGYYGSSQAVGKKIFVGRLPQEANTDDLRHYFGRFGRIVDAYIPKDPKRSGHRGFGFVTFADEGVAERVARRSHEILGHEVAIDPAAPLENDSAAGGYIDPMDLYGAYGSMRSFGRFCGGLDYNYGYGPSSGSSRSRSDWRYRPY

SEQ ID NO: 17166 - DNA, 987 bp, Sorghum bicolor
  misc_feature: Ceres ANNOT ID no. 8670519
  misc_feature: Encodes the peptide sequence at SEQ ID NO 17167
atgcctgcttcggtggccacggctgcaccaccaacactctgctccaagcgtgtgcgagccatcggcgtgtgctacggcgtgataggcagcggcctcccttccaagagcgacgtggtgcagctctacaagtccaacggcatcaccagcatgcgcttctacttcgccgacaaggacctcctcaccgcgctgcgcggctcaggcatctccctcgccctcgacgtcggcaacgacaaggtcggcgagctcgcctccgactccgccgccgccgcgtcctgggtccgggacaacgtgcaggcctactacccggacgtggacatcaggtacgtcgtggtcgggaacgaggtccccggcgccgcgtcggtgctccaggccatgcagaacgtgcacgccgcgctcgcgtccgccggcctcgccggcaacgtccgggtgtccacggcggtgaagatggacgcgatcgagaattcctcgccgccgtccagcggcgtgttcaaggaccccgccgcgatgtcgcccatcgtgcagttcctcgccggcaacggcgcgccgctgctcgccaacgtgtacccttacttcgcgtacgagtacagcgacggcatcgacctgaactacgcgctgttccagccgagctccacgacggtgacggaccccgctaacgggctggtgtacacgaacctcttcgacgccatggtggatgccgtccgcgccgcgctggacaaggccggcggaggcggcggcgtcgacgtcgtggtgtcggagagcgggtggccgtccgccgacgggaagggtgccaccgtggacaacgcgcggacctataaccagaacctgatcaaccatgccggcaagggcacgccgagaaagccgggatccatggaggtgtacgtgttcgccatgttcaacgaggaccagaaggacggggaccccacggagaagaagtttgggctcttcaatccggacaagacaccagtttaccctattaatttcgcatga

SEQ ID NO: 17167 - protein, 328 aa, Sorghum bicolor
  misc_feature: Useful for making plants with altered carbohydrate content
  misc_feature: Functional homolog of the protein sequence given in SEQ ID NO 14494
  misc_feature: Useful for making plants with altered cell wall content and/or composition
  misc_feature: Functional homolog of the protein sequence given in SEQ ID NO 14489
  misc_feature: Ceres ANNOT ID no. 8670519
  misc_feature (6)..(327): SWISSPROT Homolog: EC 3.2.1.39 Glucan endo-1,3-beta-D-glucosidase
  misc_feature (21)..(327): Pfam ID: Glyco_hydro_17 Pfam Description: Glycosyl hydrolases family 17
MPASVATAAPPTLCSKRVRAIGVCYGVIGSGLPSKSDVVQLYKSNGITSMRFYFADKDLLTALRGSGISLALDVGNDKVGELASDSAAAASWVRDNVQAYYPDVDIRYVVVGNEVPGAASVLQAMQNVHAALASAGLAGNVRVSTAVKMDAIENSSPPSSGVFKDPAAMSPIVQFLAGNGAPLLANVYPYFAYEYSDGIDLNYALFQPSSTTVTDPANGLVYTNLFDAMVDAVRAALDKAGGGGGVDVVVSESGWPSADGKGATVDNARTYNQNLINHAGKGTPRKPGSMEVYVFAMFNEDQKDGDPTEKKFGLFNPDKTPVYPINFA

SEQ ID NO: 17168 - DNA, 1533 bp, Sorghum bicolor
  misc_feature: Ceres ANNOT ID no. 8670547
  misc_feature: Encodes the peptide sequence at SEQ ID NO 17169
atggcgacgacggcgctgtgcctgtgctcctccctccctctctctctctctctctctctctcttccgctccctgcagccatgagcaagcaaaaaagcatgacaccattggctgtaaaatacaattaaaagcttcgtccggaacggcaaggctgatggtccaggacgaaggctcctcgtcgtcggtcacatcgtcctcgctgcacaacttctccaccatgccgctccacgcatcccccggcgcgggggccgccgcgtccccgacgacgccgccgtggctggcgcgcgagctccgctccgacgagcgtggcctctgcctcatccacctcctcctcaactgcgccgcggcggcgggcgcgggccggctggacgccgccaacgcggcgctcgagcacatcgcggcgctggcgtccccggacggcgacgccatgcagcgcgtggccgccgccttcgcggaggcgctggcgcggcgtgctctgcgcgcgtggcctgggctgtgccgcgcgctgctcctgccccgtgccggccccacgcctgccgagctcgccgtcgcgaggcgccacttcctcgacctctgcccgttcctccgcctcgcgggcgccgccgccaaccagtccgtgctggaggccatggagtcggagaagatcgtgcacgtcgtcgatctaggcggcgccgacgccacgcagtggctcgagctgctccacctgctggccgcgcggcccgagggcccgccgcacctccgcctcaccgccgtgcacgagcaccgggacgtgctcacgcagacggccatggtgctcaccaaggaggcggagcgcttggacgtgccgttccaattcaaccccgtcgtgtcccggctggaggcactggacgtggagtcgctccgcgtgaagaccggcgaggcgctggccgtcacctccagcctgcagctgcactgcctcctggcctccgacgacgacagctccggcaaggacggccaccaccaccagagcagcaacggcaaaggcggggacacgaacaagcggccgcggagcccggagtccggcgtgtccccgtcgacgtcgcgcgcggacgcgttcctgggcgcgctgtggggcctgtcgccgaaggtggtcgtggtgacggagcaggaggcatcgcacaacgcggcgccgctgacggagcggttcgtggaggcgctcaactactacgcggcgctgttcgactgcctggagtcggcggcgcctcgcgggtcggtggagcgcgcgcgcgtcgagcgctggctcctcggggaggaggtgaagaacatcgtggcgtgcgacggcgcggatcggcgggaaaggcacgagcggctggaccgatgggcggcgcggatggagggcgccggcttcgcacgcgtcccgctcagctactacgcgctgctgcaggcgcggcgggcggcgcaggggctgggatgcgacgggttcaaggtgcgcgaggagaagggcgccttcttcctgtgctggcaggaccgcgccatcttctccgtctccgcctggcgcggccgccgcttcgactga

SEQ ID NO: 17169 - protein, 510 aa, Sorghum bicolor
  misc_feature: The sequence is a functional homolog of SEQ ID NO 1257 in the 10/374,780 US patent application
  misc_feature: The sequence is a functional homolog of SEQ ID NO 216 in the 10/714,887 US patent application
  misc_feature: The sequence is a functional homolog of SEQ ID NO 216 in the 11/435,388 US patent application
  misc_feature: The sequence is a functional homolog of SEQ ID NO 1255 in the 10/374,780 US patent application
  misc_feature: Ceres ANNOT ID no. 8670547
  misc_feature (78)..(414): Pfam ID: GRAS Pfam Description: GRAS family transcription factor
MATTALCLCSSLPLSLSLSLSSAPCSHEQAKKHDTIGCKIQLKASSGTARLMVQDEGSSSSVTSSSLHNFSTMPLHASPGAGAAASPTTPPWLARELRSDERGLCLIHLLLNCAAAAGAGRLDAANAALEHIAALASPDGDAMQRVAAAFAEALARRALRAWPGLCRALLLPRAGPTPAELAVARRHFLDLCPFLRLAGAAANQSVLEAMESEKIVHVVDLGGADATQWLELLHLLAARPEGPPHLRLTAVHEHRDVLTQTAMVLTKEAERLDVPFQFNPVVSRLEALDVESLRVKTGEALAVTSSLQLHCLLASDDDSSGKDGHHHQSSNGKGGDTNKRPRSPESGVSPSTSRADAFLGALWGLSPKVVVVTEQEASHNAAPLTERFVEALNYYAALFDCLESAAPRGSVERARVERWLLGEEVKNIVACDGADRRERHERLDRWAARMEGAGFARVPLSYYALLQARRAAQGLGCDGFKVREEKGAFFLCWQDRAIFSVSAWRGRRFD

SEQ ID NO: 17170 - DNA, 858 bp, Sorghum bicolor
  misc_feature: Ceres ANNOT ID no. 8670553
  misc_feature: Encodes the peptide sequence at SEQ ID NO 17171
atggcggcgccgcctgtccagcccgtgccacccgcggctgcggcggccgtgaacggggacgcgttccgcctgggcttcgtcggcgcgggcaacctggccgagagcatcgcccgcggcgtggcggcgtcgggcgtcctcccggcctccgccatccgcaccgcgccccaccgccgccccgagcgcggcgaggccttcgcgtccttcggcgcgtgcttgctccaaaccaatgcccaggttgtcgacgacagcgatgtgatcgtcatctctgtgaagcctcagatcgtgaagcaggttctacttgagctgagaccacgcctgtcggaagaaaagcttttggtgtccattgctgccggcatcaagatgcaagatctgcaggattggtctggtcaacgacgtattattagagtaatgcccaacaccccttcagctgttggacaagctgcatcagtcatgtgcttgggagagatggcaactcaggatgatgaaaaccgtgtaaggaaactattcagtgctattggaaaagtttggacagctgaagagaaatattttgatgctgtaactggcctgagcggtagtggtccagcctacattttcttagcaatagaggccatggctgatggtggagttgctgctgggcttcctcgggaccttgcccttggtcttgcatctcaaacagttcttggtgctgcaaccatggtgagccagacaggtaaacatccagggcaactgaaagatcaggtcacttctccagcagggactaccatagctgggattcaggagctcgagaagggcgcatttcgtggaacactgattagtgctgttgttgctgccgcaaagcggtgccgcgaactgtcgtag

SEQ ID NO: 17171 - protein, 285 aa, Sorghum bicolor
  misc_feature: Useful for making plants with modulated drought sensitivity
  misc_feature: Functional homolog of the protein sequence given in SEQ ID NO 14495
  misc_feature: Ceres ANNOT ID no. 8670553
  misc_feature (20)..(285): SWISSPROT Homolog: EC 1.5.1.2 Pyrroline-5-carboxylate reductase
  misc_feature (23)..(269): Pfam ID: F420_oxidored Pfam Description: NADP oxidoreductase coenzyme F420-dependent
MAAPPVQPVPPAAAAAVNGDAFRLGFVGAGNLAESIARGVAASGVLPASAIRTAPHRRPERGEAFASFGACLLQTNAQVVDDSDVIVISVKPQIVKQVLLELRPRLSEEKLLVSIAAGIKMQDLQDWSGQRRIIRVMPNTPSAVGQAASVMCLGEMATQDDENRVRKLFSAIGKVWTAEEKYFDAVTGLSGSGPAYIFLAIEAMADGGVAAGLPRDLALGLASQTVLGAATMVSQTGKHPGQLKDQVTSPAGTTIAGIQELEKGAFRGTLISAVVAAAKRCRELS

SEQ ID NO: 17172 - DNA, 678 bp, Sorghum bicolor
  misc_feature: Ceres ANNOT ID no. 8670605
  misc_feature: Encodes the peptide sequence at SEQ ID NO 17173
atggccaacatgctcgctacttccctcctcgccgccgccgtcctcctggcgctcgccgcccctgctgcagtgctcgccggcgaccccgacatgctccaggacatctgcgtcgccgactacaaatccctcaagggcccactgcggctgaacggattcccgtgcaagaggccggagaacgtgacggcgaaggacttcttctccaacgcggtggcgatcgccggcaacacgagcaacgcgttgggttccgcggtgacgtcggcgaacgtgcagacgctgccggggctgaacacgctgggcgtgtcggtgtcgcgcatcgacttcgcggcgtggggcgtgaaccccccgcacgtccacccgcgcgccaccgaggtcatcttcgtcctcgagggattcctcgacgtcggcttcgtcaccaccggcaaccgcctgtacgcgcgcaccgtcagcgccggcgaggtcttcgtcttcccccgggggctcgtccactaccagaggaacaacggccgcggcgccgccgcggtgctctccgccttcgatagccagctgcctggcacgcagtccgtcgccgaggccctctttggcgcctcgccgccggtgcccaccgacgtgctcgctaggagtttccaggtcgacgcaggactcgtggaggacatcaaatccaagtttccttccaagtag

SEQ ID NO: 17173 - protein, 225 aa, Sorghum bicolor
  misc_feature: Useful for making plants with modulated nitrogen use efficiency
  misc_feature: Functional homolog of the protein sequence given in SEQ ID NO 14277
  misc_feature: Ceres ANNOT ID no. 8670605
  misc_feature (28)..(225): SWISSPROT Homolog: EC 1.15.1.1 Superoxide dismutase
  misc_feature (67)..(216): Pfam ID: Cupin_1 Pfam Description: Cupin
MANMLATSLLAAAVLLALAAPAAVLAGDPDMLQDICVADYKSLKGPLRLNGFPCKRPENVTAKDFFSNAVAIAGNTSNALGSAVTSANVQTLPGLNTLGVSVSRIDFAAWGVNPPHVHPRATEVIFVLEGFLDVGFVTTGNRLYARTVSAGEVFVFPRGLVHYQRNNGRGAAAVLSAFDSQLPGTQSVAEALFGASPPVPTDVLARSFQVDAGLVEDIKSKFPSK

SEQ ID NO: 17174 - DNA, 738 bp, Sorghum bicolor
  misc_feature: Ceres ANNOT ID no. 8670612
  misc_feature: Encodes the peptide sequence at SEQ ID NO 17175
atgacggtggtggatgccgagtcgcggttccatgtcctcgcggtggacgacagcatcgtcgacaggaagctcatcgagatgctcctcaagaactcgtcctaccaagtgaccacggtggattccgggagcaaggcgctggagctgctggggctgagggacaacggggcggaggacgcgtcgtcgccgtcttcctcctcccctgaccaccaggagatcgacgtgaatctcatcatcactgactactgcatgccaggcatgacaggatacgatctgctcaagagggtgaaggggtcctcctcgctcaaggacattcctgtggtgatcatgtcttctgagaatgtgcctgcccggatcagcaggtgcttggaagatggcgcagaggagtttttcctgaagcccgtgaagctcgctgacatgaagaagctcaagtcacacctgctgaaacggaagcagcccaagaagcctcaggtacaggcggtggagcctgagcagcagctggaccagcacccggctgtgcaaacggcgcacgagccggaggaaaccgcggcggagccggtgtcggccgcatccaacggaaccgccgttggcgactgcaacggcggcaacaagaggaaggcggctgccatggagcagcagcaggaggaggggcggctgaccctgacggcggcagcggcagcggtggcgccggagagcaccaagccgaggctgtccacgagcagcctggccgtggagacctga

SEQ ID NO: 17175 - protein, 245 aa, Sorghum bicolor
  misc_feature: Useful for making plants with modulated low light sensitivity
  misc_feature: Useful for making plants with modulated nitrogen use efficiency
  misc_feature: Functional homolog of the protein sequence given in SEQ ID NO 13599
  misc_feature: The sequence is a functional homolog of SEQ ID NO 932 in the 10/666,642 US patent application
  misc_feature: Useful for making plants with altered carotene content
  misc_feature: Useful for making plants with altered lignin content
  misc_feature: Useful for making plants with altered terpenoid content
  misc_feature: Functional homolog of the protein sequence given in SEQ ID NO 13463
  misc_feature: Ceres ANNOT ID no. 8670612
  misc_feature (10)..(144): Pfam ID: Response_reg Pfam Description: Response regulator receiver domain
MTVVDAESRFHVLAVDDSIVDRKLIEMLLKNSSYQVTTVDSGSKALELLGLRDNGAEDASSPSSSSPDHQEIDVNLIITDYCMPGMTGYDLLKRVKGSSSLKDIPVVIMSSENVPARISRCLEDGAEEFFLKPVKLADMKKLKSHLLKRKQPKKPQVQAVEPEQQLDQHPAVQTAHEPEETAAEPVSAASNGTAVGDCNGGNKRKAAAMEQQQEEGRLTLTAAAAAVAPESTKPRLSTSSLAVET

SEQ ID NO: 17176 - DNA, 3213 bp, Sorghum bicolor
  misc_feature: Ceres ANNOT ID no. 8670613
  misc_feature: Encodes the peptide sequence at SEQ ID NO 17177
atggctttagcttatgctagtgccatgtttcctccttcgagctcttcacataaaacttgggaggacccgtcattcttcaagtggagaaagcgtgaggcgcatgtgccattgcgctcacaggacacgctggaaggagccctgaagtattggcatgaacggaggaatgtgaactacctcaattctgacactgctgtctggaacgatgatgcggttcgcggtgctctggaaagtgctgttttttggtccaagggcttaccatacgccaaatctctaagtggatactggaaattccttctgtctccttcggtggaaagtgttccagagagattctatgatactcattttgatgattcaaattgggcggctttgccagttccctcaaattggcaaatgcatgggtttgaccgtccaatctacacaaatatgacttatcctttcccattgaacccaccatttgtgccggctgataatcccacgggttgttacaggacagtttttcacatcccaaaagagtggaaaggtcggaggatcttgctgcactttgaagctgttgattctgcattttttgcttgggtaaatggagtaccaattgggtatagccaggacagcaggcttcctgctgagtttgaagttaccgattgctgccatccttgtgattcggacaaggaaaatgttcttgctgttcaagttatgaggtggagtgatggttcttatcttgaagatcaggatcactggaggctgtctggtattcacagggatgtgctcctactatcaaagccacagatttttatcacagattacttcttcaaagcaaccttggatgataatttcagtttagctgatattgaggtcaatttgaaaccgaagccaaacccaactggaagcccttgtcgtggttttcatggttatgttcttggtggaaaaatagaaaatccaaaactttggtctagtgagcatcccaacttatacactcttgttgttctccttaaagatgccaatgggaagcttattgattgtgagtcatgccaagtgggcattcgtaatgtggtcctggcacacaagcaaatgcttgtcaatggatgtcctgttgtactaagaggtgtcaacagacatgagcaccatccacgccttggaaagacaaatttagaagcatgcatgattgaggatgtgattttgatgaagcaaaacaatatcaatgctgttagaaatagccattacccacagcacccgaggtggtatgagttatgtgacatctttggtctttatgtcatagatgaagccaacattgagacacatggttttgatgattctagcactttcaagcatcctacactagaacctatctgggcaaatgcaatgcttgatcgtgttgttagcatggtggagagagataagaatcatgcatgcattattgtttggtccctaggaaatgaatcttcatatggacctaatcatgtttccatgtctgggtggattcgtggaagggatccaacaagactccttcattatgagggaggtggttccagaacatcatccacagatattgtgtgccccatgtatatgcgtgtctgggatattgttaagatagcaaaagatccatctgaaacaaggcctctaattctttgcgaatattcacatgctatgggaaacagtaatgggaatattgatgcgtattggatggccatagacaacacttttggactccaaggaggttttatatgggactgggttgatgagggtttactgaaggaggactcagatggatctaaattttgggcatatggtggtgactttggagatactccaaatgactccaatttttgcctcaatggcattgtgtggcctgatcggacgattcacccagctgttcatgaagttaaataccttcaccagcctatcaaaatatcatcagcagaaaacatgcttaagattgaaaatggacacttttttgagacaacagaatctttggacttcagttgggttcttcatggagatggttgcatcttgggctctggtcctttgaatgttccaactttggcaccgcaaactagtcatctcatcaacatggaattatcaccatggtttgccctttggagtgcttgtgcagcaaaagaagtatttttgtctgtaaatgtgaaacagaggcatgaaacacgatgggctaaagccggtcatctcttggcttcagcacaactgtgtttgcctcagaaaaatgtctttgtccccaacgtgatagcattctccagcagccctttggtctgtgaacgcattggtgatagtgtaaccatctgcaagaataatgcatggaaaattaaagtaaacagtcaattgggaacaatcgacagctggaaggtcaacgacgttgagcttatgagcaaggggatactcccatgcttttggcgcgcaccaactgacaacgacaaaggaggtttcttcaccaagccatacgcttcgcgatggagagaagccttcctcgacaacgtctcgttccacagcagtcagttctctatcaaggaatcgccggacaacaccgtggagttctccaccgtctactacggcgttcccgggcacttgccgaagcctgacgacgaagcctccgagtccattctcttccgggtgaagatggtctgccggatccacgagtcaggcgacgtggttctcgactacgaggtgaaccccaaggccgacctccctccccttccccgggtaggcgtcgtgttcagcgccgagaggtccctgagccacgtcacttggtacgggcggggccccttcgagtgctacccggaccgcaaggcggcggcgcacgtcggcgtgtacgagagcagcgtggaggagctgcacgtgccgtacattgcccccgtggagtgcggcgggcgggcggacgtcaggtgggtggcgctccgcgacggcggcgggctcggcctgtacgcgtcggcgcacggcggctccccgccgatgcaggtgagcgccagctactacggcgccgcggagctcgacagggcgacgcacgtccacaggctggtgaagggggacgacatcgaggtgcatcttgaccacaggcacatggggctgggcggcgacgacagctggtcgccgtgcgtgcacgagcagtacctgctgccgccgacgcggtacgccttctccctgcggctctgccccctgctgccgacgtcgttgtgccatgacatctacaggtctcagctacccagctga

SEQ ID NO: 17177 - protein, 1070 aa, Sorghum bicolor
  misc_feature: Useful for making plants with altered alkaloid content
  misc_feature: Functional homolog of the protein sequence given in SEQ ID NO 13068
  misc_feature: Ceres ANNOT ID no. 8670613
  misc_feature: Down-regulated in root tissues in response to methyl jasmonate treatment
  misc_feature (309)..(1051): SWISSPROT Homolog: EC 3.2.1.23 Beta-galactosidase
  misc_feature (349)..(635): Pfam ID: Glyco_hydro_2_C Pfam Description: Glycosyl hydrolases family 2, TIM barrel domain
  misc_feature (85)..(260): Pfam ID: Glyco_hydro_2_N Pfam Description: Glycosyl hydrolases family 2, sugar binding domain
  misc_feature (762)..(1052): Pfam ID: Bgal_small_N Pfam Description: Beta galactosidase small chain
  misc_feature (262)..(347): Pfam ID: Glyco_hydro_2 Pfam Description: Glycosyl hydrolases family 2, immunoglobulin-like beta-sandwich domain
MALAYASAMFPPSSSSHKTWEDPSFFKWRKREAHVPLRSQDTLEGALKYWHERRNVNYLNSDTAVWNDDAVRGALESAVFWSKGLPYAKSLSGYWKFLLSPSVESVPERFYDTHFDDSNWAALPVPSNWQMHGFDRPIYTNMTYPFPLNPPFVPADNPTGCYRTVFHIPKEWKGRRILLHFEAVDSAFFAWVNGVPIGYSQDSRLPAEFEVTDCCHPCDSDKENVLAVQVMRWSDGSYLEDQDHWRLSGIHRDVLLLSKPQIFITDYFFKATLDDNFSLADIEVNLKPKPNPTGSPCRGFHGYVLGGKIENPKLWSSEHPNLYTLVVLLKDANGKLIDCESCQVGIRNVVLAHKQMLVNGCPVVLRGVNRHEHHPRLGKTNLEACMIEDVILMKQNNINAVRNSHYPQHPRWYELCDIFGLYVIDEANIETHGFDDSSTFKHPTLEPIWANAMLDRVVSMVERDKNHACIIVWSLGNESSYGPNHVSMSGWIRGRDPTRLLHYEGGGSRTSSTDIVCPMYMRVWDIVKIAKDPSETRPLILCEYSHAMGNSNGNIDAYWMAIDNTFGLQGGFIWDWVDEGLLKEDSDGSKFWAYGGDFGDTPNDSNFCLNGIVWPDRTIHPAVHEVKYLHQPIKISSAENMLKIENGHFFETTESLDFSWVLHGDGCILGSGPLNVPTLAPQTSHLINMELSPWFALWSACAAKEVFLSVNVKQRHETRWAKAGHLLASAQLCLPQKNVFVPNVIAFSSSPLVCERIGDSVTICKNNAWKIKVNSQLGTIDSWKVNDVELMSKGILPCFWRAPTDNDKGGFFTKPYASRWREAFLDNVSFHSSQFSIKESPDNTVEFSTVYYGVPGHLPKPDDEASESILFRVKMVCRIHESGDVVLDYEVNPKADLPPLPRVGVVFSAERSLSHVTWYGRGPFECYPDRKAAAHVGVYESSVEELHVPYIAPVECGGRADVRWVALRDGGGLGLYASAHGGSPPMQVSASYYGAAELDRATHVHRLVKGDDIEVHLDHRHMGLGGDDSWSPCVHEQYLLPPTRYAFSLRLCPLLPTSLCHDIYRSQLPS

SEQ ID NO: 17178 - DNA, 675 bp, Sorghum bicolor
  misc_feature: Ceres ANNOT ID no. 8670604
  misc_feature: Down-regulated in root tissues in response to methyl jasmonate treatment
  misc_feature: Encodes the peptide sequence at SEQ ID NO 17179
atgactaacaagctcgccacttccctcctcgccgccgccgtcctcctggcgctcgccgcccctgcggtgctcgccggcgaccccgacatgctccaggacatctgcgtcgccgactacaaatccctcaagggcccactgcgggtgaacgggttcccgtgcaagaggccggagaacgtgacggcgaacgacttcttctcgaacgcgctggcgaccccggggaacacgggcaacgcgttgggttccgcggtgacgtcggcgaacgtggagacgctgccggggctcaacacgctgggcgtgtcggtgtcgcgcatcgacttcgcggcgtggggcgtgaacccgccgcacgtccacccgcgcgccaccgaggtcatcttcgtcctccagggctccctcgacgtcggcttcgtcaccaccgccaaccgcctgtacgcccgcaccgtctgcgccggcgaggtcttcgtcttccccagggggctcgtccactaccagaagaacaacggcggcagccccgccgcggtgctctccgccttcgacagccagctgcccggcacgcagcccgtcgccgaggccctcttcggagcggcgccgcccgtgcccaccgacgtgctcgccaggagcttccagatcgacggaggactcgtcgaggccatcaagtccaagttcccgcccaagtaa

SEQ ID NO: 17179 - protein, 224 aa, Sorghum bicolor
  misc_feature: Useful for making plants with modulated nitrogen use efficiency
  misc_feature: Functional homolog of the protein sequence given in SEQ ID NO 14277
  misc_feature: Ceres ANNOT ID no. 8670604
  misc_feature (27)..(223): SWISSPROT Homolog: EC 1.15.1.1 Superoxide dismutase
  misc_feature (67)..(215): Pfam ID: Cupin_1 Pfam Description: Cupin
MTNKLATSLLAAAVLLALAAPAVLAGDPDMLQDICVADYKSLKGPLRVNGFPCKRPENVTANDFFSNALATPGNTGNALGSAVTSANVETLPGLNTLGVSVSRIDFAAWGVNPPHVHPRATEVIFVLQGSLDVGFVTTANRLYARTVCAGEVFVFPRGLVHYQKNNGGSPAAVLSAFDSQLPGTQPVAEALFGAAPPVPTDVLARSFQIDGGLVEAIKSKFPPK

SEQ ID NO: 17180 - DNA, 1032 bp, Sorghum bicolor
  misc_feature: Ceres ANNOT ID no. 8670630
  misc_feature: Encodes the peptide sequence at SEQ ID NO 17181
atggccgacgtcgggatggtcgtcgtcgcacgcaacagcagcaccagcaccaggagttctacatcaaatacgtttgttgcgacggctgccggcgatcccatcttcccgctgctctccgggggcccctgcgtgcttgatccggacgccgccgccaagtcggcctcctccggggcgcccgccaacgccatccagttctggcagccgccgccgcagtcgccgtcgtcggctgccgctgctgcgggcgctaaccctaaccctagcgccagccccttcgcctacctcaagaagcccctcccgatgctggacgccggcgctgggtcctccggctccggcgccaccacgtgccaggactgcggcaaccaagcgaagaaggactgcggccacaacaggtgccgcacctgctgcaagagccgcggcttcgactgctccacgcacgtcaagagcacctgggtccccgccgcgcgccgccgtgaacgccagcagctcgccgcctctggctccgcatcttcctcccccgccactgcctccgcggcagccgtcgccgtgtccgcgtccaagaagccccgcctcctctcgtcgcagaccaccacctcgcacacgtccacctccaacgccaccacgccacgaagcttcgacaccacttccagtcaccaagacgcgtcgttcagggacagcctcccgaggcaggtgcgcgcgccggcggtgtttaagtgcgtgcgcgtgacgtccatcgaggacggcgaggacgagtacgcgtaccaggcgacggtcaccatcaacggccacctgttcaaagggtttctgtacgaccagggccccgacgacggccgtcacgcggccaccagcaacgacgattccacggcgggagtgcccaacatctcggagctccatctcggagcggcgtctggctccggcgccggcggcgtgagggaaggcggcacctcgatggcgcccacagagctgtacggtggcggaggacatcatccgcacattcttggcggctcgtcaagctatggtaacaccatgaactga

SEQ ID NO: 17181 - protein, 343 aa, Sorghum bicolor
  misc_feature: The sequence is a functional homolog of SEQ ID NO 482 in the 10/666,642 US patent application
  misc_feature: Ceres ANNOT ID no. 8670630
MADVGMVVVARNSSTSTRSSTSNTFVATAAGDPIFPLLSGGPCVLDPDAAAKSASSGAPANAIQFWQPPPQSPSSAAAAAGANPNPSASPFAYLKKPLPMLDAGAGSSGSGATTCQDCGNQAKKDCGHNRCRTCCKSRGFDCSTHVKSTWVPAARRRERQQLAASGSASSSPATASAAAVAVSASKKPRLLSSQTTTSHTSTSNATTPRSFDTTSSHQDASFRDSLPRQVRAPAVFKCVRVTSIEDGEDEYAYQATVTINGHLFKGFLYDQGPDDGRHAATSNDDSTAGVPNISELHLGAASGSGAGGVREGGTSMAPTELYGGGGHHPHILGGSSSYGNTMN

SEQ ID NO: 17182 - DNA, 540 bp, Sorghum bicolor
  misc_feature: Ceres ANNOT ID no. 8670714
  misc_feature: Encodes the peptide sequence at SEQ ID NO 17183
atgatcatctccaagaagaaccgccgcgagatctgcaagtacctcttccatgagggtgtcctgtatgccaagaaggactacaacctggccaagcacccgaagcttgatgtgcccaacttggaggtgattaagctcatgcagagcttcaagtcaaaggagtatgtgagggagaccttctcctggcagtactactactggtacctcaccaacgatggcattgagcacctccgcaccttcctcaacctgccatcagaggttgtgcctaataccctcaagaagtcctccaagcccccatctcggcccttcggctctggcccaccgggtgaccgccccaggggtccccctcgttttggggaagacagacctaggtttggggatagggatggttacagaggagctccacgtggtgctccaggtgattttggtggtgagaagggtggtgctccatcagagttccagccaacttttaggggtagcagacctggctttggccgtggtggcggcggcgctttcggtgccggtggatcttccatggagtga

SEQ ID NO: 17183 - protein, 179 aa, Sorghum bicolor
  misc_feature: Useful for making plants with modulated nitrogen use efficiency
  misc_feature: Functional homolog of the protein sequence given in SEQ ID NO 13175
  misc_feature: Ceres ANNOT ID no. 8670714
  misc_feature (3)..(98): Pfam ID: S10_plectin Pfam Description: Plectin/S10 domain
MIISKKNRREICKYLFHEGVLYAKKDYNLAKHPKLDVPNLEVIKLMQSFKSKEYVRETFSWQYYYWYLTNDGIEHLRTFLNLPSEVVPNTLKKSSKPPSRPFGSGPPGDRPRGPPRFGEDRPRFGDRDGYRGAPRGAPGDFGGEKGGAPSEFQPTFRGSRPGFGRGGGGAFGAGGSSME

SEQ ID NO: 17184 - DNA, 1134 bp, Sorghum bicolor
  misc_feature: Ceres ANNOT ID no. 8670715
  misc_feature: Encodes the peptide sequence at SEQ ID NO 17185
atggcggctactactacttctcgtcctgccgctgctgctctgccgctggcggtactggcagcagccatggtggtggccctggcggcggccggcgacgtcgtcgagcagcagctcgaggtcgttggcagcaggtacccgccgctggcgccgggcctgtcgttcgacttctacaagaagagctgcccgaaggcggagtcgatcgtgaaggagttcctgtcgtcggcggtgcggcagaacgtggggctcgccgccgcgctgatccgggtccacttccacgactgcttcgtgcagggctgcgacgcctccgtcctgctcgactccacgcccacccagcccagcgagcagctgtcgccgcccaaccttacgcttcggccggcggcgttcaaggccatcaacgacatccgcgcccgcctcgagcaggcctgcggccgcgtcgtctcctgcgccgacatcaccgccctcgccgcccgtgaatccgttgccctgggtggcggtccggcgtacaaggttccactaggccggcgagacggcctagcagcggcgtcgaacgccgccgtcctggcggcgctcccgtcgccgacgtcgacggtgccaacactgctctccttcctgtcgaagatcaacctggacgtgacggacctggtggcgctgtccggcggccacacggtgggcgtcgcgcactgcagctccttcagcaaccgtctgttcccgacgcaggacccgacgctgaacaagttcttcgcggggcagctgtacgggacgtgcccgaccgacaccacggtgaacacgacggtgaacgacatccggacgcccaacacgttcgacaacaagtactacgtggacctgctgaaccggcagggcctcttcacgtcggaccaggacctgctcaccaacgctacgaccaggcctatcgtcaccaagttcgctgttgaccagaacgccttcttcgagcagttcgtctactcgtacgtcaagatggggcagatcaatgtgctcacggggtcccagggacaggttcgcgccaactgctccgcgcgcaacgctggtgctgcaggtaacggtggcgaggaccagctgccgtggtccgacgtcgtcgagaccgtcgtcgacgccaccggcagcctcgtgctctag

SEQ ID NO: 17185 - protein, 377 aa, Sorghum bicolor
  misc_feature: Useful for making plants with altered cell wall content and/or composition
  misc_feature: Functional homolog of the protein sequence given in SEQ ID NO 13759
  misc_feature: Useful for making plants with altered carbohydrate content
  misc_feature: Functional homolog of the protein sequence given in SEQ ID NO 13714
  misc_feature: Ceres ANNOT ID no. 8670715
  misc_feature (43)..(344): SWISSPROT Homolog: EC 1.11.1.7 Peroxidase
  misc_feature (68)..(311): Pfam ID: peroxidase Pfam Description: Peroxidase
MAATTTSRPAAAALPLAVLAAAMVVALAAAGDVVEQQLEVVGSRYPPLAPGLSFDFYKKSCPKAESIVKEFLSSAVRQNVGLAAALIRVHFHDCFVQGCDASVLLDSTPTQPSEQLSPPNLTLRPAAFKAINDIRARLEQACGRVVSCADITALAARESVALGGGPAYKVPLGRRDGLAAASNAAVLAALPSPTSTVPTLLSFLSKINLDVTDLVALSGGHTVGVAHCSSFSNRLFPTQDPTLNKFFAGQLYGTCPTDTTVNTTVNDIRTPNTFDNKYYVDLLNRQGLFTSDQDLLTNATTRPIVTKFAVDQNAFFEQFVYSYVKMGQINVLTGSQGQVRANCSARNAGAAGNGGEDQLPWSDVVETVVDATGSLVL

SEQ ID NO: 17186 - DNA, 1776 bp, Sorghum bicolor
  misc_feature: Ceres ANNOT ID no. 8670759
  misc_feature: Encodes the peptide sequence at SEQ ID NO 17187
atgtccatggccctcaggcggctccgaccttgggccttcattctcttcttccttgtccttttctcctacgatgaatctggacttgggagcagaagcaggaggagtggcgtcgcgcaggccacgcagagagtcttcctgtatccacaggctcccaaggtctcctccatcgtgagcagcaagtacaggactgcgtaccacttccagcctcccaagaactggatcaacggaccaatgtactacaatggtatctatcaccaattctaccagtacaacccaaatggttctgtctggggtaacatagtctgggcccactcggtctcaacagatctcatcaactggatccagctcgaaccagcgatagagcggacgactccgagcgatatcaatggctgctggacaggttcagccacaatcctcaagagtgaccagcctgccattatatacactggtgctgacacggagaagcgtcaggtccaaaacattgcgtttcccaagaacttgtctgatccatacctgagggagtggatcaaaccagacaacaacccactgatccaaccagttggacaaggattgatcccaaaccagttcagagatccgacaaccggttggatcggaccagatgggctatggagaatagcagttggggctgaactggacggctacagtgctgcacttctgtacaagagtgaggattttttgcactggactagagtggatcacccactatactcttccaatgcctccaccatgtgggagtgcccggatttcttcgcagtgttaccaggcaagaacattgggctggacctgtcggcggcaatcccgaatggcgccaagcatgtcctcaagatgagccttgacaattgtgacaagtacatgattggcatttatgatctgaaaagtgatgtctttgtgccagattccgtccttgaggaccgaagactgtggtcaaggattgattatggcaactactatgcttcaaagtcattctttgattcgaagaaaggcaggaggatcatatggggttggacaaatgagacagacagttcgtcgtatgacgttgccaaaggttgggctggaatccatgcaatccccaggactatatggttagataaagacagtaagcaactgctgcaatggccagttgaagagattgagtcgcttcgaggaaaagaagtcagccagcaaggcctggagctcaagaagggagatctgtttgagattaaggaaattgatctctgcaggttagcagatgtggagatagatttcgagcttacatccatagacagtgccgatgcttttgacccttcctggctcttggacatcgagaagcactgtcgagaagcagatgcgtcagttcatggcggtgtaggcccatttgggcttgtgcttcttgcatctgacaacatggaagagcacacctctgtgcacttcagagtttacaaatcacaggagaagtacatggttcttatgtgctctgatctgagaaagtcgtccttgagaccagaactgtacacaccagcctatggaggcttctttgagttcgacctcgagaaggaaaagactatatctttgagaactttgatcgatcgctctgcagtggaaagcttcggtggaggtggtagggtctgcatcatggctagggtctatccggtggcgctcatcgacgatggtggcactcgcatgtatgccttcaacaatggcactacaaccgtcaaagtgcctcggctaaaggcatggagcatgaggagagcacaagttaatgttaagaagggataa

SEQ ID NO: 17187 - protein, 591 aa, Sorghum bicolor
  misc_feature: Useful for making plants with altered carbohydrate content
  misc_feature: Functional homolog of the protein sequence given in SEQ ID NO 13760
  misc_feature: Useful for making plants with modulated biomass
  misc_feature: Functional homolog of the protein sequence given in SEQ ID NO 13761
  misc_feature: Ceres ANNOT ID no. 8670759
  misc_feature (11)..(591): SWISSPROT Homolog: EC 3.2.1.26 Beta-fructofuranosidase
  misc_feature (66)..(380): Pfam ID: Glyco_hydro_32N Pfam Description: Glycosyl hydrolases family 32 N terminal
  misc_feature (422)..(540): Pfam ID: Glyco_hydro_32C Pfam Description: Glycosyl hydrolases family 32 C terminal
MSMALRRLRPWAFILFFLVLFSYDESGLGSRSRRSGVAQATQRVFLYPQAPKVSSIVSSKYRTAYHFQPPKNWINGPMYYNGIYHQFYQYNPNGSVWGNIVWAHSVSTDLINWIQLEPAIERTTPSDINGCWTGSATILKSDQPAIIYTGADTEKRQVQNIAFPKNLSDPYLREWIKPDNNPLIQPVGQGLIPNQFRDPTTGWIGPDGLWRIAVGAELDGYSAALLYKSEDFLHWTRVDHPLYSSNASTMWECPDFFAVLPGKNIGLDLSAAIPNGAKHVLKMSLDNCDKYMIGIYDLKSDVFVPDSVLEDRRLWSRIDYGNYYASKSFFDSKKGRRIIWGWTNETDSSSYDVAKGWAGIHAIPRTIWLDKDSKQLLQWPVEEIESLRGKEVSQQGLELKKGDLFEIKEIDLCRLADVEIDFELTSIDSADAFDPSWLLDIEKHCREADASVHGGVGPFGLVLLASDNMEEHTSVHFRVYKSQEKYMVLMCSDLRKSSLRPELYTPAYGGFFEFDLEKEKTISLRTLIDRSAVESFGGGGRVCIMARVYPVALIDDGGTRMYAFNNGTTTVKVPRLKAWSMRRAQVNVKKG

SEQ ID NO: 17188 - DNA, 1266 bp, Sorghum bicolor
  misc_feature: Ceres ANNOT ID no. 8670791
  misc_feature: Encodes the peptide sequence at SEQ ID NO 17189
atggccgtggcggcggccttcgcccccggctccctcctccccactactcccagcacccacctcgccccgttcactctgcgcttccgcttcagcctcctcccacggcgcgccgccgtggtcgccgccgctgccacactccgcgaggtctgcgccggccgcgtcccggaccacgtcctgcagagggctgaggaggttggctatgtcgtgcccaccgaggtgcaggagcaatccctgccgcttctgctgtccggccaggattgcattctccacgcgcagacaggctccgggaagacgcttgcctacctcctgtccgtcttctccgccatcgacttcagcaggtcctcggtgcaagcgctggttgttgtccccacaagggagctcggcatgcaggttaccaaggttgctagactactcgcagccaaggcctgcaccgtcatggctttgcttgatggcggtatgctcaagaggcaaaagagctgggtcaaggcagagccccctgcagtaattgtagctaccgtggcaagcttgtgtcaaatggtcgaaaggcgggcgttcagccttcaatccatgagagtgttagttatcgatgaggttgattttatttttgggtcatcaaagcaagtcagctctcttcgcaagatattaacctcttattcagcagcttccagtcgtcaaaccatatttgcaagcgcatcgatccctcagcacaatcgctttctgcacgactgtgtacagcataaatggaccaagatctgcaccaagaaggaaaggttgcatgtcttactatccttgcttgagagggatgcaccaaagtctggaatcatatttgttgctgaacagtctgagagatcaaagaaggctggaaatcctccttcaaccaccgtcgtcgctgagttcttgagaaatgcatataagggaagcctagatgtgctgctgctggaagaagatatgaacttcaacgctcgagctgcctcgttctctgtaagaagtcagggaagaggattcctgctggtttcaacagacatagcaagcagggggtttgaccttcctcaaaccagccacatatacaacttcgaccttcctaagacggcgacagactatctgcaccgtgctggaagaactgggagagaacctttctccaggttggaatgcggcgtgacaacccttataacagaggatgagcacttcgtgctgcagaggtttcagaatgagctcaagttccactgtgaagagctgccccttgaatccatgttcacgttctcttga

SEQ ID NO: 17189 - protein, 421 aa, Sorghum bicolor
  misc_feature: Useful for making plants with altered alkaloid content
  misc_feature: Useful for making plants with altered terpenoid content
  misc_feature: Functional homolog of the protein sequence given in SEQ ID NO 14496
  misc_feature: Ceres ANNOT ID no. 8670791
  misc_feature (71)..(239): Pfam ID: DEAD Pfam Description: DEAD/DEAH box helicase
  misc_feature (302)..(378): Pfam ID: Helicase_C Pfam Description: Helicase conserved C-terminal domain
MAVAAAFAPGSLLPTTPSTHLAPFTLRFRFSLLPRRAAVVAAAATLREVCAGRVPDHVLQRAEEVGYVVPTEVQEQSLPLLLSGQDCILHAQTGSGKTLAYLLSVFSAIDFSRSSVQALVVVPTRELGMQVTKVARLLAAKACTVMALLDGGMLKRQKSWVKAEPPAVIVATVASLCQMVERRAFSLQSMRVLVIDEVDFIFGSSKQVSSLRKILTSYSAASSRQTIFASASIPQHNRFLHDCVQHKWTKICTKKERLHVLLSLLERDAPKSGIIFVAEQSERSKKAGNPPSTTVVAEFLRNAYKGSLDVLLLEEDMNFNARAASFSVRSQGRGFLLVSTDIASRGFDLPQTSHIYNFDLPKTATDYLHRAGRTGREPFSRLECGVTTLITEDEHFVLQRFQNELKFHCEELPLESMFTFS

SEQ ID NO: 17190 - DNA, 1194 bp, Sorghum bicolor
  misc_feature: Ceres ANNOT ID no. 8670788
  misc_feature: Encodes the peptide sequence at SEQ ID NO 17191
atgtcgtcgtcgtctccctctccggcggcggcggccgcgcgcctggatctggacggcaaccccatcgcgcccctcaccatctgcatgattggcgccggcggcttcatcgggtcccacctctgcgagaagctcatggccgagacgcgccacgtcgtcctcgccgtcgacgtctactgcgacaagatccgccacctcgtcgaccccgcgccgccgcacctcgccggccgcatctctttccaccgcctcaacatcaagaacgactccaggctcgagggcctcatcaagatggccgatctgaccatcaacctggcggccatctgcacgccggcggactacaacacgcgccccctcgacaccatctacagcaacttcatcgacgcactcccagtggtcaaatactgctccgagaacagcaagcgtctcatccacttctccacctgcgaggtctatggcaagaccatcggcagcttcctccccaaagaccacccgctccgcaaggaacctgaattttatgttctgaaagaagatgagtcaccctgtatttttggtccaattgtgaaacaacgatggtcctatgcatgcgcaaagcaacttattgagaggcttatatttgctgaaggcgcagaaaatggccttgaattcacgattgtgagacctttcaattggattggcccaagaatggacttcattcctggtgttgatggtcctagtgagggtgtaccccgggttttggcttgcttcagtaacaatctgctccgccgagagcccttgaagcttgttgatgggggccagtctcagagaacttttgtttacattaaggatgccatcgaagctgttgtgctaatgattgaaaatcctgctcgagccaatggtcacatcttcaatgttgggaatcctgacaatgaggttactgttagggagttggcccaaatgatgacagaggtctatgcaaacgtctcaggagaggcaccactggatgagcccatgattgatgtaagttcgagtcagttctatggtgaaggatatgatgacagtgataagagaattcccgacatgactataatcaacaagcagctaggttggaacccaaagactcctctcaaggatctgctggagacaacgttgacatatcagcacaagacatacaaagaagctgtgaagaggcaaatgtcgcaggcttcatcaacgagttag

SEQ ID NO: 17191 - protein, 397 aa, Sorghum bicolor
  misc_feature: Useful for making plants with altered carbohydrate content
  misc_feature: Functional homolog of the protein sequence given in SEQ ID NO 14497
  misc_feature: Useful for making plants with altered cell wall content and/or composition
  misc_feature: Useful for making plants with altered lignin content
  misc_feature: Functional homolog of the protein sequence given in SEQ ID NO 14498
  misc_feature: Ceres ANNOT ID no. 8670788
  misc_feature: Up-regulated in shoot tissues in response to methyl jasmonate treatment
  misc_feature (27)..(197): SWISSPROT Homolog: EC 4.1.1.35 UDP-glucuronate decarboxylase
  misc_feature (192)..(382): SWISSPROT Homolog: EC 5.1.3.2 UDP-glucose 4-epimerase
  misc_feature (27)..(297): Pfam ID: Epimerase Pfam Description: NAD dependent epimerase/dehydratase family
MSSSSPSPAAAAARLDLDGNPIAPLTICMIGAGGFIGSHLCEKLMAETRHVVLAVDVYCDKIRHLVDPAPPHLAGRISFHRLNIKNDSRLEGLIKMADLTINLAAICTPADYNTRPLDTIYSNFIDALPVVKYCSENSKRLIHFSTCEVYGKTIGSFLPKDHPLRKEPEFYVLKEDESPCIFGPIVKQRWSYACAKQLIERLIFAEGAENGLEFTIVRPFNWIGPRMDFIPGVDGPSEGVPRVLACFSNNLLRREPLKLVDGGQSQRTFVYIKDAIEAVVLMIENPARANGHIFNVGNPDNEVTVRELAQMMTEVYANVSGEAPLDEPMIDVSSSQFYGEGYDDSDKRIPDMTIINKQLGWNPKTPLKDLLETTLTYQHKTYKEAVKRQMSQASSTS

SEQ ID NO: 17192 - DNA, 1065 bp, Sorghum bicolor
  misc_feature: Ceres ANNOT ID no. 8670809
  misc_feature: Up-regulated in shoot tissues in response to methyl jasmonate treatment
  misc_feature: Encodes the peptide sequence at SEQ ID NO 17193
atggaggaggacctgcttcttctggaagcatcagtcgctgtgccgccgcttgctgagagcatcaataagtactgctggcccaacggcagcgatttcgcgacgacggaggagctgatgatgatgagtgacctcgtcgacgaggcggccttgtcgtcgtcgccggtgcagcagcaggaggaggaggagcctcgtcgccagcgggagtcgatgctcaacaagctcatctccacagtctactccggacccaccatcagcgacatagagagcgcgctctctttcaccggcgccgaccaggccgccgccgtggatgctcacatctacaactctgccggcccagtcgttttctccccggagaaggtgctgagcaagatggagaacaagtacacgctcaagatcaagacctgtgggaacggccttgcagaggatggatacaaatggaggaaatacggccagaaatccatcaagaacagccccaacccaaggagctactaccggtgcacgaaccctcggtgcaacgccaagaagcaggtggagcggtcgacggaggaggcggacacgctggtcgtcacctacgagggcctccacctgcactacacctactcgcacttcctccagccccagccccagccccagccccagcagcccaaaaagcccaagcttggaggcccaccaccacaaccacagcccatcatcatgctggaggacctcgacggcccggcccaacaagatatcaccacctgcccactggacgctaccgccatggctccagcaccaccaccagctgctttgtgctatcttgacgatatgttccaaaagcctgcctttttcgaggaggagctgcagcagcagcacatcaccaatggcgggttgctggaagacatggtgccgctgctggtccggcgaccctgcagcagcacaggggccaccaccaccaccactggcagcagcaccacctcgtcgtcgccgcagctggcaccgtcaccggacctttccacatcatcttctgtctcatggaaccccacctctccttacatcgacatggccattctctccaacattttctag

SEQ ID NO: 17193 - protein, 354 aa, Sorghum bicolor
  misc_feature: The sequence is a functional homolog of SEQ ID NO 114 in the 11/375,241 US patent application
  misc_feature: The sequence is a functional homolog of SEQ ID NO 146 in the 10/286,264 US patent application
  misc_feature: The sequence is a functional homolog of SEQ ID NO 2500 in the 10/374,780 US patent application
  misc_feature: The sequence is a functional homolog of SEQ ID NO 672 in the 10/412,699 US patent application
  misc_feature: Ceres ANNOT ID no. 8670809
  misc_feature (140)..(199): Pfam ID: WRKY Pfam Description: WRKY DNA -binding domain
MEEDLLLLEASVAVPPLAESINKYCWPNGSDFATTEELMMMSDLVDEAALSSSPVQQQEEEEPRRQRESMLNKLISTVYSGPTISDIESALSFTGADQAAAVDAHIYNSAGPVVFSPEKVLSKMENKYTLKIKTCGNGLAEDGYKWRKYGQKSIKNSPNPRSYYRCTNPRCNAKKQVERSTEEADTLVVTYEGLHLHYTYSHFLQPQPQPQPQQPKKPKLGGPPPQPQPIIMLEDLDGPAQQDITTCPLDATAMAPAPPPAALCYLDDMFQKPAFFEEELQQQHITNGGLLEDMVPLLVRRPCSSTGATTTTTGSSTTSSSPQLAPSPDLSTSSSVSWNPTSPYIDMAILSNIF

SEQ ID NO: 17194 - DNA, 1071 bp, Sorghum bicolor
  misc_feature: Ceres ANNOT ID no. 8670805
  misc_feature: Encodes the peptide sequence at SEQ ID NO 17195
atgaggaggagggcctccacgctcctttgcaccctgctcctcctctccctgccgtgcttccatctggcaagcgcccatggcggcatcgacgacggtgacaacgacggacatgccaccactccgccggccgacgccgacccgtcgtcggttcatcagcacctgcgttccaagggcctgatcgccgtcaaggtgtggtgcctcgtcatcctgctcatcttcaccttcctcggcggcgtgtcaccctacttctaccgctggaacgaggccttcctcctcctgggcacacagttcgccgccggtgtcttcctcgggacagcgctcatgcacttccttgccgactccaccagcaccttccacgggctcaccaagaaccagtacccgttctcctacatgctggcctgcgtcggcttcctgctcaccatgctcgccgactgcgtcgtcgccgcggtcaccaagagaagcgccgccggcggcggcggcggccagagggtggtcaacgaggccgccagggaagaaggtgacgcccgtcatcagactcagaccaagcaggaggatgcggcgcacgcgcgccaccccatgttggtcacggtcaggacggcgtcgtttgaggacgccgtcctgctcatcttcgcgctctgcttccactccatcttcgaaggcatcgctatcggcgtctcggcaaccaagagcgacgcgtggcgcaacctgtggacgatcgggctgcacaaggtgttcgcggcggtggccatgggtatcgcgctgctgcgcatgatccccaagcgcccgttcctgatgacggtggcctactcgctggcgttcgccgtgtccagccccgtcggcgtgggcatcggtatcggcatcgacgccacggccgagggcagggcggcggactggacgttcgccatctccatgggcttcgccacgggggtgttcctctacgtggccatcaaccacctcatcgccaagggctaccgaccccaggagcccacccgcgtggacagcccctccttcaagttcctcggcgtgctcctcggcgtcgctgtcatggccgtcgtcatgatctggggctag

SEQ ID NO: 17195 - protein, 356 aa, Sorghum bicolor
  misc_feature: Useful for making plants with altered lignin content
  misc_feature: Functional homolog of the protein sequence given in SEQ ID NO 14177
  misc_feature: Ceres ANNOT ID no. 8670805
  misc_feature (59)..(353): Pfam ID: Zip Pfam Description: ZIP Zinc transporter
MRRRASTLLCTLLLLSLPCFHLASAHGGIDDGDNDGHATTPPADADPSSVHQHLRSKGLIAVKVWCLVILLIFTFLGGVSPYFYRWNEAFLLLGTQFAAGVFLGTALMHFLADSTSTFHGLTKNQYPFSYMLACVGFLLTMLADCVVAAVTKRSAAGGGGGQRVVNEAAREEGDARHQTQTKQEDAAHARHPMLVTVRTASFEDAVLLIFALCFHSIFEGIAIGVSATKSDAWRNLWTIGLHKVFAAVAMGIALLRMIPKRPFLMTVAYSLAFAVSSPVGVGIGIGIDATAEGRAADWTFAISMGFATGVFLYVAINHLIAKGYRPQEPTRVDSPSFKFLGVLLGVAVMAVVMIWG

SEQ ID NO: 17196 - DNA, 840 bp, Sorghum bicolor
  misc_feature: Ceres ANNOT ID no. 8670801
  misc_feature: Encodes the peptide sequence at SEQ ID NO 17197
atggacgactacgagctccacatggtgtgctacggcggcgacgacgacggccgcgtgatggagtgggagtcggggctcccgggcgccgacgagctgacccctctgtcgcagccgctggttcccccgggtctggcggcggcgttccgcatcccgccggagcccgggcggacgctgctggacgtgcaccgcgcgtcggcggccacggtgtcgcggctgcggcgcgcgccgtcgtcgtcgtcgtcgggcagcggagggagcggctcctcctccttcgcgcccttccatccccatccgcaggcggcggcggcggcgggacacgcgaggggggacgaggatgcggactcgtcggcggcggccttgggcggcggcaacgcggcgacgacgaccaccaacacaggcaccaacagcaagcgtccccggctggtgtggacgccgcagctgcacaagcggttcgtggacgtggtggcgcacctggggatcaagaacgcggtgcccaagaccatcatgcagctgatgaacgtggaagggctgacgagggagaacgtggccagccacctgcagaagtaccggctgtacgtgaagcggatgcaggggctctccaacgaggggccttccccgtccgaccacatcttcgcgtccacgccggtgccgcactccctggtgcacgagccgcaggtgcccgtgccaaccagcatgtacgtcgccgctgtcggcagcatggtgcccatggccagcggcggacaggcggcgtaccaccactaccaccaccaccacaacgcaacagcaggaggaggaagagggtacccgcaggcggcagcataccaccacgccgacaaatga

SEQ ID NO: 17197 - protein, 279 aa, Sorghum bicolor
  misc_feature: The sequence is a functional homolog of SEQ ID NO 1995 in the 11/479,226 US patent application
  misc_feature: The sequence is a functional homolog of SEQ ID NO 1996 in the 11/479,226 US patent application
  misc_feature: The sequence is a functional homolog of SEQ ID NO 1997 in the 11/479,226 US patent application
  misc_feature: The sequence is a functional homolog of SEQ ID NO 1998 in the 11/479,226 US patent application
  misc_feature: The sequence is a functional homolog of SEQ ID NO 2001 in the 11/479,226 US patent application
  misc_feature: The sequence is a functional homolog of SEQ ID NO 2000 in the 11/479,226 US patent application
  misc_feature: The sequence is a functional homolog of SEQ ID NO 1999 in the 11/479,226 US patent application
  misc_feature: Ceres ANNOT ID no. 8670801
  misc_feature (140)..(190): Pfam ID: Myb_DNA-binding Pfam Description: Myb-like DNA-binding domain
MDDYELHMVCYGGDDDGRVMEWESGLPGADELTPLSQPLVPPGLAAAFRIPPEPGRTLLDVHRASAATVSRLRRAPSSSSSGSGGSGSSSFAPFHPHPQAAAAAGHARGDEDADSSAAALGGGNAATTTTNTGTNSKRPRLVWTPQLHKRFVDVVAHLGIKNAVPKTIMQLMNVEGLTRENVASHLQKYRLYVKRMQGLSNEGPSPSDHIFASTPVPHSLVHEPQVPVPTSMYVAAVGSMVPMASGGQAAYHHYHHHHNATAGGGRGYPQAAAYHHADK

SEQ ID NO: 17198 - DNA, 684 bp, Sorghum bicolor
  misc_feature: Ceres ANNOT ID no. 8670820
  misc_feature: Encodes the peptide sequence at SEQ ID NO 17199
atgaccatgtatggtggcagcgacgcgtcgggcaccatgggcggcgcctgcgggtacggcaacctctacatcgcggggtacggcgtggcgacgggggcgctcagcacgccgctcttcaacaacggactcacctgcggcgcctgcttcgagatcaagtgcagttgcaggagcggctgccagtgccagtgccacccctccgtgtcgtcggtggtgatcacggccaccaacttctgcccgcccaactacgggctgccctcggacgccggcgggtggtgcaacccgccgcgccaccacttcgacctctccatgccggccttcctccgcatcgcagactaccgcgccagcatcgtgcccgtcacataccggagggtggcgtgccgcaagtccggcggcatccggttcagcgtcaacggcttccgctacttcaacctggtgctcatcagcaacgtgggtggcgccggcgacgtggtccgcgccgccgtcaaggcctcgcacacggagtggctgcccctggcgcgcaactggggacagaactggcagtgcagctccatcctcgtgggcggggcgctctccttccgcgtcaccaccagcgaccgccgcaccctcacctcctggaacgtcgccggaccagcctggcgctttggacagacattcaccgccgccaaaaacttcagggacccctag

SEQ ID NO: 17199 - protein, 227 aa, Sorghum bicolor
  misc_feature: Useful for making plants with altered carbohydrate content
  misc_feature: Functional homolog of the protein sequence given in SEQ ID NO 14053
  misc_feature: Useful for making plants with altered cell wall content and/or composition
  misc_feature: Functional homolog of the protein sequence given in SEQ ID NO 14499
  misc_feature: Ceres ANNOT ID no. 8670820
  misc_feature (31)..(121): Pfam ID: DPBB_1 Pfam Description: Rare lipoprotein A (RlpA)-like double-psi beta-barrel
  misc_feature (132)..(209): Pfam ID: Pollen_allerg_1 Pfam Description: Pollen allergen
MTMYGGSDASGTMGGACGYGNLYIAGYGVATGALSTPLFNNGLTCGACFEIKCSCRSGCQCQCHPSVSSVVITATNFCPPNYGLPSDAGGWCNPPRHHFDLSMPAFLRIADYRASIVPVTYRRVACRKSGGIRFSVNGFRYFNLVLISNVGGAGDVVRAAVKASHTEWLPLARNWGQNWQCSSILVGGALSFRVTTSDRRTLTSWNVAGPAWRFGQTFTAAKNFRDP

SEQ ID NO: 17200 - DNA, 1233 bp, Sorghum bicolor
  misc_feature: Ceres ANNOT ID no. 8670828
  misc_feature: Encodes the peptide sequence at SEQ ID NO 17201
atgccggccctctccacccaccaccttcagctgcgccgtctcggccgacgacgcggcgccgcattcgccctcgcgctgctcgccgccgccctcgtgctcacgctctcccgctacgccacgggccctgcagcctccccgcccgcgtccccgtcctacgggcatcgcctcccggccctcgtcgacatcaccctcgtctacggcgccaccgacaagggcgcagtgtgtttggatggtacgccgcctgcctaccacttccttccaggattcggggacggatcccacaactggctcctccacctggagggcggaagctggtgccgcagtttcgaatcatgtgctcgccgtaagaaaacaaatctcggttcgtctgcccacatggatactcgtgctgaattcgtcggcatcctcagtgatgatcaatctcagaatccagacttttacaactggaacaaagtgaaaataagatactgtgatggtgcatcattctctggacatgtccaagatgaagtcaagaatggcacaggtttcttcttcagaggccagcgtatctgggaagcagtcatggccgaacttctatcaaaggggctagccagagcgaaacaggcttttctgactggatgctcggctggtggcctttctacatacattcactgtgatgatttccgggcagttctaccgaacacgcctactgtcaagtgcctcgcagatggtggattcttccttgatgatgtgcataaaaggttccctcattgcagctcagatatggaaccagggcagtgcttcttcccacaagaagttgcgaaaagcatcaccacgccgatgtttatactcaatccagcatatgatgtttggcaggtagagcatgtgttgtctccagaaggttctgaccctcaaaatctatggcaaaattgcaggacggacattaccaagtgtagctcaaaacagcttgaagttcttcaaggttttaggaaagcactgcttgatgctataaatgaattcaagaagagaagagactggggtatgttcattgactcctgctttatacactgtcaatcaatgaaagctttggcttggcattcaccatcagctgctagaatcaacaacaagacggccgccgaagcggtgggagattggttctttgatcggagggaggtgaaggaaatagattgtgaatatccctgcaacccgacatgctacaatgtggttcttgatcagccctacaaggaagactaa

SEQ ID NO: 17201 - protein, 410 aa, Sorghum bicolor
  misc_feature: Useful for making plants with altered cell wall content and/or composition
  misc_feature: Functional homolog of the protein sequence given in SEQ ID NO 13822
  misc_feature: Ceres ANNOT ID no. 8670828
  misc_feature: Up-regulated in root tissues in response to aminocyclopropane carboxylic treatment
  misc_feature (45)..(388): Pfam ID: PAE Pfam Description: Pectinacetylesterase
MPALSTHHLQLRRLGRRRGAAFALALLAAALVLTLSRYATGPAASPPASPSYGHRLPALVDITLVYGATDKGAVCLDGTPPAYHFLPGFGDGSHNWLLHLEGGSWCRSFESCARRKKTNLGSSAHMDTRAEFVGILSDDQSQNPDFYNWNKVKIRYCDGASFSGHVQDEVKNGTGFFFRGQRIWEAVMAELLSKGLARAKQAFLTGCSAGGLSTYIHCDDFRAVLPNTPTVKCLADGGFFLDDVHKRFPHCSSDMEPGQCFFPQEVAKSITTPMFILNPAYDVWQVEHVLSPEGSDPQNLWQNCRTDITKCSSKQLEVLQGFRKALLDAINEFKKRRDWGMFIDSCFIHCQSMKALAWHSPSAARINNKTAAEAVGDWFFDRREVKEIDCEYPCNPTCYNVVLDQPYKED

SEQ ID NO: 17202 - DNA, 1257 bp, Sorghum bicolor
  misc_feature: Ceres ANNOT ID no. 8670850
  misc_feature: Up-regulated in root tissues in response to aminocyclopropane carboxylic treatment
  misc_feature: Encodes the peptide sequence at SEQ ID NO 17203
atggatgcctccaagctccgcgagcttcgcgacttcgtcgaggcgtgcaagaaggacccttccctcctcgccgaccccagcctcgccttcttccgggattacctccagagtctgggtgccaaaattccacccgccgctgccgcctccttcgagaagcccaagagatcttccatggacgacattgatgatgatgatgatgacggcgatctggatatgagggatcccactcctgagccagacgagctcgatgaggagattgttgagtctgatcttgagcttgaaggagacattgtacagtctgaccatgatgacccaccacagaagatgggtgatccttcggtggaggtgactgaggaaaatcgtgatgcctctcaagaagcaaaaggcaaggctatggaagcaatgtctgaaggaaaactcgaagatgctattgaacaccttaccaacgcaattgtgctgaatccactctcagcaatcatgtatggtactagagcatctgtgtttataaaaatgaagaaaccaactgctgccattcgtgatgccaatgctgctctagagatcaacccagactctgcaaaaggctataaaactcgtggaatggcatatgccatgcttggcaaatgggaggaagccgctcgtgatctgcacacagcatctaacatggattatgatgaggagatcagtgctgtgctcaagaaggtggagcctaatgctcacaagatagtggaacatcgcaggaagtacgagaggctgagaaaagagagggaggaaaagagagcagagcgtgatcggcttcgtcgacgtgcagaggcacaggctgcttatgacaaggccaagaggaaggagcaatcgtcaagtcgctcatcaggaggtgcatctcccagaggtttccctggagggatgcccggtggaggtttccctggagggatgcccggtggaggtttccctggagggatgcccagtggaggtttccctggagggatgtccggtgggggtttccctggagggatgcctggtgggggtttccctgggagtggcatgcctggaggtttccctggggctggcatgcctggaaatgttgatatgagtaaaatcctgaatgaccctgacctgatggcagcattcagtgacccagaggtcatggcggcgctacaagatgtgatgaacaatcctgccaactttgctaagcaccaagcgaatcccaaggtgggccctatcatcacaaagatgatggccaagttcagtgggtcccagtga

SEQ ID NO: 17203 - protein, 418 aa, Sorghum bicolor
  misc_feature: Useful for making plants with altered terpenoid content
  misc_feature: Functional homolog of the protein sequence given in SEQ ID NO 13123
  misc_feature: Ceres ANNOT ID no. 8670850
  misc_feature (112)..(241): SWISSPROT Homolog: EC 3.1.3.16 Phosphoprotein phosphatase
  misc_feature (158)..(191): Pfam ID: TPR_1 Pfam Description: Tetratricopeptide repeat
MDASKLRELRDFVEACKKDPSLLADPSLAFFRDYLQSLGAKIPPAAAASFEKPKRSSMDDIDDDDDDGDLDMRDPTPEPDELDEEIVESDLELEGDIVQSDHDDPPQKMGDPSVEVTEENRDASQEAKGKAMEAMSEGKLEDAIEHLTNAIVLNPLSAIMYGTRASVFIKMKKPTAAIRDANAALEINPDSAKGYKTRGMAYAMLGKWEEAARDLHTASNMDYDEEISAVLKKVEPNAHKIVEHRRKYERLRKEREEKRAERDRLRRRAEAQAAYDKAKRKEQSSSRSSGGASPRGFPGGMPGGGFPGGMPGGGFPGGMPSGGFPGGMSGGGFPGGMPGGGFPGSGMPGGFPGAGMPGNVDMSKILNDPDLMAAFSDPEVMAALQDVMNNPANFAKHQANPKVGPIITKMMAKFSGSQ

SEQ ID NO: 17204 - DNA, 1458 bp, Sorghum bicolor
  misc_feature: Ceres ANNOT ID no. 8670889
  misc_feature: Encodes the peptide sequence at SEQ ID NO 17205
atgcagatccgtcaaccacccgaccatctcatggtgatggccaccgcggcggccgccatggacgtggatgcgccggcgccggcgccggtgcccgacggaaacgccgccgccaacaagcaggggcggcgcgggcggcgcgagatgcgccggatcgaggactccacgagccgccaggtgaccttctccaagcgccggagcgggctactcaagaaggcgtacgagctgtcggtgctgtgcgacgccgaggtcgcgctcatcgtcttctccccgcgcggccgcctctaccagttcgcctccgccgccgacttgcagaatacaattgatcggtacctgaagcacacggaaggcacacttgcaaatgggaaagttgaaacaggcatagagaagtggaaatatgaggctacaaccttgggaaagaagatagacgcaattgagacatacaagaggaagctgcttggagagaaccttggatcttgttcagttcaggagctaaaagaactggaggcacagctcgagaagagcctaagcataatcaggcaaaggaaggaaaggaagctgatggatcaaattctagagttgagggagaaggagcagaaactgttgatggagaacgcgatgctccgtgatcagtgtaaggccctgcctctgctagaactgaatgataataaggagcatgaccatcatatggatggtgctggtgacggcggcgaagatgatgaagcagcagcggcgaaggaggacgtggagacggagttggccatcggtattattggaagcaggagacttactactcaagcgcctgcgccgaggattgggttgcggtgggctggcccactgggcagagagagagagagaggagggaaaaaggaaagggaaatccgcctcgatttcgtcgacgccaagcaacccaaggcaagccaagtcgccagccactgcgctcgctcgggatccatccatccatccccctcgtcctcgtcctcgtcctcgtcttcgcctcctcctccgcccgcccgccccttgatcccgatcgacgacgccaacgccagatccccttccactcgagacgccggctcctcacccgcccgaccgaccgaccgaccgcccgccgattccacatccctccccggccttcaagcaggtactgattccgcccccaattccgctggatcggatctcccacttccgccatccgtccgccgcgccccgcccccaattcgatttctttcatgctgggtcggtcaattgagcgccctgccggtcaattcaattcagacgttgtccaattcgtttcctggggggaaggatcgataccctgatgatgcgaattcccatcaattgcgtcttccatctgggacaactggaccacaattccgtcatcatcactcacgaattggtcctcgccaacggttcgttgccaattttgagggtgctccgtctttaattgcttgctgctactag

SEQ ID NO: 17205 - protein, 485 aa, Sorghum bicolor
  misc_feature: The sequence is a functional homolog of SEQ ID NO 1368 in the 10/666,642 US patent application
  misc_feature: The sequence is a functional homolog of SEQ ID NO 422 in the 11/435,388 US patent application
  misc_feature: Useful for making plants with modulated flowering time
  misc_feature: Functional homolog of the protein sequence given in SEQ ID NO 13660
  misc_feature: The sequence is a functional homolog of SEQ ID NO 1701 in the 10/412,699 US patent application
  misc_feature: The sequence is a functional homolog of SEQ ID NO 1949 in the 10/412,699 US patent application
  misc_feature: The sequence is a functional homolog of SEQ ID NO 1955 in the 10/412,699 US patent application
  misc_feature: The sequence is a functional homolog of SEQ ID NO 1965 in the 10/412,699 US patent application
  misc_feature: The sequence is a functional homolog of SEQ ID NO 1967 in the 10/412,699 US patent application
  misc_feature: Useful for making plants with altered lignin content
  misc_feature: Functional homolog of the protein sequence given in SEQ ID NO 12944
  misc_feature: The sequence is a functional homolog of SEQ ID NO 1963 in the 10/412,699 US patent application
  misc_feature: The sequence is a functional homolog of SEQ ID NO 1957 in the 10/412,699 US patent application
  misc_feature: The sequence is a functional homolog of SEQ ID NO 1959 in the 10/412,699 US patent application
  misc_feature: Ceres ANNOT ID no. 8670889
  misc_feature (49)..(99): Pfam ID: SRF-TF Pfam Description: SRF-type transcription factor (DNA-binding and dimerisation domain)
  misc_feature (115)..(213): Pfam ID: K-box Pfam Description: K-box region
MQIRQPPDHLMVMATAAAAMDVDAPAPAPVPDGNAAANKQGRRGRREMRRIEDSTSRQVTFSKRRSGLLKKAYELSVLCDAEVALIVFSPRGRLYQFASAADLQNTIDRYLKHTEGTLANGKVETGIEKWKYEATTLGKKIDAIETYKRKLLGENLGSCSVQELKELEAQLEKSLSIIRQRKERKLMDQILELREKEQKLLMENAMLRDQCKALPLLELNDNKEHDHHMDGAGDGGEDDEAAAAKEDVETELAIGIIGSRRLTTQAPAPRIGLRWAGPLGRERERGGKKEREIRLDFVDAKQPKASQVASHCARSGSIHPSPSSSSSSSSSPPPPPARPLIPIDDANARSPSTRDAGSSPARPTDRPPADSTSLPGLQAGTDSAPNSAGSDLPLPPSVRRAPPPIRFLSCWVGQLSALPVNSIQTLSNSFPGGKDRYPDDANSHQLRLPSGTTGPQFRHHHSRIGPRQRFVANFEGAPSLIACCY

SEQ ID NO: 17206 - DNA, 1641 bp, Sorghum bicolor
  misc_feature: Ceres ANNOT ID no. 8670896
  misc_feature: Encodes the peptide sequence at SEQ ID NO 17207
atggcgtcgccgcaccttcccttcctctccttccccaaaaccctaccgccaccacctccaccgctcaagccccacgcccaccgcacctccctcgccgtcgccgctgctcctgctcccccgcccgccccgcctgacggcgcggggcccgccgcgcccacgcgtggcgaccgcttcctcggccgccagctggccaccgaggccgccgcgcgcgtgctcgcgcccgacgacgccgacaggcgccgccgacgcaaggagaagcgccgggcactgtcgcggaagccctccggcctcgcctcttgctacgggtgcggcgccccgctgcagacggcggaggaggccgcgccgggatacgtagaccccgacacgtacgaactgaaaaagaggcaccaccaactgagaaccgttctatgtggaaggtgcaagctgctctctcatggccacatggtcactgctgttggtggccacggcggttatcctgggggcaagcagtttgtttctgcggaacagctcagggagaagctgtcatacctccgtcacgagaaagcactgatagtcaaattggttgacatcgttgacttcaatgggagtttcctggcacgagtacgtgactttgctggtgcaaatccgattattcttgtgataacaaaggttgatctccttcccagagacactgatttgaattgcataggcgactgggttgtcgagtcagttgtcaagaagaagcttaatgtccttagtgtccatttgacaagctcaaagtcactggtcggtatcacaggggttatatcagagattcaacaggaaaagaagggccgagatgtatatatactgggttctgcaaatgttgggaaatctgcatttatcagtgcaatgctaagaacaatggcatacaaggatccggtggcagcggcagctcaaaaatacaagcctatacagtctgctgttcctggaacaacccttggccctattcaaattgaagcatttttaggcggagggaaattgtatgatacacctggagtccaccttcaccataggcaggcagcagttatccatgctgatgatctgccttctcttgcaccacaaagtcgtttgaaagggcgatgttttcccgctaatgatacagatgttgaattgagtgggaattcattattctgggctgggctagtccgcattgatgttgtcaaggctcttccacgcgcacggctgacattctatgggcccaagaagctaaagattaatatggtcccgacaacagaagcagatcaattttacgagactgaagttggagttacattgactccaccaactggtaaggagagagctgaaggatggcaagggcttcaaggtgttcgcgagttgaagataaagtatgaggaacgtgacaggcctgcttgtgacatcgcgatctctgggcttgggtggatttctgtggagccatcaggcgtgccctcaaacagctctgatgacaatgtcgaggaagaatacgatggcggtgagctgcatctggtagtacatgtacccaaaccggttgaggtcttcgtccgccccccattgcctgttggtaaagcagcgtcgcaatggtaccagtatcaagagctcacagaggaagaagaggagttgaggcctaaatggcactactga

SEQ ID NO: 17207 - protein, 546 aa, Sorghum bicolor
  misc_feature: Useful for making plants with modulated flowering time
  misc_feature: Functional homolog of the protein sequence given in SEQ ID NO 13928
  misc_feature: Ceres ANNOT ID no. 8670896
  misc_feature (53)..(546): SWISSPROT Homolog: EC 1.14.13.39 Nitric-oxide synthase
  misc_feature (272)..(416): Pfam ID: MMR_HSR1 Pfam Description: GTPase of unknown function
MASPHLPFLSFPKTLPPPPPPLKPHAHRTSLAVAAAPAPPPAPPDGAGPAAPTRGDRFLGRQLATEAAARVLAPDDADRRRRRKEKRRALSRKPSGLASCYGCGAPLQTAEEAAPGYVDPDTYELKKRHHQLRTVLCGRCKLLSHGHMVTAVGGHGGYPGGKQFVSAEQLREKLSYLRHEKALIVKLVDIVDFNGSFLARVRDFAGANPIILVITKVDLLPRDTDLNCIGDWVVESVVKKKLNVLSVHLTSSKSLVGITGVISEIQQEKKGRDVYILGSANVGKSAFISAMLRTMAYKDPVAAAAQKYKPIQSAVPGTTLGPIQIEAFLGGGKLYDTPGVHLHHRQAAVIHADDLPSLAPQSRLKGRCFPANDTDVELSGNSLFWAGLVRIDVVKALPRARLTFYGPKKLKINMVPTTEADQFYETEVGVTLTPPTGKERAEGWQGLQGVRELKIKYEERDRPACDIAISGLGWISVEPSGVPSNSSDDNVEEEYDGGELHLVVHVPKPVEVFVRPPLPVGKAASQWYQYQELTEEEEELRPKWHY

SEQ ID NO: 17208 - DNA, 1584 bp, Sorghum bicolor
  misc_feature: Ceres ANNOT ID no. 8670977
  misc_feature: Encodes the peptide sequence at SEQ ID NO 17209
atggagaccattggcgcgccgggaagctctctgcacgggatgacgggtcgggagccggcgttcgccttctccacggcggcgcccgagcacgacggcgacgacgccgcggcgagcaagttcgacctgccggtggactcagagcacaaggcgaagagcatccgtctcttctccttcgcgaacccgcacatgcgcaccttccacctctcctggatctccttcttcacctgcttcgtctccaccttcgccgcggctcccctcgtccccatcatccgcgacaacctcaacctcaccaaggccgacatcggcaacgccggggtggcgtccgtgtcgggctccatcttctcccgtctcaccatgggcgccgtctgcgacctgctgggcccgcgctacggctgcgctttcctcatcatgctgtcggcgcccaccgtgttctgcatggcgctcatcgacgacgccgcgggctacatcgtcgtcaggttcctcatcggcttctcgctggcgaccttcgtctcgtgccagtactggatgagcaccatgttcaacagcaagatcatcggcaccgtcaacgggctcgccgccgggtggggcaacatgggcggcggcgccacgcagctcatcatgccgctggtgtacgacgtcatccgcaagtgcggcgccacgccattcacggcgtggcgggtggcatacttcgtcccggggctgatgcacgtggtcatgggcgtgctggtgctgacgctcgggcaggacctccccgacggcaacctcaggacgctgcagaagaagggcaacgtcaacaaggacaagttctccaaggtcatgtggtacgccctgataaactaccggacctggatcttcgtcctcctctacggctactccatgggcgtcgagctcaccaccgacaacgtcatcgccgagtacatgtacgaccgcttcgacctcgacctccgcgtcgccggcaccatcgccgcctgcttcggtatggccaacctcgtcgcgcgccccatgggcggcgtgctctccgacgtcggcgcgcggtactggggcatgcgcgcgcgcctctggaacatctggatcctccagaccgccggcggcgccttctgcctctggctggggcgcgccagcacgctccccgtctccatcgtcgccatggtgctcttctccttctgcgcgcaggccgcctgcggcgccatcttcggcgtcatacccttcgtctccaggcgctccctcggcatcatctccgggatgaccggcgccggcggcaacttcggcgcggggctcacgcagctgctcttcttcacctcgtccacctactccacggccagggggctggagtacatgggcatcatgatcatggcgtgcacgctgccggtggtgttcgtgcacttcccgcagtggggatccatgttcttcccggccagcgccaccgccgacgaggagggctactacgcgtccgagtggaacgacgacgagaagagcaaggggctccatgccgccagcctcaagttcgccgagaacagccgatcagagcgcggcaagcgcaacgtcatccaggccgacgccggcgccacgccggagcacgtataa

SEQ ID NO: 17209 - protein, 527 aa, Sorghum bicolor
  misc_feature: Useful for making plants with altered carbon content
  misc_feature: Useful for making plants with altered nitrogen content
  misc_feature: Useful for making plants with modulated carbon-nitrogen partitioning
  misc_feature: Functional homolog of the protein sequence given in SEQ ID NO 14444
  misc_feature: Ceres ANNOT ID no. 8670977
  misc_feature (69)..(428): Pfam ID: MFS_1 Pfam Description: Major Facilitator Superfamily
METIGAPGSSLHGMTGREPAFAFSTAAPEHDGDDAAASKFDLPVDSEHKAKSIRLFSFANPHMRTFHLSWISFFTCFVSTFAAAPLVPIIRDNLNLTKADIGNAGVASVSGSIFSRLTMGAVCDLLGPRYGCAFLIMLSAPTVFCMALIDDAAGYIVVRFLIGFSLATFVSCQYWMSTMFNSKIIGTVNGLAAGWGNMGGGATQLIMPLVYDVIRKCGATPFTAWRVAYFVPGLMHVVMGVLVLTLGQDLPDGNLRTLQKKGNVNKDKFSKVMWYALINYRTWIFVLLYGYSMGVELTTDNVIAEYMYDRFDLDLRVAGTIAACFGMANLVARPMGGVLSDVGARYWGMRARLWNIWILQTAGGAFCLWLGRASTLPVSIVAMVLFSFCAQAACGAIFGVIPFVSRRSLGIISGMTGAGGNFGAGLTQLLFFTSSTYSTARGLEYMGIMIMACTLPVVFVHFPQWGSMFFPASATADEEGYYASEWNDDEKSKGLHAASLKFAENSRSERGKRNVIQADAGATPEHV

SEQ ID NO: 17210 - DNA, 1608 bp, Sorghum bicolor
  misc_feature: Ceres ANNOT ID no. 8670975
  misc_feature: Encodes the peptide sequence at SEQ ID NO 17211
atggcgagtgaggcgcctgcaggtagctcgctgcacggggtgacggcgcgcgagccgtcgttccccttcgccttctccacggaggagacgccagcggcggcggcaggcaagtcgttcgacctgccggtggactcggagcacaaggccaagtccatccgcctgctctccttcgccaacccgcacatgcgcaccttccacctctcctggatgtccttcttcacctgcgtcgtctccaccttcgcggcggcgccactgatccccatcatccgtgagaaccttggcctgaccaaggccgacatcggcaacgccggtgtggcctccgtctcgggcgccatcttctcgcgcctcgccatgggcgccgtctgcgacctgctgggccctcgctacggctgcgccttcgtcgtcatgctagcggcgccggcggtgttctgcatggccatcatcgacagcgccgcgggctacgtcgtgtgccggttcctcatcggcttctccctcgccaccttcgtctcgtgccagtactggaccagcaccatgttcaacatcaagatcatcggcaccgtcaacgcgctggcgtccgggtggggcgacatgggcggcggcgccacgcagctcatcatgccgttcgtctacgagggcatcctccggtgcggcgccacgccgttcgcggcgtggaggatcgcctacttcgtgccggggctcatgcacatcgccgtcggcatcctcgtgctcaccgcggggcaggacctccccgacggcaacctccggacgctgcagaagcagggcggcgacagctgccggagggacaacttctccagggtgctctggcacgccgtcgccaactaccgcacctgggtcttcgtcttcgtctacggctactgcatgggcgtgcagctcaccaccaacaacatcatcgccgagttcttctacgaccagttcgacctcgacatccgcgtcgccggcatcatcgccgccagcttcggcatggccaacctcgtgtcgcgcccgctcggcggcgtgctctccgacgtcggcgcgaggtactggggaatgcgcgcgcgcctctggaacatctggatcctccagaccgccggcggcgccttctgcctctggctcggccgcgcgagctggctcccggcctccgtgacggccatggtgctcttctccttgtgcgcgcaggccgcctgcggcgccacgttcggcgtcatccccttcgtctcccggcgatcgctgggcgtcatctcggggctcacgggcgccggcggcaacgtcggcgccgggctcacgcagctgctcttcttcaccacgtcgagctactcgacggggaaagggatcgagaacatgggcatcatgaccatggcgtgcacgctgccgctggtgctggtgcacttcccgcagtggggctccatgctcctcccgcccagcgccgacgccgacgaggagagctactatgccgcagagtggagcgaggaggagaagagcgtaggccgtcacagcaccagcctcaagttcgccgagaactgccggtccgagcgtggcaggcgcaactccgccgtcgccgtcctcgccgccgcggccacgccgccggacaacacgccggagcacgtctaa

SEQ ID NO: 17211 - protein, 535 aa, Sorghum bicolor
  misc_feature: Useful for making plants with altered carbon content
  misc_feature: Useful for making plants with altered nitrogen content
  misc_feature: Useful for making plants with modulated carbon-nitrogen partitioning
  misc_feature: Functional homolog of the protein sequence given in SEQ ID NO 14444
  misc_feature: Ceres ANNOT ID no. 8670975
  misc_feature (68)..(429): Pfam ID: MFS_1 Pfam Description: Major Facilitator Superfamily
MASEAPAGSSLHGVTAREPSFPFAFSTEETPAAAAGKSFDLPVDSEHKAKSIRLLSFANPHMRTFHLSWMSFFTCVVSTFAAAPLIPIIRENLGLTKADIGNAGVASVSGAIFSRLAMGAVCDLLGPRYGCAFVVMLAAPAVFCMAIIDSAAGYVVCRFLIGFSLATFVSCQYWTSTMFNIKIIGTVNALASGWGDMGGGATQLIMPFVYEGILRCGATPFAAWRIAYFVPGLMHIAVGILVLTAGQDLPDGNLRTLQKQGGDSCRRDNFSRVLWHAVANYRTWVFVFVYGYCMGVQLTTNNIIAEFFYDQFDLDIRVAGIIAASFGMANLVSRPLGGVLSDVGARYWGMRARLWNIWILQTAGGAFCLWLGRASWLPASVTAMVLFSLCAQAACGATFGVIPFVSRRSLGVISGLTGAGGNVGAGLTQLLFFTTSSYSTGKGIENMGIMTMACTLPLVLVHFPQWGSMLLPPSADADEESYYAAEWSEEEKSVGRHSTSLKFAENCRSERGRRNSAVAVLAAAATPPDNTPEHV

SEQ ID NO: 17212 - DNA, 183 bp, Sorghum bicolor
  misc_feature: Ceres ANNOT ID no. 8670973
  misc_feature: Encodes the peptide sequence at SEQ ID NO 17213
atgggcctcaacacgcacctgagggcgctccccggtgcggcggagaggctggtgctgtgcaaggccgacctactcgactacgacgcgctgcggtcggccgtcgccggcggccacgacgtcttccacaccgcgtcgcccgtcaccgatgatccggtacgtatacgtgtaacctatagtacttga

SEQ ID NO: 17213 - protein, 60 aa, Sorghum bicolor
  misc_feature: Useful for making plants with altered carbohydrate content
  misc_feature: Functional homolog of the protein sequence given in SEQ ID NO 14118
  misc_feature: Useful for making plants with altered cell wall content and/or composition
  misc_feature: Useful for making plants with altered lignin content
  misc_feature: Functional homolog of the protein sequence given in SEQ ID NO 13818
  misc_feature: Ceres ANNOT ID no. 8670973
  misc_feature (7)..(50): SWISSPROT Homolog: EC 1.1.1.219 Dihydrokaempferol 4-reductase
MGLNTHLRALPGAAERLVLCKADLLDYDALRSAVAGGHDVFHTASPVTDDPVRIRVTYST

SEQ ID NO: 17214 - DNA, 1584 bp, Sorghum bicolor
  misc_feature: Ceres ANNOT ID no. 8670979
  misc_feature: Encodes the peptide sequence at SEQ ID NO 17215
atggaggccgctggagcgccgggaagctctctgcacgggatgacgggtcgggagccggcgttcgccttctccacggcggcgcccgagcacgacggcgacgacgccgcggcgagcaagttcgacctgccggtggactcggagcacaaggcgaagagcatccgtctcttctccttcgcgaaccctcacatgcgcaccttccacctctcctggatctccttcttcacctgcttcgtctccaccttcgccgcggctcccctcgtccccatcatccgcgacaacctcaacctcaccaaggccgacatcggcaacgccggggtggcgtccgtgtcgggctccatcttctcccgtctcaccatgggcgccgtctgcgacctgctgggcccgcgctacggctgcgctttcctcatcatgctgtcggcgcccaccgtgttctgcatggcgctcatcgacgacgccgcgggctacatcgtcgtcaggttcctcatcggcttctcgctagcgaccttcgtctcgtgccagtactggatgagcaccatgttcaacagcaagatcatcggcaccgtcaacgggctcgccgccgggtggggcaacatgggcggcggcgccacgcagctcatcatgccgctggtgtacgacgtcatccgcaagtgcggcgccacgccattcacggcgtggcgggtggcatacttcgtcccggggctgatgcacgtggtcatgggcgtgctggtgctgacgctcgggcaggacctccccgacggcaacctcaggacgctgcagaagaagggcaacgtcaacaaggacaagttctccaaggtcatgtggtacgccctgataaactaccggacctggatcttcgtcctcctctacggctactccatgggcgtcgagctcaccaccgacaacgtcatcgccgagtacatgtacgaccgcttcgacctcgacctccgcgtcgccggcaccatcgccgcctgcttcggcatggccaacctcgtcgcgcgccccatgggcggcgtgctctccgacgtcggcgcgcggtactggggcatgcgcgcgcgcctctggaacatctggatcctccagaccgccggcggcgccttctgcctctggctggggcgcgccagcacgctccccgtctccatcgtcgccatggtgctcttctccttctgcgcgcaggccgcctgcggcgccatcttcggcgtcatccccttcgtctcccgccgctccctcggcatcatctccggcatgacgggcgccggcggcaacttcggtgcggggctcacgcagctgctcttcttcacctcgtccacctactccacggccagggggctggagtacatgggcatcatgatcatggcgtgcacgctgccggtggtgttcgtgcatttcccgcagtgggggtccatgttcttcccggccagcgccaccgccgacgaggagacctactacgcctccgagtggaacgacgacgagaagagcaagggactccacagcgccagcctcaagttcgccgagaacagccgatcagagcgcggcaagcgcaacgtcatccaggccgacgccggcgccacgccggagcacgtataa

SEQ ID NO: 17215 - protein, 527 aa, Sorghum bicolor
  misc_feature: Useful for making plants with altered carbon content
  misc_feature: Useful for making plants with altered nitrogen content
  misc_feature: Useful for making plants with modulated carbon-nitrogen partitioning
  misc_feature: Functional homolog of the protein sequence given in SEQ ID NO 14444
  misc_feature: Ceres ANNOT ID no. 8670979
  misc_feature (69)..(428): Pfam ID: MFS_1 Pfam Description: Major Facilitator Superfamily
MEAAGAPGSSLHGMTGREPAFAFSTAAPEHDGDDAAASKFDLPVDSEHKAKSIRLFSFANPHMRTFHLSWISFFTCFVSTFAAAPLVPIIRDNLNLTKADIGNAGVASVSGSIFSRLTMGAVCDLLGPRYGCAFLIMLSAPTVFCMALIDDAAGYIVVRFLIGFSLATFVSCQYWMSTMFNSKIIGTVNGLAAGWGNMGGGATQLIMPLVYDVIRKCGATPFTAWRVAYFVPGLMHVVMGVLVLTLGQDLPDGNLRTLQKKGNVNKDKFSKVMWYALINYRTWIFVLLYGYSMGVELTTDNVIAEYMYDRFDLDLRVAGTIAACFGMANLVARPMGGVLSDVGARYWGMRARLWNIWILQTAGGAFCLWLGRASTLPVSIVAMVLFSFCAQAACGAIFGVIPFVSRRSLGIISGMTGAGGNFGAGLTQLLFFTSSTYSTARGLEYMGIMIMACTLPVVFVHFPQWGSMFFPASATADEETYYASEWNDDEKSKGLHSASLKFAENSRSERGKRNVIQADAGATPEHV

SEQ ID NO: 17216 - DNA, 1998 bp, Sorghum bicolor
  misc_feature: Ceres ANNOT ID no. 8671012
  misc_feature: Encodes the peptide sequence at SEQ ID NO 17217
atggatcgggttcgcggatccgcgttcctgctcggcgtcctgctcgcaggatccctgttcgcattttcagttgcaaaggaggagaccaagaagctcgggactgtgatcggtattgatctcggtaccacctactcctgtgttggtgtgtacaagaatggtcatgtcgagatcatcgccaatgaccagggtaaccgtatcacaccctcatgggttgccttcactgatagcgagaggctcatcggtgaggctgccaagaaccaggcagccgtgaaccctgagaggaccatctttgacgtcaagcgtctcattggaagaaagtttgaggacaaggaagtccagagggacatgaaacttgttccctacaagataattaacaaggatggcaagccgtacattcaggtcaagatcaaggacggggagaataaggtcttcagccctgaggagatcagtgccatgattcttggcaagatgaaggataccgctgaggcgtaccttggcaagaagatcaacgatgctgtcgtcactgtccctgcgtacttcaatgatgcgcagaggcaggcaaccaaggatgctggtgtcattgccggcctcaatgttgctaggatcatcaatgagccaactgctgctgctattgcctacggtttggacaagaagggtggggagaagaacatccttgtctttgaccttggtggtggtacttttgatgtcagtatcttgaccattgacaacggtgtctttgaggtgctggccaccaacggtgacacccatcttggaggtgaggactttgaccagaggatcatggagtacttcatcaagttgatcaagaagaagtacagcaaggacatcagcaaggacaaccgtgctcttggaaagctgaggagggaagctgagcgtgccaagagggctctcagcaaccagcaccaggtccgtgttgagatcgagtccctctttgatgggaccgatttctcggagccgctgacccgtgccaggtttgaggagctgaacaacgacctgttccgcaagaccatgggccctgtcaagaaggccatggaggatgctggccttcagaagagccagatccatgagattgtcctggttggtggaagcaccaggattcccaaggtccagcagctcctgagggactactttgatggcaaggagcccaacaagggtgtcaaccctgatgaggctgttgcctttggtgccgcagtgcagggaagcatcttgagcggcgagggtggtgatgagaccaaagatatcctcctccttgatgtggcacccctcaccttgggtattgagaccgtcggtggagtcatgaccaagttgatcccgaggaacacagtcatcccaaccaagaagtcgcaggtgttcaccacctaccaggaccagcagaccactgtctccatccaggtcttcgagggtgagcgcagcatgaccaaggactgccgtcttctcggcaagttcgacctctctggcattccaccagctccaaggggcactccccagatcgaggtgaccttcgaggtggacgccaacggtatcctgaacgtgaaggcggaggacaagggcaccggcaagtcagagaagatcaccatcaccaacgagaagggccgtctgagccaggaggagatcgaccgcatggtgaaggaggcggaggagttcgctgaggaggacaagaaggtgaaggagcggatcgacgcccggaaccagctggagacgtacgtgtacaacatgaagaacacggtgggcgacaaggacaagctcgccgacaagctggaggccgaggagaaggagaaggtggaggaggccctcaaggaggcgctggagtggctggacgacaaccagtcggccgagaaggacgagtacgtggagaagctcaaggaggtggaggccgtctgcaaccccatcgtctcggccgtgtaccagcggtccggcggcgcccccggcggtggtgatgactcggagggtggcgtcgacgacgaccacgacgagctgtag

SEQ ID NO: 17217 - protein, 665 aa, Sorghum bicolor
  misc_feature: Useful for making plants with modulated heat sensitivity
  misc_feature: Functional homolog of the protein sequence given in SEQ ID NO 13726
  misc_feature: Useful for making plants with modulated drought sensitivity
  misc_feature: Functional homolog of the protein sequence given in SEQ ID NO 14080
  misc_feature: Ceres ANNOT ID no. 8671012
  misc_feature: Down-regulated in root tissues in response to methyl jasmonate treatment
  misc_feature: Up-regulated in shoot tissues in response to methyl jasmonate treatment
  misc_feature (35)..(642): Pfam ID: HSP70 Pfam Description: Hsp70 protein
MDRVRGSAFLLGVLLAGSLFAFSVAKEETKKLGTVIGIDLGTTYSCVGVYKNGHVEIIANDQGNRITPSWVAFTDSERLIGEAAKNQAAVNPERTIFDVKRLIGRKFEDKEVQRDMKLVPYKIINKDGKPYIQVKIKDGENKVFSPEEISAMILGKMKDTAEAYLGKKINDAVVTVPAYFNDAQRQATKDAGVIAGLNVARIINEPTAAAIAYGLDKKGGEKNILVFDLGGGTFDVSILTIDNGVFEVLATNGDTHLGGEDFDQRIMEYFIKLIKKKYSKDISKDNRALGKLRREAERAKRALSNQHQVRVEIESLFDGTDFSEPLTRARFEELNNDLFRKTMGPVKKAMEDAGLQKSQIHEIVLVGGSTRIPKVQQLLRDYFDGKEPNKGVNPDEAVAFGAAVQGSILSGEGGDETKDILLLDVAPLTLGIETVGGVMTKLIPRNTVIPTKKSQVFTTYQDQQTTVSIQVFEGERSMTKDCRLLGKFDLSGIPPAPRGTPQIEVTFEVDANGILNVKAEDKGTGKSEKITITNEKGRLSQEEIDRMVKEAEEFAEEDKKVKERIDARNQLETYVYNMKNTVGDKDKLADKLEAEEKEKVEEALKEALEWLDDNQSAEKDEYVEKLKEVEAVCNPIVSAVYQRSGGAPGGGDDSEGGVDDDHDEL

SEQ ID NO: 17218 - DNA, 1152 bp, Sorghum bicolor
  misc_feature: Ceres ANNOT ID no. 8671033
  misc_feature: Down-regulated in root tissues in response to methyl jasmonate treatment
  misc_feature: Up-regulated in shoot tissues in response to methyl jasmonate treatment
  misc_feature: Encodes the peptide sequence at SEQ ID NO 17219
atggccgccccgccgccgcccacggctgtctgcgctcgccacttccggctccacctcccctgctcctcccgcctgcccatggccgccgcctctgcctcctcctcttcaccgctccggcgccgccgccggctcgccgtctccccgcgcgccgaagctggtacagggactgggacggggaccgggaccggggacgtggaggcgctcagggccggggtgtccgtgtacaagccgcgctcctacgacgtgctcgtcactgacgccgcgcgctccctcgcctgcgccatcgacgacggcaagacccggctcgagatcgagttcccgcctctgccaagcagcatatcttcttacaagggctcctcagatgagttcatcgatgcgaacatccagcttgctcttgttgttgctaggaagctcaaagagctcaaggggactaagtcctgtatagtgtttcctgatcaacctgaaaagcgcagggcgtcacagttgttcaggacagctatagatacgattgagggtgtaactgtcagttccctggatgatgtacccaccgaccctgtcaacagcttcttcaaatcaataagaaacaccctggattttgacttctcagatgacaatgaagatagatggaaatctgatgaaccaccgtcattatatatcttcattaacagcagcacacgtgaccttgcttctatagagaagtatgtggaaaagtttgccacatctgttccagcccttctattcaatcttgaactagatacattgcgttctgacttggggcttctggggtttcccccaaaagatttgcactatcggttcctttctcagttcaccccagtattttatatcagacaacgtgactattccaagacaatcgcagtcgctccatacatagtgaattacagtggagctgtattccgtcgatatccaggcccctggcaggtcatgctgaagcagctcgatggctcctatgcatgtgttgcagagagtgaagctcggttcactttgggacaggcgaaagaagaactattgagggttattggtttacaagaagaagagggaagctcacttgaatttctcagaagaggatacaagaatgctacttggtgggaagagaacgttgatcaagagacgtcggctgcgtggcgaacttga

SEQ ID NO: 17219 - protein, 383 aa, Sorghum bicolor
  misc_feature: Useful for making plants with modulated oxidative stress sensitivity
  misc_feature: Functional homolog of the protein sequence given in SEQ ID NO 12913
  misc_feature: Ceres ANNOT ID no. 8671033
MAAPPPPTAVCARHFRLHLPCSSRLPMAAASASSSSPLRRRRRLAVSPRAEAGTGTGTGTGTGDVEALRAGVSVYKPRSYDVLVTDAARSLACAIDDGKTRLEIEFPPLPSSISSYKGSSDEFIDANIQLALVVARKLKELKGTKSCIVFPDQPEKRRASQLFRTAIDTIEGVTVSSLDDVPTDPVNSFFKSIRNTLDFDFSDDNEDRWKSDEPPSLYIFINSSTRDLASIEKYVEKFATSVPALLFNLELDTLRSDLGLLGFPPKDLHYRFLSQFTPVFYIRQRDYSKTIAVAPYIVNYSGAVFRRYPGPWQVMLKQLDGSYACVAESEARFTLGQAKEELLRVIGLQEEEGSSLEFLRRGYKNATWWEENVDQETSAAWRT

SEQ ID NO: 17220 - DNA, 432 bp, Sorghum bicolor
  misc_feature: Ceres ANNOT ID no. 8671030
  misc_feature: Encodes the peptide sequence at SEQ ID NO 17221
atgtccggcgaggaggaggagaacgccgcggagctcaagatcggcgaagagtttctcaaggccaagtgcctgatgaactgcgaggtggcgatcatcctggagcacaagtacgagcagatccagcagcactcgtcggagtcggacccgtcgtcgcaggtgtcgcaggtgttcgagaagtcgctgcagtacgtgaagcgcttcagccgctacaagaaccccgacgccgtgcgccaggtccgcgagacgctcagccgctacggactcgccgagttcgagctctgcacgctcggcaacctctgccccgacaccagcggcgaggccaccgcgctcgtcccgtccctcaagtccggcggcaggttcgtcggagacgccagggacgagaagatcgagaagatgctcaacgacctctccctcatcaagaagttcgagtag

SEQ ID NO: 17221 - protein, 143 aa, Sorghum bicolor
  misc_feature: Useful for making plants with modulated drought sensitivity
  misc_feature: Functional homolog of the protein sequence given in SEQ ID NO 14500
  misc_feature: Ceres ANNOT ID no. 8671030
  misc_feature (6)..(136): SWISSPROT Homolog: EC 2.7.7.6 DNA-directed RNA polymerase
  misc_feature (19)..(140): Pfam ID: RNA_pol_Rpb4 Pfam Description: RNA polymerase Rpb4
MSGEEEENAAELKIGEEFLKAKCLMNCEVAIILEHKYEQIQQHSSESDPSSQVSQVFEKSLQYVKRFSRYKNPDAVRQVRETLSRYGLAEFELCTLGNLCPDTSGEATALVPSLKSGGRFVGDARDEKIEKMLNDLSLIKKFE

SEQ ID NO: 17222 - DNA, 1515 bp, Sorghum bicolor
  misc_feature: Ceres ANNOT ID no. 8671029
  misc_feature: Encodes the peptide sequence at SEQ ID NO 17223
atggagtacgagcgcattgagaagccgttccccgtccagggcggcgggttctcgcccaagcggctgcgcgcgatgctgctcggggtggacaagcgccgcaaggggcaggacgacgccgaggaggaggaggacggcgagtctgagaccgattcactgtcttctcatgtaggtggtggaggcgccatgtgcgaagaatacaaggacgtcgacgtggtgagcaccatctcagagtcctcatcctcgctggagacagggggcgggcaccggtcccgagacgcccaccccatccccgtgggttccaggatcagggtgcctgaagaggactcgtgtgactcggagagtgtggcatccaactttgagttccacaaggagcgaggagccactgcccggtcagcggcggcggcatcggtcgtccctccattctcaaagcctgccccatcaaagtgggacgatgcacagaagtggattgccagcccgacgacaaaccgtcctagcaggggtggcggtggggctcctgttcctaagaagattgagaagcctagcgctggcatcgggaggttgccggcgaccaaggttgtgttggaggcaacagaggagatagatactaagaggattgatccgagccaagagaagagggaaattgggtggcagaaagcggtgaattgggcgccgcccgacccctgtcccgaagtggagccttgtccaaagactacacttgctgcagaaagtacaatggctgcttcagctgttacttttaaccgtcatgatgcatccaccacgcttcaaagtgcaacaacatgcatacctcctccatcaacagttcggtcagtgtcaatgagggatatgggcacagaaatgactcctattgcaagccaagaaccatctcgaacaggaacaccggtgagagcaacaagtccaaattgttctcggccaacaactccacgaaggacgctaggccccaacgcaattggtgctgttatcagccatggggaatgtagcaattcagaattaagtgaacaggaactgcaaacaaaaactaggagggagataatgcttcttggcacacagctaggtaagaccagtattgcagcatgggcaagcaagaaggaagaggaaaaagatgcatcactttcactgaaaacagtgcccatggaccaatcaacacagaacataactgcaatccgtgcagctgcatgggaagaggcagagaaggccaaatatttagcaagattcaaacgagaagaaatcaagatccaggcttgggaggatcatcagaaagcccaaatagaagctgaaatgagaaaaattgaggttgaggtagagcggatgcgtgcccgtgcgcaagacaagctgatgacccagctcgcatcggcaaggcacaatgcagatgagaagcgtgccgccgcagagctgaaaaggaaccgtgcagccgcaaggacggctgaacaggcagagcacatcaggagaaccggccgggtgccgccttcgtttggctgctggaactggtgctcgtag

SEQ ID NO: 17223 - protein, 504 aa, Sorghum bicolor
  misc_feature: The sequence is a functional homolog of SEQ ID NO 1040 in the 10/666,642 US patent application
  misc_feature: The sequence is a functional homolog of SEQ ID NO 264 in the 10/666,642 US patent application
  misc_feature: Ceres ANNOT ID no. 8671029
  misc_feature (388)..(498): Pfam ID: Remorin_C Pfam Description: Remorin, C-terminal region
MEYERIEKPFPVQGGGFSPKRLRAMLLGVDKRRKGQDDAEEEEDGESETDSLSSHVGGGGAMCEEYKDVDVVSTISESSSSLETGGGHRSRDAHPIPVGSRIRVPEEDSCDSESVASNFEFHKERGATARSAAAASVVPPFSKPAPSKWDDAQKWIASPTTNRPSRGGGGAPVPKKIEKPSAGIGRLPATKVVLEATEEIDTKRIDPSQEKREIGWQKAVNWAPPDPCPEVEPCPKTTLAAESTMAASAVTFNRHDASTTLQSATTCIPPPSTVRSVSMRDMGTEMTPIASQEPSRTGTPVRATSPNCSRPTTPRRTLGPNAIGAVISHGECSNSELSEQELQTKTRREIMLLGTQLGKTSIAAWASKKEEEKDASLSLKTVPMDQSTQNITAIRAAAWEEAEKAKYLARFKREEIKIQAWEDHQKAQIEAEMRKIEVEVERMRARAQDKLMTQLASARHNADEKRAAAELKRNRAAARTAEQAEHIRRTGRVPPSFGCWNWCS

SEQ ID NO: 17224 - DNA, 1311 bp, Sorghum bicolor
  misc_feature: Ceres ANNOT ID no. 8671049
  misc_feature: Encodes the peptide sequence at SEQ ID NO 17225
atggggaacatctgcggcgggaaggatcgggtggccgaggatttcaggccgtctagcccagggacgacaatgacctccaagacgagcggcagcctaaccaccagccagagcaccacagggaagctctcctccgtgagcagcggcttcatggcgtccgccggcagccgcagcaccagcggcgggttcgtcgacgagggggccaagtaccccgacggccagatcctggaggctcccaacctccgcaccttcacattcatggagctcaagacggccaccaagaactttaggcctgacagcgtgctcggtgaaggcgggttcggcagagtctacaaaggttgggtggatgagaagaccatggccccgaccaggaacggcaccggcatggttgttgccgtcaagaagctcaactcggagagcatgcagggttatgaagaatggcagtcggagataaattttctaggaaggctctcccatccgaacctagtgaagctcttgggctactgctgggaggacaaggaacttcttctcgtctatgaattcatggccaaagggagcttggaaaaccatctattcaggagaggatgcgccccactgtcttgggaactgaggctgaagatatccattggtgcagctcgagggcttgcattcttgcatgcatcagaaaagcaagtaatctaccgtgatttcaaagcgtctaacatccttttagatgcgaactataacgcaaagctctctgattttggccttgccaagcttggaccaactggtagcaactcacatatcacaaccagggtgatgggaacatatggctatgcagctccagagtacgtagcaaccggccatttgtacgtgaagagcgacgtgtacggcttcggcgtggtgatgctggagatgctgtcggggcagcgggcgctggacccgaaccgtccgagcgggcagctgagcctggccgactgggccaagccgtacctggccgaccgccggaagctggcgcggctcatggacccacggttcgaggggcagtacaactcgaagcaggcgttccaggcggcgcagctgacgctcaactgcctggccggcgagccccggagccggccgtcgatgaaggaggtggtggagacgctggagcacatcgagtcgatgaagagccgggcgcgggacgcacgtggcggcggcagcggctccactcgggacaggcaccacggccgcaccggcgcggcgcaccagcggtcgccgcgcgccggtggcgagccccgcggccgtggcgcgtccagggcctccaatggccacgccggcagggccgcgcggtga

SEQ ID NO: 17225 - protein, 436 aa, Sorghum bicolor
  misc_feature: Useful for making plants with modulated heat sensitivity
  misc_feature: Functional homolog of the protein sequence given in SEQ ID NO 14079
  misc_feature: Useful for making plants with modulated drought sensitivity
  misc_feature: Functional homolog of the protein sequence given in SEQ ID NO 14078
  misc_feature: Ceres ANNOT ID no. 8671049
  misc_feature (50)..(383): SWISSPROT Homolog: EC 2.7.11.1 Non-specific serine/threonine protein kinase
  misc_feature (95)..(375): Pfam ID: Pkinase Pfam Description: Protein kinase domain
MGNICGGKDRVAEDFRPSSPGTTMTSKTSGSLTTSQSTTGKLSSVSSGFMASAGSRSTSGGFVDEGAKYPDGQILEAPNLRTFTFMELKTATKNFRPDSVLGEGGFGRVYKGWVDEKTMAPTRNGTGMVVAVKKLNSESMQGYEEWQSEINFLGRLSHPNLVKLLGYCWEDKELLLVYEFMAKGSLENHLFRRGCAPLSWELRLKISIGAARGLAFLHASEKQVIYRDFKASNILLDANYNAKLSDFGLAKLGPTGSNSHITTRVMGTYGYAAPEYVATGHLYVKSDVYGFGVVMLEMLSGQRALDPNRPSGQLSLADWAKPYLADRRKLARLMDPRFEGQYNSKQAFQAAQLTLNCLAGEPRSRPSMKEVVETLEHIESMKSRARDARGGGSGSTRDRHHGRTGAAHQRSPRAGGEPRGRGASRASNGHAGRAAR

SEQ ID NO: 17226 - DNA, 447 bp, Sorghum bicolor
  misc_feature: Ceres ANNOT ID no. 8671100
  misc_feature: Encodes the peptide sequence at SEQ ID NO 17227
atggcgctgaggagaatcatcaaggagctcaaggacctgcagagggatccacccacgtcctgcagcgcagggcctgtgtctgacgacatgttccactggcaagcgaccatcataggccccagtgacagcccctactcagggggcgtcttcctggtcaccatccatttccctccggactaccccttcaaacctcccaaggtggcgttcaagacgaaggtgttccacccgaacatcaacagcaacggcaacatctgcctggacatcctcaaggagcagtggagcccggcgctgacggtctccaaggtgctgctctccgtctgctcgctgctcaccgacccaaacccggacgatccgctcgtcccggagatcgcacacatgtgcaagaccgaccgactcaggtacgagtccaccgccaggggatggacgcacaagtacgccatgggatga

SEQ ID NO: 17227 - protein, 148 aa, Sorghum bicolor
  misc_feature: Useful for biocontainment applications
  misc_feature: Functional homolog of the protein sequence given in SEQ ID NO 13996
  misc_feature: Ceres ANNOT ID no. 8671100
  misc_feature (1)..(148): SWISSPROT Homolog: EC 6.3.2.19 Ubiquitin--protein ligase
  misc_feature (5)..(142): Pfam ID: UQ_con Pfam Description: Ubiquitin-conjugating enzyme
MALRRIIKELKDLQRDPPTSCSAGPVSDDMFHWQATIIGPSDSPYSGGVFLVTIHFPPDYPFKPPKVAFKTKVFHPNINSNGNICLDILKEQWSPALTVSKVLLSVCSLLTDPNPDDPLVPEIAHMCKTDRLRYESTARGWTHKYAMG

SEQ ID NO: 17228 - DNA, 528 bp, Sorghum bicolor
  misc_feature: Ceres ANNOT ID no. 8671101
  misc_feature: Encodes the peptide sequence at SEQ ID NO 17229
atgagcgcgtccaggttcataaagtgcgtcacggtcggggacggcgccgtcggcaagacctgcatgctcatctcctacacctccaacaccttccccaccgactatgttccgacggtgtttgacaacttcagtgctaatgttgtggttgatggtaacactgtcaacctcggcctctgggacactgcaggtcaagaggattacaacagactgagaccactgagctatcgtggagctgatgtttttcttctggctttctcactgataagtaaggccagctatgagaatgtttcgaagaagtggatacctgaactgaagcattatgcacctggtgtgccaataattcttgtaggaacaaagcttgatcttcgagatgacaaacagttctttgtggaccatcctggtgctgtccctatcactactgctcagaacgtaaagggtgtgttcgatgcggcgataaaggttgtgctgcagccaccaaaggcgaagaagaagaaaaaggcgcagaggggggcgtgctccattttgtga

SEQ ID NO: 17229 - protein, 175 aa, Sorghum bicolor
  misc_feature: Useful for making plants with modulated nitrogen use efficiency
  misc_feature: Functional homolog of the protein sequence given in SEQ ID NO 13110
  misc_feature: Ceres ANNOT ID no. 8671101
  misc_feature (56)..(127): SWISSPROT Homolog: EC 2.7.11.1 Non-specific serine/threonine protein kinase
  misc_feature (8)..(157): Pfam ID: Ras Pfam Description: Ras family
  misc_feature (8)..(121): Pfam ID: Miro Pfam Description: Miro-like protein
MSASRFIKCVTVGDGAVGKTCMLISYTSNTFPTDYVPTVFDNFSANVVVDGNTVNLGLWDTAGQEDYNRLRPLSYRGADVFLLAFSLISKASYENVSKKWIPELKHYAPGVPIILVGTKLDLRDDKQFFVDHPGAVPITTAQNVKGVFDAAIKVVLQPPKAKKKKKAQRGACSIL

SEQ ID NO: 17230 - DNA, 1773 bp, Sorghum bicolor
  misc_feature: Ceres ANNOT ID no. 8671149
  misc_feature: Encodes the peptide sequence at SEQ ID NO 17231
atgaggaggagctcttccaaggccatggtgtcctccctcgccgtcgccctcgccgccgtcctgtgcctcacggccggcggcaacggtgtggcggcgttcaactacgcggacgcgctggacaaggcgctgctcttcttcgaggcgcagcggtccgggaagctcccgccgcggccgttgcagcgcgtgacgtggcgcggcgactccggcctgtccgacggctccgcggcaggggtagacctgtccggcggctactacgacgccggggacaacgtcaagttcggcctgcccatggccttcaccgtcaccatgctctcctggagcgtcctcgagttcatgcccggcgccgccgccggcagggccgccgtgcgctggggcgccgactacctgctcaaggcggccgcggcggcgccccacgcgctgtacgtgcaggtggccgacccgaaccgtgaccaccagtgctgggagcggcccgaggacatggacaccccgcgcgacgtctacaaggtcacccccgacatgcctggctccgacgtcgccggcgagaccgccgccgcgctcgccgccgcgtcgctcgtgttccggacctgtgaccccgcctactccgccaagctgctccagactgctcagaaggtgttcgacttcgcggaccggtacaggggctcctacagcgactcgctcagctccgtcgcctgcccgttctactgctcctactctggctaccatgacgagctgctgtgggcggcggcgtggctgcacatggcgacggcggcggcggctgcgccggccgggaactcgtcgtcggacgtctacctgtcgtacatctactccaacgggcacaacctgggagcggagcaggacgacttcaccttcagctgggacgacaagcgcgtgggcaccaaggtcctcctctccaaggccttcctacagggcaagggcaacgtggacgcgctgcgggtctacaaggcgcacgccgacacctatgtgtgctcgctcgtgccgggcgccggcggctcccagtcgtcgtcgtcgcagttcacgccggggggactcctgttcaaggaaggcgacagcaacatgcagtacgtcacctccacggcgttcctcctcctggcgcacgccaaatccctcgccggcgctggcgctatggtctcctgcggcggcgccgcggtgccggcgtccgcgctggtcgccgtcgccaagcggcaggtggactacatcctgggcgccaacccggcggcgatgtcctacatggtcggcttcggcgcgcggtacccgcggcacgtgcaccaccgcggcgcgtccatgccgtcggtgcgtgaccaccccgcgcgcatcgcctgcgacgaggggttccggtacctgcactcgtcggaccccgacgccaacgtgctcgtcggcgccgtcgtcggcgggcctgacggcagtgacgccttcactgacagccgcgacaacttcgcacagacagagccttctacctacaccaacgcgccgctcgtcggcgcgctcgccttcttcgccgagcttgctggcggcggtgagcagcgccggcgccgccgtcgtcgacgacgaccagaagtcgtcgtggccggagatggtcgatcgggaagcactttgtggaggcagccttcgtcgtcaagtcagagaggcaggacgtcatcgtggagttccacaccgccgacgacccccagccgccggacttcgacgcccaccgcgtctgcgtcttcgtcgacgccagccaacttgatcgtcgtcaggacgcccgtcgtcggctag

SEQ ID NO: 17231 - protein, 590 aa, Sorghum bicolor
  misc_feature: Useful for making plants with altered carbohydrate content
  misc_feature: Functional homolog of the protein sequence given in SEQ ID NO 13691
  misc_feature: Useful for biocontainment applications
  misc_feature: Useful for making plants with altered cell wall content and/or composition
  misc_feature: Useful for making plants with modulated nitrogen use efficiency
  misc_feature: Functional homolog of the protein sequence given in SEQ ID NO 13445
  misc_feature: Ceres ANNOT ID no. 8671149
  misc_feature (32)..(499): SWISSPROT Homolog: EC 3.2.1.4 Cellulase
  misc_feature (34)..(503): Pfam ID: Glyco_hydro_9 Pfam Description: Glycosyl hydrolase family 9
MRRSSSKAMVSSLAVALAAVLCLTAGGNGVAAFNYADALDKALLFFEAQRSGKLPPRPLQRVTWRGDSGLSDGSAAGVDLSGGYYDAGDNVKFGLPMAFTVTMLSWSVLEFMPGAAAGRAAVRWGADYLLKAAAAAPHALYVQVADPNRDHQCWERPEDMDTPRDVYKVTPDMPGSDVAGETAAALAAASLVFRTCDPAYSAKLLQTAQKVFDFADRYRGSYSDSLSSVACPFYCSYSGYHDELLWAAAWLHMATAAAAAPAGNSSSDVYLSYIYSNGHNLGAEQDDFTFSWDDKRVGTKVLLSKAFLQGKGNVDALRVYKAHADTYVCSLVPGAGGSQSSSSQFTPGGLLFKEGDSNMQYVTSTAFLLLAHAKSLAGAGAMVSCGGAAVPASALVAVAKRQVDYILGANPAAMSYMVGFGARYPRHVHHRGASMPSVRDHPARIACDEGFRYLHSSDPDANVLVGAVVGGPDGSDAFTDSRDNFAQTEPSTYTNAPLVGALAFFAELAGGGEQRRRRRRRRRPEVVVAGDGRSGSTLWRQPSSSSQRGRTSSWSSTPPTTPSRRTSTPTASASSSTPANLIVVRTPVVG

SEQ ID NO: 17232 - DNA, 759 bp, Sorghum bicolor
  misc_feature: Ceres ANNOT ID no. 8671213
  misc_feature: Encodes the peptide sequence at SEQ ID NO 17233
atgggttggcctgccgactttcaagggaggcgggaagatccgtcttctccggccgctccacccaattcgtcgtcctcccggccgcctccctcctcgcgctcccgagatctgaacatgagcgacgcgaccacggcccccaccgccgacgctgccgcgcacagcaagcaggcgccgtcgtccgccccgtcgtcgctggagacgacgatggcaagcatccgacggggcggcggcagctccgtggccgccaccatgagccagcaggcatcgcagcagcagcagcagccgtcgcggctggacgacgaccagctggcggagctgcgggagatcttccggtccttcgaccgcaacgccgacggcagcctgacgcagctggagctggggtccctgctccggtcgctgggcctgacgcccagcgccgaccagctggacgcgctcatcacccgcgccgacaccaactccaacggcctcgtcgagttctccgagttcgtcgcgctcgtcgcccccgacctcctcgccgaccggtccccgtactccgaggaccagctccgcaagctcttcgccatcttcgaccgcgatgggaacgggttcatcaccgccgccgagctcgcgcactccatggccaggctcggccacgcgctcaccgtcaaggagctcaccgggatgatcaaggaggcggacaccgacggcgacggccggatcaacttccaggagttctcgcgcgccatcaccgccgccgcatttgacaacatcttatactga

SEQ ID NO: 17233 - protein, 252 aa, Sorghum bicolor
  misc_feature: Useful for making plants with modulated salt sensitivity
  misc_feature: Functional homolog of the protein sequence given in SEQ ID NO 13894
  misc_feature: Ceres ANNOT ID no. 8671213
  misc_feature (98)..(238): SWISSPROT Homolog: EC 2.7.11.1 Non-specific serine/threonine protein kinase
  misc_feature (217)..(245): Pfam ID: efhand Pfam Description: EF hand
  misc_feature (181)..(209): Pfam ID: efhand Pfam Description: EF hand
  misc_feature (105)..(133): Pfam ID: efhand Pfam Description: EF hand
MGWPADFQGRREDPSSPAAPPNSSSSRPPPSSRSRDLNMSDATTAPTADAAAHSKQAPSSAPSSLETTMASIRRGGGSSVAATMSQQASQQQQQPSRLDDDQLAELREIFRSFDRNADGSLTQLELGSLLRSLGLTPSADQLDALITRADTNSNGLVEFSEFVALVAPDLLADRSPYSEDQLRKLFAIFDRDGNGFITAAELAHSMARLGHALTVKELTGMIKEADTDGDGRINFQEFSRAITAAAFDNILY

SEQ ID NO: 17234 - DNA, 756 bp, Sorghum bicolor
  misc_feature: Ceres ANNOT ID no. 8671220
  misc_feature: Encodes the peptide sequence at SEQ ID NO 17235
atggcgacctccaccttctccccgcgccccgccaccctcaacaagcccctgcgacctggcgccaagcccgccagcctcctacccttcccgtgccgccgtgccggcagactcgtctgcgccaccgctgccggggaggcgccgcccgtcgaggtcgagcagcgggacgaggcggagccggcccccgccgcggcctccaacggggccgccgtcaaggccgaggcgcccgccccaaaggccgtgcaggctgaggccccgccggcgcccgcgccggtcccggccttccgggacgccaggtgggtcaacggcacctgggacctcacccagttcgacaagggcggcgtcgtcgactgggacgccgtcatcgacgccgaggccaggagaaggaaatggcttgaagattatccagaggccactagcacagacgaggctgtcgtcttcgacacttcaattatcccatggtgggcatggatgaagcgattccaccttcctgaagccgagaagctaaatggtcgcgctgccatggttggcttcttcatggcatactttgtggatagcttgacgggcgtgggccttgttgaccaaatgggcaacttcttctgcaaaacgctgctgtttgttgccgtcgctggtgtactgctaatcaggaaaaatgaggacattgaatcactgaagaagcttatcgacgagactacgttctatgacaagcaatggcaggcaacctggcaagatgattccactgggggaccaaagaattag

SEQ ID NO: 17235 - protein, 251 aa, Sorghum bicolor
  misc_feature: Useful for biocontainment applications
  misc_feature: Useful for making plants with modulated biomass
  misc_feature: Functional homolog of the protein sequence given in SEQ ID NO 14501
  misc_feature: Ceres ANNOT ID no. 8671220
MATSTFSPRPATLNKPLRPGAKPASLLPFPCRRAGRLVCATAAGEAPPVEVEQRDEAEPAPAAASNGAAVKAEAPAPKAVQAEAPPAPAPVPAFRDARWVNGTWDLTQFDKGGVVDWDAVIDAEARRRKWLEDYPEATSTDEAVVFDTSIIPWWAWMKRFHLPEAEKLNGRAAMVGFFMAYFVDSLTGVGLVDQMGNFFCKTLLFVAVAGVLLIRKNEDIESLKKLIDETTFYDKQWQATWQDDSTGGPKN

SEQ ID NO: 17236 - DNA, 1572 bp, Sorghum bicolor
  misc_feature: Ceres ANNOT ID no. 8671223
  misc_feature: Encodes the peptide sequence at SEQ ID NO 17237
atgggcgcctgcttctcctcctccgcctccgctgcccccgccggcgccgccgacgaccgccgcccgtccaaggacgacgacggcaagaggaggcgccgcgccgccggagcctcgccggaagccgccgcggcggctgtccccgtgcgggtcgagttcggctacgagagggacttcgaggcgcgctatgaggtcggtcgcctgctcggccacggccagttcggctacaccttcgccgccaccgaccgcgcctccggggaccgcgtcgccgtcaagcgcatcgacaaggccaagatgacccgtcctgttgctgtggaggatgtgaaaagagaagtgaagattcttaaagcacttaaaggacatcagaatattgttcacttctacaacgcatttgaggatgattcatacgtgtatattgtgatggagctatgtgagggtggtgaactattggaccggattttggcaaaaaagaatagccgttatagtgagaaagatgctgcagtggtagtccgccaaatgctcaaagtagctgctgagtgtcatctgcgtgggttagttcaccgagatatgaagcctgagaacttccttttcaaatcaaataaggaggactcaccactaaaggcaacagattttggtttgtcagatttcattaagccagggaagaagtttcatgacattgttggaagtgcttactatgtcgcaccagaagtactaaaacgacggtctggtcctgagtcagatgtttggagcataggagttataacctacattttgctctgtgggaggcggcctttttgggataaaactgaagacggtatattcaaggaggttctaaggaacaaacctgattttcgtaagaggccttggtcaagcatcagtctaggtgctaaagattttgttaaaaggttactagtgaagaacccaagggcaaggctaacagctgctcaagctctctcacatccgtgggtaagagaaggaggagaagcatccgatatccctgttgacatatctgtgttatcaaacatgcgtcagtttgtcaagtacagccgttttaagcaattcgcacttcgggctttggcgagtactcttaatgaggaagagctagcagatctgaaggatcagtttgatgcaattgatattgataaaagtggatcaattagtatcgaggaaatgcgccatgcccttgcaaaggatcttccctggagattgaagggtccccgtgtgctcgagattattcaagcaattgacagcaacaccgatgggcttgtggacttcaaagagttcgttgcagcaactctccatatacaccagatggcggagcttgactctgaaagatggggtatacgctgccaagctgctttcagtaaattcgatctggatggtgatggatatatcacaccggaggaacttagaatgcacactggcttgaagggatctatcgagccgctgctggaggaggccgacatcgataaagacgggaagataagcctgtccgaattccgcaaactccttcgaaccgcaagcatgagcaacgttcccagcccaaggggggttccaaatcctcaagctctgtga

SEQ ID NO: 17237 - protein, 523 aa, Sorghum bicolor
  misc_feature: The sequence is a functional homolog of SEQ ID NO 2 in US patent 7084323
  misc_feature: Ceres ANNOT ID no. 8671223
  misc_feature (52)..(507): SWISSPROT Homolog: EC 2.7.11.1 Non-specific serine/threonine protein kinase
  misc_feature (62)..(322): Pfam ID: Pkinase Pfam Description: Protein kinase domain
  misc_feature (369)..(397): Pfam ID: efhand Pfam Description: EF hand
  misc_feature (448)..(476): Pfam ID: efhand Pfam Description: EF hand
  misc_feature (478)..(506): Pfam ID: efhand Pfam Description: EF hand
MGACFSSSASAAPAGAADDRRPSKDDDGKRRRRAAGASPEAAAAAVPVRVEFGYERDFEARYEVGRLLGHGQFGYTFAATDRASGDRVAVKRIDKAKMTRPVAVEDVKREVKILKALKGHQNIVHFYNAFEDDSYVYIVMELCEGGELLDRILAKKNSRYSEKDAAVVVRQMLKVAAECHLRGLVHRDMKPENFLFKSNKEDSPLKATDFGLSDFIKPGKKFHDIVGSAYYVAPEVLKRRSGPESDVWSIGVITYILLCGRRPFWDKTEDGIFKEVLRNKPDFRKRPWSSISLGAKDFVKRLLVKNPRARLTAAQALSHPWVREGGEASDIPVDISVLSNMRQFVKYSRFKQFALRALASTLNEEELADLKDQFDAIDIDKSGSISIEEMRHALAKDLPWRLKGPRVLEIIQAIDSNTDGLVDFKEFVAATLHIHQMAELDSERWGIRCQAAFSKFDLDGDGYITPEELRMHTGLKGSIEPLLEEADIDKDGKISLSEFRKLLRTASMSNVPSPRGVPNPQAL

SEQ ID NO: 17238 - DNA, 1116 bp, Sorghum bicolor
  misc_feature: Ceres ANNOT ID no. 8671232
  misc_feature: Encodes the peptide sequence at SEQ ID NO 17239
atgggccgcctgacgccgccgccgtcggaggcggcggcggtggcgccgctgctcctcgtcgtcgtccacgtcctcctcctggcggccgccgtttccgcgctcccggcgatcaacgtgacgacgatggcgttcgaggacgggtacgctccgctgttcggccacggcaacatcctccgctccgccgaccaccgcaccgtcagcctcctcctcgaccgctccaccgggtctggtttcatctcctcgtccatgtaccagcacggcttcttcagcgcctccatcaagctcccctccgactacaccgccggcgtcgtcgtcgccttctacgcgtcgaacggcgacgtgttcgagaagcggcacgacgagctggacttcgagttcctcggcaacatccgggggaagccatggcgggtgcagacgaacgtgtacggcaacggcagcgtggggcggggccgcgaggagcggtacgtgctgccgttcgacccgaccacggagttccaccgctactccatcctgtggacgcccgccgccgtggcgttctacgtcgacgacgtgccggtgcgagaggtccgccggtccgacgccatgggcggggacttcccgtccaagcccatgtccgtctacgccaccgtctgggacgcctccacctgggccacctccggcggccgctaccgcgtcaactacaggtacgggcccttcgtcgcgtccttcaccgacctcgccctcctcggctgccgcgtcgacgggcccgtcgccgccatccagcaggtgctgctgccgccggtgccaagccggtgcgccgccgacgaggagaagctcagggcgtcggacgtggccgtcatgaccgtggagaagcagcaggccatgcgcaggttccgggagcggaacatggtctactcctactgctacgacacgctgcggtaccccgccgcgttcccagagtgcgacgtcgtcgagtcggagcgccgccggttcaaggatagtggacacctccgcttcgcgttccggcggcggatgggcccgcgacgctccggcggaagggcggccagcagagccgccgccgccgccgccagcagggacagggacagggacctcaagaagcgcgcggcggacatgtag

SEQ ID NO: 17239 - protein, 371 aa, Sorghum bicolor
  misc_feature: Useful for making plants with altered cell wall content and/or composition
  misc_feature: Functional homolog of the protein sequence given in SEQ ID NO 14502
  misc_feature: Useful for making plants with altered carbohydrate content
  misc_feature: Functional homolog of the protein sequence given in SEQ ID NO 14068
  misc_feature: Ceres ANNOT ID no. 8671232
  misc_feature (44)..(314): SWISSPROT Homolog: EC 2.4.1.207 Xyloglucan:xyloglucosyl transferase
  misc_feature (44)..(229): Pfam ID: Glyco_hydro_16 Pfam Description: Glycosyl hydrolases family 16
  misc_feature (265)..(314): Pfam ID: XET_C Pfam Description: Xyloglucan endo-transglycosylase (XET) C-terminus
MGRLTPPPSEAAAVAPLLLVVVHVLLLAAAVSALPAINVTTMAFEDGYAPLFGHGNILRSADHRTVSLLLDRSTGSGFISSSMYQHGFFSASIKLPSDYTAGVVVAFYASNGDVFEKRHDELDFEFLGNIRGKPWRVQTNVYGNGSVGRGREERYVLPFDPTTEFHRYSILWTPAAVAFYVDDVPVREVRRSDAMGGDFPSKPMSVYATVWDASTWATSGGRYRVNYRYGPFVASFTDLALLGCRVDGPVAAIQQVLLPPVPSRCAADEEKLRASDVAVMTVEKQQAMRRFRERNMVYSYCYDTLRYPAAFPECDVVESERRRFKDSGHLRFAFRRRMGPRRSGGRAASRAAAAAASRDRDRDLKKRAADM

SEQ ID NO: 17240 - DNA, 396 bp, Sorghum bicolor
  misc_feature: Ceres ANNOT ID no. 8671277
  misc_feature: Encodes the peptide sequence at SEQ ID NO 17241
atggcggcggtggcaagggttttccgcgggtccctcttcctcatgtccccggcggcgggcacgggcaaggcggcgggagccaaggcggcggcggcggcggcgaccaagaagcggaccaaggcgccgtccacggagccgagggtgccgaccgggatctcgaagccgataccggtgtccgctgagttgagcaggttcgccggcggcgcgcccgaggtcgcgcgctcccaggccgtgaagctcatctgggcccacatcaaggctcacggcctgcaggacccagccaagaaaactgagatcaactgtgatgcaacactcaaaagcttgtttggtgggagggacaggattggaatgctggagatcatgaagctactgcgtcctcacttcctgaagaactag

SEQ ID NO: 17241 - protein, 131 aa, Sorghum bicolor
  misc_feature: Useful for making plants with modulated biomass
  misc_feature: Functional homolog of the protein sequence given in SEQ ID NO 14503
  misc_feature: Ceres ANNOT ID no. 8671277
  misc_feature (52)..(129): Pfam ID: SWIB Pfam Description: SWIB/MDM2 domain
MAAVARVFRGSLFLMSPAAGTGKAAGAKAAAAAATKKRTKAPSTEPRVPTGISKPIPVSAELSRFAGGAPEVARSQAVKLIWAHIKAHGLQDPAKKTEINCDATLKSLFGGRDRIGMLEIMKLLRPHFLKN

SEQ ID NO: 17242 - DNA, 1563 bp, Sorghum bicolor
  misc_feature: Ceres ANNOT ID no. 8671280
  misc_feature: Encodes the peptide sequence at SEQ ID NO 17243
atgggcgcggcggcgaggaggtgcgtgctgctcttggcgctgctgatgctcgtggccgcggcgaggacggcggccgtgggcgacggcgacggcggtggcggtggcaatggtggcggtgaggcgacggaggaggaccaggtcctgaggctgtggtcgtcgtcgttggcggcggctagtggtgaagaagccgacgacgaagatcgcttctccaactgggagtgggacgacgacgacgacgacgaagaggacaaggaggaggacgaccacgtcatggcggtgatgcaggggaagggggcgtgcaggaacgtggtgaacgtcgagagcttcggcgcggcgggcgacggcgacgccgacgacacccaggcgttcgcgagcgcgtggaagacggcgtgctcgctggacaacccggtgttcctggtgcccgccggccgccgctacaaggtcggcgccatccagttcctgggtccctgcaaggacaacaggatgatcatccagatccagggcacgatcgtggcgccggaggagccgtcggagtgggaccctcagagcccccggctgtggcttctcttctcggggctcgccggcgcgcgcatccagggcggcggcgtcatcgacggctccggctccaagtggtgggccaactcctgcaagatcaacaagtccaacccgtgcaggggtgcgccgacggcggtgacgatcgactcgtgccgtggcgtgcgcgtgcgcggcctccgcgtgcggaacgcgcagcagatgcacgtgacggtgtcccggtcccgcggcgtgcgcgtgggcgggctgcgcatcgacgcccccgaggacagccccaacacggacggcatccacgtcgccgactccaccgccgtcaccatccagagctgccgcatcggcaccggcgacgactgcatctccatcgtcaacggcagcttcggcgtcaagatgaggaacatcgactgcggccccggccacggcatcagcatcggcagcctgggcaagggcggcgcgttcgcggcggtggcggacgtggcgctcgacggcgcgcggatccgccgcgcgcagaacggggtccggatcaagacgtggcagggcggcgccggctacgtccgcggcgtgcgcttcgcgaacgtggacatggacggcgtcgaccaccccatcgtcatcgaccagttctactgcgacgtgccccccggtggcggcgaccgcagccgcacctgcgccaaccagacctccgccgtggccgtctccgacgtgtcgtaccgtaacatcaccggcacgtcgcgccgcgccgaggccatcaggttcgcctgcagcgacgccgtgccatgcaccggcatcgtgctcagagacatcaacctgcgccgcgatgatgatgatggcgaggtgcagaccgtgtgcaactgcgccgtcgggttcgactacggacgcgtccggcccgccgccgactgcctccgcagcagcacgtgcggcggcgcgcctgatgatcaccacggcgacgaggaggaggaggaggaggagcaggggaagaggaaggacgaggccgtcgtcttgcacactgagctctga

SEQ ID NO: 17243 - protein, 520 aa, Sorghum bicolor
  misc_feature: Useful for making plants with altered carbohydrate content
  misc_feature: Functional homolog of the protein sequence given in SEQ ID NO 14504
  misc_feature: Useful for making plants with altered cell wall content and/or composition
  misc_feature: Functional homolog of the protein sequence given in SEQ ID NO 14505
  misc_feature: Ceres ANNOT ID no. 8671280
  misc_feature (104)..(446): SWISSPROT Homolog: EC 3.2.1.15 Polygalacturonase
  misc_feature (131)..(481): Pfam ID: Glyco_hydro_28 Pfam Description: Glycosyl hydrolases family 28
MGAAARRCVLLLALLMLVAAARTAAVGDGDGGGGGNGGGEATEEDQVLRLWSSSLAAASGEEADDEDRFSNWEWDDDDDDEEDKEEDDHVMAVMQGKGACRNVVNVESFGAAGDGDADDTQAFASAWKTACSLDNPVFLVPAGRRYKVGAIQFLGPCKDNRMIIQIQGTIVAPEEPSEWDPQSPRLWLLFSGLAGARIQGGGVIDGSGSKWWANSCKINKSNPCRGAPTAVTIDSCRGVRVRGLRVRNAQQMHVTVSRSRGVRVGGLRIDAPEDSPNTDGIHVADSTAVTIQSCRIGTGDDCISIVNGSFGVKMRNIDCGPGHGISIGSLGKGGAFAAVADVALDGARIRRAQNGVRIKTWQGGAGYVRGVRFANVDMDGVDHPIVIDQFYCDVPPGGGDRSRTCANQTSAVAVSDVSYRNITGTSRRAEAIRFACSDAVPCTGIVLRDINLRRDDDDGEVQTVCNCAVGFDYGRVRPAADCLRSSTCGGAPDDHHGDEEEEEEEQGKRKDEAVVLHTEL

SEQ ID NO: 17244 - DNA, 1500 bp, Sorghum bicolor
  misc_feature: Ceres ANNOT ID no. 8671335
  misc_feature: Encodes the peptide sequence at SEQ ID NO 17245
atgaagtcgtcgctgaggacccggcaggagccgcggcgggtcagcaacggcgtcatcatcggcgccatgctgctgtccctctgcgtcctcagcatcgtcaaggccagatactgcgccacccccttcggcaaggccgaggaccagctccaggagcagatgaactccagcatcaggatggagccggaggagtcgtcgccggccaggacgcccggagaggaggaggacgagcaggaagaggaagaagaagaaaacggggcatcggcgacccccgccaccaccacggcgcctgcggtgacgaagacgacgccgacggccgtcccggccaccgccggcaacaggggcaaggtgagcaagggcggcaagggcaagccgacgtgctacatgacgagcaagcggtcggagcggtgcgacgcgtcaggtgacatccgggtggacgggaaccgctccgccatctacgtcagcgggatagacaaggagtggaagaccaagccgtacgcgcgctaccacgaccccgtggccatggcccacgtccgcgagtacaccctcaagccgctcccggcggcggaggcgccggcgtgcaccaggaaccactccgtccctggcttcctcttctccaacggcggcttctccggcaacctgtaccacgactacaccgacgtgctggtgccgctgttcatcagcacccaccagttccgtggccgcgtgcagttcctgctcagcgggatgaagccgtggtgggtggccaagttcaccccgttcttccggcagctcaccaagtacgacgtcatcgacgtggacaacgaccaggaggtgcactgcttcccccggatcgtggccggcgccaccttccacaaggacatgggcgtcgacccacgccggtcgccgggccacgtctccgtggtggacttcaagcgcgcgctgcgccgcgcgttcggcctggagcgcgaggcggcgtcccgcggcggcgccacgggccacggcaagccacgcctcctcatcatctcccgccgtggctcccgccggttcctgaacgagcgtgagatggcgcgggccgccgccgacgccgggttcgaggtgcgtgtggcggagcccgaccagcacacggacatggccacgttcgcggcgctggtgaactcggcggacgtgatggtgggcgtgcacggcgccgggctcaccaacatggtgttcctgccccgcggcgccgtgctcatccaggtggtgccgttcggcgggctggagtggctcaccagcgtcaccttcaaggaccccgccgcggacatggaggtgaactacatggactacaacgtgaagctggaggagagctcgctgctggaccagtacccgaggaaccaccaggtgctcaccgacccctacgccgtgcacaagcagggctgggacgcgctcaagacggcgtacctggacaagcagaacatccggatggatcttgacaggttcagagccacgctgcgggaggcaatgagccggttgccgtctccgtga

SEQ ID NO: 17245 - protein, 499 aa, Sorghum bicolor
  misc_feature: Useful for making plants with altered carbohydrate content
  misc_feature: Functional homolog of the protein sequence given in SEQ ID NO 14477
  misc_feature: Ceres ANNOT ID no. 8671335
MKSSLRTRQEPRRVSNGVIIGAMLLSLCVLSIVKARYCATPFGKAEDQLQEQMNSSIRMEPEESSPARTPGEEEDEQEEEEEENGASATPATTTAPAVTKTTPTAVPATAGNRGKVSKGGKGKPTCYMTSKRSERCDASGDIRVDGNRSAIYVSGIDKEWKTKPYARYHDPVAMAHVREYTLKPLPAAEAPACTRNHSVPGFLFSNGGFSGNLYHDYTDVLVPLFISTHQFRGRVQFLLSGMKPWWVAKFTPFFRQLTKYDVIDVDNDQEVHCFPRIVAGATFHKDMGVDPRRSPGHVSVVDFKRALRRAFGLEREAASRGGATGHGKPRLLIISRRGSRRFLNEREMARAAADAGFEVRVAEPDQHTDMATFAALVNSADVMVGVHGAGLTNMVFLPRGAVLIQVVPFGGLEWLTSVTFKDPAADMEVNYMDYNVKLEESSLLDQYPRNHQVLTDPYAVHKQGWDALKTAYLDKQNIRMDLDRFRATLREAMSRLPSP

SEQ ID NO: 17246 - DNA, 1215 bp, Sorghum bicolor
  misc_feature: Ceres ANNOT ID no. 8671400
  misc_feature: Encodes the peptide sequence at SEQ ID NO 17247
atggctcacacacgcactgctccccagccttcagctcaccagctgctcagtgcaccacatgatctactgccatcatcatcatgtgctgcttcccaatcctcaaagatccttccatttgaccttcagaaatgcagtcctgactccaccaacggaaccccagtctctcgcgtatctcaagctggattactatccaaggatctggtatcgccatccagttcttccacattctgcacaagtatgtactcgtcgtcgtcgacgaattccaagtcatgccggcaagcagacgctctgcctttcctgccccatcctcctaaaagtgagcatcagcaaacatcaggtggtcagtcatccagctcttcatcgctgctctttggtactgacctcaacaatggtggtcaaagtgaggctgaacctgcagctgatctcaaggattttcttaacctttctggagatgcttcaggaggcagtttccatggagaaagcaacggcatggctttcagagagcagatggagtttcagttcttgtctgaacagctcggaatcgccatcaccgacaacgaagagagccctcgattagatgatatatatgacagaccgccacaaacctcttcttgtccggtgttgtcttgctctgaccaagacgacctccagaggacaggatctcctgttaaagttcagctgagttcatctcgagctgcatcatgtaacaagccaagactgagatggacactggagctccatgagctttttgtaaagtctgtcaacaagcttggagggccagaaagtagggcaactcctaagggtgtgttgaagcttgtgaaggtagaaggcttgaccatctatcatgtgaagagccatttgcagaaataccgttttgcgaagcatcttccagagacaaaagaagaagacaagatatctaaatcagaaataccaggaaacaatgctggcagaaagaagagtttacaactagcagaagctcttcggatgcaaatggaggttcagaaacaacttcatgaacaattagaggtgcaaaggcagctacaggtacgcatagaagaacatgcaaagtatttgcagaagatattagaacaacagaaggcaagtaattcattaccagctatgacaagttcaatagaaagagagctttctgaatctaaagaggaaaagaaacccaagacgcaagcggacactttttcagctccattgccaaattaa

SEQ ID NO: 17247 - protein, 404 aa, Sorghum bicolor
  misc_feature: The sequence is a functional homolog of SEQ ID NO 2000 in the 11/479,226 US patent application
  misc_feature: The sequence is a functional homolog of SEQ ID NO 1995 in the 11/479,226 US patent application
  misc_feature: The sequence is a functional homolog of SEQ ID NO 1996 in the 11/479,226 US patent application
  misc_feature: The sequence is a functional homolog of SEQ ID NO 1997 in the 11/479,226 US patent application
  misc_feature: The sequence is a functional homolog of SEQ ID NO 1998 in the 11/479,226 US patent application
  misc_feature: The sequence is a functional homolog of SEQ ID NO 2001 in the 11/479,226 US patent application
  misc_feature: Ceres ANNOT ID no. 8671400
  misc_feature (239)..(291): Pfam ID: Myb_DNA-binding Pfam Description: Myb-like DNA-binding domain
MAHTRTAPQPSAHQLLSAPHDLLPSSSCAASQSSKILPFDLQKCSPDSTNGTPVSRVSQAGLLSKDLVSPSSSSTFCTSMYSSSSTNSKSCRQADALPFLPHPPKSEHQQTSGGQSSSSSSLLFGTDLNNGGQSEAEPAADLKDFLNLSGDASGGSFHGESNGMAFREQMEFQFLSEQLGIAITDNEESPRLDDIYDRPPQTSSCPVLSCSDQDDLQRTGSPVKVQLSSSRAASCNKPRLRWTLELHELFVKSVNKLGGPESRATPKGVLKLVKVEGLTIYHVKSHLQKYRFAKHLPETKEEDKISKSEIPGNNAGRKKSLQLAEALRMQMEVQKQLHEQLEVQRQLQVRIEEHAKYLQKILEQQKASNSLPAMTSSIERELSESKEEKKPKTQADTFSAPLPN

SEQ ID NO: 17248 - DNA, 2262 bp, Sorghum bicolor
  misc_feature: Ceres ANNOT ID no. 8671408
  misc_feature: Encodes the peptide sequence at SEQ ID NO 17249
atgtggcgcctgcgggtcgcggaggacggcggcggcggggggggcgggctccgcacgaagaacggccacgtcggccgccaggtctgggagttcgacgccgccgccgaccccgaccccgccgtcgacgccgcgcggcaggccttcgtcgacaccaggcaccacctcaagcacagcgccgacctgctcatgcgcatccagctggaccttctggcgatgaaactagatgagcatgaagatgttaccgttgaagccgtgtccactaccttgaaaagggcactcaaccgtttttctactatccaggcacacgatgggcactggcctggggactatggtggtcctatgttcctcatgccaggcttggtcataacattgtatgtgactggagcactaaacattgtcctatcaccagaacaccagaaggagatccgtcgatatctttataaccatcagaatgaagatggcggttggggcatgcacattgagggtccgagcaccatgtttggctcagcactgagctatgttattttgagattgcttggagagggaccagatagcggagatggagccatggagaatggtcgaaactggatcttagatcatggtggagcaacatatatagcatcatgggggaagttttggctttcgatacttggtgtatttgaatggtctggtaacaacccggtcccaccagaactatggctactaccatatctcctgccatttcatccagggaggatgtggtgtcattgtcgaatgttgtatttgcctatgtgctacatttatgggaagaggtttgtcggccgaatcacaccacttgtgttggaattgagaaaggaaattttcaatgacccttacaacgagattgattgggacaaggtccgcaacatatgtgctaaggaagatctgtaccgtccgcacccatttgttcaagatgtcttatgggcatctctccataaatttgttgaaccagttatgatgcactggcctggttgcaaattgagggagaaagctctagaaattgtcatgcaacatgttcactatgaggatgagaacactcaatacatctgcattggtcctgtaaccaaggtattaaatatgcttgcttgctggattgaagatccaaactcagaggcattcaaactccacattccacgagtatatgattacttgtggcttgctgaagatggcatgaagatgcagggttataatggcagccaactttgggatacagctttcgcagttcaagccattgtggctactaaccttattaaagagtttggtcccacccttaaactagcacacagctacatcaagaattcgcaggttcttgacgactgtcctggtgatctgaatgactggtaccgccacacatctaaaggtgcatggccattctcaactgctgataatggttggactgtatctgattgcactgcagaaggattaaaggcttcattattgttatcaaagatttctcctgagattgttggtgaaccggtggaagctaataggttttacgatgctgtcagttgtctgatgtcttatatgaatgataatggtggcttcgcgacatatgaactcacgagatcttatgcctggctggagcttatcaatcctacggagacctttggggacattatgattgattacccgtatgttgaatgtacatcagcagcaattcaggccctgacatcattcagaaaactctaccctgggcatcgcaggaaagaggtggacaactgtatcagcaaagctgccaatttcattgaggatgttcagagaagcgacggttcatggtatggctcttgggctgtttgcttcacgtatggcacttggtttggtgtgaagggactaattgctgctggtagaacatttgagaacagtcctgcgatcagaaaggcatgcggctttctgttatcaaaagagcttcttccttccggtggttggggagaaagctatttatcatctcaagaccaggtttacaccaatctcaaaggcaaccgagctcatgcagtgaacactagttgggccatgctggcactgattgatgcaggacaggctgagagagatccaacacctctacaccgagcagcaaaggttttgatcaacttgcaatcagaggatggagaatttcctcagcaagagatcgtaggagtgttcaacaagaactgcatgatcagctactcccagtacaggaacatcttcccaatttgggctctgggtgcgtaccggtgccgggtcctcctggaagatggcaagcagtag

SEQ ID NO: 17249 - protein, 753 aa, Sorghum bicolor
  misc_feature: The sequence is a functional homolog of SEQ ID NO 6 in US patent 7122717
  misc_feature: The sequence is a functional homolog of SEQ ID NO 4 in US patent 7135624
  misc_feature: The sequence is a functional homolog of SEQ ID NO 15 in US patent 7186884
  misc_feature: Ceres ANNOT ID no. 8671408
  misc_feature (1)..(752): SWISSPROT Homolog: EC 5.4.99.8 Cycloartenol synthase
  misc_feature (137)..(180): Pfam ID: Prenyltrans Pfam Description: Prenyltransferase and squalene oxidase repeat
  misc_feature (579)..(621): Pfam ID: Prenyltrans Pfam Description: Prenyltransferase and squalene oxidase repeat
MWRLRVAEDGGGGGGGLRTKNGHVGRQVWEFDAAADPDPAVDAARQAFVDTRHHLKHSADLLMRIQLDLLAMKLDEHEDVTVEAVSTTLKRALNRFSTIQAHDGHWPGDYGGPMFLMPGLVITLYVTGALNIVLSPEHQKEIRRYLYNHQNEDGGWGMHIEGPSTMFGSALSYVILRLLGEGPDSGDGAMENGRNWILDHGGATYIASWGKFWLSILGVFEWSGNNPVPPELWLLPYLLPFHPGRMWCHCRMLYLPMCYIYGKRFVGRITPLVLELRKEIFNDPYNEIDWDKVRNICAKEDLYRPHPFVQDVLWASLHKFVEPVMMHWPGCKLREKALEIVMQHVHYEDENTQYICIGPVTKVLNMLACWIEDPNSEAFKLHIPRVYDYLWLAEDGMKMQGYNGSQLWDTAFAVQAIVATNLIKEFGPTLKLAHSYIKNSQVLDDCPGDLNDWYRHTSKGAWPFSTADNGWTVSDCTAEGLKASLLLSKISPEIVGEPVEANRFYDAVSCLMSYMNDNGGFATYELTRSYAWLELINPTETFGDIMIDYPYVECTSAAIQALTSFRKLYPGHRRKEVDNCISKAANFIEDVQRSDGSWYGSWAVCFTYGTWFGVKGLIAAGRTFENSPAIRKACGFLLSKELLPSGGWGESYLSSQDQVYTNLKGNRAHAVNTSWAMLALIDAGQAERDPTPLHRAAKVLINLQSEDGEFPQQEIVGVFNKNCMISYSQYRNIFPIWALGAYRCRVLLEDGKQ

SEQ ID NO: 17250 - DNA, 1386 bp, Sorghum bicolor
  misc_feature: Ceres ANNOT ID no. 8671448
  misc_feature: Encodes the peptide sequence at SEQ ID NO 17251
atgtgcaacggcgagaccaaagccgcgacgtccacggcggcgccccacgtcgcgctgctctcgtcgccggggatgggccacgtggcgcctctggccgagctggcgcgccggctgcacgaggcgcacggcttcaccgccacggtcctcacctacgccagctccgactccgccgcgcagcgcgcgttcctggcgtccctgccgccggccgtgggcgccgcgtcgctgccggccgtcccgctggacgacctccccgcgggctccgccatcgagacgctgctctccgtcgaggcgcagcggtccgtcccggcgctcaccgcgatgctgacggacctcaggtccacgacgggcaacctcgtcgcgttcgtcgccgacctcttcggcgccgacgcgctgcgggcggcgcgcgacgccggggtgccgggctacctcttcttcccgtccaacctcctcatgctctcgctgatgctccacctcccgcgcctcgacgcggaactcgccgccaccgttggcgagttccgcgacatgccggagcccgtcaggctccccggctgcgtgccggtgcccggcgccgacatcctgcagccgctccaggaccggaccagcgacgcgtgccggtggatggtgcaccacggcgagaggtaccgcgacgcggccggcatactggtgaacacgttcgacgccgtcgagccaggcgccgcggccgtgctccggcggcccgagccgtggcgcccgccgccggagcgatcggtgctgttcgtgtcgttcggcagcggcggcgcgctgtccgcggcgcagacgcgcgagctggcgcgcgggctggagctgtccggggcacggttcctgtgggtggtgaggagccccgtcgacgacgccggcgccggcgacaccaaccccggggagagctactacgacgggtcgaagagcacggacgacccgctgagctacctcccggcggggttcgtggagaggaccaaggcggcggggcgcgtggtgccgtcgtgggcgccgcaggcgagggtgctcgcgcaccgcgccaccatggcgatgctgacgcactgcgggtggaactcggtgctggagagcgtggtgagcggggtgcccatggtggcgtggccgctgtacgccgagcagaggcagaacgccgtgctgctgtgcgaggagaccagggcggcgctcaggcctgtggtccgcggcgccgacgggatgatcctcgcggaggacatcgccgaggttgtcaaggagatgacgcatggcgagaagggggcggcggcgcgcgccaaggtggaggagctccgggaggcggcggccagcgcgctccggcccggcggcgtgtcctacgagacactggctgaagtcgtgagcaaatggaagggggctgcccactga

SEQ ID NO: 17251 - protein, 461 aa, Sorghum bicolor
  misc_feature: Useful for making plants with altered carbohydrate content
  misc_feature: Functional homolog of the protein sequence given in SEQ ID NO 14172
  misc_feature: Ceres ANNOT ID no. 8671448
  misc_feature (249)..(457): SWISSPROT Homolog: EC 2.4.1.218 Hydroquinone glucosyltransferase
  misc_feature (16)..(457): Pfam ID: UDPGT Pfam Description: UDP-glucoronosyl and UDP-glucosyl transferase
MCNGETKAATSTAAPHVALLSSPGMGHVAPLAELARRLHEAHGFTATVLTYASSDSAAQRAFLASLPPAVGAASLPAVPLDDLPAGSAIETLLSVEAQRSVPALTAMLTDLRSTTGNLVAFVADLFGADALRAARDAGVPGYLFFPSNLLMLSLMLHLPRLDAELAATVGEFRDMPEPVRLPGCVPVPGADILQPLQDRTSDACRWMVHHGERYRDAAGILVNTFDAVEPGAAAVLRRPEPWRPPPERSVLFVSFGSGGALSAAQTRELARGLELSGARFLWVVRSPVDDAGAGDTNPGESYYDGSKSTDDPLSYLPAGFVERTKAAGRVVPSWAPQARVLAHRATMAMLTHCGWNSVLESVVSGVPMVAWPLYAEQRQNAVLLCEETRAALRPVVRGADGMILAEDIAEVVKEMTHGEKGAAARAKVEELREAAASALRPGGVSYETLAEVVSKWKGAAH

SEQ ID NO: 17252 - DNA, 1608 bp, Sorghum bicolor
  misc_feature: Ceres ANNOT ID no. 8671503
  misc_feature: Encodes the peptide sequence at SEQ ID NO 17253
atgagcgacgtctccgtccgctttgtggtggcggtggcggtggcggcggtggccgccatctcgctcgccgccgcggtgtccgccgcgtccgccgctcacgactacggcgacgcgctgcacaagagcctgctctacttcgaggcgcagcggtcggggcgtctaccgtacaaccagcgggtgcggtggcgtggccactcggggctcaccgacgggctggagcaaggcgtggacctggtgggcggctactacgacgccggcgaccacgtgaagttcggcctgcccatggcgttcacggtgacgctcctctcctggggcatgctcgagtacggcggcggcgtggcggacgccggggagctggcgcacgcgctgcaggccatcaagtggggcaccgactacttcgtcaaggcgcacacggcgcccaccgagctgtgggcgcaggtgggcgacggcgactccgaccactactgctggcagcggcccgaggacatgaccacgtcgcggcgggcgtacaaggtggacgcggaacacccgggctccgaggtcgccgccgagaccgccgccgccatggccgccgcgtccgccgtgttccgcgccgccggcgacgcgcactacgcgcacctgctgctccaccacgcgcagcagctgttcgacttcgccgacacctaccggggacgctacgacgacagcgtcgacgtggtcaagagctactacccgtcctccagcggctaccaggacgagctgctgtgggcggcgctctggctgcaccgcgtcaccggccgccgtgactacctccgctacgcgctcgacaacgccgaggcgttcggcggcaccggctgggccgtctccgagttcagctgggacatcaagtacgccggcctccaggttctcgcatcccagctgctggtggaggcgaaggagcagcggctgcggctgagcgcggaggaggtggcggtggtggagcagctgcggtccaaggcggagtactacgtgtgctcgtgcatgaaccggaaccccggcggcgcgaagcacaacgccggccgcaccccggcggggctgctcttcatccgcccctggaacaacctccagtacgcctccggcgcggccttcctcctcaccgtctactccgacgtcctctcctccctcgaccagcccctccgctgcggcggctctggcgacgacgacggcgagcccgccgccgccggcgacgccggcgaggtgctggcgttcgccaagtcccaggccgactacatcctgggcacgaacccgatgcgcaccagctacctggtcgggtacggcgcggcgtacccgcggcaggtgcaccaccgcgcggcgtcgagcgcgtcgtacagtcacgaccgggacttcatcggctgcctgcaggggttcgactcgtggtacagcgcgcggcgggagaacccaaacgacctcgtcggcgccgtcgtcggcgggcccaacggcgaggacgtcttcaacgaccagcgcggcgcgtacatgcagaccgaggcctgcacgtacaacacggcgcccatggtcggggtcttctccaagctcatgcagctggaggggcagtcgccgcgcccggcgccggcgccggcggaggatctttga

SEQ ID NO: 17253 - protein, 535 aa, Sorghum bicolor
  misc_feature: Useful for making plants with altered carbohydrate content
  misc_feature: Functional homolog of the protein sequence given in SEQ ID NO 14506
  misc_feature: Useful for making plants with altered cell wall content and/or composition
  misc_feature: Useful for making plants with altered lignin content
  misc_feature: Functional homolog of the protein sequence given in SEQ ID NO 13875
  misc_feature: Ceres ANNOT ID no. 8671503
  misc_feature (33)..(534): SWISSPROT Homolog: EC 3.2.1.4 Cellulase
  misc_feature (34)..(515): Pfam ID: Glyco_hydro_9 Pfam Description: Glycosyl hydrolase family 9
MSDVSVRFVVAVAVAAVAAISLAAAVSAASAAHDYGDALHKSLLYFEAQRSGRLPYNQRVRWRGHSGLTDGLEQGVDLVGGYYDAGDHVKFGLPMAFTVTLLSWGMLEYGGGVADAGELAHALQAIKWGTDYFVKAHTAPTELWAQVGDGDSDHYCWQRPEDMTTSRRAYKVDAEHPGSEVAAETAAAMAAASAVFRAAGDAHYAHLLLHHAQQLFDFADTYRGRYDDSVDVVKSYYPSSSGYQDELLWAALWLHRVTGRRDYLRYALDNAEAFGGTGWAVSEFSWDIKYAGLQVLASQLLVEAKEQRLRLSAEEVAVVEQLRSKAEYYVCSCMNRNPGGAKHNAGRTPAGLLFIRPWNNLQYASGAAFLLTVYSDVLSSLDQPLRCGGSGDDDGEPAAAGDAGEVLAFAKSQADYILGTNPMRTSYLVGYGAAYPRQVHHRAASSASYSHDRDFIGCLQGFDSWYSARRENPNDLVGAVVGGPNGEDVFNDQRGAYMQTEACTYNTAPMVGVFSKLMQLEGQSPRPAPAPAEDL

SEQ ID NO: 17254 - DNA, 1059 bp, Sorghum bicolor
  misc_feature: Ceres ANNOT ID no. 8671598
  misc_feature: Encodes the peptide sequence at SEQ ID NO 17255
atggcggtgagcaccaggaggcggcacagcagcagcaggatggtggccgtgccggcgccggtggttcttggagtggccatggtcgtcgtcgtcctggccagcagcgcgaccggcgcgagcgggcagctgaggatggggttctacgccgagagctgccccggcgtggagcgaatggtgggcgacttcgtccggcagcacgtccgccgcgtgcccaccgtcgccgccgcgctgctccggctgcacttccacgactgcttcgtcaggggctgcgacgcctccgtcctgctcaactccaccgccggcagcgtggccgagaaggacgcgccgccgaacctgacgctgcgcggcttcgacttcgtcgaccgcgtcaagacgctcgtcgaggaggcctgcccaggcgtcgtctcctgcgccgacgtcctcgcgctcgccgcccgggacgcggtcgtcgccattggtgggccgtcgtggcgcgtgccgacggggaggagggacggcacggtgtcgaccatgcaggaggcgctcaacgacatccccaagcacaccatgaccttccagcagctggccaacctgttcgccagcaaaggcctcggcgtccgtgacctcgtctggctctcaggcgcgcacacgatcggcatcgcgcactgctcctccttcgccgaccgcctctacggctaccccggcgccggcgccggcaacgacacgacggacccgtccctggacgcgacctacgccgccaacctccgccggcgcaagtgccgggcggcgagcggcgggtacgccgaggacgccgtggtggagatggacccgggcagccacctgacgttcgacctgggctactaccgcgcgctgctcaagcacaggggcctgctccgctccgacgccgcgctgctcaccgacgcggcggcgcgcgccgacgtcgagagcgtcgtgggcggcgccgaggaggtctacttccaggtgttcgcgcggtccatggccaggctcgcgacggtgcaggtcaagaccggagctgagggggagatcaggaggaactgcgccgtcgtgaacggcggctag

SEQ ID NO: 17255 - protein, 352 aa, Sorghum bicolor
  misc_feature: Useful for making plants with altered carbohydrate content
  misc_feature: Functional homolog of the protein sequence given in SEQ ID NO 14507
  misc_feature: Ceres ANNOT ID no. 8671598
  misc_feature (37)..(350): SWISSPROT Homolog: EC 1.11.1.7 Peroxidase
  misc_feature (59)..(313): Pfam ID: peroxidase Pfam Description: Peroxidase
MAVSTRRRHSSSRMVAVPAPVVLGVAMVVVVLASSATGASGQLRMGFYAESCPGVERMVGDFVRQHVRRVPTVAAALLRLHFHDCFVRGCDASVLLNSTAGSVAEKDAPPNLTLRGFDFVDRVKTLVEEACPGVVSCADVLALAARDAVVAIGGPSWRVPTGRRDGTVSTMQEALNDIPKHTMTFQQLANLFASKGLGVRDLVWLSGAHTIGIAHCSSFADRLYGYPGAGAGNDTTDPSLDATYAANLRRRKCRAASGGYAEDAVVEMDPGSHLTFDLGYYRALLKHRGLLRSDAALLTDAAARADVESVVGGAEEVYFQVFARSMARLATVQVKTGAEGEIRRNCAVVNGG

SEQ ID NO: 17256 - DNA, 3420 bp, Sorghum bicolor
  misc_feature: Ceres ANNOT ID no. 8671599
  misc_feature: Encodes the peptide sequence at SEQ ID NO 17257
atgggggctctcgatctagaagccgagtactctctgatgcagatctttgtgaagaccctcaccggcaagactatcacccttgaggtggagtcttctgacaccatagacaacgtcaaggccaagatccaggacaaggagggcatccctcctgaccagcagcggcttatcttcgctggcaagcagcttgaggacggccgcacgcttgccgactacaacattcagaaggagtcaaccctccacttggtgctgcgcctcaggggaggcatgcagatctttgtcaagaccttgactggcaagacaatcacccttgaggtggagtcttctgacaccattgacaacgtcaaggccaagatccaggacaaggaaggcatccccccagaccagcagcggctcatctttgccggcaagcaactcgaggacgggcgcacgcttgccgactacaacatccagaaggagagcactctccaccttgtgctccgcctcaggggaggcatgcagatctttgtgaagaccctgaccggcaagactatcacccttgaggtggagtcctcggacaccatcgacaatgtcaaggccaagatccaggacaaggagggcatcccaccggaccagcagcggctcatcttcgccggcaagcagctggaggatggccgcacccttgcggattacaacatccagaaagagagcaccctccacctggtgctccgcctcaggggaggaatgcagatcttcgtgaagacattgacgggcaagaccatcaccttggaggttgagagctctgacaccatcgacaatgtcaaggccaagatccaggacaaggagggcattcccccggatcagcagcgtctgatctttgctggcaagcagctggaggatggccgtactcttgcggactacaacatccagaaggagagcaccctccacttggtgctccgcctgaggggtggtatgcagatctttgtgaagactttgactggcaagaccataaccctggaggttgagagctctgacaccatcgacaatgtgaaggctaagatccaggataaggagggtatccccccagaccagcagcgtctgatcttcgctggcaagcagctggaggatggtcgcacccttgcagactacaacatccagaaggagagcaccctccacctgatgcagatctttgtgaagaccctcaccggcaagactatcacccttgaggtggagtcttctgacaccatcgacaacgtcaaggccaagatccaggacaaggagggtatccccccggaccagcagcgcctcatctttgctggcaagcagctcgaggacgggcgcactcttgctgattacaacatccagaaggagagcaccctccacttggtgctgcgtctcaggggaggcatgcagatcttcgtgaagacccttactggcaagacgatcacccttgaggtggagtcctcggacaccatcgacaacgtcaaggccaagatccaggacaaggagggcatcccaccagaccagcagcgcctgatcttcgctggcaagcagctggaggatggccgcacccttgcggattacaacatccagaaggagagcaccctccacctggtgctccgcctcaggggtggcatgcagatatttgtgaagacccttactggcaagacgatcacccttgaggtggagtcctcggacaccatcgacaacgtcaaggccaagatccaggacaaggagggcatcccaccggaccagcagcgtctgatcttcgctggaaagcagctggaggatggccgcacccttgcggattacaacatccagaaggagagcaccctccacctggtgctccgcctcaggggtggcatgcagatctttgtgaagacattgactggcaagaccatcaccttggaggttgagagctctgacaccattgataatgtcaaggccaagattcaggacaaggagggcattcccccagaccagcagcgtctgatcttcgctggcaaacagctggaggatggccgcaccctcgctgactacaacattcagaaggagagcaccctccatcttgtgctccgcctgaggggtggtatgcagatctttgtgaagaccttgactggcaagaccattaccctggaggttgagagctctgacaccattgataacgtgaaggccaagatccaggacaaggagggcatccccccggaccagcagcgtctgatcttcgctggcaagcagctggaggatggccgcacccttgcagactacaacattcagaaggagagcaccctccatctgatgcagatctttgtgaagaccctcactggcaagactatcaccctcgaggtggagtcttctgacaccatcgacaacgtcaaggccaagatccaggacaaggaaggcatccccccggaccagcagcggctcatctttgccggcaagcagcttgaggatgggcgcacgcttgctgactacaacatccagaaggagagcaccctccaccttgtgctccgcctcaggggaggcatgcagatcttcgtgaagaccctaactggcaagacgatcacccttgaggtggagtcctcagacaccatcgacaatgtcaaggcaaagatccaggacaaggagggcatcccaccagaccagcagcgtctgatctttgccggcaaacagctggaggatggccgcacccttgcggattacaacatccagaaggagagcaccctccacttggtgctgcgtctcaggggaggcatgcaaatcttcgtgaagacccttactggcaagacgatcacccttgaggtggagtcctcggacaccatcgacaacgtcaaggccaagatccaggacaaggagggcatcccaccggaccagcagcgtctgatctttgctggcaagcagctggaggatggccgcacccttgcggattacaacatccagaaagagagtaccctccacctggtgctccgcctgaggggtggcatgcagatctttgtgaagacattgactggcaagaccatcacgttggaggttgagagctctgacactattgacaatgtgaaggccaagatccaggacaaggagggcattcccccagaccagcagcgtctgatctttgccggcaagcagctggaggatggccgtaccctcgctgactacaacatccagaaggagagcaccctccacctggtgctccgcctgaggggtggtatgcagatctttgtgaagaccttgactggcaagaccattaccttggaggttgagagctctgacaccatcgacaatgtgaaagctaagatccaggacaaggaggggatccccccggaccagcagcgtctgatcttcgccggcaagcagctggaggatggccgcacccttgcagactacaatatccagaaggagagcaccctccatctggtgctccgtctccgcggtggtcagtaa

SEQ ID NO: 17257 - protein, 1139 aa, Sorghum bicolor
  misc_feature: Useful for making plants with modulated nitrogen use efficiency
  misc_feature: Functional homolog of the protein sequence given in SEQ ID NO 13585
  misc_feature: Useful for making plants with modulated cold sensitivity
  misc_feature: Useful for making plants with modulated flowering time
  misc_feature: Functional homolog of the protein sequence given in SEQ ID NO 14303
  misc_feature: Ceres ANNOT ID no. 8671599
  misc_feature: Up-regulated in root tissues in response to salicylic acid treatment
  misc_feature: Down-regulated in shoot tissues in response to aminocyclopropane carboxylic treatment
  misc_feature: Up-regulated in root tissues in response to methyl jasmonate treatment
  misc_feature: Up-regulated in shoot tissues in response to methyl jasmonate treatment
  misc_feature: Up-regulated in shoot tissues in response to salicylic acid treatment
  misc_feature (18)..(86): Pfam ID: ubiquitin Pfam Description: Ubiquitin family
  misc_feature (94)..(162): Pfam ID: ubiquitin Pfam Description: Ubiquitin family
  misc_feature (170)..(238): Pfam ID: ubiquitin Pfam Description: Ubiquitin family
  misc_feature (246)..(314): Pfam ID: ubiquitin Pfam Description: Ubiquitin family
  misc_feature (322)..(390): Pfam ID: ubiquitin Pfam Description: Ubiquitin family
  misc_feature (391)..(459): Pfam ID: ubiquitin Pfam Description: Ubiquitin family
  misc_feature (467)..(535): Pfam ID: ubiquitin Pfam Description: Ubiquitin family
  misc_feature (543)..(611): Pfam ID: ubiquitin Pfam Description: Ubiquitin family
  misc_feature (619)..(687): Pfam ID: ubiquitin Pfam Description: Ubiquitin family
  misc_feature (695)..(763): Pfam ID: ubiquitin Pfam Description: Ubiquitin family
  misc_feature (764)..(832): Pfam ID: ubiquitin Pfam Description: Ubiquitin family
  misc_feature (840)..(908): Pfam ID: ubiquitin Pfam Description: Ubiquitin family
  misc_feature (916)..(984): Pfam ID: ubiquitin Pfam Description: Ubiquitin family
  misc_feature (992)..(1060): Pfam ID: ubiquitin Pfam Description: Ubiquitin family
  misc_feature (1068)..(1136): Pfam ID: ubiquitin Pfam Description: Ubiquitin family
MGALDLEAEYSLMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGQ

SEQ ID NO: 17258 - DNA, 2706 bp, Sorghum bicolor
  misc_feature: Ceres ANNOT ID no. 8671633
  misc_feature: Up-regulated in root tissues in response to salicylic acid treatment
  misc_feature: Down-regulated in shoot tissues in response to aminocyclopropane carboxylic treatment
  misc_feature: Up-regulated in root tissues in response to methyl jasmonate treatment
  misc_feature: Up-regulated in shoot tissues in response to methyl jasmonate treatment
  misc_feature: Up-regulated in shoot tissues in response to salicylic acid treatment
  misc_feature: Encodes the peptide sequence at SEQ ID NO 17259
atgaagctctcgccgtcggccagcggtggcctccaggaccagccggggtcgccggaagaagctgaagagcacaagtgcctaaattctgagttgtggcatgcatgtgccggccctctcgtttcattgcctgcggtcggtagtcgagtggtagcagcgtcgacaaataaggaaatggaggctcagatccccaactatcctagcctgcctccgcagcttatatgccaactgcataatgtgaccatgcatgctgatgctgagacagatgaggtgtatgcacagatgaccctgcagccactcagcccacaagagctcaaggacccatttttgcctgctgagttaggcactgccagcaagcagccaacgaattatttttgtaaaacgctaactgcaagtgatacgagcacacatggtggattctctgttccacgccgagcagcagagaaggtgtttcctccactggatttcaatcagcagcctcctgctcaggagttgattgcaacagatcttcatggcaatgagtggaaatttcgccatatttttcggggtcagccaaagcggcatcttctgacaacaggttggagtgtctttgttagtgcaaagagactggttgctggcgactctgtcctttttatctggaatgacaacaaccagctgcttctgggaattcgtcgggcaaacagaccacaaactgtcatgccatcatcagtactttctagtgatagcatgcatattggtctgcttgctgcagcagctcatgctgcatcaacaaatagccggtttactattttctataatccaagagcaagcccttgtgaatttgtcatacccatggctaagtacgtcaaagctgtgtaccatacccgtatatctgtgggcatgcgtttccggatgctttttgagacagaggaatccagtgtaaggcgttacatggggacaattacaggaataagtgatcttgatcctgttcgctggccaaactcgcactggcgctcagtaaaggttggatgggacgagtcaactgctggagagaagcagccaagggtatctctttgggagattgaaccattgacaacttttccaatgtacccatctccttttgctcttggattaaagcgtccgtggcctacaggcctgccatctttatatggtggaagggatgatggcttgacctcttctcttatgtggcttcgagacagggcaaatccgggtttccagtcactgaatttcagtgggcttggtacaagtccctggatgcagcctaggctggataattcccttcttggtctgcaatctgacatgtaccagacaatagcagcagcagcagcattacagagcactacaaagcaagtttcaccttcagtaatgcagttccagcagcctcagaatattgttgatagatctgctcttctatccagtcagattctgcagcaagtacaacctcagtttcagcaaatttacccccaaaatctcaatgaaaacaaaattcaaggtcagacggagtacctccaacaacagcttcaacgctgccaatcatttaatgagcagaagcctccgctgcattcgcagcaacaggagcaggaatcacagcagcagcaatgtgtgcaaacaccacaggatcaacaaatgcaacaacagaagcatctgcacaactttcactccttgccagatgcattatcggctttttctcagctttcctcagccactcactccccatcttccacactgcagacagttccggcattctcgcatcaacaaaactttccagatacaaacattagctctctctcaccatccagtggctcttccatgcatggcatgttggggcaattaccttctgaagcagcttcgagcctcccatgtgtggcaataaacactcctgtatcagtatctgacccatggtcatctaagagagttgcagtggagtctgttaacccttctcgacctcatgttgtttcaccacagatagaacaattggatatggcatcatgtaacatgccacaaagctctgcattagcaccgttacctgggagagaatgcttagtggatcaagatgggaactctgatcctcaaaatcacctcttatttggtgttaacatagactcacagtcacttttgatgcaaggtggcattccaagccttcagaatgataacagttcaggcacgattccatactcaacctccaatttcctgagctcttcacagaatgatttccccttgaatcaatcactacatagtgcgggctgcttagatgagtcaggttatgctccatgtgcagagaattctgaacaagcaaatcaacagtttgcaacctttgtcaaggtttacaaatctggaaacgtgggaaggttgctggatatcactagattcagcagctatgatgaacttcgtagtgaggtggggcgtctatttggccttgagggccagttggaagaccctttgagatcaggctggcagcttgtatttgttgacagagaggacgatgtccttctagttggcgatgacccgtggcaggaatttgtgaacagcgtgtcctgtataaagatactttcaccggaggaggttcagcagatgggcaagccgggcattcagctcttgagctcggctccttcaagaaggctgagcaatggctgcgacagctatgcgagcatgcaggaatcaagaagcctgagcactgggatggcgccagtgggttcggtcgagttctga

SEQ ID NO: 17259 - protein, 901 aa, Sorghum bicolor
  misc_feature: The sequence is a functional homolog of SEQ ID NO 1001 in the 10/666,642 US patent application
  misc_feature: The sequence is a functional homolog of SEQ ID NO 1621 in the 10/374,780 US patent application
  misc_feature: The sequence is a functional homolog of SEQ ID NO 1654 in the 10/412,699 US patent application
  misc_feature: The sequence is a functional homolog of SEQ ID NO 1004 in the 10/666,642 US patent application
  misc_feature: The sequence is a functional homolog of SEQ ID NO 1624 in the 10/374,780 US patent application
  misc_feature: The sequence is a functional homolog of SEQ ID NO 1657 in the 10/412,699 US patent application
  misc_feature: The sequence is a functional homolog of SEQ ID NO 1424 in the 10/666,642 US patent application
  misc_feature: The sequence is a functional homolog of SEQ ID NO 1826 in the 10/412,699 US patent application
  misc_feature: The sequence is a functional homolog of SEQ ID NO 2070 in the 10/374,780 US patent application
  misc_feature: The sequence is a functional homolog of SEQ ID NO 224 in the 10/666,642 US patent application
  misc_feature: The sequence is a functional homolog of SEQ ID NO 278 in the 10/374,780 US patent application
  misc_feature: The sequence is a functional homolog of SEQ ID NO 830 in the 10/225,066 US patent application
  misc_feature: The sequence is a functional homolog of SEQ ID NO 894 in the 10/412,699 US patent application
  misc_feature: The sequence is a functional homolog of SEQ ID NO 1003 in the 10/666,642 US patent application
  misc_feature: The sequence is a functional homolog of SEQ ID NO 1623 in the 10/374,780 US patent application
  misc_feature: The sequence is a functional homolog of SEQ ID NO 1656 in the 10/412,699 US patent application
  misc_feature: Useful for making plants with modulated light quality sensitivity
  misc_feature: Functional homolog of the protein sequence given in SEQ ID NO 13657
  misc_feature: The sequence is a functional homolog of SEQ ID NO 100 in the 10/666,642 US patent application
  misc_feature: Ceres ANNOT ID no. 8671633
  misc_feature: Up-regulated in root tissues in response to salicylic acid treatment
  misc_feature (250)..(333): Pfam ID: Auxin_resp Pfam Description: Auxin response factor
  misc_feature (123)..(228): Pfam ID: B3 Pfam Description: B3 DNA binding domain
MKLSPSASGGLQDQPGSPEEAEEHKCLNSELWHACAGPLVSLPAVGSRVVAASTNKEMEAQIPNYPSLPPQLICQLHNVTMHADAETDEVYAQMTLQPLSPQELKDPFLPAELGTASKQPTNYFCKTLTASDTSTHGGFSVPRRAAEKVFPPLDFNQQPPAQELIATDLHGNEWKFRHIFRGQPKRHLLTTGWSVFVSAKRLVAGDSVLFIWNDNNQLLLGIRRANRPQTVMPSSVLSSDSMHIGLLAAAAHAASTNSRFTIFYNPRASPCEFVIPMAKYVKAVYHTRISVGMRFRMLFETEESSVRRYMGTITGISDLDPVRWPNSHWRSVKVGWDESTAGEKQPRVSLWEIEPLTTFPMYPSPFALGLKRPWPTGLPSLYGGRDDGLTSSLMWLRDRANPGFQSLNFSGLGTSPWMQPRLDNSLLGLQSDMYQTIAAAAALQSTTKQVSPSVMQFQQPQNIVDRSALLSSQILQQVQPQFQQIYPQNLNENKIQGQTEYLQQQLQRCQSFNEQKPPLHSQQQEQESQQQQCVQTPQDQQMQQQKHLHNFHSLPDALSAFSQLSSATHSPSSTLQTVPAFSHQQNFPDTNISSLSPSSGSSMHGMLGQLPSEAASSLPCVAINTPVSVSDPWSSKRVAVESVNPSRPHVVSPQIEQLDMASCNMPQSSALAPLPGRECLVDQDGNSDPQNHLLFGVNIDSQSLLMQGGIPSLQNDNSSGTIPYSTSNFLSSSQNDFPLNQSLHSAGCLDESGYAPCAENSEQANQQFATFVKVYKSGNVGRLLDITRFSSYDELRSEVGRLFGLEGQLEDPLRSGWQLVFVDREDDVLLVGDDPWQEFVNSVSCIKILSPEEVQQMGKPGIQLLSSAPSRRLSNGCDSYASMQESRSLSTGMAPVGSVEF

SEQ ID NO: 17260 - DNA, 2460 bp, Sorghum bicolor
  misc_feature: Ceres ANNOT ID no. 8671626
  misc_feature: Up-regulated in root tissues in response to salicylic acid treatment
  misc_feature: Encodes the peptide sequence at SEQ ID NO 17261
atggcttcggaggcggagatggtacttggcgaggccggcggcggcggcggcggggagcgcaagaggaagaagacgctggggcggcggaagatcgagatcaagcccatcaagtgcatggaggcgaggcacgtgtgcttctccaagcgccgcgacgggctctacaagaaggccagcgagctctgcgcgctgaccggcgccaaggtggcgctcatcgtgttctcccccgcggggaagccttactcgttcggccacccttccgtcagcgccgtcgtcgatcggtacctcgaccccgacctacccggctccgccgccaacgacgtctccgaggcgccgacgacgacgatgtacgagttcgacgggcagcgcgaccggctgtgcgaggccatcgcggcggaggcgcggcggaaggacgcgctcgacgcggcggcgcgcgcggccggggtgtggaccgacgacgtcgtgcgccaagccgagatgcccgagctcgtcgccatgctcgccgcgctcgagcgcgtcaaggacgacgccgaccatgccatgaggcagcatcagtgcgcggcggcggctgctggcgcctgcgacgtctgctactacgacctcggcagcgatggcacgttcacggctgatgaatatggtggcgccagcagcggcagccatcatcatcagcaggcggccatggacgcgcagacgatggctcttctgatgggcggcaacgtcgtcacccatgccgccgctcacgctccgacgatgatgatgctgcctcctcctgatctccagccgccggcggcagcagcgcgggtgccgctgagtttcaactacggtactgaccacaaccatgtcacaggctatgaaggctatgcctacgaccttggagatggcggcggccagggcggcgctgcttatgaaacggaaggatgctacttcgggccaacggcaactttgcatatttttggaaacccaaatttgaaacgacgaagacacagatgccattgtgatctgatctgcatgtcaccgccacggccttcccctcccatcccggcgtgggcggcggccaactccctcttccgccgccaccgctgcctgcgtccactcctcctccccgccacctccctccgcgaccacctccccgttctgtcccactgcctcgtctcgggccttgcccgcaaccccttcgtggcgtcccgcctgctcctcgcatcctccagcctctccctccctttctccctcgccctcctcgcctatctcccggcctcctcgctctctccgttctccttcaactcgctcatccgcgcatccccgccgcgcctcgcggtccgcctgtttgaccaaatgcgcagccgaggcgtccccacggacccctacaccttgccgctcttgatcagcgcctgttcccgcagcagtcctacactgtgccagtctctgcatgggcagggcttccgtcttggctacaactgccacctcttcacccagacggcgctgatgaatgcttacctcgcgtgcgggtcggtggtcactgctcgcagggtgttcgaggaaatgccggtgaaggacgtggttgcgtggaccagcatggtgtctggttatgtagactccaggatgtacttggaagctgttgaggtgtttaacgagatgagaggtgctgatgatcttgtgtggcctaatgaggccacggtggtgtcgcttgcctctgcctgtgccggtctgggctcgatggagcatgcaaagggtctgcattcatatgtggagaagactggattagagggcgagttaattgtcaggaatgcattggttgacatgtatgggaagtgtggtagcattgaatctgcacgaagattgttttgtttgatgcgtgagaaggacttgcattcatggacagcaatgatttcagggctctcttgtcatggacatggtgaagaagcagttgaattgttcttcagcatgcgggaggaaggagtattaccagattcaactactttcattgtggttctttctgcctgtagccatgctggactggtagaagaggggatacgtatcttcaatttcatggagagtgagcacaatgtccccagggacatcaagcactatggttgcatggtggatcttttcagcagagcagggcttgttcaccgtgcttatgaattcattagcatgatgccttttgaaccgaacttggagattcttggggcactgctgagtgcatgcagtatcaataatgaactggagattggggagctcgtgctcaataagattgagtccatctgctcctacagaggaggtgctagtgtgcttctgtcaaatatatatgctaaccaaaatctgtggcatgaagtggatacccttagaaggaagataaggactgaagcaattgtcaggaagccacctggtcacagtttgtgtcatgggcagccaacgggctgcctgggccgacgggctgatagttcggcccagttatctttataa

SEQ ID NO: 17261 - protein, 819 aa, Sorghum bicolor
  misc_feature: Useful for making plants with altered lignin content
  misc_feature: Functional homolog of the protein sequence given in SEQ ID NO 12944
  misc_feature: Ceres ANNOT ID no. 8671626
  misc_feature (622)..(656): Pfam ID: PPR Pfam Description: PPR repeat
  misc_feature (519)..(553): Pfam ID: PPR Pfam Description: PPR repeat
  misc_feature (34)..(84): Pfam ID: SRF-TF Pfam Description: SRF-type transcription factor (DNA-binding and dimerisation domain)
MASEAEMVLGEAGGGGGGERKRKKTLGRRKIEIKPIKCMEARHVCFSKRRDGLYKKASELCALTGAKVALIVFSPAGKPYSFGHPSVSAVVDRYLDPDLPGSAANDVSEAPTTTMYEFDGQRDRLCEAIAAEARRKDALDAAARAAGVWTDDVVRQAEMPELVAMLAALERVKDDADHAMRQHQCAAAAAGACDVCYYDLGSDGTFTADEYGGASSGSHHHQQAAMDAQTMALLMGGNVVTHAAAHAPTMMMLPPPDLQPPAAAARVPLSFNYGTDHNHVTGYEGYAYDLGDGGGQGGAAYETEGCYFGPTATLHIFGNPNLKRRRHRCHCDLICMSPPRPSPPIPAWAAANSLFRRHRCLRPLLLPATSLRDHLPVLSHCLVSGLARNPFVASRLLLASSSLSLPFSLALLAYLPASSLSPFSFNSLIRASPPRLAVRLFDQMRSRGVPTDPYTLPLLISACSRSSPTLCQSLHGQGFRLGYNCHLFTQTALMNAYLACGSVVTARRVFEEMPVKDVVAWTSMVSGYVDSRMYLEAVEVFNEMRGADDLVWPNEATVVSLASACAGLGSMEHAKGLHSYVEKTGLEGELIVRNALVDMYGKCGSIESARRLFCLMREKDLHSWTAMISGLSCHGHGEEAVELFFSMREEGVLPDSTTFIVVLSACSHAGLVEEGIRIFNFMESEHNVPRDIKHYGCMVDLFSRAGLVHRAYEFISMMPFEPNLEILGALLSACSINNELEIGELVLNKIESICSYRGGASVLLSNIYANQNLWHEVDTLRRKIRTEAIVRKPPGHSLCHGQPTGCLGRRADSSAQLSL

SEQ ID NO: 17262 - DNA, 1341 bp, Sorghum bicolor
  misc_feature: Ceres ANNOT ID no. 8671652
  misc_feature: Encodes the peptide sequence at SEQ ID NO 17263
atgagggagatcctgcacatccagggcgggcagtgcgggaaccagatcggggccaagttctgggaggtgatctgcgacgagcacggcatcgaccacacgggcaagtacgccggcgactccgacctccagctcgagcgcatcaacgtctactacaacgaggccagcggtggccggtacgtcccgcgcgccgtgctcatggacctcgagcccggcaccatggactccgtgcgctccggaccctacggccagatcttccgccccgacaacttcgtcttcggccagtccggcgccggcaacaactgggccaagggccactacaccgagggcgccgagctcatcgactccgtgctcgacgtcgtccgcaaggaggccgagaactgcgactgcctccaaggatttcaggtttgccactcattgggtggaggtactggctctgggatgggcaccctgctcatctcaaaaatcagggaggagtacccagataggatgatgctcacattctcagttttcccatcacctaaggtgtctgataccgtggtagaaccttataatgctacactctcagttcatcaacttgttgagaatgctgatgagtgtatggtccttgacaatgaagctctttacgacatctgcttccgcactctgaagcttgctacacccacttttggtgacctgaaccatcttatttctgcaaccatgagtggtgttacctgctgcttgcggttcccaggccagctgaactctgacctccggaagctagcagtcaacttgatacccttccctcgcctccatttcttcatggttggttttgcaccactgacatcaagaggatcccagcagtaccgagccctcaccgtccccgagctgacccagcagatgtgggatgccaagaatatgatgtgtgcagctgacccacgacatgggcgctacctgacagcatcagccatgttccgtgggaagatgagcaccaaggaggtggatgagcagatgctgaatgtgcagaacaagaactcatcctacttcgtggagtggatcccgaacaacgtgaagtcgagtgtgtgcgacatccctcccacgggcctgaagatggcgtccacattcatcggcaactccacctcgatccaggagatgttcaggcgtgtgagcgagcaattcacggccatgttccggcgcaaggccttcttgcactggtacaccggggagggcatggacgagatggagttcaccgaggccgagagcaacatgaacgacctggtggctgagtaccagcagtaccaggacgcgacggcggacgacgaggaggagtacgaggatgaggaggaagaagaggtggctgcctaa

SEQ ID NO: 17263 - protein, 446 aa, Sorghum bicolor
  misc_feature: Useful for making plants with modulated flowering time
  misc_feature: Functional homolog of the protein sequence given in SEQ ID NO 14090
  misc_feature: Ceres ANNOT ID no. 8671652
  misc_feature: Down-regulated in root tissues in response to methyl jasmonate treatment
  misc_feature: Down-regulated in shoot tissues in response to aminocyclopropane carboxylic treatment
  misc_feature (45)..(244): Pfam ID: Tubulin Pfam Description: Tubulin/FtsZ family, GTPase domain
  misc_feature (246)..(383): Pfam ID: Tubulin_C Pfam Description: Tubulin/FtsZ family, C-terminal domain
MREILHIQGGQCGNQIGAKFWEVICDEHGIDHTGKYAGDSDLQLERINVYYNEASGGRYVPRAVLMDLEPGTMDSVRSGPYGQIFRPDNFVFGQSGAGNNWAKGHYTEGAELIDSVLDVVRKEAENCDCLQGFQVCHSLGGGTGSGMGTLLISKIREEYPDRMMLTFSVFPSPKVSDTVVEPYNATLSVHQLVENADECMVLDNEALYDICFRTLKLATPTFGDLNHLISATMSGVTCCLRFPGQLNSDLRKLAVNLIPFPRLHFFMVGFAPLTSRGSQQYRALTVPELTQQMWDAKNMMCAADPRHGRYLTASAMFRGKMSTKEVDEQMLNVQNKNSSYFVEWIPNNVKSSVCDIPPTGLKMASTFIGNSTSIQEMFRRVSEQFTAMFRRKAFLHWYTGEGMDEMEFTEAESNMNDLVAEYQQYQDATADDEEEYEDEEEEEVAA

SEQ ID NO: 17264 - DNA, 675 bp, Sorghum bicolor
  misc_feature: Ceres ANNOT ID no. 8671651
  misc_feature: Down-regulated in root tissues in response to methyl jasmonate treatment
  misc_feature: Down-regulated in shoot tissues in response to aminocyclopropane carboxylic treatment
  misc_feature: Encodes the peptide sequence at SEQ ID NO 17265
atggcaagcagcagcaggtctagcaagctcctccttgctctccttgtcgcagcaatggtggcgtgtcctctgtctctcgcgtacgacccgagccctctccaggacttctgcgtcgccgacaccgtctcctctgtgttcgtgaacgggctggtgtgcaaggacccggcgcaggtgtccgccggcgacttcgccttctcgggcctgcacaacgccggcgacacctccaacgcgttcggctccaaggtgacgctggtggacgtgcgcgcgctgccggggctcaactcgctgggcatctccatggcgcgcctcgacatcgcgcccggcggcctcaacccgccgcacacgcacccgcgcgccaccgaggtgctcaccgtcgtccagggccagatgtacgtcggcttcctcgccaccgacggcacgctcttcgccaaggtgatgtcgaagggcgacgtcttcgtcttccccaagggcctcctccatttcgagttcaactgcggcgccagccccgccgtcggcatcgctgggctcagcagccagaaccccgggctcatccgcgccgctgactcgctcttcggcgccacccccgccatcaccgacgaggtgctcgccaaggcgttcaggatcgatgccgccaccgtgcagaggatcaaggcgcagttcgccaccaagaagtaa

SEQ ID NO: 17265 - protein, 224 aa, Sorghum bicolor
  misc_feature: Useful for making plants with modulated nitrogen use efficiency
  misc_feature: Functional homolog of the protein sequence given in SEQ ID NO 14277
  misc_feature: Ceres ANNOT ID no. 8671651
  misc_feature (27)..(224): SWISSPROT Homolog: EC 1.15.1.1 Superoxide dismutase
  misc_feature (66)..(214): Pfam ID: Cupin_1 Pfam Description: Cupin
MASSSRSSKLLLALLVAAMVACPLSLAYDPSPLQDFCVADTVSSVFVNGLVCKDPAQVSAGDFAFSGLHNAGDTSNAFGSKVTLVDVRALPGLNSLGISMARLDIAPGGLNPPHTHPRATEVLTVVQGQMYVGFLATDGTLFAKVMSKGDVFVFPKGLLHFEFNCGASPAVGIAGLSSQNPGLIRAADSLFGATPAITDEVLAKAFRIDAATVQRIKAQFATKK

SEQ ID NO: 17266 - DNA, 867 bp, Sorghum bicolor
  misc_feature: Ceres ANNOT ID no. 8671645
  misc_feature: Encodes the peptide sequence at SEQ ID NO 17267
atggcgaaaagacgggaggagagagaagaaattgctgaggtgacaagagatctgatcgagctcgtcttggctggtcactcgagctcaggcatggagtttgccggcggcggcatcgcagctccggccgccgacagccctggcgcgggggcgtcgaggccgagcaggtacgagtcgcagaagcggcgggactggcacacgttcgggcagtacctgcggaaccaccggccgccgctggagctgccccggtgcagcggcgcgcacgtgctcgagttcctgcgctacctggaccagttcggcaagaccaaggtgcacgcgtccgggtgccccttcttcggccacccgtcgccgccggcgccgtgcccgtgcccgctcaagcaggcgtggggcagccttgacgcgctcgtcggccgcctgcgcgccgcgttcgaggagcacggcgggcggcccgaggccaacccgttcggcgcgcgcgccgtcaggctctacctccgcgaggtccgcgacagccaggccaaggcgcgcggcatcgcctacgagaagaagcggcgcaagcgacacccggcggcgcaccgccagcccaagcagcagcaggatggccatggccagcaccaccacccgtcgcaggccgcgccgggcccggtggccgagcggcgcctggctgacgtggccgagccgccggcgccgcacttcttgatcccgcacgcgcacttcctccacggccatttcctggcgccggtgacccagcccatcgaccctgccgcgggcggaggtggcggcggcgctggggaggacattgtgctcgcaatggctgccgccgccgaggcgcacgcggccgggttcttcatgccgctgtccgtgttccactag

SEQ ID NO: 17267 - protein, 288 aa, Sorghum bicolor
  misc_feature: Useful for making plants with modulated low light sensitivity
  misc_feature: Functional homolog of the protein sequence given in SEQ ID NO 14143
  misc_feature: Useful for making plants with modulated flowering time
  misc_feature: Useful for making plants with modulated nitrogen use efficiency
  misc_feature: Functional homolog of the protein sequence given in SEQ ID NO 13982
  misc_feature: Useful for making plants with modulated biomass
  misc_feature: Functional homolog of the protein sequence given in SEQ ID NO 13338
  misc_feature: Useful for biocontainment applications
  misc_feature: Functional homolog of the protein sequence given in SEQ ID NO 13983
  misc_feature: Ceres ANNOT ID no. 8671645
MAKRREEREEIAEVTRDLIELVLAGHSSSGMEFAGGGIAAPAADSPGAGASRPSRYESQKRRDWHTFGQYLRNHRPPLELPRCSGAHVLEFLRYLDQFGKTKVHASGCPFFGHPSPPAPCPCPLKQAWGSLDALVGRLRAAFEEHGGRPEANPFGARAVRLYLREVRDSQAKARGIAYEKKRRKRHPAAHRQPKQQQDGHGQHHHPSQAAPGPVAERRLADVAEPPAPHFLIPHAHFLHGHFLAPVTQPIDPAAGGGGGGAGEDIVLAMAAAAEAHAAGFFMPLSVFH

SEQ ID NO: 17268 - DNA, 1323 bp, Sorghum bicolor
  misc_feature: Ceres ANNOT ID no. 8671657
  misc_feature: Encodes the peptide sequence at SEQ ID NO 17269
atgcccccgacccccaccacagccgccgcaaccggcgccgccgtggcggcggcatcagcggagcaggcggcgttccgcctcgtgggccaccgcaacttcgtccgcgtgaacccgcgctccgaccgcttccacacgctcgcgttccaccacgtggagctctggtgcgccgacgcggcctccgccgcgggccgcttctccttcgggctcggcgcgccgctcgccgcgcggtccgacctctccacggggaacaccgcgcacgcgtccctgctgctccgctcgggcgccctcgcgttcctcttcacggcgccctacgcgcacggcgccgacgccgccacggcctcgctgccctccttctccgccgccgaggcgcggcgcttcgcggccgaccacggcctcgcggtgcgcgccgtcgcgctccgcgtggccgacgcggaggacgccttccgcgccagcgtcgcggccggcgcgcgcccggcgttcgagcccgtcgagctcggcctcggcttccgcctcgccgaagtcgagctctacggcgacgtcgtgctccggtacgtgagctacccggacgacgcggacgcgtccttcctgccggggttcgtgggcgtgaccagccccggcgcggcggactacgggctgaggaggttcgaccacatcgtcggcaacgtgccggagctggcgccggcggccgcctacttcgctggcttcacggggttccacgagttcgccgagttcacggcggaggacgtgggcaccacggagagcgggctcaactcgatggtgctcgccaacaacgcggagaacgtgctgctcccactcaacgagccggtgcacggcaccaagcgccgcagccagatacagacgtacttggaccaccacggcggccccggcgtgcagcacatggcgctggccagcgacgacgtgctcaggacgctgagggagatgcaagcgcgctcggccatgggcggcttcgagttcatggcgcctccggcgcccgaatactatgacggcgtgaggcggcgcgccggggacgtgctcacggaggcacagattaaggagtgtcaggaactaggggtgctggtggacagagatgaccagggcgtgctgctccagatcttcaccaagccagtgggggacaggccaacgttgttcttggagatcattcaaaggatcgggtgcatggagaaggatgagaaggggcaagaataccagaagggtggctgtggcgggtttggcaagggaaacttctcccagctgttcaaatccattgaggattatgagaagtcccttgaagctaagcaagctgcagcagctcagggatcctag

SEQ ID NO: 17269 - protein, 440 aa, Sorghum bicolor
  misc_feature: Useful for making plants with altered tocopherol content
  misc_feature: Functional homolog of the protein sequence given in SEQ ID NO 13376
  misc_feature: Ceres ANNOT ID no. 8671657
  misc_feature (30)..(440): SWISSPROT Homolog: EC 1.13.11.27 4-hydroxyphenylpyruvate dioxygenase
  misc_feature (214)..(371): Pfam ID: Glyoxalase Pfam Description: Glyoxalase/Bleomycin resistance protein/Dioxygenase superfamily
MPPTPTTAAATGAAVAAASAEQAAFRLVGHRNFVRVNPRSDRFHTLAFHHVELWCADAASAAGRFSFGLGAPLAARSDLSTGNTAHASLLLRSGALAFLFTAPYAHGADAATASLPSFSAAEARRFAADHGLAVRAVALRVADAEDAFRASVAAGARPAFEPVELGLGFRLAEVELYGDVVLRYVSYPDDADASFLPGFVGVTSPGAADYGLRRFDHIVGNVPELAPAAAYFAGFTGFHEFAEFTAEDVGTTESGLNSMVLANNAENVLLPLNEPVHGTKRRSQIQTYLDHHGGPGVQHMALASDDVLRTLREMQARSAMGGFEFMAPPAPEYYDGVRRRAGDVLTEAQIKECQELGVLVDRDDQGVLLQIFTKPVGDRPTLFLEIIQRIGCMEKDEKGQEYQKGGCGGFGKGNFSQLFKSIEDYEKSLEAKQAAAAQGS

SEQ ID NO: 17270 - DNA, 195 bp, Sorghum bicolor
  misc_feature: Ceres ANNOT ID no. 8671679
  misc_feature: Encodes the peptide sequence at SEQ ID NO 17271
atggcggagcagaaggagaggatgctggagttcgctcgacgctttagatggcgcatccacaaggccagcatggaagctatcaacgccttctgcttccagattggcgtccccagaactggacgagcaacaataggcacctcgcctccacgctatgcaagaagaccaagctcacggcggagcagaaggagcggatga

SEQ ID NO: 17271 - protein, 64 aa, Sorghum bicolor
  misc_feature: The sequence is a functional homolog of SEQ ID NO 122 in the 10/714,887 US patent application
  misc_feature: The sequence is a functional homolog of SEQ ID NO 122 in the 11/435,388 US patent application
  misc_feature: The sequence is a functional homolog of SEQ ID NO 126 in the 10/714,887 US patent application
  misc_feature: The sequence is a functional homolog of SEQ ID NO 126 in the 11/435,388 US patent application
  misc_feature: The sequence is a functional homolog of SEQ ID NO 58 in the 10/714,887 US patent application
  misc_feature: The sequence is a functional homolog of SEQ ID NO 58 in the 11/435,388 US patent application
  misc_feature: The sequence is a functional homolog of SEQ ID NO 622 in the 10/666,642 US patent application
  misc_feature: The sequence is a functional homolog of SEQ ID NO 60 in the 10/714,887 US patent application
  misc_feature: The sequence is a functional homolog of SEQ ID NO 60 in the 11/435,388 US patent application
  misc_feature: The sequence is a functional homolog of SEQ ID NO 128 in the 10/714,887 US patent application
  misc_feature: The sequence is a functional homolog of SEQ ID NO 128 in the 11/435,388 US patent application
  misc_feature: Ceres ANNOT ID no. 8671679
MAEQKERMLEFARRFRWRIHKASMEAINAFCFQIGVPRTGRATIGTSPPRYARRPSSRRSRRSG

SEQ ID NO: 17272 - DNA, 771 bp, Sorghum bicolor
  misc_feature: Ceres ANNOT ID no. 8671706
  misc_feature: Encodes the peptide sequence at SEQ ID NO 17273
atggcgcccgccgggtgggtggccgggctggtggcggagagcttcttcgtggcgtgccccgcgcacgagtcccgcaagaagaacgagcgcaacatcttctgcctcgcctgctgcgccagcatctgcccgcactgcgcccccgcgcaccgccaccacccgctcctccaggtgcggcgctacgtgtaccatgacgtcgtccgccttggcgacctcgagaagctcatcgactgctcctgtgttcagagctacacgatcaacagtgccaaggtgatcttcctgaagccgaggcctcagtccaggcctttcaagggctccggcaacatctgcctcacatgtgacaggatcctccaggagcccttccacttctgctccctctcttgcaaggtggatcatgtgatgatgcagggaggggacctgtccaacatcctgcagtactatggcggcagcggtgtggcgggggacccggaccgcctcgccttcccgaggttcgagaacctccgcgtcgatggctcggacctcgacgatgacaccgacggtgggcaggtgaccccaaactcgatcctcgaggacccgacgcagcactatggcaatggcggtggcgggggatcaagtgacaatggaggcgacactagggtggatggcggtgcgcggcgcggcggcgaggcggcaaagaggaagaaagggggagggttcttcccccagatcgtgctgtcgcttggcggcggcggtaacaggaggaagggtgccccccacaggtcccctctggcctaa

SEQ ID NO: 17273 - protein, 256 aa, Sorghum bicolor
  misc_feature: The sequence is a functional homolog of SEQ ID NO 666 in the 10/666,642 US patent application
  misc_feature: Ceres ANNOT ID no. 8671706
  misc_feature (19)..(129): Pfam ID: PLATZ Pfam Description: PLATZ transcription factor
MAPAGWVAGLVAESFFVACPAHESRKKNERNIFCLACCASICPHCAPAHRHHPLLQVRRYVYHDVVRLGDLEKLIDCSCVQSYTINSAKVIFLKPRPQSRPFKGSGNICLTCDRILQEPFHFCSLSCKVDHVMMQGGDLSNILQYYGGSGVAGDPDRLAFPRFENLRVDGSDLDDDTDGGQVTPNSILEDPTQHYGNGGGGGSSDNGGDTRVDGGARRGGEAAKRKKGGGFFPQIVLSLGGGGNRRKGAPHRSPLA

SEQ ID NO: 17274 - DNA, 1722 bp, Sorghum bicolor
  misc_feature: Ceres ANNOT ID no. 8671708
  misc_feature: Encodes the peptide sequence at SEQ ID NO 17275
atggccgcggccacgctgctcccgggccccgccgccgcctcgccgcgtctcggctccgcggcttccgccccgtccgcgtcccacgggaggcgtcgcctcaccttcagcttcaggtgccagtcgaccagcgtcgacaagcagcagcagcctccgccgcctaagcagaagcagcggaacctgctcgacaacgccagcaacctgctgaccaacttcctcagcggcggcaacctcggggccatgcccgtcgcggagggcgccgttactgacctcttcggcaagcccctcttcttctcgctctatgattggttcctcgagcatggctctgtctacaagcttgcttttgggcccaaatcgtttgttgtcgtctctgaccctattgttgctagacacatcctccgggagaacgctttctgttatgataagggagttcttgctgaaattttaaaacccataatggggaagggtcttatacctgctgaccttgatacctggaagcaaaggagaaaagttataacacctgggttccatgccttattcatagaagctatggtgagaacatttacgaaatgttcagagagaacaatatcaaagcttgaagagcttactgaaagcgaagctcgtgtacaaaaatcgactatagtggaccttgaagctgagttctccaatttggcactcgatatcattggcttgggtgtgttcaattttgattttgactcggttactaaggaatctcctgtaatcaaggcagtttatggaacactttttgaagctgagcaccgttctaccttctacatcccctactggaatcttcctttcacaaaatggatagttccaaggcagcgcaagttccatagtgacctcaaggtgatcaacaattgccttgataacctgataaaaaatgcaaaggagacaagacaggaagctgatgtggaaaagctccagcaaagggactactcttctctgaaggatgcaagcttgctgaggttccttgttgacatgcggggagctgatgttgatgatcgccagcttcgagatgatctaatgacaatgcttattgctggacatgaaacaactgctgctgttctgacatggtctgtttttttgctagcccagagccctaccaagatgagaaaagcccaggcagaggttgattctgttctcagcaatggggcaattactgttgaatccctcaagaaactggagtacataaaattgattattcttgaagctcttcgcttgtatcctcagccaccattgttaattaggcgttctctccggccagacaagttgccaggtggatacaacggagcaaaagagggatatgaaataccagctgggactgatatatttgtttcgatatacaacctccacagatccccatatttttgggaccggccaaatgaatttgaacctgagaggttttcagttccaaagaaggatgagagcatagaaggctggtctggttttgatcctgaccggagtcctggtgcaatgtaccccaatgagatcatagcagactttgctttccttccctttggcggtgggcctcgcaaatgtgtgggggaccaattcgcgctcctggagtcgacggtagctctggccctgctgctgcggaagtttgatgtggagctgagagggtcacccgacgaagtagagatggtgacaggcgccacgatccacacaaagaatgggctgtggtgcagactgaggaaaaggacttga

SEQ ID NO: 17275 - protein, 573 aa, Sorghum bicolor
  misc_feature: Useful for making plants with altered carbohydrate content
  misc_feature: Functional homolog of the protein sequence given in SEQ ID NO 14508
  misc_feature: Ceres ANNOT ID no. 8671708
  misc_feature (114)..(475): SWISSPROT Homolog: EC 1.14.15.3 Alkane 1-monooxygenase
  misc_feature (72)..(568): Pfam ID: p450 Pfam Description: Cytochrome P450
MAAATLLPGPAAASPRLGSAASAPSASHGRRRLTFSFRCQSTSVDKQQQPPPPKQKQRNLLDNASNLLTNFLSGGNLGAMPVAEGAVTDLFGKPLFFSLYDWFLEHGSVYKLAFGPKSFVVVSDPIVARHILRENAFCYDKGVLAEILKPIMGKGLIPADLDTWKQRRKVITPGFHALFIEAMVRTFTKCSERTISKLEELTESEARVQKSTIVDLEAEFSNLALDIIGLGVFNFDFDSVTKESPVIKAVYGTLFEAEHRSTFYIPYWNLPFTKWIVPRQRKFHSDLKVINNCLDNLIKNAKETRQEADVEKLQQRDYSSLKDASLLRFLVDMRGADVDDRQLRDDLMTMLIAGHETTAAVLTWSVFLLAQSPTKMRKAQAEVDSVLSNGAITVESLKKLEYIKLIILEALRLYPQPPLLIRRSLRPDKLPGGYNGAKEGYEIPAGTDIFVSIYNLHRSPYFWDRPNEFEPERFSVPKKDESIEGWSGFDPDRSPGAMYPNEIIADFAFLPFGGGPRKCVGDQFALLESTVALALLLRKFDVELRGSPDEVEMVTGATIHTKNGLWCRLRKRT

SEQ ID NO: 17276 - DNA, 1035 bp, Sorghum bicolor
  misc_feature: Ceres ANNOT ID no. 8671720
  misc_feature: Encodes the peptide sequence at SEQ ID NO 17277
atgttcccttccaagaaggccactagtagcgccgctgccgctgccgctgccgccgtgagctcaaatgataggcaggcgatgtgcgtgcagcagggcgactcggggtcgggcctcgtcctcaccaccgaccccaagccccgcctccgctggaccgtcgagctccatgagcgcttcgtcgacgccgtcacgcagctcggtggccccgacaaggcgactccaaagaccatcatgagggtcatgggagtgaaggggcttaccctttaccacctcaagagccatcttcagaaattcaggttagggaagcagccgcacaaggagttcaacgagcactcagttaaggatggcatgatgggaagaagcatgaacgagatgcaaatggaagtccagagaaggctacatgagcaactagaggtgcaaaggcacctccagatgaggatcgaagcccaggggaagtacatgcagtccatcctggagaaagcctaccagaccatcgccgccggcgacgtcgctgcgtgcccggcggcagggtacaaatccctactaggtaaccaccaccaggcgatgctggacgtctgctccctcaaggacatgggcccgtccatgggcttcccttcgctgcaagacctgcacatgtacggcggaggcggccacctggacctgcagcagcagatggagcggccgatggaggccttcttcgccagctgcgacattgggtcgctggccaagaaaaggcccatcagcccttacgccgacggcaagagcccgatgatgtggtgcgacgacgaggacggcaagggcatcgtcgaccagctccagatggcgccgtcgatgatggacgccgccggcatcgacgtcatggactccatcgccgacgtgtatggcgacgccaagcccatgatgtccggcgactccacggggagcaagggcggctttgacgtcaagctcgagaggccgtcaccgcggcggccgcacatgggcggcagcccgtcggtgatcggcggaggccagcagacaaggaacctgtcctacgggtaa

SEQ ID NO: 17277 - protein, 344 aa, Sorghum bicolor
  misc_feature: Useful for making plants with altered alkaloid content
  misc_feature: Useful for making plants with altered terpenoid content
  misc_feature: Functional homolog of the protein sequence given in SEQ ID NO 13070
  misc_feature: The sequence is a functional homolog of SEQ ID NO 1995 in the 11/479,226 US patent application
  misc_feature: The sequence is a functional homolog of SEQ ID NO 1996 in the 11/479,226 US patent application
  misc_feature: The sequence is a functional homolog of SEQ ID NO 1997 in the 11/479,226 US patent application
  misc_feature: The sequence is a functional homolog of SEQ ID NO 1998 in the 11/479,226 US patent application
  misc_feature: The sequence is a functional homolog of SEQ ID NO 2001 in the 11/479,226 US patent application
  misc_feature: The sequence is a functional homolog of SEQ ID NO 2000 in the 11/479,226 US patent application
  misc_feature: The sequence is a functional homolog of SEQ ID NO 1999 in the 11/479,226 US patent application
  misc_feature: Ceres ANNOT ID no. 8671720
  misc_feature (47)..(98): Pfam ID: Myb_DNA-binding Pfam Description: Myb-like DNA-binding domain
MFPSKKATSSAAAAAAAAVSSNDRQAMCVQQGDSGSGLVLTTDPKPRLRWTVELHERFVDAVTQLGGPDKATPKTIMRVMGVKGLTLYHLKSHLQKFRLGKQPHKEFNEHSVKDGMMGRSMNEMQMEVQRRLHEQLEVQRHLQMRIEAQGKYMQSILEKAYQTIAAGDVAACPAAGYKSLLGNHHQAMLDVCSLKDMGPSMGFPSLQDLHMYGGGGHLDLQQQMERPMEAFFASCDIGSLAKKRPISPYADGKSPMMWCDDEDGKGIVDQLQMAPSMMDAAGIDVMDSIADVYGDAKPMMSGDSTGSKGGFDVKLERPSPRRPHMGGSPSVIGGGQQTRNLSYG

SEQ ID NO: 17278 - DNA, 1050 bp, Sorghum bicolor
  misc_feature: Ceres ANNOT ID no. 8671717
  misc_feature: Encodes the peptide sequence at SEQ ID NO 17279
atggatagccacgccgccgggtcgagctccggcggatccggggatggcgccgcgcaggctaggaggaactccaggaagcccaagtattccaagtttacacagcaggagcttccagcttgcaagccgattcttactccaaaatgggttatttcagtatttgttcttgttggtgtgatttttgtcccaattggtattgtttcgctgcgatcttcacgacaagttgtcgagatcgttgatcggtatgatgatgcatgtgtccctgctggtgtgactgacaagcttgcctacatccggaatgagagtataccaaaagcctgcacaaggaatctgacgattacaaaggatatgaaacagccgattttcgtgtattatcagctggatgacttttaccagaatcacaggaggtatgtcaagagccgtaatgatgtacagctaagagataaaagtaaggcgagtgagactagcaattgtgatcctgaggccaaaaccgtagatggaaagccaattgtgccttgtggtcttattgcatggagcctgttcaatgatacatataacctcatccacaataatgtaaccttgagagtggataagaatgacatctcatggaagagtgacagagaccacaaattcgggagtgatgtcttcccaacaaactttcaggaaggacctcttaaaggtggaaaaacacttgattcaagtatcccgttgagtaagcaagaggaccttattgtttggatgcgaactgcagcacttccaacattcagaaagctgtatggtaggatatatgttgatctcaaggaaaacgatacaattacagttcaattggagaacaactacaacacctatagctttagtggcaagaagaagttggtgctttctactgcaacctggattggtggaaagaatgattttctgggccttgcatatctcactgttggtggaatctgctttttcttggcatttgcattcaccttgctatacttgataaaaccaaggaaaatgggagataacagctacttgtcatggaacagagccactttaggtcgctga

SEQ ID NO: 17279 - protein, 349 aa, Sorghum bicolor
  misc_feature: Useful for making plants with modulated nitrogen use efficiency
  misc_feature: Functional homolog of the protein sequence given in SEQ ID NO 13263
  misc_feature: Ceres ANNOT ID no. 8671717
  misc_feature (67)..(338): Pfam ID: CDC50 Pfam Description: LEM3 (ligand-effect modulator 3) family / CDC50 family
MDSHAAGSSSGGSGDGAAQARRNSRKPKYSKFTQQELPACKPILTPKWVISVFVLVGVIFVPIGIVSLRSSRQVVEIVDRYDDACVPAGVTDKLAYIRNESIPKACTRNLTITKDMKQPIFVYYQLDDFYQNHRRYVKSRNDVQLRDKSKASETSNCDPEAKTVDGKPIVPCGLIAWSLFNDTYNLIHNNVTLRVDKNDISWKSDRDHKFGSDVFPTNFQEGPLKGGKTLDSSIPLSKQEDLIVWMRTAALPTFRKLYGRIYVDLKENDTITVQLENNYNTYSFSGKKKLVLSTATWIGGKNDFLGLAYLTVGGICFFLAFAFTLLYLIKPRKMGDNSYLSWNRATLGR

SEQ ID NO: 17280 - DNA, 1014 bp, Sorghum bicolor
  misc_feature: Ceres ANNOT ID no. 8671724
  misc_feature: Encodes the peptide sequence at SEQ ID NO 17281
atggagtggacggccccgaagcccgcctcctcgccctcctcgcctccccttctctgggactggggagaccacgccgccacgggctcgggctcctcctccggcgacgccccggcgcggcgcggtgctgggaaggagcgggaggcgaagcgtgccaggggcgaggacggcggcgggggagctgaggtgaggtgtcaggtcgaggggtgcggattggacctcaccagggtcaaggactaccaccggaagcaccgcgtctgcgaggcccacaccaagtccccccgcgtcatcgtcgccggccaggagcgccgcttctgccagcagtgcagccgattccatgccctgtcagagtttgatcagaagaagaggagctgcaggaggcgtctgtctgatcataatgcccgccgccggaagcctcagccagatgcattcacctttgcctctgcaaggctgccttcgtcattgtttgatgataggaggcaaataagttttgtctggaataaagctcctgttagtcatgtaaggcctttcacttctccatgggacagttcatctgacttaaagctccctcatgcaaaggaaacaagagaggtatcaacaaaagttgggacaattacgggacaagttcatttggataaatctcacatgtccaatgctattccaacacttagtcatggcaaagatgagccttggccaatgaaaggtccggacatgtctataactgcttcaaaatttgatggagcaccggatcttcagcgtgctctctctcttctgtcagttggcgcttgtggattgcctgatcctgtacatcaaacatcctgcgttatccaattcactggtgccagcgagaacagtggtgaccttcatttatcacatggggggaactctggtccagcttcatgcgctgatggacagcatatagctgctcagtctcagtctcagctggttcgttttaccatggataccagcaacaatgtctatgagcccagtttcttcggtgtaaaccagataaattaa

SEQ ID NO: 17281 - protein, 337 aa, Sorghum bicolor
  misc_feature: Useful for making plants with altered terpenoid content
  misc_feature: Useful for making plants with modulated flowering time
  misc_feature: Functional homolog of the protein sequence given in SEQ ID NO 13706
  misc_feature: Ceres ANNOT ID no. 8671724
  misc_feature (63)..(141): Pfam ID: SBP Pfam Description: SBP domain
MEWTAPKPASSPSSPPLLWDWGDHAATGSGSSSGDAPARRGAGKEREAKRARGEDGGGGAEVRCQVEGCGLDLTRVKDYHRKHRVCEAHTKSPRVIVAGQERRFCQQCSRFHALSEFDQKKRSCRRRLSDHNARRRKPQPDAFTFASARLPSSLFDDRRQISFVWNKAPVSHVRPFTSPWDSSSDLKLPHAKETREVSTKVGTITGQVHLDKSHMSNAIPTLSHGKDEPWPMKGPDMSITASKFDGAPDLQRALSLLSVGACGLPDPVHQTSCVIQFTGASENSGDLHLSHGGNSGPASCADGQHIAAQSQSQLVRFTMDTSNNVYEPSFFGVNQIN

SEQ ID NO: 17282 - DNA, 1356 bp, Sorghum bicolor
  misc_feature: Ceres ANNOT ID no. 8671767
  misc_feature: Encodes the peptide sequence at SEQ ID NO 17283
atgatgaacaccaacgcgatgtcgccaacaagtacgaccgacgtcgacttctccttcggccccatgcagtcctacgtcggcttcgacgccggcggcatggccatgccaggcgtcatcgagaggccactgctccagaaccaccaccacaacaacaaccacaacctaggagtatacgacagcttcgacttcgcggcggccgcggggttaccgttccaagaatctggtctcctgccgcccacaagcagcatgccgctgatggcgccgccgacgacaagcatggccgccatggcagcaatgccgccgtcgctgctgctgacgctcccgggcgtgccgacggcggcggatgtcgtctaccccttcggcggcggcggcgcgggaggagggttcctgaagcgggaggacggctgcggcggcgggcccctcgtggacgctggcggcagcggcgggaggatcggcctgaacctcggacgccgcacctacttctcccccgcggacgtgctcgccgtcgaccggctgctgacgcggtcgcggctcggcggcggcgtgggcgtgggcatgggcatgggactcggcatgggcgtgctggggctcgggctcggcgccgcccaccaccaccaccagccgccgaagtgccaggccgagggctgcaaggccgacctctccgccgccaagcactaccaccgccgccacaaggtctgcgagtaccacgccaaggccggctccgtcgccgccgccggcaagcagcagcgcttctgccagcaatgcagcaggtttcacgtgcttgctgagtttgacgaggccaagaggagttgccggaagcggctcaccgagcacaaccgccgtcgccggaagcccatcagcgcacagggcaaagactcgtctccgccaccaccaccaccaaagaaagcggatacttgcataacaacttcctacagtaatgatctcaagacaggtgcgagcaacacggcagcagccaagtcgacggccatctcgccgaacggcagcggcgtcagctgcctcgacgtcatggacaacggccagacgagcagcgcggcggcggcagtggtggcgccgacggccctgtctcttgccgcgacgccgccgccgctgcacgagaaggacggcagcctggactccatgctgctgatgcagcgtctccaaggccggcgggacaacgacgacgatgaagagcatcgccacttcatcacctcgcttgtgatgcagacccagcagcagcagcagcagcacagcggcggcggcgccggcgccggcaacatcttgtcgtgctcgtcggtgtcagatcagcagcagaacggcggcggctgcaacggtttctttgaggtggacttcatctag

SEQ ID NO: 17283 - protein, 451 aa, Sorghum bicolor
  misc_feature: Useful for making plants with altered terpenoid content
  misc_feature: Useful for making plants with modulated flowering time
  misc_feature: Functional homolog of the protein sequence given in SEQ ID NO 13706
  misc_feature: Ceres ANNOT ID no. 8671767
  misc_feature (210)..(288): Pfam ID: SBP Pfam Description: SBP domain
MMNTNAMSPTSTTDVDFSFGPMQSYVGFDAGGMAMPGVIERPLLQNHHHNNNHNLGVYDSFDFAAAAGLPFQESGLLPPTSSMPLMAPPTTSMAAMAAMPPSLLLTLPGVPTAADVVYPFGGGGAGGGFLKREDGCGGGPLVDAGGSGGRIGLNLGRRTYFSPADVLAVDRLLTRSRLGGGVGVGMGMGLGMGVLGLGLGAAHHHHQPPKCQAEGCKADLSAAKHYHRRHKVCEYHAKAGSVAAAGKQQRFCQQCSRFHVLAEFDEAKRSCRKRLTEHNRRRRKPISAQGKDSSPPPPPPKKADTCITTSYSNDLKTGASNTAAAKSTAISPNGSGVSCLDVMDNGQTSSAAAAVVAPTALSLAATPPPLHEKDGSLDSMLLMQRLQGRRDNDDDEEHRHFITSLVMQTQQQQQQHSGGGAGAGNILSCSSVSDQQQNGGGCNGFFEVDFI

SEQ ID NO: 17284 - DNA, 2247 bp, Sorghum bicolor
  misc_feature: Ceres ANNOT ID no. 8671795
  misc_feature: Encodes the peptide sequence at SEQ ID NO 17285
atggctgctcccctctcttcctggccatggacaagcctcggcgattacaagtacgcgctgctggggcctctggcgtggaaggtggtgcaagaatggcgggagcagggccaaggggcgctgccgctggtgctgggctcgtggtggctgcacctcctcttgctgttcgtggtgcgggggctcacctaccagttctggttcacctacggcaacatgctcttcttcacccgccgccgccgagtcgtcgccgacggcgtcgacttccggcagatcgacgccgagtgggactgggacaactttctcgtgctgcaaacgctgattggggccacggtggtcaacagcccactgctcccgggcctgcggcagctctgcctgtgggacgcccgtgggtgggccgtcgccctgctgctgcatgtgggcttctcagagccggtcttctacctggcccaccgggccctccaccgggacccgctcttcgcccggcaccacgccgcgcaccactcctcgggagtcacccagtcgttgacagccgggttcgggacgccgctggaggccctgctgctgacgctggtgatgggggtcccactggcaggggccttcttggtcggggccgggtccataggcctggtctacgtgcacgccctcgccttcgactacctgcgcgccatggggtacagcaacgtcgaggtcgtgtcgcccagggtgtttgaagcgttcccgctgctcagatacatcctctacacaccttcgtacctgagcctgcaccaccgcgagcgtcgcggcaacttctgcctgttcatgccggcgctggactggctgggcgggacgctggactcgcgcgcgtggccgctgcagcgcgccgcctacgacggcgcggcgggcggcggcgcgctgggcacgccggggttcgtgttcctggcgcacgtggtggacatcatgtcgtcgatgcacgtgccgttcacgctccggtcgctgggcgccaccccgttcgccaaccacttctacctgctcccgttctggccgctggccttcttcttcatgctcctcatgtggtgctgctccaagaccttcgtcgtcagcttctactgcctccgcggccagctccaccagacctggtccgtgcctcgctacggcttccagtacttcctgccggcggcgaagaagggcatcaacaagcagatcgagctggccatccttcgggccgacaggatgggcgtcaaggtgctcagcctcgccgcgctaaacaagaacgaggcgttgaacggaggcggcaccctgttcgtgaacaagcacccggacctgcgtgtgagggtggtgcacggcaacacgctgacggcggccgtgatcctgaacgagatccccagcaacgtcaaggaggtgttcatgaccggcgccacctccaagctcggcagggccatcgcactctacctctgcaggaagaagatcagagtcctgatgttcacgatgtcgtcggagaggttcgtgaagatccagagggaggcgccgccggagttccagcagtacctcgtgcaggtgaccaaataccaggccgcacagaactgcaagacgtggatcgtgggcaagtggctgtcgccgcgcgagcagcggtgggcgccgtcggggacgcacttccaccagttcgtggtgccgcccatcatcggcttccggcgagactgcacctacggcaagctcgccgccatgaggctccccaaggacgtgcagggcctgggctcctgcgagtacacgatggagcgcggggtggtgcacgcgtgccacgccggcggcgtcgtgcacttcctcgaaggatgggaccaccacgaggtgggcgccatcgacgtcgaccggatcgacgtcgtctggaacgccgcgctcaagcacggcctcgcgccgctggtcaaggatttatctgggctcaaaactaggtgtttggttgattggctaagcccccaaaccctagctccatttccctctctctccacccacggcggcgcagagcgaggaagacggtggcgccgctgggttcccctcgccggggcacgcgtgcgcgcggctgtggctgtgcacgcggctccgtcgagcggcactcggcggtgccctttgcgaggcgaggcgggcggggcattgggcagatcctatatgagtgaggaggacccgcgccgagtctgtgcggctgatggtaggcctccgccgcccttaccttccaatctggggttacagatacatatttgtggattttgtgcgggtatatag

SEQ ID NO: 17285 - protein, 748 aa, Sorghum bicolor
  misc_feature: Useful for making plants with modulated nitrogen use efficiency
  misc_feature: Functional homolog of the protein sequence given in SEQ ID NO 13049
  misc_feature: Ceres ANNOT ID no. 8671795
  misc_feature (134)..(256): Pfam ID: FA_hydroxylase Pfam Description: Fatty acid hydroxylase
MAAPLSSWPWTSLGDYKYALLGPLAWKVVQEWREQGQGALPLVLGSWWLHLLLLFVVRGLTYQFWFTYGNMLFFTRRRRVVADGVDFRQIDAEWDWDNFLVLQTLIGATVVNSPLLPGLRQLCLWDARGWAVALLLHVGFSEPVFYLAHRALHRDPLFARHHAAHHSSGVTQSLTAGFGTPLEALLLTLVMGVPLAGAFLVGAGSIGLVYVHALAFDYLRAMGYSNVEVVSPRVFEAFPLLRYILYTPSYLSLHHRERRGNFCLFMPALDWLGGTLDSRAWPLQRAAYDGAAGGGALGTPGFVFLAHVVDIMSSMHVPFTLRSLGATPFANHFYLLPFWPLAFFFMLLMWCCSKTFVVSFYCLRGQLHQTWSVPRYGFQYFLPAAKKGINKQIELAILRADRMGVKVLSLAALNKNEALNGGGTLFVNKHPDLRVRVVHGNTLTAAVILNEIPSNVKEVFMTGATSKLGRAIALYLCRKKIRVLMFTMSSERFVKIQREAPPEFQQYLVQVTKYQAAQNCKTWIVGKWLSPREQRWAPSGTHFHQFVVPPIIGFRRDCTYGKLAAMRLPKDVQGLGSCEYTMERGVVHACHAGGVVHFLEGWDHHEVGAIDVDRIDVVWNAALKHGLAPLVKDLSGLKTRCLVDWLSPQTLAPFPSLSTHGGAERGRRWRRWVPLAGARVRAAVAVHAAPSSGTRRCPLRGEAGGALGRSYMSEEDPRRVCAADGRPPPPLPSNLGLQIHICGFCAGI

SEQ ID NO: 17286 - DNA, 1335 bp, Sorghum bicolor
  misc_feature: Ceres ANNOT ID no. 8671843
  misc_feature: Encodes the peptide sequence at SEQ ID NO 17287
atgtcgttccactaccccgaccacgggctgtccatggacgctgccgcggcagcggcagcggctgcggcggccgcggcagccgcgtcgtcgccgaaccctagcggcttctcctcccccggcgtcgtcggcggggagagggagaaggcggccatcgcggcgcacccgctgtacgagcgcctcctggaggcgcacgtcgcctgcctccgcgtcgccacccccgtcgaccagctcccccgcatcgacgcgcagatcgccgcgcggcccccgccgctcgccgccgccgctggggccgcggccgcgggagggccgtccggcggcgaggagctcgacctcttcatgacacactatgtgttgctcctttgctcattcaaggaacaactccagcagcatgtacgtgttcatgcaatggaagcagtgatgggttgctgggagcttgaacaatctttgcaaagcctaacaggggcatctcctggtgaaggcactggggcaaccatgtccgatgatgaagataaccaggtggatagcgaagccaacatgtttgatggaaatgatggatcagatggtatgggctttggccccctaatactgacagagggtgaacgatccttagttgagcgtgtacggcaggagctgaagaatgagcttaagcagggttataaagaaaagcttgttgatatcagggaagagattatgcgcaagcgcagagctggtaaacttcctggagatactgcatctgtactgaaagcttggtggcaagctcattccaagtggccatacccaactgaggacgacaaggctcgactggtgcaggaaacgggattgcagctgaagcagatcaacaactggttcattaaccaacgcaaacggaactggcacagcaacccgacatcctcgggtgaaaagactaagaagaaaagatcagatgtgggagcatattttgctcggatatgccctgaggctcctttgcagtggcacccagaagatcaagcatggagacgcatgttttgtggtagtactttcgctggacacaggttgaggttgtccttaaggattactgtctttgaagtcgtcgaaatggcagtgagtgaagctcgtgagcgcaaagaaaacagccgaactgccgaagctggagtgctggaccaggtccgagcaggtggagtccaaaccacgcggcctcttactgggatgaagatcaccaattcaccaagcaagccaaaccatggatcgtattctatcccttccccgttcgtcgttttcggtgaaaaagacgcggccggagcgcagatttcttggtccccgtcccctgccgtctccgtcgcgtcgatatcatcatag

SEQ ID NO: 17287 - protein, 444 aa, Sorghum bicolor
  misc_feature: The sequence is a functional homolog of SEQ ID NO 710 in the 10/374,780 US patent application
  misc_feature: Useful for making plants with altered lignin content
  misc_feature: Useful for making plants with altered sterol content
  misc_feature: Useful for making plants with altered terpenoid content
  misc_feature: Useful for making plants with modulated flowering time
  misc_feature: Functional homolog of the protein sequence given in SEQ ID NO 13436
  misc_feature: The sequence is a functional homolog of SEQ ID NO 490 in the 11/435,388 US patent application
  misc_feature: The sequence is a functional homolog of SEQ ID NO 76 in the 10/374,780 US patent application
  misc_feature: The sequence is a functional homolog of SEQ ID NO 882 in the 10/225,066 US patent application
  misc_feature: The sequence is a functional homolog of SEQ ID NO 711 in the 10/374,780 US patent application
  misc_feature: The sequence is a functional homolog of SEQ ID NO 713 in the 10/374,780 US patent application
  misc_feature: The sequence is a functional homolog of SEQ ID NO 712 in the 10/374,780 US patent application
  misc_feature: The sequence is a functional homolog of SEQ ID NO 1996 in the 10/374,780 US patent application
  misc_feature: The sequence is a functional homolog of SEQ ID NO 594 in the 11/479,226 US patent application
  misc_feature: The sequence is a functional homolog of SEQ ID NO 604 in the 11/435,388 US patent application
  misc_feature: The sequence is a functional homolog of SEQ ID NO 902 in the 10/225,066 US patent application
  misc_feature: Useful for making plants with altered carbohydrate content
  misc_feature: Functional homolog of the protein sequence given in SEQ ID NO 13967
  misc_feature: The sequence is a functional homolog of SEQ ID NO 708 in the 10/374,780 US patent application
  misc_feature: The sequence is a functional homolog of SEQ ID NO 709 in the 10/374,780 US patent application
  misc_feature: Ceres ANNOT ID no. 8671843
  misc_feature (99)..(154): Pfam ID: KNOX2 Pfam Description: KNOX2 domain
  misc_feature (45)..(89): Pfam ID: KNOX1 Pfam Description: KNOX1 domain
  misc_feature (210)..(231): Pfam ID: ELK Pfam Description: ELK domain
MSFHYPDHGLSMDAAAAAAAAAAAAAAASSPNPSGFSSPGVVGGEREKAAIAAHPLYERLLEAHVACLRVATPVDQLPRIDAQIAARPPPLAAAAGAAAAGGPSGGEELDLFMTHYVLLLCSFKEQLQQHVRVHAMEAVMGCWELEQSLQSLTGASPGEGTGATMSDDEDNQVDSEANMFDGNDGSDGMGFGPLILTEGERSLVERVRQELKNELKQGYKEKLVDIREEIMRKRRAGKLPGDTASVLKAWWQAHSKWPYPTEDDKARLVQETGLQLKQINNWFINQRKRNWHSNPTSSGEKTKKKRSDVGAYFARICPEAPLQWHPEDQAWRRMFCGSTFAGHRLRLSLRITVFEVVEMAVSEARERKENSRTAEAGVLDQVRAGGVQTTRPLTGMKITNSPSKPNHGSYSIPSPFVVFGEKDAAGAQISWSPSPAVSVASISS

SEQ ID NO: 17288 - DNA, 2895 bp, Sorghum bicolor
  misc_feature: Ceres ANNOT ID no. 8671858
  misc_feature: Encodes the peptide sequence at SEQ ID NO 17289
atggcgggcaatgacaactggatcaacagctacctcgacgccatcctagacgccggaaaggctgccatcggcggcgaccggccctccctcctcctgcgcgagcgcggccatttctcccccgcgcgctacttcgtcgaggaggtcatcaccggctacgacgagaccgacctctacaagacatggctacgcgcgaacgccatgcggagcccgcaggagaggaacacgcggctcgagaacatgacgtggaggatctggaaccttgcaaggaagaagaaggagttcgagaaagaagaagcttgtcgtttgtcaaaacgccagccagaaactgagaaaacacgagctgatgctactgcagatatgtctgaagatctctttgaaggtgaaaagggagaagatgctggtgatccatctgttgcatatggggacagcaccacagggagctcacctaagacaagttcaattgacaagctatacatagtattgatcagtctacatggtctggtccgtggtgagaatatggagcttggccgagattcagatacgggtggccaggtcaaatatgtggttgaacttgctaaagcactaagttcatctcctggagtttaccgggttgatctgctaacaagacaaatattagcaccaaattttgatcgtagttatggtgaacctgcagaattattggtttcaacaagtggtaaaaattctaaacaagaaaaaggagaaaatagtggtgcgtatataattcggctaccgtttggtccaaaagataagtatctagctaaagaacatctatggcctttcattcaagaatttgttgatggtgcactcagccatattgtgaggatgtcaaaagccataggtgaagaaactggccgcgtgcatccagtatggcctgctgtgattcatgggcattatgccagtgcaggaattgcagctgcgttactttctggagcacttaaccttcctatggcattcacaggacattttcttgggaaagataaattggaagggcttctcaaacaagggagacaaactagagaacagataaatatgacatacaaaataatgtgccgaattgaggcagaggagctatctcttgacgcatctgagattgtcattgcaagcactaggcaagaaatagaagagcagtggaacttgtatgatggttttgaggttatacttgcaaggaagctccgagcaagagttaaacgtggtgctaattgttatggccgttttatgcctcgtatggttataattcctcctggagttgaatttggtcacattattcacgattttgatatggatggtgaagaagagaatccatccccagcatctgaggatccacctatttggtctcagataatgcgcttctttacaaatcctaggaagcctatgattctagctgttgctcgcccttatcccgagaagaatattactacgcttgtaaaagcatttggtgaatgtcggccactaagggagcttgcaaaccttacattgataatgggtaaccgtgaagctatatctaagatgcacaatatgagtgctgctgtcttgacatcagtgcttacattgattgatgaatatgacttgtatggtcaagtggcataccccaagcatcataagcactcggaagttcctgacatttatcgtttagctgcaagaacaaagggggcttttgtaaatgtagcttacttcgaacaatttggagttactctgatagaggctgctatgaatggtttgcctataattgcgacaaaaaatggagcccctgttgaaattaatcaggtcctgaataatggtctccttgttgatccgcacgatcagaatgccattgcggatgcactatataaacttctttctgacaaacaactttggtcaaggtgcagagagaatggactgacaaatattcaccgattctcgtggcctgaacattgcaagaattacctgtcaaggatattaactcttggcccaaggtctcctgctattggtaacagagaggagcggagtaatacacctatttcaggaaggaggcaaatcattgttatctctgtagactctgttaacaaggaagatctagtcaggataatcagaaatgctattgaggtcatacatacacaaaacatgtcaagttcaactggttttgtgctgtcaacttcgctgacaatatcagagataaattcactgctactatctggtggcatgcttcccactgattttgatgctttcatctgcaatagtgggagtaacatttactatccttcatattccggtgaaacaccaaacaactccaagattacatttgcattagatcaaaatcaccagtcacatatcgagtatcgttggggaggagaaggactaaggaaatatcttgtgaagtgggccacttcagtggtagaaagaaagggaagaacagagaggcaaattatttttgaagatccagaacactcttcagcctattgtcttgcatttagagtggttaatcccaatcatcttcctcctttaaaggaattgaggaagttgatgagaatccaatctctccgttgcaatgcattgtataaccacagcgctaccagattatctgtagtccctatccacgcatcaagatctcaggctctaaggtacttgtgtatacgttgggggatagaggtgccaaatgttgcagtccttgtgggtgaaagcggcgattcagattacgaggaactgctggggggtctccataggaccattatcctgaagggcgagttcaacatccccgcaaacaggatccacacggtgaggagataccctttgcaggatgttgtcgccctcgacagctcaaacatcatcggtgtcgagggctacaccacggatgacctgaagtctgccctgcagcagatgggtatactcacacaataa

SEQ ID NO: 17289 - protein, 964 aa, Sorghum bicolor
  misc_feature: Useful for making plants with altered cell wall content and/or composition
  misc_feature: Useful for making plants with modulated biomass
  misc_feature: Useful for making plants with modulated carbohydrate content
  misc_feature: Functional homolog of the protein sequence given in SEQ ID NO 13827
  misc_feature: Useful for making plants with altered carbohydrate content
  misc_feature: Functional homolog of the protein sequence given in SEQ ID NO 13828
  misc_feature: Ceres ANNOT ID no. 8671858
  misc_feature (1)..(685): SWISSPROT Homolog: EC 2.4.1.14 Sucrose-phosphate synthase
  misc_feature (452)..(635): Pfam ID: Glycos_transf_1 Pfam Description: Glycosyl transferases group 1
  misc_feature (676)..(917): Pfam ID: S6PP Pfam Description: Sucrose-6F-phosphate phosphohydrolase
MAGNDNWINSYLDAILDAGKAAIGGDRPSLLLRERGHFSPARYFVEEVITGYDETDLYKTWLRANAMRSPQERNTRLENMTWRIWNLARKKKEFEKEEACRLSKRQPETEKTRADATADMSEDLFEGEKGEDAGDPSVAYGDSTTGSSPKTSSIDKLYIVLISLHGLVRGENMELGRDSDTGGQVKYVVELAKALSSSPGVYRVDLLTRQILAPNFDRSYGEPAELLVSTSGKNSKQEKGENSGAYIIRLPFGPKDKYLAKEHLWPFIQEFVDGALSHIVRMSKAIGEETGRVHPVWPAVIHGHYASAGIAAALLSGALNLPMAFTGHFLGKDKLEGLLKQGRQTREQINMTYKIMCRIEAEELSLDASEIVIASTRQEIEEQWNLYDGFEVILARKLRARVKRGANCYGRFMPRMVIIPPGVEFGHIIHDFDMDGEEENPSPASEDPPIWSQIMRFFTNPRKPMILAVARPYPEKNITTLVKAFGECRPLRELANLTLIMGNREAISKMHNMSAAVLTSVLTLIDEYDLYGQVAYPKHHKHSEVPDIYRLAARTKGAFVNVAYFEQFGVTLIEAAMNGLPIIATKNGAPVEINQVLNNGLLVDPHDQNAIADALYKLLSDKQLWSRCRENGLTNIHRFSWPEHCKNYLSRILTLGPRSPAIGNREERSNTPISGRRQIIVISVDSVNKEDLVRIIRNAIEVIHTQNMSSSTGFVLSTSLTISEINSLLLSGGMLPTDFDAFICNSGSNIYYPSYSGETPNNSKITFALDQNHQSHIEYRWGGEGLRKYLVKWATSVVERKGRTERQIIFEDPEHSSAYCLAFRVVNPNHLPPLKELRKLMRIQSLRCNALYNHSATRLSVVPIHASRSQALRYLCIRWGIEVPNVAVLVGESGDSDYEELLGGLHRTIILKGEFNIPANRIHTVRRYPLQDVVALDSSNIIGVEGYTTDDLKSALQQMGILTQ

SEQ ID NO: 17290 - DNA, 1095 bp, Sorghum bicolor
  misc_feature: Ceres ANNOT ID no. 8671821
  misc_feature: Encodes the peptide sequence at SEQ ID NO 17291
atggatccatggatcagcagccaaccttctctgagccttgacctgcacgtcggcctgccgccgctcagcctccaccaggcgccggtggccgccgtcgccttggcccggcccaaggtcctcgtcgaggagaacttcctgcctccaaagaaagaaccagaggtcgcggctctggagacggagctacaccggatgagcgaggagaaccggcggctgacggaggcgctggcggcggtggcgtccaagtacgaggcgctgcggagccagtacacggagatggtggccgccgccgccgcgggcacgaacaacaacccgtcgtcgacgtcggagggtgggtccgtgtcgccgtcgcggaagcgcaagagcgagagcatggacaccgcgccggcgccgcctgccgccgcgcagcagcagcagcagcacggcacgcacctgcaccagcagcagcacccgggcctcgccgcaccggaccagaacgagtgcacctccggcgagccgtgcaagcgcatccgggaggagtgcaagcccaaggtgtcgaagctgtacgtgcacgccgaccccgccgacctcagcctggtggtcaaggacggctaccagtggcgcaagtacgggcagaaggtgaccaaggacaacccgtgcccgagggcatacttccgctgctccttcgccccggcatgccccgtcaagaagaaggtgcagcggagcgccgacgacacctccatcctcgtcgccacgtacgagggcgagcacaaccacggccagcccccaccggcggcgccgtcgcaggctgcccacgacggctcggcggccccgggcgccaccaagaacgccgctgccgtcgcgaagccgccgtcgccgccgaggccggccgcaccggcgcccgcaccggcgccgcaccgcccgcagctgcagctgctgcagcaagagggtgtcgcgatgaacgttgagcagcccgtggccgcggcggcgtcggagatgatccggcgcaacctcgcggagcagatggcgatgacgctgacaagggaccccagcttcaaggcggcgctcgtcaccgcgctgtccggccggatcctcgagctgtcgcctaccaaggattga

SEQ ID NO: 17291 - protein, 364 aa, Sorghum bicolor
  misc_feature: The sequence is a functional homolog of SEQ ID NO 1200 in the 10/374,780 US patent application
  misc_feature: The sequence is a functional homolog of SEQ ID NO 1395 in the 10/412,699 US patent application
  misc_feature: The sequence is a functional homolog of SEQ ID NO 114 in the 11/375,241 US patent application
  misc_feature: The sequence is a functional homolog of SEQ ID NO 146 in the 10/286,264 US patent application
  misc_feature: The sequence is a functional homolog of SEQ ID NO 2500 in the 10/374,780 US patent application
  misc_feature: The sequence is a functional homolog of SEQ ID NO 672 in the 10/412,699 US patent application
  misc_feature: Ceres ANNOT ID no. 8671821
  misc_feature (193)..(253): Pfam ID: WRKY Pfam Description: WRKY DNA -binding domain
MDPWISSQPSLSLDLHVGLPPLSLHQAPVAAVALARPKVLVEENFLPPKKEPEVAALETELHRMSEENRRLTEALAAVASKYEALRSQYTEMVAAAAAGTNNNPSSTSEGGSVSPSRKRKSESMDTAPAPPAAAQQQQQHGTHLHQQQHPGLAAPDQNECTSGEPCKRIREECKPKVSKLYVHADPADLSLVVKDGYQWRKYGQKVTKDNPCPRAYFRCSFAPACPVKKKVQRSADDTSILVATYEGEHNHGQPPPAAPSQAAHDGSAAPGATKNAAAVAKPPSPPRPAAPAPAPAPHRPQLQLLQQEGVAMNVEQPVAAAASEMIRRNLAEQMAMTLTRDPSFKAALVTALSGRILELSPTKD

SEQ ID NO: 17292 - DNA, 1623 bp, Sorghum bicolor
  misc_feature: Ceres ANNOT ID no. 8671853
  misc_feature: Encodes the peptide sequence at SEQ ID NO 17293
atggccgtggccgtggcggcgcgtcgggcgactctactcgtcctgatcttcctcgtctccgcggccggtgcatcagcctcggcgacggcggcggcggcggcgccgggtcccggggcgaactcgacgtcgttcctgctcgcggcggagcagacgcagcggaaggacccgctcgaggggctgaggtactacaccggcgggtggaacatcagcgacgagcactactgggcctccgtcggcttcaccgcggcgccggtgttcgcggcggcgggagtctggttcgtcgtgttcggcattggcctgttcatcgccggctgctgcttctgctgctgtccgggtggcggcgccggcgccggcgacacctactcgcgcgcgtgcctgttcgtctccgtggggtgcgccgtgctgtacgacgggcagggccggttccacggcagcacggcggcgacggtggactacgtggtgcggcagtcgggcgacacggtggccaccctgcggggcttcacgggcttcctggagaccgccaaggccgccggcgtcgggcccatcacgctgcccgacgacgtcaaggggaggatcgacgacgtcgtgcgcaaggtgggcgcggcctccgacgagctcgccgcccgcacgtccagcaacgccgccaagatccgcgccgccctggagacagtaaggaaggttctgatcgttgtttcggcggcgatgctaatccttgcttttcttggactcgtgttctccttgtgtggattggagtcgattgtctacgtgttggtgttcttggggtggatcctggttgcagggacgtttgtactgtgcggtacttttctcctcctgcacaacgtggtgggcgacacgtgcgtggcgatgggcgagtgggtgcagcacccgcaggcgcggacggcgctggacgacatcctgccgtgcgtcgacacggcggcggcgaacgaggcgctggaccggagcaaggaggtgaactaccagctggtggccgtgctcaacgccgcgctcaccaacgtctccaaccgcgacttcccgccgcaggcgccgccgccgatcaactacaaccagtcgggcccggccgtgccgctgctctgcaacccctacacggcggacctccgcgaccgcgcgtgcgcgccgggcgagctgcccctcgacgccgccgccgcgcggcaggcctggcggcgctacgtgtgccgcactgcggcctccgcctccgcggacgacggcgcgtcggcggcggcggcggaggtgtgcgcgaccacggggcgcgtcacgccgtccatgtacgagcagctcgccggcgcggccgacgtcagctacgggctgtaccactacggccccgccctggtggcgctggcggactgcacgttcgtgagggagacgttccggtcgatcggcgaggatcactgcccgggactcagccggtacagcggccaggtgttccggggcctgctcgccgccgccgtcgccgtgatgctggcggtgctgctctgggtcgtgcactcgcgggagcggcggaggaggagcgaggccaaggagatcctcctgctcgcctcgtcgccctacaagtttcctgtggaggagagggcgtttctcaagagcccggcgaggccgtttatgtga

SEQ ID NO: 17293 - protein, 540 aa, Sorghum bicolor
  misc_feature: Useful for making plants with modulated biomass
  misc_feature: Functional homolog of the protein sequence given in SEQ ID NO 13555
  misc_feature: Ceres ANNOT ID no. 8671853
MAVAVAARRATLLVLIFLVSAAGASASATAAAAAPGPGANSTSFLLAAEQTQRKDPLEGLRYYTGGWNISDEHYWASVGFTAAPVFAAAGVWFVVFGIGLFIAGCCFCCCPGGGAGAGDTYSRACLFVSVGCAVLYDGQGRFHGSTAATVDYVVRQSGDTVATLRGFTGFLETAKAAGVGPITLPDDVKGRIDDVVRKVGAASDELAARTSSNAAKIRAALETVRKVLIVVSAAMLILAFLGLVFSLCGLESIVYVLVFLGWILVAGTFVLCGTFLLLHNVVGDTCVAMGEWVQHPQARTALDDILPCVDTAAANEALDRSKEVNYQLVAVLNAALTNVSNRDFPPQAPPPINYNQSGPAVPLLCNPYTADLRDRACAPGELPLDAAAARQAWRRYVCRTAASASADDGASAAAAEVCATTGRVTPSMYEQLAGAADVSYGLYHYGPALVALADCTFVRETFRSIGEDHCPGLSRYSGQVFRGLLAAAVAVMLAVLLWVVHSRERRRRSEAKEILLLASSPYKFPVEERAFLKSPARPFM

SEQ ID NO: 17294 - DNA, 1326 bp, Sorghum bicolor
  misc_feature: Ceres ANNOT ID no. 8671887
  misc_feature: Encodes the peptide sequence at SEQ ID NO 17295
atggctctatctccaactgcctctaaaaaaaagaccccgtttttacaaacaatttttcatgtagtggcactgtttgggtgcctgttaccccttataatacgtcgcatcgtcgccgtggatgaggaagtccttcatattgttaaaccacaacatttcttgcctgttcatggagaactcctatttctcaaagaacatgaattgcttggaagatcaactggcataaggcacacaactattgctactataactgcaggtaataaaaacggagaggtgcttggtgtgtcacatctaagaaacagaagagttttgtccaatggatttgtttcattagggaaggaggatcttcagctcatgtatagtgatggggacaaggcttttggtacatccactgatctctgcattgatgagagactaagaattgcatctgatggcattatttttgtcagcatggagatcttccgacctcagaaggaacatggtttagcgcagtcaggtttgaaaggaaaatttaagattactacaatatgcctatggcttgataatggaagattgttggacgcactctacaaagcagctcatgctgcattgtcaagttgtcctgtcaattgtccacttagtcacatggagaggatggtagctgaaatcttgaggaaaatggtacggaagtatagtgggaagaagcccgacgtcattgcggttgctacggagaacagcatggcaggtttctcagaacacctcgatgctaaatcatctggaaattttggaccttcctcagctactagccatttgagcaggagtccagctacgagtcttgaaggcagctataaaacacacccagacaacccagaggtggatgctgaagtgctttgtcacacagaaacccctcctgaggcagtgagaacaacacctgatgatgcaactacaagctccaatggtgaagcattcttctcttcagatttacatcagcctaaaacattggagcacttttgggagtcattcaaatcccctacagctgttaaaattgcacgaattgtcaatggggggaacaaacaaaatctcagcaaaattggcataatgggtaaggactcatcaatccagtcagctcctgctccagttaagtcttcaaaaaagaacaagtggaaacctgaggaaattaagagcttaatacagatgcgtggcgaaatgaatgagaaatttcagagcgtgaaaggaagaatggttctgtgggaggagatttctgataccatgttgaaccaaggaataagtcgtacgccggcacagtgcaaatctttatggacatcgttagttcagaaatatgagtgttaa

SEQ ID NO: 17295 - protein, 441 aa, Sorghum bicolor
  misc_feature: The sequence is a functional homolog of SEQ ID NO 994 in the 10/374,780 US patent application
  misc_feature: Ceres ANNOT ID no. 8671887
MALSPTASKKKTPFLQTIFHVVALFGCLLPLIIRRIVAVDEEVLHIVKPQHFLPVHGELLFLKEHELLGRSTGIRHTTIATITAGNKNGEVLGVSHLRNRRVLSNGFVSLGKEDLQLMYSDGDKAFGTSTDLCIDERLRIASDGIIFVSMEIFRPQKEHGLAQSGLKGKFKITTICLWLDNGRLLDALYKAAHAALSSCPVNCPLSHMERMVAEILRKMVRKYSGKKPDVIAVATENSMAGFSEHLDAKSSGNFGPSSATSHLSRSPATSLEGSYKTHPDNPEVDAEVLCHTETPPEAVRTTPDDATTSSNGEAFFSSDLHQPKTLEHFWESFKSPTAVKIARIVNGGNKQNLSKIGIMGKDSSIQSAPAPVKSSKKNKWKPEEIKSLIQMRGEMNEKFQSVKGRMVLWEEISDTMLNQGISRTPAQCKSLWTSLVQKYEC

SEQ ID NO: 17296 - DNA, 1494 bp, Sorghum bicolor
  misc_feature: Ceres ANNOT ID no. 8671895
  misc_feature: Encodes the peptide sequence at SEQ ID NO 17297
atgggcgaggaagcagcggccgcgcccaccgtggcagcagcggcagcgacaggaaccggcggcgccccgccgcacctgctcctgatctgcttccctggccaaggccacgtgaacccgatgctccgcctggcgaagcgcatcgcggcgaaaggtctcctggtgaccttctcctcggtctccaccgtcggcgcgaagctggccgcgtcggcgggcgtgtcggccggcggcgacggcgtggccgtgggccgtggccgcgtccggttcgagttcctcgacgacgaggaccccggccctgacctggacgacctcatgcggcacctcgccagggaaggaccgccggcgttcgcgaagctgctggcgcggcaggcggcggagcgcaggcccgtggcgtgcgtggtggtgaacccgttcatgccgtgggcggccgacgtggccgccgacgccgggatcccgtcggcggtgctgtgggtgcagtcgtgcgcggtgttctccctctactaccaccacgtgcacggccttgtcgagttcccgcgcgaggacgaccccgacgcgcggttcacgctgccgggtctccccgagatgtccgtcgccgacgtgccgtcgttcctgctgccgtccaacccgtacaagctgctggtggacgcgatcatcgcgcagttccgcgccatcggacgcgcgtcgtgggtgctcgtcaactccttcacggagctcgagcgcgacgtcgccgcggcgctcccgggggtgactccccgcccgccggagctcatccccgtcggcccgctcatcgagctcgccggcgacggcgacggcgcggtgcgcggcgacctgataaaggccgcggacgactgcgtggagtggctggacgcgcagcccccgcggtccgtggtgtacgcgtcggtgggcagcgtggtgctgctcaacgcggaggaggtcggggagatggcgcacgggctcgccgccacggggcgaccgttcctgtgggtggtccggccggacacccgggagcacctcccggaagggttcctggacgccgtggccgggcggggcacggtggtgccgtggagcccgcaggacagggtgctggcgcacccgtccacggcctgcttcctcacgcactgcggctggaactcgacgctggagaccatcgcggcgggcgtgcccgtcgtggcgttcccgcagtggggcgaccagtgcacggacgccaagttcctggtggaggagctcaggatgggggtccgcctccgcgggtcgccgctgcggcgggacgccgtgcgggaggcggtggaagcggccgtggccggggccgaggcagacgccatgctcgccagcgccaggaggtggagcgccgcggcgagggaggccgtggcgcccggagggtcctcggacaagcacgtccaggcgttcgtggacgaggtggcacggcgagcgtgtggcgtgcaagcggctaaggtcgtgccgccgccgccgccgtcgtcagagactccagactcgtag

SEQ ID NO: 17297 - protein, 497 aa, Sorghum bicolor
  misc_feature: Useful for making plants with altered carbohydrate content
  misc_feature: Functional homolog of the protein sequence given in SEQ ID NO 14401
  misc_feature: Ceres ANNOT ID no. 8671895
  misc_feature: Down-regulated in shoot tissues in response to methyl jasmonate treatment
  misc_feature: Down-regulated in root tissues in response to methyl jasmonate treatment
  misc_feature: Down-regulated in shoot tissues in response to salicylic acid treatment
  misc_feature (104)..(416): SWISSPROT Homolog: EC 2.4.1.210 Limonoid glucosyltransferase
  misc_feature (33)..(476): Pfam ID: UDPGT Pfam Description: UDP-glucoronosyl and UDP-glucosyl transferase
MGEEAAAAPTVAAAAATGTGGAPPHLLLICFPGQGHVNPMLRLAKRIAAKGLLVTFSSVSTVGAKLAASAGVSAGGDGVAVGRGRVRFEFLDDEDPGPDLDDLMRHLAREGPPAFAKLLARQAAERRPVACVVVNPFMPWAADVAADAGIPSAVLWVQSCAVFSLYYHHVHGLVEFPREDDPDARFTLPGLPEMSVADVPSFLLPSNPYKLLVDAIIAQFRAIGRASWVLVNSFTELERDVAAALPGVTPRPPELIPVGPLIELAGDGDGAVRGDLIKAADDCVEWLDAQPPRSVVYASVGSVVLLNAEEVGEMAHGLAATGRPFLWVVRPDTREHLPEGFLDAVAGRGTVVPWSPQDRVLAHPSTACFLTHCGWNSTLETIAAGVPVVAFPQWGDQCTDAKFLVEELRMGVRLRGSPLRRDAVREAVEAAVAGAEADAMLASARRWSAAAREAVAPGGSSDKHVQAFVDEVARRACGVQAAKVVPPPPPSSETPDS

SEQ ID NO: 17298 - DNA, 1098 bp, Sorghum bicolor
  misc_feature: Ceres ANNOT ID no. 8671894
  misc_feature: Down-regulated in shoot tissues in response to methyl jasmonate treatment
  misc_feature: Down-regulated in root tissues in response to methyl jasmonate treatment
  misc_feature: Down-regulated in shoot tissues in response to salicylic acid treatment
  misc_feature: Encodes the peptide sequence at SEQ ID NO 17299
atggggagcctggcgtccgagaggaaggtggtcggctgggccgccagggacgccaccggacacctctccccctacacctacaccctcaggaacacaggccctgaagatgtggtggtgaaggtgctctactgtggaatctgccacacggacatccaccaggccaagaaccacctcggggcttcaaagtaccctatggtccctgggcacgaggtggtcggtgaggtggtggaggtcgggcccgaggtgagcaagtacggcgtcggcgacgtggtaggcgtcggggtgatcgtcgggtgctgccgcgagtgcagcccctgcaaggccaacgttgagcagtactgcaacaagaagatctggtcctacaacgatgtctacactgacggccggcccacgcagggcggcttcgcctccaccatggtcgtcgaccagaagtttgtggtgaagatcccggcgggtctggcgccggagcaagcggcgccgctgctgtgcgcgggcgtaacggtgtacagcccgctaaaggcctttgggctgacggccccgggcctccgcggtggcatcgtgggcctgggcggcgtgggccacatgggcgtgaaggtggcgaaggccatgggccaccacgtgacggtgatcagctcgtcgtccaagaagcgcgcggaggcgatggaccacctgggcgcggacgcgtacctggtgagcacggacgcggcggccatggcggcggccgccgactcgctggactacatcatcgacacggtgcccgtgcaccacccgctggagccctacctgtcgctgctgaggctggacggcaagcacgtgctgctgggcgtcatcggcgagcccctcagcttcgtgtccccgatggtgatgctggggcggaaggccatcacggggagcttcatcggcagcatcgacgagaccgccgaggtgctccagttctgcgtcgacaaggggctcacctcccagatcgaggtggtcaagatggggtacgtgaacgaggcgctggagcggctcgagcgcaacgacgtccgctaccgcttcgtcgtcgacgtcgccggcagcaacgtcgaggaggatgccgctgatgcgccgagcaactga

SEQ ID NO: 17299 - protein, 365 aa, Sorghum bicolor
  misc_feature: Useful for making plants with altered carbohydrate content
  misc_feature: Functional homolog of the protein sequence given in SEQ ID NO 14509
  misc_feature: Useful for making plants with altered lignin content
  misc_feature: Functional homolog of the protein sequence given in SEQ ID NO 14510
  misc_feature: Useful for making plants with altered cell wall content and/or composition
  misc_feature: Functional homolog of the protein sequence given in SEQ ID NO 14511
  misc_feature: Ceres ANNOT ID no. 8671894
  misc_feature: Down-regulated in root tissues in response to methyl jasmonate treatment
  misc_feature: Up-regulated in shoot tissues in response to methyl jasmonate treatment
  misc_feature (1)..(365): SWISSPROT Homolog: EC 1.1.1.195 Cinnamyl-alcohol dehydrogenase
  misc_feature (34)..(149): Pfam ID: ADH_N Pfam Description: Alcohol dehydrogenase GroES-like domain
  misc_feature (180)..(315): Pfam ID: ADH_zinc_N Pfam Description: Zinc-binding dehydrogenase
MGSLASERKVVGWAARDATGHLSPYTYTLRNTGPEDVVVKVLYCGICHTDIHQAKNHLGASKYPMVPGHEVVGEVVEVGPEVSKYGVGDVVGVGVIVGCCRECSPCKANVEQYCNKKIWSYNDVYTDGRPTQGGFASTMVVDQKFVVKIPAGLAPEQAAPLLCAGVTVYSPLKAFGLTAPGLRGGIVGLGGVGHMGVKVAKAMGHHVTVISSSSKKRAEAMDHLGADAYLVSTDAAAMAAAADSLDYIIDTVPVHHPLEPYLSLLRLDGKHVLLGVIGEPLSFVSPMVMLGRKAITGSFIGSIDETAEVLQFCVDKGLTSQIEVVKMGYVNEALERLERNDVRYRFVVDVAGSNVEEDAADAPSN

SEQ ID NO: 17300 - DNA, 831 bp, Sorghum bicolor
  misc_feature: Ceres ANNOT ID no. 8671882
  misc_feature: Down-regulated in root tissues in response to methyl jasmonate treatment
  misc_feature: Up-regulated in shoot tissues in response to methyl jasmonate treatment
  misc_feature: Encodes the peptide sequence at SEQ ID NO 17301
atgtctgcttctcctctgatggcgatgctcctgctcgcctcaacactggcgccgcgcgttcctgtcacgcgggggagcgggagcggcaccagcgccgcccacccggcgtacgccgatgccacggcctacggtctcgccgcggcctctgccttggaggcggggctggaggagtacggcggcgggcgcatcgtggacatcacgcacgcgtaccggccggagctgccgttccccgggcgggacgggctcggcgcggtcacccgcctcacggagtccatggccaacggctccgtcaacaacgtgtcggagctgcgcatggtggtgcactccggcacccatgtcgacgcgccgggccacatggtccaggagcacttcgtggccggcctcggcgtcgacaagctcgacctcgacgtcctcaatggacctgcgttgctcattgatgttccgagggacacaaatataacagctcaagcaatggagtccctaaatatcacgcaaggaattcgccgagttcttttcagaacactaaacactgacaggaagctaatgtggaccaaggaaattgacacgagttttgttgggttcacagaggatggtgcacaatggttagttgacaacactgacatcaagctagttgggattgactatctatcagttgcggcatttgatcacttgatatcagcccatttggtctttttaaatagacgagacataataccaattgaaggtctcaaactagaccatgtaaagactggagtatatatgttgcactgcttacctctcagacttattggatgtgatggctcaccaattaggtgcatccttatcaagtga

SEQ ID NO: 17301 - protein, 276 aa, Sorghum bicolor
  misc_feature: Useful for making plants with modulated salt sensitivity
  misc_feature: Functional homolog of the protein sequence given in SEQ ID NO 13597
  misc_feature: Ceres ANNOT ID no. 8671882
  misc_feature: Up-regulated in shoot tissues in response to salicylic acid treatment
  misc_feature (63)..(262): Pfam ID: Cyclase Pfam Description: Putative cyclase
MSASPLMAMLLLASTLAPRVPVTRGSGSGTSAAHPAYADATAYGLAAASALEAGLEEYGGGRIVDITHAYRPELPFPGRDGLGAVTRLTESMANGSVNNVSELRMVVHSGTHVDAPGHMVQEHFVAGLGVDKLDLDVLNGPALLIDVPRDTNITAQAMESLNITQGIRRVLFRTLNTDRKLMWTKEIDTSFVGFTEDGAQWLVDNTDIKLVGIDYLSVAAFDHLISAHLVFLNRRDIIPIEGLKLDHVKTGVYMLHCLPLRLIGCDGSPIRCILIK

SEQ ID NO: 17302 - DNA, 2913 bp, Sorghum bicolor
  misc_feature: Ceres ANNOT ID no. 8671884
  misc_feature: Up-regulated in shoot tissues in response to salicylic acid treatment
  misc_feature: Encodes the peptide sequence at SEQ ID NO 17303
atggtggcgctcgcctcactctcgtctctctgcccctgcggcatcgcccgccgccgcgctgcctccgcctcctcatccgtcgccgtttccatctcgtgctgcgccgtcgccaccccgtcctcctcagggaaagggccccaggaatctagaacaccccgaagaaggctgaggaaaactgagggtgccaccaagagcttggaagattcggtcaagcgaaagatggagcagttctatgaaggggtcgatggtccacctctgcgagtgctccctattggcggtcttggggaaatcggcatgaattgcatgcttgtggggaattatgaccgatatatcttgattgatgctggggttatgttcccagattatgatgagtttggtgtgcaaaagattatcccagacaccacgttcatcaagaaatggagccacaaaattgaagcagttatcatcacacacggccacgaagatcacatcggtgcgttgccttgggtcattccagcactcgattcaacaacaccgatttttgcatcatctttcaccatggagctaataaagaagcgtttgaaggagtttgggatcttcctctcatccaggcttaaggttttaagaattaaaaagagatttcaagctggaccttttgaagtcgaacccatccgtgtaactcattcaattcctgactgttgtggcttagtgcttcgctgtggtgatggcataattttccatactggtgactggaaaattgatgaatcaccagtggatggaaaaatttttgaccgacaagcattggaggagctctccaaagaaggtgttactcttatgatgagtgactcaacaaatgttctatcccctggaagatcaatcagtgaatctgttgttgctggttcattgttgcgacatatttcggaagcaaaaggaagagtaattacgacacaatttgcctcaaacatacatcgaattgggagcatcaaagctgctgcagatttaactggtcgaaaaatggtgtttgttggaatgtcactcaggacataccttgaagctgctttcaaggatggaaaggcaccaatggatccatcaaccttggtcaaggcagaggacatggatgcgtatgcccctaaagatcttctggttgtcactacgggttcacaaggagagccacgtgcagctctgaatcttgcatcttatgggggaagtcatgctcttaaactatcaaaagaggatgtccttctttattcagctaaggttattcctggaaacgagacgcgggtaatgaagatgatgaatcgtctcactgatcttggcccaaaaattatcatgggtaaagattctggcctgcatacctctgggcatgcctaccgagaggagctggaggaagtccttcggattgttaaaccacaacatttcttgcctgttcatggagaactcctatttctcaaagaacatgaattgcttggaagatcaactggcataaggcacacaactgtaataaaaaatggagagatgcttggtgtgtcacatctaagaagcagaagagttttgtccaatggatttgtttcattagggaaggaggatcttcagctcatgtatagtgatggggacaaggcttttggtacatccactgatctctgcattgatgagagactaagaattgcatctgatggcattatttttgtcagcatggagatcttccgacctcagaaggaacatggtttagcgcaatcaggtttgaaaggaaaatttaagattactacaagatgtctatggcttgataatggaagattgttggacgcactctacaaagcagctcatgctgcattgtcaagctgtcctgtgaattgtccacttagtcacatggagaggatggtagctgaaatcttaaggaaaatggtgcggaagtatagtggaaagaggcctgacgtcattgcggttgctacggagaataccacggcaggtttcccagaacacctcgatgctaaatcatctggaaattttggaccttcctcaactactagccatttgagcaggagtccagctacgagtcttgaaggcagttataaaacacacccagacaacccagaggtggatgctgaagtgctttgtcacacagaaacccctcctaaggcagtgagaacaacacctgatgatgcaaccacaagctccaatggtgaagcattcttctcttcagatttacatcagcctaaaacattggagcacttttgggagtcattcaaatcccctacagctgttaaaattgcacgaattgtcaatggggggaacaaacaaaatctcagcaagattggcataatgggtaaggactcatcaatccagtcagctcctgctccagttaagtcttcaaaaaagaacaagtggaaacctgaggaaatcaagagcttaatacagatgcgtggcgaaatgaatgagaaatttcagagcgtgaaaggaagaatggttctgtgggaggagatttctgataccatgttgaaccaaggaataagtcgtacgccggcacagtgcaaatctctatggacatcgttagttcagaaatatgaggaaagcaagaaggacatggaaagcatgaagacgtggccgtatttctcggccatggataggattctatcgcagcaaggggaaatggcaacaaaaggtccggggcaccaagcacaaactgtttctgttcacaagaaaccgaagttcggtaatgctggtgtcaggacgtccgttgggacgcctctttgctgggcctacgggctgtggatcggcagctcagatcaattagttctagaagatctatccctaatccataacagatcaatcacctactcctgtcgacgacgacgaaggcgggacactgttaaacaggtagtcaatgaagacgatgttatagcaaagatgtctgtcgccagtaaatcagcacaatag

SEQ ID NO: 17303 - protein, 970 aa, Sorghum bicolor
  misc_feature: The sequence is a functional homolog of SEQ ID NO 994 in the 10/374,780 US patent application
  misc_feature: Ceres ANNOT ID no. 8671884
  misc_feature (98)..(303): Pfam ID: Lactamase_B Pfam Description: Metallo-beta-lactamase superfamily
  misc_feature (434)..(474): Pfam ID: RMMBL Pfam Description: RNA-metabolising metallo-beta-lactamase
MVALASLSSLCPCGIARRRAASASSSVAVSISCCAVATPSSSGKGPQESRTPRRRLRKTEGATKSLEDSVKRKMEQFYEGVDGPPLRVLPIGGLGEIGMNCMLVGNYDRYILIDAGVMFPDYDEFGVQKIIPDTTFIKKWSHKIEAVIITHGHEDHIGALPWVIPALDSTTPIFASSFTMELIKKRLKEFGIFLSSRLKVLRIKKRFQAGPFEVEPIRVTHSIPDCCGLVLRCGDGIIFHTGDWKIDESPVDGKIFDRQALEELSKEGVTLMMSDSTNVLSPGRSISESVVAGSLLRHISEAKGRVITTQFASNIHRIGSIKAAADLTGRKMVFVGMSLRTYLEAAFKDGKAPMDPSTLVKAEDMDAYAPKDLLVVTTGSQGEPRAALNLASYGGSHALKLSKEDVLLYSAKVIPGNETRVMKMMNRLTDLGPKIIMGKDSGLHTSGHAYREELEEVLRIVKPQHFLPVHGELLFLKEHELLGRSTGIRHTTVIKNGEMLGVSHLRSRRVLSNGFVSLGKEDLQLMYSDGDKAFGTSTDLCIDERLRIASDGIIFVSMEIFRPQKEHGLAQSGLKGKFKITTRCLWLDNGRLLDALYKAAHAALSSCPVNCPLSHMERMVAEILRKMVRKYSGKRPDVIAVATENTTAGFPEHLDAKSSGNFGPSSTTSHLSRSPATSLEGSYKTHPDNPEVDAEVLCHTETPPKAVRTTPDDATTSSNGEAFFSSDLHQPKTLEHFWESFKSPTAVKIARIVNGGNKQNLSKIGIMGKDSSIQSAPAPVKSSKKNKWKPEEIKSLIQMRGEMNEKFQSVKGRMVLWEEISDTMLNQGISRTPAQCKSLWTSLVQKYEESKKDMESMKTWPYFSAMDRILSQQGEMATKGPGHQAQTVSVHKKPKFGNAGVRTSVGTPLCWAYGLWIGSSDQLVLEDLSLIHNRSITYSCRRRRRRDTVKQVVNEDDVIAKMSVASKSAQ

SEQ ID NO: 17304 - DNA, 1593 bp, Sorghum bicolor
  misc_feature: Ceres ANNOT ID no. 8671971
  misc_feature: Encodes the peptide sequence at SEQ ID NO 17305
atggacgcggcggcggggacggcggcggcgctgccggaggcgtggtcgcaggtgcgcgcgccggtgatcgtgccgctgctgcggctggcggtggccgtctgcctcaccatgtccgtgctgctgttcctggagcggatgtacatggccatcgtcatcaccggcgtgcgcctgctgcggttccgccccgaccgccggtaccgctgcgacccgttgcccgacgacgacccggagctggggtcctccgcgttccccgtcgtgctcgtccagatccccatgttcaacgagcgcgaggtgtaccagctatccatcggcgccgtgtgcgggctgtcgtggccggcggaccggctggtggtgcaggtgctggacgactccacggacgaaatgattaaggaaatggtgcggctggagtgcgagcgttgggctcggaaggggatcaacataacgtaccagatccgtgacgaccgcaagggttacaaggccggcgcgctgagggccgggatgaagcacgcgtacgtgcgggagtgcgagtacgtggtgatcttcgacgccgacttccagccggacccggacttcctcaagcgcaccgtcccttacctcgtccacaacccggagatcgcactcgtccaggcacgatggagattcgtgaacgcggacgagtgcttgatgacgcggatgcaggagatgtccctggactaccacttcaccgtggagcaggaagtgagctcctccgtctgcgccttctttgggttcaacgcatcagctgatcagtttcggcaaccaggcaccgctggcgtgtggcgcatctctgcgataaacgaggccggagggtggaaggaccggaccacggtggaggacatggatcttgccatccgggccagcctcaagggttggaagtttgtctaccttggcgatgttcaggtgaaaagtgagctgccgagtaccttcaaggcttttcggttccagcagcacaggtggtcgtgcggcccggcaaacttgttcaggaaaatgctcatggagattgtgacaaataagaaagtgacgatctggaagaagatccatgtcatctacaactttttcttgatacgcaagatcattgcacatattatcaccttttcgttctactgcctcgtcatcccagcaacgatctttgtccccgaggtccgcataccgaagtggggctgtgtctacattccctcagccattacccttatgaactctgttggcactcccaggtcatttcacttgcttttcttctgggtcgcctttgagaacgtcatgtccctgcacagaacaaaagccacattgatcggcttgttagaggctggcagggcgaatgaatgggttgtgacagcgaagctcggcagcgctatgaagatgaaagcagctaataaagcgggactcaggaaacagttcatgaggatatgggagaggctgcacgttacggagctcggtgtggcagccttcctcttctcctgcggatggtatgattttgcatatgggagggaccattttttcatctacctcttcttccagtccgtagcattcttcattgtcggtatcggctatgtcggcacaatcgtcccgcagtcgtaa

SEQ ID NO: 17305 - protein, 530 aa, Sorghum bicolor
  misc_feature: Useful for making plants with altered cell wall content and/or composition
  misc_feature: Functional homolog of the protein sequence given in SEQ ID NO 14018
  misc_feature: Useful for making plants with altered carbohydrate content
  misc_feature: Functional homolog of the protein sequence given in SEQ ID NO 14512
  misc_feature: Ceres ANNOT ID no. 8671971
  misc_feature (83)..(454): SWISSPROT Homolog: EC 2.4.1.12 Cellulose synthase (UDP-forming)
  misc_feature (87)..(257): Pfam ID: Glycos_transf_2 Pfam Description: Glycosyl transferase family 2
MDAAAGTAAALPEAWSQVRAPVIVPLLRLAVAVCLTMSVLLFLERMYMAIVITGVRLLRFRPDRRYRCDPLPDDDPELGSSAFPVVLVQIPMFNEREVYQLSIGAVCGLSWPADRLVVQVLDDSTDEMIKEMVRLECERWARKGINITYQIRDDRKGYKAGALRAGMKHAYVRECEYVVIFDADFQPDPDFLKRTVPYLVHNPEIALVQARWRFVNADECLMTRMQEMSLDYHFTVEQEVSSSVCAFFGFNASADQFRQPGTAGVWRISAINEAGGWKDRTTVEDMDLAIRASLKGWKFVYLGDVQVKSELPSTFKAFRFQQHRWSCGPANLFRKMLMEIVTNKKVTIWKKIHVIYNFFLIRKIIAHIITFSFYCLVIPATIFVPEVRIPKWGCVYIPSAITLMNSVGTPRSFHLLFFWVAFENVMSLHRTKATLIGLLEAGRANEWVVTAKLGSAMKMKAANKAGLRKQFMRIWERLHVTELGVAAFLFSCGWYDFAYGRDHFFIYLFFQSVAFFIVGIGYVGTIVPQS

SEQ ID NO: 17306 - DNA, 426 bp, Sorghum bicolor
  misc_feature: Ceres ANNOT ID no. 8671999
  misc_feature: Encodes the peptide sequence at SEQ ID NO 17307
atgcaagacccaagggatgatgatttctcagcaccaaagctgcataagaagaaggttgtgtaccggccactgccatcaggccagctcaagggtgaacctgaactgctgcggagagagtttccacagtcatcaggcatggtccaaaagccacccaaaagaagcttgaaggttgagcctcacacgtccccttctgacagagggactccagattccctgacggaatctggtcctactgatgaataccgggcgttacggaggaagtacctgatgctggaggaagagaactttgcactggacaaagaactgagcatggaagaggaagaaatgaaggccctagaggatgaaaagcttgcactgcttgatcagcttgttgtcttggaaggtcttgtggagccatcccagctgcagtctcagcgtaggccgtga

SEQ ID NO: 17307 - protein, 141 aa, Sorghum bicolor
  misc_feature: Useful for making plants with modulated nitrogen use efficiency
  misc_feature: Functional homolog of the protein sequence given in SEQ ID NO 14513
  misc_feature: Ceres ANNOT ID no. 8671999
MQDPRDDDFSAPKLHKKKVVYRPLPSGQLKGEPELLRREFPQSSGMVQKPPKRSLKVEPHTSPSDRGTPDSLTESGPTDEYRALRRKYLMLEEENFALDKELSMEEEEMKALEDEKLALLDQLVVLEGLVEPSQLQSQRRP

SEQ ID NO: 17308 - DNA, 819 bp, Sorghum bicolor
  misc_feature: Ceres ANNOT ID no. 8672090
  misc_feature: Encodes the peptide sequence at SEQ ID NO 17309
atgccggacctcggcggcgcggacacggggctcgccgaggcgctcgtcggcgccgtgctcaacgtgcacgacgcgctcaggatgctccgtctggacgccaagatcgagctctccacgccgcactcggaggccgtcttcgccaactcgtacccgccgtccgcctgcgtcttcaaagacgacctcatggtgtacctccgcccgctgctcgacttcttctccaagaccggcgcgcccttctacgtcaacgcctacccgttcctcgcctacatgagcgacccgtcgcacatcgacatcaactacgcgctcttcaagcccaacgccggcatcgtcgaccccaagaccggcctgcactacgacaacatgttcgacgcgcagctcgacgccgcctacttcgcgctggaggccgcggggtactcgggcatggaggtgcgcgtggccgagaccgggtgggcgtccgccggcgacgccaccgaggccggcgccaacatggagaacgccgtcacctacgaccgcaacctcaggaagcgcctcttcctgcgcaaggggacgccctacaggcccgaccgggtggccaaggcctacatcttcgcgctcttcaacgaggacctcaagccggggcccacctccgagcgacactacggcctcttcaagcccgacggcagcgtctccattaacatcggcctcaaggggctcctgccgtcgtcggcgccgccgcatcctctcctgcccttcaagagagttggagcgtgggggtggattgtacagtactcggctgcgcttcttccatgcacattgttttttctagcattagggacatga

SEQ ID NO: 17309 - protein, 272 aa, Sorghum bicolor
  misc_feature: Useful for making plants with altered carbohydrate content
  misc_feature: Functional homolog of the protein sequence given in SEQ ID NO 14514
  misc_feature: Useful for making plants with altered cell wall content and/or composition
  misc_feature: Functional homolog of the protein sequence given in SEQ ID NO 14515
  misc_feature: Ceres ANNOT ID no. 8672090
  misc_feature (3)..(219): SWISSPROT Homolog: EC 3.2.1.39 Glucan endo-1,3-beta-D-glucosidase
  misc_feature (1)..(228): Pfam ID: Glyco_hydro_17 Pfam Description: Glycosyl hydrolases family 17
MPDLGGADTGLAEALVGAVLNVHDALRMLRLDAKIELSTPHSEAVFANSYPPSACVFKDDLMVYLRPLLDFFSKTGAPFYVNAYPFLAYMSDPSHIDINYALFKPNAGIVDPKTGLHYDNMFDAQLDAAYFALEAAGYSGMEVRVAETGWASAGDATEAGANMENAVTYDRNLRKRLFLRKGTPYRPDRVAKAYIFALFNEDLKPGPTSERHYGLFKPDGSVSINIGLKGLLPSSAPPHPLLPFKRVGAWGWIVQYSAALLPCTLFFLALGT

SEQ ID NO: 17310 - DNA, 1212 bp, Sorghum bicolor
  misc_feature: Ceres ANNOT ID no. 8672117
  misc_feature: Encodes the peptide sequence at SEQ ID NO 17311
atggcgttcggcagacggagccccgggtcctcgcggcaccgtcccgcgctcaccatcgtctcggcgctactcctcgccttcctctcctccgccgccgccgccgcggcggcgtcgtcgtccaccgacgcgatgcacaacaacaactgggccgtgctcgtgtgcacctcccgcttctggtttaattatcgacacatggcaaatacattgtccctttacaggactgttaagagattaggaatacctgatgagcgaatcatacttatgttggcggacgatatggcctgtaaccctaggaacagctatcctgcccaagttttcaataatgagaaccaccagctaaatctctatggtgacaatgttgaggtcgattatcgagggtatgaggtgacagttgaaaatttcttgagagttttgacaggccgacacgaaagtgctgtaccaagatcgaagcgtctccttagtgatgaaggaagtcatatacttttgtacatgactggacatggtggtgatgaatttttgaagttccaagattctgaagagcttcagagccatgacttagcagatgctgtgaagcaaatgaaagagaaacatagatttaaagagctgctgataatggtagatacctgccaagctgctactctcttttcgcagcttcaatcacctggtgttctggcgattggtagtagcatgaagggtgaaaactcttattctcaccatcttgattcagatataggtgtttctgttgtggataggtttacctattatacacttgctttctttgagaaactgaacatgtatagcaatgcctcactgaacagtcttttcacctcatacaatccttccatgctgatgtctactgcgtattatcgaatggatctttatgagcgtcccttaaatgaggtgcctgtgacaaatttctttggatcagtcatgaagactctccacacagattcagcctacacaggtttcttggctgcacatgacaatgaaactcccatggacatcggagataatctagatgatcagttcatgttaaaggatagagctaccgcaagaagatcaaacatagaaaaggaggcacaattaacgccacatggatggactgaagtgctgcttgaacagctggagggaaggaatactgatactgttgtgatatatggtctgggtgctatgggtatattgttggcactttcaacttggttatcaatgtag

SEQ ID NO: 17311 - protein, 403 aa, Sorghum bicolor
  misc_feature: Useful for making plants with altered carbohydrate content
  misc_feature: Functional homolog of the protein sequence given in SEQ ID NO 14516
  misc_feature: Useful for making plants with altered cell wall content and/or composition
  misc_feature: Functional homolog of the protein sequence given in SEQ ID NO 14517
  misc_feature: Ceres ANNOT ID no. 8672117
  misc_feature (48)..(362): SWISSPROT Homolog: EC 3.4.22.34 Legumain
  misc_feature (48)..(309): Pfam ID: Peptidase_C13 Pfam Description: Peptidase C13 family
MAFGRRSPGSSRHRPALTIVSALLLAFLSSAAAAAAASSSTDAMHNNNWAVLVCTSRFWFNYRHMANTLSLYRTVKRLGIPDERIILMLADDMACNPRNSYPAQVFNNENHQLNLYGDNVEVDYRGYEVTVENFLRVLTGRHESAVPRSKRLLSDEGSHILLYMTGHGGDEFLKFQDSEELQSHDLADAVKQMKEKHRFKELLIMVDTCQAATLFSQLQSPGVLAIGSSMKGENSYSHHLDSDIGVSVVDRFTYYTLAFFEKLNMYSNASLNSLFTSYNPSMLMSTAYYRMDLYERPLNEVPVTNFFGSVMKTLHTDSAYTGFLAAHDNETPMDIGDNLDDQFMLKDRATARRSNIEKEAQLTPHGWTEVLLEQLEGRNTDTVVIYGLGAMGILLALSTWLSM

SEQ ID NO: 17312 - DNA, 645 bp, Sorghum bicolor
  misc_feature: Ceres ANNOT ID no. 8672119
  misc_feature: Encodes the peptide sequence at SEQ ID NO 17313
atgggtgtagagaatctccactccaagaaaatggtacagccaaagaagtttcgtggagtccggcagcgccactggggttcctgggtctccgagatcaggcatcccctccttaagaggagggtctggctgggcaccttcgagaccgctgaggaggcagcgagagcatatgacgaggctgccgtgctgatgagcggccgcaacgccaagaccaacttcccggtccaaaggagcagcacaggggagccaaccccagctgcgggaagggacgctcacagcaacgccggcagcggctcctctaccgccaacctgtcccagattctcagtgcgaagctccgcaaatgctgcaaggcgccatcgccctccctgacctgtctccgccttgaccctgagaagtcccacattggtgtttggcagaagcgtgcaggagcccgtgctgactccaactgggtcatgaccgtggagctcaacaaaggtgcagcatccactgatgctgcatcacagtccacatcagcaacaactgctccaccagccaccccgatggatgacgaggagaggatcgccctgcaaatgatcgaagagttgctgagcagcagcagcccagcttcaccctcgcacggagatgaccaaggtcgcttcatcatctga

SEQ ID NO: 17313 - protein, 214 aa, Sorghum bicolor
  misc_feature: The sequence is a functional homolog of SEQ ID NO 1302 in the 10/374,780 US patent application
  misc_feature: The sequence is a functional homolog of SEQ ID NO 1447 in the 10/412,699 US patent application
  misc_feature: The sequence is a functional homolog of SEQ ID NO 150 in the 11/375,241 US patent application
  misc_feature: The sequence is a functional homolog of SEQ ID NO 908 in the 10/666,642 US patent application
  misc_feature: Useful for making plants with modulated biomass
  misc_feature: Functional homolog of the protein sequence given in SEQ ID NO 14518
  misc_feature: Useful for making plants with modulated flowering time
  misc_feature: Functional homolog of the protein sequence given in SEQ ID NO 14519
  misc_feature: Ceres ANNOT ID no. 8672119
  misc_feature (15)..(66): Pfam ID: AP2 Pfam Description: AP2 domain
MGVENLHSKKMVQPKKFRGVRQRHWGSWVSEIRHPLLKRRVWLGTFETAEEAARAYDEAAVLMSGRNAKTNFPVQRSSTGEPTPAAGRDAHSNAGSGSSTANLSQILSAKLRKCCKAPSPSLTCLRLDPEKSHIGVWQKRAGARADSNWVMTVELNKGAASTDAASQSTSATTAPPATPMDDEERIALQMIEELLSSSSPASPSHGDDQGRFII

SEQ ID NO: 17314 - DNA, 414 bp, Sorghum bicolor
  misc_feature: Ceres ANNOT ID no. 8672131
  misc_feature: Encodes the peptide sequence at SEQ ID NO 17315
atggaggaggtcaccgaggccgtgaacaacctcagcatctccggtggaggagccacggccggtgccggtgccggagcggaggggcacaagaagaaccgcatccaggtctccaacaccaagaagcccctcttcttctatgtcaacctcgccaagctgcacaacgaagtggagctgtcggccctcggcatggccattgcaacggtggtgacagtagcagaaattctgaaaaataatggccttgctgtcgagaagaagatcatgacatctactgttgatgtcaaagatgaaactaggccccgacctatccagaaggccaagattgaaatattgcttggcaagacggacaaatttgatgagctgatggcagcggctgcagaagagagggaggccaatgaggccgaggaacaaagctga

SEQ ID NO: 17315 - protein, 137 aa, Sorghum bicolor
  misc_feature: Useful for making plants with modulated nitrogen use efficiency
  misc_feature: Functional homolog of the protein sequence given in SEQ ID NO 13593
  misc_feature: Ceres ANNOT ID no. 8672131
  misc_feature (30)..(95): Pfam ID: Alba Pfam Description: Alba
MEEVTEAVNNLSISGGGATAGAGAGAEGHKKNRIQVSNTKKPLFFYVNLAKLHNEVELSALGMAIATVVTVAEILKNNGLAVEKKIMTSTVDVKDETRPRPIQKAKIEILLGKTDKFDELMAAAAEEREANEAEEQS

SEQ ID NO: 17316 - DNA, 1527 bp, Sorghum bicolor
  misc_feature: Ceres ANNOT ID no. 8672169
  misc_feature: Encodes the peptide sequence at SEQ ID NO 17317
atggcgcccacggaggaatccgccgctgctatgccagcgccaccaccgccaccacactttgtgatcgtccccctcgtggcgcagggccacaccatccccatggtcgacctcgcccgcctcctcgcggagcgcggcgcgcgcgcaagcttggtgaccacaccgctgaacggcgcacggctgcgtggcgccgtcgagcaggccgcgcgcaccaagctgtccctcgagatcgtcgagctcccgctgccgacggacaccgacgacggcctgcccccgggcatcgagaacatggacatggtcacggacaacggccacttcctcctcttgttcaacgccgtgcagaggctcgccggcccgctggaagcctacctgcgagcactggcgcagcgcccgagctgcatcatctccgactggtgcaacgcttggacggccggcgtggccagaagcctcggcgtccctcgcctcttcttccacgggccgtcgtgcttctactcgctctgcgacctcaacggcatcgaccacgggctgcacgagctgctgaccgcggcggccgacgacgaccaggagaggttcgtggtgccaggcatgccggtgcacgtggaggtgaccaaggccacggcgcccggcttctttaactcgccgggatgggagacgctccggacggagtgcgtggaggccatgcgcaccgccgacggcgcggtggtgaactcgttcgtggacctcgagggccagttcgtgtcgtgctacgaggcggcgctcggcaaacccgtgtggacgcttggcccgctctgcctctccaaccgggacgtcgaggccatggcgtcgcgcggggacacgtcgtcgccgggcggcgtccagctgcagagcgtggtgaccgcctggctcgacgccagggacacggactccgtcgtgttcgtcagcttcggcagcctggcgcagaagctcccgaagcagctgttcgaggtcggccatggcctcgaggactccggcaggccgttcctgtgggtggtgaaggaggccgaggcgtcggcggcgccggaggtggaggagtggctggcggcgctagaggcgcgcacggcggggcgcggcctcgtggtgcgtgggtgggcgccgcagctcgccatcctgtcccaccgcgccgtgggtgggttcgtcacccactgcggctggaactcgctgctggagtccgtggcgcacggcgtgccggtcgtgacgtggccgcacttcggcgaccagttcttgaacgagcggctggcggtggacgtgctcggcgtcggcgtgcccgtcggcgtcacggctcccgtgatggtgttcgacgacgagaacgtggcggtggcgcgtggggacatcgtgcgggcggtgtcggcgctgatgggcgacggggaagaggcggacgagaggaggaggaaggccaaggagtacggagaaaaagctcatgtggccatggagaaaggagggtcctcgtatgagaacctgacgcagctgattgagagcttcaggcaaagtggaggcaaaaaaaggttaggttag

SEQ ID NO: 17317 - protein, 508 aa, Sorghum bicolor
  misc_feature: Useful for making plants with altered carbohydrate content
  misc_feature: Functional homolog of the protein sequence given in SEQ ID NO 14520
  misc_feature: Ceres ANNOT ID no. 8672169
  misc_feature (19)..(495): SWISSPROT Homolog: EC 2.4.1.238 Anthocyanin 3'-O-beta-glucosyltransferase
  misc_feature (27)..(506): Pfam ID: UDPGT Pfam Description: UDP-glucoronosyl and UDP-glucosyl transferase
MAPTEESAAAMPAPPPPPHFVIVPLVAQGHTIPMVDLARLLAERGARASLVTTPLNGARLRGAVEQAARTKLSLEIVELPLPTDTDDGLPPGIENMDMVTDNGHFLLLFNAVQRLAGPLEAYLRALAQRPSCIISDWCNAWTAGVARSLGVPRLFFHGPSCFYSLCDLNGIDHGLHELLTAAADDDQERFVVPGMPVHVEVTKATAPGFFNSPGWETLRTECVEAMRTADGAVVNSFVDLEGQFVSCYEAALGKPVWTLGPLCLSNRDVEAMASRGDTSSPGGVQLQSVVTAWLDARDTDSVVFVSFGSLAQKLPKQLFEVGHGLEDSGRPFLWVVKEAEASAAPEVEEWLAALEARTAGRGLVVRGWAPQLAILSHRAVGGFVTHCGWNSLLESVAHGVPVVTWPHFGDQFLNERLAVDVLGVGVPVGVTAPVMVFDDENVAVARGDIVRAVSALMGDGEEADERRRKAKEYGEKAHVAMEKGGSSYENLTQLIESFRQSGGKKRLG

SEQ ID NO: 17318 - DNA, 519 bp, Sorghum bicolor
  misc_feature: Ceres ANNOT ID no. 8672145
  misc_feature: Encodes the peptide sequence at SEQ ID NO 17319
atgaacaggaagccaggagactgggactgcaggtcgtgccagcacctcaacttcagccgtcgggacatatgccagcgctgcagtgaaccacgcggagttgctgatcgtggcagtggtggtggaggtgactatgccaacttcggtggccgtggcggttcctccttcggaggtggctttggtgctggctctgatgtccgccctggtgactggtactgctcctgcggtgcacacaacttcgccagccgctccaactgcttcaagtgctctgcctacaaggaggaggctgctgtaaacagtggtgctggtggctttgatagtgacatgtcacgctcacggggctatggcttcggcagcggtgctgcccgtaccaaccgccccggttggaagtctggagactggatctgcaccaggtctggatgcaacgagcacaactttgctagcaggatggaatgtttcaggtgcaacgcaccacgggactccggtagcgctgccatgacctacgaaaattacttgcactga

SEQ ID NO: 17319 - protein, 172 aa, Sorghum bicolor
  misc_feature: Useful for biocontainment applications
  misc_feature: Useful for making plants with modulated biomass
  misc_feature: Functional homolog of the protein sequence given in SEQ ID NO 14521
  misc_feature: Ceres ANNOT ID no. 8672145
  misc_feature (129)..(160): Pfam ID: zf-RanBP Pfam Description: Zn-finger in Ran binding protein and others
  misc_feature (66)..(94): Pfam ID: zf-RanBP Pfam Description: Zn-finger in Ran binding protein and others
MNRKPGDWDCRSCQHLNFSRRDICQRCSEPRGVADRGSGGGGDYANFGGRGGSSFGGGFGAGSDVRPGDWYCSCGAHNFASRSNCFKCSAYKEEAAVNSGAGGFDSDMSRSRGYGFGSGAARTNRPGWKSGDWICTRSGCNEHNFASRMECFRCNAPRDSGSAAMTYENYLH

SEQ ID NO: 17320 - DNA, 984 bp, Sorghum bicolor
  misc_feature: Ceres ANNOT ID no. 8672181
  misc_feature: Encodes the peptide sequence at SEQ ID NO 17321
atggcggtggacgaggtgaattcggtctacgtcggcggccttccctacgaggccaacgaggagatgcttcgcgacgccttcgggtactacggcaccatcgtctccgtcaaggtgattaatgatcattctgtcaaaggcaagtgttatggttttgttactttcactcaccccagagctgctgagcaagcaattgcaggcatggatggcaagaaattaggcaatcgtattgttcgagtaaatgaagtgcgtacaagaggtccccgagattttggtcgagatggtttcagacgagatccaagaaggtatggtagagatccatactgggacagaagggatagggaacggagctatgatcgtgaaagggatccctaccatgacagggatagtgatagatcccgtgagcatgatagagaaagagattatgagcatggtggctttaatcgagaaattgactatcccatggatcgagatcatgaagtagacgagagacgtcctagagaacatgatcgtgcagctgaaatgcataatatggattcagataatgacaaagatagggagcatggaacaagaaaaagccgcccgaaaggtcgtgatagcagagatttatcgagttccagtgatgatcttcaaaatgatggaaagcaccagttggataaaactattcagatgcgtgaggaccttgaaaatgaggttaaccagattaaggataaaatatctggaaaagaacagcacattgcagatttgcagaagaaagctcagaaattagaggatgaactggatgccgcgcggaaagtctcttcagaacgacaattagctgttacagacctgtacaaacattttcttcaacttcaagactacaacgatagggtcaaaacggctgaacagaggctgcagtctcttgttgatgctgccatggtcgagcttgacatagccgaagatgctactaccagagatggctcaatgtatgagaatggggtggtctga

SEQ ID NO: 17321 - protein, 327 aa, Sorghum bicolor
  misc_feature: Useful for making plants with modulated biomass
  misc_feature: Functional homolog of the protein sequence given in SEQ ID NO 12995
  misc_feature: Ceres ANNOT ID no. 8672181
  misc_feature (4)..(80): SWISSPROT Homolog: EC 5.2.1.8 Peptidylprolyl isomerase
  misc_feature (9)..(79): Pfam ID: RRM_1 Pfam Description: RNA recognition motif. (a.k.a. RRM, RBD, or RNP domain)
MAVDEVNSVYVGGLPYEANEEMLRDAFGYYGTIVSVKVINDHSVKGKCYGFVTFTHPRAAEQAIAGMDGKKLGNRIVRVNEVRTRGPRDFGRDGFRRDPRRYGRDPYWDRRDRERSYDRERDPYHDRDSDRSREHDRERDYEHGGFNREIDYPMDRDHEVDERRPREHDRAAEMHNMDSDNDKDREHGTRKSRPKGRDSRDLSSSSDDLQNDGKHQLDKTIQMREDLENEVNQIKDKISGKEQHIADLQKKAQKLEDELDAARKVSSERQLAVTDLYKHFLQLQDYNDRVKTAEQRLQSLVDAAMVELDIAEDATTRDGSMYENGVV

SEQ ID NO: 17322 - DNA, 1929 bp, Sorghum bicolor
  misc_feature: Ceres ANNOT ID no. 8672180
  misc_feature: Encodes the peptide sequence at SEQ ID NO 17323
atggagtccggcctcgtcgcaagccaccgcctccgcctcccttccccgtccgcctccgccgggcaccaccaccaccacctcctccgccaccgccacgcccacgccccggcaccgctccgcctcagcctcccgcgccacctcccggggcccgccccgctccgcctgcccgccgcgctcccgctccgcccctacctcccgcccctccgcgcctccgcctccgcctccgccgccgcagcgcccggggatgacgcctccgcggcgtcgcccaagttcctgggcgtggagacgaagacgctgaagaagatcgtgccgctggggctcatgttcttctgcatcctcttcaactacaccatcctgcgggacaccaaggacgtgctcgtcgtcaccgccaagggcagcagcgccgagatcatcccgttcctcaagacctgggtcaacctgcccatggccgtcggcttcatgctcctctacaccaagctcgccgacgtgctctccaaggaggcgctcttctacgccgtcatcttccccttcatcgccttcttcggggccttcgcctacgtgctctaccccatgcgcgacgccatccaccccaccgcgctcgccgaccgactcctcgcctcgctcggccccagcttcctcgagcccgatgccatcctccgcgtctggagcttctgcctcttctacgtcatggccgagctctggggcagcgtcgtcatatccgtcctcttctgggggtttattactacagttgaagaggccaaagagttctacccgctgtttgggcttggtgccaatgtggccctcatcttctctgggcgcacggtgaaatatttctcaaacatgaggaagaatttgggtcctggagtggatggttgggcaatttcgttgaaggccatgatgagcatagtggttgtactgggtcttatcatcaccggtatctattggggggtgaacaagtttgttattgataactcatctatgcccgtggtcgagcggaaaaagaaggacaagccaaagctcagcatgggtgagagcatgaaggttctgttgtcatctcggtatgtgagggatcttgccacattggtcgttgcttatggaataagcattaaccttgtggaggtgacatggaaatcaaaattgaaagcacagttcccaagcccaaatgaatattcttcattcatgggcgatttctcaactgccaccggcatagctacctttacaatgatgttgttagggagagtaatcctcagaaagttcgggtggggagttgcagctacgatcacacctgcagtgttacttctcacaggagttgggttcttctcactgattttgtttggtgagccattgactcctcttatgaccaagtttgggatgacacctttgcttgcggcagtctatgttggagcaatgcagaacattttcagtaagagtgcaaagtacagtctgtttgatccttgcaaagagatggcatacattcctttggatgaggatatgaaggttaaaggtaaagcagctattgacgttgtctgcaaccccttggggaaatctggaggtgctttgatccagcagttcatgatcctgtcatttggatctcttgcgaattcgacaccctaccttggtggaatacttctggtgattgttcttgcatggctgggtgctgtaaggtccctcgactcacagttttcaaccctggcaaagcaagatctcgagaaagaaaagatgctgaaagcacaggccgtcgaagtcgaaacaactgccaaagtagtcgggactggaaatggttctctccaagaaactctagctagtgagccatctgcaaatggtgcagctaccaaacagtctcgagaacctgagagtacaaccacggagaaatcaggccaagaacctgagagtacaaccacggagaaatcaggccaacagtctcaataa

SEQ ID NO: 17323 - protein, 642 aa, Sorghum bicolor
  misc_feature: Useful for making plants with atered amino acid content
  misc_feature: Functional homolog of the protein sequence given in SEQ ID NO 13592
  misc_feature: Ceres ANNOT ID no. 8672180
  misc_feature (77)..(561): Pfam ID: TLC Pfam Description: TLC ATP/ADP transporter
MESGLVASHRLRLPSPSASAGHHHHHLLRHRHAHAPAPLRLSLPRHLPGPAPLRLPAALPLRPYLPPLRASASASAAAAPGDDASAASPKFLGVETKTLKKIVPLGLMFFCILFNYTILRDTKDVLVVTAKGSSAEIIPFLKTWVNLPMAVGFMLLYTKLADVLSKEALFYAVIFPFIAFFGAFAYVLYPMRDAIHPTALADRLLASLGPSFLEPDAILRVWSFCLFYVMAELWGSVVISVLFWGFITTVEEAKEFYPLFGLGANVALIFSGRTVKYFSNMRKNLGPGVDGWAISLKAMMSIVVVLGLIITGIYWGVNKFVIDNSSMPVVERKKKDKPKLSMGESMKVLLSSRYVRDLATLVVAYGISINLVEVTWKSKLKAQFPSPNEYSSFMGDFSTATGIATFTMMLLGRVILRKFGWGVAATITPAVLLLTGVGFFSLILFGEPLTPLMTKFGMTPLLAAVYVGAMQNIFSKSAKYSLFDPCKEMAYIPLDEDMKVKGKAAIDVVCNPLGKSGGALIQQFMILSFGSLANSTPYLGGILLVIVLAWLGAVRSLDSQFSTLAKQDLEKEKMLKAQAVEVETTAKVVGTGNGSLQETLASEPSANGAATKQSREPESTTTEKSGQEPESTTTEKSGQQSQ

SEQ ID NO: 17324 - DNA, 1575 bp, Sorghum bicolor
  misc_feature: Ceres ANNOT ID no. 8672163
  misc_feature: Encodes the peptide sequence at SEQ ID NO 17325
atggaaaacccggcgccgccgaccgatcctgccgccgccacgggcgccacgccaacgccgtcgtcgtcgccgtcgcggcagctgccggacttccagcagtcggtgcggctcaagtacgtgaagctggggtaccactacctcatcagccacggcatgtacctgctgctgaccccgctgatggtgctcgtcgccgtgcacctctccacgctgtccccgcgcgacgtggccgacctgtgggcacacctccgcctcaacctcatctctgtggtggcctgctccacgctgctcgtcttcctcggcacggtctacttcctgacgcggccgcggcccgtgtacctggtggacttcgcctgctacaagccgggtcccgagcggcggtgcacgcgcgacaccttcatgcgctgctccaggctcaccggctgcttcacggacggcagcctcgagttccagcgcaagatcctggagcggtcggggctcggcgaggaaacgtaccttccccccgccgtcacgcgggtgccgcccaacccgtccatggacgaggcgcgcgcggaggcgcgggaggtgatgttcggcgccgtggacgagctgctggccaagacgggcgtgaagcccaaggacatcgggatcctggtggtgaactgcagcctgttcaacccgacgccgtcgctgtcggccatggtggtgaaccactacaagctgcgtgggaacgtggtgagctacaacctcggcgggatggggtgcagcgccgggctgctgtcggtggacctcgccagggacctgctgcagacgcacccggggtcgtacgcgctggtgatcagcacggagaacatcacgctcaactggtactcgggcaacgaccgctccaagctggtgtccaactgcctgttccggatgggcggcgcggcggtgctgctctcgaaccggcggtccgaccggcggcgggccaagtacgagctggtgcacacggtgcgcacgcacaagggcgccgacgaccggtgcttcggctgcgtgacgcaggaggaggacggcgagggcgtcctgggcgtgtcgctgtcgagggacctgatggcggtggccggggacgcgctcaagaccaacatcacgacgctgggaccgctggtgctgccgctgtcggagcagctgctgttcatggccacgctggtcgccaagaaggtgctcaagatgaagaaggtgaagccgtacatcccggacttcaagctggcgttcgagcacttctgcatccacgccggcgggcgcgccgtgctggacgagctggagagcaacctgtcgctcacggactggcacatggagccgtcgcggatgacgctgcaccggttcgggaacacctccagcagctcgctctggtacgagctggcctacagcgaggccaaggggaggatccggcggcgccaccgggtgtggcagatcgcgttcgggtcagggttcaagtgcaacagcgccgtgtggagggcgctccggtcggtgaacccggcggaggagaccaacccgtggatggacgagatcgacaggttccccgtggatgtccccaaggtctccaaggttaccagcgactga

SEQ ID NO: 17325 - protein, 524 aa, Sorghum bicolor
  misc_feature: The sequence is a functional homolog of SEQ ID NO 2 in US patent 7038112
  misc_feature: Ceres ANNOT ID no. 8672163
  misc_feature (26)..(521): SWISSPROT Homolog: EC 2.3.1.119 Icosanoyl-CoA synthase
  misc_feature (103)..(392): Pfam ID: FAE1_CUT1_RppA Pfam Description: FAE1/Type III polyketide synthase-like protein
  misc_feature (407)..(491): Pfam ID: ACP_syn_III_C Pfam Description: 3-Oxoacyl-[acyl-carrier-protein (ACP)] synthase III C terminal
MENPAPPTDPAAATGATPTPSSSPSRQLPDFQQSVRLKYVKLGYHYLISHGMYLLLTPLMVLVAVHLSTLSPRDVADLWAHLRLNLISVVACSTLLVFLGTVYFLTRPRPVYLVDFACYKPGPERRCTRDTFMRCSRLTGCFTDGSLEFQRKILERSGLGEETYLPPAVTRVPPNPSMDEARAEAREVMFGAVDELLAKTGVKPKDIGILVVNCSLFNPTPSLSAMVVNHYKLRGNVVSYNLGGMGCSAGLLSVDLARDLLQTHPGSYALVISTENITLNWYSGNDRSKLVSNCLFRMGGAAVLLSNRRSDRRRAKYELVHTVRTHKGADDRCFGCVTQEEDGEGVLGVSLSRDLMAVAGDALKTNITTLGPLVLPLSEQLLFMATLVAKKVLKMKKVKPYIPDFKLAFEHFCIHAGGRAVLDELESNLSLTDWHMEPSRMTLHRFGNTSSSSLWYELAYSEAKGRIRRRHRVWQIAFGSGFKCNSAVWRALRSVNPAEETNPWMDEIDRFPVDVPKVSKVTSD

SEQ ID NO: 17326 - DNA, 1635 bp, Sorghum bicolor
  misc_feature: Ceres ANNOT ID no. 8672152
  misc_feature: Encodes the peptide sequence at SEQ ID NO 17327
atggacgcgggcggcgccgggtggctgtcgtggcgagcggcggcggtggccgtggtggcgtggctggcgctgcacgtggcggcgcgcgtggcggacgcgctgtggtggcggccccgtcgcctggaggcgcacttcgcggcgcagggcgttcgaggcccgccgtaccggttcctgctggggtccgtgaaggagatggtggggctcatggcggaggcctcgtccaagcccatgtcgccgccaacctcccacaacgcgctgccccgcgtgctcgccttctaccactactggcggaagatctacgggccgaccttcttgatctggttcgggccgacgccgcgcctgacggtggcggagccggagctggtccgcgagatcttcctcacgcgcgcggaggcgttcgaccgctacgaggcgcaccccgtcgtgcgccagctcgagggcgacggcctcgtcagcctccacggcgacaagtgggcgctccaccgccgcgtcctcaccgacgccttctacccggacaacatcaaccggctggtgccccacgtcggcaggtcggtggcggcgctggcggagaagtggcgcgccatggcggccgccgccgcgagcggcgaggtggaggtggacgtcgcggagtggttccaggcggtcaccgaggaggccatcacgcgcgccaccttcggccggagctacgacgacggccgcgtcgtgttcgccatgcagggccgcctcatggcctacgcctccgaggccttccgcaaggtcctcgtccccggctaccggttcttgcccaccaagaagaactggcagtcgtggaagctggacagggagatacggcggagcctgacccgtctcatcgcccggcgcagcgacgaggccgaggccgaggagaaagaggaggttcaggcggccagcagccactccggcggcgccttccgcgaccttctcggcgccatgatcaatgccggcgagaggaagaagaccccaacagcgatcccggtggcggacatgctggaggaatgcaagacgttcttcttcgccgggaagcagacgacgacgaacctcctggcctgggccaccgtgctcctggccatgcacccggagtggcaggagcgcgcccgccgcgaggtcctcgacgtctgcggccccgacgagctcccctccaaggagcacctcccgaagctcaagacgctgggcatgatcatcaacgagacgctccgcctctacccgccggcggtggcgacgatccggcgcgccaagacggacgtccggctctccgacgggtgcctggtcccgcgggacacggagctgctcatcccgatcatggcgatccaccacgacgccaggttctggggccccgacgcgacgcagttcaacccggccaggttcgccggcggcacggcgagggcggcgaagcacccgctggcgttcgtcccgttcgggctgggctcccggatgtgcatcggccagaacctggcgcgccttgaggccaagctcaccatggccgtcctgctgcagcggttcgagatgaaggcgtccccgaactacgtccacgcgccgacggtgctgatgctcctctacccgcagtacggagcgccggtgatcttccggccacgaggaccgccggcagcctcatcatag

SEQ ID NO: 17327 - protein, 544 aa, Sorghum bicolor
  misc_feature: The sequence is a functional homolog of SEQ ID NO 2 in US patent 7034205
  misc_feature: Ceres ANNOT ID no. 8672152
  misc_feature (32)..(535): SWISSPROT Homolog: EC 1.3.3.9 Secologanin synthase
  misc_feature (76)..(534): Pfam ID: p450 Pfam Description: Cytochrome P450
MDAGGAGWLSWRAAAVAVVAWLALHVAARVADALWWRPRRLEAHFAAQGVRGPPYRFLLGSVKEMVGLMAEASSKPMSPPTSHNALPRVLAFYHYWRKIYGPTFLIWFGPTPRLTVAEPELVREIFLTRAEAFDRYEAHPVVRQLEGDGLVSLHGDKWALHRRVLTDAFYPDNINRLVPHVGRSVAALAEKWRAMAAAAASGEVEVDVAEWFQAVTEEAITRATFGRSYDDGRVVFAMQGRLMAYASEAFRKVLVPGYRFLPTKKNWQSWKLDREIRRSLTRLIARRSDEAEAEEKEEVQAASSHSGGAFRDLLGAMINAGERKKTPTAIPVADMLEECKTFFFAGKQTTTNLLAWATVLLAMHPEWQERARREVLDVCGPDELPSKEHLPKLKTLGMIINETLRLYPPAVATIRRAKTDVRLSDGCLVPRDTELLIPIMAIHHDARFWGPDATQFNPARFAGGTARAAKHPLAFVPFGLGSRMCIGQNLARLEAKLTMAVLLQRFEMKASPNYVHAPTVLMLLYPQYGAPVIFRPRGPPAASS

SEQ ID NO: 17328 - DNA, 1467 bp, Sorghum bicolor
  misc_feature: Ceres ANNOT ID no. 8672235
  misc_feature: Encodes the peptide sequence at SEQ ID NO 17329
atggagacgacgacgaagcagctccggtggagccggcccggctccctcctcctcgtcgccgccgcgttcctggcttccgccgccctgtccaccgccaacatcgccgacttcgacgagcactggcagaagcgcaaggagctcgccgaggcctcggtgagggagacgtacaggcccgacccctacaacgttaccaacagcttcaacgtcgccgtgcacagagcaaccagcctccggcgtacgatgcgggagatgccacggaagcacaagaagaaagggccgtgccgtgcgacgaacccgatcgacaagtgctggcgctgcaagaacgactgggcgacggaccgtttccgtctggcccggtgcgccaggggtttcgggcaggcgaccaccggcggcctcggcggtccgatctacatcgtgacggatcccagcgacggcgacgtggtgaaccctcggccggggacgctccggtggggcgtgatccagccaggcccgctgtggatcatcttcgccaagtcgatgatcatccagctctcgcaggagctgctggtgagcagcgacaagaccatcgacgggcgcgctggcccggaacgtgatcatccacaacctgcacgtccacgacgtgctgcactccatggggggcctgatgcgcgactcgccgacgcacgtcgggtcccggaccaaggccgacggcgacggcatctcgctgttccaggccaccaacgtgtggatcgaccacatctccatgtccaactgcgaggacgggctcatcgacgtggtgcagagctccacggggatcaccatctccaactgccacttcaccaaccacaacgacgtgatgctgttcggcgccagcgactcgtacccgcaggaccagatgatgcagatcaccgtcgccttcaaccacttcggcagggggctcgtgcagaggatgcccaggtgccgatggggattcttccacgtcgtcaacaacgactacacgcactggctcatgtacgccattggcggcggcaaagctcccaccatcatcagccagggaaaccgatacattgcaccaccaaacatcgccgccaaagtgatcaccaagcactacgcggaagagggggagtggaagaactgggtgtggcacacggaggacgacctgttcatgaacggagccatcttcgagccgtcgggaggggcggtgcagaggcagatcaacagcaacgagtgggtgaagcccaagccagggacgtacgtgacaaggctcacgcgcttctcgggcacattgtcctgctgcatgagcaagccgtgctgatagctcggcgtcgtcaggctcatagcttgaggcgcaagcagctgccgccatggccgacaatgccgcgccggtctgtgtttcttgcaaccaaaaagggtataaaccctcaatgggaggaagcaaaggacatccacctaggatggagggtagccagcaggtcgtcgttttgctaa

SEQ ID NO: 17329 - protein, 488 aa, Sorghum bicolor
  misc_feature: Useful for making plants with altered cell wall content and/or composition
  misc_feature: Functional homolog of the protein sequence given in SEQ ID NO 14522
  misc_feature: Ceres ANNOT ID no. 8672235
  misc_feature (33)..(192): SWISSPROT Homolog: EC 4.2.2.2 Pectate lyase
  misc_feature (33)..(81): Pfam ID: Pec_lyase_N Pfam Description: Pectate lyase, N terminus
METTTKQLRWSRPGSLLLVAAAFLASAALSTANIADFDEHWQKRKELAEASVRETYRPDPYNVTNSFNVAVHRATSLRRTMREMPRKHKKKGPCRATNPIDKCWRCKNDWATDRFRLARCARGFGQATTGGLGGPIYIVTDPSDGDVVNPRPGTLRWGVIQPGPLWIIFAKSMIIQLSQELLVSSDKTIDGRAGPERDHPQPARPRRAALHGGPDARLADARRVPDQGRRRRHLAVPGHQRVDRPHLHVQLRGRAHRRGAELHGDHHLQLPLHQPQRRDAVRRQRLVPAGPDDADHRRLQPLRQGARAEDAQVPMGILPRRQQRLHALAHVRHWRRQSSHHHQPGKPIHCTTKHRRQSDHQALRGRGGVEELGVAHGGRPVHERSHLRAVGRGGAEADQQQRVGEAQARDVRDKAHALLGHIVLLHEQAVLIARRRQAHSLRRKQLPPWPTMPRRSVFLATKKGINPQWEEAKDIHLGWRVASRSSFC

SEQ ID NO: 17330 - DNA, 1134 bp, Sorghum bicolor
  misc_feature: Ceres ANNOT ID no. 8672242
  misc_feature: Encodes the peptide sequence at SEQ ID NO 17331
atgaggttgtcacccgcacgatctaccacacttaccacaatgcaggagatatccacaggcaaaacaatgtataaacaccatatagggaataaacaaagaagaagaaagcacaagactttagcctttaaagaggtgaatgctgctgaaggcttagaatttccggttgttagtttgaaagatgtcatagctatgacaaataacttccacaactcatttatgataggacaaggaggttttggcaaagtttacaaggcaaagttagatggccaagaaattgccatcaaaaggctccatagggattctgagcaagggatagtggaattcagaaatgaaattattttaattgccaggctacaacatagaaatttggttagatttctcagttgctgcatagagggagatgaaaagctattgatttttgagtatatgcctaacaacagcttagatgctcacattttcagcagtacaaggaaaactatgctagattggccaacacgttttaacataatcaaaggagttgccagagggcttctataccttcatcaagattccagactaaaggtaattcatagggatctcaaagcaagcaatgttctgttggatgaagaaatgagacccaaaatagcggactttggcatggcaaggacgtttggtgacaaccaacaaaatgaaaatacgaagagggtcgtcgggacatacggctacatggctcctgaatatgcacttagaggcaaattttctgtcaagtctgatgtgtatagcttcggtatcttgactttggaggttgtaagtggtctgaagataagctcttctgatccaatattggattttgaaaaccttactgtttatgaagggaaagcaaatgatttggtggactcaagtattatcaatagctgtacaccagatgaagctttgctttgcatccatatcggactcttgtgtgtgcaggacaaccccaacgataggccactcatgtcgtccgttttgttcatgttggagaatcaaagcatcatacttccctttccaaatgaacctgcatattttccacatacaaatactcaagtagaacaaagaaggggcaatactcaaaactcaaagaatagtgtaactcttacagttctagagggaagataa

SEQ ID NO: 17331 - protein, 377 aa, Sorghum bicolor
  misc_feature: Useful for making plants with altered cell wall content and/or composition
  misc_feature: Functional homolog of the protein sequence given in SEQ ID NO 14140
  misc_feature: Ceres ANNOT ID no. 8672242
  misc_feature (57)..(336): SWISSPROT Homolog: EC 2.7.11.1 Non-specific serine/threonine protein kinase
  misc_feature (68)..(330): Pfam ID: Pkinase Pfam Description: Protein kinase domain
MRLSPARSTTLTTMQEISTGKTMYKHHIGNKQRRRKHKTLAFKEVNAAEGLEFPVVSLKDVIAMTNNFHNSFMIGQGGFGKVYKAKLDGQEIAIKRLHRDSEQGIVEFRNEIILIARLQHRNLVRFLSCCIEGDEKLLIFEYMPNNSLDAHIFSSTRKTMLDWPTRFNIIKGVARGLLYLHQDSRLKVIHRDLKASNVLLDEEMRPKIADFGMARTFGDNQQNENTKRVVGTYGYMAPEYALRGKFSVKSDVYSFGILTLEVVSGLKISSSDPILDFENLTVYEGKANDLVDSSIINSCTPDEALLCIHIGLLCVQDNPNDRPLMSSVLFMLENQSIILPFPNEPAYFPHTNTQVEQRRGNTQNSKNSVTLTVLEGR

SEQ ID NO: 17332 - DNA, 438 bp, Sorghum bicolor
  misc_feature: Ceres ANNOT ID no. 8672253
  misc_feature: Encodes the peptide sequence at SEQ ID NO 17333
atgcaggagaagaaagcacatgcatatttgtttgtgaaacatttgcatctgatagtgaactattttaagaaggttcctcatgaaggacccatgtgtgatcttttgtggtctgacccagatgaccgatgtggatggggaatttcaccaagaggagcaggttacacatttgggcaagacattgcgcagcagttcaaccatacaaatggtctctctctcatttcaagggcccatcaacttgtaatggaaggatttaattggtgccaggataagaatgtagtcacagtcttcagtgcgcctaactattgttaccgatgtggtaacatggctgctattcttgaaattggggaaaacatggaccagaacttccttcaatttgacccggcacctcggcaaattgagccagacacaacccgcaaaaccccagactactttttgtaa

SEQ ID NO: 17333 - protein, 145 aa, Sorghum bicolor
  misc_feature: The sequence is a functional homolog of SEQ ID NO 13 in US patent 7271316
  misc_feature: Ceres ANNOT ID no. 8672253
  misc_feature (23)..(145): SWISSPROT Homolog: EC 3.1.3.16 Phosphoprotein phosphatase
MQEKKAHAYLFVKHLHLIVNYFKKVPHEGPMCDLLWSDPDDRCGWGISPRGAGYTFGQDIAQQFNHTNGLSLISRAHQLVMEGFNWCQDKNVVTVFSAPNYCYRCGNMAAILEIGENMDQNFLQFDPAPRQIEPDTTRKTPDYFL

SEQ ID NO: 17334 - DNA, 627 bp, Sorghum bicolor
  misc_feature: Ceres ANNOT ID no. 8672255
  misc_feature: Encodes the peptide sequence at SEQ ID NO 17335
atgccgtcgcacggggatctggaccggcagatcgcgcagctgcgcgactgcaagtacctgcccgaggcggaggtcaaggcgctctgcgagcaggccaaggccatcctcatggaggagtggaacgtgcagcccgtgcgctgccccgtcaccgtctgcggcgacatccacggccagttctacgacctcatcgagctcttccgcatcggcggcgacgctcccgacaccaactacctcttcatgggcgactacgtcgatcgtggctactattcagttgaaacagtttctctgttagtggctttgaaagtccgttacagagatagaattacaatacttagaggaaatcatgagagcagacaaatcactcaagtgtatggcttctatgatgaatgcttaagaaaatatggaaatgcaaatgtatggaagtattttacagacttgtttgattatttgcctctcacggctcttatagaaaatcaggtcttctgtcttcatggtggcctctctccgtcattggacacattggataacattcgttctcttgatcgcatacaggaggtaggcacaacattgcactgctttcattatgaaccaggttttcttcattgcctccagtatatcatgctgtga

SEQ ID NO: 17335 - protein, 208 aa, Sorghum bicolor
  misc_feature: The sequence is a functional homolog of SEQ ID NO 13 in US patent 7271316
  misc_feature: Ceres ANNOT ID no. 8672255
  misc_feature (1)..(186): SWISSPROT Homolog: EC 3.1.3.16 Phosphoprotein phosphatase
  misc_feature (47)..(207): Pfam ID: Metallophos Pfam Description: Calcineurin-like phosphoesterase
MPSHGDLDRQIAQLRDCKYLPEAEVKALCEQAKAILMEEWNVQPVRCPVTVCGDIHGQFYDLIELFRIGGDAPDTNYLFMGDYVDRGYYSVETVSLLVALKVRYRDRITILRGNHESRQITQVYGFYDECLRKYGNANVWKYFTDLFDYLPLTALIENQVFCLHGGLSPSLDTLDNIRSLDRIQEVGTTLHCFHYEPGFLHCLQYIML

SEQ ID NO: 17336 - DNA, 2211 bp, Sorghum bicolor
  misc_feature: Ceres ANNOT ID no. 8672273
  misc_feature: Encodes the peptide sequence at SEQ ID NO 17337
atggccgcagcgcggcgtcttcttgccgcctgcagcagcggcggcggcgccggcgccggcgccggtagtcgcatcctgctcgctgtcttcttcctggcggcctcgctcttggcctccgcggccaatgcggccgtctcgtacgaccaccgctccctcgtcatcaacggccgccgccgcatcctcatctccggctctatccactacccgagaagcacccccgagatgtggcccgggctgatccagaaggccaaggacggcggcctcgacgtcatccagacctacgtcttctggaacggccacgagccggtgcaggggcagtaccacttcgccgaccgctacgacctcgtccgcttcgtcaagctcgtcaggcaggccggcctctacgtccacctccgcatcggcccctacgtctgcgccgagtggaacttcggtggctttcctgtttggctcaagtatgtgccgggcatcaggttcaggacagacaatggccccttcaagaagttcgtcgagaagatagtgtccatgatgaagtcggaggggctatttgagtggcagggaggcccaatcatcatggctcaggtggagaacgagttcgggccgatggagtctgttgtgggcagtggcgccaagccatatgctcactgggcggcccagatggctgttgggaccaacaccggtgtgccgtgggtgatgtgcaagcaagatgacgcccctgaccctgtgatcaacacttgcaatggcttctattgcgactacttcacaccgaacaggaagtacaagccaaccatgtggaccgaagcctggactggatggtttaccaagtttggtggtgcgttgcctcaccggcctgtcgaagacctggccttcgctgtggcacggttcattcagaaaggaggctccttcgtgaactactacatgtaccatggagggacaaactttgggcgcacggctggtggcccttttatcgcaaccagctacgactatgatgcccccatcgatgaatttggtctgcttaggcaaccaaaatggggtcacctgagggacctgcacagggctatcaagcaggctgagcctgcgttgatttctggcgatccaacaatacaatcaattggaaactatgagaaggcatacatcttcaagtcgaagaatggagcctgtgctgcattcctgtcgaactaccacatgaagactgctgtgaaaatcaggtttgatgggcgtcattatgacctccctgcttggtccatcagcattcttcctgactgcaaaaccgcggtcttcaacactgcgacggtgaaggagccaactctgctgccaaagatgaacccagtgttacactttgcttggcagtcctacagcgaagacacaaactcgctggatgacagtgcgtttacaaggaatggcctggttgagcaactcagcttgacatgggacaagtcggactatctgtggtacaccacccatgtcagcattggtggcaatgaacaattcctgaagtctggccagtggcctcagctcactgtgtactcggctggacactcgatgcaggtgttcgtcaatgggagatcatatggatctgtttatggcggctatgacaacccgaaacttacgttcaatgggcatgtgaagatgtggcagggcagtaacaagatctccatcctaagctcggcagtgggccttcctaacaacgggaaccattttgagctgtggaacgtcggcgtcctcgggccggtgaccctctctggcctgaatgaggggaagagggacctcagccatcagaaatggacataccaggtcggcctgaaaggcgaatcgctcggcctccacaccgtgactggaagctccgccgtggaatgggccggccctggcggcaagcagccactgacttggcacaaggccttgttcaacgcgccggcggggagcgatccggtggctctggacatgggcagcatgggcaaaggccagatttgggtgaacgggcaccacgccgggcggtactggtcgtacagggcctactccggcagctgccggcggtgcagctacgccgggacgtaccgcgaggaccagtgcttgtccaactgcggcgacatctcccagagatggtatcacgtgccgcggtcgtggctgaagccgagcgggaacctgctggtggtgctggaggagtacggcggcggcgacctcgccggcgtcaccctcgcgacgcggaccacatga

SEQ ID NO: 17337 - protein, 736 aa, Sorghum bicolor
  misc_feature: Useful for making plants with altered cell wall content and/or composition
  misc_feature: Functional homolog of the protein sequence given in SEQ ID NO 13590
  misc_feature: Useful for making plants with altered carbohydrate content
  misc_feature: Functional homolog of the protein sequence given in SEQ ID NO 13588
  misc_feature: The sequence is a functional homolog of SEQ ID NO 2 in US patent 7084321
  misc_feature: Ceres ANNOT ID no. 8672273
  misc_feature (46)..(736): SWISSPROT Homolog: EC 3.2.1.23 Beta-galactosidase
  misc_feature (51)..(353): Pfam ID: Glyco_hydro_35 Pfam Description: Glycosyl hydrolases family 35
MAAARRLLAACSSGGGAGAGAGSRILLAVFFLAASLLASAANAAVSYDHRSLVINGRRRILISGSIHYPRSTPEMWPGLIQKAKDGGLDVIQTYVFWNGHEPVQGQYHFADRYDLVRFVKLVRQAGLYVHLRIGPYVCAEWNFGGFPVWLKYVPGIRFRTDNGPFKKFVEKIVSMMKSEGLFEWQGGPIIMAQVENEFGPMESVVGSGAKPYAHWAAQMAVGTNTGVPWVMCKQDDAPDPVINTCNGFYCDYFTPNRKYKPTMWTEAWTGWFTKFGGALPHRPVEDLAFAVARFIQKGGSFVNYYMYHGGTNFGRTAGGPFIATSYDYDAPIDEFGLLRQPKWGHLRDLHRAIKQAEPALISGDPTIQSIGNYEKAYIFKSKNGACAAFLSNYHMKTAVKIRFDGRHYDLPAWSISILPDCKTAVFNTATVKEPTLLPKMNPVLHFAWQSYSEDTNSLDDSAFTRNGLVEQLSLTWDKSDYLWYTTHVSIGGNEQFLKSGQWPQLTVYSAGHSMQVFVNGRSYGSVYGGYDNPKLTFNGHVKMWQGSNKISILSSAVGLPNNGNHFELWNVGVLGPVTLSGLNEGKRDLSHQKWTYQVGLKGESLGLHTVTGSSAVEWAGPGGKQPLTWHKALFNAPAGSDPVALDMGSMGKGQIWVNGHHAGRYWSYRAYSGSCRRCSYAGTYREDQCLSNCGDISQRWYHVPRSWLKPSGNLLVVLEEYGGGDLAGVTLATRTT

SEQ ID NO: 17338 - DNA, 135 bp, Sorghum bicolor
  misc_feature: Ceres ANNOT ID no. 8672289
  misc_feature: Encodes the peptide sequence at SEQ ID NO 17339
atgggtgttcggtcacaaccttatcctgctgctgctgcctatgcaccactcacaatggtacctggagctcctgctattcctcatggctcacagccagcagcaccattccccaatccagctcaactcagtgcttag

SEQ ID NO: 17339 - protein, 44 aa, Sorghum bicolor
  misc_feature: The sequence is a functional homolog of SEQ ID NO 1188 in the 10/412,699 US patent application
  misc_feature: The sequence is a functional homolog of SEQ ID NO 835 in the 10/374,780 US patent application
  misc_feature: The sequence is a functional homolog of SEQ ID NO 1190 in the 10/412,699 US patent application
  misc_feature: The sequence is a functional homolog of SEQ ID NO 837 in the 10/374,780 US patent application
  misc_feature: Ceres ANNOT ID no. 8672289
MGVRSQPYPAAAAYAPLTMVPGAPAIPHGSQPAAPFPNPAQLSA

SEQ ID NO: 17340 - DNA, 2298 bp, Sorghum bicolor
  misc_feature: Ceres ANNOT ID no. 8672319
  misc_feature: Encodes the peptide sequence at SEQ ID NO 17341
atgggtctgacagaaggcatgcaattggtttcgtcaagaactgaggggcacatttcatcacaagttgtggaaagtaggggtcctgaaaagaaggctatgctagagcaagaactatctgttactccatcagataaagggaggtgttttgcttgtcatgatacatcgcacaatttggagcagtgtggaataaaatacaatcataccactgtgccacatcagtttggctatgctacaaaatatccgtttaccatgattcagccttcagaggagacggttgagaaagagaaattcaaccatcactgtgttttgatcacatcggatctcagtaacttggaccaggggatattgaaatctgaactgcagaagttttggaagctgtccggtgactgggagctacggagggaatgcagcaagagtttcctggcctctttcagctctgaggatgacgtcataagttgtttaaattttcctgagatggaagcactactggatcataaggaggtaaacttaactgtaacaaggtggcaggaaggcgatgaggaaagtcttgacttgattgaagagtgggttttagtgcgcggggttcgaagaatatatagaaactggaaggatttatatcaagttgcttccgcgtttggagtgctgattgatgtggatgagaaaagtttggaagctggggataaggagcctattaggctgaagattgcactaagaagccttgatggtgctcccttctcatactactttgcgctcggaaggtcttccagactggtcatggtcacagtcgtacaagacaaagcagaaggtatgcaacagcaaaataaggaatcagacaaggagcataataaggaactgaatgacgcacaaagtatatttctggaagagacggagtgcattgaagagtcaaggttggcaggagagatcaaaggaaacaaaataagtgctccagcagccactacagctaacaccaagaaaacaacaatggacagttcaaaacctgaagaggtgcaacctgtaggtcgaagttcaacaagcatgattggagaagagcacttcgaaggtaaacgaaagcctcctatcaaacatgtgttcaaaagaagaggtaaggagcagcaagttacagaaactgaggacatccatatatatggcagtttcagtggtatgggtcttcatgaaaatctactgaagggaatatatcaatatggtttggagaagccttccgtggttcatcaaagaggaattgtcccattttgcaatggccagagtgttatccatgagtctttgtctggaacaactgtaactctttgcactggagttcttcagcgacttgattatcgatccgcagaatgccaagctttaatcattgtaccaacacgcgacttaatgtacgagaccgagaaagttattgatgcacttggtcagtttcttggtgttaaaccttacacttgtactggaggaacgagtttccgcgtggaccagcaaactctgtcaagtagagttcaggttgtcattggaactcctgggcgcattcttgacttgctgtcaagggatgcattgtgtaaagaccacatcagaatgcttgttctggatgaagcagatgaactactcacaggaggtttcaaagaccagacatgtaacattatccagtatctcccagccaaaatccagattgggcttttctctgctgccttctccagtgaagctctagaaactagccactggttcatggataagcatgtgacagttaaagtgccgagagatgaagagctaaaggatatcggaatcaagcagttctatcacaaagttgagaaggaagagaagctaggaaagctgtatgtgcttttcgacactctaactctagagtccacacaaattgtcatctttgcgaacacaaagcaggttgtcaaaacgctcatacaagatatcagaggcaagggctacactatctcagcaagccatggcggtatgagccagcttggcagggacactgccatccaggagttcagggctggatcatcgcgtattctcatcgccactgacctacgaggcaccaatctagggcaggttcccattgtcatcaattatgatctcccaacacaactgatgcagtatatcagtcgtgttcagcagcaaagaagatattctgaaactgaaagtgtggccattaattttgtgactcctgccgatgaacgcatcgtctctgatatccagaagttctgcaacggccagatgagcaaactaccctccaatccaacatttgaactcttggtgggttatgatgttcagaaatgttcctaa

SEQ ID NO: 17341 - protein, 765 aa, Sorghum bicolor
  misc_feature: Useful for making plants with altered alkaloid content
  misc_feature: Useful for making plants with altered lignin content
  misc_feature: Functional homolog of the protein sequence given in SEQ ID NO 14523
  misc_feature: Useful for making plants with altered terpenoid content
  misc_feature: Functional homolog of the protein sequence given in SEQ ID NO 14524
  misc_feature: Ceres ANNOT ID no. 8672319
  misc_feature (407)..(571): Pfam ID: DEAD Pfam Description: DEAD/DEAH box helicase
  misc_feature (641)..(709): Pfam ID: Helicase_C Pfam Description: Helicase conserved C-terminal domain
MGLTEGMQLVSSRTEGHISSQVVESRGPEKKAMLEQELSVTPSDKGRCFACHDTSHNLEQCGIKYNHTTVPHQFGYATKYPFTMIQPSEETVEKEKFNHHCVLITSDLSNLDQGILKSELQKFWKLSGDWELRRECSKSFLASFSSEDDVISCLNFPEMEALLDHKEVNLTVTRWQEGDEESLDLIEEWVLVRGVRRIYRNWKDLYQVASAFGVLIDVDEKSLEAGDKEPIRLKIALRSLDGAPFSYYFALGRSSRLVMVTVVQDKAEGMQQQNKESDKEHNKELNDAQSIFLEETECIEESRLAGEIKGNKISAPAATTANTKKTTMDSSKPEEVQPVGRSSTSMIGEEHFEGKRKPPIKHVFKRRGKEQQVTETEDIHIYGSFSGMGLHENLLKGIYQYGLEKPSVVHQRGIVPFCNGQSVIHESLSGTTVTLCTGVLQRLDYRSAECQALIIVPTRDLMYETEKVIDALGQFLGVKPYTCTGGTSFRVDQQTLSSRVQVVIGTPGRILDLLSRDALCKDHIRMLVLDEADELLTGGFKDQTCNIIQYLPAKIQIGLFSAAFSSEALETSHWFMDKHVTVKVPRDEELKDIGIKQFYHKVEKEEKLGKLYVLFDTLTLESTQIVIFANTKQVVKTLIQDIRGKGYTISASHGGMSQLGRDTAIQEFRAGSSRILIATDLRGTNLGQVPIVINYDLPTQLMQYISRVQQQRRYSETESVAINFVTPADERIVSDIQKFCNGQMSKLPSNPTFELLVGYDVQKCS

SEQ ID NO: 17342 - DNA, 1026 bp, Sorghum bicolor
  misc_feature: Ceres ANNOT ID no. 8672330
  misc_feature: Encodes the peptide sequence at SEQ ID NO 17343
atggaggtgcaggaaggaaggaaaggaataccgtcgttgctctccttgcaaggggagtgcattgcatcgaacatcacacagctgattggttggacgccgctgatagaactgaaaaatattgccaagaaggatggcatatacgctcgcctgattgggaagattgagccgtaccagcccctttcttctgttaaggatcgaagtgctctcagattgattgaagatgcggaggagaaacgcctgatctcacctggcataacaacactagtggcactcacgagtggtaatcttggtattggtctggcatttgttgcggctcagaaaggctacagattcgttgctgtcatgccagcaaaaattgcaatagataagcagatactgttgagatacttgggcgttgaagtgatattagttgatgctacaattaatggattcaaggggctacttgatagagttgaacagcttaagaacgaaatggaaaatgtttatgttatagaccagttcactaaccctgcaaatcctgatgcacacttcagatggactggacctgagatatggaacgacacaaaaggcaaagtggacatatttgttgctgcaacaggttcaggaggcacattgacaggcactgggaggtatctgaagatgacgaatccatccgtgaagctaatatgcgttgaaccagctgaaagtgcagtaatttcaggtggtgagccagcatatcatcaaatacaggggatagggcctggttttgtcccagaaatactagacacatcacaaatagatgaaatcataacagtaacttcccaagaagccatggacatggcaagaaggttggcaagggaagaaggattgctcgttggcatatcttcaggggcaaatgcagctgcttgcttaaaggttgcggcacgagaggagagcaagggaaagttgattgtgacgatgttttccagtggtggggagaggtacttgaactcagaactctttgctcaggtgaaggaggaatgcgtcaacatcaacatggccttctaa

SEQ ID NO: 17343 - protein, 341 aa, Sorghum bicolor
  misc_feature: Useful for making plants with modulated cold sensitivity
  misc_feature: Functional homolog of the protein sequence given in SEQ ID NO 13038
  misc_feature: Ceres ANNOT ID no. 8672330
  misc_feature (15)..(337): SWISSPROT Homolog: EC 2.5.1.47 Cysteine synthase
  misc_feature (25)..(316): Pfam ID: PALP Pfam Description: Pyridoxal-phosphate dependent enzyme
MEVQEGRKGIPSLLSLQGECIASNITQLIGWTPLIELKNIAKKDGIYARLIGKIEPYQPLSSVKDRSALRLIEDAEEKRLISPGITTLVALTSGNLGIGLAFVAAQKGYRFVAVMPAKIAIDKQILLRYLGVEVILVDATINGFKGLLDRVEQLKNEMENVYVIDQFTNPANPDAHFRWTGPEIWNDTKGKVDIFVAATGSGGTLTGTGRYLKMTNPSVKLICVEPAESAVISGGEPAYHQIQGIGPGFVPEILDTSQIDEIITVTSQEAMDMARRLAREEGLLVGISSGANAAACLKVAAREESKGKLIVTMFSSGGERYLNSELFAQVKEECVNINMAF

SEQ ID NO: 17344 - DNA, 1011 bp, Sorghum bicolor
  misc_feature: Ceres ANNOT ID no. 8672381
  misc_feature: Encodes the peptide sequence at SEQ ID NO 17345
atgcactctgtgcttttcctctcctgggcactgctcatttggttcaccagcgtcgtcgtccacaagcggatttccaacggcggcgagtccttcaccaccatgctcaacgtcgtcattgctggcctgtcgctcggccaggcggcgccgaacatctcgacgttcctgcgggcgaggacggcggcgtaccccatcttccagatgatcgagaggagcaccgtgaacaaggcgagctccaagatcggccgcacgctgcccgcggtcgacgggcacatccagttccgcaacgtccacttcagctacccgtcacggccggacgtcgtcatcctcgataggttcagcctggactttccggccgggaagatcgtcgccgggagcgggtccggcaagagcaccgtcgtctcgctcatcgagcgcttctatgagccgctgtccggctccattctgcttgatgggcacgacatcaaggagctcgacgtcaagtggctgcgccggcagatcgggttggttaatcaggagccggccctgttcgcgacgagcatccgcgagaacatactctacggcaaaggcgacgccactatggaggagattaaccacgcggcgaagctgtcagaggcgatcacattcatcaaccacctccctgatcggtacgagacgcaggtcggcgagcgagggatacagctctccggcggccagaaccagcgcatcgcgatctcgagaacccgtcgatactgctccatcagcgccttcgtcgggtttttggatgacacagctcggcgccgtgatctgcggcgtcgagctcggcgccaagatccacggcgtcgagggaaagaaatgagattgaaggtagcattttcaacaaaaataactggaacaataatcaaagaaggggcatttttcctcacaaaaggaattaggtttaaccacacctccaccatattcatctttgaaggcatccagtacatcaataaccccaagcaacagtgtcatgggatgatgggaacagctacatga

SEQ ID NO: 17345 - protein, 336 aa, Sorghum bicolor
  misc_feature: The sequence is a functional homolog of SEQ ID NO 3 in US patent 7041874
  misc_feature: Ceres ANNOT ID no. 8672381
  misc_feature (4)..(239): SWISSPROT Homolog: EC 3.6.3.44 Xenobiotic-transporting ATPase
  misc_feature (119)..(296): Pfam ID: ABC_tran Pfam Description: ABC transporter
MHSVLFLSWALLIWFTSVVVHKRISNGGESFTTMLNVVIAGLSLGQAAPNISTFLRARTAAYPIFQMIERSTVNKASSKIGRTLPAVDGHIQFRNVHFSYPSRPDVVILDRFSLDFPAGKIVAGSGSGKSTVVSLIERFYEPLSGSILLDGHDIKELDVKWLRRQIGLVNQEPALFATSIRENILYGKGDATMEEINHAAKLSEAITFINHLPDRYETQVGERGIQLSGGQNQRIAISRTRRYCSISAFVGFLDDTARRRDLRRRARRQDPRRRGKEMRLKVAFSTKITGTIIKEGAFFLTKGIRFNHTSTIFIFEGIQYINNPKQQCHGMMGTAT

SEQ ID NO: 17346 - DNA, 768 bp, Sorghum bicolor
  misc_feature: Ceres ANNOT ID no. 8672436
  misc_feature: Encodes the peptide sequence at SEQ ID NO 17347
atgccggaccgggaggaatcaagaagcccggcgtcatccggagcttcctcctcgccgccgctgtcaccagctgagacggccgccaggcgcagctcctcatcgggatgcgagaagcgggcgcgtgacgccgggaagcacccgtcgtaccgcggcgtccggatgcgggcgtggggcaagtgggtgtcggagatccgcgagccgcgcaagaagtcgcgcatctggctcggcacgttcccgacgccggagatggcggcgcgcgcgcacgacgccgccgcgctcgtcgtcaagggccctgccgccgtcctcaacttccctgacatggccgccgcgctcccgcggccggtctccgcgtctccgcgcgacgtccaggccgccgccgcgcgcgccgcggccatggagccatctaggatgctttgcccctcctctgccgcgacgaccggaggagcagctgcattgccgttgccgaccccggcgctagcctccatggaggggcagctgcatgacgacgagctcgaggcgatcgtcgagctcccgccgctcgacgaggacgccgccgagctgctcgtgccgctcggcgccgcgtcgtcgttctcgttccacgacgacgctacgcaagcgtcttgctggcgcgacccagagtggatcgaccacgacgtcgctgcaggctacatggcggcggcgcacgatgccgacgagatgttcggatttgctccggacggcgaccacggatgggcccagccggttggtaccctcctgtggaacttgtaa

SEQ ID NO: 17347 - protein, 255 aa, Sorghum bicolor
  misc_feature: The sequence is a functional homolog of SEQ ID NO 159 in the 11/479,226 US patent application
  misc_feature: The sequence is a functional homolog of SEQ ID NO 2218 in the 10/374,780 US patent application
  misc_feature: The sequence is a functional homolog of SEQ ID NO 36 in the 10/412,699 US patent application
  misc_feature: The sequence is a functional homolog of SEQ ID NO 466 in the 11/435,388 US patent application
  misc_feature: The sequence is a functional homolog of SEQ ID NO 492 in the 10/225,066 US patent application
  misc_feature: The sequence is a functional homolog of SEQ ID NO 2602 in the 10/374,780 US patent application
  misc_feature: The sequence is a functional homolog of SEQ ID NO 656 in the 11/435,388 US patent application
  misc_feature: The sequence is a functional homolog of SEQ ID NO 68 in the 10/225,066 US patent application
  misc_feature: The sequence is a functional homolog of SEQ ID NO 2820 in the 10/374,780 US patent application
  misc_feature: The sequence is a functional homolog of SEQ ID NO 442 in the 10/225,066 US patent application
  misc_feature: Useful for making plants with modulated biomass
  misc_feature: Useful for making plants with modulated flowering time
  misc_feature: Functional homolog of the protein sequence given in SEQ ID NO 12893
  misc_feature: Useful for making plants with altered lignin content
  misc_feature: Functional homolog of the protein sequence given in SEQ ID NO 14525
  misc_feature: Ceres ANNOT ID no. 8672436
  misc_feature (47)..(98): Pfam ID: AP2 Pfam Description: AP2 domain
MPDREESRSPASSGASSSPPLSPAETAARRSSSSGCEKRARDAGKHPSYRGVRMRAWGKWVSEIREPRKKSRIWLGTFPTPEMAARAHDAAALVVKGPAAVLNFPDMAAALPRPVSASPRDVQAAAARAAAMEPSRMLCPSSAATTGGAAALPLPTPALASMEGQLHDDELEAIVELPPLDEDAAELLVPLGAASSFSFHDDATQASCWRDPEWIDHDVAAGYMAAAHDADEMFGFAPDGDHGWAQPVGTLLWNL

SEQ ID NO: 17348 - DNA, 981 bp, Sorghum bicolor
  misc_feature: Ceres ANNOT ID no. 8672588
  misc_feature: Encodes the peptide sequence at SEQ ID NO 17349
atggcttcgttccggacgtggcactgcttgctcgccaccagctgcttgttcctcctgctgctcgcttcgccggcgcacgggcagctctcgccgtccttctacgcgacgagctgcccgacgctggggctcatcgttcggaccaccatgatcaaggctctcctcgccgagcgtcggatgggcgcgtccctcgtcaggctcttcttccacgactgctttgttcaaggctgcgacggctccattcttctggacgacgtcggcagcttcgtcggcgagaagggcgccggccccaacgtcaactccgtccgcggcttcgacgtcatcgaccagatcaagaccaacgtcgagctcatctgccccggcgttgtctcctgcgccgacatcgtcgccctcgccgcacgattcggcaccttcttgctgggaggaccaagttgggcggtgccgctcggccggcgcgactcgacgacggcgagcctgacgctagccaacagcgacctcccgtcgccggcctctggcctcgccaccctcgtcacggcattcggcaacaagggcctgagcccgggggacctgacggcgctgtccggcgcgcacaccatcggcttctcgcagtgccagaacttccgcggccacatctacaacgacaccgacatcgacgcggcgttcgccgccctgcgccagcgcagctgccccgcggcgccgggcaccggcggcgacaccaacctggcggcgctcgacgtgcagacgcagctcgtcttcgacaacgcctactaccgcaacctgctggccaaacgcggcctgctgcactccgaccaggagctcttcaacggcggctcccaggacgcgctggtgcggcagtacagctccaacccggcactcttcgcctcagacttcgccgccgccatgataaagatgggcaacatcagcccgctcaccggaaccgctggccagatcagggcaaactgtagggtggtcaacagcagctga

SEQ ID NO: 17349 - protein, 326 aa, Sorghum bicolor
  misc_feature: Useful for making plants with altered cell wall content and/or composition
  misc_feature: Functional homolog of the protein sequence given in SEQ ID NO 13605
  misc_feature: Useful for making plants with altered carbohydrate content
  misc_feature: Functional homolog of the protein sequence given in SEQ ID NO 13606
  misc_feature: Useful for making plants with modulated oxidative stress sensitivity
  misc_feature: Functional homolog of the protein sequence given in SEQ ID NO 13607
  misc_feature: Ceres ANNOT ID no. 8672588
  misc_feature (28)..(324): SWISSPROT Homolog: EC 1.11.1.7 Peroxidase
  misc_feature (45)..(288): Pfam ID: peroxidase Pfam Description: Peroxidase
MASFRTWHCLLATSCLFLLLLASPAHGQLSPSFYATSCPTLGLIVRTTMIKALLAERRMGASLVRLFFHDCFVQGCDGSILLDDVGSFVGEKGAGPNVNSVRGFDVIDQIKTNVELICPGVVSCADIVALAARFGTFLLGGPSWAVPLGRRDSTTASLTLANSDLPSPASGLATLVTAFGNKGLSPGDLTALSGAHTIGFSQCQNFRGHIYNDTDIDAAFAALRQRSCPAAPGTGGDTNLAALDVQTQLVFDNAYYRNLLAKRGLLHSDQELFNGGSQDALVRQYSSNPALFASDFAAAMIKMGNISPLTGTAGQIRANCRVVNSS

SEQ ID NO: 17350 - DNA, 966 bp, Sorghum bicolor
  misc_feature: Ceres ANNOT ID no. 8672589
  misc_feature: Encodes the peptide sequence at SEQ ID NO 17351
atggcttgcagcttcagggccttgttgcattgcttgcttgccttgtccctctgctccacggcatatggtgggcagctcacgccgacgttctacgcactgagctgcccggcgcttgagcccatcgtgcgcaccaccatgaccaaggccatcatcaacgaccgtcggatgggcgcctccctcctcaggctcttcttccatgactgcttcgtcctgggttgcgatggctcaattctcctggatgacgcggggagcttcgtcggcgagaagaccgctctccccaacgcctccatccgcggctacgaggtcatcgaccagatcaaggctaacgtcgaggccgtctgccccggcgtggtctcttgcgccgacatcgtcgccctcgccgcgcgggacggcaccgtcctgctcggcggcccaacctgggcggtcccgctgggtcggcgcgactcaacaacggcgagcctgagccaggcgaacagcgacattccggcgccgacgctgaacctggactcgcttatcttggcgttcggcaagaagggcctgagcccggcggacatgacggcactctccggcgcgcataccatcggctacgcggagtgcgaggacttccgcggccacatctacaacgacaccaacgtcgacccggcgttcgccgccctgcggcagcgcaactgccccgccgagtcgggctccggcgacaccaacctcgcgccgctcgacgtgcagacgcggtacgtcttcgacaacgcctactaccgcaacctgatggtcaggcaaggtctgctgcactcggaccaggagctcttcaacggcgggtcgcaggacgcgctggtgcagcagtacagcaccgacccggggctcttcgcgtcacactttgttgccgctatgataaagatggggaacatcggaacgctcaccggaagccaaggacagatcagggccgactgcagggtcgtcaacagtcgttag

SEQ ID NO: 17351 - protein, 321 aa, Sorghum bicolor
  misc_feature: Useful for making plants with altered cell wall content and/or composition
  misc_feature: Functional homolog of the protein sequence given in SEQ ID NO 13605
  misc_feature: Useful for making plants with altered carbohydrate content
  misc_feature: Functional homolog of the protein sequence given in SEQ ID NO 13662
  misc_feature: Useful for making plants with modulated oxidative stress sensitivity
  misc_feature: Functional homolog of the protein sequence given in SEQ ID NO 13607
  misc_feature: Ceres ANNOT ID no. 8672589
  misc_feature (25)..(319): SWISSPROT Homolog: EC 1.11.1.7 Peroxidase
  misc_feature (42)..(283): Pfam ID: peroxidase Pfam Description: Peroxidase
MACSFRALLHCLLALSLCSTAYGGQLTPTFYALSCPALEPIVRTTMTKAIINDRRMGASLLRLFFHDCFVLGCDGSILLDDAGSFVGEKTALPNASIRGYEVIDQIKANVEAVCPGVVSCADIVALAARDGTVLLGGPTWAVPLGRRDSTTASLSQANSDIPAPTLNLDSLILAFGKKGLSPADMTALSGAHTIGYAECEDFRGHIYNDTNVDPAFAALRQRNCPAESGSGDTNLAPLDVQTRYVFDNAYYRNLMVRQGLLHSDQELFNGGSQDALVQQYSTDPGLFASHFVAAMIKMGNIGTLTGSQGQIRADCRVVNSR

SEQ ID NO: 17352 - DNA, 966 bp, Sorghum bicolor
  misc_feature: Ceres ANNOT ID no. 8672593
  misc_feature: Encodes the peptide sequence at SEQ ID NO 17353
atggctgcttcatcatccactaccaccaccggcggccattatatgttccttgtcgcgctctctcttctctccttcgccgcctacgggcagctctcggaacaattctacgccgcaaagtgcccgtcgttggatcaaatcatcaaagcagaggtggatcgtaccttgtccgtggatcgacggatgggcgcctccctcctcaggctcttcttccatgactgctttgttcagggctgcgacgcctcggttcttctggacgacgacgcggcaaagtcgatcacaagcgagaagacggccggcccgaacgacaagtccctacgcggcttcgacgtgatcgaccggatcaaggatcaagtcgaggcagcctgcggcgtccccggcgcccgcgtcggcgttgtctcctgcgcagacatcctcgccctcgttaccaagcaagccgtcatctacctcgctggacaaccaggatgggctggatggtcgttgttactcggccggcgtgactccacgacggcaaacaaggatgaagcaaacaccgtcctcccgtcgccgaactcagagctcccgacgctcatcgaggcattcaagaacaagaatttcaccggcagagagctggtagcgctgtccggcgcgcacaccatcggcgtggcgcagtgcggcaacgtcgacgaaacccagcggcagaaatgcatcgacgccaataacaacaacaccttcccgctcgacgacgagacgcctgtggacttcgacaagggctactacgataacctgctgcgggacaaaggcttgctgcactcggaccgcgtgctcgtggacagcaacgatctcaagctcctcgtgctgcagtacgcgaggagaaaggaccttttcttcaaggacttcgccaacgcgatggaaaagatgtcgttgatgagcgtgctcaccggaactaatggcgagatcaggctcaactgcagtagggttaactattaa

SEQ ID NO: 17353 - protein, 321 aa, Sorghum bicolor
  misc_feature: Useful for making plants with altered carbohydrate content
  misc_feature: Functional homolog of the protein sequence given in SEQ ID NO 13713
  misc_feature: Useful for making plants with altered cell wall content and/or composition
  misc_feature: Functional homolog of the protein sequence given in SEQ ID NO 13958
  misc_feature: Ceres ANNOT ID no. 8672593
  misc_feature (30)..(320): SWISSPROT Homolog: EC 1.11.1.7 Peroxidase
  misc_feature (47)..(284): Pfam ID: peroxidase Pfam Description: Peroxidase
MAASSSTTTTGGHYMFLVALSLLSFAAYGQLSEQFYAAKCPSLDQIIKAEVDRTLSVDRRMGASLLRLFFHDCFVQGCDASVLLDDDAAKSITSEKTAGPNDKSLRGFDVIDRIKDQVEAACGVPGARVGVVSCADILALVTKQAVIYLAGQPGWAGWSLLLGRRDSTTANKDEANTVLPSPNSELPTLIEAFKNKNFTGRELVALSGAHTIGVAQCGNVDETQRQKCIDANNNNTFPLDDETPVDFDKGYYDNLLRDKGLLHSDRVLVDSNDLKLLVLQYARRKDLFFKDFANAMEKMSLMSVLTGTNGEIRLNCSRVNY

SEQ ID NO: 17354 - DNA, 1266 bp, Sorghum bicolor
  misc_feature: Ceres ANNOT ID no. 8672572
  misc_feature: Encodes the peptide sequence at SEQ ID NO 17355
atggcgatgctctcccgcgcggcctcctccgcggcccggcgcccggcactgctgccgccgaggctgctggcggcgagggcgatggcgtcgtcgctcttcggccacgtcgagccggcgcccaaggacccaatcctcggcgtcaccgaggctttcctcgccgacccctcgcccgacaaagtcaacgtcggcgtcggcgcctaccgggacgacaacggccagcccgtcgtgctcagctgcgtgcgcgaggccgaggagtaccttccgatgggaggcagtatcaagatgattgaagagtcactgaagctggcgtacggtgaggattctggcttcatcaaagataagaggatagcagcggtgcaggctctttcaggcactggtgcctgccggctctttgctgatttccagaagcgttttttgccggattcgcagatctacataccaacaccaacgtggtccaaccatcacaatatctggagggatgctcacgtgccacagaagacattcacatactaccatccagagtcaagagggcttgatttttcaggattgatgaatgacatcaagaatgctccagacggttcattctttttgcttcatgcatgtgcccataatcctactggtgtagatcctacagaggaacaatggagagaaatatcccatcagttcaaggtgaaaaaacatttcccattctttgacatggcataccaagggtttgccagtggtgatccagagagagatgccaaggcaatccgaattttccttgaagatggacaccaaattggatgtgctcagtcatacgcaaagaacatgggactttatggacagagagcgggatgcctgagtattctgtgtgaggatgagatgcaagcagttgctgtcaagagccaactgcaacagatcgcgagaccaatgtacagcaacccacctgttcatggtgcactggttgtttctataatcctcaatgatccagaattgaagagtttatggttaaaagaagtcaagggtatggctgatcgtatcattggcatgcggaaggcacttaaggaaaatcttataaagctaggttcacctttgtcatgggatcatatcactaatcagattggaatgttctgctacagtggtatgacacctgaacaagttgaccgtttaacaaatgaataccatatttacatgacccgcaatgggaggataagcatggctggtgtaacaacaggaaatgttgcttacttggcaaatgcgattcatgaggttaccaaaccaaactga

SEQ ID NO: 17355 - protein, 421 aa, Sorghum bicolor
  misc_feature: Useful for making plants with modulated nitrogen use efficiency
  misc_feature: Functional homolog of the protein sequence given in SEQ ID NO 13663
  misc_feature: Ceres ANNOT ID no. 8672572
  misc_feature (36)..(419): SWISSPROT Homolog: EC 2.6.1.1 Aspartate transaminase
  misc_feature (57)..(414): Pfam ID: Aminotran_1_2 Pfam Description: Aminotransferase class I and II
MAMLSRAASSAARRPALLPPRLLAARAMASSLFGHVEPAPKDPILGVTEAFLADPSPDKVNVGVGAYRDDNGQPVVLSCVREAEEYLPMGGSIKMIEESLKLAYGEDSGFIKDKRIAAVQALSGTGACRLFADFQKRFLPDSQIYIPTPTWSNHHNIWRDAHVPQKTFTYYHPESRGLDFSGLMNDIKNAPDGSFFLLHACAHNPTGVDPTEEQWREISHQFKVKKHFPFFDMAYQGFASGDPERDAKAIRIFLEDGHQIGCAQSYAKNMGLYGQRAGCLSILCEDEMQAVAVKSQLQQIARPMYSNPPVHGALVVSIILNDPELKSLWLKEVKGMADRIIGMRKALKENLIKLGSPLSWDHITNQIGMFCYSGMTPEQVDRLTNEYHIYMTRNGRISMAGVTTGNVAYLANAIHEVTKPN

SEQ ID NO: 17356 - DNA, 201 bp, Sorghum bicolor
  misc_feature: Ceres ANNOT ID no. 8672578
  misc_feature: Encodes the peptide sequence at SEQ ID NO 17357
atggcaaaaacaatttcgtgcttgaacaacacgtacctgagggcgctccccggcgcggcagagaggctagcgctgtgcaaggccgacctgctcgactacgacgcactgcggtcggccgtcgccggctgccacgacgtcttccacaccgcgtcgcccgtcaccgacgatccggtacgtatacgtgtaacctatagtaattga

SEQ ID NO: 17357 - protein, 66 aa, Sorghum bicolor
  misc_feature: Useful for making plants with altered carbohydrate content
  misc_feature: Functional homolog of the protein sequence given in SEQ ID NO 14118
  misc_feature: Useful for making plants with altered cell wall content and/or composition
  misc_feature: Useful for making plants with altered lignin content
  misc_feature: Functional homolog of the protein sequence given in SEQ ID NO 13818
  misc_feature: Ceres ANNOT ID no. 8672578
  misc_feature (13)..(56): SWISSPROT Homolog: EC 1.1.1.219 Dihydrokaempferol 4-reductase
MAKTISCLNNTYLRALPGAAERLALCKADLLDYDALRSAVAGCHDVFHTASPVTDDPVRIRVTYSN

SEQ ID NO: 17358 - DNA, 1254 bp, Sorghum bicolor
  misc_feature: Ceres ANNOT ID no. 8672574
  misc_feature: Encodes the peptide sequence at SEQ ID NO 17359
atggccgcgccgccgggtggggcccacgccggcgccggcgccgcggacccgatgcaggtggaccagccgctccctggcgccgccgccgccgccgccgcagccgcagcacacggccccgccgacgccaagcatgctggttctatgattgaagggagtgatccagtcacgggtcatataatctcgacaaccattggagggaagaatggagagcctaaaaggactatcagctacatggcagagagagttgtgggaactggatcatttggaatcgtcttccaggcaaaatgtctggagactggtgagactgttgccattaagaaggttttgcaggacaagcgctacaagaatagggagctgcaaatcatgcgatccatggatcactgcaatgttgtttccttgaagcattgcttcttctctaccacaagcagagatgaacttttccttaacttagtgatggagtttgttcctgagtcattatatcgtgtgttgaagcattacagcaatatgaaccagaggatgccgcttatttatgttaaattatatacctaccagatatttcgaggtttagcctatattcacacagtacctggagtttgccacagggatgtgaaaccacagaatcttttggttgatccgctgactcaccaagtgaagatatgtgactttgggagtgccaaaatgttggtcaaaggtgaagcaaacatatcatatatatgctcacgttattaccgtgctccagagctcatatttggggcaaccgagtacacaacgtcaattgatatttggtcagctggatgtgttcttgctgagctgcttcttggccagcctctcttccctggtgaaagtgcggtggatcagcttgttgagataataaaggttcttggtactccaacacgtgaggaaatccgatgtatgaatccgaactacaccgagttcagatttcctcagatcaaagcccacccatggcacaagattttccacaagcggatgcctccagaagctatagatctcgcttcacgtttgctccagtattcaccaaatctacgatgcactgctcttgaagcgtgtgcacacccattcttcgatgagttgcgagaaccacatgcaaggttgccgaatggacggccatttcctccgctgttcaactttaaacaggaactagcaaatgcctccccagagctcatcaacaggttgatcccagaccatgctaggcggcatcttgggctcactttattgcccactaccggaccatag

SEQ ID NO: 17359 - protein, 417 aa, Sorghum bicolor
  misc_feature: Useful for making plants with modulated biomass
  misc_feature: Functional homolog of the protein sequence given in SEQ ID NO 14074
  misc_feature: Useful for making plants with modulated water use efficiency
  misc_feature: Functional homolog of the protein sequence given in SEQ ID NO 14073
  misc_feature: Ceres ANNOT ID no. 8672574
  misc_feature (47)..(405): SWISSPROT Homolog: EC 2.7.11.1 Non-specific serine/threonine protein kinase
  misc_feature (77)..(361): Pfam ID: Pkinase Pfam Description: Protein kinase domain
MAAPPGGAHAGAGAADPMQVDQPLPGAAAAAAAAAAHGPADAKHAGSMIEGSDPVTGHIISTTIGGKNGEPKRTISYMAERVVGTGSFGIVFQAKCLETGETVAIKKVLQDKRYKNRELQIMRSMDHCNVVSLKHCFFSTTSRDELFLNLVMEFVPESLYRVLKHYSNMNQRMPLIYVKLYTYQIFRGLAYIHTVPGVCHRDVKPQNLLVDPLTHQVKICDFGSAKMLVKGEANISYICSRYYRAPELIFGATEYTTSIDIWSAGCVLAELLLGQPLFPGESAVDQLVEIIKVLGTPTREEIRCMNPNYTEFRFPQIKAHPWHKIFHKRMPPEAIDLASRLLQYSPNLRCTALEACAHPFFDELREPHARLPNGRPFPPLFNFKQELANASPELINRLIPDHARRHLGLTLLPTTGP

SEQ ID NO: 17360 - DNA, 630 bp, Sorghum bicolor
  misc_feature: Ceres ANNOT ID no. 8672606
  misc_feature: Encodes the peptide sequence at SEQ ID NO 17361
atgcccaagtggaacccatcaccggcaactacgcgcccgtcgaggagtgcctgcccaacaacgagctcctggtatgtccgcaacggcgcgaacccgctccacaccccacgcacggggcaccacctcttcgacggcgacaacatgctccacgtcgtgcggctccgtgccgggcgcgctgagtcgtacgcatgccgcttcatggagacggagcacctcagggcaggagcgcgccatcgggaaggccgtcttccccaaggccatcgtgcacgctccctctgcggcatgctcgacgcatctcaggggatcggggtcgctaacgctgggctggtgtaccataacaaccgcctcctcgccatgttcgaggacgacctcccctaccacgtgcgcatcatcaccgacggtgacctcaagaccctcgacaccaccatgatcgctcacccgaagctggacctggccactggcgagctcttcacgctcagctacaatgtcgtcaccaagtcgttcctcaagtacttctacttcaccgccgacggccgcaagtcccctgacgtggagatccccgtcgacgcgcccaccatgatgcatgacttcgccgtcaccgagaaccacaccatcatcctagaccagtag

SEQ ID NO: 17361 - protein, 209 aa, Sorghum bicolor
  misc_feature: Useful for making plants with modulated water use efficiency
  misc_feature: Functional homolog of the protein sequence given in SEQ ID NO 14275
  misc_feature: The sequence is a functional homolog of SEQ ID NO 6 in US patent 7049487
  misc_feature: Useful for making plants with modulated drought sensitivity
  misc_feature: Ceres ANNOT ID no. 8672606
  misc_feature (89)..(209): SWISSPROT Homolog: EC 1.13.11.51 9-cis-epoxycarotenoid dioxygenase
  misc_feature (9)..(209): Pfam ID: RPE65 Pfam Description: Retinal pigment epithelial membrane protein
MPKWNPSPATTRPSRSACPTTSSWYVRNGANPLHTPRTGHHLFDGDNMLHVVRLRAGRAESYACRFMETEHLRAGARHREGRLPQGHRARSLCGMLDASQGIGVANAGLVYHNNRLLAMFEDDLPYHVRIITDGDLKTLDTTMIAHPKLDLATGELFTLSYNVVTKSFLKYFYFTADGRKSPDVEIPVDAPTMMHDFAVTENHTIILDQ

SEQ ID NO: 17362 - DNA, 1107 bp, Sorghum bicolor
  misc_feature: Ceres ANNOT ID no. 8672617
  misc_feature: Encodes the peptide sequence at SEQ ID NO 17363
atggtggcggtgcaggctgcggcgacggcggaggcgccgatccgggccgaggccaaggtcgcggtggcgccggagacggatgcggaggccgaggtggaggaggtgaagaagggcgatgccgccgttgccgccgccgccccgggagagacggaggaggagccggtgtacagcagcgacttgaggaagctggaggagctcatgtccaagctcaacccttgcgcgcaggagttcgtgccgtcgtcgcgccgcacggctccagtcgccgtgccggcagcggcagcaaagccggcggcgggaggaggaggggtgctctccgccgacgcgcctgtgttcgtgtccgccgccgagtactacggcgctgccggcgggcgcctggagataagcggcggcggcgccggcgggggcagggactctagcagcgacggatccagcaacggcggcggcgccggacacccactgaatcgccggagaaggaacagcttcaaccaggggaggcggagggtgggaggccggccccgacgggctgatagggaggacagtgtgcggcggaccgtctatgtctctgacattgatcagaatgtgactgagcagaagctcgctgaagtgttttctaactgcgggcaagtggtagattgtcgtatctgtggtgacccccattctgtcctgcgctttgcgttcattgagtttgctgatgatgctggtgcaagagcagcactaacacttggaggaaccatgcttggctattatcctgttagagttttgccttctaaaacagcaattctacctgttaatcctaaatttcttcctcgaactgaagacgagaaagaaatggtatcgaggactgtatattgtactaacatagacaagaaggttacagaggatgatgtaaagggtttcttccagcaatcatgcggaaaggtttctcggctgaggctccttggtgactatgtacactccacatgcattgcttttgttgagtttgctgaagctgaaagtgcaattatggccttgaacttcagtggtgtggtccttggtttactccctatcagggtgagcccttccaagacaccagtacgtccgcggtctcctcgtgtgatgtccaactga

SEQ ID NO: 17363 - protein, 368 aa, Sorghum bicolor
  misc_feature: The sequence is a functional homolog of SEQ ID NO 1301 in the 10/666,642 US patent application
  misc_feature: Ceres ANNOT ID no. 8672617
  misc_feature (185)..(253): Pfam ID: RRM_1 Pfam Description: RNA recognition motif. (a.k.a. RRM, RBD, or RNP domain)
  misc_feature (282)..(351): Pfam ID: RRM_1 Pfam Description: RNA recognition motif. (a.k.a. RRM, RBD, or RNP domain)
  misc_feature (65)..(82): Pfam ID: PAM2 Pfam Description: Ataxin-2 C-terminal region
MVAVQAAATAEAPIRAEAKVAVAPETDAEAEVEEVKKGDAAVAAAAPGETEEEPVYSSDLRKLEELMSKLNPCAQEFVPSSRRTAPVAVPAAAAKPAAGGGGVLSADAPVFVSAAEYYGAAGGRLEISGGGAGGGRDSSSDGSSNGGGAGHPLNRRRRNSFNQGRRRVGGRPRRADREDSVRRTVYVSDIDQNVTEQKLAEVFSNCGQVVDCRICGDPHSVLRFAFIEFADDAGARAALTLGGTMLGYYPVRVLPSKTAILPVNPKFLPRTEDEKEMVSRTVYCTNIDKKVTEDDVKGFFQQSCGKVSRLRLLGDYVHSTCIAFVEFAEAESAIMALNFSGVVLGLLPIRVSPSKTPVRPRSPRVMSN

SEQ ID NO: 17364 - DNA, 2142 bp, Sorghum bicolor
  misc_feature: Ceres ANNOT ID no. 8672625
  misc_feature: Encodes the peptide sequence at SEQ ID NO 17365
atgactcaagctcattcaaagtcatgcttccaacaattttcagatggagttcaagttaagaggaacagtggcagcttcaccattgagctcctgccatctcttggtgcaacaataaatcaatctaacaagttgcagaagttcatcatatctccctatgatccccgttatagatactgggagttgttccttatagtcctagtcatttactctgcctggatttgcccgtttgaactagcatttttgagggacttgtcctctaagcttctgctagttgagaacattgtcaatagcttcttcgctattgatattgttttgacattctttgtagcttatgtcgacagcaaaacacatcttcttgtggatgatcgaaagagaattgcagtaaggtacctatcaacctggttcatctttgatgtatgttcaacagctccatttcagccaatcagccttctttttacacacaaggggaatgaccttgcttttaagatactcaatatgttgaggctatggcgtcttcaccgagtcagctcgctgtttgcaagactggagaaggatataagattcaactatttctggactaggtgctcaaaacttatttctgttactctgtttgcggtgcattgtgcgggatgtttcaactatatgattgccgacagatatcctgatccagagagaacatggataggtgctgttatgcctaccttcagatcagagagcttatggactagatatgtaactgccctttactggtcgatcacaacactgacaacaacaggttatggggacctacatgctgagaacccaagagagatgctgtttgatatctgctatatgctgtttaatctgggcctgacagcttatcttattggtaatatgaccaacctggttgttcatgggaccagccgcacccagaattttagggactcaatccaatcggcatcggaatttgcggcacgaaatcagttgcccgagaagataaagcagcaaatgttgtcgcacttctgcctacagttcaagacagaggggctcaaccagcaagctatgctaaattgtctcccaaaaggaattcggtcaagcatagcatacaacttattttttacaatcctacaacaagcctacctctttcatggagtatccaataatttcattgcagaactggctgagtatttcccaccaaaggaagacataatgttgcaaaatgagggggcagcagatatctacgtaatagtttcaggagtagtggtgtatgaaaaagttgaggagggagacatgttcggagaggttggtgctctctgtgacataccccagccatttacttgccgcaccactaccctatcacagctcttgagaataaggaagataagactaacagagattatgcaagaacacagggaagacagcaatatactaatgaataatctatttcagaagctaaagctgcaggaaaatttaccagaattaaatcaactagatcgaagattcatgcacaagtatgagctattccatgctcctcgagaagcatggttgttacctcaaccttacctacaatacactgagcacaaatttgaagacattagtaagaaggtcccaacctttggtggagatcatggtccaacaaaactagcagcagaaacaatccaattgaggatgccacagcaaggaaacagtcatgaccatggcaattttggggcgacagatgggatggcaggcggagaagacaaatgtaatgaggttcacataaactgcgagaccaaaaaaggaaccaaagagttctgcgttcagataaaatccgaagattgtgatgcagcaagctattggcaaacaagtcatgaaacagtgaagctggggtcttcccacaatacattagatggcataactacgagagaaaatcaagatagtggtaacatacaatcatccaacaaaagagttacaattcacgcatatcctcataatgcaacaggttctttagtacagaatgggaagcttatcaatctgcctggttcactggaggagatttttgaaatcggaagtcagaagtttccaggtttccaccctacaaaattggtcagtagagactatgctgagatagatgacattagtgttattcgagatggtgaccacctattccttcttcagatgtag

SEQ ID NO: 17365 - protein, 713 aa, Sorghum bicolor
  misc_feature: The sequence is a functional homolog of SEQ ID NO 1838 in the 10/374,780 US patent application
  misc_feature: The sequence is a functional homolog of SEQ ID NO 3 in US patent 7235713
  misc_feature: Ceres ANNOT ID no. 8672625
  misc_feature (91)..(292): Pfam ID: Ion_trans Pfam Description: Ion transport protein
  misc_feature (201)..(298): Pfam ID: Ion_trans_2 Pfam Description: Ion channel
  misc_feature (387)..(465): Pfam ID: cNMP_binding Pfam Description: Cyclic nucleotide-binding domain
MTQAHSKSCFQQFSDGVQVKRNSGSFTIELLPSLGATINQSNKLQKFIISPYDPRYRYWELFLIVLVIYSAWICPFELAFLRDLSSKLLLVENIVNSFFAIDIVLTFFVAYVDSKTHLLVDDRKRIAVRYLSTWFIFDVCSTAPFQPISLLFTHKGNDLAFKILNMLRLWRLHRVSSLFARLEKDIRFNYFWTRCSKLISVTLFAVHCAGCFNYMIADRYPDPERTWIGAVMPTFRSESLWTRYVTALYWSITTLTTTGYGDLHAENPREMLFDICYMLFNLGLTAYLIGNMTNLVVHGTSRTQNFRDSIQSASEFAARNQLPEKIKQQMLSHFCLQFKTEGLNQQAMLNCLPKGIRSSIAYNLFFTILQQAYLFHGVSNNFIAELAEYFPPKEDIMLQNEGAADIYVIVSGVVVYEKVEEGDMFGEVGALCDIPQPFTCRTTTLSQLLRIRKIRLTEIMQEHREDSNILMNNLFQKLKLQENLPELNQLDRRFMHKYELFHAPREAWLLPQPYLQYTEHKFEDISKKVPTFGGDHGPTKLAAETIQLRMPQQGNSHDHGNFGATDGMAGGEDKCNEVHINCETKKGTKEFCVQIKSEDCDAASYWQTSHETVKLGSSHNTLDGITTRENQDSGNIQSSNKRVTIHAYPHNATGSLVQNGKLINLPGSLEEIFEIGSQKFPGFHPTKLVSRDYAEIDDISVIRDGDHLFLLQM

SEQ ID NO: 17366 - DNA, 3414 bp, Sorghum bicolor
  misc_feature: Ceres ANNOT ID no. 8672636
  misc_feature: Encodes the peptide sequence at SEQ ID NO 17367
atggcagcccaggcggcgacggctgaggcagggtcgagtgaggccgctgcggaggtagggtgcaggcccacagggcgtggagcggcggcggcgcccacaggggcggctcccaggcccgcgcctgccaggagggcaacagccacagcggcggcgcgtgtggtggcagcggggggaagggacccaccacctgcgcccaggaggaagaggatagagcggggagccaggagggccgacaatggccggcaacggcgacgcgccggcgtgcctggccgctggtcctggaagcccattcctggtgggtcttctgcgtccgtggcccctccgctcgcgaccagagcagtggcggcgcgctgggccgtggtagcgcccgcgccggcccccacactcgcggccagagcagcggcggcgctcgcgcccgcgctggggaaggccgcgcccgcaccggggaaggccgcgctcgcggccggagaggcggcggcggctgcgccaggagcgcgcggaggggctggagaacccgcgatctgcgcccagctgaagtttggaatgggtgggaaggagtttataaacaaacaagaacatcgatatgaggtgacaattctgctccaagatattgttgatattctactccaggatatgattgtggatcctcaaagtatactggatgtggttaattcttcagagagactgatctctgatgattatggagcattcaactactatgaaccagagctctttgcatcagtcagctcaataacaagcatccgatatccatatcctgatcagcaaaaagaacaggttaaacgcctctatcttttgcttagtacaaaagaaaaggctgcggaaataccatcaaatttagaggctcggcgacgcatttcatttttcgccacatctctgtttatggatatgcctgctgctcccaaagttcgcagtatgttgtcgtttagtgtaataactccatatttcatggaagaagtgaagttttcagatgaagaacttcattcaaatcaagatgaagcatccattctttcctacatgcaaaagatatatccagatcaatggaaaaactttttggaacgccttggttcaaaggtaacaaatgatgaaattagatgctgggcttccttccgtggccaaacactaagccgaactggtaatccagaaaaagcattgaaagtacaagctttgttagacaggacaaatgatcaagctgaactagaagcgcttgcagatatgaaattttcatatgtcatttcatgtcagaaatttggggaacaaaaaatcaaaggtgatccccatgctcaagacatcatagatctgatgatgaggtaccctgctctgagggttgcttatatcgaagagaaggaagtcatagtaaataactgttctcatacgattgaagggaaggaagtcatagtaaataactgtcctcataaggtttattcctctgtgttaataaaagcagagaataatttggaccaggagatttaccgtataaagctgcctggtccacctatcattggagaagggaagcctgaaaatcagaaccatgccattatcttcactcgtggagaagctctacaaacaattgatatgaatcaagacaattatctggaagaagcttacaaaatgaggaatgtccttcaagagtttgtaaggcgtcctagggaccaatctccaactatccttggattaagagagcatatcttcactggaagtgtttcatctcttgccggattcatgtcatatcaagaaacaagttttgttacaattggacaaagatttcttgctgaacccctcagggtacggtttcactatggtcatccagatatttttgatcggatatttcatttaacaagaggcggaataagtaaagcatctaaaactataaacttaagtgaggatgtctttgctgggtataattccatattgcgtcgtgggaatataatttacaacgaatacattcaagttggcaaagggcgtgatgttggtcttaaccagatatcaaaatttgaagctaaagtggcaaatggcaatagtgagcaaacaatcagtcgtgatattcaccggctaggtcggcgatttgatttcttcaggatgctttcatgctattttacaacagtgggattttactttaatagcctaatatcagttgttggtgtttatgttttcctctatggccagttgtacttggttctcagtggcctgcagagggctctgttacttgaagctcagactcagaatataaagtccttagaaacagcccttgcatctcagtcttttctccagctgggactgcttacaggattgcctatggtgatggaactaggtttggaaaagggttttcgtgcagctctgagtgattttatcctcatgcaattgcagttggcatcagttttcttcacattctctcttggaacaaaagcacactactacggccgtactattctccatgggggtgctaaataccggcctacagggcgtaaatttgtagttttccatgcaagctttactgagaactatcagttgtattctagaagtcatttcgtcaaaggatttgagttgatcttccttttgatagtctatcacatctttaggagatctcatgtgagcaatgtggtgcatgtgatgatcacatactcaacatggtttatggcagtggcttggctgtttactccttttctttttaacccggctggttttgcttggcaaaaaattgttgacgactgggctgactggaataggtggatgaagaatcaagggggcataggagtgcaaccagaaaagagctgggagtcatggtggaatggtgagaatgcacatctacgtcactcagtattgagttctagaattcttgaagtgctgctctcgctacgcttcttcatatatcaatatggccttgtctaccacctgaatatctctcaagacaacaagaatttccttgtctacctgctttcatgggtcgtaattattgccattattggttttgttaagcttgtcaattgtgctagccgccgtttgagcacaaagcaccaactcatcttcaggttcataaaacttttgacattcctctcagtggttacttccttgatccttctctattgtctctgccaattatctatcatggatctgatcatctgttgtctggcattcataccaactggctggggtctcctccttattgttcaagttttgagacccaaaatagagtactatgcaatatgggagcctattcaggtcatagctcacgcttacgactatggaatggggtctctgctcttcttcccgatcgctgtacttgcatggatgcctgttatctcggccattcaaactcgggttcttttcaacagagcattttcccggcaactacagatccagcctttcattgatgtaggcaaaactaaacggagatag

SEQ ID NO: 17367 - protein, 1137 aa, Sorghum bicolor
  misc_feature: Useful for making plants with altered cell wall content and/or composition
  misc_feature: Functional homolog of the protein sequence given in SEQ ID NO 14526
  misc_feature: Useful for making plants with altered carbohydrate content
  misc_feature: Functional homolog of the protein sequence given in SEQ ID NO 14257
  misc_feature: Ceres ANNOT ID no. 8672636
  misc_feature (371)..(1048): SWISSPROT Homolog: EC 2.4.1.34 1,3-beta-glucan synthase
  misc_feature (280)..(1014): Pfam ID: Glucan_synthase Pfam Description: 1,3-beta-glucan synthase component
MAAQAATAEAGSSEAAAEVGCRPTGRGAAAAPTGAAPRPAPARRATATAAARVVAAGGRDPPPAPRRKRIERGARRADNGRQRRRAGVPGRWSWKPIPGGSSASVAPPLATRAVAARWAVVAPAPAPTLAARAAAALAPALGKAAPAPGKAALAAGEAAAAAPGARGGAGEPAICAQLKFGMGGKEFINKQEHRYEVTILLQDIVDILLQDMIVDPQSILDVVNSSERLISDDYGAFNYYEPELFASVSSITSIRYPYPDQQKEQVKRLYLLLSTKEKAAEIPSNLEARRRISFFATSLFMDMPAAPKVRSMLSFSVITPYFMEEVKFSDEELHSNQDEASILSYMQKIYPDQWKNFLERLGSKVTNDEIRCWASFRGQTLSRTGNPEKALKVQALLDRTNDQAELEALADMKFSYVISCQKFGEQKIKGDPHAQDIIDLMMRYPALRVAYIEEKEVIVNNCSHTIEGKEVIVNNCPHKVYSSVLIKAENNLDQEIYRIKLPGPPIIGEGKPENQNHAIIFTRGEALQTIDMNQDNYLEEAYKMRNVLQEFVRRPRDQSPTILGLREHIFTGSVSSLAGFMSYQETSFVTIGQRFLAEPLRVRFHYGHPDIFDRIFHLTRGGISKASKTINLSEDVFAGYNSILRRGNIIYNEYIQVGKGRDVGLNQISKFEAKVANGNSEQTISRDIHRLGRRFDFFRMLSCYFTTVGFYFNSLISVVGVYVFLYGQLYLVLSGLQRALLLEAQTQNIKSLETALASQSFLQLGLLTGLPMVMELGLEKGFRAALSDFILMQLQLASVFFTFSLGTKAHYYGRTILHGGAKYRPTGRKFVVFHASFTENYQLYSRSHFVKGFELIFLLIVYHIFRRSHVSNVVHVMITYSTWFMAVAWLFTPFLFNPAGFAWQKIVDDWADWNRWMKNQGGIGVQPEKSWESWWNGENAHLRHSVLSSRILEVLLSLRFFIYQYGLVYHLNISQDNKNFLVYLLSWVVIIAIIGFVKLVNCASRRLSTKHQLIFRFIKLLTFLSVVTSLILLYCLCQLSIMDLIICCLAFIPTGWGLLLIVQVLRPKIEYYAIWEPIQVIAHAYDYGMGSLLFFPIAVLAWMPVISAIQTRVLFNRAFSRQLQIQPFIDVGKTKRR

SEQ ID NO: 17368 - DNA, 780 bp, Sorghum bicolor
  misc_feature: Ceres ANNOT ID no. 8672637
  misc_feature: Encodes the peptide sequence at SEQ ID NO 17369
atggcgcagttgccgccgagggcgccgagcgccttgccgcaggaccactggtcggcagcgggggcggagttcctgggcttcgccgcggcgaggcggggcgcgcaccgccgctcggcgagcgactcggccgcgttcctcgaggtcgtgcctatggacgacgtcatcggcggcggcggcagcggcagcgccggcgacgacttcgaccgcctcgacgacgagcagctcatgtccatgttctctgacgtcgacgcgccggccgtctccgacggcgccggggagagggccggggacgcggcgcagctcatggacgtcggggacgcggaggacggaatggccgcctcgtcgccggccggtgcgcgggcggctgcggacggcgtcgctgaccccaaaagggtcaagaggatattggcaaacaggcagtcagctcagaggtcacgagtcaggaagctgcagtacatctcggagcttgaacggagtgtcactagcctccagatggaggtgtcagcgctgtcccctcgcgtggccttcctggatcaccagcggtcactgctcaccgttggcaacagccatctcaagcaaagaatcgcggcgctcgcccaagacaagatcttcaaagacgctcatcaagaggcgctgaagaaggagatcgagcggctacgccaagtgtaccagcagcagcagatcaaggtggccaccaccggcggcgccgacatcgccgcggccgcctccatgcaggccaggcaagagctgctcgcctgcgaaggcgccgccattcgatag

SEQ ID NO: 17369 - protein, 259 aa, Sorghum bicolor
  misc_feature: The sequence is a functional homolog of SEQ ID NO 1363 in the 10/374,780 US patent application
  misc_feature: The sequence is a functional homolog of SEQ ID NO 1364 in the 10/374,780 US patent application
  misc_feature: The sequence is a functional homolog of SEQ ID NO 1483 in the 10/412,699 US patent application
  misc_feature: Ceres ANNOT ID no. 8672637
  misc_feature (126)..(180): Pfam ID: bZIP_2 Pfam Description: Basic region leucine zipper
MAQLPPRAPSALPQDHWSAAGAEFLGFAAARRGAHRRSASDSAAFLEVVPMDDVIGGGGSGSAGDDFDRLDDEQLMSMFSDVDAPAVSDGAGERAGDAAQLMDVGDAEDGMAASSPAGARAAADGVADPKRVKRILANRQSAQRSRVRKLQYISELERSVTSLQMEVSALSPRVAFLDHQRSLLTVGNSHLKQRIAALAQDKIFKDAHQEALKKEIERLRQVYQQQQIKVATTGGADIAAAASMQARQELLACEGAAIR

SEQ ID NO: 17370 - DNA, 1035 bp, Sorghum bicolor
  misc_feature: Ceres ANNOT ID no. 8672768
  misc_feature: Encodes the peptide sequence at SEQ ID NO 17371
atgcatccgagctgctctccactggcagtgcctccgggcttccggttccacccgacagacgaggagctcctctactactacctgaggaagaaggttgcttatgagcccatagatcttgatgtcataagggaggtggatctcaacaagcttgaaccatgggacctcaaagatcggtgcaggattgggacggagtctcaggatgagtggtatttcttcagccacaaggacaagaagtatcctacggggacacgaacgaaccgggcaacaacggctgggttttggaaggccaccgggcgggacaaggccatcttcctcggcaacgctgggaggaggatcggcctgaggaagacgctggtgttttacaccggcagggcaccccatggcaagaagaccgactggatcatgcacgagtaccgcctcaacgatgacagcgtcgaggtgccgattacggaggacggatgggtggtgtgtagggttttcaagaaaaagagcatccagaggggattcgacgaccatctgggcatggcggctgccggcgatgacgatgaactccattccttccactcgcctggcggcgtgatgactccggtggaccagaagcacggcctccaccacctcatgcacggcggagtccccgccttcgacccctccatgcaccttccacacctcacgagtgcggaggcaccgctgggcgccccggcatttacatccggcggcacatcggctgtggccatgaacctgctcgacatgggctgttcttcgcacaacatggtgatgaagatgacaacatcatgtggctctgccagtgacatgccgctgaacagcggtggtgagcgcttcggtgccgccgccgattggtcgatcctcgacaagctgctagcgtcacaccagaatcttgaccagctcttccattgcaagttcgggggaacaaccttagcagtgcctcgccattatcaacagcagcagatgcagcagcagcagcagcagctcatggaaatgagcgcgtcttcactgcataggctgcctctccattaa

SEQ ID NO: 17371 - protein, 344 aa, Sorghum bicolor
  misc_feature: Useful for making plants with altered carbohydrate content
  misc_feature: Functional homolog of the protein sequence given in SEQ ID NO 13622
  misc_feature: Useful for making plants with altered cell wall content and/or composition
  misc_feature: Functional homolog of the protein sequence given in SEQ ID NO 13703
  misc_feature: Useful for making plants with altered lignin content
  misc_feature: Functional homolog of the protein sequence given in SEQ ID NO 14527
  misc_feature: The sequence is a functional homolog of SEQ ID NO 1729 in the 11/479,226 US patent application
  misc_feature: The sequence is a functional homolog of SEQ ID NO 160 in the 10/666,642 US patent application
  misc_feature: The sequence is a functional homolog of SEQ ID NO 634 in the 10/412,699 US patent application
  misc_feature: The sequence is a functional homolog of SEQ ID NO 638 in the 11/435,388 US patent application
  misc_feature: The sequence is a functional homolog of SEQ ID NO 194 in the 10/374,780 US patent application
  misc_feature: The sequence is a functional homolog of SEQ ID NO 898 in the 10/225,066 US patent application
  misc_feature: Useful for biocontainment applications
  misc_feature: Functional homolog of the protein sequence given in SEQ ID NO 13623
  misc_feature: The sequence is a functional homolog of SEQ ID NO 1270 in the 10/374,780 US patent application
  misc_feature: The sequence is a functional homolog of SEQ ID NO 1423 in the 10/412,699 US patent application
  misc_feature: The sequence is a functional homolog of SEQ ID NO 898 in the 10/666,642 US patent application
  misc_feature: The sequence is a functional homolog of SEQ ID NO 132 in the 10/225,066 US patent application
  misc_feature: The sequence is a functional homolog of SEQ ID NO 1508 in the 10/666,642 US patent application
  misc_feature: The sequence is a functional homolog of SEQ ID NO 1924 in the 10/412,699 US patent application
  misc_feature: The sequence is a functional homolog of SEQ ID NO 2186 in the 10/374,780 US patent application
  misc_feature: The sequence is a functional homolog of SEQ ID NO 564 in the 11/435,388 US patent application
  misc_feature: The sequence is a functional homolog of SEQ ID NO 2346 in the 10/374,780 US patent application
  misc_feature: The sequence is a functional homolog of SEQ ID NO 238 in the 10/225,068 US patent application
  misc_feature: The sequence is a functional homolog of SEQ ID NO 338 in the 10/412,699 US patent application
  misc_feature: The sequence is a functional homolog of SEQ ID NO 774 in the 11/479,226 US patent application
  misc_feature: The sequence is a functional homolog of SEQ ID NO 1036 in the 10/225,066 US patent application
  misc_feature: The sequence is a functional homolog of SEQ ID NO 216 in the 10/666,642 US patent application
  misc_feature: The sequence is a functional homolog of SEQ ID NO 2608 in the 10/374,780 US patent application
  misc_feature: The sequence is a functional homolog of SEQ ID NO 658 in the 11/435,388 US patent application
  misc_feature: The sequence is a functional homolog of SEQ ID NO 880 in the 10/412,699 US patent application
  misc_feature: Useful for making plants with modulated water use efficiency
  misc_feature: Ceres ANNOT ID no. 8672768
  misc_feature (10)..(141): Pfam ID: NAM Pfam Description: No apical meristem (NAM) protein
MHPSCSPLAVPPGFRFHPTDEELLYYYLRKKVAYEPIDLDVIREVDLNKLEPWDLKDRCRIGTESQDEWYFFSHKDKKYPTGTRTNRATTAGFWKATGRDKAIFLGNAGRRIGLRKTLVFYTGRAPHGKKTDWIMHEYRLNDDSVEVPITEDGWVVCRVFKKKSIQRGFDDHLGMAAAGDDDELHSFHSPGGVMTPVDQKHGLHHLMHGGVPAFDPSMHLPHLTSAEAPLGAPAFTSGGTSAVAMNLLDMGCSSHNMVMKMTTSCGSASDMPLNSGGERFGAAADWSILDKLLASHQNLDQLFHCKFGGTTLAVPRHYQQQQMQQQQQQLMEMSASSLHRLPLH

SEQ ID NO: 17372 - DNA, 1224 bp, Sorghum bicolor
  misc_feature: Ceres ANNOT ID no. 8672805
  misc_feature: Encodes the peptide sequence at SEQ ID NO 17373
atggccgacggcggcagcggcagcggcgagccgggggccggcggtggatcggcgccggtgtgcagtttcgtgaggaaaccacccaagaacatgcggaagcgccccgccgcgcccgcgggatctgatgacgacgacgacggcggcggcagcggcgccctcgcggccgcgcgctccaagaaggggccgccgtcctctgccgctggcaagctcgttttctccaccgccgacgcctcctccgagccgcggcggttccagtacgagtcgtcccggacgatccagtccacggacagccgcgcaaccgccgtgctcgagacggagacggagttcgaccgcgactcccgcgccatccgcgagaaacagctcaagcaggccgaggagttcctcaagaagaatccctcctccggtgcctccgcctccgcctccggggaggtgtacaaggggatccacggctacacggactacaaggctgggttccggcgggagcacacggtgtctagcgagaaggccggcggttcgcacggcccgctccgggcggccgcgcacattcgcgtctcccagcggttcgactaccagcccgacatctgcaaggactacaaggagacggggtattgtggctacggcgattcctgcaagttcatgcacgaccgtggggattacaagtccgggtggcagctcgagagggaacatgaggaggcccagaaggcccgcaagcggcgcattgccatgggtggtggggatgggagtgatgatgaggcagcagatgaggacgaggatgatgaggaggcgctgccctttgcctgctacatttgccgacagccattcgttgatccagtggtcaccaaatgcaagcactacttttgtgaacattgcgctttgaagcatcactcgaagaacaagaagtgcttcgtctgcctcaaaccgacgctgggcatcttcaacgctgcacaggagatccgcaagaagatggcacaagacaagaagcaacaggaaaaaatgagaagaaaaggtagatcaggacccagttttgaacgattacatgaaggacattcagatccagaccctagtccctacccccagctagtccatcttgctgtcgtgttcatgtctcgtcgcctgccagttggttcctggcgatgggcaaaagctccaaagggcaccagaagatcttacctattatacagtagcaatcgtgtcgtgcagcctggctttgagaattcccggtag

SEQ ID NO: 17373 - protein, 407 aa, Sorghum bicolor
  misc_feature: Useful for making plants with altered alkaloid content
  misc_feature: Useful for making plants with altered terpenoid content
  misc_feature: Functional homolog of the protein sequence given in SEQ ID NO 14528
  misc_feature: The sequence is a functional homolog of SEQ ID NO 870 in the 11/435,388 US patent application
  misc_feature: Ceres ANNOT ID no. 8672805
  misc_feature (190)..(216): Pfam ID: zf-CCCH Pfam Description: Zinc finger C-x8-C-x5-C-x3-H type (and similar)
  misc_feature (267)..(304): Pfam ID: zf-C3HC4 Pfam Description: Zinc finger, C3HC4 type (RING finger)
MADGGSGSGEPGAGGGSAPVCSFVRKPPKNMRKRPAAPAGSDDDDDGGGSGALAAARSKKGPPSSAAGKLVFSTADASSEPRRFQYESSRTIQSTDSRATAVLETETEFDRDSRAIREKQLKQAEEFLKKNPSSGASASASGEVYKGIHGYTDYKAGFRREHTVSSEKAGGSHGPLRAAAHIRVSQRFDYQPDICKDYKETGYCGYGDSCKFMHDRGDYKSGWQLEREHEEAQKARKRRIAMGGGDGSDDEAADEDEDDEEALPFACYICRQPFVDPVVTKCKHYFCEHCALKHHSKNKKCFVCLKPTLGIFNAAQEIRKKMAQDKKQQEKMRRKGRSGPSFERLHEGHSDPDPSPYPQLVHLAVVFMSRRLPVGSWRWAKAPKGTRRSYLLYSSNRVVQPGFENSR

SEQ ID NO: 17374 - DNA, 1224 bp, Sorghum bicolor; identical to SEQ ID NO: 17372
  misc_feature: Ceres ANNOT ID no. 8672808
  misc_feature: Encodes the peptide sequence at SEQ ID NO 17375

SEQ ID NO: 17375 - protein, 407 aa, Sorghum bicolor; identical to SEQ ID NO: 17373
  misc_feature: Useful for making plants with altered alkaloid content
  misc_feature: Useful for making plants with altered terpenoid content
  misc_feature: Functional homolog of the protein sequence given in SEQ ID NO 14528
  misc_feature: The sequence is a functional homolog of SEQ ID NO 870 in the 11/435,388 US patent application
  misc_feature: Ceres ANNOT ID no. 8672808
  misc_feature (190)..(216): Pfam ID: zf-CCCH Pfam Description: Zinc finger C-x8-C-x5-C-x3-H type (and similar)
  misc_feature (267)..(304): Pfam ID: zf-C3HC4 Pfam Description: Zinc finger, C3HC4 type (RING finger)

SEQ ID NO: 17376 - DNA, 1347 bp, Sorghum bicolor
  misc_feature: Ceres ANNOT ID no. 8672842
  misc_feature: Encodes the peptide sequence at SEQ ID NO 17377
atggcggcgtcatggcgcggcccagtggtggccgtcctttgtgcggtcgtcgtcctccatgcagtggcggcggcggcggcggcggcgacgtcgtgcgccggcgtggccccggccaagcaccgtccggaggcgatatccatcacggacttcggcggcgtgggcgacgggcggacgctcaacacgtgggcgttccggaaggccgtgtaccgcatccagcaccagcgccggcgcggcggcacgacgctgcacgtccccgcgggcacctggctcaccggcagcttcaacctcaccagccacatgacgctcttcctcgccagaggcgccgtgctcaaagccacgcaggacacgaggaggtggccgctgatggagccgctgccgtcgtacggccggggcagggagctgccgggggcgaggtacgccagcttcatccacggcaacggcctccgcgacgtcgccattacaggtgacaagggagtgatcgatggccaaggtgaggtgtggtggaacatgtggaggcgaaggactcttgagcacaccaggccgaaccttgtggagttcatgcattccaccggcattcacatctccaacatcgtcctcaagaactcaccgttctggaacatccaccctgtttactgcgacaatgtggttgtaaccaacatgatgatcttggcgccacatgactccccaaacacagacggaatcgatccagattctagctccaacgtgtgcatcgaggactcgtacatatccaccggcgacgacctggtggcgatcaagagcgggtgggacgagtacgggatcgcgtacggccggccgagctccggcatcacgatccggcgggtgaggggctcgtcgccgttcagcggcatcgccatcggcagcgaggcctccggcggggtgcgcgacgtcctggtggaggactgcagcatcttcgacagcggctacggcatccacatcaagaccaacgtcgggcgcggaggctacatccggaacgtcactgtcgacaacgtgcgcatgagcggcgtgcgcatcagcggcgtccgcatcgccggcgacgtcggcgaccaccccgacgcgcacttcagccagctcgccgtgccgctggtggacgccgtgcgcatcagcaacgtgtggggcgtcaacgtccagcacccggggtcgctggagggcatcaggagctcgcccttcacgcggatctgcctctccaacgtcaagctcttcgggtggcggaagaacgacgcggcctggaggtgcagggacgtgcgcggtgccgcgctcggggtgcagccgtcgccctgcgccgagctcgccaccagcttcgcgtccgcaggctcgtcttgcagctaa

SEQ ID NO: 17377 - protein, 448 aa, Sorghum bicolor
  misc_feature: Useful for making plants with altered carbohydrate content
  misc_feature: Functional homolog of the protein sequence given in SEQ ID NO 14427
  misc_feature: Useful for making plants with altered cell wall content and/or composition
  misc_feature: Functional homolog of the protein sequence given in SEQ ID NO 14428
  misc_feature: Ceres ANNOT ID no. 8672842
  misc_feature (187)..(395): SWISSPROT Homolog: EC 3.2.1.15 Polygalacturonase
  misc_feature (42)..(201): SWISSPROT Homolog: EC 3.2.1.82 Exo-poly-alpha-galacturonosidase
  misc_feature (78)..(434): Pfam ID: Glyco_hydro_28 Pfam Description: Glycosyl hydrolases family 28
MAASWRGPVVAVLCAVVVLHAVAAAAAAATSCAGVAPAKHRPEAISITDFGGVGDGRTLNTWAFRKAVYRIQHQRRRGGTTLHVPAGTWLTGSFNLTSHMTLFLARGAVLKATQDTRRWPLMEPLPSYGRGRELPGARYASFIHGNGLRDVAITGDKGVIDGQGEVWWNMWRRRTLEHTRPNLVEFMHSTGIHISNIVLKNSPFWNIHPVYCDNVVVTNMMILAPHDSPNTDGIDPDSSSNVCIEDSYISTGDDLVAIKSGWDEYGIAYGRPSSGITIRRVRGSSPFSGIAIGSEASGGVRDVLVEDCSIFDSGYGIHIKTNVGRGGYIRNVTVDNVRMSGVRISGVRIAGDVGDHPDAHFSQLAVPLVDAVRISNVWGVNVQHPGSLEGIRSSPFTRICLSNVKLFGWRKNDAAWRCRDVRGAALGVQPSPCAELATSFASAGSSCS

SEQ ID NO: 17378 - DNA, 1179 bp, Sorghum bicolor
  misc_feature: Ceres ANNOT ID no. 8672897
  misc_feature: Encodes the peptide sequence at SEQ ID NO 17379
atggcggacggcctgtgcgagctcctggtcgacgaccactgcgagctccggcaccgcctgtcgggcgctgaggacctcttcagcatcatcgggactacgtggaaggagggcacgaaccgcgccggcggtgatggtgctggaggctgttcttctggggctatgcgggcatatagccagagctcccctgctggcgccgtgggggctaggccgtctgtgaactgccggaagcgcacgggcgacgaggagaaaggcagcggcggcggcggcgctcccgtgcagaagaagcacaagggttcagcggtgacagatgatgcagccgctgacgagggggaggcgaagatgtcacacatcacggtggagcgcaaccggaggaagcagatgaacgagcacctcaccgtgctacgctcgctcatgccctgcttctacgtcaagaggggagaccaagcgtccatcataggaggggtggtggactacatcaaggagcttcagcaggtgctgcgttcgctggagaccaagaagcaccgcaaggcatacgcggagcaggtgctgagccctcggcctgcaggtggtagcgtgtcggcagccagcccgcggcctctcgccgccgtcgtcaagtccacgccgccgctcagcccgcgtgtcgcggtgcccataagcccccggacgccgaccccgggcagcccgtacaagcctgctgctgctgcatccggcgcggctggaacagctggaagctgcaggctcccatacccgcctgccgctgccgcctacatggcggcggcgtcaccggcgataacgccaacgtcgtcgtcgtcgtcctactcgctcgatcagcagcagcagcagcagcactactccatgcagacgacgacgacgacgtacctgccgaccctagacagcctcgtaaccgagctcgccgcgcaggcagcctgcaggccagcggcggccggcctcaacctccccgacgtgaaggtggagtttgctgggcccaacctggtgctcaagacggtgtctcaccggtcgccggggcaggcgctcaaaatcatcgccgcactcgagtctctgtcgctggagatccttcacgtcagcgtcagcaccgtggacgacaccatggtgcactccttcaccatcaagataccactcttagttatagcaataggtatatggagataccacttttag

SEQ ID NO: 17379 - protein, 392 aa, Sorghum bicolor
  misc_feature: The sequence is a functional homolog of SEQ ID NO 1504 in the 10/374,780 US patent application
  misc_feature: Ceres ANNOT ID no. 8672897
  misc_feature (112)..(163): Pfam ID: HLH Pfam Description: Helix-loop-helix DNA-binding domain
MADGLCELLVDDHCELRHRLSGAEDLFSIIGTTWKEGTNRAGGDGAGGCSSGAMRAYSQSSPAGAVGARPSVNCRKRTGDEEKGSGGGGAPVQKKHKGSAVTDDAAADEGEAKMSHITVERNRRKQMNEHLTVLRSLMPCFYVKRGDQASIIGGVVDYIKELQQVLRSLETKKHRKAYAEQVLSPRPAGGSVSAASPRPLAAVVKSTPPLSPRVAVPISPRTPTPGSPYKPAAAASGAAGTAGSCRLPYPPAAAAYMAAASPAITPTSSSSSYSLDQQQQQQHYSMQTTTTTYLPTLDSLVTELAAQAACRPAAAGLNLPDVKVEFAGPNLVLKTVSHRSPGQALKIIAALESLSLEILHVSVSTVDDTMVHSFTIKIPLLVIAIGIWRYHF

SEQ ID NO: 17380 - DNA, 300 bp, Sorghum bicolor
  misc_feature: Ceres ANNOT ID no. 8672946
  misc_feature: Encodes the peptide sequence at SEQ ID NO 17381
atgggctccctgggtcctagcgtcgtgaccctgcagcagcatcccaaggccggcaagcctccggcggcggcgggtggcggccaccatgagcagcagagcagcaactgcggcggcgggtcgtcgtcgtcgtcgttccggatgccgctgcactacccgcggtacaagaaggcggactacgaggcgatgccggagtggcgcgtcgactgcctcctccgcgagtacggcctccccgtcgccggcgacctccgcgagaagcgggagttcgccatgggcgccttcctctggcccgatcagtactga

SEQ ID NO: 17381 - protein, 99 aa, Sorghum bicolor
  misc_feature: Useful for making plants with modulated nitrogen use efficiency
  misc_feature: Functional homolog of the protein sequence given in SEQ ID NO 13496
  misc_feature: Ceres ANNOT ID no. 8672946
MGSLGPSVVTLQQHPKAGKPPAAAGGGHHEQQSSNCGGGSSSSSFRMPLHYPRYKKADYEAMPEWRVDCLLREYGLPVAGDLREKREFAMGAFLWPDQY

SEQ ID NO: 17382 - DNA, 222 bp, Sorghum bicolor
  misc_feature: Ceres ANNOT ID no. 8672987
  misc_feature: Encodes the peptide sequence at SEQ ID NO 17383
atggctgggatgagggctccgctcggcgtggtggcggtggccgccctcgtcgtcgccatcttcatgcccgccgccgccgcggcgcaggcaccggcgcccgcgcccaccagtgacggcacatcaatcgacctggggatcgcgtacatccttatgctggtggccctggtgctcacctacctgatccacccgctggacgcgtcctctccctacaagctcttgtaa

SEQ ID NO: 17383 - protein, 73 aa, Sorghum bicolor
  misc_feature: Useful for making plants with altered carbohydrate content
  misc_feature: Functional homolog of the protein sequence given in SEQ ID NO 14436
  misc_feature: Ceres ANNOT ID no. 8672987
MAGMRAPLGVVAVAALVVAIFMPAAAAAQAPAPAPTSDGTSIDLGIAYILMLVALVLTYLIHPLDASSPYKLL

SEQ ID NO: 17384 - DNA, 807 bp, Sorghum bicolor
  misc_feature: Ceres ANNOT ID no. 8673085
  misc_feature: Encodes the peptide sequence at SEQ ID NO 17385
atggctccagcacgagttcttggattcgtgtcgctcgcagtcgcctgcatgctggccatcatggccgccgctggtgacgccgccaccagcactccgtcgtctccgacgccgaccaccggatggctgaaggcgcatgccacgttctacggcggggccgatgcctcggacaccatgggaggggcgtgcgggtacgggaacctctactcccagggctacggcacgcggacggcggctctgagcacggtgctctttcaggatggggcctcatgcggccagtgctacaagattgcgtgcgaccgtaagaaagccgactccaggttctgcaagcccggcgtcacagtcaccgtcacggccaccaacttctgcccccccaactcggcgctgcccgagggtggctggtgcaatcagcagcgcccgcacttcgacatggcgcaaccggctttcgagaagatcggcgtctacaccggcggcatcatccccgtcatgtacaagagggttccttgtgtgaagcgaggtggggtgcggttcacaatcaatggtcacgactacttcaatctcgtgctcgtgaccaatgttgcaggagctggctccatcaagtcaatggacgtcaagacctccaactccaatagttggatatcaatggcacgcaactggggtgcgaactggcactctcttgctcaccttactggacagatgctctcatttagagtaacggacacggatggacaaactattgaattcacaaacgttgtgccacaaggatggaagtttggccaaacatttgcatccaagttacagttcaagtga

SEQ ID NO: 17385 - protein, 268 aa, Sorghum bicolor
  misc_feature: Useful for making plants with altered carbohydrate content
  misc_feature: Functional homolog of the protein sequence given in SEQ ID NO 13784
  misc_feature: Useful for making plants with altered cell wall content and/or composition
  misc_feature: Functional homolog of the protein sequence given in SEQ ID NO 14001
  misc_feature: Useful for making plants with altered lignin content
  misc_feature: Functional homolog of the protein sequence given in SEQ ID NO 12888
  misc_feature: Ceres ANNOT ID no. 8673085
  misc_feature (174)..(252): Pfam ID: Pollen_allerg_1 Pfam Description: Pollen allergen
  misc_feature (76)..(163): Pfam ID: DPBB_1 Pfam Description: Rare lipoprotein A (RlpA)-like double-psi beta-barrel
MAPARVLGFVSLAVACMLAIMAAAGDAATSTPSSPTPTTGWLKAHATFYGGADASDTMGGACGYGNLYSQGYGTRTAALSTVLFQDGASCGQCYKIACDRKKADSRFCKPGVTVTVTATNFCPPNSALPEGGWCNQQRPHFDMAQPAFEKIGVYTGGIIPVMYKRVPCVKRGGVRFTINGHDYFNLVLVTNVAGAGSIKSMDVKTSNSNSWISMARNWGANWHSLAHLTGQMLSFRVTDTDGQTIEFTNVVPQGWKFGQTFASKLQFK

SEQ ID NO: 17386 - DNA, 774 bp, Sorghum bicolor
  misc_feature: Ceres ANNOT ID no. 8673082
  misc_feature: Encodes the peptide sequence at SEQ ID NO 17387
atggctggacctgcttacgcccgcgcggcgctcgcgctcgcgctcgccgtggccgcggccgccgcggccgacgcgcagacggagtggctcagggggcatgccacgttctacggcggcgcggacgcctccggcaccatggggggcgcgtgcgggtacggcgacctgttcgcgcaggggtacggcacgcggacgacggcgctgagcacggcgctcttctccggcggggcctcgtgcgggcagtgctacaagctggtgtgcgacaggaagacggacgcgacgtggtgcaagccgggggtgtccgtcaccgtcaccgccaccaacttctgcccgcccaactggaagctccccgacggcgggtggtgcaacgcggtgcgcgcccacttcgacatggcgcagccggcgtgggagaagatcggcgtcttcagcggcggcatcatccccgtcatctacaggagggtctcctgcgtcaggaagggcggggtgcgcttcaccgtcaacggccacgactacttcaacctcgtcctgctcaccaacgtcgccggcccgggatccatcagggccatggacgtcaggagctcgaaaccgccggtggactggatgcacatggcgcgcaactggggcgccaactggcactccctcagatacctcaccggccaggggctgtcgttcagggtcaccgtcacagacggccagaccatcgtcttcgccgacgtcgtgccgcccaagtggaggttcggccagtccttctccagcaagctgcagttcaagctgtga

SEQ ID NO: 17387 - protein, 257 aa, Sorghum bicolor
  misc_feature: Useful for making plants with altered carbohydrate content
  misc_feature: Functional homolog of the protein sequence given in SEQ ID NO 13784
  misc_feature: Useful for making plants with altered cell wall content and/or composition
  misc_feature: Functional homolog of the protein sequence given in SEQ ID NO 14001
  misc_feature: Useful for making plants with altered lignin content
  misc_feature: Functional homolog of the protein sequence given in SEQ ID NO 12888
  misc_feature: Ceres ANNOT ID no. 8673082
  misc_feature (36)..(196): SWISSPROT Homolog: EC 3.2.1.4 Cellulase
  misc_feature (161)..(240): Pfam ID: Pollen_allerg_1 Pfam Description: Pollen allergen
  misc_feature (64)..(150): Pfam ID: DPBB_1 Pfam Description: Rare lipoprotein A (RlpA)-like double-psi beta-barrel
MAGPAYARAALALALAVAAAAAADAQTEWLRGHATFYGGADASGTMGGACGYGDLFAQGYGTRTTALSTALFSGGASCGQCYKLVCDRKTDATWCKPGVSVTVTATNFCPPNWKLPDGGWCNAVRAHFDMAQPAWEKIGVFSGGIIPVIYRRVSCVRKGGVRFTVNGHDYFNLVLLTNVAGPGSIRAMDVRSSKPPVDWMHMARNWGANWHSLRYLTGQGLSFRVTVTDGQTIVFADVVPPKWRFGQSFSSKLQFKL

SEQ ID NO: 17388 - DNA, 642 bp, Sorghum bicolor
  misc_feature: Ceres ANNOT ID no. 8673093
  misc_feature: Encodes the peptide sequence at SEQ ID NO 17389
atggctccagctcgagttcttggattcgtgtcgctcgcagtcgcctgcatgctggccatcatggccgccgctggtgacgccgccaccagcactccgtcgtctccgacgccgaccaccggatggctgaaggcgcatgccacgttctacggcggcgccgatgcctctgacaccatggtcaccatcacggccaccaacttctgcccgcccaactcggcgctgcccgacggcggctggtgcaatcagcagcgcccgcacttcgacatggcgcagccggcgttcgagaagatcggcgtctacaccggcggcatcatccccgtcatgtacaagagggttccttgtgtgaagcgaggtggggtgcggttcacaatcaatggtcacgactacttcaatctcgtactcgtgaccaatgttgcaggagctggctccatcaagtcaatggacgtcaagacctccaactccaatagttggataccaatggcacgcaactggggtgcgaattggcactctcttacgcaccttactggacagatgctctcatttagagtaacggacacggatggacaaactattgaattcacaaacgttgtgccacaaggatggaagtttggccaaacgtttgcatccaagttacaattcaagtga

SEQ ID NO: 17389 - protein, 213 aa, Sorghum bicolor
  misc_feature: Useful for making plants with altered carbohydrate content
  misc_feature: Functional homolog of the protein sequence given in SEQ ID NO 13784
  misc_feature: Useful for making plants with altered cell wall content and/or composition
  misc_feature: Functional homolog of the protein sequence given in SEQ ID NO 14001
  misc_feature: Useful for making plants with altered lignin content
  misc_feature: Functional homolog of the protein sequence given in SEQ ID NO 12888
  misc_feature: Ceres ANNOT ID no. 8673093
  misc_feature (119)..(197): Pfam ID: Pollen_allerg_1 Pfam Description: Pollen allergen
  misc_feature (22)..(108): Pfam ID: DPBB_1 Pfam Description: Rare lipoprotein A (RlpA)-like double-psi beta-barrel
MAPARVLGFVSLAVACMLAIMAAAGDAATSTPSSPTPTTGWLKAHATFYGGADASDTMVTITATNFCPPNSALPDGGWCNQQRPHFDMAQPAFEKIGVYTGGIIPVMYKRVPCVKRGGVRFTINGHDYFNLVLVTNVAGAGSIKSMDVKTSNSNSWIPMARNWGANWHSLTHLTGQMLSFRVTDTDGQTIEFTNVVPQGWKFGQTFASKLQFK

SEQ ID NO: 17390 - DNA, 735 bp, Sorghum bicolor
  misc_feature: Ceres ANNOT ID no. 8673104
  misc_feature: Encodes the peptide sequence at SEQ ID NO 17391
atggctccagctagagttcttggattcgtgtcgctcgcagtagcctgcatgctggctatcatggccgccgctggtgacgccgccgccaccagcactccgtcgtctccgacgccgaccaccagatggctgaaggcgcatgccacgttctacggaggcgccgatgcctctgacaccatgggcggcgcgtgcgggtacggcaacctctactcccagggctacggcacgcggacagcggccctgagcacgactctatttcaggatggggcctcatgtggccagtgctataggatcgcgtgcgaccgcaagagagccgactccagcgctgcccaacggcggcagcgcccgcacttcgacatggcgcagccagcatttgaaaagactggcgtctacaccggcggcatcatccccgtcatgtacaagagggttccttgtgtgaagcgagatggagtgcggttcacaatcaacggtcacgactacttcaatctcgtgcttgtgaccaatgttgcaggtgctggctccatcaagtcaatggatgtcaagacctccaactccaatagttggataccaatggcacgcaactggggtgcgaactggcactctcttgcgcaccttactggacagatgctctcatttagagtaacagatacggatggacaaactattgaattcacaaatgttgtgccacaaggatggaagtttggccaaacgtttgcatccaagttacagttcaagtga

SEQ ID NO: 17391 - protein, 244 aa, Sorghum bicolor
  misc_feature: Useful for making plants with altered carbohydrate content
  misc_feature: Functional homolog of the protein sequence given in SEQ ID NO 13784
  misc_feature: Useful for making plants with altered cell wall content and/or composition
  misc_feature: Functional homolog of the protein sequence given in SEQ ID NO 14001
  misc_feature: Useful for making plants with altered lignin content
  misc_feature: Functional homolog of the protein sequence given in SEQ ID NO 12888
  misc_feature: Ceres ANNOT ID no. 8673104
  misc_feature (150)..(228): Pfam ID: Pollen_allerg_1 Pfam Description: Pollen allergen
  misc_feature (77)..(139): Pfam ID: DPBB_1 Pfam Description: Rare lipoprotein A (RlpA)-like double-psi beta-barrel
MAPARVLGFVSLAVACMLAIMAAAGDAAATSTPSSPTPTTRWLKAHATFYGGADASDTMGGACGYGNLYSQGYGTRTAALSTTLFQDGASCGQCYRIACDRKRADSSAAQRRQRPHFDMAQPAFEKTGVYTGGIIPVMYKRVPCVKRDGVRFTINGHDYFNLVLVTNVAGAGSIKSMDVKTSNSNSWIPMARNWGANWHSLAHLTGQMLSFRVTDTDGQTIEFTNVVPQGWKFGQTFASKLQFK

SEQ ID NO: 17392 - DNA, 606 bp, Sorghum bicolor
  misc_feature: Ceres ANNOT ID no. 8673188
  misc_feature: Encodes the peptide sequence at SEQ ID NO 17393
atggctctagctcgagttcttgcagtcctgttgcttgcagtcgcctgcatgctgaccgtggctgccgctgatgacgccactacgaggagtctttcgtctccggcaccgaccggaatggctcacgcgaataatgccacgttctacggcggcgccgatgaggtgcgtgtgggtatgggaacctgcactcgcagggctacgtacggcacaagaacgacggcgctgagcactgcgctcttcaacggtgcctcgtgtgagcagtgctacaagaccgcgtgtgaccgcaagagggccaacccaatgttttgcaaacctggcgtcacggtgaccatcacggccaccaacttatgcccgcccaactacgcactgcccggcaacaacggcggttggtgcaaccctcggccgcactttgacatggcccagccggcctgggagaagaccgtcgtctacaacggaggcatcatccaggtgctgactccatcaagtccatggatgtcaaaacctccaactccaatagctggataccaatggcgcgaaactgggatgctctcgtttagagtcaccaacatagacggacaaactattaaattcacaaacgtggtgccataa

SEQ ID NO: 17393 - protein, 201 aa, Sorghum bicolor
  misc_feature: Useful for making plants with altered carbohydrate content
  misc_feature: Functional homolog of the protein sequence given in SEQ ID NO 13784
  misc_feature: Useful for making plants with altered cell wall content and/or composition
  misc_feature: Useful for making plants with altered lignin content
  misc_feature: Functional homolog of the protein sequence given in SEQ ID NO 12888
  misc_feature: Ceres ANNOT ID no. 8673188
  misc_feature (71)..(158): Pfam ID: DPBB_1 Pfam Description: Rare lipoprotein A (RlpA)-like double-psi beta-barrel
MALARVLAVLLLAVACMLTVAAADDATTRSLSSPAPTGMAHANNATFYGGADEVRVGMGTCTRRATYGTRTTALSTALFNGASCEQCYKTACDRKRANPMFCKPGVTVTITATNLCPPNYALPGNNGGWCNPRPHFDMAQPAWEKTVVYNGGIIQVLTPSSPWMSKPPTPIAGYQWRETGMLSFRVTNIDGQTIKFTNVVP

SEQ ID NO: 17394 - DNA, 747 bp, Sorghum bicolor
  misc_feature: Ceres ANNOT ID no. 8673198
  misc_feature: Encodes the peptide sequence at SEQ ID NO 17395
atggcggttccagctcgagttttcacactcttgctgctcgcagctgccagttgggtgtcggccatggcagccaatgctccggcaccaaccgggtggctgaaggcgcatgccaccttctacggaggcgctgatgcctccgacaccatgggcggcgcatgcgggtacggcaacctctactcccagggctacggcacgcggacggcggccctgagcacgtgctacaagatcgcgtgcgaccgcaagagagccgacccaaggttctgcaagcccggcgtcacggtgaccgtcacggccaccaacttctgcccgcctaacttggcgctgcctgagggcggttggtgcaatcagcagcgcccgcactttgacatggcccaaccggcatttgagaagatcggcgtctacagcggcggtatcatccccatcatgtacaaaagagttccttgtgtgaagcgaggtggggtgcgcttcaccatcaatggacatgactacttcaatcttgtgcttgtgaccaatgttgcggctgccggctccatcaaatccatggaagtcaagacctcgaattcgagtaactggtctccattggcacgcaactggggtgcgaactggcactctcttgcatatcttacaaggcagatgctctcgtttagggtcaccgacacagatgggcaaactattgaattcaaagatgtggtgccacaaggatggaagtttggccaaacatttgcatccaagttgcagttcaagtga

SEQ ID NO: 17395 - protein, 248 aa, Sorghum bicolor
  misc_feature: Useful for making plants with altered carbohydrate content
  misc_feature: Functional homolog of the protein sequence given in SEQ ID NO 13784
  misc_feature: Useful for making plants with altered cell wall content and/or composition
  misc_feature: Functional homolog of the protein sequence given in SEQ ID NO 14001
  misc_feature: Useful for making plants with altered lignin content
  misc_feature: Functional homolog of the protein sequence given in SEQ ID NO 12888
  misc_feature: Ceres ANNOT ID no. 8673198
  misc_feature (154)..(232): Pfam ID: Pollen_allerg_1 Pfam Description: Pollen allergen
  misc_feature (51)..(143): Pfam ID: DPBB_1 Pfam Description: Rare lipoprotein A (RlpA)-like double-psi beta-barrel
MAVPARVFTLLLLAAASWVSAMAANAPAPTGWLKAHATFYGGADASDTMGGACGYGNLYSQGYGTRTAALSTCYKIACDRKRADPRFCKPGVTVTVTATNFCPPNLALPEGGWCNQQRPHFDMAQPAFEKIGVYSGGIIPIMYKRVPCVKRGGVRFTINGHDYFNLVLVTNVAAAGSIKSMEVKTSNSSNWSPLARNWGANWHSLAYLTRQMLSFRVTDTDGQTIEFKDVVPQGWKFGQTFASKLQFK

SEQ ID NO: 17396 - DNA, 789 bp, Sorghum bicolor
  misc_feature: Ceres ANNOT ID no. 8673191
  misc_feature: Encodes the peptide sequence at SEQ ID NO 17397
atggcggttccagctcgagtcttcacgctcttggtgctcgcatcagctgccggttgggtgtcggccatggcagctaatgctccggcaccaccaccaacagggtggctgaaggcgcatgccaccttctacggaggcgcagatgcctccgacaccatgggcggcgcgtgcgggtacggcaacctctactcccagggctatggcacgcggacagcggccttgagcacggtgctctttcaggatggggcctcatgcggtcagtgctacaagatcgcgtgcgaccgcaagagagccgaccccaggttctgcaagcccggcgtcacggtgaccgtcacggccaccaacttctgcccgcccaacttggcgctgcccgagggcggctggtgtaatcagcagcgcccgcactttgacatggcgcagccggcatttgagaagatcggcgtctacaacggtggtatcatccctgtcatgtacaagagagttccttgcgtgaagcgaggtggggtacgcttcaccatcaatgggcatgactacttcaatcttgtgcttgtgaccaatgttgcggctgccggctccatcaaatccatggaagtcaagacctcgaattcgagtaactggtctccattggcacgcaactggggtgcaaactggcactctcttgcatatcttacagggcagatgctctcgtttaggctcaccaacacggatggacaaactattgaattcacagatgtgatgccacaagaatggaagtttggccaaacatttgcatccaagttgcagttcaagtga

SEQ ID NO: 17397 - protein, 262 aa, Sorghum bicolor
  misc_feature: Useful for making plants with altered carbohydrate content
  misc_feature: Functional homolog of the protein sequence given in SEQ ID NO 13784
  misc_feature: Useful for making plants with altered cell wall content and/or composition
  misc_feature: Functional homolog of the protein sequence given in SEQ ID NO 14001
  misc_feature: Useful for making plants with altered lignin content
  misc_feature: Functional homolog of the protein sequence given in SEQ ID NO 12888
  misc_feature: Ceres ANNOT ID no. 8673191
  misc_feature (168)..(246): Pfam ID: Pollen_allerg_1 Pfam Description: Pollen allergen
  misc_feature (70)..(157): Pfam ID: DPBB_1 Pfam Description: Rare lipoprotein A (RlpA)-like double-psi beta-barrel
MAVPARVFTLLVLASAAGWVSAMAANAPAPPPTGWLKAHATFYGGADASDTMGGACGYGNLYSQGYGTRTAALSTVLFQDGASCGQCYKIACDRKRADPRFCKPGVTVTVTATNFCPPNLALPEGGWCNQQRPHFDMAQPAFEKIGVYNGGIIPVMYKRVPCVKRGGVRFTINGHDYFNLVLVTNVAAAGSIKSMEVKTSNSSNWSPLARNWGANWHSLAYLTGQMLSFRLTNTDGQTIEFTDVMPQEWKFGQTFASKLQFK

SEQ ID NO: 17398 - DNA, 294 bp, Sorghum bicolor
  misc_feature: Ceres ANNOT ID no. 8673282
  misc_feature: Encodes the peptide sequence at SEQ ID NO 17399
atggtgtgctggccggggttcgctgaccggttcaccaactgtaagtacgcctgcgacatgtggggtgtgggcgtgcggctggatgaggaggtgaggagggagcaggtcgccacgcacgtcggcgaggtgatgggaagcgaggagatgcggaggagagcggcgaggtggaaagaggaggcagactcctccgctgcctgtgcctgccccggcggtggctcgtcgtcgtcgtgtgagaacctgatgagcatggtgggaggactcatggaaaaaagcacacccaactcggaaaaataa

SEQ ID NO: 17399 - protein, 97 aa, Sorghum bicolor
  misc_feature: Useful for making plants with altered carbohydrate content
  misc_feature: Functional homolog of the protein sequence given in SEQ ID NO 14529
  misc_feature: Ceres ANNOT ID no. 8673282
  misc_feature (1)..(58): SWISSPROT Homolog: EC 2.4.1.115 Anthocyanidin 3-O-glucosyltransferase
MVCWPGFADRFTNCKYACDMWGVGVRLDEEVRREQVATHVGEVMGSEEMRRRAARWKEEADSSAACACPGGGSSSSCENLMSMVGGLMEKSTPNSEK

SEQ ID NO: 17400 - DNA, 1101 bp, Sorghum bicolor
  misc_feature: Ceres ANNOT ID no. 8673284
  misc_feature: Encodes the peptide sequence at SEQ ID NO 17401
atggcgaggccgcacgtcgtggtggtgccttacccgtgcgccggcaacgtgaacccggcgctgcagatcgccaagctgctccaccaccaaagcgtctacgtcaccttcatcaacaccgagcacaaccaccgccgcgtgcaggccaccgagggccccggcgctgtgcgcggccacgatgggttccgcttcgaggccatccccgacggcctgtccgacgccgaccgccgcaagcaggactacggccgcggcctggagtctggagatggtcggacgtcctcagtcctcacgcggctctcctgcacgccggggccgggcgtgccgcccgtctcgtgcgtcctcaccacgatgctgatgagcttcgcgctcgacgtcgcccgcgagctcaggatcccgaccatggcgttcttgactggcagcgtcgcctcgctgatgacgcttactccaacacacatgaggctccggcagctccaggaaagagggtacgtggcactcaaagatgagagcttgctgacgaacggctacctcgagagcaccgtcatcgactggatccccggcatgccaccgatctgcctcggcgacgtctccagcttcctccgaaccaccgacccggacgacttctgcctccgcttcaacgagtcggaggccaaccgctgcaccagcgccggcgccctcatcctcaacaccttcgaaggactggaggccgacgtcctcgccgccctgcgtgccgagtttccgcgcgtctacaccgtcggtcccctgggcacacttctccgccgtacgctcaacggcggcggcggcgggctgagcctgtggaagcaggacgccgagtgcgtcgcgtcatcgcgtggctggatatgcaggaacagggctccgtcgtgtacgtcaactttcggcagccacacggtggtgacgccggagcagctggccgagttcgcgtggggcctcgcggcgaccggccaggcggccacccgtttctctgggctatcagggacaacctcatccgtggcgatggcggtggcggtggcggtggccgccgcctgctggcgcttgacgcgcttccggcaggcttcacggctgagacgacagggcagtgctgcctga

SEQ ID NO: 17401 - protein, 366 aa, Sorghum bicolor
  misc_feature: Useful for making plants with altered carbohydrate content
  misc_feature: Functional homolog of the protein sequence given in SEQ ID NO 14529
  misc_feature: Ceres ANNOT ID no. 8673284
  misc_feature (5)..(252): SWISSPROT Homolog: EC 2.4.1.210 Limonoid glucosyltransferase
MARPHVVVVPYPCAGNVNPALQIAKLLHHQSVYVTFINTEHNHRRVQATEGPGAVRGHDGFRFEAIPDGLSDADRRKQDYGRGLESGDGRTSSVLTRLSCTPGPGVPPVSCVLTTMLMSFALDVARELRIPTMAFLTGSVASLMTLTPTHMRLRQLQERGYVALKDESLLTNGYLESTVIDWIPGMPPICLGDVSSFLRTTDPDDFCLRFNESEANRCTSAGALILNTFEGLEADVLAALRAEFPRVYTVGPLGTLLRRTLNGGGGGLSLWKQDAECVASSRGWICRNRAPSCTSTFGSHTVVTPEQLAEFAWGLAATGQAATRFSGLSGTTSSVAMAVAVAVAAACWRLTRFRQASRLRRQGSAA

SEQ ID NO: 17402 - DNA, 417 bp, Sorghum bicolor
  misc_feature: Ceres ANNOT ID no. 8673336
  misc_feature: Encodes the peptide sequence at SEQ ID NO 17403
atggtcccaaaatttagtttaaacgggctcgccgccggggtggcgcgcggcggcgcgccccgcgcccggctggccgtctacaaggcgtgctggggcgcgacggtctggtgcggcggcgccgcgctcctggcggccatagacgacgccaccaacgacggcgtcgacgtgctgtcgctctcgctgggggggttccaggagttcgccggcacgctgcacgccgtggcgaggggcgtcccggtggtgttcgcgggcatgaaccgcggccccgcgccgcagacggtgcggaacacggcgccgtggctcatcacggtggccgctagcatgatcgaccggtcgttcccgacaaaggtggtcctcgggaacaacgaagagctggtggtaagtagtaatacgcgtccacaatttacaatagagtag

SEQ ID NO: 17403 - protein, 138 aa, Sorghum bicolor
  misc_feature: The sequence is a functional homolog of SEQ ID NO 1433 in the 10/374,780 US patent application
  misc_feature: The sequence is a functional homolog of SEQ ID NO 1519 in the 10/412,699 US patent application
  misc_feature: Ceres ANNOT ID no. 8673336
  misc_feature (27)..(131): SWISSPROT Homolog: EC 3.4.21.25 Cucumisin
MVPKFSLNGLAAGVARGGAPRARLAVYKACWGATVWCGGAALLAAIDDATNDGVDVLSLSLGGFQEFAGTLHAVARGVPVVFAGMNRGPAPQTVRNTAPWLITVAASMIDRSFPTKVVLGNNEELVVSSNTRPQFTIE

SEQ ID NO: 17404 - DNA, 1713 bp, Sorghum bicolor
  misc_feature: Ceres ANNOT ID no. 8673445
  misc_feature: Encodes the peptide sequence at SEQ ID NO 17405
atgtcttccttggcggcggctgcggcacccgacctgcaggtggacgaggccgtaaggaggagatggtggccatggccgcgcagttgctcctccaacactactagaaggaaggccctgctggccatctgcgccggggcgaccgtcatcgtcgtgctattcgccggcgggagctcacccgacgggatgctgcactccttgctcttccaccacttacaaggttttgaagacagaccaccatttaacctcaccaccgaccatctcctcgacggccttctcacggctgagtacggctaccagtcgtgccggagccgatatgaattcgccggttaccacaagaaatcgtcgcatcagccatcaccctacctcctcgccaagctgcggaagcaagaagcactccaaaagcgatgcggccccggcacggccgcgtacaagaaggcactccggcggcttgaatccaacgctgccgacgtcgaggacgacgatgactgccggtacctcgtgaacatcagctttcgattccgaggcctcggcaaccggatgctcgccgtcgcgtcggccttcctctacgcggtgcttacagagcgcgtcctcctcatcaacgcagacaagggtgatgtgcccgatctcttctgcgagccctttccaggcgcgacgtggctgctgccgcgcgccggtcgccgctccccgctcacgaagctcgatgattaccagggggggtcgaaggagagcctggggaacatgctgcagagaggcgtcgccggcgtgtccgccgacgggaacatgtcgtggctgtctccaccgcagccgccgccatatgtgtacctccacctcgctggcgtgtacggcttccacgacaagcttttctactgcggggagcaccagcggctcctccgcggagtgccgtggctgttcatgagggcggacggctacctggtgcccgggctgttcctcacgccgccgttcgtcggagagctcgaggccatgttcccggagaaagacgccgtgttctaccacctgggtcgataccttttcctccccagcaacgccgtctggcgcgctgtcacgagctactacagcgccaacctcgcaggcgtcggccgcctcgtcggcatccagatcagggtgttccaggagaagaagccgccgcagcaaatcctggaccagatcctgtcctgcgtccgcgacgagaagctgctcccagagacgaccacaaaagacaacggcacgtcgtcgccctacggtgtccttgtgacgtcgctgagctcgtggtactacgagaggctcaagggcgagtacggcggtagactcgccggcggcgtgcaccagccgagccacgaggggcggcagcggttgcgcaacgaagcgcacgacgtgaaggcgctgagcgagatgtacctgctcagcatgtgcgacgtgctcgtcaccagcggcttctccacgttcgggtacgtcgcgcagggcctcggcgggctgcagccgtgggtcatgtcgaggccgtccccgttcgaggagtggacggagggtcaggcggcgccagaaccgccatgccagcgcgcgctctccgtcgagccttgcttccactcaccatcgtcctatgactgcacggtgaggagagacgtggagctggacaaggtgacgccctacatcaggcgctgcgtggacgtcagctggggcataaagcttgtgaatcaaagccgcgacggtcagtggtag

SEQ ID NO: 17405 - protein, 570 aa, Sorghum bicolor
  misc_feature: Useful for making plants with altered carbohydrate content
  misc_feature: Functional homolog of the protein sequence given in SEQ ID NO 14024
  misc_feature: Ceres ANNOT ID no. 8673445
  misc_feature (157)..(562): SWISSPROT Homolog: EC 2.4.1.69 Galactoside 2-alpha-L-fucosyltransferase
  misc_feature (53)..(536): Pfam ID: XG_FTase Pfam Description: Xyloglucan fucosyltransferase
MSSLAAAAAPDLQVDEAVRRRWWPWPRSCSSNTTRRKALLAICAGATVIVVLFAGGSSPDGMLHSLLFHHLQGFEDRPPFNLTTDHLLDGLLTAEYGYQSCRSRYEFAGYHKKSSHQPSPYLLAKLRKQEALQKRCGPGTAAYKKALRRLESNAADVEDDDDCRYLVNISFRFRGLGNRMLAVASAFLYAVLTERVLLINADKGDVPDLFCEPFPGATWLLPRAGRRSPLTKLDDYQGGSKESLGNMLQRGVAGVSADGNMSWLSPPQPPPYVYLHLAGVYGFHDKLFYCGEHQRLLRGVPWLFMRADGYLVPGLFLTPPFVGELEAMFPEKDAVFYHLGRYLFLPSNAVWRAVTSYYSANLAGVGRLVGIQIRVFQEKKPPQQILDQILSCVRDEKLLPETTTKDNGTSSPYGVLVTSLSSWYYERLKGEYGGRLAGGVHQPSHEGRQRLRNEAHDVKALSEMYLLSMCDVLVTSGFSTFGYVAQGLGGLQPWVMSRPSPFEEWTEGQAAPEPPCQRALSVEPCFHSPSSYDCTVRRDVELDKVTPYIRRCVDVSWGIKLVNQSRDGQW

SEQ ID NO: 17406 - DNA, 492 bp, Sorghum bicolor
  misc_feature: Ceres ANNOT ID no. 8673485
  misc_feature: Encodes the peptide sequence at SEQ ID NO 17407
atgcggaaacattgcaatagtttgatgcatgtttgttataatttattgaggattgggatacactacgagggacaattttttgaatttgtaccttggactggaacagtaagctgggacattgcactgtggggtcgttggaagatgtctggcgagaacaaaactcatctggtagaaatagaggcaaccactacagaaccaggaactgctctgcgagctcctactatcgaggctggactggtaccagcgtgcaaagacacctgctatggggatctaaggctacagttgtgggaaaagaaatacgatggtagcaagggagcgatgatactcgatgccacaagcaacatggccgcactagaagttggcggaggcccctggttcaatgggtggaaagggacaactgttacgaacgaggctgtaaataacattgtgggcaccccaatcgatgtagagagtctcttcccaatcccatttcttaagcccccaggcctgtag

SEQ ID NO: 17407 - protein, 163 aa, Sorghum bicolor
  misc_feature: Useful for making plants with altered tocopherol content
  misc_feature: Functional homolog of the protein sequence given in SEQ ID NO 14530
  misc_feature: Ceres ANNOT ID no. 8673485
MRKHCNSLMHVCYNLLRIGIHYEGQFFEFVPWTGTVSWDIALWGRWKMSGENKTHLVEIEATTTEPGTALRAPTIEAGLVPACKDTCYGDLRLQLWEKKYDGSKGAMILDATSNMAALEVGGGPWFNGWKGTTVTNEAVNNIVGTPIDVESLFPIPFLKPPGL

SEQ ID NO: 17408 - DNA, 534 bp, Sorghum bicolor
  misc_feature: Ceres ANNOT ID no. 8673489
  misc_feature: Encodes the peptide sequence at SEQ ID NO 17409
atgaacctcgccgtcgcagccgccctgccggccgtgacgccgcgttccggcgtcgtcctcccacggggcggccgccgccgcggggtcgtccctctcgcggcctcgacctcggcggcctcctttacctcctcctcctcctcggcggcggcggcggcggcgcctatctacgcgcccacgccgcaggaccggcctctccggacgccgcatagcgggtatcactttgacggcacagctcgacctttcttcgaaggatggtacttcaaggtgtcgattccagagtgcaggcagagtttctgctttatgtactctgtcgagaaccctctcttccgtgatggtatgagtgatttggacaagttggtacatggtccacgctttactggtgtgggagcacaaatccttggcgcggacgataagtacatatgccagttctcagagaaatcaaacaatttttggggaagtaggcttcttgctcagtctctctgtcctttgctgttactgttttattttgtactttgttgtatgcaaactctgtag

SEQ ID NO: 17409 - protein, 177 aa, Sorghum bicolor
  misc_feature: Useful for making plants with altered tocopherol content
  misc_feature: Functional homolog of the protein sequence given in SEQ ID NO 14530
  misc_feature: Ceres ANNOT ID no. 8673489
MNLAVAAALPAVTPRSGVVLPRGGRRRGVVPLAASTSAASFTSSSSSAAAAAAPIYAPTPQDRPLRTPHSGYHFDGTARPFFEGWYFKVSIPECRQSFCFMYSVENPLFRDGMSDLDKLVHGPRFTGVGAQILGADDKYICQFSEKSNNFWGSRLLAQSLCPLLLLFYFVLCCMQTL

SEQ ID NO: 17410 - DNA, 888 bp, Sorghum bicolor
  misc_feature: Ceres ANNOT ID no. 8673551
  misc_feature: Encodes the peptide sequence at SEQ ID NO 17411
atgatcatgggagagcaacgaaaccctacaaggcagctgatgtcgtcctccctgctcgcacttttttttgcatcgtccgtgctcgttggcctcgcggccggcggcagcttctacgaggagtgcgacgcgacctgggagccccagaactgctgggcctacgacgatggcaacaggctctccctcgcgctcgtcagcagctcctcaggctccatgatccggtcgaagcggcagttcgtgtacgggaccgtgtccaccatgatccagcttgtccccggcgactccgccggcaccgtcaccaccttctatacgtcgtcgctgggcgacaaccacgacgagatcgacttcgagttcctgggcaacgtgagcgggcagccctacaccatccacaccaacgtgtacgctgccggcgtgggcaacaaggagatgcagttcaagccatggttcgaccccaccgccgactaccacaactacactatctcctggactccctgcatgatcgtgtggtacatcgacggcgtccccatccgtgtgttccgcaactacgcggcgagccacggcgtggcgttcccgacgagccagcccatgtacgcctactccagcatatgggcggcggaggactgggccacgcagggcggccgcgtcaaggccgactggtccaaggcgcccttcgtcgccagctaccacggcatcgacctcgacgtctgcgagtgctacggcgggggctgcgtctccgcctgcgccggcggctgcagtagtagcctgagcgacgcgcaggtggggaagatgcagtgggtgcagagcagctacaggatctacgactactgcgtcgaccccaagcgcttggtcaacggccagaagccggtcgagtgcggcctgccgcagcactga

SEQ ID NO: 17411 - protein, 295 aa, Sorghum bicolor
  misc_feature: Useful for making plants with altered cell wall content and/or composition
  misc_feature: Functional homolog of the protein sequence given in SEQ ID NO 14531
  misc_feature: Ceres ANNOT ID no. 8673551
  misc_feature (32)..(292): SWISSPROT Homolog: EC 2.4.1.207 Xyloglucan:xyloglucosyl transferase
  misc_feature (37)..(220): Pfam ID: Glyco_hydro_16 Pfam Description: Glycosyl hydrolases family 16
  misc_feature (246)..(290): Pfam ID: XET_C Pfam Description: Xyloglucan endo-transglycosylase (XET) C-terminus
MIMGEQRNPTRQLMSSSLLALFFASSVLVGLAAGGSFYEECDATWEPQNCWAYDDGNRLSLALVSSSSGSMIRSKRQFVYGTVSTMIQLVPGDSAGTVTTFYTSSLGDNHDEIDFEFLGNVSGQPYTIHTNVYAAGVGNKEMQFKPWFDPTADYHNYTISWTPCMIVWYIDGVPIRVFRNYAASHGVAFPTSQPMYAYSSIWAAEDWATQGGRVKADWSKAPFVASYHGIDLDVCECYGGGCVSACAGGCSSSLSDAQVGKMQWVQSSYRIYDYCVDPKRLVNGQKPVECGLPQH

SEQ ID NO: 17412 - DNA, 873 bp, Sorghum bicolor
  misc_feature: Ceres ANNOT ID no. 8673639
  misc_feature: Encodes the peptide sequence at SEQ ID NO 17413
atggtgaggttgagggctctcctccttgttgctgtggccgctgcggtggccggccttgccgctgccaatttccgggatgactgcgacatcccctgggagccccagaacgccaagtttaccagcgacggcaacggcctctcgatgtcgctggtcagcaactcctcaggctgcatgctccggacaaagaagcagtacatctacgggaccgtgtcaaccctcatccagctcgtcccaggcaactcggccggcactgtcaccacatactacgcatcctctgttggcgacaaccatgacgagatcgactttgagttcctgggcaacgtgagcggccaaccatacaccttccacaccaacatctacaccaatggcgtcggcaacaaggagattcagttcaagccctggttcgaccccaccaccggctaccacaactacaccatctcatggagcccctgcatgatcgtgtggtacgttgacagcatccccatccgtgtgttccgcaactaccaggagagctacggcgtggcgtacccgacgagccggcccatgtacgcctactccagcatctgggcggcggaggattgggccacgcagggcggccgcgtcaagacggactggtccaaggcgcccttcgtcgccaactaccagaacatccacctcgacgtctgtgagtgcggcggcggcggcggcggctgcagtatcaactgcccggcagcggctgcgaagccgaacaacggggcgtgccagctgagccccgaccagcgggagctgatgcagagccggcagagaaactacaccatctacgactactgcgtcgactccaagaggtggaccaacggcatcaagccaaccgagtgcagcctgccacaatactga

SEQ ID NO: 17413 - protein, 290 aa, Sorghum bicolor
  misc_feature: Useful for making plants with altered cell wall content and/or composition
  misc_feature: Functional homolog of the protein sequence given in SEQ ID NO 14532
  misc_feature: Useful for making plants with altered carbohydrate content
  misc_feature: Functional homolog of the protein sequence given in SEQ ID NO 13783
  misc_feature: Ceres ANNOT ID no. 8673639
  misc_feature (23)..(285): SWISSPROT Homolog: EC 2.4.1.207 Xyloglucan:xyloglucosyl transferase
  misc_feature (24)..(207): Pfam ID: Glyco_hydro_16 Pfam Description: Glycosyl hydrolases family 16
  misc_feature (231)..(285): Pfam ID: XET_C Pfam Description: Xyloglucan endo-transglycosylase (XET) C-terminus
MVRLRALLLVAVAAAVAGLAAANFRDDCDIPWEPQNAKFTSDGNGLSMSLVSNSSGCMLRTKKQYIYGTVSTLIQLVPGNSAGTVTTYYASSVGDNHDEIDFEFLGNVSGQPYTFHTNIYTNGVGNKEIQFKPWFDPTTGYHNYTISWSPCMIVWYVDSIPIRVFRNYQESYGVAYPTSRPMYAYSSIWAAEDWATQGGRVKTDWSKAPFVANYQNIHLDVCECGGGGGGCSINCPAAAAKPNNGACQLSPDQRELMQSRQRNYTIYDYCVDSKRWTNGIKPTECSLPQY

SEQ ID NO: 17414 - DNA, 993 bp, Sorghum bicolor
  misc_feature: Ceres ANNOT ID no. 8673668
  misc_feature: Encodes the peptide sequence at SEQ ID NO 17415
atgaggactctacaggtggccgccggacgcggggctgtcgcctgcgccgccacgcccgttccccggagatcgctgctcctctccaccgctgccgcaggtgcggcgctgcagtccgagcaggtgcccttgaggctgaccaggaacgtgcccggcgccgctgcaaagttccgggcctcggcggacgccgcgcaggcggccaccttcgccaccacggacgaggccttctcgtgggcaaagaaggataaccgccggctcctccacgtcgtctaccgggtcggcgacattgacaagacaatcaagttctacaccgagtgcctggggatgaagctgctcaggaagagggacataccagaggagaagtacaccaacgcgttcctaggatacggccccgaggaatcgcatttcgtcgtcgagctcacatacaattatggggtggacaaatatgacgttggcgcaggttttggccacttcggtatcggagttgaggatgtggccaagacagtagagctcataagagcaaagggaggcaaggtcacaagggagcctggtcctgtcaagggcggcaagaccgtcatcgccttcgtggaggaccctgacggctacatctttgagatcatcgagaggcctggaacgccggagcccttgagccaggtgatgctccgcgtcggcgaccttgaccgtgccataagcttctatgagaagtacacggtggcaatgatgggttacggccctgaagacaggaacgcggtgctggagctgacgtacaactatggtgtcaccgagtatgccaaggggaatgcatatgcccagattgccattggcaccgatgatgtctacaagaccgcggaggtggtgaagctgtccggagggcaggtggtgcgagagccggggcccttgccggggatcaacacaaagatcacatccatcctggaccctgatggctggaaatcggtgttcgtcgacaacatcgactttgccaaggaactggagtag

SEQ ID NO: 17415 - protein, 330 aa, Sorghum bicolor
  misc_feature: Useful for making plants with modulated nitrogen use efficiency
  misc_feature: Functional homolog of the protein sequence given in SEQ ID NO 13155
  misc_feature: Ceres ANNOT ID no. 8673668
  misc_feature (77)..(234): SWISSPROT Homolog: EC 4.4.1.5 Lactoylglutathione lyase
  misc_feature (84)..(205): Pfam ID: Glyoxalase Pfam Description: Glyoxalase/Bleomycin resistance protein/Dioxygenase superfamily
  misc_feature (214)..(319): Pfam ID: Glyoxalase Pfam Description: Glyoxalase/Bleomycin resistance protein/Dioxygenase superfamily
MRTLQVAAGRGAVACAATPVPRRSLLLSTAAAGAALQSEQVPLRLTRNVPGAAAKFRASADAAQAATFATTDEAFSWAKKDNRRLLHVVYRVGDIDKTIKFYTECLGMKLLRKRDIPEEKYTNAFLGYGPEESHFVVELTYNYGVDKYDVGAGFGHFGIGVEDVAKTVELIRAKGGKVTREPGPVKGGKTVIAFVEDPDGYIFEIIERPGTPEPLSQVMLRVGDLDRAISFYEKYTVAMMGYGPEDRNAVLELTYNYGVTEYAKGNAYAQIAIGTDDVYKTAEVVKLSGGQVVREPGPLPGINTKITSILDPDGWKSVFVDNIDFAKELE

SEQ ID NO: 17416 - DNA, 255 bp, Sorghum bicolor
  misc_feature: Ceres ANNOT ID no. 8673663
  misc_feature: Encodes the peptide sequence at SEQ ID NO 17417
atggtttatgtaatcgacttcgggctcgcaaagagatatcgtgattcaaccaccaaccgtcatataccttatagagaaaataaaaacttgactggcacagctcgctatgctagccgcaatactcatcttgggattgagcaaagccgcagagatgatttggaatcgattggatacgttctcctgtatttcctcaggggaaggtatgattttgtgttaaagatctctattgtgctttttttttcaccattgtcctag

SEQ ID NO: 17417 - protein, 84 aa, Sorghum bicolor
  misc_feature: The sequence is a functional homolog of SEQ ID NO 32 in US patent 7179962
  misc_feature: Ceres ANNOT ID no. 8673663
  misc_feature (2)..(66): SWISSPROT Homolog: EC 2.7.11.1 Non-specific serine/threonine protein kinase
MVYVIDFGLAKRYRDSTTNRHIPYRENKNLTGTARYASRNTHLGIEQSRRDDLESIGYVLLYFLRGRYDFVLKISIVLFFSPLS

SEQ ID NO: 17418 - DNA, 279 bp, Sorghum bicolor
  misc_feature: Ceres ANNOT ID no. 8673659
  misc_feature: Encodes the peptide sequence at SEQ ID NO 17419
atggaaaacagcaaaaccaatcatccacagttgctatatgaggccaaactgtacaatgctcttcaaggagggactggtatcgcaaacataaaatggtgcggcattgatggcgatgaaaacattcttgttatcgatttactcggaccaagccttgaagatctgtttgtttactgtggccggagattctcactgaagacggtcttgatgctggcagatcagatggagacgccgcgcccgcgacgtatgcagggagaaggcgcccaacagactaggggctag

SEQ ID NO: 17419 - protein, 92 aa, Sorghum bicolor
  misc_feature: The sequence is a functional homolog of SEQ ID NO 32 in US patent 7179962
  misc_feature: Ceres ANNOT ID no. 8673659
  misc_feature (1)..(74): SWISSPROT Homolog: EC 2.7.11.1 Non-specific serine/threonine protein kinase
MENSKTNHPQLLYEAKLYNALQGGTGIANIKWCGIDGDENILVIDLLGPSLEDLFVYCGRRFSLKTVLMLADQMETPRPRRMQGEGAQQTRG

SEQ ID NO: 17420 - DNA, 1188 bp, Sorghum bicolor
  misc_feature: Ceres ANNOT ID no. 8673735
  misc_feature: Encodes the peptide sequence at SEQ ID NO 17421
atgtcctatcagagtggatcccatagctcaaaaattggcttaatacttggaacagttggtggaattttagggcttcttatcgtgggagctctgtttctaatctgtaatgcaaggaggaaaagccacctgcgggaagtttttgtggatgtagcaggcgaggacgatcgacgaattgcgtttggccagatcaaaagatttgcatggcgagaactgcagattgcgactgataatttcaatgaaagaaatgttcttggacagggaggttttggtaaagtatacaagggagttcttcctgatgcaactaagatcgctgtaaaacgattgactgactatgacagtcctggtggggaggctgccttcttgcgggaggttgagcttattagtgttgcagttcatcgcaatctcttaagattaattggcttctgcacgacacaaacagagcgcttgctggtctatccatttatgcagaatttgagtgttgcctgccgcttaagagattttaagcctggagaacccatcctagactggccttcaaggaaacgggtggctataggtacagctcgtggactggagtatctgcatgaacactgcaaccccaagatcatacaccgtgatgttaaagctgcaaatgtattacttgacgaggatttcgagcctgttgttggtgattttggcctagcaaagctcgtagatgtgcagaagacatctgtgacaacacaagtccgtggaaccatgggtcacatagcacctgagtacctgtccacagggaagtcgtccgagaggactgatgtttttggctatgggatcatgcttcttgaacttgtgacgggtcagcgggctattgacttctcacggttggaagaggaagaagatgtaaagaagctacagagagaaggggagctagactccattgtggacaagaaccttaatcagaattatgatagtgaggatcttgagatgataatacagatagcactgctctgcacgcaggcatcacctgaggaccgaccatcaatgtctgaagtggttaggatgctggaaggtgagggtttggcggagcggtgggaggagtggcagcatgtggaggtgacaaggaggcaggagtatgagcggatgcagcggaggttcgactggggagaggattctgtctacaatcaggaagcgatggagttgtctgcaggtagatga

SEQ ID NO: 17421 - protein, 395 aa, Sorghum bicolor
  misc_feature: Useful for making plants with modulated nitrogen use efficiency
  misc_feature: Functional homolog of the protein sequence given in SEQ ID NO 14533
  misc_feature: Ceres ANNOT ID no. 8673735
  misc_feature (38)..(366): SWISSPROT Homolog: EC 2.7.11.1 Non-specific serine/threonine protein kinase
  misc_feature (78)..(346): Pfam ID: Pkinase Pfam Description: Protein kinase domain
MSYQSGSHSSKIGLILGTVGGILGLLIVGALFLICNARRKSHLREVFVDVAGEDDRRIAFGQIKRFAWRELQIATDNFNERNVLGQGGFGKVYKGVLPDATKIAVKRLTDYDSPGGEAAFLREVELISVAVHRNLLRLIGFCTTQTERLLVYPFMQNLSVACRLRDFKPGEPILDWPSRKRVAIGTARGLEYLHEHCNPKIIHRDVKAANVLLDEDFEPVVGDFGLAKLVDVQKTSVTTQVRGTMGHIAPEYLSTGKSSERTDVFGYGIMLLELVTGQRAIDFSRLEEEEDVKKLQREGELDSIVDKNLNQNYDSEDLEMIIQIALLCTQASPEDRPSMSEVVRMLEGEGLAERWEEWQHVEVTRRQEYERMQRRFDWGEDSVYNQEAMELSAGR

SEQ ID NO: 17422 - DNA, 1692 bp, Sorghum bicolor
  misc_feature: Ceres ANNOT ID no. 8673813
  misc_feature: Encodes the peptide sequence at SEQ ID NO 17423
atggaccaccacctcctcgcccgtcgcctcggcgcgcctcctgtcctcctcctcatcctctcctgcctggcgctcattctcgccgggtgcagctgcagctgcagcagcgcgcacgcagcctcagccccgcggcccccggtcttcgcgttcccggccgccgccgccaaggccaaggcgcagcatgcagtggcgcgccaccacgagtcgcgcctgcgcgccgcgctcgacgccgccgccacgcgcgtgggcgaggcgctcggcgcgctggccgccacctcgtcgccgacgctcgccgcggccgccgcccgggaggactgcgcggagctgctggacgaggcgctccagctcctggccggcgcgagggcggcgacccgcggcgacgcgctcacgtggctctcggccgcgctcaccaaccacgacacgtgcgccgacagcctcgcggaggccggcgcgccgctccacgcgcacgcgcacctcgccgccgcccgcgccgtggtccgcgacagcctcgccacgatgtacgcctcgtccaccaccaccaccgctgcgaccgcaaccggaacaaccgaggatgccggcggcgcggcgggcctcgtccgcagctgctgcaacaagaacgagacgacgacgagacggcagggcggcccgtgccgtttcccacggtgggtgccggcgagggaccggcggctgctgctggcccccgcggcgtcgctggccgggaccgccgacattgtggtcgccaaggacggcacagggacgcacgccaccatcgccgacgccgtcaaggcggcgcccgagtgcagcgagcgacggacggtgatctacgtcaaggcggggcggtatgacgagaacgtcaaggtggggatgaacaagaccaacctggtgttcgtcggggacggcaagggcgtcaccgtcgtcgccggcaaccgcagcgtcgctgacaactacaccaccttccggaccgccacctttgccgcgtccgggttcgggttcatgatgcttgacatgacggtggagaactgggcggggccggcgaggcaccaggcggtggcgctgcgcgcgagcgccgaccgcgccgtcgtccaccgctgcggcatcgcggggtaccaggacacgctgtacgcgcactccaaccgccagttctaccgcgactgcgacgtctacggcaccgtcgacttcgtcttcggcaacgccgccgccgtgctgcagcgctgcgacctctgggcgcgggtgccgctgccggggcagaggaacaccgtcaccgcgcagagccggaacgagtcgtgccagcgcaccggcatcgtcctccacggctgccgcctcctggccgcaccggcgtcggagccggacctgatcctcgcgccgccgacgacgtacctgggccggccatggaagcccttctccagggtggtggtgatgctgtcgtacatcggcccgcacgtgccgccgcaggggtggctggagtggaacgccaccagcgacactccgtacgcgctcgacaggctctacttcggcgagtacatgaacaacgggcccggcgcggggttggccggacgcgtgccgtggcacggccaccgcgccatcaacagcaccgcggaggcggagaggttcacggtggcgcgattcatcgacggcgcgtcctggctgccggccaccggggtctccttcgtcgcggggctctcgctgctgtaa

SEQ ID NO: 17423 - protein, 563 aa, Sorghum bicolor
  misc_feature: Useful for making plants with modulated time to senescence
  misc_feature: Functional homolog of the protein sequence given in SEQ ID NO 14413
  misc_feature: Useful for making plants with altered cell wall content and/or composition
  misc_feature: Functional homolog of the protein sequence given in SEQ ID NO 14386
  misc_feature: Useful for making plants with altered carbohydrate content
  misc_feature: Functional homolog of the protein sequence given in SEQ ID NO 14381
  misc_feature: Ceres ANNOT ID no. 8673813
  misc_feature (198)..(558): SWISSPROT Homolog: EC 3.1.1.11 Pectinesterase
  misc_feature (243)..(547): Pfam ID: Pectinesterase Pfam Description: Pectinesterase
  misc_feature (51)..(172): Pfam ID: PMEI Pfam Description: Plant invertase/pectin methylesterase inhibitor
MDHHLLARRLGAPPVLLLILSCLALILAGCSCSCSSAHAASAPRPPVFAFPAAAAKAKAQHAVARHHESRLRAALDAAATRVGEALGALAATSSPTLAAAAAREDCAELLDEALQLLAGARAATRGDALTWLSAALTNHDTCADSLAEAGAPLHAHAHLAAARAVVRDSLATMYASSTTTTAATATGTTEDAGGAAGLVRSCCNKNETTTRRQGGPCRFPRWVPARDRRLLLAPAASLAGTADIVVAKDGTGTHATIADAVKAAPECSERRTVIYVKAGRYDENVKVGMNKTNLVFVGDGKGVTVVAGNRSVADNYTTFRTATFAASGFGFMMLDMTVENWAGPARHQAVALRASADRAVVHRCGIAGYQDTLYAHSNRQFYRDCDVYGTVDFVFGNAAAVLQRCDLWARVPLPGQRNTVTAQSRNESCQRTGIVLHGCRLLAAPASEPDLILAPPTTYLGRPWKPFSRVVVMLSYIGPHVPPQGWLEWNATSDTPYALDRLYFGEYMNNGPGAGLAGRVPWHGHRAINSTAEAERFTVARFIDGASWLPATGVSFVAGLSLL

SEQ ID NO: 17424 - DNA, 2313 bp, Sorghum bicolor
  misc_feature: Ceres ANNOT ID no. 8673858
  misc_feature: Encodes the peptide sequence at SEQ ID NO 17425
atgccgctcgcggatgccgttgcggccggtgacagcgcccggggtgtggactccgcggcggcgagcgccgactgctttggcatggcggtcgaggagatcgtgcagcacccgctgccgggctacggggcgccttcggtgctcagcttcagccccgacgaccgccgggttgcctacctgtacagccccgacggcacgctccaccggaaggtgttcaccttcgacaccgcgcagcgctgccaggagctgctcttcggcccccccgacggtggcgggctcgaggaggggaatctctccgccgaggagcgcctgcggcgtgagcgagcacgggagcgcggcctcggggtcactcgctacgagtggcgcgctcgccattccggtgaatcctcctctcgcgctggcattgtcgtgccactcccatccggggtttacttccaggatttatctggctccgaaccagtgctgaaactacaaagttctcccacatctccgataattgacccatatctatctccaaatgggagcatgattgcatacgttagggatgacgagctgcataccttggggttttccagtggagaaactaggcaattaacttttggtgcaagagaaagtaggaaggtccacgggctcgctgagtatattgcacaggaagagatggaaaggaagatgggattttggtggtctcctgacagcaagcaccttgcatttactgaagtggactcaactgagattccattgtatagaattatgcatcagggcaaaagttctgttggtccagatgctcaagaagaccatgcgtaccctttcgcaggagcagctaatgttaaagtgcgacttggtgttgttccttcccatggaggggaagtaacttggatggatctcctttgtggagatccagatggtccccacagtgatgaagaatatttagctagagtcaactggatgcataatagtgctcttgctgttcaagttctcaacagatctcatacgaaacttaaattactgaagtttgatattactacaggtaaaagagaagtcttactagaagagcagcatgatatatggatcacattgcatgattgcttcactccactagacaaaggagtgaatagtaaacatccaggtggctttatttgggccagtgaaaaaacaggattcaggcacttatatgttcatggcaatgatggagcatgcttaggacctctcacacaaggtgattggatggtcgagcacattgctggtgtcaatgagagtaatggacttatatatttcactggcacgttggatggaccattggagacaaatctctaccacactaatctgtttccagattggagccttcccttgcaaacccctaaaaggctgactcgtggaactggccggcattcagtaattctcgatcaccagttgctaaagtttattgatgtgtacgacacaataaagtctccacctgtgatcttgctgtgctctttgcttgatggaagtgtaattatgcccctgtttgagcagccattgacagttccgccacttaaaaagttccagcagctgtctccagagatagttgaaattacagcaaaggatgggaccaatttatatggcgctctctaccttcctgatgagagaaaatatgggccacctccctacaaaacactgattaatgtttatggtggccccagtgtccagcttgttagtgattcatggatgtgtacagttgacatgagagctcaatatctacgaagtaagggtatattagtttggaagatggataatcgaggatcggcaaggcgaggcctgcattttgagggacaactgaagtacaacattggtcgcattgatgctgaagatcaattagcaggggctgagtggttaataaagaagggccttgcaaaacctggccatattggtatctatggctggagctacggaggatttctctcagcaatgtgcctcacaaggtttccagacacgttctgttgtgcagtgtctggcgctccggtgacagcttgggatgggtacgacaccttttacacagagaagtacttgggtctgcctgcggagcacccggatgcttacgagtatgggtcaattatgcaccacacgaagaacctgagagggaagctgctcctcatccatgggatgattgacgagaacgtgcatttcaggcacacggcaaggctcgtcaactcgctgatggcagatggcaagccctatgaaatcctccttttccctgacgagaggcacatgccacgacggcttggtgaccggatctacatggaggagaggatctgggattttgtcgagaggagcctttga

SEQ ID NO: 17425 - protein, 770 aa, Sorghum bicolor
  misc_feature: Useful for making plants with modulated salt sensitivity
  misc_feature: Functional homolog of the protein sequence given in SEQ ID NO 13664
  misc_feature: Ceres ANNOT ID no. 8673858
  misc_feature (402)..(770): SWISSPROT Homolog: EC 3.4.14.5 Dipeptidyl-peptidase IV
  misc_feature (128)..(484): Pfam ID: DPPIV_N Pfam Description: Dipeptidyl peptidase IV (DPP IV) N-terminal region
  misc_feature (569)..(769): Pfam ID: Peptidase_S9 Pfam Description: Prolyl oligopeptidase family
MPLADAVAAGDSARGVDSAAASADCFGMAVEEIVQHPLPGYGAPSVLSFSPDDRRVAYLYSPDGTLHRKVFTFDTAQRCQELLFGPPDGGGLEEGNLSAEERLRRERARERGLGVTRYEWRARHSGESSSRAGIVVPLPSGVYFQDLSGSEPVLKLQSSPTSPIIDPYLSPNGSMIAYVRDDELHTLGFSSGETRQLTFGARESRKVHGLAEYIAQEEMERKMGFWWSPDSKHLAFTEVDSTEIPLYRIMHQGKSSVGPDAQEDHAYPFAGAANVKVRLGVVPSHGGEVTWMDLLCGDPDGPHSDEEYLARVNWMHNSALAVQVLNRSHTKLKLLKFDITTGKREVLLEEQHDIWITLHDCFTPLDKGVNSKHPGGFIWASEKTGFRHLYVHGNDGACLGPLTQGDWMVEHIAGVNESNGLIYFTGTLDGPLETNLYHTNLFPDWSLPLQTPKRLTRGTGRHSVILDHQLLKFIDVYDTIKSPPVILLCSLLDGSVIMPLFEQPLTVPPLKKFQQLSPEIVEITAKDGTNLYGALYLPDERKYGPPPYKTLINVYGGPSVQLVSDSWMCTVDMRAQYLRSKGILVWKMDNRGSARRGLHFEGQLKYNIGRIDAEDQLAGAEWLIKKGLAKPGHIGIYGWSYGGFLSAMCLTRFPDTFCCAVSGAPVTAWDGYDTFYTEKYLGLPAEHPDAYEYGSIMHHTKNLRGKLLLIHGMIDENVHFRHTARLVNSLMADGKPYEILLFPDERHMPRRLGDRIYMEERIWDFVERSL

SEQ ID NO: 17426 - DNA, 1770 bp, Sorghum bicolor
  misc_feature: Ceres ANNOT ID no. 8674833
  misc_feature: Encodes the peptide sequence at SEQ ID NO 17427
atgaaggcggtggagcgcgcgaaactggtgaggagcctccggcacgagtcgcggcggctgcgtctactcgtcctcgtcatcggtttcttcctcgtcacgctcaccttcgttgtcgtctccaagcccgacgccctcctcttcaacctgaacggcaggctgttggtggaccaggcgccgcgctcgctcttgatccgccagcgggttgacgcccacgacgggagatccgccgacactctcgcctctgcctctggggatctaaaggtggtcgacgacgataccgccggcgaggaagccagcaccaacgccatagggaccagtggagaggaggaacgggtgctcgctagcgagcccgagcagagcaaaagggcagtggaagccactacatcagagattttaggtggggaacacgacgagggaaggaaaagccagcaagagggggagaaagagcaccagcagcacaagttgactctcccaactgtttcaaattataccattcatgatgccactgatggcaccgacaatggcaaccgggatgatgcagaatttaagcccactctggatgttgaccagagaaatggtcgtgacagatctcatcaagcagcattggataatgtggagcgggacaaaccattgtgtgatttctcaaacttcagagcaaatacctgtgagatgagaggtaacatcagaatacacccaaatggcagttcggtcatttacgtggaacctacaagttcaagtccaaagagaaatgaacaatggaaaattaagccttaccctcgcaaaggtgatgaattatgccttaatcatattacagaagtgacagtgaaatccagcaaagtggcacctgagtgttccaagtaccatcatgtgcctgctgtgatctttgctctgactggatacactggaaatctattccatgacttcaccgacgtgcttgtcccccttttcacgactgcaagtgagttcaatggtgaagttcaattcctaatcacagacatggctatttggtggacaaggaagtatgcagtggtgtttgagaagttaactaagtaccccttgattgatttcaacaaagacaatgaagtgcattgcttcaagcatgccatcgttggccttcatgcttacatggagttcacaattgacccgttaaaggctccacacaattactcaatggtggacttcaaccggttcatgcgcaggacctactctctgcctagggatgcagtgacagcacttggtgagatcccgaagaccaggccaaggttgctgattatctccaggcaaaggacaagaatgttcctcaatctcaaggaaatcgtggccatggctgacgagataggctatgacgtggtggttgaagaggccaatgtgaactccaatgtcactcattttgccaaggtagttaactccgtcgatgtgatgatgggtgtccatggtgctgggctcacaaattgtgtgttccttccacacgatgccatactgattcagattgtaccttggggtgctctagatgggatatgcagaattgattttggctacccagcagaacaaatgggcttgagatacaagcactacagcataggtgtgcacgagagcagcctcacggagcaataccccctggatcacgagatcttcagaaacccacttgctttccacaagaatggattcgagtttgtcagacaaaccttcatggatacacaaaatgtgaggcttgattgcaaccgtttcagacctatactcttggaggctcttgatcaattgaaccaataa

SEQ ID NO: 17427 - protein, 589 aa, Sorghum bicolor
  misc_feature: Useful for making plants with altered carbohydrate content
  misc_feature: Functional homolog of the protein sequence given in SEQ ID NO 14534
  misc_feature: Ceres ANNOT ID no. 8674833
MKAVERAKLVRSLRHESRRLRLLVLVIGFFLVTLTFVVVSKPDALLFNLNGRLLVDQAPRSLLIRQRVDAHDGRSADTLASASGDLKVVDDDTAGEEASTNAIGTSGEEERVLASEPEQSKRAVEATTSEILGGEHDEGRKSQQEGEKEHQQHKLTLPTVSNYTIHDATDGTDNGNRDDAEFKPTLDVDQRNGRDRSHQAALDNVERDKPLCDFSNFRANTCEMRGNIRIHPNGSSVIYVEPTSSSPKRNEQWKIKPYPRKGDELCLNHITEVTVKSSKVAPECSKYHHVPAVIFALTGYTGNLFHDFTDVLVPLFTTASEFNGEVQFLITDMAIWWTRKYAVVFEKLTKYPLIDFNKDNEVHCFKHAIVGLHAYMEFTIDPLKAPHNYSMVDFNRFMRRTYSLPRDAVTALGEIPKTRPRLLIISRQRTRMFLNLKEIVAMADEIGYDVVVEEANVNSNVTHFAKVVNSVDVMMGVHGAGLTNCVFLPHDAILIQIVPWGALDGICRIDFGYPAEQMGLRYKHYSIGVHESSLTEQYPLDHEIFRNPLAFHKNGFEFVRQTFMDTQNVRLDCNRFRPILLEALDQLNQ

SEQ ID NO: 17428 - DNA, 726 bp, Sorghum bicolor
  misc_feature: Ceres ANNOT ID no. 8677081
  misc_feature: Encodes the peptide sequence at SEQ ID NO 17429
atgcatcgtcggaccaccagctgcacccgccggcggagagcgcgccccggtgtcgtggcgctggacttcgtcaataaggcttgcgaggcgaggttcagcgcgtcggcctcggggaccagctcgtcgctgccgtcgagcctcacagtcacagccggcgaagggagcgtctccaacggccgcgctcagcctcagggtcagtaccccttccagcctgtgagcggcggcggcggcagcgacggccactctgccaggaagccgctgccgctggcggtatccatgcagcagcagcagcatgcctcccccgatcactccgcccctgcaggcaccgcgcttaaaaacggcaagtgccacgaccgcgcgcgctccgagaacgacgccggcggcaagacgcacggccaccgctgccactgctctaagaaacggaaatcgcgcgtgaagcggacggtccgcgtgccggcgatcagctcccggaacgcggacatcccggcggatgactactcgtggcgcaagtacggccagaagcccatcaagggatcgccgtatccccgcggctactacaagtgcagcacggtgcgcgggtgcccggcgcggaagcacgtggagcgagaccccggcgagccggcgatgcttatcgtcacctacgagggcgaccaccgccacgacgaccagcagcaggaacggtcggccggcggcgcgcagacggatcacacgacgacgtccagttga

SEQ ID NO: 17429 - protein, 241 aa, Sorghum bicolor
  misc_feature: The sequence is a functional homolog of SEQ ID NO 528 in the 10/374,780 US patent application
  misc_feature: The sequence is a functional homolog of SEQ ID NO 114 in the 11/375,241 US patent application
  misc_feature: The sequence is a functional homolog of SEQ ID NO 146 in the 10/286,264 US patent application
  misc_feature: The sequence is a functional homolog of SEQ ID NO 2500 in the 10/374,780 US patent application
  misc_feature: The sequence is a functional homolog of SEQ ID NO 672 in the 10/412,699 US patent application
  misc_feature: Ceres ANNOT ID no. 8677081
  misc_feature (162)..(222): Pfam ID: WRKY Pfam Description: WRKY DNA -binding domain
MHRRTTSCTRRRRARPGVVALDFVNKACEARFSASASGTSSSLPSSLTVTAGEGSVSNGRAQPQGQYPFQPVSGGGGSDGHSARKPLPLAVSMQQQQHASPDHSAPAGTALKNGKCHDRARSENDAGGKTHGHRCHCSKKRKSRVKRTVRVPAISSRNADIPADDYSWRKYGQKPIKGSPYPRGYYKCSTVRGCPARKHVERDPGEPAMLIVTYEGDHRHDDQQQERSAGGAQTDHTTTSS

SEQ ID NO: 17430 - DNA, 1593 bp, Sorghum bicolor
  misc_feature: Ceres ANNOT ID no. 8677566
  misc_feature: Encodes the peptide sequence at SEQ ID NO 17431
atggcggtgtccgcggccagggtggccgtcgccacggccgtctccttagccgtgcactggctcctccggtccttcctccaggcgcagcaccccgcgctgggcctgctcctcctggccgccgtcttcctcggcattgccgcgacgggcaacgctggcgccgccaacgcgccgccggggccggcggccgtgccggtgttcggcaactggctgcaggtgggcaacgacctgaaccaccgcttcctggcgcgcctgtcggcgcggtacgggcccgtcttccgcctccgcctcggcgtgcgcaacctggtggtcgtctccgacccgcggctcgccacggaggtgctgcacacgcagggggtggagttcggctcccgcccccgcaacgtcgtcttcgacatcttcaccgccaacggcgccgacatggtcttcaccgagtacggcgaccactggcgccgcatgcgccgcgtgatgacgctgcccttcttcaccgcgcgcgtggtgcagcagtacagggacatgtgggaggccgagatggacgccgtcgtctccgacatctccggggacggcgcggcccagcaagccggcttcgtcgtgcgccgcaggctgcagctcatgctgtacaacatcatgtaccggatgatgttcgacgcgcgcttcgactcggtcgacgaccccatgttcgtggaggccaccaggttcaactccgagcgcagccgcctcgcgcagagcttcgactacaactacggcgacttcatccccatcctgcgccccttcctgcgcggctacctcaacaagtgcaaggacctgcagaccaggaggctcgccttcttcaacaacaactacgtcgagaagaggagaaaggtgatggacacgccgggggacaagaacaagctcaggtgcgccatcgaccacatcctccaggcggagaagagcggcgagatcacctcggagaacgtcatctacatcgtcgagaacatcaacgtcgcggccatcgagaccacgctctggtccatcgagtgggcgctcgcagaggtcgtcaaccacccggcggtgcagcgcaaggtccgcgacgagatcaaggccgtcgtcggcgacgacgagcccatcacggagtccaccatccacagactcccttacctgcaggctgtcatcaaggagacgctgcgcctccactcgcccatcccgctcctcgtcccgcacatgaacctcgaggaggccaagctcggcggctacaccatccccaagggctccaaggtggtggtcaacgcgtggtggctggccaacaacccggagctgtgggagaagcccgaggagttccggccggagcggttcctaggcgaggagaagagcgtggacgctaccgtcggcgggaaggtggacttcaggttcctgccgttcggcgtgggccgccgcagctgccccgggatcatcctggcgctgcccatcctcgcgctcatcgtcgggaagctcgtgcgcagcttcgagatggtaccaccgcccggcgtggagaagctcgacgtcagcgagaaaggaggacagttcagcctgcacattgccaagcactctgtcatcgccttccaccctgtctctgcatga

SEQ ID NO: 17431 - protein, 530 aa, Sorghum bicolor
  misc_feature: Useful for making plants with altered carbohydrate content
  misc_feature: Functional homolog of the protein sequence given in SEQ ID NO 14535
  misc_feature: The sequence is a functional homolog of SEQ ID NO 8 in US patent 7148406
  misc_feature: Useful for biocontainment applications
  misc_feature: Useful for making plants with altered cell wall content and/or composition
  misc_feature: Useful for making plants with modulated biomass
  misc_feature: Useful for making plants with modulated flowering time
  misc_feature: Functional homolog of the protein sequence given in SEQ ID NO 14291
  misc_feature: Useful for making plants with altered lignin content
  misc_feature: Functional homolog of the protein sequence given in SEQ ID NO 14292
  misc_feature: Ceres ANNOT ID no. 8677566
  misc_feature (63)..(529): SWISSPROT Homolog: EC 1.14.13.11 Trans-cinnamate 4-monooxygenase
  misc_feature (57)..(524): Pfam ID: p450 Pfam Description: Cytochrome P450
MAVSAARVAVATAVSLAVHWLLRSFLQAQHPALGLLLLAAVFLGIAATGNAGAANAPPGPAAVPVFGNWLQVGNDLNHRFLARLSARYGPVFRLRLGVRNLVVVSDPRLATEVLHTQGVEFGSRPRNVVFDIFTANGADMVFTEYGDHWRRMRRVMTLPFFTARVVQQYRDMWEAEMDAVVSDISGDGAAQQAGFVVRRRLQLMLYNIMYRMMFDARFDSVDDPMFVEATRFNSERSRLAQSFDYNYGDFIPILRPFLRGYLNKCKDLQTRRLAFFNNNYVEKRRKVMDTPGDKNKLRCAIDHILQAEKSGEITSENVIYIVENINVAAIETTLWSIEWALAEVVNHPAVQRKVRDEIKAVVGDDEPITESTIHRLPYLQAVIKETLRLHSPIPLLVPHMNLEEAKLGGYTIPKGSKVVVNAWWLANNPELWEKPEEFRPERFLGEEKSVDATVGGKVDFRFLPFGVGRRSCPGIILALPILALIVGKLVRSFEMVPPPGVEKLDVSEKGGQFSLHIAKHSVIAFHPVSA

SEQ ID NO: 17432 - DNA, 240 bp, Sorghum bicolor
  misc_feature: Ceres ANNOT ID no. 8678058
  misc_feature: Encodes the peptide sequence at SEQ ID NO 17433
atgtcgggaggaccgtgctggtcacggctcctcctcgcgggattttatgccgtcggtttcgacaacctcaacaactcctcggagctcgccgtccgacgtgtcgccgcactcgcgggggaccactcgcgccaccgctccttccacaaggtcacgacgaggccgggaagaagagattttgggggagcacgcaccggagaaggagaagtagcaggcggtgacggaaactcagccaagagctag

SEQ ID NO: 17433 - protein, 79 aa, Sorghum bicolor
  misc_feature: Useful for making plants with altered carbohydrate content
  misc_feature: Functional homolog of the protein sequence given in SEQ ID NO 13976
  misc_feature: Ceres ANNOT ID no. 8678058
  misc_feature (9)..(53): SWISSPROT Homolog: EC 5.1.3.2 UDP-glucose 4-epimerase
MSGGPCWSRLLLAGFYAVGFDNLNNSSELAVRRVAALAGDHSRHRSFHKVTTRPGRRDFGGARTGEGEVAGGDGNSAKS

SEQ ID NO: 17434 - DNA, 1299 bp, Sorghum bicolor
  misc_feature: Ceres ANNOT ID no. 8678228
  misc_feature: Encodes the peptide sequence at SEQ ID NO 17435
atggcgtcgtggacgaggagctcgcggtgcaggggctcggcgcttggcgaactcgacgttggggcgtccacgggctccgggggcgaggtgctcagcgagggcgcggtcaccatggggttgcggggtcacgaccgatgttgcggacgatggcgtcgtcgtggtggctcggcgtcgaggcaaaagctcgacgaggacgcgctccggggtgccgtgctcgcggcgagggctcgatgcgcgtggtcggggcgagatgagctcatcaagaacgccgcatatattggcacccctggaaagggtatccttgctgctgatgagtccacaggcaccattggcaagcgactttcaagcatcaatgtcgagaacattgaggagaaccgccgtgcccttcgtgagctcctcttctgtgcccctggtgccctccagtacctcagcggtgtgatcctctttgaggagaccctctaccagaaaaccaaggatggcaagccctttgttgatgtcctcaatgagggaggtgtgctccccggcatcaaggttgacaagggcaccattgaggttgctggcaccaacaaggagaccaccacacaaggccatgatgaccttggcaagcgctgcgccaagtactatgaggctggtgcccgctttgccaagtggcgtgccgtcctcaacatcggccctaacgagccatcacagcttgccattgacttgaacgctcagggtcttgctcgctacgccatcatctgccaggagaatggtctggtgccaattgttgagcctgagatcctcgtcgatgggccacatgacattgagcgttgtgcctatgttacggagatggtccttgctgcctgctacaaggctctcaatgagcaccatgtcctccttgagggtaccctcctgaagcccaacatggttacccctggctctgactccaagaaggtggctcctgaggtgatcgctgagtacactgtgcgtgccctccagaggactgtccctgctgctgtgcccgccatcgtcttcctctctggtggacagagtgaggaggaggccacactaaacctgaatgccatgaacaagctcaacaccaagaagccgtggtccctatccttctcattcggccgtgcccttcaggcgagcaccctcaaggcctgggctggcaaggaggagaacgtggagaaggccagggctgccttcctcaccaggtgcaaggccaactcggaggccaccctcggcacatacaagggtgacgctgctgccggcgagggtgtctcggagagcctccacgtgaaggactacaagtactga

SEQ ID NO: 17435 - protein, 432 aa, Sorghum bicolor
  misc_feature: Useful for making plants with modulated phosphate use efficiency
  misc_feature: Functional homolog of the protein sequence given in SEQ ID NO 12920
  misc_feature: Useful for making plants with modulated biomass
  misc_feature: Functional homolog of the protein sequence given in SEQ ID NO 13636
  misc_feature: Ceres ANNOT ID no. 8678228
  misc_feature: Up-regulated in shoot tissues in response to salicylic acid treatment
  misc_feature (83)..(432): SWISSPROT Homolog: EC 4.1.2.13 Fructose-bisphosphate aldolase
  misc_feature (85)..(432): Pfam ID: Glycolytic Pfam Description: Fructose-bisphosphate aldolase class-I
MASWTRSSRCRGSALGELDVGASTGSGGEVLSEGAVTMGLRGHDRCCGRWRRRGGSASRQKLDEDALRGAVLAARARCAWSGRDELIKNAAYIGTPGKGILAADESTGTIGKRLSSINVENIEENRRALRELLFCAPGALQYLSGVILFEETLYQKTKDGKPFVDVLNEGGVLPGIKVDKGTIEVAGTNKETTTQGHDDLGKRCAKYYEAGARFAKWRAVLNIGPNEPSQLAIDLNAQGLARYAIICQENGLVPIVEPEILVDGPHDIERCAYVTEMVLAACYKALNEHHVLLEGTLLKPNMVTPGSDSKKVAPEVIAEYTVRALQRTVPAAVPAIVFLSGGQSEEEATLNLNAMNKLNTKKPWSLSFSFGRALQASTLKAWAGKEENVEKARAAFLTRCKANSEATLGTYKGDAAAGEGVSESLHVKDYKY

SEQ ID NO: 17436 - DNA, 96 bp, Sorghum bicolor
  misc_feature: Ceres ANNOT ID no. 8678319
  misc_feature: Up-regulated in shoot tissues in response to salicylic acid treatment
  misc_feature: Encodes the peptide sequence at SEQ ID NO 17437
atgtacaaagtccaggggaatcaatgcaccgaagaggaggctatttgtaaaagagaagaggatctaagaaaaacatacccgcaatggtttgagtaa

SEQ ID NO: 17437 - protein, 31 aa, Sorghum bicolor
  misc_feature: The sequence is a functional homolog of SEQ ID NO 1584 in the 10/374,780 US patent application
  misc_feature: Ceres ANNOT ID no. 8678319
MYKVQGNQCTEEEAICKREEDLRKTYPQWFE

SEQ ID NO: 17438 - DNA, 1176 bp, Sorghum bicolor
  misc_feature: Ceres ANNOT ID no. 8678346
  misc_feature: Encodes the peptide sequence at SEQ ID NO 17439
atgtcgtcgttaggaactccggcacgtagagccatctgcttgctagctgctgtgtccatcgtccttagcacggtcagtctccgttgcgatgccagcaggtcctccgccgatttctcacctgacgatgatgactatggacacgacgagaacggcggcaactcatcctcctcctccttctcgttcaccttccagccggagacgagttcacccggtctggtcttcgggttctacgacgagacatgcccggacgccgaggacatcatctcgtccacgatgcgcaagctctaccactccgaccccaacgtcgccgctgcgctcgtccgcctcttcttccacgactgcttcatccacggctgcgacgcctcggtgctgctggacgtcgtcgacggcggccggaaatcagagcgcgacgccgggccaaaccagtcgctacgaggcatgagcgccatcgaggagatcaagcggagagtggaggcagcgtgtccaagaaccgtctcctgcgcggacatcctggcgctcgccgcgcgagacagcgtcgtcctcgtcggcggaccaacctacccggtcctcacgggccgccgcgacagcgcgcagagcttctaccacgacgccgccgccggcggcatcccgtcgccgaacgccacgtacggcatgacgctggcagcgttcgcgcggcacgggcgggagttcacggagcgggagaccgtcgcgctgttaggagcgcacagcatcgggaaggtgcggtgcaggttcttcgccgacaggatctggaacttcgccggcaccggcgcgcctgacgactccattgatccggacatggtcggcgagatgcgcgcggtgtgcggcggcagcggcggcgatgatggcgatggcgacgacgacggtgcggcggcgatggagatggggtattacaggcagggacgggaggtgggattcggcgcgcactactacgcgaggttgttggaaggccgcggcatcctgcgcgccgaccagcagctcaccgccgggagcaccgtgcggtgggtgcgcgtgtacgcgtctggagcgcgtggggaggaggtgttccgtgaggactttgcgcacgccatggttaagctgtcggggctcgcgccactcacggggtcagctgggcagatacggattagctgctccaaacctgttgtccatgataactga

SEQ ID NO: 17439 - protein, 391 aa, Sorghum bicolor
  misc_feature: Useful for making plants with altered carbohydrate content
  misc_feature: Functional homolog of the protein sequence given in SEQ ID NO 14536
  misc_feature: Ceres ANNOT ID no. 8678346
  misc_feature (72)..(383): SWISSPROT Homolog: EC 1.11.1.7 Peroxidase
  misc_feature (88)..(348): Pfam ID: peroxidase Pfam Description: Peroxidase
MSSLGTPARRAICLLAAVSIVLSTVSLRCDASRSSADFSPDDDDYGHDENGGNSSSSSFSFTFQPETSSPGLVFGFYDETCPDAEDIISSTMRKLYHSDPNVAAALVRLFFHDCFIHGCDASVLLDVVDGGRKSERDAGPNQSLRGMSAIEEIKRRVEAACPRTVSCADILALAARDSVVLVGGPTYPVLTGRRDSAQSFYHDAAAGGIPSPNATYGMTLAAFARHGREFTERETVALLGAHSIGKVRCRFFADRIWNFAGTGAPDDSIDPDMVGEMRAVCGGSGGDDGDGDDDGAAAMEMGYYRQGREVGFGAHYYARLLEGRGILRADQQLTAGSTVRWVRVYASGARGEEVFREDFAHAMVKLSGLAPLTGSAGQIRISCSKPVVHDN

SEQ ID NO: 17440 - DNA, 654 bp, Sorghum bicolor
  misc_feature: Ceres ANNOT ID no. 8678495
  misc_feature: Encodes the peptide sequence at SEQ ID NO 17441
atggcgactcatgccttcctcctagctgcagcgctcttgtctttgttatgctttcatgccattgcctctgatccaagccttctccaagacttttgcgttgtggataagatgtctacagtgcgtgtgaatgggttcccatgcaaggacgcaaaggatgttgttgctgaagatttcttcttccagggccttgacatggccggcaacacaaccaacaagcaaggctccgccgtgacaccggtgaacgtggctcagattgctgggctcaacaccttgggcatctctcttgcccgcatcgattatgcaccctttggtcttaaccctcctcacacacatccgaggggcactgagatattgaccgtgctcgatggctccctgtacgtcggctttgtcacatcaaacccggacaacaagctgatagcaaaggttttgaacaaaggggatgtgttcgtgttccctgagggattgatccatttccaattcaactatggaacaaagagtgctgttgctcttgcagcattgagtagccaaaaccctggggtgatcactgtggccaacgctgtatttggttcgaagccatccatctcagatgatgtccttgccaaggcttttcaagtcgacaagcaaactattgaccgcatccaagctcagttctag

SEQ ID NO: 17441 - protein, 217 aa, Sorghum bicolor
  misc_feature: Useful for making plants with modulated nitrogen use efficiency
  misc_feature: Functional homolog of the protein sequence given in SEQ ID NO 14277
  misc_feature: Ceres ANNOT ID no. 8678495
  misc_feature (22)..(217): SWISSPROT Homolog: EC 1.15.1.1 Superoxide dismutase
  misc_feature (61)..(211): Pfam ID: Cupin_1 Pfam Description: Cupin
MATHAFLLAAALLSLLCFHAIASDPSLLQDFCVVDKMSTVRVNGFPCKDAKDVVAEDFFFQGLDMAGNTTNKQGSAVTPVNVAQIAGLNTLGISLARIDYAPFGLNPPHTHPRGTEILTVLDGSLYVGFVTSNPDNKLIAKVLNKGDVFVFPEGLIHFQFNYGTKSAVALAALSSQNPGVITVANAVFGSKPSISDDVLAKAFQVDKQTIDRIQAQF

SEQ ID NO: 17442 - DNA, 654 bp, Sorghum bicolor
  misc_feature: Ceres ANNOT ID no. 8678508
  misc_feature: Encodes the peptide sequence at SEQ ID NO 17443
atgacgactcatgcattcctcctagctgcagccctcttgtctttgtcatgctttcatgccatggcctctgatccaagccttctccaagacttctgcgttgtggataagatgtctacagtgcgtgtgaatgggttcccatgcaaggatgcaaaagatgttgttgctgaagatttcttcttccagggccttcacatggctggcaacacaaccaacaagcaaggctctgccgtgacaccggtgaacgtggctcagattgccgggctcaacaccttgggcatctctcttgcccgcatcgattatgcaccctttggtcttaaccctcctcacacacatccgcggggcactgagatattgacgatgcttgagggatccttgtacgtcggctttgtcacatcaaacccggacaacaagctgttcacaaaggttcttaacaaaggagatgtgttcgtgttccctgagggattgatccatttccaattcaattatggaagaaagagtgctgtcgctcttgcagcattaagtagccaaaaccctggggtaatcacagtggccaacgctgtatttgggtcaaagccatccatctccgatgacattcttgccaaggcttttcaagtcgacaagcatactgttgaccgtatccaagctcagttctag

SEQ ID NO: 17443 - protein, 217 aa, Sorghum bicolor
  misc_feature: Useful for making plants with modulated nitrogen use efficiency
  misc_feature: Functional homolog of the protein sequence given in SEQ ID NO 14277
  misc_feature: Ceres ANNOT ID no. 8678508
  misc_feature (22)..(217): SWISSPROT Homolog: EC 1.15.1.1 Superoxide dismutase
  misc_feature (61)..(211): Pfam ID: Cupin_1 Pfam Description: Cupin
MTTHAFLLAAALLSLSCFHAMASDPSLLQDFCVVDKMSTVRVNGFPCKDAKDVVAEDFFFQGLHMAGNTTNKQGSAVTPVNVAQIAGLNTLGISLARIDYAPFGLNPPHTHPRGTEILTMLEGSLYVGFVTSNPDNKLFTKVLNKGDVFVFPEGLIHFQFNYGRKSAVALAALSSQNPGVITVANAVFGSKPSISDDILAKAFQVDKHTVDRIQAQF

SEQ ID NO: 17444 - DNA, 660 bp, Sorghum bicolor
  misc_feature: Ceres ANNOT ID no. 8678528
  misc_feature: Encodes the peptide sequence at SEQ ID NO 17445
atggcgagccatcatctgcttctccttgttctgttagctatggcctgctgtcatgccattgcctccgatccgagtcttctccaagatttctgcgttgccgacaagacatctccagtgcgtgtcaatggatttgcttgcaaagacgccaaggacgttgcagcagaagacttccacttctccggcctccacaaggctggcgacacgagcagcagcaagcaggggtcagccgtgacggccgtcaacgtggcacagatcccagggctgaacacgatggggatctccatggtccgcatcgactacgcccccagcggcatgaacccgccgcacacccaccctcgtgccacggagatcctgacggtgctcgagggctccctcttggttggctttgtcacctccaatccaaacaacacgctcgtcgccaaggtcctgaacaagggggacgtgttcgtgttccccaagggcctcgtccacttccagttcaacaatggcaagggcaatgccgtggcccttgcaggcctgagcagccagaaccctggagtcatcactgttgccaacacaaggtttggatcccaaccgtccattgcgaaccatatactcgccaaggcctttcaggttggacaaagcaacggtggacttaatgcaagctcagttctaatataa

SEQ ID NO: 17445 - protein, 219 aa, Sorghum bicolor
  misc_feature: Useful for making plants with modulated nitrogen use efficiency
  misc_feature: Functional homolog of the protein sequence given in SEQ ID NO 14277
  misc_feature: Ceres ANNOT ID no. 8678528
  misc_feature (18)..(205): SWISSPROT Homolog: EC 1.15.1.1 Superoxide dismutase
  misc_feature (60)..(211): Pfam ID: Cupin_1 Pfam Description: Cupin
MASHHLLLLVLLAMACCHAIASDPSLLQDFCVADKTSPVRVNGFACKDAKDVAAEDFHFSGLHKAGDTSSSKQGSAVTAVNVAQIPGLNTMGISMVRIDYAPSGMNPPHTHPRATEILTVLEGSLLVGFVTSNPNNTLVAKVLNKGDVFVFPKGLVHFQFNNGKGNAVALAGLSSQNPGVITVANTRFGSQPSIANHILAKAFQVGQSNGGLNASSVLI

SEQ ID NO: 17446 - DNA, 654 bp, Sorghum bicolor
  misc_feature: Ceres ANNOT ID no. 8678505
  misc_feature: Encodes the peptide sequence at SEQ ID NO 17447
atggcgagtcataccttcctcctagctgcagcactcttgtctttgtcatgctttcatgccattgcctctgatccaagcctactccaagacttctgcgttgtggataagatgtctacagtgcgtgtgaatgggttcccatgcaaggacgcaaaagatgttgttgctgaagatttcttcttccagggccttcacatagccggcaacacaaccaacaagcaaggctctattgtgacaccggtgaacgtggctcagattgccgggctcaacaccttgggtatctctcttgcccgcatcgactatgcaccctatggtcttaaccctcctcacacacatccgcggggcactgagatattgaccgtgctcgagggctccctatacgtcggctttgtcacatcaaacccggacaacaagttgttcgcaaaagttcttaacaaaggggatgtgttcgtgttccctgagggattgatccatttccaattcaattatggaacaaagagtgctgtggctcttgcagcattgagtagccaaaaccccggggtgatcactgtggccaacgctgtatttggatcaaagccatccatctcggatgatgtccttgccaaggcatttcaagtcgacaaacaaactattgaccgcatccaagctcagttttag

SEQ ID NO: 17447 - protein, 217 aa, Sorghum bicolor
  misc_feature: Useful for making plants with modulated nitrogen use efficiency
  misc_feature: Functional homolog of the protein sequence given in SEQ ID NO 14277
  misc_feature: Ceres ANNOT ID no. 8678505
  misc_feature (19)..(217): SWISSPROT Homolog: EC 1.15.1.1 Superoxide dismutase
  misc_feature (61)..(211): Pfam ID: Cupin_1 Pfam Description: Cupin
MASHTFLLAAALLSLSCFHAIASDPSLLQDFCVVDKMSTVRVNGFPCKDAKDVVAEDFFFQGLHIAGNTTNKQGSIVTPVNVAQIAGLNTLGISLARIDYAPYGLNPPHTHPRGTEILTVLEGSLYVGFVTSNPDNKLFAKVLNKGDVFVFPEGLIHFQFNYGTKSAVALAALSSQNPGVITVANAVFGSKPSISDDVLAKAFQVDKQTIDRIQAQF

SEQ ID NO: 17448 - DNA, 654 bp, Sorghum bicolor
  misc_feature: Ceres ANNOT ID no. 8678511
  misc_feature: Encodes the peptide sequence at SEQ ID NO 17449
atggtgactcatgccttcctcctagctgcagcccttttggctttgtcatgctttcatgccattgcctctgatccaagccttatccaagacttctgcgttgccgataagatgtctacagtgcgtatgaatggactcacatgcaaggatgcaaaggatgttgttgccgaggatttcttcttcccgggtcttcaaatggctggcaacacgaccaacaagcaaggctctgccgtgacaccagtgaacgtggctcagatagccgggctcaacaccctgggcatctctcttgctcgcatcgactatgcaccctatggtcttaaccctcctcacacacatccacgggccactgagatattgacagtgcttgagggctccttgtacgtcggctttgtcacatcaaacccagacaacaagctgttcgcaaaggttattaacaaaggggatgtgttcgtgtttcctgagggattgatccatttccagttcaattatggagcaaactgcgccgtggcccttgcagcattgagtagccaaaaccctggggtgatcacagtggccaacgctgtatttgggtccaagccatccatctccgacgacgtccttgccaaggcttttcaagtcgacaagctaactgttgaccgcatccaagctcaattctaa

SEQ ID NO: 17449 - protein, 217 aa, Sorghum bicolor
  misc_feature: Useful for making plants with modulated nitrogen use efficiency
  misc_feature: Functional homolog of the protein sequence given in SEQ ID NO 14277
  misc_feature: Ceres ANNOT ID no. 8678511
  misc_feature (19)..(217): SWISSPROT Homolog: EC 1.15.1.1 Superoxide dismutase
  misc_feature (61)..(211): Pfam ID: Cupin_1 Pfam Description: Cupin
MVTHAFLLAAALLALSCFHAIASDPSLIQDFCVADKMSTVRMNGLTCKDAKDVVAEDFFFPGLQMAGNTTNKQGSAVTPVNVAQIAGLNTLGISLARIDYAPYGLNPPHTHPRATEILTVLEGSLYVGFVTSNPDNKLFAKVINKGDVFVFPEGLIHFQFNYGANCAVALAALSSQNPGVITVANAVFGSKPSISDDVLAKAFQVDKLTVDRIQAQF

SEQ ID NO: 17450 - DNA, 1467 bp, Sorghum bicolor
  misc_feature: Ceres ANNOT ID no. 8678581
  misc_feature: Encodes the peptide sequence at SEQ ID NO 17451
atggcaccgccccaaacctccggtctcggcgcgccgcagcggcggctcctccaggcggcggccgacggcgacctccagctcttcaagaggaccgcaagtgcgctggacgccggcaagggccgcctcagagaggcagtcgaggccgtgaagagccggggcgcttcacttcgccgcgggacgcggcaggctggctgggatacacctctagcctatgcaattcaaggtggcactgtggacacagtacaatatcttcttgatcatgatgctaatccagataaacctattgggaaagggtctacacctcttcatttagctgccgccggaggaaattgtgaaatgttaaaagccttactctcaaagggggccaatgtcgattcactttctgatactgggacaccactgcatgtggctgcttactgtaagcaggatggtgctatgaagattttgttggaccatggtgcagattataacaaggtttttaacactctgtgcacaccactttttgtgtctctcacttctcgctcactggaatgtgtgaagcttctaattaagtttgggcaccttcctattgaacttgctgcatatgagaacagaaggaaagatgttgagattctacttccagtaacttcacgtgttccgtatgtgcgtgattggagtgttgatgggataattgattttgtgagatcaatgccatcagttgagggtgaccccatgtacaaaatgaaaccagatgatatcaagtttgaaggaaacaaggcatataagagaaaggattatcttactgctgtaaaactctattctatggcaataaaccacaggcctgatgatacgaccttgtactcaaataggtgtctttgttggattaagatgggcgaaggagtccgggcattcacagatgctgggatttgcaggatgcagtgccctgattcggcaaaggcctgctatctacaaggagctgctaatatgttacttaaggactacaaaaaggcatgtgatgcatttcttgatggtctcaaactggacccagcaaatgttgagattgagaaagcattacgggaacaaggaggtggcggcggacgccgacgcttcacgggatcgcaccgcggctgcctcgcgtgcgttgtcttcctccgcggggaggagttggccgcgggcgcgagcgcggacgacgaccgcgtagcgcgcatcctcgctcgcctcggccacctcctccgcggcgacggcgaggccccgggtgccgtggctgccgtgcccgccacgggcgtcgcgcacgccgaccgccgcctccaccagctcatggccgcggacctcgaccgcgcgtcgtcgttctcggccccggcactgtctccagctgtgtccgtacagagctccggcgtggtgacggctccgccgtgcgctacggcgtgcggtgcggggtggggagggggaaagtggggtgggtacggggctgccagatctgggggttga

SEQ ID NO: 17451 - protein, 488 aa, Sorghum bicolor
  misc_feature: The sequence is a functional homolog of SEQ ID NO 1467 in the 10/374,780 US patent application
  misc_feature: The sequence is a functional homolog of SEQ ID NO 873 in the 10/666,642 US patent application
  misc_feature: Ceres ANNOT ID no. 8678581
  misc_feature (64)..(189): SWISSPROT Homolog: EC 2.7.11.1 Non-specific serine/threonine protein kinase
  misc_feature (230)..(351): SWISSPROT Homolog: EC 3.1.3.16 Phosphoprotein phosphatase
  misc_feature (97)..(129): Pfam ID: Ank Pfam Description: Ankyrin repeat
  misc_feature (311)..(344): Pfam ID: TPR_2 Pfam Description: Tetratricopeptide repeat
MAPPQTSGLGAPQRRLLQAAADGDLQLFKRTASALDAGKGRLREAVEAVKSRGASLRRGTRQAGWDTPLAYAIQGGTVDTVQYLLDHDANPDKPIGKGSTPLHLAAAGGNCEMLKALLSKGANVDSLSDTGTPLHVAAYCKQDGAMKILLDHGADYNKVFNTLCTPLFVSLTSRSLECVKLLIKFGHLPIELAAYENRRKDVEILLPVTSRVPYVRDWSVDGIIDFVRSMPSVEGDPMYKMKPDDIKFEGNKAYKRKDYLTAVKLYSMAINHRPDDTTLYSNRCLCWIKMGEGVRAFTDAGICRMQCPDSAKACYLQGAANMLLKDYKKACDAFLDGLKLDPANVEIEKALREQGGGGGRRRFTGSHRGCLACVVFLRGEELAAGASADDDRVARILARLGHLLRGDGEAPGAVAAVPATGVAHADRRLHQLMAADLDRASSFSAPALSPAVSVQSSGVVTAPPCATACGAGWGGGKWGGYGAARSGG

SEQ ID NO: 17452 - DNA, 1566 bp, Sorghum bicolor
  misc_feature: Ceres ANNOT ID no. 8678791
  misc_feature: Encodes the peptide sequence at SEQ ID NO 17453
atggggtcgcccaaggcggccaagagcatggtgaagcagcgcatctggcgtcaccggctcgtcgcaccgttcgctgccgttcttgtcacggccgtcctcgccgtcgtcgtattctccggcctgttcgcgcaggatccaaacgccaccccggagttcactgctgtaaatgtgggcaacacccggccagtgcgcgataagtcggagttcacagcagccagtggatctcccaacaaggaggatcttgcaacatcggcatctgatcaagaattggatgatggaaattctgagcccaatcaagcttcccaaggcaccgtgcctgcaacaggggagggagggacagcaacggcagtgccgacccaaagagaaagaagcactggaggatctggtttagttcagtacacaacatgcacacctcgaactagaacaaccatctgtgatctctccaaccaacgcttcgacatctgtgagctttgtggtaatgctcgcaccattggccgctcctccactgtaatgtatgtcccacagtcccttacttccaatggagaagagtggaatattccagcacagtcacggaaaagccttccatggatcaagaaggtgactgtcaaaaccctgaaggcttcccaacaggtgccaagatgcacatccaggcatgccataccagccattgtctttgcattgggcgggtttacagcgaatgtctggcatgatgtcagtgatgttcttgtccctctgtttcttactgcccagcagtttgaccgagatgtccaattacttatcaccaataatcagccctggttcatcaagaaatactcagcaatctttcatcgcctcacaagacacaacattattgattttgatgcagacgatgaggtcaggtgctatccacatgtcattgttgggctgaggagccaccgggatcttggtattgatccaaactctacaccgcagaactacacaatgatggatttccgtttgtttgtccgtgaagcctatggattacctgcgcctgaagtggatataccatacagggttgacaaagatgaccctgaaaagaagcccaggataatgctcattgaccgaggcaagacacgaaggttcatgaatatgcctgatgttttacgagggcttgattggtttggtttcgaggtggtcagggcagatccaaggattgattctactcttgatgaatttgtccgcctagttgattcatgtgatgcaatgatgggtgttcacggtgcgggcttgactaacatggtgttcctgaggtcaggtgcagtggtggtgcacattgtaccctatggggttgagttcatggctaatggattctacggtgcacctgcaagggacatgggcctcagacacgtgcagtacagcatcagtccagatgagagcacactactggagaagtatggcgagaaccatatggtgattaaagatccagaagccataaggaacagtggatgggagaaggttggggagttgtatatgaccaaacaggacgttgtgctcaatatgacgaggtttgggcctagtttgttgaaggcaatagagttcattgtgtag

SEQ ID NO: 17453 - protein, 521 aa, Sorghum bicolor
  misc_feature: Useful for making plants with altered carbohydrate content
  misc_feature: Functional homolog of the protein sequence given in SEQ ID NO 14537
  misc_feature: Ceres ANNOT ID no. 8678791
MGSPKAAKSMVKQRIWRHRLVAPFAAVLVTAVLAVVVFSGLFAQDPNATPEFTAVNVGNTRPVRDKSEFTAASGSPNKEDLATSASDQELDDGNSEPNQASQGTVPATGEGGTATAVPTQRERSTGGSGLVQYTTCTPRTRTTICDLSNQRFDICELCGNARTIGRSSTVMYVPQSLTSNGEEWNIPAQSRKSLPWIKKVTVKTLKASQQVPRCTSRHAIPAIVFALGGFTANVWHDVSDVLVPLFLTAQQFDRDVQLLITNNQPWFIKKYSAIFHRLTRHNIIDFDADDEVRCYPHVIVGLRSHRDLGIDPNSTPQNYTMMDFRLFVREAYGLPAPEVDIPYRVDKDDPEKKPRIMLIDRGKTRRFMNMPDVLRGLDWFGFEVVRADPRIDSTLDEFVRLVDSCDAMMGVHGAGLTNMVFLRSGAVVVHIVPYGVEFMANGFYGAPARDMGLRHVQYSISPDESTLLEKYGENHMVIKDPEAIRNSGWEKVGELYMTKQDVVLNMTRFGPSLLKAIEFIV

SEQ ID NO: 17454 - DNA, 1605 bp, Sorghum bicolor
  misc_feature: Ceres ANNOT ID no. 8678773
  misc_feature: Encodes the peptide sequence at SEQ ID NO 17455
atggtagccggcgccgggaaccccgggcggcctgtcgccgtcctcgctctcctcctcttcctcctcgccgccgccgcggcgcccgcggcttcaggggccgggtccgcggccgtgaacggggaccgcctccgggcagagcagatccggaagcaggcctcggacgccgccgcatccgccgccgcgctcgccgcggcgtcgcgcaggctccacctcgaccgcgcgcggcacctccgcctcctctcctcgctccaccgcaacctcaccaacacgctccgcgccctctccatagccgccgactccgcctccgcctcggacgcttcctccggctccggctccgactccgcctccgccaacgtttcgtcctcccgcctgctcgacctccaggccaaggacctcatccgcgccgcgcgcgccgccatcgccgactccaagccgctcttcgacccgcagctcaagatccagcgcctcaaggacaccatcttcgcgcagaacgagctgctcgcgcgcgccaagaagcgcggcgccttcgcctccctcatcgccgccaagtccatccccaagccgctccactgcctcgccgtccgcctcaccgccgagcggatcgcaaggcccgaccactacgcagacccggtgccgccgccgcgggcgctcgaggaccccgcgctcttccactatgcgatcttctccgacaacgtgctcgcggcctcatgcgtcgtgcgctccgccgtagccaactccaacgatccctctaagcacgtcttccatgttgtcaccgaccggatgaacctcggcgccatgcaggtgataatacgccgaatggacttaaaaggtgcacactatgaggttaaagcatttgaggattacaaattcctcaactcctcatacgttcctgtgctccggcaactggagtcagcaaacctccagaaattctattttgagaacaagcttgagaatgccaccaaagatgctagcaatatgaagtttaggaatcccaaatatctgtctatgcttaatcacttgcgattctatttgccggagatgtacccaaagctacaccgcattcttttcctggatgatgatgttgtggtacaaagggatcttactggactctggaagattgacatggatgggaaggtgaatggggcagtagaaacatgctttggatcttttcatcgatatgcacagtatatgaatttctcacacccccttatcaaagcaaagtttaatcctaatgcctgtggttgggcatacggaatgaatttctttgatcttgattcttggaggagggagaagtgtactgagcagtaccattattggcagaatcagaacgagaaccggacattatggaagctaggaacgctacccccaggcttaatcactttctactccaccacaaaacctcttgagaaatcttggcatgttcttggacttggatacaatccaagcatcagcatggaggagattagaaatgctgctgttgtgcatttcaatggcaacatgaagccctggcttgacatcggtatgaaccagttcaggcacctttggacaaagtacgtggactatgatgactcatatattcgtcaatgcaatttcgcaccaccatag

SEQ ID NO: 17455 - protein, 534 aa, Sorghum bicolor
  misc_feature: Useful for making plants with altered carbohydrate content
  misc_feature: Functional homolog of the protein sequence given in SEQ ID NO 14538
  misc_feature: Useful for making plants with altered cell wall content and/or composition
  misc_feature: Functional homolog of the protein sequence given in SEQ ID NO 13957
  misc_feature: Ceres ANNOT ID no. 8678773
  misc_feature (191)..(507): Pfam ID: Glyco_transf_8 Pfam Description: Glycosyl transferase family 8
MVAGAGNPGRPVAVLALLLFLLAAAAAPAASGAGSAAVNGDRLRAEQIRKQASDAAASAAALAAASRRLHLDRARHLRLLSSLHRNLTNTLRALSIAADSASASDASSGSGSDSASANVSSSRLLDLQAKDLIRAARAAIADSKPLFDPQLKIQRLKDTIFAQNELLARAKKRGAFASLIAAKSIPKPLHCLAVRLTAERIARPDHYADPVPPPRALEDPALFHYAIFSDNVLAASCVVRSAVANSNDPSKHVFHVVTDRMNLGAMQVIIRRMDLKGAHYEVKAFEDYKFLNSSYVPVLRQLESANLQKFYFENKLENATKDASNMKFRNPKYLSMLNHLRFYLPEMYPKLHRILFLDDDVVVQRDLTGLWKIDMDGKVNGAVETCFGSFHRYAQYMNFSHPLIKAKFNPNACGWAYGMNFFDLDSWRREKCTEQYHYWQNQNENRTLWKLGTLPPGLITFYSTTKPLEKSWHVLGLGYNPSISMEEIRNAAVVHFNGNMKPWLDIGMNQFRHLWTKYVDYDDSYIRQCNFAPP

SEQ ID NO: 17456 - DNA, 327 bp, Sorghum bicolor
  misc_feature: Ceres ANNOT ID no. 8678932
  misc_feature: Encodes the peptide sequence at SEQ ID NO 17457
atggtggcgccggtggtgatcgcgtcggcggggctgggcatgctggccggcgtggcgatggccaaccggtcccttgggggggacgggctcccagcggcgtccaagtgggacgcgcgcccgcgctgcgccacgtgcggcggctccggccgcgtcgagtgcatgtgcaaccgctggtccgacggcgactccggttgccggacctgcgcggggtccgggaggatgccctgccgcagctgcggcggatccggcacgggcaggccgctccccgcgcggctcatcgtccagcaccagaagccgccgccgccgccgccggccggccacaactga

SEQ ID NO: 17457 - protein, 108 aa, Sorghum bicolor
  misc_feature: Useful for making plants with modulated nitrogen use efficiency
  misc_feature: Functional homolog of the protein sequence given in SEQ ID NO 13294
  misc_feature: Ceres ANNOT ID no. 8678932
MVAPVVIASAGLGMLAGVAMANRSLGGDGLPAASKWDARPRCATCGGSGRVECMCNRWSDGDSGCRTCAGSGRMPCRSCGGSGTGRPLPARLIVQHQKPPPPPPAGHN

SEQ ID NO: 17458 - DNA, 1230 bp, Sorghum bicolor
  misc_feature: Ceres ANNOT ID no. 8678995
  misc_feature: Encodes the peptide sequence at SEQ ID NO 17459
atggccgtgccggtctgggacacgcccatgagtctgcctgggtacattgcgcgccttcccaagcctcctgcgactgaattgcttgagcaggtgctgcgtcttgttggtgaatcaaggcgccctgttctttatgttggtggtggctgcgcagcatctggcgaggagttgcgccgctttgtggagatgactggaatcccagtcacaactactcttatgggccttggcaatttccctggcgacgacccactgtctctgcgcatgcttggtatgcatggcacggtgtatgcaaattatgcagtggataaggcggatctgttgcttgcatttggtgtgcggtttgatgatcgtgtgacagggaagattgaggcttttgcaagcagggctaagattgtgcacattgatattgatcccgctgagattggcaagaacaagcagccacatgtgtccatctgtgcagacgttaagcttgctttgcagggcatgaatgctcttctggaaggaagcacatcaaagaagagctttgactttggctcatggcaagctgagttggatcagcagaagagagagttcccccttgggtataaaacttttgatgacgagatccagccacaatatgctattcaggttcttgatgagctgacaaaaggggaggccatcattgccacaggtgttgggcagcaccagatgtgggcggcacagtactacacttacaagcggccaaggcagtggttgtcttcagctggtcttggggctatgggatttggtttgccggctgctgctggcgctgctgtggccaacccaggtatcactgttgttgacatcgacggagatggtagcttcctcatgaacattcaggagctagctatgatccgaattgagaacctcccagtgaaggtctttgtgctaaacaaccagcacctggggatggtggtgcagtgggaggacaggttctataaggccaatagagcacacacatacttgggaaacccagagaatgaaagtgagatatatccagatttcgtgacaattgccaaagggttcaacattccagcagtccgtgtgacaaagaagagcgaagtccatgcagcaatcaagaagatgcttgagactccagggccatacctcttggatataatcgtcccgcaccaggagcatgtgttgcctatgatccctagtggtggggctttcaaggatatgatcctggatggtgatggcaggactgtgtattga

SEQ ID NO: 17459 - protein, 409 aa, Sorghum bicolor
  misc_feature: Useful for making plants with modulated herbicide sensitivity
  misc_feature: Functional homolog of the protein sequence given in SEQ ID NO 14539
  misc_feature: Ceres ANNOT ID no. 8678995
  misc_feature: Down-regulated in shoot tissues in response to salicylic acid treatment
  misc_feature (1)..(409): SWISSPROT Homolog: EC 2.2.1.6 Acetolactate synthase
  misc_feature (28)..(161): Pfam ID: TPP_enzyme_M Pfam Description: Thiamine pyrophosphate enzyme, central domain
  misc_feature (223)..(378): Pfam ID: TPP_enzyme_C Pfam Description: Thiamine pyrophosphate enzyme, C-terminal TPP binding domain
MAVPVWDTPMSLPGYIARLPKPPATELLEQVLRLVGESRRPVLYVGGGCAASGEELRRFVEMTGIPVTTTLMGLGNFPGDDPLSLRMLGMHGTVYANYAVDKADLLLAFGVRFDDRVTGKIEAFASRAKIVHIDIDPAEIGKNKQPHVSICADVKLALQGMNALLEGSTSKKSFDFGSWQAELDQQKREFPLGYKTFDDEIQPQYAIQVLDELTKGEAIIATGVGQHQMWAAQYYTYKRPRQWLSSAGLGAMGFGLPAAAGAAVANPGITVVDIDGDGSFLMNIQELAMIRIENLPVKVFVLNNQHLGMVVQWEDRFYKANRAHTYLGNPENESEIYPDFVTIAKGFNIPAVRVTKKSEVHAAIKKMLETPGPYLLDIIVPHQEHVLPMIPSGGAFKDMILDGDGRTVY

SEQ ID NO: 17460 - DNA, 1539 bp, Sorghum bicolor
  misc_feature: Ceres ANNOT ID no. 8679096
  misc_feature: Down-regulated in shoot tissues in response to salicylic acid treatment
  misc_feature: Encodes the peptide sequence at SEQ ID NO 17461
atgggctgcttctcgtgcttcgactccccggcggatgagcagctcaacccaaaattcggtggcgccggtgggtacggcggcggcacgtccgctgccgccgcggcgtacggagccggcgccggcgccggcgtcggccggcacgggggcaggggcgggtacccggacctgcagcaggcgcccatggcggcgccgcgcgtcgagaagttctccgcagcggctgagaaagcaagagttaagagcaatgtgctcaccaaggaggcttcggtgccaaaggatgccaacggcaatgccatctcggcgcagactttcaccttccgtgagctcgccaccgctaccaggaacttcaggcctgagtgcttcctgggagagggaggttttggacgtgtttacaagggacgccttgagagcacaggccaggttgttgctataaagcagcttaacagggatgggcttcaaggaaacagagaatttctagtagaagttctcatgctcagcttactacatcatcaaaacctggttaatttgattggttattgtgctgatggagaccagcgacttcttgtttatgaatatatgccctccggatcactggaagatcatttgcatgatctacctcttgataaggaggccttggactggaacaccaggatgaaaattgcagcaggtgctgccaaaggacttgagtaccttcatgacaaagctaatccgccagttatttatagggatttcaagtcatcaaacattctgttggatgaaagtttccacccgaagctgtctgactttggacttgctaagttgggtccagttggcgacaaatcacatgtctcaacacgtgtaatgggtacatatggttattgtgcaccagaatatgctatgacagggcagctaacagtgaagtctgatgtgtatagctttggggttgtcttgctagagttgattactggtcgtagggctatcgacagcaccagaccacatggagaacaaaatcttgtctcatgggcacgtcctcttttcaatgacagaagaaagctccctaagatggctgacccaaggctggaagggcgataccccatgcgtgggctttaccaagccctcgcggtggcttccatgtgcattcagtcggaggctgcttcacgcccactgattgcagatgtggtgactgctctgtcctacttggcatcccagcaatatgatcccaacacagctcttgcttcaaggaagccaggtggcgatcaacgaagcaggcctggtgagaacggcagggtggtttccaggaatgacgagactggaagctcgggccacaaatcacctggcaaggaccgggaggactcacccagggacctcccagcgatcctgaacaaggacctggaacgtgagcgcatggtggcggaggcgaagatgtggggcgaccgggagcgcatggttgccgaggcgaagatgtggggcgaccgggagcgcatggtggccgaggcgaagatgtggggcgagaattggcgtgataagcggcgtgcagagaatgggcaggggagcctggactag

SEQ ID NO: 17461 - protein, 512 aa, Sorghum bicolor
  misc_feature: Useful for making plants with modulated drought sensitivity
  misc_feature: Functional homolog of the protein sequence given in SEQ ID NO 14078
  misc_feature: Ceres ANNOT ID no. 8679096
  misc_feature (57)..(473): SWISSPROT Homolog: EC 2.7.11.1 Non-specific serine/threonine protein kinase
  misc_feature (115)..(389): Pfam ID: Pkinase Pfam Description: Protein kinase domain
MGCFSCFDSPADEQLNPKFGGAGGYGGGTSAAAAAYGAGAGAGVGRHGGRGGYPDLQQAPMAAPRVEKFSAAAEKARVKSNVLTKEASVPKDANGNAISAQTFTFRELATATRNFRPECFLGEGGFGRVYKGRLESTGQVVAIKQLNRDGLQGNREFLVEVLMLSLLHHQNLVNLIGYCADGDQRLLVYEYMPSGSLEDHLHDLPLDKEALDWNTRMKIAAGAAKGLEYLHDKANPPVIYRDFKSSNILLDESFHPKLSDFGLAKLGPVGDKSHVSTRVMGTYGYCAPEYAMTGQLTVKSDVYSFGVVLLELITGRRAIDSTRPHGEQNLVSWARPLFNDRRKLPKMADPRLEGRYPMRGLYQALAVASMCIQSEAASRPLIADVVTALSYLASQQYDPNTALASRKPGGDQRSRPGENGRVVSRNDETGSSGHKSPGKDREDSPRDLPAILNKDLERERMVAEAKMWGDRERMVAEAKMWGDRERMVAEAKMWGENWRDKRRAENGQGSLD

SEQ ID NO: 17462 - DNA, 351 bp, Sorghum bicolor
  misc_feature: Ceres ANNOT ID no. 8679124
  misc_feature: Encodes the peptide sequence at SEQ ID NO 17463
atgccgcagccacacatcatggtggtgccctacccgggctccggtaacatcaacccggcgctgcagctggccctgcttttgtgctaccacggcatcttcatcaccttcgtcgtcaccgggcacaacctccgccgcgcccaggccgccgccaccgaaggcgccgtgagcagttgcgacgacgcgttccggatcgagaccatcccagacgggactacgacttcagccaacgacgacagggcgttcgcggaggagctggccgagctgtgggccaccacggcgtgcgttcccgacgacgtgctcgtgtgcctggtgggcaacatggtgacggaggaggcgctgcccacgtactag

SEQ ID NO: 17463 - protein, 116 aa, Sorghum bicolor
  misc_feature: Useful for making plants with altered carbohydrate content
  misc_feature: Functional homolog of the protein sequence given in SEQ ID NO 14529
  misc_feature: Ceres ANNOT ID no. 8679124
  misc_feature (4)..(60): SWISSPROT Homolog: EC 2.4.1.121 Indole-3-acetate beta-glucosyltransferase
  misc_feature (95)..(116): SWISSPROT Homolog: EC 1.14.19.2 Acyl-[acyl-carrier-protein] desaturase
MPQPHIMVVPYPGSGNINPALQLALLLCYHGIFITFVVTGHNLRRAQAAATEGAVSSCDDAFRIETIPDGTTTSANDDRAFAEELAELWATTACVPDDVLVCLVGNMVTEEALPTY

SEQ ID NO: 17464 - DNA, 804 bp, Sorghum bicolor
  misc_feature: Ceres ANNOT ID no. 8679197
  misc_feature: Encodes the peptide sequence at SEQ ID NO 17465
atggcgtactacgacgtgggcacacgctcctccgcctcctcgtcgcttcagcccggcgacatggacgccacagccgtgccgccggtggccactggtgggtctcctcatcaccgggttccgctggaagcgggggctgccgcgggtggttcctccgcggccgggcaagcagccgtggaggttgaagaaggtacctcgacgacgacgatgcgtcactaccgtggcgtccggcggcggccatggggcaagtgggcggcggagatccgcgaccccgccaaagcggcgcgcgtctggctgggcaccttcgacaccgcggaggccgccgcggctgcctacgacgacgccgcgctccggttcaagggcgccaaggccaagctcaacttccccgagcgcgtccggggccgcaccggccagggcgccttcctcgtctcccctggtatcccccagccgccgccgccgccagtatcagctcccccattattgccattgccaccgtcgtctccggtgccgttcccggacctgatgcggtacgcgcaactgcttcacagcggcaacgtcgtggccagcagcaccggtgatctcgcggcgccgtcgtcgtcgtcacaggcatcgtcgtcgtcggtgcagattctggacttctcgacgcggcaactcctccgggcctcaccgccttcaacgttcggccgaccgccgatgctgacatcggcatcgatgtctatgtcttcttcgaccagcatgtcggtgcctcacgtcgaggccaacgatagcggagtaggggaggagactggcactgctccgcctgactga

SEQ ID NO: 17465 - protein, 267 aa, Sorghum bicolor
  misc_feature: The sequence is a functional homolog of SEQ ID NO 14 in the 10/903,236 US patent application
  misc_feature: The sequence is a functional homolog of SEQ ID NO 1737 in the 10/374,780 US patent application
  misc_feature: The sequence is a functional homolog of SEQ ID NO 2129 in the 10/666,642 US patent application
  misc_feature: The sequence is a functional homolog of SEQ ID NO 74 in the 10/714,887 US patent application
  misc_feature: The sequence is a functional homolog of SEQ ID NO 74 in the 11/435,388 US patent application
  misc_feature: The sequence is a functional homolog of SEQ ID NO 164 in the 10/714,887 US patent application
  misc_feature: The sequence is a functional homolog of SEQ ID NO 164 in the 11/435,388 US patent application
  misc_feature: The sequence is a functional homolog of SEQ ID NO 32 in the 10/903,236 US patent application
  misc_feature: Useful for making plants with altered lignin content
  misc_feature: Functional homolog of the protein sequence given in SEQ ID NO 13219
  misc_feature: The sequence is a functional homolog of SEQ ID NO 18 in the 10/903,236 US patent application
  misc_feature: The sequence is a functional homolog of SEQ ID NO 2211 in the 10/666,642 US patent application
  misc_feature: The sequence is a functional homolog of SEQ ID NO 78 in the 10/714,887 US patent application
  misc_feature: The sequence is a functional homolog of SEQ ID NO 78 in the 11/435,388 US patent application
  misc_feature: Ceres ANNOT ID no. 8679197
  misc_feature (70)..(121): Pfam ID: AP2 Pfam Description: AP2 domain
MAYYDVGTRSSASSSLQPGDMDATAVPPVATGGSPHHRVPLEAGAAAGGSSAAGQAAVEVEEGTSTTTMRHYRGVRRRPWGKWAAEIRDPAKAARVWLGTFDTAEAAAAAYDDAALRFKGAKAKLNFPERVRGRTGQGAFLVSPGIPQPPPPPVSAPPLLPLPPSSPVPFPDLMRYAQLLHSGNVVASSTGDLAAPSSSSQASSSSVQILDFSTRQLLRASPPSTFGRPPMLTSASMSMSSSTSMSVPHVEANDSGVGEETGTAPPD

SEQ ID NO: 17466 - DNA, 804 bp, Sorghum bicolor; identical to SEQ ID NO: 17464
  misc_feature: Ceres ANNOT ID no. 8679195
  misc_feature: Encodes the peptide sequence at SEQ ID NO 17467

SEQ ID NO: 17467 - protein, 267 aa, Sorghum bicolor; identical to SEQ ID NO: 17465
  misc_feature: The sequence is a functional homolog of SEQ ID NO 14 in the 10/903,236 US patent application
  misc_feature: The sequence is a functional homolog of SEQ ID NO 1737 in the 10/374,780 US patent application
  misc_feature: The sequence is a functional homolog of SEQ ID NO 2129 in the 10/666,642 US patent application
  misc_feature: The sequence is a functional homolog of SEQ ID NO 74 in the 10/714,887 US patent application
  misc_feature: The sequence is a functional homolog of SEQ ID NO 74 in the 11/435,388 US patent application
  misc_feature: The sequence is a functional homolog of SEQ ID NO 164 in the 10/714,887 US patent application
  misc_feature: The sequence is a functional homolog of SEQ ID NO 164 in the 11/435,388 US patent application
  misc_feature: The sequence is a functional homolog of SEQ ID NO 32 in the 10/903,236 US patent application
  misc_feature: Useful for making plants with altered lignin content
  misc_feature: Functional homolog of the protein sequence given in SEQ ID NO 13219
  misc_feature: The sequence is a functional homolog of SEQ ID NO 18 in the 10/903,236 US patent application
  misc_feature: The sequence is a functional homolog of SEQ ID NO 2211 in the 10/666,642 US patent application
  misc_feature: The sequence is a functional homolog of SEQ ID NO 78 in the 10/714,887 US patent application
  misc_feature: The sequence is a functional homolog of SEQ ID NO 78 in the 11/435,388 US patent application
  misc_feature: Ceres ANNOT ID no. 8679195
  misc_feature (70)..(121): Pfam ID: AP2 Pfam Description: AP2 domain

SEQ ID NO: 17468 - DNA, 1398 bp, Sorghum bicolor
  misc_feature: Ceres ANNOT ID no. 8679223
  misc_feature: Encodes the peptide sequence at SEQ ID NO 17469
atgtttgcacttcaacatgcatgtgaaaacctaacattggttcatgatatccctttggcagatgctgatgtggaagtagtggctttgtcacccaaggcactcctggcaacaaacagatacatatgtgaggtctgtcacaagggcttccaaagagaccagaacctccagctccataggaggggccataacctaccatggaagctgaagcagagaagcagcaatgaagctaaaaagaaggtgtatgtctgccctgaggtcacctgccctcatcatgatggaagccgagcattgggcgatctcacaggcataaagaagcactactccaggaaacatggggagaagaagtggaagtgtgacaggtgttcaaagaagtatgctgttcagtcggactggaaggcgcacacaaagatatgtggcacaaaggagtaccgatgtgactgtggaacaatattctcaagaaaggacagtttcatcacacatcgagccttctgtgatgcactggctgaagacaactccagggctaaccatagccttgcaacaatggtgggaagtctgcatggtcaccagcacaatatcttttcacatggagtacctaccttccccacttcaccaactaatgtgatggcaaacttgtcgagcaatgatcataattcatatagtcatctgaaatctctgtccccttatgctctgattacaagaaacacaacattgttctccaaccagatatcacccaaggattcaggctttccacttgatggaagcgcgtcaagttacccttatatgccaatgaattccccatacatgtctgctactgcacttctacagaaagctgcagagatgggtgcgaagaccagccaggatcctatatcaccattactcctaaaaagcttcccaagtaacgtgacaactcctagtcttagagatcacatggacatatcttctggaagacaaggatactgccttgggaattcagcagctagcagtgttggcatcatggcaactgaacatgagggctcttacatgagtggtcacagtaacattctgaccaatacaccatgggtgaataataataggcctaccacagtgcccttaattggactaatgaatgatccatttggcatgagagcagagaaggataactctggcatatttcctggaggccagacgcaacacagcaggcaggaaaatatttcacgggtaggagatgctggactaacccaagactttctaggattaggaggcagtgggaatttagaaatgacttctgagacttacaatgcagatgtcacagcattgagctattctgatgagcagcaaaagctacaggaacatatctactcttaccatcagtcatctcttaactccactgcactggagaaacccatttgggaatcctga

SEQ ID NO: 17469 - protein, 465 aa, Sorghum bicolor
  misc_feature: The sequence is a functional homolog of SEQ ID NO 1524 in the 10/666,642 US patent application
  misc_feature: The sequence is a functional homolog of SEQ ID NO 312 in the 10/666,642 US patent application
  misc_feature: The sequence is a functional homolog of SEQ ID NO 1087 in the 10/666,642 US patent application
  misc_feature: Useful for making plants with altered lignin content
  misc_feature: Functional homolog of the protein sequence given in SEQ ID NO 13275
  misc_feature: Ceres ANNOT ID no. 8679223
  misc_feature (40)..(62): Pfam ID: zf-C2H2 Pfam Description: Zinc finger, C2H2 type
MFALQHACENLTLVHDIPLADADVEVVALSPKALLATNRYICEVCHKGFQRDQNLQLHRRGHNLPWKLKQRSSNEAKKKVYVCPEVTCPHHDGSRALGDLTGIKKHYSRKHGEKKWKCDRCSKKYAVQSDWKAHTKICGTKEYRCDCGTIFSRKDSFITHRAFCDALAEDNSRANHSLATMVGSLHGHQHNIFSHGVPTFPTSPTNVMANLSSNDHNSYSHLKSLSPYALITRNTTLFSNQISPKDSGFPLDGSASSYPYMPMNSPYMSATALLQKAAEMGAKTSQDPISPLLLKSFPSNVTTPSLRDHMDISSGRQGYCLGNSAASSVGIMATEHEGSYMSGHSNILTNTPWVNNNRPTTVPLIGLMNDPFGMRAEKDNSGIFPGGQTQHSRQENISRVGDAGLTQDFLGLGGSGNLEMTSETYNADVTALSYSDEQQKLQEHIYSYHQSSLNSTALEKPIWES

SEQ ID NO: 17470 - DNA, 546 bp, Sorghum bicolor
  misc_feature: Ceres ANNOT ID no. 8679293
  misc_feature: Encodes the peptide sequence at SEQ ID NO 17471
atggtgggatattttctacttaaaccccccactcatcctaccctgaaggtgcactggtggctttgtattctccacgctgcgttcagccggccggaaggtgattcacgggtccaccactgcactttgccggctagctcaggggcgagtcccgacgaagacgtggcagcagaggtccgagtccgatccatgggtgaggaagcagcggccgcgcccaccgtggcagcagcagcagcgacagcgagcggcgccccgccacacctgctcctaatctgcttccctggccaaggccacgtgaacccgatgctccgcctggtgaagcgcatcgcggcgaaaggtctcctggtgaccttctcctcggtctccaccttcggcgtgaagctggccgcgtccacgggcgtgtcggccagcggcgatggcgtcgccctcggccggggacgcgtccggatcgaattcctcgacgacgaggaccccggccctgacctggacgacctcatgcggcacctcgccaaggaaggactgccggcgttcgcgaagctgctggcgtag

SEQ ID NO: 17471 - protein, 181 aa, Sorghum bicolor
  misc_feature: Useful for making plants with altered carbohydrate content
  misc_feature: Functional homolog of the protein sequence given in SEQ ID NO 14401
  misc_feature: Ceres ANNOT ID no. 8679293
  misc_feature (86)..(151): SWISSPROT Homolog: EC 2.4.1.210 Limonoid glucosyltransferase
MVGYFLLKPPTHPTLKVHWWLCILHAAFSRPEGDSRVHHCTLPASSGASPDEDVAAEVRVRSMGEEAAAAPTVAAAAATASGAPPHLLLICFPGQGHVNPMLRLVKRIAAKGLLVTFSSVSTFGVKLAASTGVSASGDGVALGRGRVRIEFLDDEDPGPDLDDLMRHLAKEGLPAFAKLLA

SEQ ID NO: 17472 - DNA, 2883 bp, Sorghum bicolor
  misc_feature: Ceres ANNOT ID no. 8679313
  misc_feature: Encodes the peptide sequence at SEQ ID NO 17473
atggggaaggagcgggaggagcaggtggccatggtgcgcgcggtgctcggcgacggcacgccggagatggacatcatccgtgctctccacatggccggcgacgaccccaccaaggccattaacatcctcctcgacttcaaccacaacgctgcgccacctctcccgccgacgccgacgccgacgccgtcgccgtctccctcccctccgccggggaaacccgccaaagccctcgtcgactcaaacccaccaccaccaccaccaagaaaagcccctacccggcccatgcccacggcagagaaatctaagcccgccgcacccacaaccaacggtggcggcggggagcactggtggctggtggggagcgccgagatggcggggctgtccacctgcaagggcaggcgaattgcctcaggggacgcagtcaccttcaccttccccaacgccgcagccgccgtgggcaagagccgtccaggccgtgccgccctagcttcctgctcctccgagatcatgcgcttctccacctcaagccacggggaggtggggcgcatccccaatgagtgggcaaggtgcctccttccccttctcaaggagaacaagttaaaagtcaagggctcgtgcaaatcagctcccgaggtgcttaccattatggacactgtcctcttgtcagtgagttcaatgtttcatgatcaaaagcaatcggcgcccaaggcagctcgtgttgctccagatgactccacatttcaccccctacctgcacttttcaaattgataggggttgctccttttataaaggccgcctttactccagaagatctttattccaggaagcgaccaattgaaacaaagagcagtataggagcgcctgccacaaagttgacatccgagagattgaggttgtcttctgatggaaatgaagacgatcacggcgaagaaactgtttcagattcagatttggatgatataattgggatctcagacagctctgcactagaggaaagggctccccctgattctctgctgtgtgatctacgctcttatcaaaagcaggcactgcattggatgctgcagcttgagaaagcaaaaattaagattctggcagatgcaatgggactggggaagactattatgacgatagctcttcttctttctgattctagcaaagggtgcatcacaactcagaatgctgctcagatccctagagaagctagtgggttgggtgaatcgcatgatgatgtgaagaagcttgctagccctttctcttttagcaaacacaagaaacctaaggccccacttattggaggaagcaatctaattatctgtccaatgacactaattagtcagtggaaggcggagattgaagctcatactaagccaggcactgtgagtatatatgttcactatggacaaaacaggccaaaagaggcgagcatcattggtcagagtgatattgtcctgactacatatggtgttgtgtcatcagaattttcaatggatggttcaacggaaaatggggctttgtactctgtacattggttcagagttgtgcttgatgaagcacacatgataaaatcttctaaaagtttgatatccctagctgcggctgctttgactgcagatcggcgctggtgtctcactggtacaccaattcagaacaacttggaggatttgtacagccttttccggtggaataaacttgtacagaaaccatatgaagaaggtgatgaaaggggcttaaagctactgcagtccattttgaagccaataatgctgagaaggactaaaaacagcacagacaaggagggcaggccaatccttaatttaccccctgcaaatattgaagtaaaatactgtgttttatctgaggccgagaaggatttctatgaagctctatttcgaagatctaaggtaaaatttgatcaatttgttgagcaaggaagggttctgcacaactatgcttcaattttggagttacttttacgcctaagacaatgctgtgatcatccattccttgttatgagtcgtggggatacacaagagtttgcagacctaaagaagcttgcaaagcgttttctgcgtggtggtaatggtgctgttaatggtgattcttcttgcattccctctagagcttatatcgaagaggttgttcaagaattgcaaaagggtgaaggggagtgccctatttgcctggaagcctttgaggatgcagtattaactccatgtgctcaccgtttatgccgagagtgtctcttatctagttggcggagtgcaacagcaggcctttgccctgtctgtagaaagtcaatgagcaagcaggaccttataactgctcctactgataaccgctttcaaattgacgttgaaaagaactgggttgaatcttccaagatatctgctctcctgcaggagttggaggttcttcgcagttcaggtgccaagagtatcgtgtttagccagtggactgcatttttagatcttttgcaaattccactttctaggaataatttctcatttgctaggctggatgggacattgaatcttcagcaaagggagaaagttatcaaggagttctcagaggacaaaggcattttggttctgcttatgtctctgaaggctggtggtgttggaatcaaccttactgctgcttctaatgcatttgtcatggacccttggtggaatcctgccgtggaagagcaagctgtcatgcgcatccatcgaattggtcaaacgaagactgtttctatcagaagattcattgtgaagggcactgtcgaagaacgcatggaggccgtccaggctcgaaagcagcgaatgatttctggagctttgactgaccaagaagtccgcactgcacgtatagaagaactgaagatgcttttctcttga

SEQ ID NO: 17473 - protein, 960 aa, Sorghum bicolor
  misc_feature: The sequence is a functional homolog of SEQ ID NO 1846 in the 11/479,226 US patent application
  misc_feature: The sequence is a functional homolog of SEQ ID NO 300 in the 10/374,780 US patent application
  misc_feature: The sequence is a functional homolog of SEQ ID NO 836 in the 10/225,066 US patent application
  misc_feature: Ceres ANNOT ID no. 8679313
  misc_feature (346)..(671): Pfam ID: SNF2_N Pfam Description: SNF2 family N-terminal domain
  misc_feature (829)..(907): Pfam ID: Helicase_C Pfam Description: Helicase conserved C-terminal domain
  misc_feature (119)..(226): Pfam ID: HIRAN Pfam Description: HIRAN domain
  misc_feature (725)..(764): Pfam ID: zf-C3HC4 Pfam Description: Zinc finger, C3HC4 type (RING finger)
MGKEREEQVAMVRAVLGDGTPEMDIIRALHMAGDDPTKAINILLDFNHNAAPPLPPTPTPTPSPSPSPPPGKPAKALVDSNPPPPPPRKAPTRPMPTAEKSKPAAPTTNGGGGEHWWLVGSAEMAGLSTCKGRRIASGDAVTFTFPNAAAAVGKSRPGRAALASCSSEIMRFSTSSHGEVGRIPNEWARCLLPLLKENKLKVKGSCKSAPEVLTIMDTVLLSVSSMFHDQKQSAPKAARVAPDDSTFHPLPALFKLIGVAPFIKAAFTPEDLYSRKRPIETKSSIGAPATKLTSERLRLSSDGNEDDHGEETVSDSDLDDIIGISDSSALEERAPPDSLLCDLRSYQKQALHWMLQLEKAKIKILADAMGLGKTIMTIALLLSDSSKGCITTQNAAQIPREASGLGESHDDVKKLASPFSFSKHKKPKAPLIGGSNLIICPMTLISQWKAEIEAHTKPGTVSIYVHYGQNRPKEASIIGQSDIVLTTYGVVSSEFSMDGSTENGALYSVHWFRVVLDEAHMIKSSKSLISLAAAALTADRRWCLTGTPIQNNLEDLYSLFRWNKLVQKPYEEGDERGLKLLQSILKPIMLRRTKNSTDKEGRPILNLPPANIEVKYCVLSEAEKDFYEALFRRSKVKFDQFVEQGRVLHNYASILELLLRLRQCCDHPFLVMSRGDTQEFADLKKLAKRFLRGGNGAVNGDSSCIPSRAYIEEVVQELQKGEGECPICLEAFEDAVLTPCAHRLCRECLLSSWRSATAGLCPVCRKSMSKQDLITAPTDNRFQIDVEKNWVESSKISALLQELEVLRSSGAKSIVFSQWTAFLDLLQIPLSRNNFSFARLDGTLNLQQREKVIKEFSEDKGILVLLMSLKAGGVGINLTAASNAFVMDPWWNPAVEEQAVMRIHRIGQTKTVSIRRFIVKGTVEERMEAVQARKQRMISGALTDQEVRTARIEELKMLFS

SEQ ID NO: 17474 - DNA, 1335 bp, Sorghum bicolor
  misc_feature: Ceres ANNOT ID no. 8679306
  misc_feature: Encodes the peptide sequence at SEQ ID NO 17475
atgcatgtgaaaaccttaacattggttcatgatatcccttgggcagatgctgatgtggaagtagtggctttgtcacccaagacactcctggcaacaaacagatacatatgtgaggtctgtcacaagggcttccagagagaccagaacctccagctccataggaggggccataacctaccatggaagctgaagcagagaagcagcactgaagctaagaagaaggtgtatgtctgccccgaggtcacctgccctcatcatgatggaagccgagcattgggcgacctcacgggcataaagaagcactactctaggaaacatggagagaagaagtggaaatgtgacaggtgttcaaagaagtatgctgtccagtcagactggaaggcgcacacaaagatatgtggcacaaaggagtatcgatgtgactgtggaacgatattttcaagaaaggacagcttcatcacacatcgagccttctgtgatgcacttgctgaagacaactccaaggttaaccatagccttgcaacaatggtgggaaatttgcatggacaccatcatgatatcttttcacatggagtacctaccttccccacttcaccaactgatgtgatggcaaacttgtctaatactctgattacaagaaacacaacattgttctccaaccagatgtcgcccaaggattcaggctttccacttgatggaagcgcgtcgagttacccttatatgtccatgaattctccatacatgtctgctaccgcactgcttcagaaagctgcagtgataggtgcgaagaccagccaggatcctatatcaccattgctcctaaaaagtttcccaagtaacgtgacaactcctagtcctagagatcacatggacatatcttctggaagccagggagactccctcgggaattcagcagctaacagtattggcatcaaggcagctgaagatgagggctcttacatgagtggtcgcggtaacattctgatgaacacaccatgggtgaatagttacaggcctacaacagtgcctttaattggactaatgaatcatccatttggcatgagagcagaaaaggagagctctggattattttctggaagccaaacgcaacacaacaggcaggaaaatatttcaggggtaggagatgttggactaacccaggactttctaggactaggaggcagtgggaatttggaaatgagttctgagacttacaatgcagatgtgacacaattgagctattctgatgagcagcaaaagtcgcatgaacatatgtactcttaccatcagtcatctcttgactccattgcactggagaaacccatttgggaatga

SEQ ID NO: 17475 - protein, 444 aa, Sorghum bicolor
  misc_feature: The sequence is a functional homolog of SEQ ID NO 1087 in the 10/666,642 US patent application
  misc_feature: Useful for making plants with altered lignin content
  misc_feature: Functional homolog of the protein sequence given in SEQ ID NO 13275
  misc_feature: Ceres ANNOT ID no. 8679306
  misc_feature (35)..(57): Pfam ID: zf-C2H2 Pfam Description: Zinc finger, C2H2 type
MHVKTLTLVHDIPWADADVEVVALSPKTLLATNRYICEVCHKGFQRDQNLQLHRRGHNLPWKLKQRSSTEAKKKVYVCPEVTCPHHDGSRALGDLTGIKKHYSRKHGEKKWKCDRCSKKYAVQSDWKAHTKICGTKEYRCDCGTIFSRKDSFITHRAFCDALAEDNSKVNHSLATMVGNLHGHHHDIFSHGVPTFPTSPTDVMANLSNTLITRNTTLFSNQMSPKDSGFPLDGSASSYPYMSMNSPYMSATALLQKAAVIGAKTSQDPISPLLLKSFPSNVTTPSPRDHMDISSGSQGDSLGNSAANSIGIKAAEDEGSYMSGRGNILMNTPWVNSYRPTTVPLIGLMNHPFGMRAEKESSGLFSGSQTQHNRQENISGVGDVGLTQDFLGLGGSGNLEMSSETYNADVTQLSYSDEQQKSHEHMYSYHQSSLDSIALEKPIWE

SEQ ID NO: 17476 - DNA, 1491 bp, Sorghum bicolor
  misc_feature: Ceres ANNOT ID no. 8679316
  misc_feature: Encodes the peptide sequence at SEQ ID NO 17477
atggaccgcgcccgccccaccgccgccgccgcgatgctgctggagcccaagctcgaggacgaggacgtgccgccgctgctgcagcagctggcgtccccgggcccccccttcgtgtccctggaccagctgatgccggcgccggcggccgagccgccgcgcccgctggaggcgctgctgcagggcccgcagctgccgcccttcctgtccaagacgtacgacctggtgagcgagccggcgctggacggggtcatctcctggggcgcggccgggaacagcttcgtcgtctgggacccctccaccttcgcgcgcgacgtgctgccgcacaacttcaagcacaacaatttctccagcttcgtcaggcagctcaacacctatggtttccgcaaggttcatgctgacagatgggagtttgctcacgaagatttcctgcgagatagcaagcatctgttgaagaggattgtcaggcgcaggtcctccccaacaaaacaaagcagcattcagcctggttcttcttctggagaatccatcctggaccctgagctccacacgctgagaagagagaagaacacgctgcttgaagaagtggcaaggttgaaacaggaacaccgccagacaattgagcacatgagcacgctgaatcacaggctggaatctgcagaggaccggcagaggcagatggtctctttcctggccaagctccttcagaacccgagtttcgtgaggcagctgaagctgcacagggagaagaaagagattgactccaccagggtgaaaaggaagtttctgaagcatgttcctcatagcatagagtcaggtgagtccagctcacagcatgccggagagagtggttcgcatttcgctgtgagttcttccatggctacaagcctgcacgacgacatcacagaacttcagaattttctcttggaagacgatgacgtcaactttggcatgggttcagaaaacatggggcttgaaggcatcgatgcaccagaggatattggagaattgattcaggggttcgacacgcaagaagaacttgagctgggcagtggagctgagctactggagatgcctccagcttctggtcctctgggtcaagatcccacaatcggcaggtccaagggaaagaatgtgctgtgtccaggtttggacgctacctcttctgaagccgactgcctcagtccattgtctgacaacatggggttgctttcaggcaccatgctaggggcagcaggcaggatgatggacgctgatgatcagcaagtgtggggcgttgatgcctcagcagccctgcaaagctcttgcagtggcactagtcaacaagctttcagtagccatgctagtgatccctatctgatggacattgccaacaagcctgagagattctgggagcttgatttccaggcactggatgaaactgatctgcagctggacaagtgtgctattgatgaccctgctcttcagcagcagccaagtatggagaagccgtag

SEQ ID NO: 17477 - protein, 496 aa, Sorghum bicolor
  misc_feature: The sequence is a functional homolog of SEQ ID NO 2794 in the 10/374,780 US patent application
  misc_feature: The sequence is a functional homolog of SEQ ID NO 82 in the 10/225,066 US patent application
  misc_feature: The sequence is a functional homolog of SEQ ID NO 882 in the 11/435,388 US patent application
  misc_feature: Ceres ANNOT ID no. 8679316
  misc_feature (65)..(230): Pfam ID: HSF_DNA-bind Pfam Description: HSF-type DNA-binding
MDRARPTAAAAMLLEPKLEDEDVPPLLQQLASPGPPFVSLDQLMPAPAAEPPRPLEALLQGPQLPPFLSKTYDLVSEPALDGVISWGAAGNSFVVWDPSTFARDVLPHNFKHNNFSSFVRQLNTYGFRKVHADRWEFAHEDFLRDSKHLLKRIVRRRSSPTKQSSIQPGSSSGESILDPELHTLRREKNTLLEEVARLKQEHRQTIEHMSTLNHRLESAEDRQRQMVSFLAKLLQNPSFVRQLKLHREKKEIDSTRVKRKFLKHVPHSIESGESSSQHAGESGSHFAVSSSMATSLHDDITELQNFLLEDDDVNFGMGSENMGLEGIDAPEDIGELIQGFDTQEELELGSGAELLEMPPASGPLGQDPTIGRSKGKNVLCPGLDATSSEADCLSPLSDNMGLLSGTMLGAAGRMMDADDQQVWGVDASAALQSSCSGTSQQAFSSHASDPYLMDIANKPERFWELDFQALDETDLQLDKCAIDDPALQQQPSMEKP

SEQ ID NO: 17478 - DNA, 2319 bp, Sorghum bicolor
  misc_feature: Ceres ANNOT ID no. 8679317
  misc_feature: Encodes the peptide sequence at SEQ ID NO 17479
atgatgaaggatgccaagtggccgcacgcggcggcgagcgtcggtgggaggcgagggccgggcccctccgccgcctcatcatcatccgccgcggggccgtcgtacaccctcctcgcgtcctccccgcccaccaccgccagcaacgacggctgctcgccgcactaccctcccgcgcccgcgtccgacgacgacgggccctcctcgttcgacgcgtccgtcgctgccgcgaagcttccgttccagcaccagccgcacaggaacagcccccaactcggtgtcgcggattggctgcggctgcagcggcagtccagcgggagcagcgttggggccgacgacggcgaggtatcctccaccgtctcctccaccttggccaacgccgcagagtacagggacaacaagggcgacgcggaccgcccgccgagcagcagcagcaagagctgggcgcagcaggcggaggaggcctaccatctccagctggccctcgcgctccgcctctgctccgaggcctcctccgccacggaccccaacttcctcgactcctccaccgccgccgccgccgaccacctccagcacattgcatcgcctcaatccctctcccaccgcttctgggtcaacggcagcttgtcctactccgacaaggtcccggatggcttctacctcatccaggggatggatcccttcatatggacgctctgcaacgacgtgcacgacggcggccgcgtcccctccattgagtctctcaaggctgtcaatcccaccgattctgccatcgaggtggtcatcgtagataaagtagcggactatgacctgaggcagctgataagcatggccattgacgtttctcggaaccgtgccgactccaaggagatcgccactcgactcgctgccgtcgtgtccacaaagatggggggatcactagcagctaccgaggaacacgagctgggtccccggtggagagactctgttgggttcctgaagattagctcagggtctgttgtacttcccatcggaaagttatcaattggcttttgctgccaccgagcattactgttcaaggtgatcttggaatatctaattgatttaattgggaacccaggattcttatctgaacctgactccctcttgaatggactatcatccatctctgtttcttcaccattgcgcccaccaaaacatgactcagctgacatttctgataattttaagttgttggccaagcaatatttccgtgattgtcaatcgttaaatctcatgttcagtgacccagcagctggaacggttatcgacttagatgaggctatgggatcaaatctaggtccaaactcatcacatgcaacaaacagtgattgtcaagctacctttaaggctggtactcaacgcggtagtcaagatgggaattttataatgcagaggaggtactcagataagattctatctaaaaattccccagaggatactcaatctggactaagtgatccctttagcgatatgtcccttgagatagaagacttgattatcccatggagtgagcttgttctgaaagagaaaattggtgcagattggaatgattcggatgtcgcagtaaagattctaatggagcaggacttccacccagagcgtctcaaagaatttttgagagaggttgcaattatgagaagtttgcgtcatccgaacatcgttcttcttatgggtgctgtcactcagccacctaacctttcaattgtgactgaatacctgtcaagaggtagcctgtacagacttttacacaggcatggtgcaagggaaaatctggatgagcggcgccgcttgagtatggctttcgacgtggcaaaagggatgaattatcttcataagcgtaatcctccaatagtccaccgggatctaaagtctccaaacctgttggttgacaaaaagtacactgtgaaagtctgtgactttggtctctccagattgaaggcaaacacatttctgtcttccaagactgcagcagggactcctgagtggatggcgccagaagttcttcgtgacgagccctcaaatgagaagtctgatgtctacagcttcggtgttatcctatgggagattatgacattgcagcagccatggagtaatttaaatccagcacaggtcgtagcagctgttggtttcaagggacgaaggcttgatatcccaagcagtgttgatccgaaagtggcggcagtaattgagtcctgctgggccagagaaccctggagacgaccctcttttgccagtatcatggaatccctgaaacctctcatcaagacattaccacccaatcaactactggaggaaaattag

SEQ ID NO: 17479 - protein, 772 aa, Sorghum bicolor
  misc_feature: The sequence is a functional homolog of SEQ ID NO 48 in US patent 7317140
  misc_feature: Ceres ANNOT ID no. 8679317
  misc_feature (356)..(767): SWISSPROT Homolog: EC 2.7.11.1 Non-specific serine/threonine protein kinase
  misc_feature (511)..(756): Pfam ID: Pkinase_Tyr Pfam Description: Protein tyrosine kinase
MMKDAKWPHAAASVGGRRGPGPSAASSSSAAGPSYTLLASSPPTTASNDGCSPHYPPAPASDDDGPSSFDASVAAAKLPFQHQPHRNSPQLGVADWLRLQRQSSGSSVGADDGEVSSTVSSTLANAAEYRDNKGDADRPPSSSSKSWAQQAEEAYHLQLALALRLCSEASSATDPNFLDSSTAAAADHLQHIASPQSLSHRFWVNGSLSYSDKVPDGFYLIQGMDPFIWTLCNDVHDGGRVPSIESLKAVNPTDSAIEVVIVDKVADYDLRQLISMAIDVSRNRADSKEIATRLAAVVSTKMGGSLAATEEHELGPRWRDSVGFLKISSGSVVLPIGKLSIGFCCHRALLFKVILEYLIDLIGNPGFLSEPDSLLNGLSSISVSSPLRPPKHDSADISDNFKLLAKQYFRDCQSLNLMFSDPAAGTVIDLDEAMGSNLGPNSSHATNSDCQATFKAGTQRGSQDGNFIMQRRYSDKILSKNSPEDTQSGLSDPFSDMSLEIEDLIIPWSELVLKEKIGADWNDSDVAVKILMEQDFHPERLKEFLREVAIMRSLRHPNIVLLMGAVTQPPNLSIVTEYLSRGSLYRLLHRHGARENLDERRRLSMAFDVAKGMNYLHKRNPPIVHRDLKSPNLLVDKKYTVKVCDFGLSRLKANTFLSSKTAAGTPEWMAPEVLRDEPSNEKSDVYSFGVILWEIMTLQQPWSNLNPAQVVAAVGFKGRRLDIPSSVDPKVAAVIESCWAREPWRRPSFASIMESLKPLIKTLPPNQLLEEN

SEQ ID NO: 17480 - DNA, 1443 bp, Sorghum bicolor
  misc_feature: Ceres ANNOT ID no. 8679332
  misc_feature: Encodes the peptide sequence at SEQ ID NO 17481
atggggcaggaggggatggggtacagcagcaagggcggaggaggaggaggaggagggggagcgggagggctgccgatgacggcgccgcggccgcggggcgcgtcgccgctccaccaccacagccggtcgcgcaagatccaccgcactttcaacaacctcaagattaccgtgctctgcggcctcgtcaccatcctcgtcctgcggggcaccatcggcctcaacctctccctcccctcgcagccctccgacgccgacgcgctcgccgacgccaaggccgtcgaggacatcgaccgcatcctccgcgagatccgctccgactccggccccgaccccgacgacgagggcgacttcagcgccgcctccgggttcaacgcctccgcgctcagcgccaccgaggccgacgcggcgtacgcggccgcggtcggcagatacgcgctgggccccaagatctccgactgggacgcgcagcggcgacgctggctagcacggaacccgggcttcccggccaccgttgccgggggcaagcctaggattatgctcgtcaccggctcgcagccggggccctgcgacaacccgctcggtgaccattacctgctcaagactaccaagaacaagatcgattactgccgcatccatggcatccagatcgtccacaacctcgcgcaccttgacaacgagctcgcgggatactgggccaaattgccgctgctgcgacgcctcatgctctcccacccggaggtcgagtggatctggtggatggacagcgacgcgctcttcaccgacatggcgttcgagctgccactgtcgcgctacgatggtcacaacctcatcatccacggctaccaggacctcctctttgagaagcactcttggattgctctcaacaccggcagtttcctcttcaggaattgccagtggtcgcttgacctactggacgcgtgggcgcccatgggccccaagggcttcatccgcgaccaggccggcaaggtactcacggcgaacctcaagggccggccagcattcgaggccgacgaccagtcggcactgatttacctcttgctctcgcaaaaggacaagtggatggacaaggtgttcatagagaattcctactacttgcatggcttctgggctgggctggtggacaagtatgaggagatgatggagaatcaccacccaggccttggtgacgagcggtggccttttgtgactcactttgttgggtgcaagccatgtgggagctatggggactacccagtggagcgctgcctcaggagcatggagcgagcgtttaattttgccgacaaccaggtgcttcggctatatggtttctcacacaaggggctggaaagccccaagatcaagagaaccagggatcagacaaccagaccgattaatgatgtggagaacttagatatgaaggccaaaatatccacagtttcctga

SEQ ID NO: 17481 - protein, 480 aa, Sorghum bicolor
  misc_feature: Useful for making plants with altered cell wall content and/or composition
  misc_feature: Functional homolog of the protein sequence given in SEQ ID NO 14540
  misc_feature: Useful for making plants with altered carbohydrate content
  misc_feature: Functional homolog of the protein sequence given in SEQ ID NO 14541
  misc_feature: Ceres ANNOT ID no. 8679332
  misc_feature (146)..(465): SWISSPROT Homolog: EC 2.4.2.39 Xyloglucan 6-xylosyltransferase
  misc_feature (174)..(418): Pfam ID: Glyco_transf_34 Pfam Description: galactosyl transferase GMA12/MNN10 family
MGQEGMGYSSKGGGGGGGGGAGGLPMTAPRPRGASPLHHHSRSRKIHRTFNNLKITVLCGLVTILVLRGTIGLNLSLPSQPSDADALADAKAVEDIDRILREIRSDSGPDPDDEGDFSAASGFNASALSATEADAAYAAAVGRYALGPKISDWDAQRRRWLARNPGFPATVAGGKPRIMLVTGSQPGPCDNPLGDHYLLKTTKNKIDYCRIHGIQIVHNLAHLDNELAGYWAKLPLLRRLMLSHPEVEWIWWMDSDALFTDMAFELPLSRYDGHNLIIHGYQDLLFEKHSWIALNTGSFLFRNCQWSLDLLDAWAPMGPKGFIRDQAGKVLTANLKGRPAFEADDQSALIYLLLSQKDKWMDKVFIENSYYLHGFWAGLVDKYEEMMENHHPGLGDERWPFVTHFVGCKPCGSYGDYPVERCLRSMERAFNFADNQVLRLYGFSHKGLESPKIKRTRDQTTRPINDVENLDMKAKISTVS

SEQ ID NO: 17482 - DNA, 1746 bp, Sorghum bicolor
  misc_feature: Ceres ANNOT ID no. 8679388
  misc_feature: Encodes the peptide sequence at SEQ ID NO 17483
atggggactcggcaacgggtcctcgcgccatgggcggtgctgctgctcaccgcgctgcagctcgccggtgcctcccatgttgtcgtccaccggagcctggaggccgaggcggcggcggcaccgccgtcggtgccggcctccattgtcagccccctgctcaggacagggtaccatttccagccgccaatgaactggatcaacgaccccaacgctccgatgtactacaagggatggtatcacctgttctaccagtacaaccccaagggcgcagtatggggcaacatcgtgtgggctcactccatatcacgcgacctcatcaactggatcgcgctggagcccgccatctacccgagcatcccctccgaccagtacggctgctggtcgggctcggcgacgatgctgcaagacggcacgccggcgatcctctacactgggatcaaccgcccggacatcaactaccaggtgcaggtgctcgccttccccaagaacgcgtcggacccgctgctccgggagtgggagaagccggcggcgtacaacccggtggcggcgccggtgggcggcatcaacgcgacgcagttccgcgacccgacgacggcgtggtacgccgacgggcactggcggatgctggtgggcagcgtgcgggacacccggggcatggcgatcgtgtaccggagccgggacttccggcgctggacgaaagccaagcacccgctgcactcggcgctgacggggatgtgggagtgcccggacttcttcccggtgtccggcccggcgctccaggacggggtcgacacctccgacgccggcgccaagtacgtgctcaagaacagcctcgacctcacgcggtacgactactacaccatcgggtcgtatgataagaggaaggaccggtactacccggataatccgaacggcgactaccaccggctccggtacgactacggcaacttctacgcgtccaagacgttctatgatccggcgaagcggcggcgggtgctcctcgggtgggctaacgagtccgacagcgtccccgacgacaaggccaagggatgggccggcatccatgcgatcccaaggaagatctggctggatcccagcgggaagcagctgctgcagtggcccatcgaggaggtcgagaagctcagagggaaggccgtcactgtgggcggcaaggtggtgaagcccggcgagcattttgaggtcacaggcatcgcaacttaccaggctgatgtggaggtgagcttcgagatctcgagcttggacaaggcggagcccttcgacccggcgtacgacaacgacgcgcagaagctgtgcggcgtcaagggcgccgacgtcaagggcggcgtagggcccttcggcctgtgggtgttggcctctgccgacctgcaggagaagacggccgtcttcttcagagtcttcaaggacggctacggcaagcccaaggtgctcatgtgcaccgaccccaccaagtcatcgcttagtccagatctgtacaagccgaccttcgccggcttcgtcgacactgacatttcaagcgggaagattgctcttagaagcttgatcgatcggtccgtggtcgagagcttcggcgaaaaaggaaggacttgcatcctgtcacgggtctacccgtccatcgccattggaaaggaggctcacctctacgttttcaacaacggtgacgtggacgtcaaggtgtcaagcctgacagcatgggagatgaagaagccgctgatgaacggcgcctaa

SEQ ID NO: 17483 - protein, 581 aa, Sorghum bicolor
  misc_feature: Useful for making plants with altered carbohydrate content
  misc_feature: Functional homolog of the protein sequence given in SEQ ID NO 13829
  misc_feature: Useful for making plants with modulated biomass
  misc_feature: Functional homolog of the protein sequence given in SEQ ID NO 13761
  misc_feature: Ceres ANNOT ID no. 8679388
  misc_feature (1)..(581): SWISSPROT Homolog: EC 3.2.1.26 Beta-fructofuranosidase
  misc_feature (58)..(374): Pfam ID: Glyco_hydro_32N Pfam Description: Glycosyl hydrolases family 32 N terminal
  misc_feature (415)..(533): Pfam ID: Glyco_hydro_32C Pfam Description: Glycosyl hydrolases family 32 C terminal
MGTRQRVLAPWAVLLLTALQLAGASHVVVHRSLEAEAAAAPPSVPASIVSPLLRTGYHFQPPMNWINDPNAPMYYKGWYHLFYQYNPKGAVWGNIVWAHSISRDLINWIALEPAIYPSIPSDQYGCWSGSATMLQDGTPAILYTGINRPDINYQVQVLAFPKNASDPLLREWEKPAAYNPVAAPVGGINATQFRDPTTAWYADGHWRMLVGSVRDTRGMAIVYRSRDFRRWTKAKHPLHSALTGMWECPDFFPVSGPALQDGVDTSDAGAKYVLKNSLDLTRYDYYTIGSYDKRKDRYYPDNPNGDYHRLRYDYGNFYASKTFYDPAKRRRVLLGWANESDSVPDDKAKGWAGIHAIPRKIWLDPSGKQLLQWPIEEVEKLRGKAVTVGGKVVKPGEHFEVTGIATYQADVEVSFEISSLDKAEPFDPAYDNDAQKLCGVKGADVKGGVGPFGLWVLASADLQEKTAVFFRVFKDGYGKPKVLMCTDPTKSSLSPDLYKPTFAGFVDTDISSGKIALRSLIDRSVVESFGEKGRTCILSRVYPSIAIGKEAHLYVFNNGDVDVKVSSLTAWEMKKPLMNGA

SEQ ID NO: 17484 - DNA, 423 bp, Sorghum bicolor
  misc_feature: Ceres ANNOT ID no. 8679391
  misc_feature: Encodes the peptide sequence at SEQ ID NO 17485
atggggatggtggcgtcagacatgtctaagtgcaagctcggatacaacgaccaatgtatgacatgctccgccatggaggttggaggcggccgacggagaggcgcgcaatctcggaggaagaagacgcgggagcccaaggaggagaacgtgacgcttgaccccgccgtccgtgagggcgagcagccgagcacgtcttcgcatgtgacggatctctccggaagggagacgctcgtcccatcatcactggttaaagctgatcgtgatgagtcctcatcttatgctgcgatgcttccctcacaggatgttgcacaaagatgcaaggagcttggaatcacagcattgcacattaaactctgtgctactggtggaaacaagaccaaaacccctggccctggtaggtctgcccttagagcccttgcttga

SEQ ID NO: 17485 - protein, 140 aa, Sorghum bicolor
  misc_feature: Useful for making plants with modulated biomass
  misc_feature: Functional homolog of the protein sequence given in SEQ ID NO 14542
  misc_feature: Ceres ANNOT ID no. 8679391
  misc_feature (64)..(140): Pfam ID: Ribosomal_S11 Pfam Description: Ribosomal protein S11
MGMVASDMSKCKLGYNDQCMTCSAMEVGGGRRRGAQSRRKKTREPKEENVTLDPAVREGEQPSTSSHVTDLSGRETLVPSSLVKADRDESSSYAAMLPSQDVAQRCKELGITALHIKLCATGGNKTKTPGPGRSALRALA

SEQ ID NO: 17486 - DNA, 321 bp, Sorghum bicolor
  misc_feature: Ceres ANNOT ID no. 8679416
  misc_feature: Encodes the peptide sequence at SEQ ID NO 17487
atggcatggcttgtgttttctctcttgttgtgtcggccgggcaggtcatctcttagtacagatctgtacaagccgacctttgcgggcttcgtccacaccgacatttcaagcagcaagatcgctcttagaagcttgatcgatcggtccgtggtcgagagcttcggcgcgggaggcaggacgtgcatcctgtcacgggtctacccgtccatcgccattggaaaggatgctcacctctacgttttcaacaacggtgacgtggacgtcaaagtgtcaagcctgactgcttgggagatgaagaaaccgttgatgaacggcgcctag

SEQ ID NO: 17487 - protein, 106 aa, Sorghum bicolor
  misc_feature: Useful for making plants with altered carbohydrate content
  misc_feature: Functional homolog of the protein sequence given in SEQ ID NO 13829
  misc_feature: Useful for making plants with modulated biomass
  misc_feature: Functional homolog of the protein sequence given in SEQ ID NO 13761
  misc_feature: Ceres ANNOT ID no. 8679416
  misc_feature (8)..(106): SWISSPROT Homolog: EC 3.2.1.26 Beta-fructofuranosidase
  misc_feature (1)..(58): Pfam ID: Glyco_hydro_32C Pfam Description: Glycosyl hydrolases family 32 C terminal
MAWLVFSLLLCRPGRSSLSTDLYKPTFAGFVHTDISSSKIALRSLIDRSVVESFGAGGRTCILSRVYPSIAIGKDAHLYVFNNGDVDVKVSSLTAWEMKKPLMNGA

SEQ ID NO: 17488 - DNA, 837 bp, Sorghum bicolor
  misc_feature: Ceres ANNOT ID no. 8679507
  misc_feature: Encodes the peptide sequence at SEQ ID NO 17489
atgcggccacctcctccttgccccccggcaccgacggcggcggccttacgcgaggccatggagacggcagccatcgtggccgccctgacgcacgtcattgccggtggccgtgcagaaacgctgacgcaaacgccaccgccgccgtgtccgtgggcgtcattgggctaccgctgccatcatgaaaacgtcgggccagcgtcgtgccaaggcgagactgggacgacgtccccgccgccggcgaacatggtctcgggtacctctgttcgctttcctgctcctgcacccgtcgcgtcgcccgggtggtggatgctcacgtgcttctccatctttgcagtggaacgtcgcgtcgcgcctgcgccgccgccgccgccgtcgcagcgtagctaccgcggggtgaggcgccggccatggggcaagtgggcggcggagatccgtgaccccaagaaggcggcgcgcgtctggctcggcacgttcgttacccccgaggacgcggcgcgcgcctacgacgccgcggcgctccgtatccgcgggagccgcgccaagctcaacttcccggaggacgcgtcgtcgctacgtcgtcgcccgccggtcgccgtgggctcctctccgcagtcgcgttctcgcttggatttggatttggatggcacggccaccacgggccgctcgccgtcgtgcctggagatgatgtacgccgggaccgggacggatgcgttcatggtgggcggtggaaataatggccggttcttgggttcctggagcatcggaacttcgtcgccgtcgcacaagcctgtatgttcgagtgctcccgtcgtcgtcgctcctgcagcagcggagtag

SEQ ID NO: 17489 - protein, 278 aa, Sorghum bicolor
  misc_feature: Useful for making plants with altered alkaloid content
  misc_feature: Functional homolog of the protein sequence given in SEQ ID NO 12879
  misc_feature: The sequence is a functional homolog of SEQ ID NO 22 in the 10/903,236 US patent application
  misc_feature: The sequence is a functional homolog of SEQ ID NO 2215 in the 10/666,642 US patent application
  misc_feature: The sequence is a functional homolog of SEQ ID NO 82 in the 10/714,887 US patent application
  misc_feature: The sequence is a functional homolog of SEQ ID NO 82 in the 11/435,388 US patent application
  misc_feature: Useful for biocontainment applications
  misc_feature: Functional homolog of the protein sequence given in SEQ ID NO 13707
  misc_feature: The sequence is a functional homolog of SEQ ID NO 14 in the 10/903,236 US patent application
  misc_feature: The sequence is a functional homolog of SEQ ID NO 1737 in the 10/374,780 US patent application
  misc_feature: The sequence is a functional homolog of SEQ ID NO 2129 in the 10/666,642 US patent application
  misc_feature: The sequence is a functional homolog of SEQ ID NO 74 in the 10/714,887 US patent application
  misc_feature: The sequence is a functional homolog of SEQ ID NO 74 in the 11/435,388 US patent application
  misc_feature: The sequence is a functional homolog of SEQ ID NO 200 in the 10/714,887 US patent application
  misc_feature: The sequence is a functional homolog of SEQ ID NO 200 in the 11/435,388 US patent application
  misc_feature: The sequence is a functional homolog of SEQ ID NO 36 in the 10/903,236 US patent application
  misc_feature: Ceres ANNOT ID no. 8679507
  misc_feature (127)..(178): Pfam ID: AP2 Pfam Description: AP2 domain
MRPPPPCPPAPTAAALREAMETAAIVAALTHVIAGGRAETLTQTPPPPCPWASLGYRCHHENVGPASCQGETGTTSPPPANMVSGTSVRFPAPAPVASPGWWMLTCFSIFAVERRVAPAPPPPPSQRSYRGVRRRPWGKWAAEIRDPKKAARVWLGTFVTPEDAARAYDAAALRIRGSRAKLNFPEDASSLRRRPPVAVGSSPQSRSRLDLDLDGTATTGRSPSCLEMMYAGTGTDAFMVGGGNNGRFLGSWSIGTSSPSHKPVCSSAPVVVAPAAAE

SEQ ID NO: 17490 - DNA, 1059 bp, Sorghum bicolor
  misc_feature: Ceres ANNOT ID no. 8679540
  misc_feature: Encodes the peptide sequence at SEQ ID NO 17491
atggacaagtacgagctgctcaaggacatcggctccggcaacttcggggtggcgcgcctcatgcgcaacaaggacaccaaggagctcgtcgccatgaagtacatccccagggggctcaagattgacgagaatgtggcgagggagatcataaaccaccgctcgctgcggcaccccaacatcatccgattcaaggaggtcgtgctcacgcccacgcacctcgccatcgtcatggagtacgccgccggcggcgagctcttcgaccggatctgcagcgccgggaggttcagcgaggacgagcagctcatctgcggtgtcagttattgccacttcatgcaaatttgtcaccgggacttgaagctggagaacacgctgttggatggcagcccggcgccgcgcctaaagatctgcgactttggctactctaagtcatcgctgctgcactcaaagcctaaatccacggttggaactcccgcttacattgctccggaggtgctctctcgccgggaatacgacggcaagatggcagacgtttggtcttgtggagtgactctttacgtgatgctggttggtgcgtacccttttgaggaccccgatgatcccaagaatttcagaaaaacgattgggtaccagataccagagtatgtccacatatcccaagactgcagacagctcctcgctaggatctttgtcgcaaatcctgcaaagagaataacaattagggagattaggaatcacccctggttcctgaagaatttgcccagagagcttacagaagctgcacaagcgaagtactacaagaaggacaacagtgctcccaccttctctgatcaaaccgtcgaagagatcatgaagattgtagaggaggcccgcatgccgcccgaatcatctactccggtggctggttttggttgggctgaggaagaagagcaggaagatggcaagaaacctgaggatgacgagcaggatggggaggatgaggaatacgatggcgaggacgagtatgacaaacaggtgaagcaagtacatgccagcggggattttcaacacctgataaaatga

SEQ ID NO: 17491 - protein, 352 aa, Sorghum bicolor
  misc_feature: Useful for biocontainment applications
  misc_feature: Useful for making plants with modulated biomass
  misc_feature: Useful for making plants with modulated time to senescence
  misc_feature: Functional homolog of the protein sequence given in SEQ ID NO 14093
  misc_feature: Useful for making plants with modulated water use efficiency
  misc_feature: Functional homolog of the protein sequence given in SEQ ID NO 14094
  misc_feature: Ceres ANNOT ID no. 8679540
  misc_feature (1)..(304): SWISSPROT Homolog: EC 2.7.11.1 Non-specific serine/threonine protein kinase
  misc_feature (4)..(248): Pfam ID: Pkinase Pfam Description: Protein kinase domain
MDKYELLKDIGSGNFGVARLMRNKDTKELVAMKYIPRGLKIDENVAREIINHRSLRHPNIIRFKEVVLTPTHLAIVMEYAAGGELFDRICSAGRFSEDEQLICGVSYCHFMQICHRDLKLENTLLDGSPAPRLKICDFGYSKSSLLHSKPKSTVGTPAYIAPEVLSRREYDGKMADVWSCGVTLYVMLVGAYPFEDPDDPKNFRKTIGYQIPEYVHISQDCRQLLARIFVANPAKRITIREIRNHPWFLKNLPRELTEAAQAKYYKKDNSAPTFSDQTVEEIMKIVEEARMPPESSTPVAGFGWAEEEEQEDGKKPEDDEQDGEDEEYDGEDEYDKQVKQVHASGDFQHLIK

SEQ ID NO: 17492 - DNA, 1200 bp, Sorghum bicolor
  misc_feature: Ceres ANNOT ID no. 8679580
  misc_feature: Encodes the peptide sequence at SEQ ID NO 17493
atggggagcgcaccggccaccgcccaagagatgaggcgtgcgcagcgcgcggatgggccagccgccgtgctcggcatcggcacggcgaacccgccgacgtgcttagcgcaggacgactaccccgactactacttccgcgtcaccaacagcgagcacctgaccgacctcaagggcaagctcaccaggatctgcaacaagtcaggcatcaagcagcgctacatccacctcaacgaggacctgctcgccgccaacccggacttcgccgaccgcacgcgcccgtccctggacgcgcgcgtggacatcgcctccgccgccgtcccggagctggccgcggccgccgcggccaaggccatcgccgagtggggccgcccggccaccgacatcacccacctcgtcttcagcacctactccggcgcgcgcgccccgagcgccgaccgccgcctcgcgtccctgctgggcctccgccccacggtgtcgcgcaccatcctcaacctccacggctgctacggcggcggccggtcgctccagctcgccaaggagcttgccgagaacaaccgcggcgcgcgcgtccttgtcgcctgctctgagatcacgctcatcgccttctacggccccgaaggaggctgcgccgacaacatcctcgggcaggctctgttcggcgacggcgctggcgccgtcatcgtcggcgccgaccccgtcgcccccgtcgagcgcccgctgttcgagatggccttcgcctcgcagacaacgataccggagaccgaggacgccatctccatgcagatcaacaaaggtggcatggagtaccacatctccaaccaggtgccccgactgctggggtgcaacgtggagcgctgccttgtcgacgcgtttcgcgcgctcggcgtcagcgctgcgtggaacgaccttttctgggcgatccaccctggcggccgtgccattctggaccacatcgagggagtgctcggcctggacgacagcaagctggcggcgagtcgccatgtgctcagcgagtttggcaacatgagcggcaccacggtgatcttcgtgctcgatgagttgcgccgccgtcgggcagcgatggccatgcagggaggggaagcgccggagtggggagtgatgatggcttttggaccgggaatcacaattgagaccatggtgctccacgcccctagcaaccttgacctgaagggaaattaa

SEQ ID NO: 17493 - protein, 399 aa, Sorghum bicolor
  misc_feature: The sequence is a functional homolog of SEQ ID NO 2 in US patent 7202397
  misc_feature: Ceres ANNOT ID no. 8679580
  misc_feature (3)..(390): SWISSPROT Homolog: EC 2.3.1.74 Naringenin-chalcone synthase
  misc_feature (6)..(232): Pfam ID: Chal_sti_synt_N Pfam Description: Chalcone and stilbene synthases, N-terminal domain
  misc_feature (242)..(392): Pfam ID: Chal_sti_synt_C Pfam Description: Chalcone and stilbene synthases, C-terminal domain
MGSAPATAQEMRRAQRADGPAAVLGIGTANPPTCLAQDDYPDYYFRVTNSEHLTDLKGKLTRICNKSGIKQRYIHLNEDLLAANPDFADRTRPSLDARVDIASAAVPELAAAAAAKAIAEWGRPATDITHLVFSTYSGARAPSADRRLASLLGLRPTVSRTILNLHGCYGGGRSLQLAKELAENNRGARVLVACSEITLIAFYGPEGGCADNILGQALFGDGAGAVIVGADPVAPVERPLFEMAFASQTTIPETEDAISMQINKGGMEYHISNQVPRLLGCNVERCLVDAFRALGVSAAWNDLFWAIHPGGRAILDHIEGVLGLDDSKLAASRHVLSEFGNMSGTTVIFVLDELRRRRAAMAMQGGEAPEWGVMMAFGPGITIETMVLHAPSNLDLKGN

SEQ ID NO: 17494 - DNA, 258 bp, Sorghum bicolor
  misc_feature: Ceres ANNOT ID no. 8679576
  misc_feature: Encodes the peptide sequence at SEQ ID NO 17495
atgtgggggaagggaaagaagcgtttcggcggcggcggcgagccggcggccaagcggcaggccgccggggacgaaggcccctccgaacccgccgaagacggtacggtcgtagccgagatatcgaagaacaagaaggtgtctgttaggaactggaaaggcagggtcttcgttgacctccgcgagttctacgtcaaggacggcaagtctctccccacccgcaaagggaggactgctctcaccatacacccatctcagtag

SEQ ID NO: 17495 - protein, 85 aa, Sorghum bicolor
  misc_feature: Useful for making plants with modulated nitrogen use efficiency
  misc_feature: Functional homolog of the protein sequence given in SEQ ID NO 14543
  misc_feature: Useful for making plants with altered lignin content
  misc_feature: Functional homolog of the protein sequence given in SEQ ID NO 12875
  misc_feature: Ceres ANNOT ID no. 8679576
  misc_feature (14)..(85): Pfam ID: PC4 Pfam Description: Transcriptional Coactivator p15 (PC4)
MWGKGKKRFGGGGEPAAKRQAAGDEGPSEPAEDGTVVAEISKNKKVSVRNWKGRVFVDLREFYVKDGKSLPTRKGRTALTIHPSQ

SEQ ID NO: 17496 - DNA, 1200 bp, Sorghum bicolor
  misc_feature: Ceres ANNOT ID no. 8679570
  misc_feature: Encodes the peptide sequence at SEQ ID NO 17497
atgcctcctcgccgccgccgcgttgtcagagcgccgctgctcacgccgtctcctccacagccctcctctaccccgccgccggtcccgtccgtagaggcccccaaacccgaaacccccgaccaccacgatcccactccctccgcccgtcgccgtctccccctcgctgccggggccgttgaggcgcaggaagagtggcatccgctcccgctctccacggccgacctttccctcccgctcaccctccccaccggccagaccttcctctggcgccgcacctccctctccccgctccgcttcaccggtgccgtggggccccacctcgtctccctctcccacctgccggactccgacgatggccgcctcgcattcctcctccacaacgacggcagttgccccgcctcctcggtgcccgccgcccgcgccgcactctgcgactatctcaacgcggccgtctcgctcgccgacctctggcggcagttcgccgccgcagacgagcgcttcgctgaggtctccgcgcgtctcgggggcggcggcgcccgggtgctcaggcaggaccccgtcgagtgcgtcttccagttcctctgctcctccaacaacaacattgcccggatcgagaagatggtgtggacgctggcaggctacggggagcggctcggcgaggttggtgggttcgtgttccaccggttccccacgatcgagcggctcgcgcgcgtgtcggagcaggaacttcgtgaggccgggttcgggtacagggcaaagtacattgttggcactgctaaagaattgcaggccaaacctggtggaggtgaaaaatggcttgcctcactgcgtgagaaggagctttcatatgtgattgaagccctttgcactctgccaggtgttggtccaaaggtcgctgcctgcattgctctgttctcccttgatcaaaaccatgctattcctgtcgacactcatgtttggaaggttgctacacagtatctactaccagagctagctggcaagagcttgaccccaaaacttagtgttattgttgccgatgcctttgttactagatttggaagctatgctggttgggcacaaaatgttcttttcattggccagctaccagcccaaaaacttgtggtggctcaagttaacagtgacaatggtaccacaaaacctaccaaaaggaagcgcggggtgcaaccgaaaccatgttga

SEQ ID NO: 17497 - protein, 399 aa, Sorghum bicolor
  misc_feature: Useful for making plants with altered alkaloid content
  misc_feature: Useful for making plants with altered terpenoid content
  misc_feature: Useful for making plants with modulated nitrogen use efficiency
  misc_feature: Functional homolog of the protein sequence given in SEQ ID NO 14544
  misc_feature: Ceres ANNOT ID no. 8679570
  misc_feature (65)..(368): SWISSPROT Homolog: EC 4.2.99.18 DNA-(apurinic or apyrimidinic site) lyase
  misc_feature (67)..(190): Pfam ID: OGG_N Pfam Description: 8-oxoguanine DNA glycosylase, N-terminal domain
  misc_feature (191)..(346): Pfam ID: HhH-GPD Pfam Description: HhH-GPD superfamily base excision DNA repair protein
MPPRRRRVVRAPLLTPSPPQPSSTPPPVPSVEAPKPETPDHHDPTPSARRRLPLAAGAVEAQEEWHPLPLSTADLSLPLTLPTGQTFLWRRTSLSPLRFTGAVGPHLVSLSHLPDSDDGRLAFLLHNDGSCPASSVPAARAALCDYLNAAVSLADLWRQFAAADERFAEVSARLGGGGARVLRQDPVECVFQFLCSSNNNIARIEKMVWTLAGYGERLGEVGGFVFHRFPTIERLARVSEQELREAGFGYRAKYIVGTAKELQAKPGGGEKWLASLREKELSYVIEALCTLPGVGPKVAACIALFSLDQNHAIPVDTHVWKVATQYLLPELAGKSLTPKLSVIVADAFVTRFGSYAGWAQNVLFIGQLPAQKLVVAQVNSDNGTTKPTKRKRGVQPKPC

SEQ ID NO: 17498 - DNA, 1830 bp, Sorghum bicolor
  misc_feature: Ceres ANNOT ID no. 8679678
  misc_feature: Encodes the peptide sequence at SEQ ID NO 17499
atgcatccccctctgactttacataggcatccaatgtgtgccgaggtaatttgctgtttttgttttgattttatccttgtcttcttgaatattttattcatctatatgctgttgcattactttagtaaaacttacaatgataatatatttgtccagatcattgaagaattccagaagtgccatctggatcaccctgttaagaagttctttggagagtgcacagaccttaaaatcaagctagaccgctgcttccgacaggagaaagctttgaagagaaaggcaaactttgaagagagcaagaaatttaaagaacagttgcagatgtgttttagttattgtaggaatcatcctcttttcaataccaatttatcctatgagagaagcattcctacggaatcaagaacagaagtatatgtggaagattttcctgtttcccttctcgaatcacatgaaatagacaaggatgcagaaatgtggtttcaacataaattggggattcatggaggcaaagataagctcaaaggaacgggtgtaccttacgtgaatgcaagtcatgcccccacaacatgccatgctgttgctgcactcgcgtgccagttttctgggaactacctcgcagctggctttaccgtccccagtctgctctcctccctgacgcacagtaatcaggcatcaacatcatcaccatcaccaacaacaaagccaaggaacaaagcaggatcgtccatggaagcaaaagcaatcccactcctcacgccctacaccatggggaggttccacctctcccacagggttgtccatgcaccgctcacaaggtcaaggtgctacaacaaccttcctggcgagcatgtcgccctctactactcccagagggcttcggaaggcggcctcctgatcagtgagtccactggggtctcggagagtgcccaggggtatcccagcactccaggtatatggaccaaggaccaggtggaagcctggaagccagtcgtcgaaggtgtgcatcagaaaggtggagtttttttctgccaaatctggcacgtagggagggcttcaacttatgattatcaacccaatggacaagcaccaatttcttgtacggacaagcagatcacccctaaggttcttgatgatgggaccgtggaagaattctcagccccaaggagacttagagaagatgaaatcccccaaattgtcaatgattttcggcttgctgctcggaactgcattgaagcaggctttgacggagttgaaatccactgtgcatttggctatctcatcgagcagttcatgaaagacagtgtcaacgacagaactgatgagtacggtggaagcatggaaaaccgatgccgctttgcactagaggtaatccaagctgccatcgatgaggtcggagctgacaaggttggtgtccgtctctcaccatattccaactgcctggattgctgggactcagacccagacgcacttggcttgtacatgatccacgccatgaacaagctgggcgtcctctactgcagcatggttgagccggaggtggtcaaagtggatggtaaggtgcagatcccccacaagctgctgcatttcaggaaggcattttctgggacttccattgttggtggaggatacaacagggaagaaggcaacagagctgtgtctgaaggctacactgacctggtggcatacggcaaatggtttctggcgaacccagacttgccaaagcgatttgagctgaatgcacctttgaacaagtacgacaggtccacgttctacactcctgaccccgttgttgggtacactgattacccttttatcagtccttctgtgtga

SEQ ID NO: 17499 - protein, 609 aa, Sorghum bicolor
  misc_feature: Useful for making plants with modulated water use efficiency
  misc_feature: Functional homolog of the protein sequence given in SEQ ID NO 13609
  misc_feature: Ceres ANNOT ID no. 8679678
  misc_feature (244)..(605): SWISSPROT Homolog: EC 1.3.1.42 12-oxophytodienoate reductase
  misc_feature (249)..(583): Pfam ID: Oxidored_FMN Pfam Description: NADH:flavin oxidoreductase / NADH oxidase family
MHPPLTLHRHPMCAEVICCFCFDFILVFLNILFIYMLLHYFSKTYNDNIFVQIIEEFQKCHLDHPVKKFFGECTDLKIKLDRCFRQEKALKRKANFEESKKFKEQLQMCFSYCRNHPLFNTNLSYERSIPTESRTEVYVEDFPVSLLESHEIDKDAEMWFQHKLGIHGGKDKLKGTGVPYVNASHAPTTCHAVAALACQFSGNYLAAGFTVPSLLSSLTHSNQASTSSPSPTTKPRNKAGSSMEAKAIPLLTPYTMGRFHLSHRVVHAPLTRSRCYNNLPGEHVALYYSQRASEGGLLISESTGVSESAQGYPSTPGIWTKDQVEAWKPVVEGVHQKGGVFFCQIWHVGRASTYDYQPNGQAPISCTDKQITPKVLDDGTVEEFSAPRRLREDEIPQIVNDFRLAARNCIEAGFDGVEIHCAFGYLIEQFMKDSVNDRTDEYGGSMENRCRFALEVIQAAIDEVGADKVGVRLSPYSNCLDCWDSDPDALGLYMIHAMNKLGVLYCSMVEPEVVKVDGKVQIPHKLLHFRKAFSGTSIVGGGYNREEGNRAVSEGYTDLVAYGKWFLANPDLPKRFELNAPLNKYDRSTFYTPDPVVGYTDYPFISPSV

SEQ ID NO: 17500 - DNA, 1830 bp, Sorghum bicolor; identical to SEQ ID NO: 17498
  misc_feature: Ceres ANNOT ID no. 8679681
  misc_feature: Encodes the peptide sequence at SEQ ID NO 17501

SEQ ID NO: 17501 - protein, 609 aa, Sorghum bicolor; identical to SEQ ID NO: 17499
  misc_feature: Useful for making plants with modulated water use efficiency
  misc_feature: Functional homolog of the protein sequence given in SEQ ID NO 13609
  misc_feature: Ceres ANNOT ID no. 8679681
  misc_feature (244)..(605): SWISSPROT Homolog: EC 1.3.1.42 12-oxophytodienoate reductase
  misc_feature (249)..(583): Pfam ID: Oxidored_FMN Pfam Description: NADH:flavin oxidoreductase / NADH oxidase family

SEQ ID NO: 17502 - DNA, 420 bp, Sorghum bicolor
  misc_feature: Ceres ANNOT ID no. 8679679
  misc_feature: Encodes the peptide sequence at SEQ ID NO 17503
atggtggcggactcgacgttctgggtgttcagcgtgcttgggcaggccaccatcccgtccacgccaaccaagccgtccagggcgcccatgtggaagggcatcgtcgccgcatacctcgtcactgccgcctgctacttccccgtcgcgctcctcgggtgctgggcctttgggcgcgacgttggcgacaacgtcctcgtcgcgctgcagcgcccgccttggctggtcgccgccgccaacatgatggtcgtcatccatgtcgttggaagctatcagctaagtgttcgatcggtttgtctttgttggtctgtacatacatgtcactcaactactgaagacgaaacacaaaaatggcctctgaatctgcatctgcaacgtctgacaggtgtatgcgatgccactgaagaaactcgttgtacatga

SEQ ID NO: 17503 - protein, 139 aa, Sorghum bicolor
  misc_feature: Useful for making plants with altered oil content
  misc_feature: Functional homolog of the protein sequence given in SEQ ID NO 13448
  misc_feature: Ceres ANNOT ID no. 8679679
MVADSTFWVFSVLGQATIPSTPTKPSRAPMWKGIVAAYLVTAACYFPVALLGCWAFGRDVGDNVLVALQRPPWLVAAANMMVVIHVVGSYQLSVRSVCLCWSVHTCHSTTEDETQKWPLNLHLQRLTGVCDATEETRCT

SEQ ID NO: 17504 - DNA, 420 bp, Sorghum bicolor; identical to SEQ ID NO: 17502
  misc_feature: Ceres ANNOT ID no. 8679682
  misc_feature: Encodes the peptide sequence at SEQ ID NO 17505

SEQ ID NO: 17505 - protein, 139 aa, Sorghum bicolor; identical to SEQ ID NO: 17503
  misc_feature: Useful for making plants with altered oil content
  misc_feature: Functional homolog of the protein sequence given in SEQ ID NO 13448
  misc_feature: Ceres ANNOT ID no. 8679682

SEQ ID NO: 17506 - DNA, 771 bp, Sorghum bicolor
  misc_feature: Ceres ANNOT ID no. 8679759
  misc_feature: Encodes the peptide sequence at SEQ ID NO 17507
atggacggcgacggaggaggcgctgcggcggtgcaccaccacacgcgctcccccgaggacgtcttccgcgatttccgcgcgcgccgcgccggcatcgtcaaggcgctcaccacggatgtggagaagttctatcagcagtgcgatccagagaaagagaacttgtgcctttatggtttgccaaatgagacttgggaggtcactcttccagctgaggaagtacctcctgagcttccagaacccgcactggggataaactttgcacgtgatggaatgatcgaaaaagattggctgtctctagttgcagttcatagtgatgcatggctcctgtccgttgcattctactttggtgctcgctttggatttgataaagaggccaggagaaggctcttcaccatgattaataacctgcccactgtttatgaagttgtgacgggggttgctaagaagcaatcgaaagcccccaatggcagcagcaaaagcagcaaatctaactctaaaccatcaaaacagaccaactctaacagtaagcctgcgaagccaacccacccaaaagaagaggaggacagcggccatgaggacgcagaggaggaggaccaggcgtacctgtgtgggtcctgtggggagagctatgcgaacggggagttctggatctgctgcgatgtctgcgagaagtggttccatggcaagtgtgtccgcatcaccccagcgaaggcggagcacatcaagcagtacaagtgtcccagctgcagcaccaagcggagccgggaatga

SEQ ID NO: 17507 - protein, 256 aa, Sorghum bicolor
  misc_feature: The sequence is a functional homolog of SEQ ID NO 1981 in the 11/479,226 US patent application
  misc_feature: Useful for making plants with altered alkaloid content
  misc_feature: Functional homolog of the protein sequence given in SEQ ID NO 13176
  misc_feature: The sequence is a functional homolog of SEQ ID NO 1645 in the 11/479,226 US patent application
  misc_feature: The sequence is a functional homolog of SEQ ID NO 782 in the 10/412,699 US patent application
  misc_feature: The sequence is a functional homolog of SEQ ID NO 816 in the 10/412,699 US patent application
  misc_feature: The sequence is a functional homolog of SEQ ID NO 1052 in the 10/225,066 US patent application
  misc_feature: The sequence is a functional homolog of SEQ ID NO 2552 in the 10/374,780 US patent application
  misc_feature: Useful for making plants with altered lignin content
  misc_feature: Useful for making plants with modulated flowering time
  misc_feature: Functional homolog of the protein sequence given in SEQ ID NO 13473
  misc_feature: Ceres ANNOT ID no. 8679759
  misc_feature (212)..(250): SWISSPROT Homolog: EC 1.14.11.27 [Histone H3]-lysine-36 demethylase
  misc_feature (202)..(252): Pfam ID: PHD Pfam Description: PHD-finger
MDGDGGGAAAVHHHTRSPEDVFRDFRARRAGIVKALTTDVEKFYQQCDPEKENLCLYGLPNETWEVTLPAEEVPPELPEPALGINFARDGMIEKDWLSLVAVHSDAWLLSVAFYFGARFGFDKEARRRLFTMINNLPTVYEVVTGVAKKQSKAPNGSSKSSKSNSKPSKQTNSNSKPAKPTHPKEEEDSGHEDAEEEDQAYLCGSCGESYANGEFWICCDVCEKWFHGKCVRITPAKAEHIKQYKCPSCSTKRSRE

SEQ ID NO: 17508 - DNA, 1488 bp, Sorghum bicolor
  misc_feature: Ceres ANNOT ID no. 8679775
  misc_feature: Encodes the peptide sequence at SEQ ID NO 17509
atgggcggtttcgtggatcccttcgtcccggaatctgcttggccacaggacaccatgttcatcggctcatcctggccagcagcaggccctgcagggacgtacctgggaggagcaggagctgctgcaccagatcagcttcacctccagaacgtctcctcctcctccacaggagcgctcttgaacggcagcgccaaggagatcgtgtcgctgtcgccggtggaggagctgcacgagcagttcctgagcgcgcacctgccgctgccggcggacgacgtggcgccgcagggcctcaactttgaagtggactcggtggttctgagcacgccctgcgcaatatcgctcgccgacagcgcacctgtggtgtgctgcagctccaacgacagcagcgggagcgagcagtccggcctgccgccgttcctcctcctcggggtcggggagcagcagccggcgtgggcgccttccacgttcccgcggatttcgtccttggttggggaagaaacctcgcagagctgcttcggtttcagcaaccatctcctgcgtgaggcctcctgtgccgctgatgccaagaagtatccacagctaggcgatctgccctctgcaccgctgcagctacatgatgatgtcgagttcgacactgggaagatgctgtctttcactccgggtcttggacagcaactgaatgctagtacaaactttggcgatctgcagctcagtcaaaaggaattcagcggtctgcatcacctgaacctctctgggcagcagctcccgtcgtttaatgcaacaggagcgacgcataatcctgaacagtctagcgaagtcagcagtggcaaaattggactgaatgcgccgccgttcatgaatcgacaagaggtggcaaatggcaatggggctgctgggagtggagctcctaagccgcgcgtcagagctcgccgtggccaggcaactgatccgcacagcattgcagagaggctccgaagggagaagatctctgacaggatgaagaatttgcaggagctcgttccaaactccaacaggactgacaaggcatccatgcttgaggagatcatcgaatacgtcaaatttctccagttgcaagtcaaggttcttagcatgagcaggctgggcgcgacggaagccgtcgtcccgctcctgacggagtctcagaccgagagctccggcggtcttctcctgtccccgaggtcaggctcatcaggcaggcagcgggcaggcggaggcagcctgccgtcgtctgaggcccgggacggcgcggcgttcgagcaggaggtggcgcagctgatggagaacaacatgacgacggcgatgcagtacctgcagagcaagggcctgtgcctcatgcccatcgcgctggcgtcggcgatctcggatcagaaggggtcctcctccgccgcggtccagccggaaaatggcggcgccaaggaaatgctgcgcgccgtgaagcccctgggaagcccgatccaagggagatga

SEQ ID NO: 17509 - protein, 495 aa, Sorghum bicolor
  misc_feature: The sequence is a functional homolog of SEQ ID NO 1106 in the 10/225,066 US patent application
  misc_feature: The sequence is a functional homolog of SEQ ID NO 220 in the 10/225,068 US patent application
  misc_feature: The sequence is a functional homolog of SEQ ID NO 2368 in the 10/374,780 US patent application
  misc_feature: The sequence is a functional homolog of SEQ ID NO 390 in the 10/412,699 US patent application
  misc_feature: The sequence is a functional homolog of SEQ ID NO 909 in the 11/479,226 US patent application
  misc_feature: The sequence is a functional homolog of SEQ ID NO 1211 in the 11/479,226 US patent application
  misc_feature: The sequence is a functional homolog of SEQ ID NO 546 in the 10/412,699 US patent application
  misc_feature: The sequence is a functional homolog of SEQ ID NO 186 in the 10/714,887 US patent application
  misc_feature: The sequence is a functional homolog of SEQ ID NO 186 in the 11/435,388 US patent application
  misc_feature: Ceres ANNOT ID no. 8679775
  misc_feature (314)..(363): Pfam ID: HLH Pfam Description: Helix-loop-helix DNA-binding domain
MGGFVDPFVPESAWPQDTMFIGSSWPAAGPAGTYLGGAGAAAPDQLHLQNVSSSSTGALLNGSAKEIVSLSPVEELHEQFLSAHLPLPADDVAPQGLNFEVDSVVLSTPCAISLADSAPVVCCSSNDSSGSEQSGLPPFLLLGVGEQQPAWAPSTFPRISSLVGEETSQSCFGFSNHLLREASCAADAKKYPQLGDLPSAPLQLHDDVEFDTGKMLSFTPGLGQQLNASTNFGDLQLSQKEFSGLHHLNLSGQQLPSFNATGATHNPEQSSEVSSGKIGLNAPPFMNRQEVANGNGAAGSGAPKPRVRARRGQATDPHSIAERLRREKISDRMKNLQELVPNSNRTDKASMLEEIIEYVKFLQLQVKVLSMSRLGATEAVVPLLTESQTESSGGLLLSPRSGSSGRQRAGGGSLPSSEARDGAAFEQEVAQLMENNMTTAMQYLQSKGLCLMPIALASAISDQKGSSSAAVQPENGGAKEMLRAVKPLGSPIQGR

SEQ ID NO: 17510 - DNA, 957 bp, Sorghum bicolor
  misc_feature: Ceres ANNOT ID no. 8679785
  misc_feature: Encodes the peptide sequence at SEQ ID NO 17511
atggagcttgagcttagtctgggggattctcgagctccagcaaagagcactttcatgcctgcactgactcctatacacgcaggtgaaggagaaggccatgagcttgtgctagagctaggagtagggactgccaaaagagctgaacaggacaatcaaaagacggtcgtgcaagcagaagctgtgcaggaggaagaagaagaaacatgctcatacaacgagtcacctgtcgagctgagcctcgtctgccctttgctgcctgcctcgacagaaatagaggtgtgcggacgaggatctgatgtgaacactgttctggtggatggagacacagcacaaggaagatctttgtcaacttcgtccttggctttggaggttcctgttcggcagacagctgatcaggaagctgcagaggatgcggagattagtggggttggcgggggaacgaggaagaagctgaggctgtccatggagcagtctgcgttcctggaggatatctttaaggcacacagcacactttccccaaaacagaagagtgatttggcgaaccggcttagccttcgaccgcgccaggtggaggtctggtttcagaacagaagagcgagaactaagctaaagcaaacggaggtggactgtgagtacttgaagcgttgctgcgagaacctagcacaggagaaccgaaggctccagagggaggtagcagagctgcgtgcccagcgtatttccaacaccgctgcctacacgttttacggccatcatctgcctgcatcagggttcagcacagcccgagtgtgtccctcatgtgataaaaacaagggcacagctcactacactgctatcagcgcaccatcagcagtagtgacaccaccatcggcggtgtccaccaccttgttcgccaggcctcacttcggacccttcaccatccacccactgctccgccgccagccgtcggcgacctcctga

SEQ ID NO: 17511 - protein, 318 aa, Sorghum bicolor
  misc_feature: The sequence is a functional homolog of SEQ ID NO 254 in the 10/412,699 US patent application
  misc_feature: The sequence is a functional homolog of SEQ ID NO 550 in the 11/479,226 US patent application
  misc_feature: Useful for biocontainment applications
  misc_feature: Useful for making plants with modulated biomass
  misc_feature: Useful for making plants with modulated flowering time
  misc_feature: Functional homolog of the protein sequence given in SEQ ID NO 13544
  misc_feature: The sequence is a functional homolog of SEQ ID NO 2326 in the 10/374,780 US patent application
  misc_feature: The sequence is a functional homolog of SEQ ID NO 252 in the 10/412,699 US patent application
  misc_feature: The sequence is a functional homolog of SEQ ID NO 546 in the 11/479,226 US patent application
  misc_feature: The sequence is a functional homolog of SEQ ID NO 8 in the 10/225,068 US patent application
  misc_feature: The sequence is a functional homolog of SEQ ID NO 542 in the 11/479,226 US patent application
  misc_feature: The sequence is a functional homolog of SEQ ID NO 1674 in the 10/374,780 US patent application
  misc_feature: Ceres ANNOT ID no. 8679785
  misc_feature (204)..(248): Pfam ID: HALZ Pfam Description: Homeobox associated leucine zipper
  misc_feature (149)..(203): Pfam ID: Homeobox Pfam Description: Homeobox domain
MELELSLGDSRAPAKSTFMPALTPIHAGEGEGHELVLELGVGTAKRAEQDNQKTVVQAEAVQEEEEETCSYNESPVELSLVCPLLPASTEIEVCGRGSDVNTVLVDGDTAQGRSLSTSSLALEVPVRQTADQEAAEDAEISGVGGGTRKKLRLSMEQSAFLEDIFKAHSTLSPKQKSDLANRLSLRPRQVEVWFQNRRARTKLKQTEVDCEYLKRCCENLAQENRRLQREVAELRAQRISNTAAYTFYGHHLPASGFSTARVCPSCDKNKGTAHYTAISAPSAVVTPPSAVSTTLFARPHFGPFTIHPLLRRQPSATS

SEQ ID NO: 17512 - DNA, 1308 bp, Sorghum bicolor
  misc_feature: Ceres ANNOT ID no. 8679806
  misc_feature: Encodes the peptide sequence at SEQ ID NO 17513
atgcagatggcagcggcagtggcccccaccgacgccccggcctcggcggctgcggcggcgccgcacccccacccccacccgcacgccgcggctgcggcggctgcggctgcggccgcctcgccgcacccgcacgcaccaccgcacccgcaccaccatatgccgcaaccgcggtgggtggtcatcccgtaccctccgccacaccaccccatggtggccgcgccgccgccacctcccccgcagttcgtcaagcatttcgcgccgccggcctcggtgacaccgccgccgccgcccgctggatccggcgggaacgggggcgaggacaaccggaccatctgggttggcgacctgcagtactggatggacgagaactacctccacagctgcttcggccccagcggcgaggtggtgaatattaaagtcattcgcaatagacactcgggagtttctgagggttatggttttgtagagttctattcgcacgtgtcagcagagaaggcactacagaatttttctggtcatgtaatgcctaatactgaccgggcttttaagttaaactgggcatcatatagcatgggagaaaaacgcacggaactttcatctgatcactcgatatttgttggcgatttggctgttgatgttactgatgagatgttgctggagcttttttctaacaaataccgatcagtgaaaggagctaaagttattattgatgcaaacacaggccgttctagaggctacggctttgttaggtttggagatgataatgacaaaactcatgcaatgaccgaaatgaatggtgtatactgttccacaagaccaattcgtgtaggaccagcgactcctagaagatctcaaggtgattctggctcttctccaccaaggcaatctgatgttgactctactaacaggacggtatatgttggtgggcttgatcccaatgttagcgaagatgaactgaggaaagcatttgcaaaatatggtgatcttgcctctgtcaaaattccttttgggaagcaatgtgggtttgttcaatttgtaaacagagctgatgctgaagaagcactgcaagggttgaatggagcaactattgggaagcaggcagttcgactttcctggggccgcagtcctgcaagtaaacagtctaggggtgattctggccaccgtcgcaatggcaatggcaatggcatgtactacgggacgccattctacagtggatatggctacgcgtcacctgttccccacccaaacatgtatgcggcggcctatggagcctacccatactatggcaaccagcagctagtgagctga

SEQ ID NO: 17513 - protein, 435 aa, Sorghum bicolor
  misc_feature: The sequence is a functional homolog of SEQ ID NO 252 in the 10/714,887 US patent application
  misc_feature: The sequence is a functional homolog of SEQ ID NO 252 in the 11/435,388 US patent application
  misc_feature: The sequence is a functional homolog of SEQ ID NO 568 in the 10/666,642 US patent application
  misc_feature: The sequence is a functional homolog of SEQ ID NO 1484 in the 10/666,642 US patent application
  misc_feature: The sequence is a functional homolog of SEQ ID NO 278 in the 10/714,887 US patent application
  misc_feature: The sequence is a functional homolog of SEQ ID NO 278 in the 11/435,388 US patent application
  misc_feature: The sequence is a functional homolog of SEQ ID NO 536 in the 10/666,642 US patent application
  misc_feature: Ceres ANNOT ID no. 8679806
  misc_feature (204)..(333): SWISSPROT Homolog: EC 5.2.1.8 Peptidylprolyl isomerase
  misc_feature (305)..(370): Pfam ID: RRM_1 Pfam Description: RNA recognition motif. (a.k.a. RRM, RBD, or RNP domain)
  misc_feature (204)..(276): Pfam ID: RRM_1 Pfam Description: RNA recognition motif. (a.k.a. RRM, RBD, or RNP domain)
  misc_feature (111)..(182): Pfam ID: RRM_1 Pfam Description: RNA recognition motif. (a.k.a. RRM, RBD, or RNP domain)
MQMAAAVAPTDAPASAAAAAPHPHPHPHAAAAAAAAAAASPHPHAPPHPHHHMPQPRWVVIPYPPPHHPMVAAPPPPPPQFVKHFAPPASVTPPPPPAGSGGNGGEDNRTIWVGDLQYWMDENYLHSCFGPSGEVVNIKVIRNRHSGVSEGYGFVEFYSHVSAEKALQNFSGHVMPNTDRAFKLNWASYSMGEKRTELSSDHSIFVGDLAVDVTDEMLLELFSNKYRSVKGAKVIIDANTGRSRGYGFVRFGDDNDKTHAMTEMNGVYCSTRPIRVGPATPRRSQGDSGSSPPRQSDVDSTNRTVYVGGLDPNVSEDELRKAFAKYGDLASVKIPFGKQCGFVQFVNRADAEEALQGLNGATIGKQAVRLSWGRSPASKQSRGDSGHRRNGNGNGMYYGTPFYSGYGYASPVPHPNMYAAAYGAYPYYGNQQLVS

SEQ ID NO: 17514 - DNA, 1581 bp, Sorghum bicolor
  misc_feature: Ceres ANNOT ID no. 8679796
  misc_feature: Encodes the peptide sequence at SEQ ID NO 17515
atgaagaaaaagaaaagagaaggaaaatgctttcaaaagtgggaagaggaggaaggcaacaaagtgtgggggcatcacgcgctccattgcagagtttggggcggccagcttcctcctcctcctccccaccaaggcactaaggccaggcccggtcggctcaccgcctcggtgaccgccgccttctttgacgcctgcctccgacgctgccgatacgccaaatctccgtgcgtgtttggccgaaatccacgggaggtgctcgtcctcgtctctgctccggagcggagctgtgcctacttgagttcaggtttgtttcgccatccgaggccggccaagattcggagcgtcgccggagggaaggcgatgaaggggaaaggcggggcgatggaccggaggtcctccgccaggtggagggtgctggtgctctgcgcattctgcttcggcctcggcatgctcttcaccgaccggttctggtcagcaccggatactagtaaccatatcatgtctcaacaacggaggcaagagcgagagctccaacttgtatcagaggattgcaacacaaagaggaagcatggggaagacaaggatataatgggagaggtaaccaagacccatgaagccatacaatcattggataagtccatctcaacgctgcagatggagcttgcagcaaagaggagcacacttgagcggctacggtctagtggttcaccagtaacctctgaaactagccaaccaaggaaaaaggcatttgttgtcattggagtcaacactgcattcagcagccgcaagcgccgtgattctgtccgggagacatggatgcctcaaggagaaaagctgaaacaattagaagaacagaagggaatagttatccgcttcactatcgggcacagtgctacgtccaacagtatactggacaaagctatagattcagaggacgctcagcatcatgactttcttaggctggaccatgttgagggatatcatgaactctcagctaagacaaaaatattcttctctactgctgttggcatctgggatgctgacttctacgtcaaggttgatgatgatgtgcatttttgtttgctggtccatgcacataaccaaacaggaatgcttgccactacccttgctcggcataaaacgaaaccaagaacttatattggctgcatgaagtcaggcccagttcttgctgacaagaatgtgaagtaccatgagcctgagtactggaaatttggggaggaaggaaataaatacttccgtcatgctacggggcagatatatgctgtttcgaaagatcttgcgacttatatttcaatcaatcagcctatcctgcacaaatatgcaaatgaagacgtgtcgcttggatcatggttcattggcttggaagttaatcacattgatgaaaggaacatgtgctgtggaactccaccagattgtgagtggaaagggcaagctggcaatgtctgtgtagcatctttcgattggagctgcagtggcatatgcaagtctgttgagaggatcaaagatgtacatgctcgctgtggtgaaggggattcagcagtttggagtgctcttatctag

SEQ ID NO: 17515 - protein, 526 aa, Sorghum bicolor
  misc_feature: Useful for making plants with altered carbohydrate content
  misc_feature: Functional homolog of the protein sequence given in SEQ ID NO 13658
  misc_feature: Ceres ANNOT ID no. 8679796
  misc_feature (228)..(463): SWISSPROT Homolog: EC 2.4.1.134 Galactosylxylosylprotein 3-beta-galactosyltransferase
  misc_feature (263)..(469): Pfam ID: Galactosyl_T Pfam Description: Galactosyltransferase
MKKKKREGKCFQKWEEEEGNKVWGHHALHCRVWGGQLPPPPPHQGTKARPGRLTASVTAAFFDACLRRCRYAKSPCVFGRNPREVLVLVSAPERSCAYLSSGLFRHPRPAKIRSVAGGKAMKGKGGAMDRRSSARWRVLVLCAFCFGLGMLFTDRFWSAPDTSNHIMSQQRRQERELQLVSEDCNTKRKHGEDKDIMGEVTKTHEAIQSLDKSISTLQMELAAKRSTLERLRSSGSPVTSETSQPRKKAFVVIGVNTAFSSRKRRDSVRETWMPQGEKLKQLEEQKGIVIRFTIGHSATSNSILDKAIDSEDAQHHDFLRLDHVEGYHELSAKTKIFFSTAVGIWDADFYVKVDDDVHFCLLVHAHNQTGMLATTLARHKTKPRTYIGCMKSGPVLADKNVKYHEPEYWKFGEEGNKYFRHATGQIYAVSKDLATYISINQPILHKYANEDVSLGSWFIGLEVNHIDERNMCCGTPPDCEWKGQAGNVCVASFDWSCSGICKSVERIKDVHARCGEGDSAVWSALI

SEQ ID NO: 17516 - DNA, 426 bp, Sorghum bicolor
  misc_feature: Ceres ANNOT ID no. 8679799
  misc_feature: Encodes the peptide sequence at SEQ ID NO 17517
atgagaggagttggaggtccactgctcaccatcggggatctactcagcgacctcgccgtcgacggcggtgacgaccccctcgtcggcgtcggagatgcgtccgccccctcctctccatcggcgacgcagcaagcggggaaggccgatccgtccgatctcagccggctcttcgaggaacactacaacaatttgatgaaagctctagaagagaaggatccttcatggccctcgctgatgctgaagctgtgcgcagcattgaagactgcagataagctggtgagttgcgcgaacatgaacgcggaacagctgctggagaaggtgaaggcgctggagggcgtccttgagaggagcgatcatgcggtggcagagattgtagaagctctccagaagtctggcctcgccaaggatcgtcaaggttcccaataa

SEQ ID NO: 17517 - protein, 141 aa, Sorghum bicolor
  misc_feature: Useful for biocontainment applications
  misc_feature: Functional homolog of the protein sequence given in SEQ ID NO 14545
  misc_feature: Ceres ANNOT ID no. 8679799
MRGVGGPLLTIGDLLSDLAVDGGDDPLVGVGDASAPSSPSATQQAGKADPSDLSRLFEEHYNNLMKALEEKDPSWPSLMLKLCAALKTADKLVSCANMNAEQLLEKVKALEGVLERSDHAVAEIVEALQKSGLAKDRQGSQ

SEQ ID NO: 17518 - DNA, 1518 bp, Sorghum bicolor
  misc_feature: Ceres ANNOT ID no. 8679803
  misc_feature: Encodes the peptide sequence at SEQ ID NO 17519
atggcgaggccacacgttgtggttgtaccgtacccatgctccggcaacatcaacccagcgttgcagatcgccaagctgctgcaccgccacggcgtgtacgtcaccttcgtcaacaccgagcacaaccaccgccgcgtgcaggccaccgagggcgccggagctgtgcgcggccgggacggcttccgcttcgaggccatcccggacggcctgcccgacgccgaccgcggcaggcaggactacggccgcggcctggccgtgtccacgagcacccgctgcgcggcgccgctcagggacctcctcgcgcggctcaactgcacgcccggcgtgccgccggtcacctgcgtgctgcccaccatgctgatgagcttcgccctggacgtcgcgcgggagctccgtatcccgaccatgtcgttctggacggccagcgccgcctcgctgatgacgcacatgaggctccgcgagctccaggaaaaaggatacgtcccactcaagtgcggccggcgtgcagatgagagtttcttgacgaacggctacctggagacgacggtcatcgactggatccccggcatgccgccgacgcggctcggcgacttctcgagcttcctccgcaccaccgacccggacgacttcggtctccgcttcaacgagtcggaggcgaacaggtgcgccgaggccggcgccgtgatcctcaacaccttcgacggcctcgaggccgacgtcctcgccgcgctacgcgccgagtatccgcgcgtgtacaccgtcggcaccctgggcttgctcctccgccagcaccagcaggacgacggcgccgccgccgccaccgccagcgacaccgagtccacgacgaccggcggcctgagcctgtggaagcaggacgccgagtgcctggcctggctggacacgcaggaccggggctccgtcgtgtacgtcaacttcggcagccacacggtggtgacgccggagcagctgaccgagttcgcgtggggtctcgcggcgagcggccaccggttcctatggtccatgagagacaacttcgtcctcggcggcggcggcctggacgcgatgccgccggcgttcaaggccgaggcggcggcggggcggtgccacgtgacggcgtggtgtccccaggagcaggtgctgcggcacccggccgtgggctgcttcctgacccacagcgggtggaactcgacgtgcgagagcgtggccgccggcgtgcccatggtgtgctggccgggcttctcggaccagtacaccaactgcaagtacgcctgcgaggtgtggggcgtcggcgtccggctggagccggaggtggacagggagcaggtcgccatgcgcgtcaggaaggtgatggcgagcgaggagatgcggaagagcgcggccaggtggaaggagccggcggaggctgctgccggccccggcggctcgtcgcgcgagaacctgctgagcatggtgagagcgctcagccgcccacccaatgcaactcatcagacgctcgatcaagagctcaaagaccagtag

SEQ ID NO: 17519 - protein, 505 aa, Sorghum bicolor
  misc_feature: Useful for making plants with altered carbohydrate content
  misc_feature: Functional homolog of the protein sequence given in SEQ ID NO 14529
  misc_feature: Ceres ANNOT ID no. 8679803
  misc_feature: Down-regulated in shoot tissues in response to methyl jasmonate treatment
  misc_feature (295)..(454): SWISSPROT Homolog: EC 2.4.1.115 Anthocyanidin 3-O-glucosyltransferase
  misc_feature (4)..(491): Pfam ID: UDPGT Pfam Description: UDP-glucoronosyl and UDP-glucosyl transferase
MARPHVVVVPYPCSGNINPALQIAKLLHRHGVYVTFVNTEHNHRRVQATEGAGAVRGRDGFRFEAIPDGLPDADRGRQDYGRGLAVSTSTRCAAPLRDLLARLNCTPGVPPVTCVLPTMLMSFALDVARELRIPTMSFWTASAASLMTHMRLRELQEKGYVPLKCGRRADESFLTNGYLETTVIDWIPGMPPTRLGDFSSFLRTTDPDDFGLRFNESEANRCAEAGAVILNTFDGLEADVLAALRAEYPRVYTVGTLGLLLRQHQQDDGAAAATASDTESTTTGGLSLWKQDAECLAWLDTQDRGSVVYVNFGSHTVVTPEQLTEFAWGLAASGHRFLWSMRDNFVLGGGGLDAMPPAFKAEAAAGRCHVTAWCPQEQVLRHPAVGCFLTHSGWNSTCESVAAGVPMVCWPGFSDQYTNCKYACEVWGVGVRLEPEVDREQVAMRVRKVMASEEMRKSAARWKEPAEAAAGPGGSSRENLLSMVRALSRPPNATHQTLDQELKDQ

SEQ ID NO: 17520 - DNA, 2100 bp, Sorghum bicolor
  misc_feature: Ceres ANNOT ID no. 8679828
  misc_feature: Down-regulated in shoot tissues in response to methyl jasmonate treatment
  misc_feature: Encodes the peptide sequence at SEQ ID NO 17521
atgtcagcatcgcagtcctcgatgagcggcgccgccggggagccggggatgcggacggtggtctggttcaggcgagacctgcgcgtggaggacaacccggcgctggcggcagccgctcggacggccggagaggtcgtgccggcgtacgtgtgggcgcccgaggaggacgggccctactaccccggcagggtgtcccggtggtggctcagccaaagcctcaagcacctggacgcctcgctccgccggctcggcgccggccgcctcgtcacccgccgctccaacgacgctgtcgtcgcgctgctcgacctcgtccgcagcaccggcgccacccacctctttttcaaccacctctacgacccgctgtcgctggtccgggaccaccgcgtgaaggagcagctgacggccgagggcatcactgtgcagtccttcaacgcggatctgctgtacgagccgtgggaggtcctcgacgacgacggctgccccttcaccatgttcgcgccattctggaacaggtgcctgtgcatgccggaccccgccgcaccactgctgccgcccaagaggatcaattcaggtgacctgtcgaggtgtccgtgggacgagctgatctttgaagacgagtccgagaggggcagcaacgcgctgcttgcgcgggcgtggtcaccagggtggcagaatgctgacaaggcactgacggccttcctcaatggtccgctgatggactactccgtgaaccgcaagaaggccgacagtgccagcacgtccctgttgtctccgtacctgcacttcggcgagctcagcgtccgcaaggtcttccaccaggtccggatgaagcagctgatgtggagcaacgacggtaaccacgctggcgaggagagctgcaccctgttcctgcgctccatcggcctgcgggagtactcgaggtacctcaccttcaaccacccctgcagccacgagaagccccttctgtcgcacctcaggttcttcccctgggtcgtcaatgaggtgtacttcaaggtttggagacaagggaggactggctaccctctcgtcgacgctggcatgagggagctctgggccaccgggtgggtccatgaccggatacgtgtcgtcgtctctagcttctttgtcaaggtactccagctgccatggcgctgggggatgaagtacttctgggacaccttgctggatgctgaccttgagagtgatgcactaggctggcagtacatttctgggtctctccctgatggccgtgagcttgaccgcatcgacaaccctcagtttgaagggtacaagtttgatccgcacggggagtacgtacggcgatggctaccggagttggcgaggctgccaacagaatggatacaccacccctgggatgcacctgagtctgtgcttcaggctgcaggagttgagctaggctccaactatccacgccccattgttgagttagatgctgccaattccaggttgcaggatgccctgtcagagatgtgggagcttgaggcagcctctcgtgctgcgatggagaatggaatggaagaaggccttggcgattccacagatgagccgctgatcgacttccctcaggaattacggatggaagtggaccgacaaccggctcaacctgctatccacacaccggcagtggctggtcggagacgagaagatcagatggtgcctagcatgacttcctcattcattagagctgaaaccgaactcactgcagattttggcaacaccagtgaggacagtaggccagaagtcccgtcaaacattcatttgcaggctcgggcggagagggaagaaacagttgacggtggcactggcaatactgtcaggatgaatggcaaccatcagcagcagaatcttcagaacaacatgcaccgtgtgctaggtattgctccatcagtttcagaggcatcgagcagctggacgggcagggaaggtggagtggtaccggtctggtcacctccggcagcttcgggacattctgatccttatgctgccgatgaggctgacatttccagtaggagttatttggacaggcatccacaatcacatacgatgatgaactggagtcaactctctcagtcattgtga

SEQ ID NO: 17521 - protein, 699 aa, Sorghum bicolor
  misc_feature: Useful for making plants with modulated light quality response
  misc_feature: Useful for making plants with modulated low light sensitivity
  misc_feature: Useful for making plants with modulated nitrogen use efficiency
  misc_feature: Functional homolog of the protein sequence given in SEQ ID NO 13918
  misc_feature: Useful for making plants with modulated light quality sensitivity
  misc_feature: Functional homolog of the protein sequence given in SEQ ID NO 13499
  misc_feature: Ceres ANNOT ID no. 8679828
  misc_feature (18)..(501): SWISSPROT Homolog: EC 4.1.99.3 Deoxyribodipyrimidine photo-lyase
  misc_feature (220)..(498): Pfam ID: FAD_binding_7 Pfam Description: FAD binding domain of DNA photolyase
  misc_feature (17)..(189): Pfam ID: DNA_photolyase Pfam Description: DNA photolyase
MSASQSSMSGAAGEPGMRTVVWFRRDLRVEDNPALAAAARTAGEVVPAYVWAPEEDGPYYPGRVSRWWLSQSLKHLDASLRRLGAGRLVTRRSNDAVVALLDLVRSTGATHLFFNHLYDPLSLVRDHRVKEQLTAEGITVQSFNADLLYEPWEVLDDDGCPFTMFAPFWNRCLCMPDPAAPLLPPKRINSGDLSRCPWDELIFEDESERGSNALLARAWSPGWQNADKALTAFLNGPLMDYSVNRKKADSASTSLLSPYLHFGELSVRKVFHQVRMKQLMWSNDGNHAGEESCTLFLRSIGLREYSRYLTFNHPCSHEKPLLSHLRFFPWVVNEVYFKVWRQGRTGYPLVDAGMRELWATGWVHDRIRVVVSSFFVKVLQLPWRWGMKYFWDTLLDADLESDALGWQYISGSLPDGRELDRIDNPQFEGYKFDPHGEYVRRWLPELARLPTEWIHHPWDAPESVLQAAGVELGSNYPRPIVELDAANSRLQDALSEMWELEAASRAAMENGMEEGLGDSTDEPLIDFPQELRMEVDRQPAQPAIHTPAVAGRRREDQMVPSMTSSFIRAETELTADFGNTSEDSRPEVPSNIHLQARAEREETVDGGTGNTVRMNGNHQQQNLQNNMHRVLGIAPSVSEASSSWTGREGGVVPVWSPPAASGHSDPYAADEADISSRSYLDRHPQSHTMMNWSQLSQSL

SEQ ID NO: 17522 - DNA, 1389 bp, Sorghum bicolor
  misc_feature: Ceres ANNOT ID no. 8679837
  misc_feature: Encodes the peptide sequence at SEQ ID NO 17523
atggagcacgacgtcgcccacggtggtggcggcggcgctgtccccgcaggcgaagaagcgttcgaggtggctcatcatcaggaggtggagcagcaggaggagttcagcgactctgagtcggggtccgagcccatcgagatctccgacctgaagcgccgcatgtggaaggaccagatgctgctcagcaagctggaggggcgcgcgggtgtcttcagggccggcggcggggcggcgggcccgtcgtccagcaggccgcttgcgccaccgtcgtcgacggcgagcgcggacggggcggaggaggaggaggaggaggagaaccccgagatgcggtgccggcgcaaggcgatgctccgcgcgcaggacggcgtgctccgccacatgctcaagatgatggaggcctgcaacgcgcgcgggttcgtgtacggcgtcatcgacgaggccggcgagcccatgtccgggtcctccgacagcctccgcgggtggtggaaggacaacgtgagcttcgaccggtccgggcccatggcgctgacggccccggccggcgagagcccgccgggcgtcgcgtcgtgcctccaccggctccaggacatccaggacagcacgctggggtccgtgctctcggcgctcatccagcactgcgtgccgccgcagcggagcttcccgctggagcgcgggctggcgccgccgtggtggccgaccggggaggaggcctggtggggctcccagggcgaggtccaggcgcaccagggcgtgccgccgtaccggaagccgcacgacctcaagaaggcgtggaagatctcgctgctgagcgcggtgatcaagcacatgagcccgcgcttcgaccagatgcgcaagctcgtgtggcagtccaagcgcctgcagcagaagatgagcgccaaggagacggagacgtggtccaagatcctgcgccaggaggagacgctcagccgccgcctcaagaccgcgctcaagatcacgcccctcgacggcgacggcgacgaggagcacggcagcagcagggacgaccagaacgacggcctggaggacgtagtccgcggtgtgcatgacaagcgcaagcgcgagctgatcagcacagtagacaacggcggggaggcgctggtggccggcctgctcgtggcggatgttcaccttagcccgatggacgagctcctgaagcgttactactacggctgcgtgcctgatcagcaagaaggcgccgtcgcgccggatcagaacgaagaagctggcgtcatgatgatgcctctgggagagctggacctggacctgtgcggcgtcgtcgacgaggtgccgccggacgtgctgttcgatctcatcgcgagctggtcgggagcggacgaggacgacgcgttccgcctgatgcaggactga

SEQ ID NO: 17523 - protein, 462 aa, Sorghum bicolor
  misc_feature: The sequence is a functional homolog of SEQ ID NO 632 in the 10/666,642 US patent application
  misc_feature: The sequence is a functional homolog of SEQ ID NO 1350 in the 11/479,226 US patent application
  misc_feature: The sequence is a functional homolog of SEQ ID NO 2464 in the 10/374,780 US patent application
  misc_feature: The sequence is a functional homolog of SEQ ID NO 632 in the 10/412,699 US patent application
  misc_feature: The sequence is a functional homolog of SEQ ID NO 818 in the 10/225,066 US patent application
  misc_feature: Ceres ANNOT ID no. 8679837
  misc_feature (30)..(419): Pfam ID: EIN3 Pfam Description: Ethylene insensitive 3
MEHDVAHGGGGGAVPAGEEAFEVAHHQEVEQQEEFSDSESGSEPIEISDLKRRMWKDQMLLSKLEGRAGVFRAGGGAAGPSSSRPLAPPSSTASADGAEEEEEEENPEMRCRRKAMLRAQDGVLRHMLKMMEACNARGFVYGVIDEAGEPMSGSSDSLRGWWKDNVSFDRSGPMALTAPAGESPPGVASCLHRLQDIQDSTLGSVLSALIQHCVPPQRSFPLERGLAPPWWPTGEEAWWGSQGEVQAHQGVPPYRKPHDLKKAWKISLLSAVIKHMSPRFDQMRKLVWQSKRLQQKMSAKETETWSKILRQEETLSRRLKTALKITPLDGDGDEEHGSSRDDQNDGLEDVVRGVHDKRKRELISTVDNGGEALVAGLLVADVHLSPMDELLKRYYYGCVPDQQEGAVAPDQNEEAGVMMMPLGELDLDLCGVVDEVPPDVLFDLIASWSGADEDDAFRLMQD

SEQ ID NO: 17524 - DNA, 1125 bp, Sorghum bicolor
  misc_feature: Ceres ANNOT ID no. 8679859
  misc_feature: Encodes the peptide sequence at SEQ ID NO 17525
atggcaagagctcctcctcctcctcctctgcaccggctccctgctcttctcgccgccctgtgccttgccgtggcggtttgcttctccggcgtcgtcgaaaatgctgcagcggcgaccctagcggcggacaggaccggcaggaagatggtcggtgttcacgagctcaggatgggagatttctccatcaaggtcaccaactggggggcgactctcatgtccgtcatcctccccgactccaaagggaacttgggcgacgttgtgctcggctacgacaccgtcgctgaatatgtcaacggcagcgcctacttcgggggtctgatcggccgcgtggccaacaggatcgccggcgctcggttcgtgctggacggcaaggcctaccgcctctaccgcaacgacggcaacaactcgcttcacggtggccaccgggggttcagcaaggtgatatggacggtgaaggagcacgtcggcggcggcgactcaccgtacatcacgctctactaccatagcttcgacggggagcaagggtttccgggcgacctggacgtgtacgtgacgtaccgactctcgtccccgtacgcgctgagcgtgcgcatgaacgccacggcggcggagagcaggagcagggccaccccggtgaacctggcgcaccacgcctactggaacctgggcggccacggcagcgggcccatcctcggcgagacggtgcagctcttcgcgtcgcggtacacgccggtggacgccgccacgctcatcccgacgggcgcgctggcgcccgtggccggcacgccctacgacttcccccgacctgccgcacggcctcgccggctacgacaccaactacgccgtggatcacgacgacgacgacgacgatggcgccgcgccgccgttgcggccggtggcgcgcgtctgggacggcgcgacggggcgggccatggagctgtgggcggaccagcccggggtgcagttctacaccagcaacgggctcgcgggcgtcaggggaaagggcggcagcgtgtacgggcggtacggcgcgctgtgcctcgagacgcaggggttccccgacgccgtgaaccacccgagcttcccgtcgcagatcgtcaggccaggacaggtgtacaagcatga

SEQ ID NO: 17525 - protein, 374 aa, Sorghum bicolor
  misc_feature: Useful for making plants with altered oil content
  misc_feature: Functional homolog of the protein sequence given in SEQ ID NO 13360
  misc_feature: Ceres ANNOT ID no. 8679859
  misc_feature (45)..(265): SWISSPROT Homolog: EC 5.1.3.3 Aldose 1-epimerase
  misc_feature (51)..(340): Pfam ID: Aldose_epim Pfam Description: Aldose 1-epimerase
MARAPPPPPLHRLPALLAALCLAVAVCFSGVVENAAAATLAADRTGRKMVGVHELRMGDFSIKVTNWGATLMSVILPDSKGNLGDVVLGYDTVAEYVNGSAYFGGLIGRVANRIAGARFVLDGKAYRLYRNDGNNSLHGGHRGFSKVIWTVKEHVGGGDSPYITLYYHSFDGEQGFPGDLDVYVTYRLSSPYALSVRMNATAAESRSRATPVNLAHHAYWNLGGHGSGPILGETVQLFASRYTPVDAATLIPTGALAPVAGTPYDFPRPAARPRRLRHQLRRGSRRRRRRWRRAAVAAGGARLGRRDGAGHGAVGGPARGAVLHQQRARGRQGKGRQRVRAVRRAVPRDAGVPRRREPPELPVADRQARTGVQA

SEQ ID NO: 17526 - DNA, 780 bp, Sorghum bicolor
  misc_feature: Ceres ANNOT ID no. 8679866
  misc_feature: Encodes the peptide sequence at SEQ ID NO 17527
atgggggatcatgtcgcggtggatgttggggagctcgtagcgtcccgagtcggtgaggcagccgggttggtgtcccgcggtaaggaggaaacggaggcgctgattgggatggtggagtgccgcatttgccaggaggaggacctcgcgaagaacctcgagagcccctgcgcttgcagcggcagcctcaagtatgctcacagggaatgtgtgcagcgttggtgcaatgagaaaggagatataacctgtgaaatctgccatgagtcgtacaagcctggttacactgccccaccccaagtgcatcatgatgaaacaaccatagagataagtggtggagattggaccatctctggcaaccgtttggatttacatgatcctagaatattggcaatggctgctgctcaacaccgtttacttgaagacgagtatgatgaatatactacaacaaacaacaatgctgctgcgttttgccgctctatatttctgattttgatggcccttctgctcctgaggcatacactgaccattactaacagtgatgatgaagatgatgcatcagctattttctcgctatttcttttgagggcagctggatttttgctgccatgctatattatggcttgggctattagtatcatgcagcgtcaaagacaaagacaggaagaagcaatgctattgccaaccgaagtggctatcattctgcaccggaacggaagaacgatgcaatttgcggtggcaccaccagaatctcctacctcacctcagcccgagccaatccaatag

SEQ ID NO: 17527 - protein, 259 aa, Sorghum bicolor
  misc_feature: Useful for making plants with altered lignin content
  misc_feature: Functional homolog of the protein sequence given in SEQ ID NO 12907
  misc_feature: Ceres ANNOT ID no. 8679866
  misc_feature (40)..(85): Pfam ID: zf-C3HC4 Pfam Description: Zinc finger, C3HC4 type (RING finger)
MGDHVAVDVGELVASRVGEAAGLVSRGKEETEALIGMVECRICQEEDLAKNLESPCACSGSLKYAHRECVQRWCNEKGDITCEICHESYKPGYTAPPQVHHDETTIEISGGDWTISGNRLDLHDPRILAMAAAQHRLLEDEYDEYTTTNNNAAAFCRSIFLILMALLLLRHTLTITNSDDEDDASAIFSLFLLRAAGFLLPCYIMAWAISIMQRQRQRQEEAMLLPTEVAIILHRNGRTMQFAVAPPESPTSPQPEPIQ

SEQ ID NO: 17528 - DNA, 1458 bp, Sorghum bicolor
  misc_feature: Ceres ANNOT ID no. 8679873
  misc_feature: Encodes the peptide sequence at SEQ ID NO 17529
atgagcgctgctgctactctcccgaccggccatggccagaagccgcacgcggtgtgcgtgccgttcccggcgcagggccacatcacgccgatgctgaagctggccaagatcctccacgccaggggcttccgcgtcaccttcgtcaacaccgagtacaaccaccgccgcctcatccgctcccgcggcgccgccgccgtcgcgggcctcgcggggttccgcttcgccaccatcccggacggcctgccggagtccgacgccgacgccacgcaggacccggcgaccatcagccacgccaccaagcacaactgcccgcctcacctgcggagcctcctcgccggccttgacggcgtcacgtgcgtcgtggcggacaacctgatgagcttcagcgtggacgccgccagggaggccggcgtgccgtgcgcgctcttctggaccgccagcgcctccggctacatgggctaccgcaacttccgcctcctcatcgacaggggcatcatccccttcaaagacgaagagcagctgacgaacgggttcatggaaacgccggtggactgggcgcccggcatgagcaagcacatgcggctcaaggacttcccgaccttcctccgcaccacggaccccaacgacgcgctgatgaccttccagctccaggaggtggagcgctcggagtacgcgtccgccgtcgtcatcaacaccttcgacgagctggagcagccggcgctcgacgccatgcgcgccatcatcccggccctatacaccatcggcccgctcgattccgtcgcggagcaggtcgccgtccgcagggggcccctggacgcggtgagctgcagcctgtggcgggaggaccagtggtgcctggcgtggctggacggcaggaggccccggccgcggtcggtggtgtacgtgaacttcgggagcgtgacggtcatgagcgggcaggagctggcggagttcgcgtgggggctggcgagcagcggccacgacttcctgtgggtcgtcaggccggacgtcgtgaagggcgacacggcctcggcggcggcgctgacgccggggttcctggaggcgaccaagggcagggggatcctggcgagctggtgcgaccaggaggccgtgctgcggcacgaggcggtgggcctgttcctgacgcacagcgggtggaactcgacgctggagagcctcggcgccggggtgccgatgctgtgctggccattcttcgccgagcagcagaccaactgccggtacaagtgcgccgagtggggcgtggcgatggaggtcggcgacgacgtgcggcgggaggccgtggaggcgaggatacgggaggcgatgggtggggacaaggggaaggagatggcgcgcagggcggcggagtggaaacaggccgccgcggggtcggcggcgaggtcgctcgcgaacctcgacagcctgatcaacgatgtgctgctctccggcacgatttga

SEQ ID NO: 17529 - protein, 485 aa, Sorghum bicolor
  misc_feature: Useful for making plants with altered carbohydrate content
  misc_feature: Functional homolog of the protein sequence given in SEQ ID NO 14546
  misc_feature: Ceres ANNOT ID no. 8679873
  misc_feature (16)..(416): SWISSPROT Homolog: EC 2.4.1.210 Limonoid glucosyltransferase
  misc_feature (17)..(483): Pfam ID: UDPGT Pfam Description: UDP-glucoronosyl and UDP-glucosyl transferase
MSAAATLPTGHGQKPHAVCVPFPAQGHITPMLKLAKILHARGFRVTFVNTEYNHRRLIRSRGAAAVAGLAGFRFATIPDGLPESDADATQDPATISHATKHNCPPHLRSLLAGLDGVTCVVADNLMSFSVDAAREAGVPCALFWTASASGYMGYRNFRLLIDRGIIPFKDEEQLTNGFMETPVDWAPGMSKHMRLKDFPTFLRTTDPNDALMTFQLQEVERSEYASAVVINTFDELEQPALDAMRAIIPALYTIGPLDSVAEQVAVRRGPLDAVSCSLWREDQWCLAWLDGRRPRPRSVVYVNFGSVTVMSGQELAEFAWGLASSGHDFLWVVRPDVVKGDTASAAALTPGFLEATKGRGILASWCDQEAVLRHEAVGLFLTHSGWNSTLESLGAGVPMLCWPFFAEQQTNCRYKCAEWGVAMEVGDDVRREAVEARIREAMGGDKGKEMARRAAEWKQAAAGSAARSLANLDSLINDVLLSGTI

SEQ ID NO: 17530 - DNA, 780 bp, Sorghum bicolor; identical to SEQ ID NO: 17526
  misc_feature: Ceres ANNOT ID no. 8679867
  misc_feature: Encodes the peptide sequence at SEQ ID NO 17531

SEQ ID NO: 17531 - protein, 259 aa, Sorghum bicolor; identical to SEQ ID NO: 17527
  misc_feature: Useful for making plants with altered lignin content
  misc_feature: Functional homolog of the protein sequence given in SEQ ID NO 12907
  misc_feature: Ceres ANNOT ID no. 8679867
  misc_feature (40)..(85): Pfam ID: zf-C3HC4 Pfam Description: Zinc finger, C3HC4 type (RING finger)

SEQ ID NO: 17532 - DNA, 1533 bp, Sorghum bicolor
  misc_feature: Ceres ANNOT ID no. 8679871
  misc_feature: Encodes the peptide sequence at SEQ ID NO 17533
atggcagccggcgacaacaccaagccgcacgcggtgtgcgtcccgttcccggcgcagggccacgtgacgccgatgatgaagctggccaaggtcctctactgcaagggcttccacatcaccttcgtcaacaccgagtacaaccaccgccgcctgatccggtcccggggcccccaggccgtcgcgggcctcccgggcttccgcttcgccaccatccctgacggcctgccgcactcggacgccgacgccacgcaggaccccgccgcgatctgcgactccaccatgaagacctgcctcccgcacctcaagcgcctgctcgaccgcctcaaccacgacgccgccggcgatggcgagcaggtgccgccgccgccgccgccggtgacgtgcgtcgtggccgacaacgtcaccagcttctgcctggacgctgccaaggacatcggcgtgccttgcctgctcttctggacggccagcgcctgcggctacctgggctaccgccacttccagttcctcatggacgaaggccttgcgcctctcaaagacgaggcgcagctgacgaacgggtacctggacacgccggtggggtgggcgcgcgggatgagcaagcacatgcggctcagggacttcccgagcttcatctacacgatgcagcgcggcgacatcctgctggacttcatgatgcacgaggtgtcgcggacgaacgccgccgccgccgtcatcctcaacaccttcgacgagctcgagccagaggcgctggacgccatgcgcgccatcctgccgccgcccgtctacaccatcggcccgctcagtctcctcctcgagcggctggtggccaccgccgccgccgccgtccctgaacctggcgacgacgtcgtcgtcgtcgacgccgccgcgctcggcacggtccgcgccagcctctggaaggaagaccacacctgcctgcggtggctggacggcagggcggcccgccggtccgtggtgtacgtgaactacgggtgcgtcaccaccatgtcgaaccaggacctggtggagttcgcgtgggggctggcgagcagcggctacgacttcctgtggatcatccggccggacctggtgaagggcgagacggcggtgctgccgccggagttcgtggagtccaccaagggcaggtgcctcctggcgagctggtgcgagcaggaggcggtgctgcggcacgaggcggtgggggtgttcctgacgcacagcgggtggaactccatgacggagagcctcagcgcgggcgtgcccatgctgtgctggcccttcttcgcggagcagcagaccaaccgtcggtacgcgtgcaccgagtggggcgtggggatggaggtcgacggcgacgtgcggcgggaggctctggcggcaacgatacgggaggcaatggccggcgacaaggggaaggagatgaagcggagggcggacgagtggaaggaggccgccattcgggccacgcagcctggcggcacggcgttgaccaacctggacgacctaatcaagaatcacgtcctgctacctaagtgctga

SEQ ID NO: 17533 - protein, 510 aa, Sorghum bicolor
  misc_feature: Useful for making plants with altered carbohydrate content
  misc_feature: Functional homolog of the protein sequence given in SEQ ID NO 14338
  misc_feature: Ceres ANNOT ID no. 8679871
  misc_feature (307)..(502): SWISSPROT Homolog: EC 2.4.1.115 Anthocyanidin 3-O-glucosyltransferase
  misc_feature (11)..(508): Pfam ID: UDPGT Pfam Description: UDP-glucoronosyl and UDP-glucosyl transferase
MAAGDNTKPHAVCVPFPAQGHVTPMMKLAKVLYCKGFHITFVNTEYNHRRLIRSRGPQAVAGLPGFRFATIPDGLPHSDADATQDPAAICDSTMKTCLPHLKRLLDRLNHDAAGDGEQVPPPPPPVTCVVADNVTSFCLDAAKDIGVPCLLFWTASACGYLGYRHFQFLMDEGLAPLKDEAQLTNGYLDTPVGWARGMSKHMRLRDFPSFIYTMQRGDILLDFMMHEVSRTNAAAAVILNTFDELEPEALDAMRAILPPPVYTIGPLSLLLERLVATAAAAVPEPGDDVVVVDAAALGTVRASLWKEDHTCLRWLDGRAARRSVVYVNYGCVTTMSNQDLVEFAWGLASSGYDFLWIIRPDLVKGETAVLPPEFVESTKGRCLLASWCEQEAVLRHEAVGVFLTHSGWNSMTESLSAGVPMLCWPFFAEQQTNRRYACTEWGVGMEVDGDVRREALAATIREAMAGDKGKEMKRRADEWKEAAIRATQPGGTALTNLDDLIKNHVLLPKC

SEQ ID NO: 17534 - DNA, 750 bp, Sorghum bicolor
  misc_feature: Ceres ANNOT ID no. 8679889
  misc_feature: Encodes the peptide sequence at SEQ ID NO 17535
atggggaggggaaagattgtgatccgcaggatcgacaactccacgagccggcaggtgaccttctccaagcgccggaacgggatcttcaagaaggccaaggagctcgccatcctctgcgatgcggaggtcggcctcatgatcttctccagcaccggccgcctctacgagtactctagcaccagcatgaaatcagttatagatcgttacggcaaggccaaggaagagcagcaagtcgtcgcaaatcccaactcagagcttaagttttggcaaagggaggcagcaagcttgagacaacaactgcacaacttgcaagaaaattatcggcagttgatgggagaggatctttctgggctgaatgttaaagaactgcagtccctagagaatcagttggaaacaagcctgcgtggtgtccgcgcaaagaaggaccatctcttgatagatgagattcacgaattgaatcgaaaggcaagtttatttcaccaagaaaacacagacttgtacaataagatcaacctggttcgccaagaaaatgctgagttacataaaaagatctatgagactgaaggaccaagtggagttaatcaggagtcaccgactccattcaactttccagtagtagaaaccagagatgttcctgtgcaacttggactcagcacattgccacaacagaataacattgagccatcgactgctcctaagctagggtataacatttattctctattctctctatatatttcaattcgttaa

SEQ ID NO: 17535 - protein, 249 aa, Sorghum bicolor
  misc_feature: The sequence is a functional homolog of SEQ ID NO 2199 in the 10/666,642 US patent application
  misc_feature: The sequence is a functional homolog of SEQ ID NO 2197 in the 10/666,642 US patent application
  misc_feature: The sequence is a functional homolog of SEQ ID NO 2189 in the 10/666,642 US patent application
  misc_feature: The sequence is a functional homolog of SEQ ID NO 1243 in the 11/479,226 US patent application
  misc_feature: The sequence is a functional homolog of SEQ ID NO 1420 in the 10/666,642 US patent application
  misc_feature: The sequence is a functional homolog of SEQ ID NO 1814 in the 10/412,699 US patent application
  misc_feature: The sequence is a functional homolog of SEQ ID NO 570 in the 10/412,699 US patent application
  misc_feature: The sequence is a functional homolog of SEQ ID NO 2191 in the 10/666,642 US patent application
  misc_feature: The sequence is a functional homolog of SEQ ID NO 2195 in the 10/666,642 US patent application
  misc_feature: Useful for making plants with altered lignin content
  misc_feature: Functional homolog of the protein sequence given in SEQ ID NO 13210
  misc_feature: The sequence is a functional homolog of SEQ ID NO 1460 in the 10/666,642 US patent application
  misc_feature: The sequence is a functional homolog of SEQ ID NO 938 in the 10/412,699 US patent application
  misc_feature: The sequence is a functional homolog of SEQ ID NO 2193 in the 10/666,642 US patent application
  misc_feature: The sequence is a functional homolog of SEQ ID NO 1366 in the 10/666,642 US patent application
  misc_feature: The sequence is a functional homolog of SEQ ID NO 1730 in the 10/412,699 US patent application
  misc_feature: The sequence is a functional homolog of SEQ ID NO 207 in the 11/479,226 US patent application
  misc_feature: The sequence is a functional homolog of SEQ ID NO 64 in the 10/412,699 US patent application
  misc_feature: The sequence is a functional homolog of SEQ ID NO 1732 in the 10/412,699 US patent application
  misc_feature: The sequence is a functional homolog of SEQ ID NO 44 in the 10/666,642 US patent application
  misc_feature: The sequence is a functional homolog of SEQ ID NO 66 in the 10/412,699 US patent application
  misc_feature: The sequence is a functional homolog of SEQ ID NO 1701 in the 10/412,699 US patent application
  misc_feature: Useful for making plants with modulated flowering time
  misc_feature: Functional homolog of the protein sequence given in SEQ ID NO 13660
  misc_feature: The sequence is a functional homolog of SEQ ID NO 1965 in the 10/412,699 US patent application
  misc_feature: The sequence is a functional homolog of SEQ ID NO 1967 in the 10/412,699 US patent application
  misc_feature: Useful for biocontainment applications
  misc_feature: Useful for making plants with modulated nitrogen use efficiency
  misc_feature: Functional homolog of the protein sequence given in SEQ ID NO 12982
  misc_feature: The sequence is a functional homolog of SEQ ID NO 1963 in the 10/412,699 US patent application
  misc_feature: The sequence is a functional homolog of SEQ ID NO 1955 in the 10/412,699 US patent application
  misc_feature: Ceres ANNOT ID no. 8679889
  misc_feature (73)..(172): Pfam ID: K-box Pfam Description: K-box region
  misc_feature (9)..(59): Pfam ID: SRF-TF Pfam Description: SRF-type transcription factor (DNA-binding and dimerisation domain)
MGRGKIVIRRIDNSTSRQVTFSKRRNGIFKKAKELAILCDAEVGLMIFSSTGRLYEYSSTSMKSVIDRYGKAKEEQQVVANPNSELKFWQREAASLRQQLHNLQENYRQLMGEDLSGLNVKELQSLENQLETSLRGVRAKKDHLLIDEIHELNRKASLFHQENTDLYNKINLVRQENAELHKKIYETEGPSGVNQESPTPFNFPVVETRDVPVQLGLSTLPQQNNIEPSTAPKLGYNIYSLFSLYISIR

SEQ ID NO: 17536 - DNA, 849 bp, Sorghum bicolor
  misc_feature: Ceres ANNOT ID no. 8679902
  misc_feature: Encodes the peptide sequence at SEQ ID NO 17537
atggctggcggcgggcaggcggcggtgtcgttcctgacgcggatggcggcggcggcggcggggttgggcctggcggcgtccgcggcctccacgtccttctacacggtggacggcggggagcgcgccgtcatcttcgaccgcgtccgcggcgtgctcccgcagacgacgtcggagggcactcatttcctggtccccatcctccagaagcccttcatcttcgacatccgcactcgcccccacagcttctcctccacctccggcaccaaggacctccagatggtcaacctcacgctccgcgtcctgtcgcgccccgacgtcgaacacctcccggacatcttcaactccctcggcctcgagtacgacgagaaggtcctcccatccatcggcaacgaggtgctcaaggccgtcgtcgcgcagttcaacgccgaccagctcctcaccgagcgtccccacgtctccgcgctcgtccgcgaatcgctcacccagcgcgcccgcgagttcaacatcgtcctcgacgacgtcgccatcacccaccttgcctacgggccggagttctcgcaggccgtcgagaagaagcaggtcgcgcagcaggaggccgagcgctccaggttcctcgtcgcgcgcgccgagcaggagaggcgcgccgccatcgtccgcgccgagggggagagcgaggccgcgcgccttatctccgaggccacgaccaccgcgggcaacggcctgatcgagctcaggaggatcgaggcggccaaggagatcgccggcgtgctggcgcgcacgcccaacgtctcctacatccccgccggcaacaatggccagatgctgctcgggcttaacgccgcccggtga

SEQ ID NO: 17537 - protein, 282 aa, Sorghum bicolor
  misc_feature: Useful for making plants with modulated biomass
  misc_feature: Functional homolog of the protein sequence given in SEQ ID NO 14547
  misc_feature: Ceres ANNOT ID no. 8679902
  misc_feature (34)..(213): Pfam ID: Band_7 Pfam Description: SPFH domain / Band 7 family
MAGGGQAAVSFLTRMAAAAAGLGLAASAASTSFYTVDGGERAVIFDRVRGVLPQTTSEGTHFLVPILQKPFIFDIRTRPHSFSSTSGTKDLQMVNLTLRVLSRPDVEHLPDIFNSLGLEYDEKVLPSIGNEVLKAVVAQFNADQLLTERPHVSALVRESLTQRAREFNIVLDDVAITHLAYGPEFSQAVEKKQVAQQEAERSRFLVARAEQERRAAIVRAEGESEAARLISEATTTAGNGLIELRRIEAAKEIAGVLARTPNVSYIPAGNNGQMLLGLNAAR

SEQ ID NO: 17538 - DNA, 1440 bp, Sorghum bicolor
  misc_feature: Ceres ANNOT ID no. 8679949
  misc_feature: Encodes the peptide sequence at SEQ ID NO 17539
atggtgacgactgtgctgctggctgtctttgtagccgccgccgtcctcgccgcggtggtgtaccgccacttcgtgccgctgctccgcaaccccggcgccccaaggggcagcttcggctggcccctcgtcggtgagaccatcggcttcctccgcccccacgcctccaacaccaccggcgacttcttgcacagtcacatcaccaggtacggcgcggtgttcaagtcgcacctgttcggcgcgccgacggtggtgtcgtgcgacgaggagctcaaccagttggtgctgcagaacgaggagcgactgttccagtgcagctacccgggctccatccggggcatcctgggcgcgtcctccctgctggtggtcacgggcgagcgccaccgccggatccgcggcgtgtcgctggcattcgtcgcctccagggggatgcgccccgcccacctcgccgacgtcgaccgggccgcgcgcgccgccatcgcgtcctggcgcggccgctgcggcgccgtcgttgtcttctgcgacgaggcaagacaggtgctgggcttgtccccggaggagccgctcatccgcaggctcctggagcactactccaccttcatgaaagggctcgtcgctctccctctcaacatccctgggacaccgtatgccagagctgtagaggcgaggaggaagatatctctcactttggaagagattatggacgagaggtggaaggaagatgggtcatccaggaagtcatccgctttcctagacgtgctcatcgcaaatagcgagctgtcccacgatgacaaggtcaccttcctgctggactcgcttttagcaggctatgagaccacctccgtcttgctgtccatgctcgtgtatttcatcgggcaatctccccagtgtttgcagcaactcaaggttgagcatgagagcataaggtccagcaaggggacagatgagttcttgaacgctgaagactacaggaagatggaatatacccaacgtgttatcaacgagacgttaagatgcggtaacattgtcaagtttctgcaccggaaggccctcaaggatgtcaaatataaagggtatgtgatcccagctggctggaaagtgctgccaattttgagctccgttcatttggaccctgctctctacaagaaccctcaagagttcgatccttgcagatgggaggggcaggaccaggcgtcgtcaggcaagaagtttgcgccgttcggcggcgggctccggctgtgccccggatcggagctgggcaaactggaggctgccttcttcctgcaccacctcgtgctccagtacaggtggagcttggacggcgaggacgtcccgatggcgcacccgtacgtggagttcagcaagggcctgcccatcaagatatggcgccaccagcaggagtcgtctgatacgacgatcccttggttcgtcgggcagctgtag

SEQ ID NO: 17539 - protein, 479 aa, Sorghum bicolor
  misc_feature: Useful for making plants with modulated oxidative stress sensitivity
  misc_feature: Functional homolog of the protein sequence given in SEQ ID NO 14548
  misc_feature: Ceres ANNOT ID no. 8679949
  misc_feature (34)..(462): SWISSPROT Homolog: EC 1.14.13.93 (+)-abscisic acid 8'-hydroxylase
  misc_feature (34)..(460): Pfam ID: p450 Pfam Description: Cytochrome P450
MVTTVLLAVFVAAAVLAAVVYRHFVPLLRNPGAPRGSFGWPLVGETIGFLRPHASNTTGDFLHSHITRYGAVFKSHLFGAPTVVSCDEELNQLVLQNEERLFQCSYPGSIRGILGASSLLVVTGERHRRIRGVSLAFVASRGMRPAHLADVDRAARAAIASWRGRCGAVVVFCDEARQVLGLSPEEPLIRRLLEHYSTFMKGLVALPLNIPGTPYARAVEARRKISLTLEEIMDERWKEDGSSRKSSAFLDVLIANSELSHDDKVTFLLDSLLAGYETTSVLLSMLVYFIGQSPQCLQQLKVEHESIRSSKGTDEFLNAEDYRKMEYTQRVINETLRCGNIVKFLHRKALKDVKYKGYVIPAGWKVLPILSSVHLDPALYKNPQEFDPCRWEGQDQASSGKKFAPFGGGLRLCPGSELGKLEAAFFLHHLVLQYRWSLDGEDVPMAHPYVEFSKGLPIKIWRHQQESSDTTIPWFVGQL

SEQ ID NO: 17540 - DNA, 633 bp, Sorghum bicolor
  misc_feature: Ceres ANNOT ID no. 8679952
  misc_feature: Encodes the peptide sequence at SEQ ID NO 17541
atgtcgtacgcctacctcttcaagtacatcatcatcggcgacacaggcgtggggaagtcgtgcctgctgctgcagttcacggacaagcgcttccagcccgtgcacgacctcaccatcggcgtcgaattcggcgcccgcatgatcaccatcgacaacaagcccatcaaactccagatttgggacacggctggccaagaatcattcagatctattactaggtcatactacagaggtgctgctggtgcccttttggtttatgatatcactaggagggagaccttcaatcatctcgcaagttggctagaagatgcaaggcagcatgcaaatgctaacatgacagtgatgctgattggaaacaaatgtgatctttctcatagacgtgctgtcagctatgaggaaggcgaacagtttgccaaggagcatggtctggtctttatggaggcatctgctaaaactgcacaaaacgttgaggaggcattcattaagaccgctggtacaatatacaagaaaatccaagatggcatatttgatgtatcaaatgagtccaatgggatcaaagttggctacgttgttcccaactcatctggaggtggtgctggctcgtcctcccaggctggtggctgctgcagttga

SEQ ID NO: 17541 - protein, 210 aa, Sorghum bicolor
  misc_feature: Useful for making plants with altered lignin content
  misc_feature: Functional homolog of the protein sequence given in SEQ ID NO 13076
  misc_feature: Useful for making plants with altered terpenoid content
  misc_feature: Functional homolog of the protein sequence given in SEQ ID NO 13157
  misc_feature: Ceres ANNOT ID no. 8679952
  misc_feature (8)..(193): SWISSPROT Homolog: EC 2.7.11.1 Non-specific serine/threonine protein kinase
  misc_feature (8)..(169): Pfam ID: Ras Pfam Description: Ras family
  misc_feature (8)..(122): Pfam ID: Miro Pfam Description: Miro-like protein
MSYAYLFKYIIIGDTGVGKSCLLLQFTDKRFQPVHDLTIGVEFGARMITIDNKPIKLQIWDTAGQESFRSITRSYYRGAAGALLVYDITRRETFNHLASWLEDARQHANANMTVMLIGNKCDLSHRRAVSYEEGEQFAKEHGLVFMEASAKTAQNVEEAFIKTAGTIYKKIQDGIFDVSNESNGIKVGYVVPNSSGGGAGSSSQAGGCCS

SEQ ID NO: 17542 - DNA, 660 bp, Sorghum bicolor
  misc_feature: Ceres ANNOT ID no. 8679986
  misc_feature: Encodes the peptide sequence at SEQ ID NO 17543
atggcgccgacgtcgaagctgtcgatgggcatcaagcgcgcgtcgaggtcgcacgcgtaccaccgccgtgggctgtgggccatcaaggccaagcatggcggcgccttccccaaggcagagaagcccgccgccgccgcggaacccaagttctacccggccgacgacgtcaagccccgcgtccccagcacccgcaagcctaagcccaccaagctcaggtcgagcatcacgcccggtacggtgctgatcctcctcgcggggcgcttcatggggaagagagtggtgttcctcaagcagctcaagtccggcctgctcctcgtctctgggcctttcaagatcaatggagtgccgatccgccgtgtgaaccagacctatgtcattgctacatccaccaaggttgacatctctggtgttgatgtcgcaaagtttgatgacaagtactttgccagggagaagaagcagaaggcgaagaagaccgagggcgagctttttgagacagagaaggagacatccaagtctctgcctgacttcaagaaggatgaccagaaggctgtggatgctgctctgatcaaggctattgaggctgtcccagagctgaaaacctatcttggcgcccggttctctctcagggatggtgacaagccccatgagatggtcttctaa

SEQ ID NO: 17543 - protein, 219 aa, Sorghum bicolor
  misc_feature: Useful for making plants with modulated nitrogen use efficiency
  misc_feature: Functional homolog of the protein sequence given in SEQ ID NO 13136
  misc_feature: Ceres ANNOT ID no. 8679986
  misc_feature (112)..(219): Pfam ID: Ribosomal_L6e Pfam Description: Ribosomal protein L6e
  misc_feature (1)..(49): Pfam ID: Ribosomal_L6e_N Pfam Description: Ribosomal protein L6, N-terminal domain
MAPTSKLSMGIKRASRSHAYHRRGLWAIKAKHGGAFPKAEKPAAAAEPKFYPADDVKPRVPSTRKPKPTKLRSSITPGTVLILLAGRFMGKRVVFLKQLKSGLLLVSGPFKINGVPIRRVNQTYVIATSTKVDISGVDVAKFDDKYFAREKKQKAKKTEGELFETEKETSKSLPDFKKDDQKAVDAALIKAIEAVPELKTYLGARFSLRDGDKPHEMVF

SEQ ID NO: 17544 - DNA, 837 bp, Sorghum bicolor
  misc_feature: Ceres ANNOT ID no. 8680111
  misc_feature: Encodes the peptide sequence at SEQ ID NO 17545
atggatcatgaggagatcaagaccatcgtgcgcaagttcccagcatttgcatactacagtgtggatcgcaagatcaaacccctggtggagctactacttgagctcggggtgccaaagtccagcataccaggaatcataaagaaaaggcctcagctgtgtggcatcagcatgtcagataatcttaaaccgatgatggtttatttggagaacattggtgtcaacaaagctcagtggagcaaggtgattacccggttccctgcacttctcacgtatagtaggaacaaggtggagacaaccgtgagcttccttactgagctaggagtttccaagaaaaacattggcaagatcctgacacgatgccctcatctcatgagctacagcgtcgatgacaatctcaggccaactgctgagtacttccggtcgatcggtgcagatgccgcatctcttattcagaagagcccacaggccttcggtctgaatgtcgaggcaaagctgaagccgatcacagaattcttcctggcaagggaatttagcatcgaggaaattggcattatggcaaacagatttggaattattcacacactaagcttggaagaaaacttacttccgaaatatgagttcttcctgacgatggaatacccaaggtgcgagcttgtgaaatttccacagtactttgggtacagcttggatcagcggataaaaccacggtatgctcggatgactggctgtggggtgaggttgattttgaatcagatgctttcagtctcagatgacaggtttgagaaaattttagaaaagaagaagactggctttgaaaagacaataatttcagattag

SEQ ID NO: 17545 - protein, 278 aa, Sorghum bicolor
  misc_feature: Useful for making plants with altered lignin content
  misc_feature: Functional homolog of the protein sequence given in SEQ ID NO 13088
  misc_feature: Ceres ANNOT ID no. 8680111
  misc_feature (2)..(262): Pfam ID: mTERF Pfam Description: mTERF
MDHEEIKTIVRKFPAFAYYSVDRKIKPLVELLLELGVPKSSIPGIIKKRPQLCGISMSDNLKPMMVYLENIGVNKAQWSKVITRFPALLTYSRNKVETTVSFLTELGVSKKNIGKILTRCPHLMSYSVDDNLRPTAEYFRSIGADAASLIQKSPQAFGLNVEAKLKPITEFFLAREFSIEEIGIMANRFGIIHTLSLEENLLPKYEFFLTMEYPRCELVKFPQYFGYSLDQRIKPRYARMTGCGVRLILNQMLSVSDDRFEKILEKKKTGFEKTIISD

SEQ ID NO: 17546 - DNA, 1017 bp, Sorghum bicolor
  misc_feature: Ceres ANNOT ID no. 8680121
  misc_feature: Encodes the peptide sequence at SEQ ID NO 17547
atgaggcgcttcctgccggccggaggcggcggcggcggcggcggggagccgtcgtcttcctcctcctcgggcgggcaacaccagcacggcggcgggctcgcgggcgagagggcggcggcgggcctgcggtaccgaggaggcgacatctcgctggggcacgggcacgacgacggacatcgtcgtcatcagtaccacctcggcgccggcgacgcggcggataggcagaacgacgggtccatggacatgctggcgcggcacagcagctcgccggtcggcttcttctccaacctcgtcatggacaacgggtacccacgctcaaataaagccggagtcagtggtggcggcgaaggtcagcgtgatccttcaacggccaacaacaatagtggaagtagcagcagcggccggaagatgaagccgtcgtcgtccgggttcaacttcgccggcgggacgcagcagcagggccagcagcagggcgccgccgggggccacctctcgcggatctccgaggacggctgcgccagcttcccggccggcggcctggtgggcgaccgcgctgcaggtggccgcggctctggcgagagcagcagcggtggtgctgccgcggcggcgcgctcgtactccggcgggttctccattgttgggccgtgggaagagtccagggacatcattaccaccctcggcgcatacgaccctcagtttagcggcgccatggcgggtacggcgctggagatggcgggcatggacaggtacatgcagctgcagcaggaccaggtgccgttcaaagtgcgcgccaagcgcgggtgcgccacgcaccccaggagcatcgccgagagggagaggaggacgaggatcagcgagaagctcaggaagctccaggacctcgtgcccaacatggacaagcaaacgagcaccgcggacatgttggaccttgcagttgagcacatcaagggcctgcagagcgaactgcaggctctgaaacacgagcaggagaagtgcacctgctgccgaaagcgatag

SEQ ID NO: 17547 - protein, 338 aa, Sorghum bicolor
  misc_feature: The sequence is a functional homolog of SEQ ID NO 168 in the 10/714,887 US patent application
  misc_feature: The sequence is a functional homolog of SEQ ID NO 168 in the 11/435,388 US patent application
  misc_feature: The sequence is a functional homolog of SEQ ID NO 178 in the 10/714,887 US patent application
  misc_feature: The sequence is a functional homolog of SEQ ID NO 178 in the 11/435,388 US patent application
  misc_feature: The sequence is a functional homolog of SEQ ID NO 174 in the 10/714,887 US patent application
  misc_feature: The sequence is a functional homolog of SEQ ID NO 174 in the 11/435,388 US patent application
  misc_feature: The sequence is a functional homolog of SEQ ID NO 186 in the 10/714,887 US patent application
  misc_feature: The sequence is a functional homolog of SEQ ID NO 186 in the 11/435,388 US patent application
  misc_feature: The sequence is a functional homolog of SEQ ID NO 194 in the 10/714,887 US patent application
  misc_feature: The sequence is a functional homolog of SEQ ID NO 194 in the 11/435,388 US patent application
  misc_feature: Ceres ANNOT ID no. 8680121
  misc_feature (271)..(319): Pfam ID: HLH Pfam Description: Helix-loop-helix DNA-binding domain
MRRFLPAGGGGGGGGEPSSSSSSGGQHQHGGGLAGERAAAGLRYRGGDISLGHGHDDGHRRHQYHLGAGDAADRQNDGSMDMLARHSSSPVGFFSNLVMDNGYPRSNKAGVSGGGEGQRDPSTANNNSGSSSSGRKMKPSSSGFNFAGGTQQQGQQQGAAGGHLSRISEDGCASFPAGGLVGDRAAGGRGSGESSSGGAAAAARSYSGGFSIVGPWEESRDIITTLGAYDPQFSGAMAGTALEMAGMDRYMQLQQDQVPFKVRAKRGCATHPRSIAERERRTRISEKLRKLQDLVPNMDKQTSTADMLDLAVEHIKGLQSELQALKHEQEKCTCCRKR

SEQ ID NO: 17548 - DNA, 1413 bp, Sorghum bicolor
  misc_feature: Ceres ANNOT ID no. 8680190
  misc_feature: Encodes the peptide sequence at SEQ ID NO 17549
atggagtccaagggtggcaagaagaagtctagcagtagtcgttcctccctgatgtacgaagctccccttggctacagcattgaggatctccgccctgcaggcggcatcaagaagttctccgctgcttactcgaacgtatgtactggtgaccaaaagatttcaagaaaccactccctgtcttcctcccccggctgtctgtcatcttgctctgaaacaatggctgtcctgcaagttgctgctgctgcccctccccctgtctcagcgattgggtttgagggatatgagaagcgccttgagatcagcttctctgaggcacctgtcttcgctgatcccaatggaaggggattgcgtgcgctctcacgtgaccagattgagactgttcttgaccttgcacggtgcaccattgtgtctgagctctcaaatgaggactttgactcttatgtcttatccgagtcaagcctgtttgtctacccatataaaatggtgatcaagacctgtgggactacaaagcttctgctcgctattccgaggatccttgagcttgctaaagagctctcgttgccactttctgcagttaaatactcccgtgggacattcatattccctgatgcacagccttccccacacaagaactttgctgatgaggttgccttcctgaatcgcttctttggtggcctcaagtctggcggtaatgcttatgttattggtgattctgcaaagcctgggcagaagtggcacgtctactatgcctctgagcaccctgaggagcctgttgttactctcgagatgtgcatgactgggctggacaagaagaaagcttctgtcttcttcaagacatctgctgatggttacacatcgtgtgctaaggagatgaccaagctctctggtatctcggacattattccagagatggagatctgtgactttgatttcgagccctgtggctactccatgaatgctgttcatggccctgctttctcgaccattcatgtgaccccagaggatggcttcagctatgcaagctacgaggtcatgggcttcaacccaggctcttcttcttatggtgacctggttaagagggtgctgaggtgctttggcccagttgagttctctgttgccgtgactatcttcggtgagcgggacaatgcaaagacctgggggaagaaactggaagctgaggcctatgcctgcagcaacatggttgagcaggtgctgccgtctggtggcttgctcatatatcagagcttcactgctacgggtgcagccacccctgggtcgccgaggtcagtcctgcatgacttcgctggtgacattgtcaagcctggcgatagtggtgaggccgatggcccctgctgggaagctgatgctgtggatgagagcgaggaaagagaggtaaagaagatgaaatgctga

SEQ ID NO: 17549 - protein, 470 aa, Sorghum bicolor
  misc_feature: Useful for making plants with modulated nitrogen use efficiency
  misc_feature: Functional homolog of the protein sequence given in SEQ ID NO 14549
  misc_feature: Ceres ANNOT ID no. 8680190
  misc_feature: Up-regulated in root tissues in response to methyl jasmonate treatment
  misc_feature: Up-regulated in root tissues in response to salicylic acid treatment
  misc_feature (89)..(463): SWISSPROT Homolog: EC 4.1.1.50 Adenosylmethionine decarboxylase
  misc_feature (86)..(420): Pfam ID: SAM_decarbox Pfam Description: Adenosylmethionine decarboxylase
  misc_feature (1)..(51): Pfam ID: AdoMetDC_leader Pfam Description: S-adenosyl-l-methionine decarboxylase leader peptide
MESKGGKKKSSSSRSSLMYEAPLGYSIEDLRPAGGIKKFSAAYSNVCTGDQKISRNHSLSSSPGCLSSCSETMAVLQVAAAAPPPVSAIGFEGYEKRLEISFSEAPVFADPNGRGLRALSRDQIETVLDLARCTIVSELSNEDFDSYVLSESSLFVYPYKMVIKTCGTTKLLLAIPRILELAKELSLPLSAVKYSRGTFIFPDAQPSPHKNFADEVAFLNRFFGGLKSGGNAYVIGDSAKPGQKWHVYYASEHPEEPVVTLEMCMTGLDKKKASVFFKTSADGYTSCAKEMTKLSGISDIIPEMEICDFDFEPCGYSMNAVHGPAFSTIHVTPEDGFSYASYEVMGFNPGSSSYGDLVKRVLRCFGPVEFSVAVTIFGERDNAKTWGKKLEAEAYACSNMVEQVLPSGGLLIYQSFTATGAATPGSPRSVLHDFAGDIVKPGDSGEADGPCWEADAVDESEEREVKKMKC

SEQ ID NO: 17550 - DNA, 294 bp, Sorghum bicolor
  misc_feature: Ceres ANNOT ID no. 8680223
  misc_feature: Up-regulated in root tissues in response to methyl jasmonate treatment
  misc_feature: Up-regulated in root tissues in response to salicylic acid treatment
  misc_feature: Encodes the peptide sequence at SEQ ID NO 17551
atggcgagcacagcatgctttgtgattgttagtaagaatgacatcccaatctatgaggctgaagttggatctgctctcaaaaaagaagatttagctcatcagcatcagttcattttgcatgctgcattggatgttgctcaggaccttgcatggtttctgagatcagttgatagattcagtgacttcgtcgtgtctgtatatatattcctcaatccgctctacttgcctggttctcgcatcacatcttcctattttgataccaaggttaggacgcttgcaaggaaatacctttag

SEQ ID NO: 17551 - protein, 97 aa, Sorghum bicolor
  misc_feature: Useful for biocontainment applications
  misc_feature: Functional homolog of the protein sequence given in SEQ ID NO 12968
  misc_feature: Ceres ANNOT ID no. 8680223
  misc_feature (9)..(95): Pfam ID: Sedlin_N Pfam Description: Sedlin, N-terminal conserved region
MASTACFVIVSKNDIPIYEAEVGSALKKEDLAHQHQFILHAALDVAQDLAWFLRSVDRFSDFVVSVYIFLNPLYLPGSRITSSYFDTKVRTLARKYL

SEQ ID NO: 17552 - DNA, 2559 bp, Sorghum bicolor
  misc_feature: Ceres ANNOT ID no. 8680275
  misc_feature: Encodes the peptide sequence at SEQ ID NO 17553
atggctctcgagaaggccaaggagatcgtcgcttcctcccccgtcgtcgtcttcagcaaaacttactgtcctttctgcgcccgagtgaagcaattgttagcacagctgggtgcaagttacaaggccattgagttggatgtggaaagtgatggcgctgatctgcaatcagctctcgctgaatggaccggtcagaaaactgttcccaatgtctttgtgaaaggggagcgtattggtggctgcgacggtgagttcaaccatggcaatgcacgacggtgggaagctggtgcctctgctgaccgaggctggagcaattgtcactgccagtgccactgcaactaccactccgtctttgtagacatgttttacagtgtcattccgtttgcttcgtggctcagctggccccacgatccgaaccgctctcagcacgggacgtcggcacgggcggccgagatcgcacggccggctcgcccgagcgcgcccagccgtcgctttgccttttattttactccgcggccgcggcgccgtgcggctggctctgcttcctccccgtctctcctctgttcgccttcgccccgcgccgagagagctcccaaccccactcactactgcggaaagcggaaaaagcgaggaaaaatatccatcctgctccagcgaagcaccgcaggccgccccgcagcagagaagagcggacgccatcgcccgccaccgccgccgccgcccctcaatagattaggcgcggataatggtgcgggccggaccgcgacgggcggaggagggcgccgcggcccacggcggacccagccgccgccgccgccgctgatagcagtacacctgctaaccagccatctgcaggcacgcgcggtggtagcccgcgaggcgaggggccccgggttgactgggcggtactggcggcggcggggatggaggaggaggcgtctgcagattcgccgaccgcgtcgtcgtcctgcgcctgtgtctctggttccagccggcggcggcgagggggatcgagtgggcggcggcggcggaggcggaggcggtttgggggttgggggaggccagcagttcgtggaccggagcaaggtgaggattcttctctgcgacggtgatgccaccagctccagggaggtgctgcggctcctctgcaactgctcgtaccatgtaacttgcgccaagtctccgcggcaggtgatcaatattctcaactatgagggtggcgagatcgacatcatcctggctgaggttgatctgccggtctccaagtgcttcaagatgctcaagtacattgccaggaacaaggacctgcgccacatcccaatcatcatgatgtccaacagagatgaggtgtctgttgttgtcaagtgcttgcggcttggtgcggctgagtacctggtgaagccgctgcgcacgaatgagctgctgaacctttggacccatgtgtggcggcggagacggatgcttggtttgcccgagaaaaacttcttccatgacaacttcgagttggtgctctcagaacctagtgatgccaacaccaatagcaccaccctcctctcagacgagacagacgataggcctaaagaaaacatgaatcaagaaacgggcacctcaaatcaacttgaatacgagtccaatccttctgttgctgagcctgaccagagagacaagatggagggtgtaccaggttctgtcgtagatgccagtcaagcatcctctccgggaagaatgttttcacgccctataaaaactaacctgaggattgctgagtcgtctgcatttctagcatatgttaagacaagcacaccaaccaccagctcacttgatagcgaattacaaagaggtggcagtcagttagattctttggataaccagggtaattgctctagtgcaacagatagaagtgacaccgttactgatgtaaatattcggaataaagaagcttttgagatgcctgtgcagtaccctatggtgtgcttttcttcctctaacacacatatggagcgaagcaatgaaggccataatgatacttcaggaactccacctgtataccatttcccattttattatccagggatggtagagcacaacatggcagtttcatcagtgcaaaattttcaagcaaacataaacaatgctcaagcacatacaccaccaacgatgcttccccagtacaatgtttatccccaatgccatggtttacctatgatatcatcatttcagtttaatcctgcgggcatgaatatgcactcaagtcatttaccgacacaaaatgtgtggtcatcggcatcaagcacaccaatgcctgaggaaacatgcaatcgctctgaaaggagggctgcagcacttgccaaattcaggcagaaaaggaaagagcgctgctttgacaagaaggtgaggtatgtgaaccggaagaaacttgctgaaacaaggcctagggtgcgaggtcaatttgttagacaggcaagcaatacagatatcaccagcactggagatgatatctctgaagacgaagatgacgatccatcgtccagggaggtagatatcgtttcctctccagagtag

SEQ ID NO: 17553 - protein, 852 aa, Sorghum bicolor
  misc_feature: Useful for biocontainment applications
  misc_feature: Functional homolog of the protein sequence given in SEQ ID NO 14550
  misc_feature: Ceres ANNOT ID no. 8680275
  misc_feature: Up-regulated in shoot tissues in response to salicylic acid treatment
  misc_feature (15)..(81): SWISSPROT Homolog: EC 1.11.1.15 Peroxiredoxin
  misc_feature (360)..(485): SWISSPROT Homolog: EC 3.1.4.17 3',5'-cyclic-nucleotide phosphodiesterase
  misc_feature (15)..(77): Pfam ID: Glutaredoxin Pfam Description: Glutaredoxin
  misc_feature (777)..(821): Pfam ID: CCT Pfam Description: CCT motif
  misc_feature (362)..(478): Pfam ID: Response_reg Pfam Description: Response regulator receiver domain
MALEKAKEIVASSPVVVFSKTYCPFCARVKQLLAQLGASYKAIELDVESDGADLQSALAEWTGQKTVPNVFVKGERIGGCDGEFNHGNARRWEAGASADRGWSNCHCQCHCNYHSVFVDMFYSVIPFASWLSWPHDPNRSQHGTSARAAEIARPARPSAPSRRFAFYFTPRPRRRAAGSASSPSLLCSPSPRAERAPNPTHYCGKRKKRGKISILLQRSTAGRPAAEKSGRHRPPPPPPPLNRLGADNGAGRTATGGGGRRGPRRTQPPPPPLIAVHLLTSHLQARAVVAREARGPGLTGRYWRRRGWRRRRLQIRRPRRRPAPVSLVPAGGGEGDRVGGGGGGGGGLGVGGGQQFVDRSKVRILLCDGDATSSREVLRLLCNCSYHVTCAKSPRQVINILNYEGGEIDIILAEVDLPVSKCFKMLKYIARNKDLRHIPIIMMSNRDEVSVVVKCLRLGAAEYLVKPLRTNELLNLWTHVWRRRRMLGLPEKNFFHDNFELVLSEPSDANTNSTTLLSDETDDRPKENMNQETGTSNQLEYESNPSVAEPDQRDKMEGVPGSVVDASQASSPGRMFSRPIKTNLRIAESSAFLAYVKTSTPTTSSLDSELQRGGSQLDSLDNQGNCSSATDRSDTVTDVNIRNKEAFEMPVQYPMVCFSSSNTHMERSNEGHNDTSGTPPVYHFPFYYPGMVEHNMAVSSVQNFQANINNAQAHTPPTMLPQYNVYPQCHGLPMISSFQFNPAGMNMHSSHLPTQNVWSSASSTPMPEETCNRSERRAAALAKFRQKRKERCFDKKVRYVNRKKLAETRPRVRGQFVRQASNTDITSTGDDISEDEDDDPSSREVDIVSSPE

SEQ ID NO: 17554 - DNA, 1470 bp, Sorghum bicolor
  misc_feature: Ceres ANNOT ID no. 8680294
  misc_feature: Up-regulated in shoot tissues in response to salicylic acid treatment
  misc_feature: Encodes the peptide sequence at SEQ ID NO 17555
atggcgacgtgcgccacgaccctcgcgccgcttctgggcccggcggcggcgaacgcgacggagtacctgtgcaaccagttcgcggacaccacgtcggcggtggactcgacgtacctgctcttctcggcgtacctcgtcttcgccatgcagctcgggttcgccatgctctgcgcgggctccgtccgcgccaagaacaccatgaacatcatgctcaccaacgtgctcgacgccgccgccggcgcgctcttctactacctcttcggcttcgccttcgcgtacgggaccccgtccaacggcttcatcggcaagcacttcttcggcctcaagcgacttccccaggtcggcttcgactacgacttcttcctcttccagtgggccttcgccatcgccgccgccgggatcacgtcgggctccatcgccgagcgcacgcagttcgtcgcgtacctcatctactccgccttcctcaccggcttcgtgtacccggtcgtgtcccactgggtctggtccgccgacggctgggcctcgccgacccggacgtcggggaacctgctcttcggctccggcatcatcgacttcgccgggtccagcgtcgtccacatggtcggcggcatcgccggcctctggggcgccctcatcgagggcccacgcattggccggttcgaccacgcaggccgctccgtggcgctgcgcggccacagcgcgtcgctcgtcgtgctcggcaccttcctgctctggttcggctggttcggcttcaaccccgggtcgttcctcaccatcctcaagagctacggccccgccggaagcatccacgggcagtggtcggccgtgggccgcacggcggtcaccaccacgctcgccggcagcacggcggcgctcacgacgctgttcgggaagaggctccagacggggcactggaacgtggtggacgtctgcaacggcctcctgggcggcttcgcggccatcaccgcgggctgctccgtggtcgacccttgggcggccgtcatctgcgggttcgtgtcggcgtgggtgctcatcgggctcaacgcgctggccgccaggctccggttcgacgacccgctggaggccgcgcagctgcacggcgggtgcggcgcgtggggggtgctcttcacggcgctgttcgcgcgcagggagtacgtggagcagatctacggcacgccggggcggccgtacggcctcttcatgggcggcggcgggaggctgctggcggcgaacgtggtgatgatcctggtgatcgcggcgtgggtgagcgtcaccatggccccgctgttcctggcgctcaacaagctgggcctgctccgcgtctcggccgaggacgagatggccggcatggaccagacgcggcacggcgggttcgcgtacgcgtaccacgacgaggacatgagcttgagcagcagacccaagggggctcagagcacgcagatcgcggccgcgtccagcggcgagttctag

SEQ ID NO: 17555 - protein, 489 aa, Sorghum bicolor
  misc_feature: Useful for making plants with modulated carbon-nitrogen partitioning
  misc_feature: Functional homolog of the protein sequence given in SEQ ID NO 14551
  misc_feature: Useful for making plants with altered carbon content
  misc_feature: Useful for making plants with altered nitrogen content
  misc_feature: Functional homolog of the protein sequence given in SEQ ID NO 14552
  misc_feature: Ceres ANNOT ID no. 8680294
  misc_feature (36)..(460): Pfam ID: Ammonium_transp Pfam Description: Ammonium Transporter Family
MATCATTLAPLLGPAAANATEYLCNQFADTTSAVDSTYLLFSAYLVFAMQLGFAMLCAGSVRAKNTMNIMLTNVLDAAAGALFYYLFGFAFAYGTPSNGFIGKHFFGLKRLPQVGFDYDFFLFQWAFAIAAAGITSGSIAERTQFVAYLIYSAFLTGFVYPVVSHWVWSADGWASPTRTSGNLLFGSGIIDFAGSSVVHMVGGIAGLWGALIEGPRIGRFDHAGRSVALRGHSASLVVLGTFLLWFGWFGFNPGSFLTILKSYGPAGSIHGQWSAVGRTAVTTTLAGSTAALTTLFGKRLQTGHWNVVDVCNGLLGGFAAITAGCSVVDPWAAVICGFVSAWVLIGLNALAARLRFDDPLEAAQLHGGCGAWGVLFTALFARREYVEQIYGTPGRPYGLFMGGGGRLLAANVVMILVIAAWVSVTMAPLFLALNKLGLLRVSAEDEMAGMDQTRHGGFAYAYHDEDMSLSSRPKGAQSTQIAAASSGEF

SEQ ID NO: 17556 - DNA, 909 bp, Sorghum bicolor
  misc_feature: Ceres ANNOT ID no. 8680320
  misc_feature: Encodes the peptide sequence at SEQ ID NO 17557
atggcactgagggagatcgagtcgacgttgccaccggggttcaggttctaccccagcgacgaggagctggtgtgccactacctccacaagaaggtggccaacgagcgcatcgcgcaggggacgctcgtcgaggtcgacctgcacgcgcgcgagccctgggagctcccagaggtggcgaagctgacggccaccgagtggtacttcttcagcttccgggaccgcaagtacgcgacggggtcgcgcaccaaccgcgccaccaagacgggctactggaaggccacgggcaaggaccgcgaggtgcgcagcagcagcagcagcggcgccgtcgtcggcatgcgcaagacgctcgtcttctaccggggcagagcccccaacggcgtcaagtccggctgggtcatgcacgagttccgcctcgacaccccgcattcgccaccgagggaggactgggtgctgtgcagggtgttccagaagacgaaaggcgacggcggcgacggccaagacggcgactactcctcctcctcgcccgcctttgccggcacgtcgcaagccatgccggacccggactactattccgcggcgtcgtcagcaggatcaggctactacggcctcgcatttgcgccgccgccgccgcagcagcaggaggaggtggcggcgcccgtgcttccacagtattactacggcggcacggtcgacgtcgaccaccaccaccaccaccacggcttcacgcgagacgacaacgtgggcgccgcgttgccagggttcggcggcgcgatgatgaggggatcatcagtcgccgccggcggtgatcagtacgggtttggatactttgacatgggcgggggcggctttgatgacatggccagctttggtggtggagacatggacttcgtccctcaagtgtggagctag

SEQ ID NO: 17557 - protein, 302 aa, Sorghum bicolor
  misc_feature: The sequence is a functional homolog of SEQ ID NO 1196 in the 10/412,699 US patent application
  misc_feature: The sequence is a functional homolog of SEQ ID NO 865 in the 10/374,780 US patent application
  misc_feature: The sequence is a functional homolog of SEQ ID NO 1198 in the 10/412,699 US patent application
  misc_feature: The sequence is a functional homolog of SEQ ID NO 867 in the 10/374,780 US patent application
  misc_feature: The sequence is a functional homolog of SEQ ID NO 1197 in the 10/412,699 US patent application
  misc_feature: The sequence is a functional homolog of SEQ ID NO 866 in the 10/374,780 US patent application
  misc_feature: The sequence is a functional homolog of SEQ ID NO 100 in the 10/374,780 US patent application
  misc_feature: The sequence is a functional homolog of SEQ ID NO 318 in the 10/412,699 US patent application
  misc_feature: The sequence is a functional homolog of SEQ ID NO 749 in the 11/479,226 US patent application
  misc_feature: The sequence is a functional homolog of SEQ ID NO 884 in the 10/225,066 US patent application
  misc_feature: The sequence is a functional homolog of SEQ ID NO 2418 in the 10/374,780 US patent application
  misc_feature: The sequence is a functional homolog of SEQ ID NO 554 in the 10/225,066 US patent application
  misc_feature: The sequence is a functional homolog of SEQ ID NO 68 in the 10/286,264 US patent application
  misc_feature: The sequence is a functional homolog of SEQ ID NO 2840 in the 10/374,780 US patent application
  misc_feature: The sequence is a functional homolog of SEQ ID NO 450 in the 10/225,066 US patent application
  misc_feature: The sequence is a functional homolog of SEQ ID NO 2776 in the 10/374,780 US patent application
  misc_feature: The sequence is a functional homolog of SEQ ID NO 416 in the 10/225,066 US patent application
  misc_feature: The sequence is a functional homolog of SEQ ID NO 2470 in the 10/374,780 US patent application
  misc_feature: The sequence is a functional homolog of SEQ ID NO 798 in the 10/225,066 US patent application
  misc_feature: Useful for making plants with altered lignin content
  misc_feature: Functional homolog of the protein sequence given in SEQ ID NO 12985
  misc_feature: The sequence is a functional homolog of SEQ ID NO 476 in the 10/666,642 US patent application
  misc_feature: The sequence is a functional homolog of SEQ ID NO 326 in the 10/412,699 US patent application
  misc_feature: The sequence is a functional homolog of SEQ ID NO 760 in the 11/479,226 US patent application
  misc_feature: The sequence is a functional homolog of SEQ ID NO 2346 in the 10/374,780 US patent application
  misc_feature: The sequence is a functional homolog of SEQ ID NO 238 in the 10/225,068 US patent application
  misc_feature: The sequence is a functional homolog of SEQ ID NO 338 in the 10/412,699 US patent application
  misc_feature: The sequence is a functional homolog of SEQ ID NO 774 in the 11/479,226 US patent application
  misc_feature: The sequence is a functional homolog of SEQ ID NO 1729 in the 11/479,226 US patent application
  misc_feature: Useful for biocontainment applications
  misc_feature: Functional homolog of the protein sequence given in SEQ ID NO 13623
  misc_feature: Useful for making plants with altered cell wall content and/or composition
  misc_feature: Useful for making plants with modulated biomass
  misc_feature: Functional homolog of the protein sequence given in SEQ ID NO 12949
  misc_feature: Useful for making plants with altered carbohydrate content
  misc_feature: Functional homolog of the protein sequence given in SEQ ID NO 13685
  misc_feature: The sequence is a functional homolog of SEQ ID NO 853 in the 10/374,780 US patent application
  misc_feature: The sequence is a functional homolog of SEQ ID NO 1036 in the 10/225,066 US patent application
  misc_feature: The sequence is a functional homolog of SEQ ID NO 216 in the 10/666,642 US patent application
  misc_feature: The sequence is a functional homolog of SEQ ID NO 2608 in the 10/374,780 US patent application
  misc_feature: The sequence is a functional homolog of SEQ ID NO 658 in the 11/435,388 US patent application
  misc_feature: The sequence is a functional homolog of SEQ ID NO 880 in the 10/412,699 US patent application
  misc_feature: Useful for making plants with modulated water use efficiency
  misc_feature: The sequence is a functional homolog of SEQ ID NO 2012 in the 10/374,780 US patent application
  misc_feature: The sequence is a functional homolog of SEQ ID NO 312 in the 10/412,699 US patent application
  misc_feature: The sequence is a functional homolog of SEQ ID NO 731 in the 11/479,226 US patent application
  misc_feature: The sequence is a functional homolog of SEQ ID NO 102 in the 10/374,780 US patent application
  misc_feature: The sequence is a functional homolog of SEQ ID NO 886 in the 10/225,066 US patent application
  misc_feature: The sequence is a functional homolog of SEQ ID NO 2060 in the 10/374,780 US patent application
  misc_feature: The sequence is a functional homolog of SEQ ID NO 516 in the 10/412,699 US patent application
  misc_feature: Ceres ANNOT ID no. 8680320
  misc_feature (10)..(139): Pfam ID: NAM Pfam Description: No apical meristem (NAM) protein
MALREIESTLPPGFRFYPSDEELVCHYLHKKVANERIAQGTLVEVDLHAREPWELPEVAKLTATEWYFFSFRDRKYATGSRTNRATKTGYWKATGKDREVRSSSSSGAVVGMRKTLVFYRGRAPNGVKSGWVMHEFRLDTPHSPPREDWVLCRVFQKTKGDGGDGQDGDYSSSSPAFAGTSQAMPDPDYYSAASSAGSGYYGLAFAPPPPQQQEEVAAPVLPQYYYGGTVDVDHHHHHHGFTRDDNVGAALPGFGGAMMRGSSVAAGGDQYGFGYFDMGGGGFDDMASFGGGDMDFVPQVWS

SEQ ID NO: 17558 - DNA, 627 bp, Sorghum bicolor
  misc_feature: Ceres ANNOT ID no. 8680326
  misc_feature: Encodes the peptide sequence at SEQ ID NO 17559
atggacctgtccccgaaccccgagagcccgggaggcggtggtgatggcggcggaggcggaggcggagccggtggatcgagcagcgggccgtcgtcttcgtcggcgcagggcggcggcacgccgcagacgccgagccggtacgaggcgcagaagcggcgggactggaacacgttcgggcagtacctgcggaaccaccggccgccgctgagcctcgcgcagtgcagcggcgcgcacgtgctggagttcctgcggtacctggaccagttcggcaagaccaaggtccacacggcggcgtgccccttcttcggccacccgaacccgcccgcgccgtgcccctgcccgctgcgccaggcgtggggcagcctcgacgcgctggtgggccgcctccgcgccgccttcgaggagaacggaggccgcccggagtccaaccccttcgcggcgcgcgccgtccgcctctacctccgcgaggtccgcgagcaccaggcccgcgcgcgcggcgtcagctacgagaagaagaagcgcaagaaggcgcagccgcccgatcacgccagcggcagcggaggccaaggtcctcaccaccaccacccgccgcctccggccccgccgtccgccggcgcggcgtgctga

SEQ ID NO: 17559 - protein, 208 aa, Sorghum bicolor
  misc_feature: Useful for making plants with modulated low light sensitivity
  misc_feature: Functional homolog of the protein sequence given in SEQ ID NO 14143
  misc_feature: Useful for making plants with modulated nitrogen use efficiency
  misc_feature: Functional homolog of the protein sequence given in SEQ ID NO 13437
  misc_feature: Useful for making plants with modulated flowering time
  misc_feature: Functional homolog of the protein sequence given in SEQ ID NO 13982
  misc_feature: Useful for making plants with modulated biomass
  misc_feature: Functional homolog of the protein sequence given in SEQ ID NO 13338
  misc_feature: Useful for biocontainment applications
  misc_feature: Functional homolog of the protein sequence given in SEQ ID NO 13983
  misc_feature: Ceres ANNOT ID no. 8680326
MDLSPNPESPGGGGDGGGGGGGAGGSSSGPSSSSAQGGGTPQTPSRYEAQKRRDWNTFGQYLRNHRPPLSLAQCSGAHVLEFLRYLDQFGKTKVHTAACPFFGHPNPPAPCPCPLRQAWGSLDALVGRLRAAFEENGGRPESNPFAARAVRLYLREVREHQARARGVSYEKKKRKKAQPPDHASGSGGQGPHHHHPPPPAPPSAGAAC

SEQ ID NO: 17560 - DNA, 2145 bp, Sorghum bicolor
  misc_feature: Ceres ANNOT ID no. 8680356
  misc_feature: Encodes the peptide sequence at SEQ ID NO 17561
atggcgtgcgagaacggccgcgttgctgctaccaacggcgacggcctgtgcatggcgacgccccgcgccgacccgcttaactgggggaaggccgcggaggagctgatgggcagccacctcgacgaggtgaagcggatggtggccgagtaccgccagcccttggtgaagatcgagggcgccagcctccgcatcgcgcaggtggccgccgtggccgccggcgctggcgaggcccgcgtcgagctcgacgagtccgcccgtggccgcgtcaaggccagcagcgactgggtcatgaacagcatgatgaacggcaccgacagctacggcgtcaccaccggcttcggcgccacgtcccacaggaggaccaaggagggcggcgcgctccagagggagctcatccgcttcctcaacgccggcgcattcggcaccggcaccgacggccacgtcctgccggccgaggccacgcgtgcggccatgctcgtccgcatcaacaccctcctccaggggtactccggcatccgcttcgagatcctcgaggcgatcgtcaagctgctcaacgccaacgtcacgccgtgcctgcctctccgcggcacggtcaccgcgtccggcgacctcgtgccgctctcctacattgccggcctcgtcaccgggcgcgagaactctgttgcagtcgccccggatggcaccaaggtgaacgcagcagaggcgttcaagattgccggaatccagggcggcttcttcgagctgcagcccaaggagggtcttgcgatggtgaacggcacggccgtgggctctggccttgcctccacggtgctctttgaggcgaacgtccttgccatccttgccgaggtcctgtccgccgtgttctgcgaggtcatgaacggcaagccggagtacaccgaccacctgacccacaagctgaagcaccacccgggacagatcgaggcggctgccatcatggagcacatcttggagggcagctcctacatgaagcttgccaagaagctcggcgagctggacccgctgatgaagcccaagcaggaccggtacgcgctccgcacgtcgccgcagtggcttggcccccagattgaggttatccgtgccgccaccaagtccattgagcgcgagatcaactccgtcaacgacaacccgctcatcgacgtcgcccggagcaaggctcttcacggtggcaacttccagggcacgcccatcggggtgtccatggacaacacccgtctcgccatcgcagccatcggcaagctcatgtttgcccagttctctgagctcgtcaacgactactacaacaacggcttgccctccaacctgtccggtgggcgcaaccccagcttggactacggcttcaagggcgccgagatcgccatggcgtcctactgctctgagctgcagttcctggggaacccggtcaccaaccacgtccagagcgcggagcagcacaaccaggacgtgaactcgctcgggctcatctcctccaggaagactgctgaggccatcgagatcctgaagctcatgtcctccacgttcctgatcgccctgtgccaggcggtggacctgcggcacatcgaggagaacgtcaagagcgccgtcaagagctgcgtgatgacggtggcgaagaagactctgagcaccaactccaccggtggtctccacgtcgcccgcttctgcgagaaggacctgctccaggagatcgagcgcgaggccgtgttcgcgtatgccgacgacccctgcagcgccaactacccgctcatgaagaagcttcgcaacgtgctcgtggagcgcgccctcgccaacggcgctgccgagttcgacgccgagacatccgtcttcgccaaggtcgcccagttcgaggaggagctgcgcgcggcgctgcccaaggccgtcgaggctgcacgggcggccgtcgagaacggcaccgcagcgatacccaacagaatcaccgagtgccgctcctacccgctctaccgcttcgtgcgccaggaggtcggagccgtctacctcaccggcgagaagacgcgctctcccggcgaggagctcaacaaggtgctcgttgccatcaaccaggggaaacacatcgacccgctgctcgagtgcctcaaggagtggaacggcgagccactgcccatctgctga

SEQ ID NO: 17561 - protein, 714 aa, Sorghum bicolor
  misc_feature: Useful for making plants with altered cell wall content and/or composition
  misc_feature: Useful for making plants with altered lignin content
  misc_feature: Functional homolog of the protein sequence given in SEQ ID NO 14131
  misc_feature: Ceres ANNOT ID no. 8680356
  misc_feature: Down-regulated in shoot tissues in response to aminocyclopropane carboxylic treatment
  misc_feature: Down-regulated in shoot tissues in response to salicylic acid treatment
  misc_feature: Up-regulated in root tissues in response to salicylic acid treatment
  misc_feature: Up-regulated in shoot tissues in response to methyl jasmonate treatment
  misc_feature (1)..(714): SWISSPROT Homolog: EC 4.3.1.5 Phenylalanine ammonia-lyase
  misc_feature (54)..(551): Pfam ID: PAL Pfam Description: Phenylalanine and histidine ammonia-lyase
MACENGRVAATNGDGLCMATPRADPLNWGKAAEELMGSHLDEVKRMVAEYRQPLVKIEGASLRIAQVAAVAAGAGEARVELDESARGRVKASSDWVMNSMMNGTDSYGVTTGFGATSHRRTKEGGALQRELIRFLNAGAFGTGTDGHVLPAEATRAAMLVRINTLLQGYSGIRFEILEAIVKLLNANVTPCLPLRGTVTASGDLVPLSYIAGLVTGRENSVAVAPDGTKVNAAEAFKIAGIQGGFFELQPKEGLAMVNGTAVGSGLASTVLFEANVLAILAEVLSAVFCEVMNGKPEYTDHLTHKLKHHPGQIEAAAIMEHILEGSSYMKLAKKLGELDPLMKPKQDRYALRTSPQWLGPQIEVIRAATKSIEREINSVNDNPLIDVARSKALHGGNFQGTPIGVSMDNTRLAIAAIGKLMFAQFSELVNDYYNNGLPSNLSGGRNPSLDYGFKGAEIAMASYCSELQFLGNPVTNHVQSAEQHNQDVNSLGLISSRKTAEAIEILKLMSSTFLIALCQAVDLRHIEENVKSAVKSCVMTVAKKTLSTNSTGGLHVARFCEKDLLQEIEREAVFAYADDPCSANYPLMKKLRNVLVERALANGAAEFDAETSVFAKVAQFEEELRAALPKAVEAARAAVENGTAAIPNRITECRSYPLYRFVRQEVGAVYLTGEKTRSPGEELNKVLVAINQGKHIDPLLECLKEWNGEPLPIC

SEQ ID NO: 17562 - DNA, 2115 bp, Sorghum bicolor
  misc_feature: Ceres ANNOT ID no. 8680351
  misc_feature: Down-regulated in shoot tissues in response to aminocyclopropane carboxylic treatment
  misc_feature: Down-regulated in shoot tissues in response to salicylic acid treatment
  misc_feature: Up-regulated in root tissues in response to salicylic acid treatment
  misc_feature: Up-regulated in shoot tissues in response to methyl jasmonate treatment
  misc_feature: Encodes the peptide sequence at SEQ ID NO 17563
atggcgggcaacggcgccatcgtggagagcgacccgctgaactggggcgcggcggcggcggagctgtccggcagccacctggacgaggtgaagcgcatggtggcgcaggcgcggcagcccgtggtgaagatcgagggctccacgctccgcgtcggccaggtggccgccgtcgcgtccgccaaggacgcgtcgggcgtcgccgtcgagctcgacgaggaggcccgcccccgcgtcaaggccagcagcgagtggatcctcgactgcatcgcccacggcggcgacatctacggcgtcaccacggggttcggcggcacctcccaccgccgcaccaaggacgggcccgcgctccaggtcgagctgctcaggcatctcaacgccgggatcttcggcaccggcagcgatggccacacgctgccgtcggaggtcgtccgcgcggcgatgctggtgcgcatcaacaccctcctccagggctactcgggcatccgcttcgagatcctggaggccatcaccaagctgctcaacaccggggtcagcccgtgcctgccgctccggggcaccatcaccgcgtcgggagacctcgtcccgctctcctacattgccggcctcatcacgggccgccccaacgcgcaggccaccaccgtcgacgggaggaaggtggacgccgccgaggcgttcaagatcgccggcatcgagggcggcttcttcaagctcaaccccaaggaaggtctggccatcgtcaacggcacctccgtgggctccgcgctcgcggccaccgtgatgtacgacgccaacgtcctcgccgtcctgtccgaggtcctgtccgccatcttctgcgaggtgatgaacggcaagcccgagtacaccgaccacctcacccacaagctcaagcaccacccgggctccatcgaggccgccgccatcatggagcacatcctggacggcagcgccttcatgaagcacgccaagaaggtgaacgagctggacccgctgctgaagccgaagcaggacaggtacgcgctccgcacgtcgccgcagtggcttggcccccagatcgaggtcctccgcgccgccaccaagtccatcgagcgcgaggtcaactccgtcaacgacaacccggtcatcgacgtccaccgtggcaaggcgctgcacggcggcaacttccagggcacgcccatcggtgtctccatggacaacgcccgcctcgccatcgccaacatcggcaagctcatgttcgcgcagttctccgagctggtcaacgagttctacaacaacgggctcacctccaacctcgccggcagccgcaaccccagcctggactacgggttcaagggcacggagatcgccatggcctcctactgctctgagctccagtaccttggcaaccccatcaccaaccacgtccagagcgcggagcagcacaaccaggacgtcaactccctgggcctcgtctccgccaggaagaccgcggaggccatcgacatcctgaagctcatgtcgtccacctacatcgtggcgctgtgccaggccatcgacctgcgccacctcgaggagaacatcaagacgtcggtgaagaacacggtgacgcaggtggcgaagaaggtgctgaccatgaacccgtcgggcgacctctccagcgcgcgattcagcgagaaggagctcatcaccgccatcgaccgcgagggcgtgttcacgtacgcggaggacccggccagcgccagcctgccgctgatgacgaagctgcgcgccgtgctggtggaccacgcgctcagcagcggcgacgcggagcgggagccctccgtgttctccaagatcaccaagttcgaggaggagctccgcgcggtgctgccacgggaggtggaggccgcccgcgtcgccgtcgccgagggcaccgcccccgtggcgaaccggatcgcggacagccggtcgttcccgctgtaccgcttcgtccgcgaggagctcggctgcgtgttcctgacgggcgagaagctcaagtcccccggcgaggagtgcaccaaggtgttcaacggcatcaaccagggcaagctcgtcgaccctatgctagagtgcctcaaggagtgggacggcaagccgctgcccatcaacgtcgtcaactaa

SEQ ID NO: 17563 - protein, 704 aa, Sorghum bicolor
  misc_feature: Useful for making plants with altered cell wall content and/or composition
  misc_feature: Useful for making plants with altered lignin content
  misc_feature: Functional homolog of the protein sequence given in SEQ ID NO 14131
  misc_feature: Ceres ANNOT ID no. 8680351
  misc_feature: Down-regulated in root tissues in response to aminocyclopropane carboxylic treatment
  misc_feature: Down-regulated in root tissues in response to methyl jasmonate treatment
  misc_feature: Down-regulated in shoot tissues in response to methyl jasmonate treatment
  misc_feature: Down-regulated in shoot tissues in response to aminocyclopropane carboxylic treatment
  misc_feature: Down-regulated in shoot tissues in response to salicylic acid treatment
  misc_feature: Up-regulated in root tissues in response to methyl jasmonate treatment
  misc_feature: Up-regulated in root tissues in response to aminocyclopropane carboxylic treatment
  misc_feature: Up-regulated in shoot tissues in response to methyl jasmonate treatment
  misc_feature: Up-regulated in root tissues in response to salicylic acid treatment
  misc_feature: Up-regulated in shoot tissues in response to salicylic acid treatment
  misc_feature (1)..(701): SWISSPROT Homolog: EC 4.3.1.5 Phenylalanine ammonia-lyase
  misc_feature (41)..(540): Pfam ID: PAL Pfam Description: Phenylalanine and histidine ammonia-lyase
MAGNGAIVESDPLNWGAAAAELSGSHLDEVKRMVAQARQPVVKIEGSTLRVGQVAAVASAKDASGVAVELDEEARPRVKASSEWILDCIAHGGDIYGVTTGFGGTSHRRTKDGPALQVELLRHLNAGIFGTGSDGHTLPSEVVRAAMLVRINTLLQGYSGIRFEILEAITKLLNTGVSPCLPLRGTITASGDLVPLSYIAGLITGRPNAQATTVDGRKVDAAEAFKIAGIEGGFFKLNPKEGLAIVNGTSVGSALAATVMYDANVLAVLSEVLSAIFCEVMNGKPEYTDHLTHKLKHHPGSIEAAAIMEHILDGSAFMKHAKKVNELDPLLKPKQDRYALRTSPQWLGPQIEVLRAATKSIEREVNSVNDNPVIDVHRGKALHGGNFQGTPIGVSMDNARLAIANIGKLMFAQFSELVNEFYNNGLTSNLAGSRNPSLDYGFKGTEIAMASYCSELQYLGNPITNHVQSAEQHNQDVNSLGLVSARKTAEAIDILKLMSSTYIVALCQAIDLRHLEENIKTSVKNTVTQVAKKVLTMNPSGDLSSARFSEKELITAIDREGVFTYAEDPASASLPLMTKLRAVLVDHALSSGDAEREPSVFSKITKFEEELRAVLPREVEAARVAVAEGTAPVANRIADSRSFPLYRFVREELGCVFLTGEKLKSPGEECTKVFNGINQGKLVDPMLECLKEWDGKPLPINVVN

SEQ ID NO: 17564 - DNA, 2145 bp, Sorghum bicolor
  misc_feature: Ceres ANNOT ID no. 8680361
  misc_feature: Down-regulated in root tissues in response to aminocyclopropane carboxylic treatment
  misc_feature: Down-regulated in root tissues in response to methyl jasmonate treatment
  misc_feature: Down-regulated in shoot tissues in response to methyl jasmonate treatment
  misc_feature: Down-regulated in shoot tissues in response to aminocyclopropane carboxylic treatment
  misc_feature: Down-regulated in shoot tissues in response to salicylic acid treatment
  misc_feature: Up-regulated in root tissues in response to methyl jasmonate treatment
  misc_feature: Up-regulated in root tissues in response to aminocyclopropane carboxylic treatment
  misc_feature: Up-regulated in shoot tissues in response to methyl jasmonate treatment
  misc_feature: Up-regulated in root tissues in response to salicylic acid treatment
  misc_feature: Up-regulated in shoot tissues in response to salicylic acid treatment
  misc_feature: Encodes the peptide sequence at SEQ ID NO 17565
atggcgtgcgacaacggccgcgttgctgctaccaacggcgacggcctgtgcatggcgacgccccgcgccgacccgcttaactgggggaaggccgcggaggagctgatgggcagccacctcgacgaggtgaagcggatggtggccgagtaccgccagcccttggtgaagatcgagggcgccagcctccgcatcgcgcaggtggccgccgtggccgccggcgctggcgaggcccgcgtcgagctcgacgagtccgcccgtggccgcgtcaaggccagcagcgactgggtcatgaacagcatgatgaacggcaccgacagctacggcgtcaccaccggcttcggcgccacgtcccacaggaggaccaaggagggcggcgcgctccagagggagctcatccgcttcctcaacgccggcgcattcggcaccggcaccgacggccacgtcctgccggccgaggccacgcgtgcggccatgctcgtccgcatcaacaccctcctccaggggtactccggcatccgcttcgagatcctcgaggcgatcgtcaagctgctcaacgccaacgtcacgccgtgcctgcctctccgcggcacggtcaccgcgtccggcgacctcgtgccgctctcctacattgccggcctcgtcaccgggcgcgagaactctgttgcagtcgccccggatggcaccaaggtgaacgcagcagaggcgttcaagattgccggaatccagggcggcttcttcgagctgcagcccaaggagggtcttgccatggtgaacggcacggccgtgggctctggccttgcctccacggtgctctttgaggcgaacgtccttgccatccttgccgaggtcctgtccgccgtgttctgcgaggtcatgaacggcaagccggagtacaccgaccacctgacccacaagctgaagcaccacccgggacagatcgaggcggctgccatcatggagcacatcttggagggcagctcctacatgaagcttgccaagaagctcggcgagctggacccgctgatgaagcccaagcaggacaggtacgcgctccgcacgtcgccgcagtggcttggcccccagattgaggttatccgtgcggccaccaagtccattgagcgcgagatcaactccgtcaacgacaacccgctcatcgatgtcgcccggagcaaggctcttcacggtggcaacttccagggcacgcccatcggggtgtccatggacaacacccgtctcgccatcgcagccatcggcaagctcatgtttgcgcagttctctgagctcgtcaacgactactacaacaacggcttgccctccaacctgtccggcgggcgcaaccccagcttggactacggcttcaagggcgccgagatcgccatggcgtcctactgctctgagctgcagttcctggggaacccggtcaccaaccacgtccagagcgcggagcagcacaaccaggacgtgaactcgctcgggctcatctcctccaggaagactgctgaggccatcgagatcctcaagctcatgtcctccacgttcctgatcgccctgtgccaggcggtggacctgcggcacatcgaggagaacgtcaagagcgccgtcaagagctgcgtgatgacggtggcgaagaagactctgagcaccaactccaccggtggtctccacgtcgcccgcttctgcgagaaggacctgctccaggagatcgagcgcgaggccgtgttcgcgtatgccgacgacccctgcagcgccaactacccgctcatgaagaagcttcgcaacgtgctcgtggagcgcgccctcgccaacggcgctgccgagttcgacgccgagacatccgtcttcgccaaggtcgcccagttcgaggaggagctgcgcgcggcgctgcccaaggccgtcgaggctgcacgggcggccgtcgagaacggcaccgcagcgatacccaacagaatcaccgagtgccgctcctacccgctctaccgcttcgtgcgccaggaggtcggagccgtctacctcaccggcgagaagacgcgctctcccggcgaggagctcaacaaggtgctcgttgccatcaaccaggggaaacacatcgacccgctgctcgagtgcctcaaggagtggaacggcgagccactgcccatctgctga

SEQ ID NO: 17565 - protein, 714 aa, Sorghum bicolor
  misc_feature: Useful for making plants with altered cell wall content and/or composition
  misc_feature: Useful for making plants with altered lignin content
  misc_feature: Functional homolog of the protein sequence given in SEQ ID NO 14131
  misc_feature: Ceres ANNOT ID no. 8680361
  misc_feature: Down-regulated in shoot tissues in response to aminocyclopropane carboxylic treatment
  misc_feature: Down-regulated in shoot tissues in response to salicylic acid treatment
  misc_feature: Up-regulated in root tissues in response to salicylic acid treatment
  misc_feature: Up-regulated in shoot tissues in response to methyl jasmonate treatment
  misc_feature (1)..(714): SWISSPROT Homolog: EC 4.3.1.5 Phenylalanine ammonia-lyase
  misc_feature (54)..(551): Pfam ID: PAL Pfam Description: Phenylalanine and histidine ammonia-lyase
MACDNGRVAATNGDGLCMATPRADPLNWGKAAEELMGSHLDEVKRMVAEYRQPLVKIEGASLRIAQVAAVAAGAGEARVELDESARGRVKASSDWVMNSMMNGTDSYGVTTGFGATSHRRTKEGGALQRELIRFLNAGAFGTGTDGHVLPAEATRAAMLVRINTLLQGYSGIRFEILEAIVKLLNANVTPCLPLRGTVTASGDLVPLSYIAGLVTGRENSVAVAPDGTKVNAAEAFKIAGIQGGFFELQPKEGLAMVNGTAVGSGLASTVLFEANVLAILAEVLSAVFCEVMNGKPEYTDHLTHKLKHHPGQIEAAAIMEHILEGSSYMKLAKKLGELDPLMKPKQDRYALRTSPQWLGPQIEVIRAATKSIEREINSVNDNPLIDVARSKALHGGNFQGTPIGVSMDNTRLAIAAIGKLMFAQFSELVNDYYNNGLPSNLSGGRNPSLDYGFKGAEIAMASYCSELQFLGNPVTNHVQSAEQHNQDVNSLGLISSRKTAEAIEILKLMSSTFLIALCQAVDLRHIEENVKSAVKSCVMTVAKKTLSTNSTGGLHVARFCEKDLLQEIEREAVFAYADDPCSANYPLMKKLRNVLVERALANGAAEFDAETSVFAKVAQFEEELRAALPKAVEAARAAVENGTAAIPNRITECRSYPLYRFVRQEVGAVYLTGEKTRSPGEELNKVLVAINQGKHIDPLLECLKEWNGEPLPIC

SEQ ID NO: 17566 - DNA, 2145 bp, Sorghum bicolor; identical to SEQ ID NO: 17560
  misc_feature: Ceres ANNOT ID no. 8680358
  misc_feature: Down-regulated in shoot tissues in response to aminocyclopropane carboxylic treatment
  misc_feature: Down-regulated in shoot tissues in response to salicylic acid treatment
  misc_feature: Up-regulated in root tissues in response to salicylic acid treatment
  misc_feature: Up-regulated in shoot tissues in response to methyl jasmonate treatment
  misc_feature: Encodes the peptide sequence at SEQ ID NO 17567

SEQ ID NO: 17567 - protein, 714 aa, Sorghum bicolor; identical to SEQ ID NO: 17561
  misc_feature: Useful for making plants with altered cell wall content and/or composition
  misc_feature: Useful for making plants with altered lignin content
  misc_feature: Functional homolog of the protein sequence given in SEQ ID NO 14131
  misc_feature: Ceres ANNOT ID no. 8680358
  misc_feature: Down-regulated in shoot tissues in response to aminocyclopropane carboxylic treatment
  misc_feature: Down-regulated in shoot tissues in response to salicylic acid treatment
  misc_feature: Up-regulated in root tissues in response to salicylic acid treatment
  misc_feature: Up-regulated in shoot tissues in response to methyl jasmonate treatment
  misc_feature (1)..(714): SWISSPROT Homolog: EC 4.3.1.5 Phenylalanine ammonia-lyase
  misc_feature (54)..(551): Pfam ID: PAL Pfam Description: Phenylalanine and histidine ammonia-lyase

SEQ ID NO: 17568 - DNA, 2145 bp, Sorghum bicolor; identical to SEQ ID NO: 17560
  misc_feature: Ceres ANNOT ID no. 8680357
  misc_feature: Down-regulated in shoot tissues in response to aminocyclopropane carboxylic treatment
  misc_feature: Down-regulated in shoot tissues in response to salicylic acid treatment
  misc_feature: Up-regulated in root tissues in response to salicylic acid treatment
  misc_feature: Up-regulated in shoot tissues in response to methyl jasmonate treatment
  misc_feature: Encodes the peptide sequence at SEQ ID NO 17569

SEQ ID NO: 17569 - protein, 714 aa, Sorghum bicolor; identical to SEQ ID NO: 17561
  misc_feature: Useful for making plants with altered cell wall content and/or composition
  misc_feature: Useful for making plants with altered lignin content
  misc_feature: Functional homolog of the protein sequence given in SEQ ID NO 14131
  misc_feature: Ceres ANNOT ID no. 8680357
  misc_feature: Down-regulated in shoot tissues in response to aminocyclopropane carboxylic treatment
  misc_feature: Down-regulated in shoot tissues in response to salicylic acid treatment
  misc_feature: Up-regulated in root tissues in response to salicylic acid treatment
  misc_feature: Up-regulated in shoot tissues in response to methyl jasmonate treatment
  misc_feature (1)..(714): SWISSPROT Homolog: EC 4.3.1.5 Phenylalanine ammonia-lyase
  misc_feature (54)..(551): Pfam ID: PAL Pfam Description: Phenylalanine and histidine ammonia-lyase

SEQ ID NO: 17570 - DNA, 2061 bp, Sorghum bicolor
  misc_feature: Ceres ANNOT ID no. 8680378
  misc_feature: Down-regulated in shoot tissues in response to aminocyclopropane carboxylic treatment
  misc_feature: Down-regulated in shoot tissues in response to salicylic acid treatment
  misc_feature: Up-regulated in root tissues in response to salicylic acid treatment
  misc_feature: Up-regulated in shoot tissues in response to methyl jasmonate treatment
  misc_feature: Encodes the peptide sequence at SEQ ID NO 17571
atgatcacgttcgcggacctgacggagccggccacggccggcgccgagcggtgcgtggaccggcagctttggctggcgtgcgcgggcggcatgtgcaccgtgccacccgtgggcgccagcgtctactacttcccgcagggccacgcggagcacgcgctgggcctcgccggtacggccgacctctccgcggcgcgcgtcccggcgctggtcccctgccgcgtcgccgcagtgcgctacatggctgacccggacaccgacgaggtcttcgccaggatccgcctcgtcccgctacgcggcggggaggcggacgcgggtggcctcgaggacgatgcggcggacgagcaggagaagccggcctcgttcgccaagacgctgacacagtccgacgccaacaacggcggcgggttctccgtgccgaggtactgcgccgagaccatcttcccgcggctcgactacgccgccgacccgcccgtgcagaccgtcgtcgccaaggacgtgcacggggccgcctggaagttccgccacatctaccggggcacgccgcgccggcacctgctcaccacggggtggagcacgttcgtgaaccagaagaagctcgtcgccggggactccatcgtgttcctccgcggcgacagcggggacctgcacgtcggcatccgtcgcgcgaagcgtgggttctgcggcgccggtggaggcggaggcgaggaggcgccttcgcccgggtgggatcattacgcgggcctcatgcgaggtaatgtgagcccgtgcgcggccgccaaggcacggggcaaggtgcgaccagaggacgtggccgaggcggcgaggctggcggctgccgggcagtcgtttgaggcggtgtactaccctcgcgcgagcacgcccgagttctgcgttcgcgccgccgcggtccgcgcggcgatgagggtgcagtggtccccagggatgcggttcaagatggcgttcgagaccgaggactcctcccggatcagctggttcatgggcaccgtcgccggcgtccaggtcaccgaccccatccgctggccgcagtcgccgtggcgccttcttcaggtgacctgggacgagccggacctcctgcagaacgtgaagcgggtgagcccatggctggtggagctggtgtccagcatgccggccatccacctcgcctccttctcgccgccgcgcaagaagccccggatcccggcgtacccggagttccccttcgaagggcagctcctgaacccggcgttcccgcccaacccactgccacacggccagcacccccacccccaccaccatttccttcacgcccacccaccgttcttcccgttcccggacggcagtgctcctgcagccatacagggagccaggcatgcgcaattcgttccatctttatcagatctccaccttacccacctgcagtcgagcctgctgtacccggggctccgccgtcccgaccatgtcggtccgacgatccctatcccggcaagaatcagcaccgacctgaccatcggaggcgcaccggcgcgcgacgacgacgtcccgtgcgctctgtccatcggcgccaccaacaagcagaagcccgacgccgtcaagccggcggggctagtgctcttcggacggaccatactaaccgagcagcagatgagcctcagcagctccggcggcgcgacctccccagccgcgactaccggcaacagctctcagctgtactggaacgccgagaaggggcccaatgtctcggagggctcgggctccggcgtcatccagaacagcccgaccaagaaccacgcgtcgtcggagcggctgccgtggtgcgtcggggacggcggcagccagcagcaggtctccgagctcgggcttgagcccgggcaatgcaaggtgttcgtcgagtccgacacggtcggccgcaacctcgacctctcggcgctgagctcgttcgacgagctctaccgccgcctgtccgagatgttcggcatcgagggcgcggagctgcggagccgcgtgctgtaccgctgcgccaccggtgaagtgaagcacgccggcgacgagcccttcaggtaa

SEQ ID NO: 17571 - protein, 686 aa, Sorghum bicolor
  misc_feature: The sequence is a functional homolog of SEQ ID NO 1184 in the 10/666,642 US patent application
  misc_feature: The sequence is a functional homolog of SEQ ID NO 1428 in the 10/666,642 US patent application
  misc_feature: The sequence is a functional homolog of SEQ ID NO 1431 in the 11/479,226 US patent application
  misc_feature: The sequence is a functional homolog of SEQ ID NO 168 in the 10/666,642 US patent application
  misc_feature: The sequence is a functional homolog of SEQ ID NO 442 in the 10/666,642 US patent application
  misc_feature: Ceres ANNOT ID no. 8680378
  misc_feature (273)..(356): Pfam ID: Auxin_resp Pfam Description: Auxin response factor
  misc_feature (120)..(225): Pfam ID: B3 Pfam Description: B3 DNA binding domain
MITFADLTEPATAGAERCVDRQLWLACAGGMCTVPPVGASVYYFPQGHAEHALGLAGTADLSAARVPALVPCRVAAVRYMADPDTDEVFARIRLVPLRGGEADAGGLEDDAADEQEKPASFAKTLTQSDANNGGGFSVPRYCAETIFPRLDYAADPPVQTVVAKDVHGAAWKFRHIYRGTPRRHLLTTGWSTFVNQKKLVAGDSIVFLRGDSGDLHVGIRRAKRGFCGAGGGGGEEAPSPGWDHYAGLMRGNVSPCAAAKARGKVRPEDVAEAARLAAAGQSFEAVYYPRASTPEFCVRAAAVRAAMRVQWSPGMRFKMAFETEDSSRISWFMGTVAGVQVTDPIRWPQSPWRLLQVTWDEPDLLQNVKRVSPWLVELVSSMPAIHLASFSPPRKKPRIPAYPEFPFEGQLLNPAFPPNPLPHGQHPHPHHHFLHAHPPFFPFPDGSAPAAIQGARHAQFVPSLSDLHLTHLQSSLLYPGLRRPDHVGPTIPIPARISTDLTIGGAPARDDDVPCALSIGATNKQKPDAVKPAGLVLFGRTILTEQQMSLSSSGGATSPAATTGNSSQLYWNAEKGPNVSEGSGSGVIQNSPTKNHASSERLPWCVGDGGSQQQVSELGLEPGQCKVFVESDTVGRNLDLSALSSFDELYRRLSEMFGIEGAELRSRVLYRCATGEVKHAGDEPFR

SEQ ID NO: 17572 - DNA, 456 bp, Sorghum bicolor
  misc_feature: Ceres ANNOT ID no. 8680410
  misc_feature: Encodes the peptide sequence at SEQ ID NO 17573
atggccagcgtcgtcggtggagcagcagcggtcgcgagtgcggcggcggcggcggcggcggcggccggtggggcggcgggcgtgggggcgacgccgcacgtcctcgcggtggacgacagctccgtcgaccgcgccatcatcgctgccatcctacggagctcccggtttcgtgtgacggcggtggaaagtgggaagagggccctggaactgttgggcacggagccgaacgtgagtatgataatcactgattactggatgccagagatgacgggatacgagctcctcaagaaggtcaaggagtcatccaagctgaagcagatcccggtggtgatcatgtcctcagagaacgtctccaccagaatcagcagatgcctggaggaaggggcagaggatttcctggtgaagcccgtccgcgcgtcggacgtgtcgcgcgtcttcagccgcgtcctccgatga

SEQ ID NO: 17573 - protein, 151 aa, Sorghum bicolor
  misc_feature: The sequence is a functional homolog of SEQ ID NO 932 in the 10/666,642 US patent application
  misc_feature: Useful for making plants with modulated low light sensitivity
  misc_feature: Useful for making plants with modulated nitrogen use efficiency
  misc_feature: Functional homolog of the protein sequence given in SEQ ID NO 13599
  misc_feature: Ceres ANNOT ID no. 8680410
  misc_feature (34)..(151): SWISSPROT Homolog: EC 3.1.4.17 3',5'-cyclic-nucleotide phosphodiesterase
  misc_feature (32)..(146): Pfam ID: Response_reg Pfam Description: Response regulator receiver domain
MASVVGGAAAVASAAAAAAAAAGGAAGVGATPHVLAVDDSSVDRAIIAAILRSSRFRVTAVESGKRALELLGTEPNVSMIITDYWMPEMTGYELLKKVKESSKLKQIPVVIMSSENVSTRISRCLEEGAEDFLVKPVRASDVSRVFSRVLR

SEQ ID NO: 17574 - DNA, 1407 bp, Sorghum bicolor
  misc_feature: Ceres ANNOT ID no. 8680482
  misc_feature: Encodes the peptide sequence at SEQ ID NO 17575
atggagccggtgggcggggacggcggcggcggtggaggccgcgggcgcgggcgcgggaggggcggatggaaggggaagggcgtgagcggctcgggctccgccgccgcggggaggcagctggcgccagttttagaagacgcgccggcggccgcattgctccggcccctgaagaagatccgcagcccggatcgccgcctcaaccgctccctgtcctcgctctcgtcggctccgccttcccctgactcgtcctctgtttccaaccccttgtcgccgcaatcgacgcgacacatatttccgttcgcgtacgatcaggctccggcggcatccacggcagcggcggcggcggcgtccacagccgggtcgccaaggctcctgccgctgctgcaatactccagcgtgttccagcagcctctgccaccgcagccgcagcagcatcagcatcagcagataatttcgttcggaagcagcgagctgccgcagcaacagttcggggcggcggcggcggctcctctgttcccgccgcatctcctggcgccggaggtgcagcagcaaatgctgctgcgctactggagcgaggcgctgaacctgagcccccgcgggttccgcggcggcggggccgtgccgccggcgctgtaccagcagctgttgatgcgcgcgtcgggcccgcccaccaagctctaccgcggcgtgcggcagcgccactggggcaagtgggtggcggagatccgcctcccgcggaaccgcacgcgcctgtggctcggcaccttcgacaccgccgaggacgccgccatggcgtacgaccgcgaggccttcaagctccgcggcgagaacgccaagctcaacttccccgacctgttcctcggcaagggccgcgtcggcgggagtgggcgcaccagcgccagcgcggcggcgtcgtgctcctcctcttcctcgtctgctccgccgacgcccgacgagaatcacacgaagcaagctcagcagcagcatgacggtggacagcagccgtgcaacagcgaagcgaagcctctgctcccggaaacagagcaggccaagagctcggaacccgagccaaatcctcagctccagtcggccgatcaccaaggcggtgacggcaacacggtcatgttccagccgtcgtcggtggcgtcgggcggcgtgtggggtccggccgacgaggcgtggttcagcgcctggggcccgggcagctccgtgtgggactacgacatggacaacgcccacggcctcttcctccagtctcgcttcgccagtgaggcgaccagcatggactacgtgtccagcacgccggaagccccggcggcaccggtagcagggaccgccatggcctctgctgcctcccttcctcctcctcctcctccccgcagtccaacctacatgtggaaggactga

SEQ ID NO: 17575 - protein, 468 aa, Sorghum bicolor
  misc_feature: The sequence is a functional homolog of SEQ ID NO 162 in the 10/714,887 US patent application
  misc_feature: The sequence is a functional homolog of SEQ ID NO 162 in the 11/435,388 US patent application
  misc_feature: The sequence is a functional homolog of SEQ ID NO 30 in the 10/903,236 US patent application
  misc_feature: The sequence is a functional homolog of SEQ ID NO 16 in the 10/412,699 US patent application
  misc_feature: The sequence is a functional homolog of SEQ ID NO 14 in the 10/903,236 US patent application
  misc_feature: The sequence is a functional homolog of SEQ ID NO 1737 in the 10/374,780 US patent application
  misc_feature: The sequence is a functional homolog of SEQ ID NO 2129 in the 10/666,642 US patent application
  misc_feature: The sequence is a functional homolog of SEQ ID NO 74 in the 10/714,887 US patent application
  misc_feature: The sequence is a functional homolog of SEQ ID NO 74 in the 11/435,388 US patent application
  misc_feature: The sequence is a functional homolog of SEQ ID NO 164 in the 10/714,887 US patent application
  misc_feature: The sequence is a functional homolog of SEQ ID NO 164 in the 11/435,388 US patent application
  misc_feature: The sequence is a functional homolog of SEQ ID NO 32 in the 10/903,236 US patent application
  misc_feature: The sequence is a functional homolog of SEQ ID NO 18 in the 10/903,236 US patent application
  misc_feature: The sequence is a functional homolog of SEQ ID NO 2211 in the 10/666,642 US patent application
  misc_feature: The sequence is a functional homolog of SEQ ID NO 78 in the 10/714,887 US patent application
  misc_feature: The sequence is a functional homolog of SEQ ID NO 78 in the 11/435,388 US patent application
  misc_feature: The sequence is a functional homolog of SEQ ID NO 200 in the 10/714,887 US patent application
  misc_feature: The sequence is a functional homolog of SEQ ID NO 200 in the 11/435,388 US patent application
  misc_feature: The sequence is a functional homolog of SEQ ID NO 36 in the 10/903,236 US patent application
  misc_feature: The sequence is a functional homolog of SEQ ID NO 1466 in the 10/666,642 US patent application
  misc_feature: The sequence is a functional homolog of SEQ ID NO 2136 in the 10/374,780 US patent application
  misc_feature: The sequence is a functional homolog of SEQ ID NO 36 in the 10/714,887 US patent application
  misc_feature: The sequence is a functional homolog of SEQ ID NO 36 in the 11/435,388 US patent application
  misc_feature: The sequence is a functional homolog of SEQ ID NO 368 in the 10/225,066 US patent application
  misc_feature: The sequence is a functional homolog of SEQ ID NO 6 in the 10/903,236 US patent application
  misc_feature: Useful for making plants with altered lignin content
  misc_feature: Functional homolog of the protein sequence given in SEQ ID NO 13219
  misc_feature: The sequence is a functional homolog of SEQ ID NO 10 in the 10/903,236 US patent application
  misc_feature: The sequence is a functional homolog of SEQ ID NO 1735 in the 10/374,780 US patent application
  misc_feature: The sequence is a functional homolog of SEQ ID NO 2125 in the 10/666,642 US patent application
  misc_feature: The sequence is a functional homolog of SEQ ID NO 690 in the 10/666,642 US patent application
  misc_feature: The sequence is a functional homolog of SEQ ID NO 70 in the 10/714,887 US patent application
  misc_feature: The sequence is a functional homolog of SEQ ID NO 70 in the 11/435,388 US patent application
  misc_feature: Useful for making plants with altered sterol content
  misc_feature: Useful for making plants with altered terpenoid content
  misc_feature: Functional homolog of the protein sequence given in SEQ ID NO 13518
  misc_feature: The sequence is a functional homolog of SEQ ID NO 172 in the 11/375,241 US patent application
  misc_feature: The sequence is a functional homolog of SEQ ID NO 800 in the 11/435,388 US patent application
  misc_feature: Ceres ANNOT ID no. 8680482
  misc_feature (225)..(276): Pfam ID: AP2 Pfam Description: AP2 domain
MEPVGGDGGGGGGRGRGRGRGGWKGKGVSGSGSAAAGRQLAPVLEDAPAAALLRPLKKIRSPDRRLNRSLSSLSSAPPSPDSSSVSNPLSPQSTRHIFPFAYDQAPAASTAAAAAASTAGSPRLLPLLQYSSVFQQPLPPQPQQHQHQQIISFGSSELPQQQFGAAAAAPLFPPHLLAPEVQQQMLLRYWSEALNLSPRGFRGGGAVPPALYQQLLMRASGPPTKLYRGVRQRHWGKWVAEIRLPRNRTRLWLGTFDTAEDAAMAYDREAFKLRGENAKLNFPDLFLGKGRVGGSGRTSASAAASCSSSSSSAPPTPDENHTKQAQQQHDGGQQPCNSEAKPLLPETEQAKSSEPEPNPQLQSADHQGGDGNTVMFQPSSVASGGVWGPADEAWFSAWGPGSSVWDYDMDNAHGLFLQSRFASEATSMDYVSSTPEAPAAPVAGTAMASAASLPPPPPPRSPTYMWKD

SEQ ID NO: 17576 - DNA, 822 bp, Sorghum bicolor
  misc_feature: Ceres ANNOT ID no. 8680493
  misc_feature: Encodes the peptide sequence at SEQ ID NO 17577
atggccgccggcgcctcgagctcctctcacgcctacggcttctccatcagcgcggtgctcctcgcatcgtcgttcgtgtgcctcttcggctccggggaggcttcgggggcggcgcacagggtggtcgaccccgagtggcacccggccaccgccacctggtacggcagcgccgagggcgacggcagcgacggcggcgcgtgcgggtacgggacgctggtggacgtggtgccgatgaaggcgcgcgtgggcgccgtgagccccgtgctgttcaagtccggggagggctgcggcgcctgctacaaggtccggtgcctggaccacggcatctgctcgcgccgcgccgtcacggtcatcgtcaccgacgagtgccctggcggggtctgctccggcggccgcacgcacttcgacctcagcggcgccgcgttcggccgcctcgccgtggccggcgccggcggccagctgcgcaaccggggcgagatcaacgtcgtcttccgcaggacggcgtgcaggtacgggggcaagaacatcgccttccacgtgaacgagggctccactagcttctggctctccctcctggtcgaatttgaggacggcgacggcgacatcggatccatgcagctcaaacaggccaactcggcgcagtggcgagacatgcagcacgtctggggggccacatatagcctcaccccgggcccacttgtcgggcccttctccgtgcggctgacgaccctgtccagcaagcagacccttacggcccaggacgtcatccccaagaactgggcccccaaggccacctacacctcccggctcaacttcgcgtag

SEQ ID NO: 17577 - protein, 273 aa, Sorghum bicolor
  misc_feature: Useful for making plants with altered carbohydrate content
  misc_feature: Functional homolog of the protein sequence given in SEQ ID NO 14553
  misc_feature: Useful for making plants with altered cell wall content and/or composition
  misc_feature: Functional homolog of the protein sequence given in SEQ ID NO 14554
  misc_feature: Ceres ANNOT ID no. 8680493
  misc_feature (176)..(257): Pfam ID: Pollen_allerg_1 Pfam Description: Pollen allergen
  misc_feature (82)..(164): Pfam ID: DPBB_1 Pfam Description: Rare lipoprotein A (RlpA)-like double-psi beta-barrel
MAAGASSSSHAYGFSISAVLLASSFVCLFGSGEASGAAHRVVDPEWHPATATWYGSAEGDGSDGGACGYGTLVDVVPMKARVGAVSPVLFKSGEGCGACYKVRCLDHGICSRRAVTVIVTDECPGGVCSGGRTHFDLSGAAFGRLAVAGAGGQLRNRGEINVVFRRTACRYGGKNIAFHVNEGSTSFWLSLLVEFEDGDGDIGSMQLKQANSAQWRDMQHVWGATYSLTPGPLVGPFSVRLTTLSSKQTLTAQDVIPKNWAPKATYTSRLNFA

SEQ ID NO: 17578 - DNA, 525 bp, Sorghum bicolor
  misc_feature: Ceres ANNOT ID no. 8680496
  misc_feature: Encodes the peptide sequence at SEQ ID NO 17579
atggcctcccgcctcgccgtcgccgtcgccgcgcccgcgtcgccgtcgccttccccggccgccaccgtcgccccgccccgcctcgcgctccgccgaggcgtcccggcgccgacgtggagcgcgctccgcaccgccgtcccgcgatcccgtggcgcggccgttgtgtgcctggcccagggcggccaggacaccgccatccaagttcctgatgtgagcaaatccacatggcaatcacttgtggtggagagcgagcttcccgtccttgttcagttctgggcctcatggtgcggaccgtgtaagatgatagaccccatcgttggcaagctctcaaaggagtacgaaggaaagctgaaatgttacaagctaaacactgacgagaaccccgacatcgcgacccaattgggcatccggagcatccccaccatgatgatcttcaagaacggtgagaagaaggacgccgtgattggagccgtgccagagagcaccctggtcacctgcatcgacaagtatgttggtgggaggtga

SEQ ID NO: 17579 - protein, 174 aa, Sorghum bicolor
  misc_feature: Useful for making plants with modulated heat sensitivity
  misc_feature: Functional homolog of the protein sequence given in SEQ ID NO 14555
  misc_feature: Ceres ANNOT ID no. 8680496
  misc_feature (91)..(161): SWISSPROT Homolog: EC 1.8.1.8 Protein-disulfide reductase
  misc_feature (67)..(170): Pfam ID: Thioredoxin Pfam Description: Thioredoxin
MASRLAVAVAAPASPSPSPAATVAPPRLALRRGVPAPTWSALRTAVPRSRGAAVVCLAQGGQDTAIQVPDVSKSTWQSLVVESELPVLVQFWASWCGPCKMIDPIVGKLSKEYEGKLKCYKLNTDENPDIATQLGIRSIPTMMIFKNGEKKDAVIGAVPESTLVTCIDKYVGGR

SEQ ID NO: 17580 - DNA, 1455 bp, Sorghum bicolor
  misc_feature: Ceres ANNOT ID no. 8680534
  misc_feature: Encodes the peptide sequence at SEQ ID NO 17581
atgagctccggaaaggcgcagcagcggccacacgccgtgctcatcccgcagccggcgcagggccacgtcacgccgatgctgcacctcgccaaggcgctgcacgccagggggttccgcgtcacctacgtcaactccgagtacaaccaccgccgcctgctccggtcccgcggccaggactcgctcgccggcaccgacggcttccgcttcgaggccgtccccgacggcctgccgcagtccgacaacgacgacgtcacgcaggacatcgccgcgctctgcctgtccaccaccgagcacagcgccgcgccgttcagggacctgctggcgaggctgaacgccacgcccggcagcccgccggtcagctgcgtcatagccgacggcgtgatgagcttcgcgcagcgggtcgccgaggagatggggatcctggccttggttttctggaccaccagtgcgtgcggcttcatggggtacctccacttcgccgagctcatccgacgagcctacgtgccactcaaagacgaaagtgacctgtcgaacgggtacctggacaccgcgatcgactggatccccggcatgcccggcatccgtctgaaggacatccccagcttcatcaggacgacggacccggacgacgtgatgctcaacttcgacggcggcgaggcgcagaacgcgcgcaaggcccgcggggtcatcctcaacacgtacgacgcgctggagcaggacgtggtggacgcgctgcgccgcgagttcccgcgcgtgtacaccgtcggcccgctcgccacgttcgcgaacgccgcggcaggaggcgggctggacgcgatcggcgggaacctctggaaggaggacacgagctgcctccggtggctggacacgcagcgaccgggatcggtggtgtacgtcaacttcggcagcatcacggtgatgaccgccgctcagctcgccgagttcgcctggggcctggcgagctgcggctcgccgttcctgtgggtcatcaggccggacctcgtgtccggcgagaacgccatgctgccggaggggttcgtcacggacaccaaagaaaggggaatcctggcgagctggtgtccgcaagagctggtgctctcgcacccgtccgtcggcctgtttctgacgcactgcgggtggaactcgacgctggagagcatatgtgccggcgtgccgatgctctgctggccgttcttcgctgagcaaccgacgaactgccggtacgtgtgtgacaaatgggggattgggatggagatcgacagtgatgtgaggaggcaggaggtggcgcggctcgtgcgcgaggcgatggacggggagaggggcaaggcgatgagattgaagtcgatggtgtggaaggagaaagctcgacaagcagtggacgaaggtggatcctcgaggaaaaacatggaccggatggtcgagttcctgctcgctgggaatgatgttcctagctga

SEQ ID NO: 17581 - protein, 484 aa, Sorghum bicolor
  misc_feature: Useful for making plants with altered carbohydrate content
  misc_feature: Functional homolog of the protein sequence given in SEQ ID NO 14556
  misc_feature: Ceres ANNOT ID no. 8680534
  misc_feature (10)..(479): SWISSPROT Homolog: EC 2.4.1.121 Indole-3-acetate beta-glucosyltransferase
  misc_feature (12)..(480): Pfam ID: UDPGT Pfam Description: UDP-glucoronosyl and UDP-glucosyl transferase
MSSGKAQQRPHAVLIPQPAQGHVTPMLHLAKALHARGFRVTYVNSEYNHRRLLRSRGQDSLAGTDGFRFEAVPDGLPQSDNDDVTQDIAALCLSTTEHSAAPFRDLLARLNATPGSPPVSCVIADGVMSFAQRVAEEMGILALVFWTTSACGFMGYLHFAELIRRAYVPLKDESDLSNGYLDTAIDWIPGMPGIRLKDIPSFIRTTDPDDVMLNFDGGEAQNARKARGVILNTYDALEQDVVDALRREFPRVYTVGPLATFANAAAGGGLDAIGGNLWKEDTSCLRWLDTQRPGSVVYVNFGSITVMTAAQLAEFAWGLASCGSPFLWVIRPDLVSGENAMLPEGFVTDTKERGILASWCPQELVLSHPSVGLFLTHCGWNSTLESICAGVPMLCWPFFAEQPTNCRYVCDKWGIGMEIDSDVRRQEVARLVREAMDGERGKAMRLKSMVWKEKARQAVDEGGSSRKNMDRMVEFLLAGNDVPS

SEQ ID NO: 17582 - DNA, 1971 bp, Sorghum bicolor
  misc_feature: Ceres ANNOT ID no. 8680547
  misc_feature: Encodes the peptide sequence at SEQ ID NO 17583
atgtcgcggccgctgtacaggggcgtctcggggatcggcggcaagctggcggcggcggacgaggcgtactacgaccccaaggagcccagcgagaacggcattggcggcggcggccggggcggcgcgcggaagcggcacctcgcggccgcggcggtgaagatcggggtcctgctgctggccgcggcggcgctcgtgggctcggtcgcgtgggcggggacgctctacgcggggcgcggcgccgcggcgcgcgcaaccgccgccgccgcgcaccgcgggtaccgccggctgcaggagcagctggtcacggacctgctcgacatcggcgagctcgcgggcggcggcgtccgcgccaaggaggcggaggtgtgcccgcccgagtacgagaactacgtgccctgctactacaacgtcacggacgccgtcgacgtctcggatctgggcgccggcgtcctcataagctacgaccgccagtgcacgcgcgacggcagggtcacttgcctcgtcgcgccaccaaggagctaccggattcccgtgcgatggcccagcggcaagggcttcatctggaaggacaacgtgcggattagcgggcaggagttctcgtccgggagcctgttcaagaggatgatggtggaggaggaccagatctcgttcccgtcggacgcccacatggccgacggtgtggaggattatgcccatcaaattgccgagatgattgggttgcggaatgaattcaatttcaatgaggctggggttaggacagtccttgacatagaatgtggatttggtacctttggggcacatctttttgagagagatctcttgaccatgtgcattgctaactatgaagcatcaggcagccaagtgcaaattacactggagagaggcattcctgcaatgattggttcatttgcaacaaagcagcttccatatccctatctttcctttgatatggtgcattgtgcaaaatgcaatatcgaatggtacaaaaatgatggcattttcttggttgaagtgaacaggcttttgaggcctgatggatattttgtatggacatcgaatttgaatacacatagggccttgcgtgacaaagaaaaccaaaagaaatggacggccattcgtgacttcgctgagggcctttgttgggagatgctgtcacaacaagatgagacaattgtatggaaaaagacaaataaaagggagtgttacaattcaagaaaatctgggcctgagctatgtggccatgatccagaatcaccatactaccaaccactaagcccctgcatatcaggcacaagaagccagcgttggatccccattgaacatcgttccacctggccatctcagtctagacaaaactcaacagaactggacatacatggtgtgcattcagaagtctttgctgatgatacttcaagctgggactccatggtgcgaaactactggtctttgctatctccacttatattttcagaccatccaaagagacctggtgatgaagacccccagccaccatttaacatgctaaggaatgttttagatatgaatgctcactttggtggatttaatgctgctttactgaaggctggaaagtctgtatgggtgatgaatgttgttcctacaaatgccccaaattatctaccactaatatttgaccgtggttttattggggttcaacatgattggtgcgacgcatttccaacttacccaagaacatatgatatggtgcatgctgatggctttctatcacttgagaagaaccacaagcatagatgttctactcttgacatattcttggaagttgatcgcatcctacgaccagagggctgggtcataatccgtgacaccgcccctcttattgaagcagcaagatctgttgttactcaactcagatgggatgcccgtattttagatcttgacatagctagtgatgaaaagctactcgtctgtcagaagccttttatcagaaaataa

SEQ ID NO: 17583 - protein, 656 aa, Sorghum bicolor
  misc_feature: The sequence is a functional homolog of SEQ ID NO 44 in the 10/286,264 US patent application
  misc_feature: The sequence is a functional homolog of SEQ ID NO 564 in the 10/412,699 US patent application
  misc_feature: The sequence is a functional homolog of SEQ ID NO 2738 in the 10/374,780 US patent application
  misc_feature: The sequence is a functional homolog of SEQ ID NO 386 in the 10/225,066 US patent application
  misc_feature: Ceres ANNOT ID no. 8680547
MSRPLYRGVSGIGGKLAAADEAYYDPKEPSENGIGGGGRGGARKRHLAAAAVKIGVLLLAAAALVGSVAWAGTLYAGRGAAARATAAAAHRGYRRLQEQLVTDLLDIGELAGGGVRAKEAEVCPPEYENYVPCYYNVTDAVDVSDLGAGVLISYDRQCTRDGRVTCLVAPPRSYRIPVRWPSGKGFIWKDNVRISGQEFSSGSLFKRMMVEEDQISFPSDAHMADGVEDYAHQIAEMIGLRNEFNFNEAGVRTVLDIECGFGTFGAHLFERDLLTMCIANYEASGSQVQITLERGIPAMIGSFATKQLPYPYLSFDMVHCAKCNIEWYKNDGIFLVEVNRLLRPDGYFVWTSNLNTHRALRDKENQKKWTAIRDFAEGLCWEMLSQQDETIVWKKTNKRECYNSRKSGPELCGHDPESPYYQPLSPCISGTRSQRWIPIEHRSTWPSQSRQNSTELDIHGVHSEVFADDTSSWDSMVRNYWSLLSPLIFSDHPKRPGDEDPQPPFNMLRNVLDMNAHFGGFNAALLKAGKSVWVMNVVPTNAPNYLPLIFDRGFIGVQHDWCDAFPTYPRTYDMVHADGFLSLEKNHKHRCSTLDIFLEVDRILRPEGWVIIRDTAPLIEAARSVVTQLRWDARILDLDIASDEKLLVCQKPFIRK

SEQ ID NO: 17584 - DNA, 1080 bp, Sorghum bicolor
  misc_feature: Ceres ANNOT ID no. 8680571
  misc_feature: Encodes the peptide sequence at SEQ ID NO 17585
atgacgaaccaggacgtggtcgtgtcggagatgggcattgcggccggggccgcgctgccgggcgcgagcccggccctcctggcctgccggggcgcggccgccggcgccatgtccctgcggtacctcgacctggccgcggcggccgcgcgctcggccagctgcacctgggtcgacgccatgcgcgcctcctcgcccacccgctcccgcgccgccgccgacgtcgacgagttcacggcatggatgaggaagcacccgtcggcgctcgccaagttcgagcagatcgccagcgcgtccaaggggaagaaggtcgtcatgttcctagactacgacggcacgctctcccccatcgtcgccgaccccgacgccgcgtacatgagcgacgcgatgagagcggcggtgcgcgacgtcgcgaagcacttcccgacggcgatcgtgagcgggcgctgccgcgacaaggtgcgcaacttcgtcgacctctcggagctctactacgccggcagccatggcatggacatcaagggaccaagctccaatcccgagtcagttttatgccaacctgcaagcgagttcctccccgtgatcgacgaggtgtacaaggcgctggtggaaaagacgaagtccacgcctggcgccaaggtggagaacaacaagttctgcttgtccgtgcacttcagatgtgttgatgaaaagagatggaatgctttggcagagcaagtcaaggcagtgatcaaggactaccccaagctgaagctcactcaagggaggaaggttctggagatccgtccgagcattatgtgggacaagggcaaggccttggagttcctgctcgaatcgctcggattcgccaactgcagcgacgtcctcccggtgtacatcggtgacgaccgcaccgacgaggatgctttcaaggtgctgaggaagagggggcaaggcatcgggatccttgtgtccaagtgccccaaggagacgaacgcctcctactccctgcaggaccccggcgaggtgatggacttcctgctccgtctggcggaatggaagcggaaatcctcggcgccaccgatgattcggccgcgggtgtag

SEQ ID NO: 17585 - protein, 359 aa, Sorghum bicolor
  misc_feature: Useful for making plants with modulated flowering time
  misc_feature: Useful for making plants with modulated low light sensitivity
  misc_feature: Functional homolog of the protein sequence given in SEQ ID NO 13725
  misc_feature: Useful for making plants with modulated drought sensitivity
  misc_feature: Functional homolog of the protein sequence given in SEQ ID NO 13424
  misc_feature: Useful for making plants with modulated water use efficiency
  misc_feature: Functional homolog of the protein sequence given in SEQ ID NO 13348
  misc_feature: The sequence is a functional homolog of SEQ ID NO 16 in US patent 7214858
  misc_feature: Ceres ANNOT ID no. 8680571
  misc_feature (98)..(345): SWISSPROT Homolog: EC 3.1.3.12 Trehalose-phosphatase
  misc_feature (106)..(333): Pfam ID: Trehalose_PPase Pfam Description: Trehalose-phosphatase
MTNQDVVVSEMGIAAGAALPGASPALLACRGAAAGAMSLRYLDLAAAAARSASCTWVDAMRASSPTRSRAAADVDEFTAWMRKHPSALAKFEQIASASKGKKVVMFLDYDGTLSPIVADPDAAYMSDAMRAAVRDVAKHFPTAIVSGRCRDKVRNFVDLSELYYAGSHGMDIKGPSSNPESVLCQPASEFLPVIDEVYKALVEKTKSTPGAKVENNKFCLSVHFRCVDEKRWNALAEQVKAVIKDYPKLKLTQGRKVLEIRPSIMWDKGKALEFLLESLGFANCSDVLPVYIGDDRTDEDAFKVLRKRGQGIGILVSKCPKETNASYSLQDPGEVMDFLLRLAEWKRKSSAPPMIRPRV

SEQ ID NO: 17586 - DNA, 1092 bp, Sorghum bicolor
  misc_feature: Ceres ANNOT ID no. 8680561
  misc_feature: Encodes the peptide sequence at SEQ ID NO 17587
atggggtacctgccgtccctgagcagcaaggcggcgcacttcgtgtccgacctcaccaccgtcatcctcaaccccgtctccgagcgcgagacctcccacctccccgaggttgacgaagtgcaagaaaatttggaggatgataaagattctgagcacaattctgacagccttgatggacctgacacatcttcctttagagcattcttgatctcatttttgtcatcatcgagctctaataacgattcaatggagataattcctgagcagaatggggacatgggttaccctactttaacacccatggggaagggaagcaagggaagaacaggtctgataagtaggggaaagcattccatcggaaaaatcattaacaaggcgacaaggattggtggtttcaaacaaacaactgcagagcctaaaattgacagggagacaataactcatactgaaccagttgcacctgtattggagcgccaggaaccaaaggaagttgtttcctttagtagtttgccaactatgtcggaaccatctgttcttttgtcagaacggatgcaatcaattctttatgcatctctccctgttcttgcccagggaaggaactgggtcttgctatacagtacatggaggcatggcatatctttatctactttatatagaaggagcatgctttgccctggtttctcactcttggttgttggggataaagaaggtacaatttttggtggtttagttgaggccccattacagccatccagttcaaagaagtatcaggggaccaataattcctttgttttcactaatttgcataatcgccctgtcatatatcgaccgacaggtgcaaataactattttacggtgtgctccactgactatatggctttggggggaggaggtcattttgcactttatcttgattctgaccttttgactggttcaagttcaaattcagagacttttaacaacgggtgtttatcgcattcttcagacttctcagtgaaagatgttgagctttggggcttcgtctacccttccaaatacgaggagatgctgacaatctgcaggactgagaaaccaggaatctgtcgatggtga

SEQ ID NO: 17587 - protein, 363 aa, Sorghum bicolor; identical to SEQ ID NO: 8094
  misc_feature: Useful for making plants with altered protein content
  misc_feature: Functional homolog of the protein sequence given in SEQ ID NO 13487
  misc_feature: Ceres ANNOT ID no. 8680561
  misc_feature (203)..(341): Pfam ID: TLD Pfam Description: TLD

SEQ ID NO: 17588 - DNA, 996 bp, Sorghum bicolor
  misc_feature: Ceres ANNOT ID no. 8680573
  misc_feature: Encodes the peptide sequence at SEQ ID NO 17589
atggccgcagctatcgacatgtacaagtactacaacgcacaccagatcgcctcctcctccccctcggatgaggagctcgcgaaagcactcgagccttttataacgagtgcttcctcctcctctccctaccatcgctactcgtcttctccatccatgtcccaagattcttacatgcctacaccctcctacaccagcttcgccacctcgcctcttcccacccccgccgccacctcctcctcctcctcgcctttctcgcagcttccgccactctactcgtcgccttacgcggcgccgagcatggttgggcagatgggcctgaaccagctcggcccggcccagatccagcagatccaggcccagttcatgttccagcagcagcagcagcagcagaggggtctgcacgcggcgttcctgggcccgcgggcgcagccgatgaagcagtccggatcgccgccgctggcgccggcgcagtcgaagctgtaccgcggcgtccgccagcgccactggggcaagtgggtggcagagatccgcctccccaagaaccgcacccggctgtggctcggcaccttcgacaccgccgaggacgcggcgctcgcctacgacaaggccgccttccgcctccgcggcgacatggcgcgcctcaacttcccggccctccgccgcgacggcgcgcacctcgccggcccgctccacgcctccgtggacgccaagctcaccgccatctgccagtccctgacgggttccaagaacggcggctcctccggcgacgagtcggccgggtccccgccggactcccccaagtgctcggcgtcggcgtcgacggagggggaggaggagtcgggctccgccggctcccctccttccccgacgctggcgccgcccgtgccggagatggcgaagctggacttcaccgaggcgccgtgggacgagacggagaccttccacctccgcaagtacccgtcctgggagatcgactgggattccatcctctcgtga

SEQ ID NO: 17589 - protein, 331 aa, Sorghum bicolor
  misc_feature: The sequence is a functional homolog of SEQ ID NO 1288 in the 10/374,780 US patent application
  misc_feature: The sequence is a functional homolog of SEQ ID NO 1434 in the 10/412,699 US patent application
  misc_feature: The sequence is a functional homolog of SEQ ID NO 1290 in the 10/374,780 US patent application
  misc_feature: The sequence is a functional homolog of SEQ ID NO 1436 in the 10/412,699 US patent application
  misc_feature: The sequence is a functional homolog of SEQ ID NO 1289 in the 10/374,780 US patent application
  misc_feature: The sequence is a functional homolog of SEQ ID NO 1435 in the 10/412,699 US patent application
  misc_feature: The sequence is a functional homolog of SEQ ID NO 1291 in the 10/374,780 US patent application
  misc_feature: Ceres ANNOT ID no. 8680573
  misc_feature: Up-regulated in root tissues in response to methyl jasmonate treatment
  misc_feature: Up-regulated in shoot tissues in response to methyl jasmonate treatment
  misc_feature: Up-regulated in shoot tissues in response to salicylic acid treatment
  misc_feature: Up-regulated in root tissues in response to salicylic acid treatment
  misc_feature (159)..(210): Pfam ID: AP2 Pfam Description: AP2 domain
MAAAIDMYKYYNAHQIASSSPSDEELAKALEPFITSASSSSPYHRYSSSPSMSQDSYMPTPSYTSFATSPLPTPAATSSSSSPFSQLPPLYSSPYAAPSMVGQMGLNQLGPAQIQQIQAQFMFQQQQQQQRGLHAAFLGPRAQPMKQSGSPPLAPAQSKLYRGVRQRHWGKWVAEIRLPKNRTRLWLGTFDTAEDAALAYDKAAFRLRGDMARLNFPALRRDGAHLAGPLHASVDAKLTAICQSLTGSKNGGSSGDESAGSPPDSPKCSASASTEGEEESGSAGSPPSPTLAPPVPEMAKLDFTEAPWDETETFHLRKYPSWEIDWDSILS

SEQ ID NO: 17590 - DNA, 993 bp, Sorghum bicolor
  misc_feature: Ceres ANNOT ID no. 8680613
  misc_feature: Up-regulated in root tissues in response to methyl jasmonate treatment
  misc_feature: Up-regulated in shoot tissues in response to methyl jasmonate treatment
  misc_feature: Up-regulated in shoot tissues in response to salicylic acid treatment
  misc_feature: Up-regulated in root tissues in response to salicylic acid treatment
  misc_feature: Encodes the peptide sequence at SEQ ID NO 17591
atggaggcgggcctggcgctgcagacgcgggccgcgggcttcggctccggacggcgccggggcggcctacagtcgcccatcgggagcctgagagtcgctgatccggcgggagctgcggttgccgcgggcttcggctccggacggcgccggggcggcctacagtcgcccatcgggagcctgagagtcgctgatccggcgggagctgcggttgccgtgcgggctcgcgggtccaagcccgtcgcaccgctccgtgccaagaaatcgttcggaggtcatgaaaacttgcataactccgttgacgaagctctcctgttgaagaggaaatccgaagaagttctgttctacttgaacgggaggtgtatttacttagtaggaatgatgggttctggaaaaagtacagtggggaagattatgtctgaagtcttgggttattcgttctttgacagtgacaaattagtggagcaagctgttggaatgccttcagttgctcaaatattcaaggttcatagcgaagccttctttcgggataatgagagtagtgtcttgagagatttgtcctccatgcaacgattagttgttgccaccggcggtggtgctgttatccgaccagttaactggaaatatatgaagaagggcctatctgtttggttagatgtgcccttggatgctcttgctaggcgtattgctaaagtgggaactgcctctcgtcctctcctggaccaaccatctggtgatccatacacaatggccttctctaagctcagcatgcttgcagagcaaaggggtgacgcttatgcaaatgcagatgtaagggtttctctagaagagattgcatctaagcaaggtcaccatgatgtctctaagctgacacccactgatatcgcaattgagtcacttcataagatcgagagcttcgtcagcgagcacactcctgataatccagctagcgactcgcaagctgagtcgcagatccaaaggatacagaccttgtag

SEQ ID NO: 17591 - protein, 330 aa, Sorghum bicolor
  misc_feature: Useful for making plants with modulated salt sensitivity
  misc_feature: Functional homolog of the protein sequence given in SEQ ID NO 13442
  misc_feature: Ceres ANNOT ID no. 8680613
  misc_feature: Up-regulated in shoot tissues in response to methyl jasmonate treatment
  misc_feature (98)..(306): SWISSPROT Homolog: EC 2.7.1.71 Shikimate kinase
  misc_feature (127)..(303): Pfam ID: SKI Pfam Description: Shikimate kinase
MEAGLALQTRAAGFGSGRRRGGLQSPIGSLRVADPAGAAVAAGFGSGRRRGGLQSPIGSLRVADPAGAAVAVRARGSKPVAPLRAKKSFGGHENLHNSVDEALLLKRKSEEVLFYLNGRCIYLVGMMGSGKSTVGKIMSEVLGYSFFDSDKLVEQAVGMPSVAQIFKVHSEAFFRDNESSVLRDLSSMQRLVVATGGGAVIRPVNWKYMKKGLSVWLDVPLDALARRIAKVGTASRPLLDQPSGDPYTMAFSKLSMLAEQRGDAYANADVRVSLEEIASKQGHHDVSKLTPTDIAIESLHKIESFVSEHTPDNPASDSQAESQIQRIQTL

SEQ ID NO: 17592 - DNA, 273 bp, Sorghum bicolor
  misc_feature: Ceres ANNOT ID no. 8680624
  misc_feature: Up-regulated in shoot tissues in response to methyl jasmonate treatment
  misc_feature: Encodes the peptide sequence at SEQ ID NO 17593
atgtcgagccgaaggtcgtcgtcgtcgcgtggcaacatctccgaggacgagatcaacgagctcatctccaagctccaggccctgctccccagctcccgccgccgcggctccggccaggcgtcgacgacgaagctgctgaaggagacctgcagctacatcaagagcctccaccgggaggtcgacgacctgagcgaccggctgtcggacctgatgtccactatggaccacaacagccccggcgcggaaatcatccgcagcatcctccgctcctga

SEQ ID NO: 17593 - protein, 90 aa, Sorghum bicolor
  misc_feature: Useful for making plants with modulated nitrogen use efficiency
  misc_feature: Functional homolog of the protein sequence given in SEQ ID NO 14244
  misc_feature: Useful for making plants with altered terpenoid content
  misc_feature: Functional homolog of the protein sequence given in SEQ ID NO 14245
  misc_feature: Ceres ANNOT ID no. 8680624
MSSRRSSSSRGNISEDEINELISKLQALLPSSRRRGSGQASTTKLLKETCSYIKSLHREVDDLSDRLSDLMSTMDHNSPGAEIIRSILRS

SEQ ID NO: 17594 - DNA, 894 bp, Sorghum bicolor
  misc_feature: Ceres ANNOT ID no. 8680642
  misc_feature: Encodes the peptide sequence at SEQ ID NO 17595
atgtcgaccaactcgaggtcgaactccagggccaacttcaacaacgagatccatgacatcggcacggtgcagaactccaccatgatgccccccacgtactacgaccgatcgctggcggacatcttccctccccacctcctcaagaaggtggtctcggaggtggtgtccacgttcttgctggtgttcgtgacgtgcggggcggcggggatctacggcagcgacaaggaccgcatatcgcagctgggacagtcggtcgccggcgggctcatcgtcacggtgatgatctacgccgtcggccacatctccggcgcgcacatgaaccccgccgtcacgctcgcgttcgccgtgttccgccatttcccctggattcaggtcccgttctactgggcggcgcagttcacgggcgccatctgcgcgtcgttcgtgctcaaggccgtgctgcaccccatctccgtgctgggctgcaccacgccgacggggccgcactggcactcgctcatcatcgagatcatcgtcaccttcaacatgatgttcgtcaccctcgccgtcgccacggacacgagagcggtgggtgagttggcggggttggcagttggttccgcggtttgcattacgtccatcttcgcaggggcagtgtctggcggatcgatgaacccggcgaggacgctggggccggcgctggcgagcaacctctacaccggactctggatctacttcttgggccccgtcctcgaagctctcctccttcaagctccgccgcctgcagagccagtccgtcgccgcggaagacgacgagctcgaccacatccaagtgtgatatgctttgcatgcagagcagagcgcacactgcttgttactcctcactcaaatgtatcggtgatactcctagagtag

SEQ ID NO: 17595 - protein, 297 aa, Sorghum bicolor
  misc_feature: Useful for making plants with modulated silicon content
  misc_feature: Functional homolog of the protein sequence given in SEQ ID NO 13422
  misc_feature: Ceres ANNOT ID no. 8680642
  misc_feature (40)..(249): Pfam ID: MIP Pfam Description: Major intrinsic protein
MSTNSRSNSRANFNNEIHDIGTVQNSTMMPPTYYDRSLADIFPPHLLKKVVSEVVSTFLLVFVTCGAAGIYGSDKDRISQLGQSVAGGLIVTVMIYAVGHISGAHMNPAVTLAFAVFRHFPWIQVPFYWAAQFTGAICASFVLKAVLHPISVLGCTTPTGPHWHSLIIEIIVTFNMMFVTLAVATDTRAVGELAGLAVGSAVCITSIFAGAVSGGSMNPARTLGPALASNLYTGLWIYFLGPVLEALLLQAPPPAEPVRRRGRRRARPHPSVICFACRAERTLLVTPHSNVSVILLE

SEQ ID NO: 17596 - DNA, 2403 bp, Sorghum bicolor
  misc_feature: Ceres ANNOT ID no. 8680649
  misc_feature: Encodes the peptide sequence at SEQ ID NO 17597
atggaaggtggccacgcgttgcgcgccgtcggtgacgtcgtcttcttgggcgcgtacggccgccggttgtcgttgtcagcgacgatcgccgccttcgtggagtcgctgctccaggggtgggcggaggtcagggccgggctgctggtgccgctgctccgggccgcggtgctgctgtgcacggccatgtcggtgatcgtgctggccgagaaggtgttcctgggcgcggtcagctccgtgatgaagctgcggcgccggcggccgtcgcgggtgtacaggtgcgaccccatcgcgcggcccgacaaggacgaggaggcagctgcttatcccatggtgctcgtccagatccccatgtacaacgagaaggaggtgtaccagctatcaataggggcagcttgcaggctcacatggccggtagatcgactgatagtgcaggtgctggacgactccaccgacgccgtcatcaaggagctggtgaagggcgagtgcgagcggtgggccgcggaggggatcaacgtcaagtacgagacgcgcaaggacagggccgggtacaaggccggcaacctcaaggaagggatgcgccacgcctacgtgcgcggctgcgagttcgtcgccatgttcgacgccgacttccagccggcgccggacttcctcgtcaagaccgtcccgttcctcgtccacaacccaagcctcgcgctcgtgcagacgcgctggaagttcgtgaatgccaacgactgcttgctgacgagaatgcaagagatgtccatggactaccatttcaaggtggagcaggaagctggatcttcactctgcaacttctttggctacaacggaactgctggagtatggagaacgcaagcgattgtcgagtccgggggttgggaggaccgaactactgctgaggacatggacttggcactcagagcagggctcttgggctgggaattcgtttacgttgggagcataaaggtcaagaatgagctgccaagtactctcaaggcgtaccggtcccagcagcatcgctggtcatgtggacctgcgctcctgttcaagaaaatgttctgggaaattcttgctgccaagaaagtgtcggtttggaagaagttgtatatcatctatgacttcttcattgcccggaggatcataggcaccttcttcaccttcttctttttcagcgtcctgattcctctttacattctattaccagaagcgcagattcctgtgtgggagctgatctacatccctacagctatcactcttctcaactctgttgggactccaaggtctatccatctgattatactgtgggtcttatttgagaatgtaatggcgttgcatcggtttaaagccatcttgatagggtttttcgaagctgacagggccaatgaatggattgttacacaaaagctggggaacttgcagaagctgaaatcgattgccagtcttacagggaactatcgtttcaaagacagtgacgtgactgtgagagacagccctgcggtcgtcggcgagcccgaggtcgcaccgttcgccggtggaaatcgcgcgtccggggatgcattttgctttgaccgaaccgacgaatcgagagggcaaggcagcgacaacacgcatccgtcaggtcggatggtgcggcacgatgcgtcgccgcatcgccgttcgagatcggcgactgtgacgagtctggacactctggtctctgggttcgcgtgccacggagtttctcgtttcgcgtgctacggcgttagcgccccggcagtacgcgagcggaaagccggaaacggtctgtttggtagcctggttgtttttagcctagccccaattgtaagccagggcacattaggcctagtctacctcgcccaacaggcctctgtttggttggctgggctggacaacagcgacagtgcggttcctgacgcggtcctagagccagagtggtcaggcttgggcattgttcgtatacccaagtgtgctcattctcgccatgcgacgctgaagaaggcaatcggtggcaagcacgtaggccgtcgcttcctggggtgtgcccttcagaatgaggaggagcaatgtcagttcgtcgaatggcttgacgagccctggcctgaaaggattcaggaaagcctaaaggatgtttggaaggctgtcaagcaagccaagcgcaacgaggcaagggtctctgaagcactgcagcgatccttggagaggaatgatactcctactgctcagagggttgttctgcaggaagaagttaataggaccaagaggatggcagagcgtatttgcaggggctatcagaggcaggccattgttgcgaaggtggagaagaacacgctgatgttcctgatgtactgtctggttagggtgatcatcctcctggttgctgctatggtcttcaagactaactga

SEQ ID NO: 17597 - protein, 800 aa, Sorghum bicolor
  misc_feature: Useful for making plants with altered cell wall content and/or composition
  misc_feature: Functional homolog of the protein sequence given in SEQ ID NO 13963
  misc_feature: Useful for making plants with altered carbohydrate content
  misc_feature: Functional homolog of the protein sequence given in SEQ ID NO 13964
  misc_feature: Ceres ANNOT ID no. 8680649
  misc_feature (104)..(350): SWISSPROT Homolog: EC 2.4.1.12 Cellulose synthase (UDP-forming)
  misc_feature (654)..(698): Pfam ID: zf-GRF Pfam Description: GRF zinc finger
MEGGHALRAVGDVVFLGAYGRRLSLSATIAAFVESLLQGWAEVRAGLLVPLLRAAVLLCTAMSVIVLAEKVFLGAVSSVMKLRRRRPSRVYRCDPIARPDKDEEAAAYPMVLVQIPMYNEKEVYQLSIGAACRLTWPVDRLIVQVLDDSTDAVIKELVKGECERWAAEGINVKYETRKDRAGYKAGNLKEGMRHAYVRGCEFVAMFDADFQPAPDFLVKTVPFLVHNPSLALVQTRWKFVNANDCLLTRMQEMSMDYHFKVEQEAGSSLCNFFGYNGTAGVWRTQAIVESGGWEDRTTAEDMDLALRAGLLGWEFVYVGSIKVKNELPSTLKAYRSQQHRWSCGPALLFKKMFWEILAAKKVSVWKKLYIIYDFFIARRIIGTFFTFFFFSVLIPLYILLPEAQIPVWELIYIPTAITLLNSVGTPRSIHLIILWVLFENVMALHRFKAILIGFFEADRANEWIVTQKLGNLQKLKSIASLTGNYRFKDSDVTVRDSPAVVGEPEVAPFAGGNRASGDAFCFDRTDESRGQGSDNTHPSGRMVRHDASPHRRSRSATVTSLDTLVSGFACHGVSRFACYGVSAPAVRERKAGNGLFGSLVVFSLAPIVSQGTLGLVYLAQQASVWLAGLDNSDSAVPDAVLEPEWSGLGIVRIPKCAHSRHATLKKAIGGKHVGRRFLGCALQNEEEQCQFVEWLDEPWPERIQESLKDVWKAVKQAKRNEARVSEALQRSLERNDTPTAQRVVLQEEVNRTKRMAERICRGYQRQAIVAKVEKNTLMFLMYCLVRVIILLVAAMVFKTN

SEQ ID NO: 17598 - DNA, 1722 bp, Sorghum bicolor
  misc_feature: Ceres ANNOT ID no. 8680718
  misc_feature: Encodes the peptide sequence at SEQ ID NO 17599
atgcgatcccctgggccgcgcctcccagcgccggcgcggctcgccgtggctgccctcctcctcgcggctctcaccgggctcgccgtcggcgccgatgggtacgggcgggcgaggaggctgcacatgaagaccaaggtcctggagatgttttaccatgcctatgacaactacatgacttatgcattccctcatgatgaattgaagcctcttactaaaagtttcacggactcgcttagtgagcttggcaacttaaatgattatagtggatccgcattgacactggttgagtcattatccagtcttgttgtcttaggtaacctcacagagtttgagagaggagttctctggctttcagaaaatctgacatttgatgttgatgctcggattaatctttttgagtgtaacataagacttcttggggggcttatttctgctcatattcttgcaaaagactacaacagccagtttaaacatggactgtatcaggatcaattactacatcttgctgaaagtttaggcaatcgttttctaccggcatttgagacacctactggattgccatatgcatggattaatcttaagtatggagtgatggaaaatgaaacaactgaaacaagcacatcagggtgtggttcccttatacttgaaatgggtgtattgtcacgtttgactggtgattctagatatgaagctgcagctcttcgtgctctccgcaagttatggagcatgagaagttcactgaatctagtaggcacaacacttgatgttttaactggcaagtggattgagtattcatctggaattggtgctggtgttgactcattttatgagtatctgattaaagcatatattcttttcggaagcgatgattactgggatatgtttcattcagcttatcttgcagtgcagaagtacttccgacatggtccatggtatcatgaggctgatatgaggactggagaagcaacacactggcagctaactagccttcaggccttctggccaggtcttcagacactgttgggagacgtaactgctgcaaatctatcacaccgtgagttttacaatatatggcaaagatttggtgtgttacctgaaagatatcttttggactatggaatgttgcatcctacagagaagtactatcccttgcgtcctgagtttgctgagtcaacattttatctttatcaagctactaaagatccttggtacctagaagtgggtgaagctattgttggatcacttaattactatactaaagtggatggaggttttgctagtgtcagagatgtttcaacaatgaaacttgaagatcatcagcacagcttctttctttcagaaacgtgcaaatatctttttcttctgtacgacgattcattcttgaggaatcaaaattacatatttacaacagagggacacccccttccaataagaagcacatggcatgagaaatttccagcagcatatgttcccagcaattggacatttgttaaggatgagatccaaccaattcgcgtgagcgcattatcgtctcaagtttgtccggagacaattttccggaaaagcgttggcaccccatgggagagtgcgtgtcatgtaccagatgcacacgctagccacagatgcaggactgatgatgactgtggtatagaagcaataacatgcaagaagaggacctgcagtatggctggctactgcggcttatggctggtgatttattag

SEQ ID NO: 17599 - protein, 573 aa, Sorghum bicolor
  misc_feature: Useful for making plants with altered carbohydrate content
  misc_feature: Functional homolog of the protein sequence given in SEQ ID NO 14011
  misc_feature: Ceres ANNOT ID no. 8680718
  misc_feature: Up-regulated in shoot tissues in response to salicylic acid treatment
  misc_feature (43)..(479): SWISSPROT Homolog: EC 3.2.1.113 Mannosyl-oligosaccharide 1,2-alpha-mannosidase
  misc_feature (49)..(477): Pfam ID: Glyco_hydro_47 Pfam Description: Glycosyl hydrolase family 47
MRSPGPRLPAPARLAVAALLLAALTGLAVGADGYGRARRLHMKTKVLEMFYHAYDNYMTYAFPHDELKPLTKSFTDSLSELGNLNDYSGSALTLVESLSSLVVLGNLTEFERGVLWLSENLTFDVDARINLFECNIRLLGGLISAHILAKDYNSQFKHGLYQDQLLHLAESLGNRFLPAFETPTGLPYAWINLKYGVMENETTETSTSGCGSLILEMGVLSRLTGDSRYEAAALRALRKLWSMRSSLNLVGTTLDVLTGKWIEYSSGIGAGVDSFYEYLIKAYILFGSDDYWDMFHSAYLAVQKYFRHGPWYHEADMRTGEATHWQLTSLQAFWPGLQTLLGDVTAANLSHREFYNIWQRFGVLPERYLLDYGMLHPTEKYYPLRPEFAESTFYLYQATKDPWYLEVGEAIVGSLNYYTKVDGGFASVRDVSTMKLEDHQHSFFLSETCKYLFLLYDDSFLRNQNYIFTTEGHPLPIRSTWHEKFPAAYVPSNWTFVKDEIQPIRVSALSSQVCPETIFRKSVGTPWESACHVPDAHASHRCRTDDDCGIEAITCKKRTCSMAGYCGLWLVIY

SEQ ID NO: 17600 - DNA, 834 bp, Sorghum bicolor
  misc_feature: Ceres ANNOT ID no. 8680709
  misc_feature: Up-regulated in shoot tissues in response to salicylic acid treatment
  misc_feature: Encodes the peptide sequence at SEQ ID NO 17601
atggcgtccagcgcctctcggttcatcaagtgcgtcacggtcggcgacggcgccgtgggcaagacctgtatgcttatctgctacaccagcaacaagttccccactgactacatacctacggtgttcgacaatttcagtgcaaatgtagttgtggatggcaccacggtgaatttgggcctttgggataccgctgggcaggaagattacaaccggctgaggcctctaagctaccgaggtgccgatgttttcgtgcttgcattctcacttgtgagccgagctagctatgagaatatcatgaagaagtggataccggagcttcagcattatgcacctggtgtgcctgttgtgttggtaggcacaaaattggatcttcgtgaagacaagcactacttgatggaccatcctgggttggtgcctgttaccacagcacagggtgaggaacttcgtagacaaattggtgctatgtattacgtcgaatgcagttcaaagacacagcagaatgtcaaagctgtgttcgatgctgccatcaaggtagtaatccagcctccaactaaactaagagaaaagaagaaaaagaaatcacgcaagggatgttcaatggtaggatcagtggatgctgacttcgtttcattgaatatgagaatgcatgcactattgatccatttttggtgcctctgcactctttcaatgcttgatgttgctattaagaaacatcgtggttacctaagttcagttgctcttcaacattccttagctgatgtggaacctcttctgtggaagaaaaatgctatgcttcaagtcctgaatgatctaagagggtcgtacatgaactaa

SEQ ID NO: 17601 - protein, 277 aa, Sorghum bicolor
  misc_feature: Useful for making plants with modulated nitrogen use efficiency
  misc_feature: Functional homolog of the protein sequence given in SEQ ID NO 13110
  misc_feature: Ceres ANNOT ID no. 8680709
  misc_feature (10)..(181): Pfam ID: Ras Pfam Description: Ras family
  misc_feature (10)..(123): Pfam ID: Miro Pfam Description: Miro-like protein
MASSASRFIKCVTVGDGAVGKTCMLICYTSNKFPTDYIPTVFDNFSANVVVDGTTVNLGLWDTAGQEDYNRLRPLSYRGADVFVLAFSLVSRASYENIMKKWIPELQHYAPGVPVVLVGTKLDLREDKHYLMDHPGLVPVTTAQGEELRRQIGAMYYVECSSKTQQNVKAVFDAAIKVVIQPPTKLREKKKKKSRKGCSMVGSVDADFVSLNMRMHALLIHFWCLCTLSMLDVAIKKHRGYLSSVALQHSLADVEPLLWKKNAMLQVLNDLRGSYMN

SEQ ID NO: 17602 - DNA, 1074 bp, Sorghum bicolor
  misc_feature: Ceres ANNOT ID no. 8680719
  misc_feature: Encodes the peptide sequence at SEQ ID NO 17603
atgcgcctgtccctcctcctcctcctcgtggccgccctcacggcgcgcgccgcggcacagctgccggcgccggcgggcggcggcgctctgaagccagacttctacagccagtcgtgcccgcgcgcggagcggatcatcgcggaggtgatgcagacgaagcagatggcgaacccgacgacggccgcgggcgtgctccgcgtcttcttccacgactgcttcgtcagcgggtgcgacgcgtcggtgctgatcgcgtccacccagttccagaagtcggagcacgacgcggagatcaaccactccctccccggcgacgccttcgacgccgtggtgcgcgccaagctggccctggagctggagtgccccggggtggtgtcctgcgccgacatcctcgcgctggcgtcgggcgtgctggtcaccatgaccggcggcccccgctacccgatcccgctgggccgcagggactcgctgtcgtcgtcgcccacggcgcccgacatcgagcttccccactccaacttcaccatggaccgcctcatccagatgttcggcgccaagggcttcacggtgcaggagctggtggcgctgtcgggcgcccacacgctgggcttctcccactgcaacgagttcgccaaccggctctacaacttccgcaaccagggcgggaagccggagccgttcgaccccagcatgaacccgtcctacgccagggggctgcaggacgtgtgcaagaactacctcaaggaccccaccatcgccgccttcaacgacatcatgacgccaggcaagttcgacaacatgtacttcgtcaacctggagcggggcctcggcctgctcagcaccgacgaggagctgtggacggacccgcgcaccaagcccctcgtgcagctctacgcctccaaccccgcagccttcttcaccgacttcggccgcgccatggagaagctcagcttgtacggcgtcaagacaggcgccgacggcgaggtcaggcggcgctgcgacgcctacaacagcggacccgccatccccggcgccctcggcggcggcggcgccatgcccatgcccatgcccaagatgtaa

SEQ ID NO: 17603 - protein, 357 aa, Sorghum bicolor
  misc_feature: Useful for making plants with altered cell wall content and/or composition
  misc_feature: Functional homolog of the protein sequence given in SEQ ID NO 14557
  misc_feature: Useful for making plants with altered carbohydrate content
  misc_feature: Functional homolog of the protein sequence given in SEQ ID NO 13617
  misc_feature: Ceres ANNOT ID no. 8680719
  misc_feature (33)..(336): SWISSPROT Homolog: EC 1.11.1.7 Peroxidase
  misc_feature (46)..(299): Pfam ID: peroxidase Pfam Description: Peroxidase
MRLSLLLLLVAALTARAAAQLPAPAGGGALKPDFYSQSCPRAERIIAEVMQTKQMANPTTAAGVLRVFFHDCFVSGCDASVLIASTQFQKSEHDAEINHSLPGDAFDAVVRAKLALELECPGVVSCADILALASGVLVTMTGGPRYPIPLGRRDSLSSSPTAPDIELPHSNFTMDRLIQMFGAKGFTVQELVALSGAHTLGFSHCNEFANRLYNFRNQGGKPEPFDPSMNPSYARGLQDVCKNYLKDPTIAAFNDIMTPGKFDNMYFVNLERGLGLLSTDEELWTDPRTKPLVQLYASNPAAFFTDFGRAMEKLSLYGVKTGADGEVRRRCDAYNSGPAIPGALGGGGAMPMPMPKM

SEQ ID NO: 17604 - DNA, 1608 bp, Sorghum bicolor
  misc_feature: Ceres ANNOT ID no. 8680756
  misc_feature: Encodes the peptide sequence at SEQ ID NO 17605
atgagtagcgccgccgcgaccgcgacgtcgtgtcaccgcctcggggtcgcgctgccgctcttgctgctgcttgctgctgccgcggttctgggtggagccgaggggaaggcgcacagctacgaggacgcgctgcagaagagcctgctctacttcgaggcgcagcgctcgggccgcctcccgcacagccagcgcgtcgcctggcgccaccactccggcctcaccgacggcctcgagcaaggggtggacttggtggggggatactacgacgccggcgaccatgtcaagttcggcctgcccatggcgttcaccgtgacgatgctgtcgtggagcctgatcgagtacggcggcgacgtcgcggacgccggagagctcggccacgcgctcgaggccgtcaagtggggcaccgactacttcatcaaggcgcacaccaggcccgatgagctgtgggctgaggtgggcgacggcgacacggaccactactgctggcagcggccggaggacatgacgacgtcgcggcaggcgtacaaggtggaccgggaccacccaggctccgacgtcgccggcgagaccgcggcggccatggccgccgcgtccatcgtcttccgcgactccaacccgcactacgcgcaccttctcctgcaccacgcccagcagctgttcgagttcgccgacaagtacaggggcaaatacgacagcagcatcgcggaggtgaagagctactacgcgtcggtgagcgggtacaaggacgagctcctgtgggccgccctgtggctccaccgcgccaccggcagagctgactacctcgactacgtcgtcgacaacgccgacagcttcggcggcaccggctgggccatcaacgagttcagctgggacgtcaagtacgccggcgtccagatcatagcagcaaggttgctgctgagaggggagcacgcgacgcgccaccggagcacgctggagcggtacagggcgaaggcggagcgctacgtgtgcgcgtgcctgggccggaacacggaaggcggcgcggacgccaacgtggagcgcagccccggcgggatgctctacatccggcagtggaacaacatgcagtacgtgaccagcgccgcgttcctgctctccgtctactcagactacctggccgaggccggcgccccgaccgtgtcgtgcgcgggcggcgagaccgtggcggccgaggaggtgttcgcgctcgccagggcgcaggtggactacgtgctgggcaccaaccccaggggcgtcagctacctcgtcggctacggctccaagtaccccaaccgggtgcaccaccgcgccgcgtccatcgtgccgtacaagcacagcaaggagttcatcggctgcacgcaggggtttgaccactggttcggcaggcggagctccaacccgaacgtgctcgtcggcgcgatcgtcggcgggccggaccggcaggacaggttcagggacaaccgggagaactacatgcagacggaggcctgcacgtacaacacggccccgatggtcggcatgttcgccaagctgcaccggatggcgcggcaggagcgggaacacgggtcgccggcgccggtgcccgtgacgtccactgcggctgaggtgtaa

SEQ ID NO: 17605 - protein, 535 aa, Sorghum bicolor
  misc_feature: Useful for making plants with altered carbohydrate content
  misc_feature: Functional homolog of the protein sequence given in SEQ ID NO 13874
  misc_feature: Useful for making plants with altered cell wall content and/or composition
  misc_feature: Useful for making plants with altered lignin content
  misc_feature: Functional homolog of the protein sequence given in SEQ ID NO 13875
  misc_feature: Ceres ANNOT ID no. 8680756
  misc_feature (34)..(535): SWISSPROT Homolog: EC 3.2.1.4 Cellulase
  misc_feature (39)..(508): Pfam ID: Glyco_hydro_9 Pfam Description: Glycosyl hydrolase family 9
MSSAAATATSCHRLGVALPLLLLLAAAAVLGGAEGKAHSYEDALQKSLLYFEAQRSGRLPHSQRVAWRHHSGLTDGLEQGVDLVGGYYDAGDHVKFGLPMAFTVTMLSWSLIEYGGDVADAGELGHALEAVKWGTDYFIKAHTRPDELWAEVGDGDTDHYCWQRPEDMTTSRQAYKVDRDHPGSDVAGETAAAMAAASIVFRDSNPHYAHLLLHHAQQLFEFADKYRGKYDSSIAEVKSYYASVSGYKDELLWAALWLHRATGRADYLDYVVDNADSFGGTGWAINEFSWDVKYAGVQIIAARLLLRGEHATRHRSTLERYRAKAERYVCACLGRNTEGGADANVERSPGGMLYIRQWNNMQYVTSAAFLLSVYSDYLAEAGAPTVSCAGGETVAAEEVFALARAQVDYVLGTNPRGVSYLVGYGSKYPNRVHHRAASIVPYKHSKEFIGCTQGFDHWFGRRSSNPNVLVGAIVGGPDRQDRFRDNRENYMQTEACTYNTAPMVGMFAKLHRMARQEREHGSPAPVPVTSTAAEV

SEQ ID NO: 17606 - DNA, 2901 bp, Sorghum bicolor
  misc_feature: Ceres ANNOT ID no. 8680761
  misc_feature: Encodes the peptide sequence at SEQ ID NO 17607
atggcgggcaagtactccggggcgaggacgaacaggaggtggagggggctggcagcggccgcgtgggtgctaatcgcggtggccggcgccgcggtgatgcactggacccagcgccggcagagcatggaccgcgccgaggagcgcctcgtcagcatgtgcgaggagagggccaggatgctgcaggagcagtttggagtcaccgtcaaccacgtccacgcgatcgccattctcatcgccaccttcaactacgagaagtcccctccagccatcgacccggacacttttgcaacatacacggcaaggacatcatttgagcgacccctgctgaatggggtggcatacgcacagcgtgtcttccatcatgagagggaaatgtttgaaagccagcagggatggattatgaatacgatgcagcgggagcctgcacctccccgggatgaatacgccccagtgattttctctcaggatacagtttcctaccttgcacgcattgacatgatgtctggggaggaggaccaagaaaacattttgcgggccaggactactggcaaagctgtgttaacaaacccattccgtttgcttggatcaaaccacttgggagtagttctcacttttgctgtgtaccgccctgatctccctgctgatgcatcagttgagcaacgtgtggaagcaactattggatatcttggtggaggattcgatgtggagtcacttgtggaaaatttgctaagcaaacttgctggcaatcaggatattgtggttaatgtctatgatgtcacaaatgcttcagagcctatggctttgtatggaccttcaattttggatgaacaagtgcctttgcatgttagcatgttggattttggagatccatttaggaggcatgaaatgaggtgcaggtatagacaaaagcctcctataccgtggtctaccataaccaatcctttaggcttatttgtcatatggatgcttctggggtatagcattgccgctgcatattctagatatgacaaagttacagaagattgtagaaagatggaagagctaaaaactcaggcagaagctgctgatgttgcaaagtctcagttcctggcaactgtctcacatgagatcagaacacctatgaatggcgtccttggaacagatttaactatgacacagaaggattatgctcaaactgctcaaatgtgtggcagagcattgataacactgataaatgatgtgcttgatcgagcaaagattgaagctggaaagttagagcttgaagcggtgccttttgacctgcgttctctcatggatgatgttatttccttgttttcttcaaagtcacgagagaagtgcattgagcttgcagtatttgtatgtgacgatgttccgaaggttgttcttggagatccttggaggtttcgacagatactgacaaatttggtcgggaatgcagtcaaattcacggaaagaggtcatgtatttgtgcgggtctgtttggctgagaactcaaatatggaagctaatcaggtcctacatggaaccatgaatgggaaagatggtaaagttgagtcaacaactaatggcgccttcaatactttgagtgggtttgaagcggcagacagacggaatagttggcaatattttaagctgctcctctctaataaggagtcacttttggatgatcttgagggcgaaaattctaatctaagtgattcagaccatgtcacactagcgataagtattgaggacacaggtgttgggataccattgcaagcacaggatcgtgtgtttacaccttttatgcaggctgatagttcaacttcaaggaattatggtggtactggcattggtctaagtatcagcaagtgtctagctgaacttatgggtgggcagataagtttcaccagccgtccttttgttggaagcacattcacattctcagccacgctgaagcgctcatacaaagatatttcagttgattcaagtaggagcttgtcagaggcactaccaactgcttttaagggaatgaaggccatcttgatagatgggagacctgtacgtagtgctgttacaaaatatcacctcaagaggttgggaataattgttcaagttgtgaacaatatgagtacagtagtaaaagctttccctggacaaaatggagcgaccgtttctagggaaaaggcaaccatgctttttattgagagtgacttctggaggcctgaaacagatgttcaattattgaaccatctacgcgagcacaagaatggtctgttgtctgatgcgcctaaggtagttcttttggtcacctctgaagctgacaaggacaattatggatctatatttgatattgtgatgtgtaagcctataagggcaagcacaattgcttcatctattcaacaactgctcaaagtagagatgcccaaaagaaaagaaaatcaaaatcggccatcgtttcttcgtagcttgctggttgggaagaacatattggtcgtagatgataataaagtcaatctcagagttgctgcagctgcactaaagaagtacggtgctaatgttagctgtgttgaaagtggcaaggatgctatcagtctacttcaacccccacattcctttcatgcatgttttatggatgttcagatgccagagatggatgggtttgaggcaaccagacaaataaggcaaatggagatgaaagctaatgaggaaaggaagaacaagttgtctttgactgaagcctcgacatttgttgagtaccgtttgcctgttctggcaatgacagccgatgttatccaggcaacttatgaagagtgtataaaatcgggtatggatggatatgtatctaaacccttcgacgaggagcagctatgccaagtagtctccagattagtagtggaaacgacggattcagctgtttaa

SEQ ID NO: 17607 - protein, 966 aa, Sorghum bicolor
  misc_feature: The sequence is a functional homolog of SEQ ID NO 5 in US patent 7026530
  misc_feature: Ceres ANNOT ID no. 8680761
  misc_feature (318)..(502): SWISSPROT Homolog: EC 2.7.13.3 Histidine kinase
  misc_feature (86)..(297): Pfam ID: CHASE Pfam Description: CHASE domain
  misc_feature (463)..(646): Pfam ID: HATPase_c Pfam Description: Histidine kinase-, DNA gyrase B-, and HSP90-like ATPase
  misc_feature (821)..(955): Pfam ID: Response_reg Pfam Description: Response regulator receiver domain
  misc_feature (358)..(416): Pfam ID: HisKA Pfam Description: His Kinase A (phosphoacceptor) domain
MAGKYSGARTNRRWRGLAAAAWVLIAVAGAAVMHWTQRRQSMDRAEERLVSMCEERARMLQEQFGVTVNHVHAIAILIATFNYEKSPPAIDPDTFATYTARTSFERPLLNGVAYAQRVFHHEREMFESQQGWIMNTMQREPAPPRDEYAPVIFSQDTVSYLARIDMMSGEEDQENILRARTTGKAVLTNPFRLLGSNHLGVVLTFAVYRPDLPADASVEQRVEATIGYLGGGFDVESLVENLLSKLAGNQDIVVNVYDVTNASEPMALYGPSILDEQVPLHVSMLDFGDPFRRHEMRCRYRQKPPIPWSTITNPLGLFVIWMLLGYSIAAAYSRYDKVTEDCRKMEELKTQAEAADVAKSQFLATVSHEIRTPMNGVLGTDLTMTQKDYAQTAQMCGRALITLINDVLDRAKIEAGKLELEAVPFDLRSLMDDVISLFSSKSREKCIELAVFVCDDVPKVVLGDPWRFRQILTNLVGNAVKFTERGHVFVRVCLAENSNMEANQVLHGTMNGKDGKVESTTNGAFNTLSGFEAADRRNSWQYFKLLLSNKESLLDDLEGENSNLSDSDHVTLAISIEDTGVGIPLQAQDRVFTPFMQADSSTSRNYGGTGIGLSISKCLAELMGGQISFTSRPFVGSTFTFSATLKRSYKDISVDSSRSLSEALPTAFKGMKAILIDGRPVRSAVTKYHLKRLGIIVQVVNNMSTVVKAFPGQNGATVSREKATMLFIESDFWRPETDVQLLNHLREHKNGLLSDAPKVVLLVTSEADKDNYGSIFDIVMCKPIRASTIASSIQQLLKVEMPKRKENQNRPSFLRSLLVGKNILVVDDNKVNLRVAAAALKKYGANVSCVESGKDAISLLQPPHSFHACFMDVQMPEMDGFEATRQIRQMEMKANEERKNKLSLTEASTFVEYRLPVLAMTADVIQATYEECIKSGMDGYVSKPFDEEQLCQVVSRLVVETTDSAV

SEQ ID NO: 17608 - DNA, 3486 bp, Sorghum bicolor
  misc_feature: Ceres ANNOT ID no. 8680787
  misc_feature: Encodes the peptide sequence at SEQ ID NO 17609
atggttggcagaactattcaggtccatggttttgctctaactgacagtgccgagtctgtcaaagaatttttggagcggatttctggtgctggaaccatctatgctctcaagctcaggcatccaaggaacatctctgccaactcaagggcgtttgctatagttcagttccagtcacaggaaagtgcttcattggtagaagatgtggttcaaagaaatgctccccggattggacgattttatctgaaaaccagacctgcagaccgggacattgttccaagaccaagaattccaatgttttctctggaggacactgtgctgcatttgggatgcttggttaaggaaaatattctatctgctctttttactgcaagtaatgtttcagttcaatttggatttgatatgaaaaagatttacttctacctctcctacaactttattaaatataaacttgaactttcttacgaaagtatatgggagatacagcttcaccgtccacctgcttataggtcacggacaaagttccttttgattcaggttcaggcagctcctaaaatttatgaactgctcccacgccgtccaggtcttatgtatgaggatcctttcttcaactggtttatggatgacacagatgaacaatggaccaggacgattgattttactccatcagttagcatcgggcaatcatctattttctgtctggaggtgccacagcagtgtgagctcccaagaattggtgactactttgtttactataaagagcgaaatcttgactttgaatgtcggaatgggtattcatattcctgtggtaattgcctcgttccaattgtaaaatctcctgattacatagaggtcccttatgagatactcttcaaaataaaccatttggttcagaatgggacactcagtgggccaacagttgatcacagtttcttctgtcatgttagcccagaatttgaacctattgatcatataaagcgagcacttttaaagatgtcatatttgaaaagcacctgcttgaatccaacaaattggttatctgtacaatactcaagaatacggagatcgcgccatgcatcacaaagatcatctaatatatctctggatgatggcttggtctatgtccacagggttcaagttacccctgctaaagtgtatttttatggacctgagataaatgtctccaatcgtgttgtgcggaatttctctgctgacatagataacttccttcggatttcatttgttgatgaggactgtgagaagctccgttcacttgatttgtcacctcgttctacttctggaaatgatgcaaggagaactgctctatataatagagttttgtcagtcctttcaaatggcattaatattggtgacaagcactttgagtttcttgctttttcttcaagccagcttcgagataactctgcatggatgtttgcttctcggcagggattgactgcgagtgacataaggaagtggatgggagactttcgagatatcagaaatgtggcaaagtatgctgcaagacttgggcaatcttttagttcctcaacagaaactttaatagtacgcaagcatgaggtggaacaaattcctgatattaaaaatggcacaaactacatattctctgatggagttggaaagatctcagctaattttgcaaaggaggtggctatgaagtgcaaattgagacgctttgccccttcggttttccagataaggtatggtggttacaaaggtgttgtcgctgtagatccaagatcaaatcgtaagctttcattgagaagaagcatgttaaagttccagtcagaaaatatcactcttgatgtccttgcgtacagcaagtaccaaccgtgcttcctgaatcggcagttgattactcttctctcaacacttggggttggtgataatgtctttgaactaaagcagaaggaagccattaagcagttgaacagaatggtaactgaaccacaggctgctcgtgaagcagttgaacttatgcccatgggagaagtaaccaatgtagttaaagaattgttgtcatgtggctaccagcctgatcatgagccgtatctttccatgctgctacaaacttttagagcatccaagcttctagaattgaaaacaaagtcaaggatattcatcacacaagggcgagcaatgatgggttgcttggatgaaacccgcacactaaagtatggccaggtattcatccaagcttcttactgtgcagatgaccatcacaagatcgttgtaactggaaaagtagttgttgccaaaaatccttgtctccaccctggtgacatacgggttctccaggctgtagatgttccttctctgcaccacatgtttgattgtgttgtctttccacagcagggaccaaggccgcatcctaatgagtgttcagggagcgatcttgatggggacatatattttgtttcttgggatcccgatcttattccaagtcatatggaggatcctatggactacactccagctccagcagaaacattagatcatgatgttactattgaggaaatacaggagtacttcacaaactacatagttaatgagagtcttggcattatcgccaatgcgcatgtggtctatgcagataaggaagatctgaaggctaagagtcgaccatgccttgaactggccaagctcttctctatagctgttgatttcccaaagactggagtgccggctctgattccacctgaattacatgtcaaggagtatcctgattttatggagaagctcgacaaagcaacctatgaatcaaagggtgtgatcgggaagctctacagggaaataaagaagcacacaccgcacataaggcactttacgagggaagtggcaaagcggtcttatgacaccgatttgattgttgatggctatgaagactacattactgaggctatagagttcaaggaagagtacgatttcaggctgggtaatcttatggatcactatggaataaaaagtgaagcggagataataagtggatgttttctgaagatggcaaagaatttcaccaagagtagtgatgctgatgcaattagaatggcggtgagatctttgaggaaagaagctaggtcatggttcaatgagatgagcacaagcgaggatgaccaagatgccacagaggccaaggcgtctgcttggtaccatgttacttatgatccacagtactggggcaactacaatgaaggatatgatcggccgcatcttattagctttccatggtgcgtatatgacaagcttgtgatcattaagcagaggaggaatttcttcacgcagatggatcctaatctggtgtctcccatgaataacatgagattgcatgagcattgccagcagcaacttcgtttggttgccagttatgccatacatcctgttcagttacggatttacaaggtttgcgctgagctgcatggaagaccacgaacaacaagtctatttcttccattaccaagagtgaagtga

SEQ ID NO: 17609 - protein, 1161 aa, Sorghum bicolor
  misc_feature: The sequence is a functional homolog of SEQ ID NO 6 in US patent 7060813
  misc_feature: Ceres ANNOT ID no. 8680787
  misc_feature: Down-regulated in shoot tissues in response to salicylic acid treatment
  misc_feature (372)..(731): SWISSPROT Homolog: EC 2.7.7.48 RNA-directed RNA polymerase
  misc_feature (529)..(900): Pfam ID: RdRP Pfam Description: RNA dependent RNA polymerase
MVGRTIQVHGFALTDSAESVKEFLERISGAGTIYALKLRHPRNISANSRAFAIVQFQSQESASLVEDVVQRNAPRIGRFYLKTRPADRDIVPRPRIPMFSLEDTVLHLGCLVKENILSALFTASNVSVQFGFDMKKIYFYLSYNFIKYKLELSYESIWEIQLHRPPAYRSRTKFLLIQVQAAPKIYELLPRRPGLMYEDPFFNWFMDDTDEQWTRTIDFTPSVSIGQSSIFCLEVPQQCELPRIGDYFVYYKERNLDFECRNGYSYSCGNCLVPIVKSPDYIEVPYEILFKINHLVQNGTLSGPTVDHSFFCHVSPEFEPIDHIKRALLKMSYLKSTCLNPTNWLSVQYSRIRRSRHASQRSSNISLDDGLVYVHRVQVTPAKVYFYGPEINVSNRVVRNFSADIDNFLRISFVDEDCEKLRSLDLSPRSTSGNDARRTALYNRVLSVLSNGINIGDKHFEFLAFSSSQLRDNSAWMFASRQGLTASDIRKWMGDFRDIRNVAKYAARLGQSFSSSTETLIVRKHEVEQIPDIKNGTNYIFSDGVGKISANFAKEVAMKCKLRRFAPSVFQIRYGGYKGVVAVDPRSNRKLSLRRSMLKFQSENITLDVLAYSKYQPCFLNRQLITLLSTLGVGDNVFELKQKEAIKQLNRMVTEPQAAREAVELMPMGEVTNVVKELLSCGYQPDHEPYLSMLLQTFRASKLLELKTKSRIFITQGRAMMGCLDETRTLKYGQVFIQASYCADDHHKIVVTGKVVVAKNPCLHPGDIRVLQAVDVPSLHHMFDCVVFPQQGPRPHPNECSGSDLDGDIYFVSWDPDLIPSHMEDPMDYTPAPAETLDHDVTIEEIQEYFTNYIVNESLGIIANAHVVYADKEDLKAKSRPCLELAKLFSIAVDFPKTGVPALIPPELHVKEYPDFMEKLDKATYESKGVIGKLYREIKKHTPHIRHFTREVAKRSYDTDLIVDGYEDYITEAIEFKEEYDFRLGNLMDHYGIKSEAEIISGCFLKMAKNFTKSSDADAIRMAVRSLRKEARSWFNEMSTSEDDQDATEAKASAWYHVTYDPQYWGNYNEGYDRPHLISFPWCVYDKLVIIKQRRNFFTQMDPNLVSPMNNMRLHEHCQQQLRLVASYAIHPVQLRIYKVCAELHGRPRTTSLFLPLPRVK

SEQ ID NO: 17610 - DNA, 1590 bp, Sorghum bicolor
  misc_feature: Ceres ANNOT ID no. 8680795
  misc_feature: Down-regulated in shoot tissues in response to salicylic acid treatment
  misc_feature: Encodes the peptide sequence at SEQ ID NO 17611
atggatctccccccgctctcgcaccaggcgctcttcgccgccgtccgatccgccgacgcggccgccgtccgcgcgctcctggccgacgccgaggcgccgggctcgggcacctccctggccgcgctcgccgccgcgcagacggacgccggagagaccgcgctgtacgtcgccgcggaggccggcagcgaggaggtcgtgcgcctcctcctcccgctctacgacttcgaggccgccaccgtccgctcacgcctcgacctcgacgccttccatgtcgccgccaagcagggccataccggggttgtgaaagagttcttggggcggtggccagggctttgctcagtctgtgactcctccaacactagtcccctctactccgctgctgtcaaggatcacttggatgtggtaaatgctatactggacactgatgatagctgcataaggattgtgcggaaaaatgggaagacatcactacatactgccgcaagaattggataccatcgtattgtcaaagcactcatagagagggatccaggaatcgttccgatcaaggataggaagggacaaactgcccttcacatggctgtgaaggggaaaaatacagatgtagtggaagagttactgatggctgatgtttccattctcaatgtgcgtgacaagaaaggaaatactgccttgcacatagctacacggaaatggaggccccagatggtacagcttcttcttagctatgatgaaacacttgaagttaatgctatcaatagtcaaaatgaaacagctatggatttggctgacaaagttccttatggtgagtccaaaacggaaataatagagtggctgacagaggctggtgcaaagaatgccagaaatgtggggaaaattgatgaggcatcagaactgaggagaactgtgagtgatatcaagcacaatgtgcaggcacagcttagcgagaatgctaagaccaataaacgagtgaccgggattcgcaaagaattgcagaaactgcatagagaagctattcagaacactataaattcagtcaccatggtagcaaccctgattgcctccattgccttcgttgccatattcaatttgccaggtcaatacttccaagatgtgaatagtgggggagacattggtgaggctcacatagccaagcttactggttttcggctcttctgccttctgaatgccactgctctcttcatttctctcgcggtggtcgttgtgcagatcaccttggttgcctgggaaactggtgcccagaagcaaattatcaagatcgtaaataagctcatgtggacggcatgccttagcacaggtgcggcttttatctcgctggcctatgttgtagttggcccgcagcatgcgtggatggccttcacagtatcagccataggaggaccgatcatgattggaaccctcctgttcctagcctatctgctgttgcgcccacggttcaagtttggcgaagacagacagcgccgcatcaagagggcaagtggcagcaagtccttctcctggtcactccatgatggtttttcagatctagaagccttctctgatcatgagaagaagatctatgccctgtag

SEQ ID NO: 17611 - protein, 529 aa, Sorghum bicolor
  misc_feature: The sequence is a functional homolog of SEQ ID NO 340 in the 10/666,642 US patent application
  misc_feature: Ceres ANNOT ID no. 8680795
  misc_feature (55)..(255): SWISSPROT Homolog: EC 2.7.11.1 Non-specific serine/threonine protein kinase
  misc_feature (186)..(216): Pfam ID: Ank Pfam Description: Ankyrin repeat
MDLPPLSHQALFAAVRSADAAAVRALLADAEAPGSGTSLAALAAAQTDAGETALYVAAEAGSEEVVRLLLPLYDFEAATVRSRLDLDAFHVAAKQGHTGVVKEFLGRWPGLCSVCDSSNTSPLYSAAVKDHLDVVNAILDTDDSCIRIVRKNGKTSLHTAARIGYHRIVKALIERDPGIVPIKDRKGQTALHMAVKGKNTDVVEELLMADVSILNVRDKKGNTALHIATRKWRPQMVQLLLSYDETLEVNAINSQNETAMDLADKVPYGESKTEIIEWLTEAGAKNARNVGKIDEASELRRTVSDIKHNVQAQLSENAKTNKRVTGIRKELQKLHREAIQNTINSVTMVATLIASIAFVAIFNLPGQYFQDVNSGGDIGEAHIAKLTGFRLFCLLNATALFISLAVVVVQITLVAWETGAQKQIIKIVNKLMWTACLSTGAAFISLAYVVVGPQHAWMAFTVSAIGGPIMIGTLLFLAYLLLRPRFKFGEDRQRRIKRASGSKSFSWSLHDGFSDLEAFSDHEKKIYAL

SEQ ID NO: 17612 - DNA, 1071 bp, Sorghum bicolor
  misc_feature: Ceres ANNOT ID no. 8680798
  misc_feature: Encodes the peptide sequence at SEQ ID NO 17613
atggcctccctcaccgacctcgtcaacctcagcctctcggacaccaccgagaagatcatcgccgagtacatatggatcggtggatctggcatggatctcaggagcaaagccaggaccctctccggcccggtgaccgatcccagcaagctgcccaagtggaactacgacggctccagcaccggccaggcccccggcgaggacagtgaggtcatcctgtacccgcaggctatcttcaaggacccattccggaggggcaacaacatccttgtcatgtgcgattgctacaccccagctggcgagccaattcccaccaacaagaggcacaacgccgccaagatcttcagcaaccctgaggtcgctgctgaggagccctggtacggtattgagcaggagtacaccctccttcagaaggacaccaactggccccttgggtggcctcttggtggcttccctggccctcagggtccttactactgtggaatcggtgcggacaagtcattcgggcgtgacatagttgatgcccactacaaggcttgcatttatgcaggcatcaacatcagtggcatcaacggagaggtcatgccagggcagtgggaattccaagttggaccgtccgtcggcatttcttcaggtgatcaggtctgggttgctcgctacattcttgagaggatcaccgagatcgccggtgtggtgttgacattcgacccaaagcccatccctggtgactggaacggtgccggcgcacacaccaactacagcaccaagtccatgaggaacgagggcgggtacgaggtgatcaaggccgccattgagaagctgaagttgcggcacaaggagcacatcgcggcctacggcgagggcaacgagcgccgcctcaccggcaggcacgagaccgccgacatcaacaccttcagctggggagtggcaaaccgtggcgcgtcagtgcgcgtgggccgggagacggagcagaacggcaagggctacttcgaggaccgccggccggcgtccaacatggacccatacgtggtgacctccatgatcgccgacaccaccatcctctggaagccctga

SEQ ID NO: 17613 - protein, 356 aa, Sorghum bicolor
  misc_feature: Useful for making plants with modulated water use efficiency
  misc_feature: Functional homolog of the protein sequence given in SEQ ID NO 13877
  misc_feature: Ceres ANNOT ID no. 8680798
  misc_feature: Down-regulated in root tissues in response to methyl jasmonate treatment
  misc_feature (1)..(356): SWISSPROT Homolog: EC 6.3.1.2 Glutamate--ammonia ligase
  misc_feature (103)..(355): Pfam ID: Gln-synt_C Pfam Description: Glutamine synthetase, catalytic domain
  misc_feature (17)..(97): Pfam ID: Gln-synt_N Pfam Description: Glutamine synthetase, beta-Grasp domain
MASLTDLVNLSLSDTTEKIIAEYIWIGGSGMDLRSKARTLSGPVTDPSKLPKWNYDGSSTGQAPGEDSEVILYPQAIFKDPFRRGNNILVMCDCYTPAGEPIPTNKRHNAAKIFSNPEVAAEEPWYGIEQEYTLLQKDTNWPLGWPLGGFPGPQGPYYCGIGADKSFGRDIVDAHYKACIYAGINISGINGEVMPGQWEFQVGPSVGISSGDQVWVARYILERITEIAGVVLTFDPKPIPGDWNGAGAHTNYSTKSMRNEGGYEVIKAAIEKLKLRHKEHIAAYGEGNERRLTGRHETADINTFSWGVANRGASVRVGRETEQNGKGYFEDRRPASNMDPYVVTSMIADTTILWKP

SEQ ID NO: 17614 - DNA, 1656 bp, Sorghum bicolor
  misc_feature: Ceres ANNOT ID no. 8680849
  misc_feature: Down-regulated in root tissues in response to methyl jasmonate treatment
  misc_feature: Encodes the peptide sequence at SEQ ID NO 17615
atggctgcaaggagggctgcttcctccgtcctctctcgcttcctcctcacaaggccttcgccttcgccttcgcctgcttctgctgcttctcccgccggcaaatccgccctcctaggagcagggggccctcttcacaggttcagcactgcaccggcagccgctgctgccaccgcagaggagccaatccagcccgccgtggaggtgaagcacacccagctcctcatcaatggcaacttcgttgacgccgcttctgggaagacgttcccgacgctggacccccgcaccggcgaggtcatcgcgcgcgtcgccgagggcgacagcgaggacatcgaccgcgccgtcgccgccgcccgcagggccttcgacgagggcccgtggccgaggatgaccgcctacgagcggtgccgggtgctgctgcgcttcgcggacctgatcgagcggcacgcggaggagatcgcggcgctggagacgtgggacaacgggaagacgctggcgcaggcggcgggcgccgaggtgcccatggtggcgcggtgcatccggtactacgccgggtgggcggacaagatccacggcctggtggtgccgggcgacggcgcgcaccacgtgcaggtgctgcacgagcccgtcggcgtggccgggcagatcatcccctggaacttcccgctgctcatgttcgcctggaaggtcggcccggcgctggcctgcggcaacaccgtcgtcctcaagaccgccgagcagacgccgctctccgcgctctacgtcgccaacctcctccacgaggctgggctccccgagggcgttctgaacgtcgtgtccggcttcggtccgacggccggcgccgcgctctgtagccacatgggtgttgacaagcttgcgttcacgggatcgacgggcacggggcagatcgtgctcgaactggcggcgaggagcaacctgaagccggtgacgctggagctcggtggcaagtcccctttcgtcgtcatggacgacgccgacgtcgaccaggccgtcgagctcgcgcaccaagcggtcttcttcaaccagggccaatgctgctgcgccgggtcgcggacgttcgtgcacgagcgcgtgtacgacgagttcgtggagaagtccaaggcccgcgccctgaagcgcgtggtcggcgaccccttcaggaacggggtcgaacaggggcctcagatcgacggcgatcagttcaacaagatcttgcggtacgtccagtccggtgtcgacagcggcgccaccctcgtcaccggcggcgacagggtaggcagcaggggcttctacatacagccgacggtgtttgccgacgccaaggacgacatgaagatcgctcgggaggagatattcgggccggtgcagaccatcctcaagttcagcggcatggaggaggtgatccggcgcgcgaacgcgacgcactacgggctggcggcgggggtgttcacgcggagcctggacgcggccaacacgctgtcccgggcgctgcgggcgggcacggtgtgggtgaactgctacgacgtgttcgacgccaccatcccgttcggcggctacaagatgagcggcgtcgggcgagagaagggcgtctacgccctccgcaactacctccagaccaaggccgtcgtcacgcccatcaaggaccccgcctggctgtaa

SEQ ID NO: 17615 - protein, 551 aa, Sorghum bicolor
  misc_feature: Useful for making plants with altered carbohydrate content
  misc_feature: Functional homolog of the protein sequence given in SEQ ID NO 13916
  misc_feature: Ceres ANNOT ID no. 8680849
  misc_feature (62)..(551): SWISSPROT Homolog: EC 1.2.1.3 Aldehyde dehydrogenase (NAD(+))
  misc_feature (79)..(541): Pfam ID: Aldedh Pfam Description: Aldehyde dehydrogenase family
MAARRAASSVLSRFLLTRPSPSPSPASAASPAGKSALLGAGGPLHRFSTAPAAAAATAEEPIQPAVEVKHTQLLINGNFVDAASGKTFPTLDPRTGEVIARVAEGDSEDIDRAVAAARRAFDEGPWPRMTAYERCRVLLRFADLIERHAEEIAALETWDNGKTLAQAAGAEVPMVARCIRYYAGWADKIHGLVVPGDGAHHVQVLHEPVGVAGQIIPWNFPLLMFAWKVGPALACGNTVVLKTAEQTPLSALYVANLLHEAGLPEGVLNVVSGFGPTAGAALCSHMGVDKLAFTGSTGTGQIVLELAARSNLKPVTLELGGKSPFVVMDDADVDQAVELAHQAVFFNQGQCCCAGSRTFVHERVYDEFVEKSKARALKRVVGDPFRNGVEQGPQIDGDQFNKILRYVQSGVDSGATLVTGGDRVGSRGFYIQPTVFADAKDDMKIAREEIFGPVQTILKFSGMEEVIRRANATHYGLAAGVFTRSLDAANTLSRALRAGTVWVNCYDVFDATIPFGGYKMSGVGREKGVYALRNYLQTKAVVTPIKDPAWL

SEQ ID NO: 17616 - DNA, 648 bp, Sorghum bicolor
  misc_feature: Ceres ANNOT ID no. 8680838
  misc_feature: Encodes the peptide sequence at SEQ ID NO 17617
atggggagggggaagatagtgataaggaggatcgacaactcgacgagcaggcaggtgaccttctctaagagacggaacgggctgctgaagaaggcaaaggagctctcaatcctctgcgatgcggaggttggcctcatcatcttctccagcaccggaaggctctacgagttctccagcaccaacatgaaagctgtgatagaccgatacggaaaggcaaaagaggagcagattggcaccaacaatgcaacttcagaactcatgctctggcaaagggaggcagcaagcttgaggcaacaactgcacaacttgcaagaaagccacaagtatggcctaggtgtaagagacctccaaagtttagagagccatcttgaaatgagcctgcgtagtatcagaatgaggaagggtagcctaattcaccaggaaaacatggaactcggtagaacagtagatgtcatgtcacagcaaaaagttgaactacacaggaaggccagtgaaccaagaggtgttgctgatgcaagctctagcactccctacagctttagtattacaacacaatatgcagatgtccctgctaatcttgaacagaggcaatcacaacaaaaagagggggatcgacgcaaggaactgatggctcctgaactggggtaa

SEQ ID NO: 17617 - protein, 215 aa, Sorghum bicolor
  misc_feature: The sequence is a functional homolog of SEQ ID NO 2189 in the 10/666,642 US patent application
  misc_feature: The sequence is a functional homolog of SEQ ID NO 2199 in the 10/666,642 US patent application
  misc_feature: The sequence is a functional homolog of SEQ ID NO 2197 in the 10/666,642 US patent application
  misc_feature: The sequence is a functional homolog of SEQ ID NO 2193 in the 10/666,642 US patent application
  misc_feature: The sequence is a functional homolog of SEQ ID NO 1243 in the 11/479,226 US patent application
  misc_feature: The sequence is a functional homolog of SEQ ID NO 1420 in the 10/666,642 US patent application
  misc_feature: The sequence is a functional homolog of SEQ ID NO 1814 in the 10/412,699 US patent application
  misc_feature: The sequence is a functional homolog of SEQ ID NO 570 in the 10/412,699 US patent application
  misc_feature: The sequence is a functional homolog of SEQ ID NO 1460 in the 10/666,642 US patent application
  misc_feature: The sequence is a functional homolog of SEQ ID NO 938 in the 10/412,699 US patent application
  misc_feature: The sequence is a functional homolog of SEQ ID NO 2191 in the 10/666,642 US patent application
  misc_feature: Useful for making plants with altered lignin content
  misc_feature: Functional homolog of the protein sequence given in SEQ ID NO 13210
  misc_feature: The sequence is a functional homolog of SEQ ID NO 2195 in the 10/666,642 US patent application
  misc_feature: The sequence is a functional homolog of SEQ ID NO 1702 in the 10/412,699 US patent application
  misc_feature: The sequence is a functional homolog of SEQ ID NO 715 in the 10/666,642 US patent application
  misc_feature: The sequence is a functional homolog of SEQ ID NO 1732 in the 10/412,699 US patent application
  misc_feature: The sequence is a functional homolog of SEQ ID NO 44 in the 10/666,642 US patent application
  misc_feature: The sequence is a functional homolog of SEQ ID NO 66 in the 10/412,699 US patent application
  misc_feature: The sequence is a functional homolog of SEQ ID NO 1366 in the 10/666,642 US patent application
  misc_feature: The sequence is a functional homolog of SEQ ID NO 1730 in the 10/412,699 US patent application
  misc_feature: The sequence is a functional homolog of SEQ ID NO 207 in the 11/479,226 US patent application
  misc_feature: The sequence is a functional homolog of SEQ ID NO 64 in the 10/412,699 US patent application
  misc_feature: The sequence is a functional homolog of SEQ ID NO 1701 in the 10/412,699 US patent application
  misc_feature: Useful for making plants with modulated flowering time
  misc_feature: Functional homolog of the protein sequence given in SEQ ID NO 13660
  misc_feature: The sequence is a functional homolog of SEQ ID NO 1949 in the 10/412,699 US patent application
  misc_feature: The sequence is a functional homolog of SEQ ID NO 1967 in the 10/412,699 US patent application
  misc_feature: The sequence is a functional homolog of SEQ ID NO 1965 in the 10/412,699 US patent application
  misc_feature: The sequence is a functional homolog of SEQ ID NO 1963 in the 10/412,699 US patent application
  misc_feature: Useful for biocontainment applications
  misc_feature: Useful for making plants with modulated nitrogen use efficiency
  misc_feature: Functional homolog of the protein sequence given in SEQ ID NO 12982
  misc_feature: Ceres ANNOT ID no. 8680838
  misc_feature (9)..(59): Pfam ID: SRF-TF Pfam Description: SRF-type transcription factor (DNA-binding and dimerisation domain)
  misc_feature (73)..(165): Pfam ID: K-box Pfam Description: K-box region
MGRGKIVIRRIDNSTSRQVTFSKRRNGLLKKAKELSILCDAEVGLIIFSSTGRLYEFSSTNMKAVIDRYGKAKEEQIGTNNATSELMLWQREAASLRQQLHNLQESHKYGLGVRDLQSLESHLEMSLRSIRMRKGSLIHQENMELGRTVDVMSQQKVELHRKASEPRGVADASSSTPYSFSITTQYADVPANLEQRQSQQKEGDRRKELMAPELG

SEQ ID NO: 17618 - DNA, 2304 bp, Sorghum bicolor
  misc_feature: Ceres ANNOT ID no. 8680846
  misc_feature: Encodes the peptide sequence at SEQ ID NO 17619
atggatctggaggccgcgggcggcggggaggcggcgcaacgcaagcggcggaatggggagtcatggcgcgcgacgctgctgctcgcgtaccagagcctcggggtggtgtacggcgacgtggccacgtcgccgctctacgtctacaagagcgccttcgccggcaatgacatccagcactcggagggcaacgaggagatctacggcgtgctctcattcgtgttctggacgctgaccctcatcaccctcgtcaagtacgtgctcatcgtgctccgtgccgacgtcggcggggagggcggcaccttcgcgctctactccctcatctgccgtcacgtccgcgccggcctcctgcccggcggcggcaccagagacgagctcatggaggaagacaaggtcaccgggcgtcgtggcgagcggcccgtgtccagggtcagggcggtgctggagaagtacagagtgctgcagcggctgttgctgctcttcgcactgctcgggacatgtatggtcatcggggacggcgtgctcacccctgcagtctcagtgttttctgcggtatctgggcttgagttgtcgttggaaaaggaacagcacaaatatatagaacttccagtggcttgtgccatacttatatgcttgtttgcactgcaacactacggcacacacaaagttgggtttctttttgcaccaatcgtatgcatttggcttctctgcataagtgcaataggcctctacaatatcatccactgggaccaccatgtttatcgagccctctcgccatactacatgtatcaattcctccggaagactcaaactggtggctggatgtcactgggtggaatccttctttgtgtgacagatcttggacatttttcacaatcatcaatccagattgcattcatatccttggtttatcctgcacttgtattggcttatatgggacaagcagcttttatttcacaacatcacaacattgagagcagttatcatattggcttttatgtgtcagtaccagaaacactcagatggcctgttctggtgattgcgatactagcagctgtagttgggagtcaggcaattattactggaaccttttcaatcatcaagcagtgctcttcattaagttgtttccctggagtgaagattgtgcacacatcctcgacagtgcatggtcagatatacataccagaaatcaattggatgctgatgatactctgcctggctgttactattggcttcagagacacaaagcacttggcaaatgcacaagggttggcagtaataactgtcatgcttgttaccacttgcttaatgtcactcgttattgtgctttgctggaacaagagtatcttccttgcccttggtttcctgcttttctttggcacgatcgaagtaatctacttctcagctgcccttgtcaagtttcacgaaggtgcttgggttcctattactctctccttcatatttatggtggtcacgtgtgtctggcactatggcacaataaagaagtacgagttcgatgtgcaaaacaaggtttcagtaaactggctcttaaaccttggtccttcactgggcattgttcgtgttcgaggcattgggctaatacatacagaactaatgtctggaattccagctatcttctcccacttcgtcaccaatctgcctgcgtttcaccaggtactggtattcctctgtgtcaaatcagttcctgtgccgcatgtggaacctgaggaacgatttctggtgggtcgcattggtccaaaagagtataggttatacagggtcattgtcagatatggttatcgcgatgtgcagaaggatgatctagagttcgagaaggagctagtcagcaacattgcagagttcatccgcagcagtggggagtatgacaagaatggcttcgtcgaggacacagataagccctccgagaagctgtccaccatcagtactggaattaatatgtgggaagaggatggagaacttgatgcatctggaacccctcataaggagatagacccacacaatgcagtacccaagcaaaagaaagcaaggttcatgataccgaagagtgctcaggtggacagtgaggtgcgccgtgagctgcaggagctcatggacgctagggaggcaggcatgtccttcatcctggggcactcgtacatgaaggcaaagagcgggtcaagtttcataaagcgaattgtgataaacttcttctacgagttcttgaggaagaacagccgtggccctgcatacgctgcgaacataccacatgcctccactctggaggtaggaatggtctaccaggtctga

SEQ ID NO: 17619 - protein, 767 aa, Sorghum bicolor
  misc_feature: Useful for making plants with modulated biomass
  misc_feature: Functional homolog of the protein sequence given in SEQ ID NO 13565
  misc_feature: Ceres ANNOT ID no. 8680846
  misc_feature: Up-regulated in shoot tissues in response to salicylic acid treatment
  misc_feature (27)..(767): Pfam ID: K_trans Pfam Description: K+ potassium transporter
MDLEAAGGGEAAQRKRRNGESWRATLLLAYQSLGVVYGDVATSPLYVYKSAFAGNDIQHSEGNEEIYGVLSFVFWTLTLITLVKYVLIVLRADVGGEGGTFALYSLICRHVRAGLLPGGGTRDELMEEDKVTGRRGERPVSRVRAVLEKYRVLQRLLLLFALLGTCMVIGDGVLTPAVSVFSAVSGLELSLEKEQHKYIELPVACAILICLFALQHYGTHKVGFLFAPIVCIWLLCISAIGLYNIIHWDHHVYRALSPYYMYQFLRKTQTGGWMSLGGILLCVTDLGHFSQSSIQIAFISLVYPALVLAYMGQAAFISQHHNIESSYHIGFYVSVPETLRWPVLVIAILAAVVGSQAIITGTFSIIKQCSSLSCFPGVKIVHTSSTVHGQIYIPEINWMLMILCLAVTIGFRDTKHLANAQGLAVITVMLVTTCLMSLVIVLCWNKSIFLALGFLLFFGTIEVIYFSAALVKFHEGAWVPITLSFIFMVVTCVWHYGTIKKYEFDVQNKVSVNWLLNLGPSLGIVRVRGIGLIHTELMSGIPAIFSHFVTNLPAFHQVLVFLCVKSVPVPHVEPEERFLVGRIGPKEYRLYRVIVRYGYRDVQKDDLEFEKELVSNIAEFIRSSGEYDKNGFVEDTDKPSEKLSTISTGINMWEEDGELDASGTPHKEIDPHNAVPKQKKARFMIPKSAQVDSEVRRELQELMDAREAGMSFILGHSYMKAKSGSSFIKRIVINFFYEFLRKNSRGPAYAANIPHASTLEVGMVYQV

SEQ ID NO: 17620 - DNA, 510 bp, Sorghum bicolor
  misc_feature: Ceres ANNOT ID no. 8680873
  misc_feature: Up-regulated in shoot tissues in response to salicylic acid treatment
  misc_feature: Encodes the peptide sequence at SEQ ID NO 17621
atgtaccctgctgagattgctagtgttccatacttatctcctgcaagtgcagcctctttcaaacctcattaccatgtagctaccgacgacttcctctaccagtatagcaaccttatgttgcctcacccttcatcctaccaagatgttgctcacctggtccttgaagctagcttcccagttggtaataaatccaattcggaggagtcagatgactatcaacgcagtcttgcagaagagcgcaggaagagaaggatgatatccaatagggagtctgcccgacgatcacgcatgagaaagcagaagcagctgagcgagctctgggcgcaggttgttcacctccgcagcaccaaccgtcaactccttgatcagctaaaccatgtcatcagagactgtgaccgtgtccagcatgaaaactcccagctgagagatgaacaaaccaaattgcagcagcagctagagaagctccctttagagaccacagagagtggtgtcatgagtcctgactcttga

SEQ ID NO: 17621 - protein, 169 aa, Sorghum bicolor
  misc_feature: The sequence is a functional homolog of SEQ ID NO 410 in the 10/412,699 US patent application
  misc_feature: The sequence is a functional homolog of SEQ ID NO 960 in the 11/479,226 US patent application
  misc_feature: Ceres ANNOT ID no. 8680873
  misc_feature (76)..(139): Pfam ID: bZIP_1 Pfam Description: bZIP transcription factor
MYPAEIASVPYLSPASAASFKPHYHVATDDFLYQYSNLMLPHPSSYQDVAHLVLEASFPVGNKSNSEESDDYQRSLAEERRKRRMISNRESARRSRMRKQKQLSELWAQVVHLRSTNRQLLDQLNHVIRDCDRVQHENSQLRDEQTKLQQQLEKLPLETTESGVMSPDS

SEQ ID NO: 17622 - DNA, 1122 bp, Sorghum bicolor
  misc_feature: Ceres ANNOT ID no. 8680879
  misc_feature: Encodes the peptide sequence at SEQ ID NO 17623
atggcgagcagcaacgtctccaccgtctacatctctgtcattgatgacgtcatctccaaggtccgcgaggatttcatcacctacggagtcggcgacgccgtcctaaacgagctccaggctctctgggagatgaaaatgctgcactgtggcgcgatctcggggaacatagaccgaaccaaggctgctgcaccgtccgccggaggcaccaccggcacgacaccgcccgtgcacgacctcaacgtgccgtacgaggccacatccgaggagtacgccaccccgaccgctgacatgctgttcccgccgacaccattgcagaccccaatccagactcctctgccagggacagacacagggatgtacaacatacccaccggcccttctgattatgccccatcacctatcagcgatatcaggaacgggatggcgataaatggggcagacccaaaagctggccgtccaagtccctacatgccaccaccttccccatggatgagtcagaggccgctgggtgttgatgtgaatgtcgcctatgtggaaggccgtgaagatcctgacaggggcgtgcagcctcagccactgactcaggattttttgatgatgtcctctggaaaacgcaagagggatgagtatcctggtcagtcccttctggaaaatgcaaaccaactttggagttccatcatcaacaagcttgaaacaccaaccaagacaatcactccagttattccgcagtgtgatgggattcaggatgactataatgatcaatttttctttcaaggagttccaactgaagattataatacccctggagaatctgcggagtatcgagctcctacacctgctgttggaacaccaaaaccaagaaatgatgctggagatgatgacgatgacgatgatgaacctcctcttaatgaagacgatgacgacgatgatgagttagatgaccttgagcaaggggaggatgaacctaacacacaacatcttgtacttgcacaatttgacaaagtgacaaggaccaagaatcgttggaagtgcactttgaaggatggaatcatgcatttgaatggcagggatgttctatttaacaaggttggtaacataatatttttttggtcaagtttgtga

SEQ ID NO: 17623 - protein, 373 aa, Sorghum bicolor
  misc_feature: Useful for making plants with altered terpenoid content
  misc_feature: Functional homolog of the protein sequence given in SEQ ID NO 13000
  misc_feature: Ceres ANNOT ID no. 8680879
  misc_feature (8)..(370): Pfam ID: TFIIA Pfam Description: Transcription factor IIA, alpha/beta subunit
MASSNVSTVYISVIDDVISKVREDFITYGVGDAVLNELQALWEMKMLHCGAISGNIDRTKAAAPSAGGTTGTTPPVHDLNVPYEATSEEYATPTADMLFPPTPLQTPIQTPLPGTDTGMYNIPTGPSDYAPSPISDIRNGMAINGADPKAGRPSPYMPPPSPWMSQRPLGVDVNVAYVEGREDPDRGVQPQPLTQDFLMMSSGKRKRDEYPGQSLLENANQLWSSIINKLETPTKTITPVIPQCDGIQDDYNDQFFFQGVPTEDYNTPGESAEYRAPTPAVGTPKPRNDAGDDDDDDDEPPLNEDDDDDDELDDLEQGEDEPNTQHLVLAQFDKVTRTKNRWKCTLKDGIMHLNGRDVLFNKVGNIIFFWSSL

SEQ ID NO: 17624 - DNA, 831 bp, Sorghum bicolor
  misc_feature: Ceres ANNOT ID no. 8680914
  misc_feature: Encodes the peptide sequence at SEQ ID NO 17625
atggactccagcttcctccctgccggcgcggagagtggctcggtggtgtcgggcggcgccaacaatggcgctgcggctcagcagcaggcgccgccgctgatccgcgagcaggaccggctgatgccgatcgcgaacgtgatccgcatcatgcgtcgcgtgctgccggcgcacgccaagatctcggacgacgcccaggagacgatccaggagtgcgtgtccgagtacatcagcttcatcacgggggaagccaacgagcggtgccagcgtgagcagcgcaagaccatcaccgccgaggacgtgctgtgggccatgagccgcctcggcttcgacgactacgtcgagccgctcagcgtctacctccaccgctaccgcgatttccagggcgaggcgcggggcgtccggctcgccccgggggcggccccttcgcgcggcggagaccaccaccaccaccaccccctcaagtcccgcggtcccggcggcggctccggagccgccatgttaccgcaccaccaccaccaccacgacatgcagatgcacgccgccatgtacgggggcaccgtgcccccggcgccggggcctccgcaccacggccacggccacgggttcctgatgccacacccacagggcggcagccactacctgccttacccctacgagcccacgtacggcggcgagcacgccatggccgcgtactacggaggagccgccgcgtacgcgcccggcaacggcggcgggagcggcgacggcagtggcagcagcggcgggagcgcgtcgcacacaccgcagggcagcggcggattcgagcacccgcacccgttcgcgtacaagtag

SEQ ID NO: 17625 - protein, 276 aa, Sorghum bicolor
  misc_feature: The sequence is a functional homolog of SEQ ID NO 134 in US patent 7294759
  misc_feature: The sequence is a functional homolog of SEQ ID NO 2 in US patent 7220894
  misc_feature: The sequence is a functional homolog of SEQ ID NO 795 in the 10/374,780 US patent application
  misc_feature: The sequence is a functional homolog of SEQ ID NO 2382 in the 10/374,780 US patent application
  misc_feature: The sequence is a functional homolog of SEQ ID NO 540 in the 10/225,066 US patent application
  misc_feature: The sequence is a functional homolog of SEQ ID NO 72 in the 10/286,264 US patent application
  misc_feature: The sequence is a functional homolog of SEQ ID NO 2143 in the 10/666,642 US patent application
  misc_feature: The sequence is a functional homolog of SEQ ID NO 338 in the 11/435,388 US patent application
  misc_feature: The sequence is a functional homolog of SEQ ID NO 340 in the 10/714,887 US patent application
  misc_feature: The sequence is a functional homolog of SEQ ID NO 76 in the 10/675,852 US patent application
  misc_feature: The sequence is a functional homolog of SEQ ID NO 796 in the 10/374,780 US patent application
  misc_feature: The sequence is a functional homolog of SEQ ID NO 1164 in the 10/412,699 US patent application
  misc_feature: The sequence is a functional homolog of SEQ ID NO 29 in the 10/675,852 US patent application
  misc_feature: The sequence is a functional homolog of SEQ ID NO 780 in the 10/374,780 US patent application
  misc_feature: The sequence is a functional homolog of SEQ ID NO 807 in the 10/666,642 US patent application
  misc_feature: The sequence is a functional homolog of SEQ ID NO 134 in the 10/225,068 US patent application
  misc_feature: The sequence is a functional homolog of SEQ ID NO 1398 in the 10/666,642 US patent application
  misc_feature: The sequence is a functional homolog of SEQ ID NO 14 in the 10/286,264 US patent application
  misc_feature: The sequence is a functional homolog of SEQ ID NO 290 in the 11/435,388 US patent application
  misc_feature: The sequence is a functional homolog of SEQ ID NO 292 in the 10/714,887 US patent application
  misc_feature: The sequence is a functional homolog of SEQ ID NO 306 in the 10/412,699 US patent application
  misc_feature: The sequence is a functional homolog of SEQ ID NO 4 in the 10/675,852 US patent application
  misc_feature: The sequence is a functional homolog of SEQ ID NO 708 in the 11/479,226 US patent application
  misc_feature: The sequence is a functional homolog of SEQ ID NO 90 in the 10/374,780 US patent application
  misc_feature: The sequence is a functional homolog of SEQ ID NO 2153 in the 10/666,642 US patent application
  misc_feature: The sequence is a functional homolog of SEQ ID NO 366 in the 11/435,388 US patent application
  misc_feature: The sequence is a functional homolog of SEQ ID NO 368 in the 10/714,887 US patent application
  misc_feature: The sequence is a functional homolog of SEQ ID NO 50 in the 10/675,852 US patent application
  misc_feature: The sequence is a functional homolog of SEQ ID NO 805 in the 10/374,780 US patent application
  misc_feature: The sequence is a functional homolog of SEQ ID NO 16 in the 10/675,852 US patent application
  misc_feature: The sequence is a functional homolog of SEQ ID NO 2179 in the 10/666,642 US patent application
  misc_feature: The sequence is a functional homolog of SEQ ID NO 402 in the 11/435,388 US patent application
  misc_feature: The sequence is a functional homolog of SEQ ID NO 404 in the 10/714,887 US patent application
  misc_feature: The sequence is a functional homolog of SEQ ID NO 797 in the 10/374,780 US patent application
  misc_feature: The sequence is a functional homolog of SEQ ID NO 82 in the 10/675,852 US patent application
  misc_feature: The sequence is a functional homolog of SEQ ID NO 20 in the 10/675,852 US patent application
  misc_feature: The sequence is a functional homolog of SEQ ID NO 2181 in the 10/666,642 US patent application
  misc_feature: The sequence is a functional homolog of SEQ ID NO 404 in the 11/435,388 US patent application
  misc_feature: The sequence is a functional homolog of SEQ ID NO 406 in the 10/714,887 US patent application
  misc_feature: The sequence is a functional homolog of SEQ ID NO 800 in the 10/374,780 US patent application
  misc_feature: The sequence is a functional homolog of SEQ ID NO 66 in the 10/675,852 US patent application
  misc_feature: The sequence is a functional homolog of SEQ ID NO 2151 in the 10/666,642 US patent application
  misc_feature: The sequence is a functional homolog of SEQ ID NO 364 in the 11/435,388 US patent application
  misc_feature: The sequence is a functional homolog of SEQ ID NO 366 in the 10/714,887 US patent application
  misc_feature: The sequence is a functional homolog of SEQ ID NO 48 in the 10/675,852 US patent application
  misc_feature: The sequence is a functional homolog of SEQ ID NO 804 in the 10/374,780 US patent application
  misc_feature: The sequence is a functional homolog of SEQ ID NO 2141 in the 10/666,642 US patent application
  misc_feature: The sequence is a functional homolog of SEQ ID NO 336 in the 11/435,388 US patent application
  misc_feature: The sequence is a functional homolog of SEQ ID NO 338 in the 10/714,887 US patent application
  misc_feature: The sequence is a functional homolog of SEQ ID NO 794 in the 10/374,780 US patent application
  misc_feature: The sequence is a functional homolog of SEQ ID NO 92 in the 10/675,852 US patent application
  misc_feature: The sequence is a functional homolog of SEQ ID NO 106 in the 10/666,642 US patent application
  misc_feature: The sequence is a functional homolog of SEQ ID NO 1784 in the 10/412,699 US patent application
  misc_feature: The sequence is a functional homolog of SEQ ID NO 2010 in the 10/374,780 US patent application
  misc_feature: The sequence is a functional homolog of SEQ ID NO 292 in the 11/435,388 US patent application
  misc_feature: The sequence is a functional homolog of SEQ ID NO 294 in the 10/714,887 US patent application
  misc_feature: The sequence is a functional homolog of SEQ ID NO 6 in the 10/675,852 US patent application
  misc_feature: The sequence is a functional homolog of SEQ ID NO 719 in the 11/479,226 US patent application
  misc_feature: The sequence is a functional homolog of SEQ ID NO 22 in the 10/675,852 US patent application
  misc_feature: The sequence is a functional homolog of SEQ ID NO 2175 in the 10/666,642 US patent application
  misc_feature: The sequence is a functional homolog of SEQ ID NO 398 in the 11/435,388 US patent application
  misc_feature: The sequence is a functional homolog of SEQ ID NO 400 in the 10/714,887 US patent application
  misc_feature: The sequence is a functional homolog of SEQ ID NO 80 in the 10/675,852 US patent application
  misc_feature: The sequence is a functional homolog of SEQ ID NO 801 in the 10/374,780 US patent application
  misc_feature: The sequence is a functional homolog of SEQ ID NO 18 in the 10/675,852 US patent application
  misc_feature: The sequence is a functional homolog of SEQ ID NO 2183 in the 10/666,642 US patent application
  misc_feature: The sequence is a functional homolog of SEQ ID NO 406 in the 11/435,388 US patent application
  misc_feature: The sequence is a functional homolog of SEQ ID NO 408 in the 10/714,887 US patent application
  misc_feature: The sequence is a functional homolog of SEQ ID NO 798 in the 10/374,780 US patent application
  misc_feature: The sequence is a functional homolog of SEQ ID NO 2155 in the 10/666,642 US patent application
  misc_feature: The sequence is a functional homolog of SEQ ID NO 368 in the 11/435,388 US patent application
  misc_feature: The sequence is a functional homolog of SEQ ID NO 370 in the 10/714,887 US patent application
  misc_feature: The sequence is a functional homolog of SEQ ID NO 94 in the 10/675,852 US patent application
  misc_feature: The sequence is a functional homolog of SEQ ID NO 308 in the 11/435,388 US patent application
  misc_feature: The sequence is a functional homolog of SEQ ID NO 310 in the 10/714,887 US patent application
  misc_feature: Useful for making plants with modulated biomass
  misc_feature: Functional homolog of the protein sequence given in SEQ ID NO 13228
  misc_feature: The sequence is a functional homolog of SEQ ID NO 12 in the 10/675,852 US patent application
  misc_feature: The sequence is a functional homolog of SEQ ID NO 34 in the 10/675,852 US patent application
  misc_feature: The sequence is a functional homolog of SEQ ID NO 807 in the 10/374,780 US patent application
  misc_feature: The sequence is a functional homolog of SEQ ID NO 46 in the 10/675,852 US patent application
  misc_feature: The sequence is a functional homolog of SEQ ID NO 56 in the 10/675,852 US patent application
  misc_feature: The sequence is a functional homolog of SEQ ID NO 785 in the 10/374,780 US patent application
  misc_feature: The sequence is a functional homolog of SEQ ID NO 786 in the 10/374,780 US patent application
  misc_feature: The sequence is a functional homolog of SEQ ID NO 38 in the 10/675,852 US patent application
  misc_feature: The sequence is a functional homolog of SEQ ID NO 64 in the 10/675,852 US patent application
  misc_feature: The sequence is a functional homolog of SEQ ID NO 26 in the 10/675,852 US patent application
  misc_feature: The sequence is a functional homolog of SEQ ID NO 802 in the 10/374,780 US patent application
  misc_feature: The sequence is a functional homolog of SEQ ID NO 2171 in the 10/666,642 US patent application
  misc_feature: The sequence is a functional homolog of SEQ ID NO 2173 in the 10/666,642 US patent application
  misc_feature: The sequence is a functional homolog of SEQ ID NO 2185 in the 10/666,642 US patent application
  misc_feature: The sequence is a functional homolog of SEQ ID NO 24 in the 10/675,852 US patent application
  misc_feature: The sequence is a functional homolog of SEQ ID NO 394 in the 11/435,388 US patent application
  misc_feature: The sequence is a functional homolog of SEQ ID NO 396 in the 10/714,887 US patent application
  misc_feature: The sequence is a functional homolog of SEQ ID NO 396 in the 11/435,388 US patent application
  misc_feature: The sequence is a functional homolog of SEQ ID NO 398 in the 10/714,887 US patent application
  misc_feature: The sequence is a functional homolog of SEQ ID NO 408 in the 11/435,388 US patent application
  misc_feature: The sequence is a functional homolog of SEQ ID NO 410 in the 10/714,887 US patent application
  misc_feature: The sequence is a functional homolog of SEQ ID NO 84 in the 10/675,852 US patent application
  misc_feature: The sequence is a functional homolog of SEQ ID NO 418 in the 11/435,388 US patent application
  misc_feature: The sequence is a functional homolog of SEQ ID NO 420 in the 10/714,887 US patent application
  misc_feature: The sequence is a functional homolog of SEQ ID NO 2135 in the 10/666,642 US patent application
  misc_feature: The sequence is a functional homolog of SEQ ID NO 28 in the 10/675,852 US patent application
  misc_feature: The sequence is a functional homolog of SEQ ID NO 330 in the 11/435,388 US patent application
  misc_feature: The sequence is a functional homolog of SEQ ID NO 332 in the 10/714,887 US patent application
  misc_feature: The sequence is a functional homolog of SEQ ID NO 792 in the 10/374,780 US patent application
  misc_feature: The sequence is a functional homolog of SEQ ID NO 88 in the 10/675,852 US patent application
  misc_feature: The sequence is a functional homolog of SEQ ID NO 416 in the 11/435,388 US patent application
  misc_feature: The sequence is a functional homolog of SEQ ID NO 418 in the 10/714,887 US patent application
  misc_feature: The sequence is a functional homolog of SEQ ID NO 789 in the 10/374,780 US patent application
  misc_feature: The sequence is a functional homolog of SEQ ID NO 1440 in the 10/666,642 US patent application
  misc_feature: The sequence is a functional homolog of SEQ ID NO 1856 in the 10/412,699 US patent application
  misc_feature: The sequence is a functional homolog of SEQ ID NO 2102 in the 10/374,780 US patent application
  misc_feature: The sequence is a functional homolog of SEQ ID NO 290 in the 10/225,066 US patent application
  misc_feature: The sequence is a functional homolog of SEQ ID NO 8 in the 10/675,852 US patent application
  misc_feature: The sequence is a functional homolog of SEQ ID NO 60 in the 10/675,852 US patent application
  misc_feature: Useful for making plants with altered alkaloid content
  misc_feature: Useful for making plants with altered terpenoid content
  misc_feature: Functional homolog of the protein sequence given in SEQ ID NO 13247
  misc_feature: The sequence is a functional homolog of SEQ ID NO 14 in the 10/675,852 US patent application
  misc_feature: The sequence is a functional homolog of SEQ ID NO 2137 in the 10/666,642 US patent application
  misc_feature: The sequence is a functional homolog of SEQ ID NO 332 in the 11/435,388 US patent application
  misc_feature: The sequence is a functional homolog of SEQ ID NO 334 in the 10/714,887 US patent application
  misc_feature: The sequence is a functional homolog of SEQ ID NO 54 in the 10/675,852 US patent application
  misc_feature: The sequence is a functional homolog of SEQ ID NO 74 in the 10/675,852 US patent application
  misc_feature: The sequence is a functional homolog of SEQ ID NO 790 in the 10/374,780 US patent application
  misc_feature: The sequence is a functional homolog of SEQ ID NO 36 in the 10/675,852 US patent application
  misc_feature: The sequence is a functional homolog of SEQ ID NO 2149 in the 10/666,642 US patent application
  misc_feature: The sequence is a functional homolog of SEQ ID NO 362 in the 11/435,388 US patent application
  misc_feature: The sequence is a functional homolog of SEQ ID NO 364 in the 10/714,887 US patent application
  misc_feature: The sequence is a functional homolog of SEQ ID NO 40 in the 10/675,852 US patent application
  misc_feature: The sequence is a functional homolog of SEQ ID NO 58 in the 10/675,852 US patent application
  misc_feature: The sequence is a functional homolog of SEQ ID NO 78 in the 10/675,852 US patent application
  misc_feature: The sequence is a functional homolog of SEQ ID NO 806 in the 10/374,780 US patent application
  misc_feature: The sequence is a functional homolog of SEQ ID NO 787 in the 10/374,780 US patent application
  misc_feature: The sequence is a functional homolog of SEQ ID NO 44 in the 10/675,852 US patent application
  misc_feature: The sequence is a functional homolog of SEQ ID NO 306 in the 11/435,388 US patent application
  misc_feature: The sequence is a functional homolog of SEQ ID NO 308 in the 10/714,887 US patent application
  misc_feature: The sequence is a functional homolog of SEQ ID NO 70 in the 10/675,852 US patent application
  misc_feature: The sequence is a functional homolog of SEQ ID NO 803 in the 10/374,780 US patent application
  misc_feature: The sequence is a functional homolog of SEQ ID NO 42 in the 10/675,852 US patent application
  misc_feature: The sequence is a functional homolog of SEQ ID NO 2177 in the 10/666,642 US patent application
  misc_feature: The sequence is a functional homolog of SEQ ID NO 400 in the 11/435,388 US patent application
  misc_feature: The sequence is a functional homolog of SEQ ID NO 402 in the 10/714,887 US patent application
  misc_feature: The sequence is a functional homolog of SEQ ID NO 52 in the 10/675,852 US patent application
  misc_feature: The sequence is a functional homolog of SEQ ID NO 799 in the 10/374,780 US patent application
  misc_feature: The sequence is a functional homolog of SEQ ID NO 2139 in the 10/666,642 US patent application
  misc_feature: The sequence is a functional homolog of SEQ ID NO 334 in the 11/435,388 US patent application
  misc_feature: The sequence is a functional homolog of SEQ ID NO 336 in the 10/714,887 US patent application
  misc_feature: The sequence is a functional homolog of SEQ ID NO 90 in the 10/675,852 US patent application
  misc_feature: The sequence is a functional homolog of SEQ ID NO 793 in the 10/374,780 US patent application
  misc_feature: The sequence is a functional homolog of SEQ ID NO 1167 in the 10/412,699 US patent application
  misc_feature: The sequence is a functional homolog of SEQ ID NO 783 in the 10/374,780 US patent application
  misc_feature: The sequence is a functional homolog of SEQ ID NO 810 in the 10/666,642 US patent application
  misc_feature: The sequence is a functional homolog of SEQ ID NO 294 in the 11/435,388 US patent application
  misc_feature: The sequence is a functional homolog of SEQ ID NO 296 in the 10/714,887 US patent application
  misc_feature: The sequence is a functional homolog of SEQ ID NO 308 in the 10/412,699 US patent application
  misc_feature: The sequence is a functional homolog of SEQ ID NO 723 in the 11/479,226 US patent application
  misc_feature: The sequence is a functional homolog of SEQ ID NO 788 in the 10/374,780 US patent application
  misc_feature: The sequence is a functional homolog of SEQ ID NO 414 in the 11/435,388 US patent application
  misc_feature: The sequence is a functional homolog of SEQ ID NO 416 in the 10/714,887 US patent application
  misc_feature: Ceres ANNOT ID no. 8680914
  misc_feature (35)..(129): SWISSPROT Homolog: EC 2.7.7.7 DNA-directed DNA polymerase
  misc_feature (39)..(104): Pfam ID: CBFD_NFYB_HMF Pfam Description: Histone-like transcription factor (CBF/NF-Y) and archaeal histone
MDSSFLPAGAESGSVVSGGANNGAAAQQQAPPLIREQDRLMPIANVIRIMRRVLPAHAKISDDAQETIQECVSEYISFITGEANERCQREQRKTITAEDVLWAMSRLGFDDYVEPLSVYLHRYRDFQGEARGVRLAPGAAPSRGGDHHHHHPLKSRGPGGGSGAAMLPHHHHHHDMQMHAAMYGGTVPPAPGPPHHGHGHGFLMPHPQGGSHYLPYPYEPTYGGEHAMAAYYGGAAAYAPGNGGGSGDGSGSSGGSASHTPQGSGGFEHPHPFAYK

SEQ ID NO: 17626 - DNA, 2127 bp, Sorghum bicolor
  misc_feature: Ceres ANNOT ID no. 8680928
  misc_feature: Encodes the peptide sequence at SEQ ID NO 17627
atggccgggagcagcgtccgcggcggcgggagcaaccgcttaccgctgctcgtgacggagaaaccgacggggatggcgacgtacgcttaccggctgttcgcgagcacggtcctcgcgggggttctcctggtatggctgtacagagccacgcacgtgccgccgaggagcagcggcgcccggtggtgggcgtggcttgggctctccgcggccgagctctggttcggcttctactgggtgctcacgctgtccgtgcggtggagccccgtctaccgccgcgccttcccggaccagctctcgcgaaggtacaaggaagagcagcttcctgggatggacatatttgtgtgtacagcagaccccactgttgagccgccaatgcttgtcatctccactgtcctatctgttatggcctatgactacccgcaggagaagttgaacatctatttgtctgatgatgctggttccatcataacattatatgctctatatgaggcatcagagtttgcaaagcactggcttccattttgcaagaagtaccaagtggaacccaggtcgccggccgcttactttggtaaagaagctacccctcccgatgcatgtgaccgtaaagagtggttttccttgaaggagatgtacaaagatttggcagatcgagtgaattcagttgttaattcagggaagatccctgatgtttcaaaatgcaagcttaggggcttctctaagtggagcgagaatacaagttttagagatcacccttcaatagttcagattttaattgatggaaacaaaagaaaagcaactgatgtcgatggaaatgtgttgcccacactggtttatatggctcgtgagaagagacctcaggaacatcatcatttcaaggctggatcactgaatgctttgataagggtatcatcagtgataagcaacagcccagtcattatgaatgtggactgtgatatgtactccaacaattcagggtctatcagagatgcattgtgcttcttccaagatgaagagcaaggtcaagatattgcttttgttcagtatcctcagaactttgaaaatgtggtgcacaatgacatctatggcaatcccatcaacaccgtcaatgagttggatcatccttgcttggatggatggggtggaatgtgttactatggcacaggatgcttccatcggagagaggctctatgtgggcgaatatatagtcgagactacaaggaggattggactaggatgttgagtaaaactgaagatgtcagtgagttggaaggaatggctgagtcacttgtgacttgcacatatgagcacaacaccctttggggaatcgagaagggagttagatatggttgcccactggaggatgttattacaggattgcaaatccagtgccgtgggtggagatcagtttaccacaacccaccaagaaaggggtttttaggcatggccccgacctcactaggacagatcctggttcagcacaagagatggacagaagggttcctccagatctccctatcaaagtacagcccatttctgctaggtcacaggaagatcaggctgggtcttcaaatgggttactccgtatgtgggttctgggctcttaacagcttccccaccttgtactatgtcaccatcccttcactttgcttcctcaatggcatctcattgttccctgagtggtggaacgcacaaaggatgtggcttttcagaagaatcacctcatacctcttggccgccatcgacacaatccgcagattgcttggtatcactgagtcaggattcaccctgacagcgaaggtaactgattcgcaggccctagagaggtacaagaaggggatgatggagttcgggtccttctccgcaatgtttgtgatcattacaaccgtcgcactgcttaacctggcatgcatgatgctcggggtgacaaaagttttgctgcataaaggtgcgatgagtttgggagctatgtttgtgcaggctgttctatgtgcgctactagtagcactgaatttcccagtgtatgaagcagtgttcctccgcaaggacagtggcagattaccagcttctgtcagtctaatttcgctctgcattgtaatgccattatgtatattgccaaccaacttctag

SEQ ID NO: 17627 - protein, 708 aa, Sorghum bicolor
  misc_feature: Useful for making plants with altered cell wall content and/or composition
  misc_feature: Functional homolog of the protein sequence given in SEQ ID NO 13903
  misc_feature: Ceres ANNOT ID no. 8680928
  misc_feature (64)..(398): SWISSPROT Homolog: EC 2.4.1.12 Cellulose synthase (UDP-forming)
  misc_feature (15)..(705): Pfam ID: Cellulose_synt Pfam Description: Cellulose synthase
MAGSSVRGGGSNRLPLLVTEKPTGMATYAYRLFASTVLAGVLLVWLYRATHVPPRSSGARWWAWLGLSAAELWFGFYWVLTLSVRWSPVYRRAFPDQLSRRYKEEQLPGMDIFVCTADPTVEPPMLVISTVLSVMAYDYPQEKLNIYLSDDAGSIITLYALYEASEFAKHWLPFCKKYQVEPRSPAAYFGKEATPPDACDRKEWFSLKEMYKDLADRVNSVVNSGKIPDVSKCKLRGFSKWSENTSFRDHPSIVQILIDGNKRKATDVDGNVLPTLVYMAREKRPQEHHHFKAGSLNALIRVSSVISNSPVIMNVDCDMYSNNSGSIRDALCFFQDEEQGQDIAFVQYPQNFENVVHNDIYGNPINTVNELDHPCLDGWGGMCYYGTGCFHRREALCGRIYSRDYKEDWTRMLSKTEDVSELEGMAESLVTCTYEHNTLWGIEKGVRYGCPLEDVITGLQIQCRGWRSVYHNPPRKGFLGMAPTSLGQILVQHKRWTEGFLQISLSKYSPFLLGHRKIRLGLQMGYSVCGFWALNSFPTLYYVTIPSLCFLNGISLFPEWWNAQRMWLFRRITSYLLAAIDTIRRLLGITESGFTLTAKVTDSQALERYKKGMMEFGSFSAMFVIITTVALLNLACMMLGVTKVLLHKGAMSLGAMFVQAVLCALLVALNFPVYEAVFLRKDSGRLPASVSLISLCIVMPLCILPTNF

SEQ ID NO: 17628 - DNA, 1716 bp, Sorghum bicolor
  misc_feature: Ceres ANNOT ID no. 8680933
  misc_feature: Encodes the peptide sequence at SEQ ID NO 17629
atggaggcggcggcgatgcgcaaggcgtcgtcgcaggcgtcgctggcggacccggacgacttcgacctgacgcggctgctgaaccacaagccgcggatcaacgtggagaggcagcggtcgttcgacgaccgctccctcggcgagctctcgctcgccggcgcgggcgcgggcacgggcagccgcggcggctggggctactacggcgtaggggtggagagctacgagagcatgtactcccccggcggcgggctgcggtcctactgcggcacgccggcctcgtccacgcggctctcgttcgagccccacccgctgatcggcgaggcctgggacgcgctgcgccgctccatcgtgtccttccgcgaccagccgatcggcaccatcgccgccgtcgaccactccgccgccgccgaagtgctcaactacgaccaggtgttcgttagggacttcgtcccgagcgcgttggcgttcctgatgaacggggagcccgaaatcgtgcgcaacttcctgctgaagacgctgctgctgcaggggtgggagaagcggatcgaccgcttcaagctcggcgagggcgccatgccggcgagcttcaaggtgctcaaggaccccaagcgcggcgtggacaagctggtggccgacttcggggagagcgccatcgggcgtgtggcgccggtggattccgggttctggtggatcatcatcctgagggcctacaccaagtccaccggcgacatgacgctcgccgagacgcccatgtgccagaagggcatccggctcatcatgaaccagtgcctcgccgagggcttcgacaccttccccaccctgctctgcgccgacggatgctgcatgatcgatcgcagaatgggcgtgtacgggtacccgatcgagatccaggccctgttcttcatggcgctgcggtgcgcgctggtgatgctgaagccggacgcggaggggaaggagatcatggagcggatcgtgacgcggctggcggcgctgagctaccacatgcggagctacttctggctggacttccagcagctcaacgacatctaccggttcaagacggaggagtactcgcacacggccgtcaacaagttcaacgtcaacccggagtccatcccggactggctcttcgacttcatgcccacccgcggcggctacttcgtcggcaacgtcagccccgcccggatggacttccggtggttcgcgctcggcaactgcgtcgccatcctcgcgtcgctcgccacgcccgaccaggccgctgccatcatggacctcatcgaggagcgctgggaggacctcgtcggcgagatgcctgtcaagatatgctacccggccatcgaggggcacgagtggcagatcgtcaccggctgcgaccccaagaacaccagatggagctaccacaacgggggatcatggccagtgctgctgtggctgctcacggcggcatgcatcaagaccgggaggctgaagattgctcggcgcgccatcgacctagccgaggcgaggctcgcgagggacggctggccagagtactacgacggcaagctgggccgctacatcggcaagcaggcgaggaagttccagacgtggtccatcgcggggtacctggtggccaaaatgatgctggaggacccgtctcacctcggcatgatctccctggaggaggagaagccgaccaaaccggtgctcaggaggtcggcctcttggacagggtaa

SEQ ID NO: 17629 - protein, 571 aa, Sorghum bicolor
  misc_feature: Useful for making plants with modulated oxidative stress sensitivity
  misc_feature: Functional homolog of the protein sequence given in SEQ ID NO 13231
  misc_feature: Useful for making plants with altered carbohydrate content
  misc_feature: Functional homolog of the protein sequence given in SEQ ID NO 13652
  misc_feature: Ceres ANNOT ID no. 8680933
  misc_feature: Down-regulated in shoot tissues in response to salicylic acid treatment
  misc_feature: Up-regulated in root tissues in response to methyl jasmonate treatment
  misc_feature (96)..(564): Pfam ID: Invertase_neut Pfam Description: Plant neutral invertase
MEAAAMRKASSQASLADPDDFDLTRLLNHKPRINVERQRSFDDRSLGELSLAGAGAGTGSRGGWGYYGVGVESYESMYSPGGGLRSYCGTPASSTRLSFEPHPLIGEAWDALRRSIVSFRDQPIGTIAAVDHSAAAEVLNYDQVFVRDFVPSALAFLMNGEPEIVRNFLLKTLLLQGWEKRIDRFKLGEGAMPASFKVLKDPKRGVDKLVADFGESAIGRVAPVDSGFWWIIILRAYTKSTGDMTLAETPMCQKGIRLIMNQCLAEGFDTFPTLLCADGCCMIDRRMGVYGYPIEIQALFFMALRCALVMLKPDAEGKEIMERIVTRLAALSYHMRSYFWLDFQQLNDIYRFKTEEYSHTAVNKFNVNPESIPDWLFDFMPTRGGYFVGNVSPARMDFRWFALGNCVAILASLATPDQAAAIMDLIEERWEDLVGEMPVKICYPAIEGHEWQIVTGCDPKNTRWSYHNGGSWPVLLWLLTAACIKTGRLKIARRAIDLAEARLARDGWPEYYDGKLGRYIGKQARKFQTWSIAGYLVAKMMLEDPSHLGMISLEEEKPTKPVLRRSASWTG

SEQ ID NO: 17630 - DNA, 1332 bp, Sorghum bicolor
  misc_feature: Ceres ANNOT ID no. 8680945
  misc_feature: Down-regulated in shoot tissues in response to salicylic acid treatment
  misc_feature: Up-regulated in root tissues in response to methyl jasmonate treatment
  misc_feature: Encodes the peptide sequence at SEQ ID NO 17631
atgccgccgcgcgctgcgacggcgaagccgtcgtggctcagcgacgcgctcctcttcgccgcgggcgccgtggtggccaccgtggcgctgctcgcgttcgccaacccgttcgttcagcctgagggttactacggcgacgcagcagccctgtcctccggctctgctggctcatcatccgcgggtggtggtggtggtgccgcccgcacgttctacgacgacccggcgctggcgtacaccgtggaccgccccatcacggggtgggacgagaagcgcgccgggtggctgcgcgcgcacccggagctcgccggtggtggcgaggagcgcgtcctcatggtgtccggctcgcagccgacgccgtgccggtccccgggcggtgaccacacgctgatgcggctgctgaagaacaaggccgactactgccgcctccacggcgtgcagctgctgtccaacatggcgctgctgcggccgtccatggaccggtactgggccaagataccggtgatccgcgccgccatggtcgcgcacccggaggcggagtgggtgtggtgggtcgactccgacgccgtgttcaccgacatggacttccgcctcccgctgcgccggtaccgcgcccacaacctcgtcgtccacggctggccgagcctcgtgttcgaggcccaggccagctcctggaccagcctcaacgccggcgtgttcctcatccggaactgccagtggtcgctcgacttcatggacgcgtgggccgccatggggccagactccccggactaccagcgctggggctccgtgctcaagtccacgttcaaggacaaggtgttcgacgagtcggacgaccagtcggcgctcgtgtacatgctgctgcagaaggagaagggcagccggccgtggcgggacaaggtgttcctggagagcgactactacttcgagggctactgggcggagatcgtggggcggctcgggaacatgacggagcggtacgaggcgatggagcgccgcccgggggctgccgcgctgcggaggcggcacgcggagagggagcacgcggagtacgcggcggcaagggacgccgccctggccggggccgggctggcggagaccggggtgcacgggtggcgccgcccgttcgtgacgcacttcacggggtgccagccgtgcagcgggcagcggaacgagcactactccggggacagctgcgaccagggcatgcgccgcgcgctcaacttcgccgacgaccaggtgctgagggcgtacggtttccggcacgccggtccgctcagtgacgacgtggagccactgccgttcgattaccctgcaaaggcagtgactagctga

SEQ ID NO: 17631 - protein, 443 aa, Sorghum bicolor
  misc_feature: Useful for making plants with altered cell wall content and/or composition
  misc_feature: Functional homolog of the protein sequence given in SEQ ID NO 14558
  misc_feature: Useful for making plants with altered carbohydrate content
  misc_feature: Functional homolog of the protein sequence given in SEQ ID NO 13770
  misc_feature: Ceres ANNOT ID no. 8680945
  misc_feature (78)..(327): SWISSPROT Homolog: EC 2.4.2.39 Xyloglucan 6-xylosyltransferase
  misc_feature (105)..(392): Pfam ID: Glyco_transf_34 Pfam Description: galactosyl transferase GMA12/MNN10 family
MPPRAATAKPSWLSDALLFAAGAVVATVALLAFANPFVQPEGYYGDAAALSSGSAGSSSAGGGGGAARTFYDDPALAYTVDRPITGWDEKRAGWLRAHPELAGGGEERVLMVSGSQPTPCRSPGGDHTLMRLLKNKADYCRLHGVQLLSNMALLRPSMDRYWAKIPVIRAAMVAHPEAEWVWWVDSDAVFTDMDFRLPLRRYRAHNLVVHGWPSLVFEAQASSWTSLNAGVFLIRNCQWSLDFMDAWAAMGPDSPDYQRWGSVLKSTFKDKVFDESDDQSALVYMLLQKEKGSRPWRDKVFLESDYYFEGYWAEIVGRLGNMTERYEAMERRPGAAALRRRHAEREHAEYAAARDAALAGAGLAETGVHGWRRPFVTHFTGCQPCSGQRNEHYSGDSCDQGMRRALNFADDQVLRAYGFRHAGPLSDDVEPLPFDYPAKAVTS

SEQ ID NO: 17632 - DNA, 507 bp, Sorghum bicolor
  misc_feature: Ceres ANNOT ID no. 8680955
  misc_feature: Encodes the peptide sequence at SEQ ID NO 17633
atggctgcgggccgtggcctcttggtcctcttcttctcggccgccgtggtggctgggctcacctctgcggcgaatggttctttcctgtccgatagcgtcttccagccgagcgccggatctacagggaggagcttgctgcaggccaagaatagttgccctgtgaactttgagttcctgaactacacaatcatcacaggcaagtgcaaagggccaaagtttccagccagccaatgctgtgcggcactcaaggaattcgcgtgcccttattatatgtacctcaatgatgagagcaacgactgtgcatcgacaatgttcagctacatcaacctctatggcaagtatccaccaggcctgttttccagcgagtgcaaagaaggcaagttggggctttcttgcgcagatgtcccccagaaggacagtgccactgcaaacagtggttatcacgctcaaagcagcttgcttgtgttgattactgtcttgagtgtggtagtagcgttgttccactga

SEQ ID NO: 17633 - protein, 168 aa, Sorghum bicolor
  misc_feature: Useful for making plants with altered carbohydrate content
  misc_feature: Functional homolog of the protein sequence given in SEQ ID NO 14319
  misc_feature: Useful for making plants with altered cell wall content and/or composition
  misc_feature: Functional homolog of the protein sequence given in SEQ ID NO 14318
  misc_feature: Ceres ANNOT ID no. 8680955
MAAGRGLLVLFFSAAVVAGLTSAANGSFLSDSVFQPSAGSTGRSLLQAKNSCPVNFEFLNYTIITGKCKGPKFPASQCCAALKEFACPYYMYLNDESNDCASTMFSYINLYGKYPPGLFSSECKEGKLGLSCADVPQKDSATANSGYHAQSSLLVLITVLSVVVALFH

SEQ ID NO: 17634 - DNA, 1971 bp, Sorghum bicolor
  misc_feature: Ceres ANNOT ID no. 8680951
  misc_feature: Encodes the peptide sequence at SEQ ID NO 17635
atggtcgccaagatgttgccatccccatggatctcggcgtccgtgctcattctgctcctgagcctgcacccgggtgtccatgccttctacctccccggcaccttcatgcacacttactcctctggagaggtgatctcggccaaggtcaactcgctcacctccatcgagaccgagctgcccttcagctactacagcctgccgtactgcaagcctcctgatggtgtcaagaagagcgctgagaaccttggtgagatcctcatgggtgaccagatcgacaactccccataccgcttccaagttaatgtcaatgagtcagtatacctttgcaccacggacccactcaccaaggagcaggctgagctgctcaagaagagggcacgagatctgtaccaggtcaacatgatcctggataatttaccggtcatgcgattcaccgagcagaacgggatgacaatccagtggactgggtttccggttgggtacaacccgacagggagcaatgaggattatatcattaaccacctcaagttcagagtcttggtccatcagtaccaggcgcaaggtgatgtggtggtcacgagtgaggatggtgttgcaatggttgagtctgatcgcaagagtgggttccagattgttgggtttgaggtcgtgccttgcagtgtaaggcgtgatcctgaggccatgtccaagctcaagatgtatgacaaggctgaatctgtgaattgcccgttggagcttgagaaatctcaggtgatccatgagaatgagaggattacatttacctatgaggttgagtatgtcaagagcaacatcaagtggccatcgaggtgggatgcgtatctgaagatggatggtgccaaagtccactggttctcgatcatgaactcgatgatggttgtcttcttcctggctggtattgtgtttgtcatattcttgaggactgtcagaagggatctgacaaggtatgaggagatggacaaggagccacaagctcagatgaatgaggagctctcaggatggaagcttgttgttggtgatgtcttcagagagcccagctgtccaaagttgttgtgtgttatggttgctgatggtatccagatcaccggtatggcagttgttacaattgtgtttgctgctctgggattcctctcacctgcttccaggggaatgctcctgaccggaatgatcattctctacctcttccttggtatcattgctggatatgttggtgtccgtgtttggaggactatcaaaggaacatcagaagggtggaaatctgttgcttggctgactgcctgcttcttccctgggattgtgttcatcatcctcactgtgcttaactccattctatggggcaagaagagcactggagctctacccatctcactgttcttcaccctcctggccctgtggttctgcatctctgtgccactcacacttattggaggcttgctaggcacacgtgctgcaagcatcgactaccctgtccgaaccaaccagattccacgagagatccctgagcgcaagttcccctcatggctgcttgtgctcggtgcaggaacattgccttttggtactctcttcattgagctcttcttcatcctttccagcatttggttgggaagattctattacgtctttggcttcctgtttattgtcctcttcctgctggtcatagtctgcggtgaggtttctctggtcctaacctacatgcatctttgcgtggaggactggaaatggtggtggaaggccttctttgcttctggctctgtcgcgttctatgtgttcctctactcgattaactacctggtgttcgatctcaggagcctgagcggacctgtttccgccacactctaccttggctattccctgatcatggcccttgcaatcatgctctccactggtgccattggtttcctgctctccttctacttcgtccactacctcttctcgtctgttaagattgattag

SEQ ID NO: 17635 - protein, 656 aa, Sorghum bicolor
  misc_feature: Useful for making plants with altered cell wall content and/or composition
  misc_feature: Functional homolog of the protein sequence given in SEQ ID NO 13969
  misc_feature: Ceres ANNOT ID no. 8680951
  misc_feature (59)..(614): Pfam ID: EMP70 Pfam Description: Endomembrane protein 70
MVAKMLPSPWISASVLILLLSLHPGVHAFYLPGTFMHTYSSGEVISAKVNSLTSIETELPFSYYSLPYCKPPDGVKKSAENLGEILMGDQIDNSPYRFQVNVNESVYLCTTDPLTKEQAELLKKRARDLYQVNMILDNLPVMRFTEQNGMTIQWTGFPVGYNPTGSNEDYIINHLKFRVLVHQYQAQGDVVVTSEDGVAMVESDRKSGFQIVGFEVVPCSVRRDPEAMSKLKMYDKAESVNCPLELEKSQVIHENERITFTYEVEYVKSNIKWPSRWDAYLKMDGAKVHWFSIMNSMMVVFFLAGIVFVIFLRTVRRDLTRYEEMDKEPQAQMNEELSGWKLVVGDVFREPSCPKLLCVMVADGIQITGMAVVTIVFAALGFLSPASRGMLLTGMIILYLFLGIIAGYVGVRVWRTIKGTSEGWKSVAWLTACFFPGIVFIILTVLNSILWGKKSTGALPISLFFTLLALWFCISVPLTLIGGLLGTRAASIDYPVRTNQIPREIPERKFPSWLLVLGAGTLPFGTLFIELFFILSSIWLGRFYYVFGFLFIVLFLLVIVCGEVSLVLTYMHLCVEDWKWWWKAFFASGSVAFYVFLYSINYLVFDLRSLSGPVSATLYLGYSLIMALAIMLSTGAIGFLLSFYFVHYLFSSVKID

SEQ ID NO: 17636 - DNA, 633 bp, Sorghum bicolor
  misc_feature: Ceres ANNOT ID no. 8680958
  misc_feature: Encodes the peptide sequence at SEQ ID NO 17637
atggctcccggtgtcggcggtgctctccgtctccggggaacgacgacgaccacgggcgcgcggccagacatgtcccgtctctggacgacgcggctccagaaggagctcgaggggctctgggcggacccgcccgagtggtgcgtccccggcgccgacgccacggacctcttccactggcaggtcatcgtcgtcggcccccgaggaagcccctacgacggcggagtcttcgccgtccgcttcaagttccctcgccactaccccttgaagcctcccaaggtcaccttcgcaaccaaggtgtaccacccgaacatcgatccgaggactggacgggtttgcctggacttcctgactgacagtaagcactggtggacgccggcatggacggtggacaagattctcctggccctagtctcgcttttgcacgagcctgtcatggatggccgcgccatatcaaccccgacgccgcgaacctctacaggcggaagagactcaggtacgtggagatcgcgagggccaagaccctggagcacgccacggcgtcatcgtcgtcgtcgtcggcggcggcagcggcagcttcagagaaggagcgtcgtccgcagtcccggggcgtttccctgtgccgtcggctcatga

SEQ ID NO: 17637 - protein, 210 aa, Sorghum bicolor
  misc_feature: Useful for biocontainment applications
  misc_feature: Functional homolog of the protein sequence given in SEQ ID NO 13996
  misc_feature: Ceres ANNOT ID no. 8680958
  misc_feature (31)..(146): SWISSPROT Homolog: EC 6.3.2.19 Ubiquitin--protein ligase
  misc_feature (31)..(189): Pfam ID: UQ_con Pfam Description: Ubiquitin-conjugating enzyme
MAPGVGGALRLRGTTTTTGARPDMSRLWTTRLQKELEGLWADPPEWCVPGADATDLFHWQVIVVGPRGSPYDGGVFAVRFKFPRHYPLKPPKVTFATKVYHPNIDPRTGRVCLDFLTDSKHWWTPAWTVDKILLALVSLLHEPVMDGRAISTPTPRTSTGGRDSGTWRSRGPRPWSTPRRHRRRRRRRQRQLQRRSVVRSPGAFPCAVGS

SEQ ID NO: 17638 - DNA, 1905 bp, Sorghum bicolor
  misc_feature: Ceres ANNOT ID no. 8680995
  misc_feature: Encodes the peptide sequence at SEQ ID NO 17639
atgactggaggccttgccggcggcgtcgtcgaggtagaggtgctgggtccggtctcgttcttcccgacgtgcctatcgtcgtccccgtcgccggagaagttgctgcgtggtcgcaccggagggtttatcaaggaaggttcagaaaactcactggacaagctgatggatcctaccactattgattcgaaatggacgtctcccatcactgaagatgggtccatggacagacgaggaaacccagctgtcaagacaaccaccggaggatggagatctgccatcctgctgttagctaactatggactcgcgacgtgcgccttcttcggcgtcggcgtgaacctcgtggtgttcctgcgccgggtgctccaccagggcaacgccgaggcggccaacaacatcagcaagtggacagggaccgtctacatcttctccctcatcggcgccttcctcagcgactcctactggggccgttacgtcacctgcgccatctttcagatcatctatgtgacgggcctggtgatcctgtcgcttgcgtcatggttcttgttggtgaagccctccggctgcggcggcgtcaaggtgcactgcgacgagccgtcggcgcccggcgtcgcgctgttctacctgtccacctacatgatcgcgttcggcaacggagggtaccagccttccatcgcgaccttcggatcggaccagttcgacgagacggaccccaaggaggggcgctccaaggtcgccttcttcagctacttctacctggcgctcaacgtggggtccctgttttccaacacggtgctggtgtactacgaggactcagggcggtgggtcatggggttctgggtctcggcggccgccgccgcgctggcgctcgtgctcttcttgctcggcacgcccaactaccggcacttcaagccgagcggcaacccgctgacccgcgtcgcgcaggtgttcgtcgccgcgttccgcaagtggcacgctgaggttccccgcggcgagctcctccacgaggtggaaggagaggaccctaagatctcgggcatccgcaagatccttcacagcgacgagctcaggttcctcgacaaagcggcgacgatcaccgagggggagaagatggagaacccgtggaggctctgcacggtgacgcaggtggaggaggtgaagtgcatcctgaagatgctgcccatctggctgtgcacgatcgtgtactcggtggtgttcacccagatggcgtcgctgttcgtggagcagggcgccaccatggacaccaacatcgggtcgttccacttccccgcagcgagcatgtcgctgttcgacgtcctcagcgtgctggcgttcatcgccatctaccggcgggtcctggtgcccgtcatggcgcggctgtcgggcaacccgcagggcctgacggagctgcagcgcatgggcgtcgggctcgtgatcggcatggcggcgatggtggtggcgggcgtggtggaggtggagcggctgaagcgcgtggcagccccggaccagccgagctccctgagcgtgctgtggcaggtgccgcagtacgcgctgatcggggcgtcggaggtgttcatgtacgtggggcagctggagttcttcaacgggcaggcgcccgacggcgtcaagagcttcggcagcgcgctgtgcatggcgtccatctcgctggggaactacgtgagcatcatgctggtgagcgtggtcacaagcctcaccgccggggagaagcgtccggggtggatccctgggaacctcaactccggccacctggacaggttctacttcctcctcgcagcgctctcgctcgtcgacctcgccgtctacatcgcctgtgccatgtggtacaagggcatcaagcttgacggcggcgacggcgatgacagtagaaaggtctctgcgcatgtctag

SEQ ID NO: 17639 - protein, 634 aa, Sorghum bicolor
  misc_feature: Useful for making plants with altered carbon content
  misc_feature: Useful for making plants with altered nitrogen content
  misc_feature: Functional homolog of the protein sequence given in SEQ ID NO 14559
  misc_feature: Ceres ANNOT ID no. 8680995
  misc_feature: Up-regulated in shoot tissues in response to salicylic acid treatment
  misc_feature (157)..(553): Pfam ID: PTR2 Pfam Description: POT family
MTGGLAGGVVEVEVLGPVSFFPTCLSSSPSPEKLLRGRTGGFIKEGSENSLDKLMDPTTIDSKWTSPITEDGSMDRRGNPAVKTTTGGWRSAILLLANYGLATCAFFGVGVNLVVFLRRVLHQGNAEAANNISKWTGTVYIFSLIGAFLSDSYWGRYVTCAIFQIIYVTGLVILSLASWFLLVKPSGCGGVKVHCDEPSAPGVALFYLSTYMIAFGNGGYQPSIATFGSDQFDETDPKEGRSKVAFFSYFYLALNVGSLFSNTVLVYYEDSGRWVMGFWVSAAAAALALVLFLLGTPNYRHFKPSGNPLTRVAQVFVAAFRKWHAEVPRGELLHEVEGEDPKISGIRKILHSDELRFLDKAATITEGEKMENPWRLCTVTQVEEVKCILKMLPIWLCTIVYSVVFTQMASLFVEQGATMDTNIGSFHFPAASMSLFDVLSVLAFIAIYRRVLVPVMARLSGNPQGLTELQRMGVGLVIGMAAMVVAGVVEVERLKRVAAPDQPSSLSVLWQVPQYALIGASEVFMYVGQLEFFNGQAPDGVKSFGSALCMASISLGNYVSIMLVSVVTSLTAGEKRPGWIPGNLNSGHLDRFYFLLAALSLVDLAVYIACAMWYKGIKLDGGDGDDSRKVSAHV

SEQ ID NO: 17640 - DNA, 1335 bp, Sorghum bicolor
  misc_feature: Ceres ANNOT ID no. 8681018
  misc_feature: Up-regulated in shoot tissues in response to salicylic acid treatment
  misc_feature: Encodes the peptide sequence at SEQ ID NO 17641
atgtccacccaggaaagcttgatcacaaactgcaaggcccctgctttcctcatttgctcaattccatttcggttgatggcaagaacatttgagaacaagcagatgcagccgagacagattggctctcctatgcaaggaaaatatcaatcaatatcagtgggcgacaaggtggagggcgtgttcttcgtcggtgcttctcgtcgtattaggagcgaggccggtgttgctaaaggtccaggctgcaggtcgtctagccgtggtgcagcggtgctggtggcggcgactggagctggcgagaccgtgaagctggcggccggcaagtggtgggagcggccagatgacacggccatgccgggaatggacccgggcgggggcggcagctcgcgctacttccaccagctgctgcggccgcagcagcagcagcagccgtcgccgctgtcgcccaattcccacgtcaagatggagcaccaccacaagatgtctccggacaagagccccgtcggtggcgaggccgaggcgggcgggagcggcggcggcggcgaccagccgtcctcgtcggctttggtcccagtcgagggtggcagcggcgggggaggaggcagcgggtcgggcacgcccacgcggcggccgcggggccgcccgccggggtccaagaacaagcctaagccgcccatcatcgtgacgcgcgacagccccaacgcgctgcactcgcacgtcctcgaggtcgccgcgggagccgacgtcgtggactgcgtcgcggagtacgcgcgccgccggggtcgaggcgtgtgcgtgctcagcggcgggggcgccgtcgtcaacgtggcgctcaggcagcccggcgcgtcgccccccgggagcatggtggccacgctgaggggacggttcgagatcctctccctcaccggcaccgtgctgccgccgcccgctccccccggcgcgagtggcctcacggtgttcctctccggcgggcagggccaggtcatcggcgggagcgtggtgggcccactggtcgccgcggggcccgttgtcctgatggctgcgtcgttcgccaacgccgtgtacgagcggctcccgctggagggggaggaagaggagacagccgcggctgccgccggagccgaaccacaagatcaagtggcgcagtcggctggacccccaggtcagcagccgacggcgtctcagtcctctggtgtgaccggaggaggcgacgccggcggcggcggcatgtcgctctacaacctcgctgggaatgtaggggcctaccagctaccgggagacaacttcggaggctggagtggaggcggtggcggcggagtccggccaccgttttga

SEQ ID NO: 17641 - protein, 444 aa, Sorghum bicolor
  misc_feature: The sequence is a functional homolog of SEQ ID NO 10 in the 10/669,824 US patent application
  misc_feature: The sequence is a functional homolog of SEQ ID NO 10 in the 10/870,198 US patent application
  misc_feature: The sequence is a functional homolog of SEQ ID NO 1399 in the 10/374,780 US patent application
  misc_feature: The sequence is a functional homolog of SEQ ID NO 1509 in the 10/412,699 US patent application
  misc_feature: The sequence is a functional homolog of SEQ ID NO 340 in the 11/435,388 US patent application
  misc_feature: The sequence is a functional homolog of SEQ ID NO 342 in the 10/714,887 US patent application
  misc_feature: Ceres ANNOT ID no. 8681018
MSTQESLITNCKAPAFLICSIPFRLMARTFENKQMQPRQIGSPMQGKYQSISVGDKVEGVFFVGASRRIRSEAGVAKGPGCRSSSRGAAVLVAATGAGETVKLAAGKWWERPDDTAMPGMDPGGGGSSRYFHQLLRPQQQQQPSPLSPNSHVKMEHHHKMSPDKSPVGGEAEAGGSGGGGDQPSSSALVPVEGGSGGGGGSGSGTPTRRPRGRPPGSKNKPKPPIIVTRDSPNALHSHVLEVAAGADVVDCVAEYARRRGRGVCVLSGGGAVVNVALRQPGASPPGSMVATLRGRFEILSLTGTVLPPPAPPGASGLTVFLSGGQGQVIGGSVVGPLVAAGPVVLMAASFANAVYERLPLEGEEEETAAAAAGAEPQDQVAQSAGPPGQQPTASQSSGVTGGGDAGGGGMSLYNLAGNVGAYQLPGDNFGGWSGGGGGGVRPPF

SEQ ID NO: 17642 - DNA, 843 bp, Sorghum bicolor
  misc_feature: Ceres ANNOT ID no. 8681061
  misc_feature: Encodes the peptide sequence at SEQ ID NO 17643
atggcgagagccttccgcgcggcctccccgctgcccctgccgagctcgaggagcggcgccgccaccgcggtgacgaacggcggcgggagagggaacttcccgtggctaacgaagaagagctcgagcaagccggcggcgccgagcgggggcagccaagagagcaagggtgacgagcccgagggggcgaacaccacccccgccgccgccgccaccgggtccgtcgagcagtctccgtccccgccgtcgtcgtcgtcgaggaagcgcgcggacgcgctggcgcggctgcgggcggcgttcctggcggcgatcacgcacaggcgccggcgccggcagctggggtcctgcgtgacgggcaccatcttcggccggcggcgcgggcgcgtgcacgtcgcgctgcagacggacccgcgctccgcgcccgtgctgctggtggagatggccgcctactccacaggcgcgctcgtcagggagatgtcctcgggcctcgtgcgcctcgcgctcgagtgcgagaagacgccgctcgccgccggggagaagcggcgggggttgctggaggagccaacgtggcgcgcgtactgcaacggtcgcaagtgcgggttcgcggtgcggcgggagtgcggcgcggacgagtggagggtgctcggcgcggtcgagccggtgtccgtgggcgccggcgtgctcccggacgacgtcgccggcgccggagccgtggagggcgacctgatgtacatgcgggcaaggttcgagcgcgtggtgggctccagggactcggaggcgttctacatgatgaaccccgacggcagcggcggccccgagctcagcatctaccttctacgagtctga

SEQ ID NO: 17643 - protein, 280 aa, Sorghum bicolor
  misc_feature: Useful for biocontainment applications
  misc_feature: Functional homolog of the protein sequence given in SEQ ID NO 14434
  misc_feature: Useful for making plants with modulated flowering time
  misc_feature: Functional homolog of the protein sequence given in SEQ ID NO 14560
  misc_feature: Ceres ANNOT ID no. 8681061
MARAFRAASPLPLPSSRSGAATAVTNGGGRGNFPWLTKKSSSKPAAPSGGSQESKGDEPEGANTTPAAAATGSVEQSPSPPSSSSRKRADALARLRAAFLAAITHRRRRRQLGSCVTGTIFGRRRGRVHVALQTDPRSAPVLLVEMAAYSTGALVREMSSGLVRLALECEKTPLAAGEKRRGLLEEPTWRAYCNGRKCGFAVRRECGADEWRVLGAVEPVSVGAGVLPDDVAGAGAVEGDLMYMRARFERVVGSRDSEAFYMMNPDGSGGPELSIYLLRV

SEQ ID NO: 17644 - DNA, 1122 bp, Sorghum bicolor
  misc_feature: Ceres ANNOT ID no. 8681108
  misc_feature: Encodes the peptide sequence at SEQ ID NO 17645
atgacgccggcggcggcgatctccggctccagcggccacctcgtcgtctcctccccctgcctcaggcagccgctcccgccatctccgcgcaccgctcgcccaatcgcggccaacgccgcctcgcccgtggcccgccgcggggtcgcggccgccgccgtgtccagccccgctgtgtcggccgccgcggggaaggatgccaaacaggctcctaaggatttccttcatatcaatgattttgacaaggatacaataatgaatatccttaatcgagcgattgaggttaaggcagcgataaagtctggggacaggagcttccaaccgttcaaagggaaatcaatggcgatgatttttgccaagccatcaatgaggacccgtgtttcatttgagacgggattcttcttacttggcgggcatgctatttatttgggtccagatgatatccagatgggcaagcgtgaggagactcgtgatgttgctcgagtactttctggctataatgacatcattatggctagggtctttgctcaccaggatattctggacttggcaaattatgcacctgtacctgtcataaatggtctcactgactataaccatccatgccagataatggctgatgcacttactatgcttgagcacattggtcgtattgaaaacaccaaggttgtctatgttggagatgggaacaacattgtgcactcatggcttctattggctgctgtacttccttttcactttgtatgtgcttgtcccaagggatttgagcctgatgcgaagacagtggagatcgctaggagtgctggaatcagtaagattgaaataacaaacgatcccagggaagcagttaagggagcagatgttgtgtatacagatgtttgggccagcatgggccaaaaggaagaagctgattatagaaaacagaagtttcagggattcacggtcgatgaagccctgatggagattgctggctcccaagcctaccttatgcactgtttgcctgctgagagaggagtggaggtgacagacggtgccatcgaggctcccaactcaatcgtgttcccccaggctgaaaacagaatgcacgctcagaatgccatcatgctccacgtgctcggtgcttaa

SEQ ID NO: 17645 - protein, 373 aa, Sorghum bicolor
  misc_feature: Useful for making plants with modulated nitrogen use efficiency
  misc_feature: Functional homolog of the protein sequence given in SEQ ID NO 14561
  misc_feature: Ceres ANNOT ID no. 8681108
  misc_feature (71)..(372): SWISSPROT Homolog: EC 2.1.3.3 Ornithine carbamoyltransferase
  misc_feature (217)..(370): Pfam ID: OTCace Pfam Description: Aspartate/ornithine carbamoyltransferase, Asp/Orn binding domain
  misc_feature (71)..(213): Pfam ID: OTCace_N Pfam Description: Aspartate/ornithine carbamoyltransferase, carbamoyl-P binding domain
MTPAAAISGSSGHLVVSSPCLRQPLPPSPRTARPIAANAASPVARRGVAAAAVSSPAVSAAAGKDAKQAPKDFLHINDFDKDTIMNILNRAIEVKAAIKSGDRSFQPFKGKSMAMIFAKPSMRTRVSFETGFFLLGGHAIYLGPDDIQMGKREETRDVARVLSGYNDIIMARVFAHQDILDLANYAPVPVINGLTDYNHPCQIMADALTMLEHIGRIENTKVVYVGDGNNIVHSWLLLAAVLPFHFVCACPKGFEPDAKTVEIARSAGISKIEITNDPREAVKGADVVYTDVWASMGQKEEADYRKQKFQGFTVDEALMEIAGSQAYLMHCLPAERGVEVTDGAIEAPNSIVFPQAENRMHAQNAIMLHVLGA

SEQ ID NO: 17646 - DNA, 417 bp, Sorghum bicolor
  misc_feature: Ceres ANNOT ID no. 8681118
  misc_feature: Encodes the peptide sequence at SEQ ID NO 17647
atgattgtaggagtgtctccaagtacaattgttgttcagtcaccctacattgctcaagtgcaattgttaagagagaagctacaagaatatcctgggctttgtcctgttgaggtttcaaccatagatagctttcagggtagggaggcagatgcagtgatcatatcaatggttcgctcgaatccactaggagctgtagggtttctgggcgacagcaggcgcatcaatgtggctattacgagagcacggaagcacgttactgtggtttgtgatacctccacaatttgtcacagcaccttccttgccaggcttcttcgccatatcaggcggtatggccaagtaaaacacgttgcccctggttccttggatggggcttctggcctcggcttcagtcaacctactctcccctctatcagttaa

SEQ ID NO: 17647 - protein, 138 aa, Sorghum bicolor
  misc_feature: Useful for making plants with modulated salt sensitivity
  misc_feature: Functional homolog of the protein sequence given in SEQ ID NO 13507
  misc_feature: Ceres ANNOT ID no. 8681118
MIVGVSPSTIVVQSPYIAQVQLLREKLQEYPGLCPVEVSTIDSFQGREADAVIISMVRSNPLGAVGFLGDSRRINVAITRARKHVTVVCDTSTICHSTFLARLLRHIRRYGQVKHVAPGSLDGASGLGFSQPTLPSIS

SEQ ID NO: 17648 - DNA, 1113 bp, Sorghum bicolor
  misc_feature: Ceres ANNOT ID no. 8681142
  misc_feature: Encodes the peptide sequence at SEQ ID NO 17649
atggctcacgcgacgctgctccactgctcccaatcctccacgagccccctagcctgtcgccgcggcagccactactactaccgcgccccttcgcacgtcccgcgccgctcccgcccccgcggacgcggcggcgtcgtcagcctgcgtccgatggcctcgtcgacggcggctcagccccccgcgccggcgcccccgggcctgaaggagggcatcgcggggctgtacgacgagtcttcggggctgtgggagaacatctggggcgaccacatgcaccacggcttctacgactcgggcgaggccgcgtccatggccgaccaccgacgcgcccagatccgcatgatcgaggaggcgctcgccttcgccgccgtcccatccccagatgatccggagaaggcaccaaaaaccatagtagatgttggatgtggcattggtggtagctcaaggtacttggctaagaaatacggagcacagtgcaaggggatcacattgagccctgttcaagctgaaagaggaaatgctcttgctgcagcgcaggggttgtcggatcaggttactctgcaagttgctgatgctctggagcaaccgtttcctgatgggcagtttgatctggtatggtccatggagagtggcgagcacatgccggacaagagaaagtttgttagtgagctggcacgcgtcgctgctcctggagggacaataatcatcgtgacatggtgccataggaacctcgaaccatctgagacttcgctaaaacccgatgaactgagtctcttgaagaggatttgcgatgcgtactacctcccagactggtgctcaccttcagactatgtgaacatcgccaaatcactgtctctggaggatatcaaggcagctgattggtcagagaatgtggccccattttggcccgctgtgataaaatcagcactaacatggaagggcctcacctctctactgacaagcggatggaagacgatcagaggggcgatggtgatgccgctgatgatccaaggttacaagaaggggctcatcaaattcaccatcatcacctgtcgcaagcctggagcagcgtatgtgaccaatgggcagaagttactgtcaaagcacctctgctaa

SEQ ID NO: 17649 - protein, 370 aa, Sorghum bicolor
  misc_feature: The sequence is a functional homolog of SEQ ID NO 22 in US patent 7226745
  misc_feature: The sequence is a functional homolog of SEQ ID NO 36 in US patent 7244877
  misc_feature: Useful for making plants with modulated nitrogen use efficiency
  misc_feature: Functional homolog of the protein sequence given in SEQ ID NO 13084
  misc_feature: Ceres ANNOT ID no. 8681142
  misc_feature (67)..(353): SWISSPROT Homolog: EC 2.1.1.95 Tocopherol O-methyltransferase
  misc_feature (137)..(235): Pfam ID: Methyltransf_11 Pfam Description: Methyltransferase domain
MAHATLLHCSQSSTSPLACRRGSHYYYRAPSHVPRRSRPRGRGGVVSLRPMASSTAAQPPAPAPPGLKEGIAGLYDESSGLWENIWGDHMHHGFYDSGEAASMADHRRAQIRMIEEALAFAAVPSPDDPEKAPKTIVDVGCGIGGSSRYLAKKYGAQCKGITLSPVQAERGNALAAAQGLSDQVTLQVADALEQPFPDGQFDLVWSMESGEHMPDKRKFVSELARVAAPGGTIIIVTWCHRNLEPSETSLKPDELSLLKRICDAYYLPDWCSPSDYVNIAKSLSLEDIKAADWSENVAPFWPAVIKSALTWKGLTSLLTSGWKTIRGAMVMPLMIQGYKKGLIKFTIITCRKPGAAYVTNGQKLLSKHLC

SEQ ID NO: 17650 - DNA, 1416 bp, Sorghum bicolor
  misc_feature: Ceres ANNOT ID no. 8681154
  misc_feature: Encodes the peptide sequence at SEQ ID NO 17651
atggacgcaggatcccactcgatctcctcggagaagagccgcgccgccgccgcgccccggccgccgctgcaggaggcggtctcccgcccctacatgccatcgctgggctcgggatgccgtaacccgtcggccaagtgctacggcgacagattcatcccggacagatcggcgatggacatggacatggcacacttcctgctcactgagcccaggaaggacaaggagaacgcggcggcgtccccgtccaaggaggcgtaccggaggctgctcgcggagaagctgctcaacaaccggacacggatcctcgccttcaggaacaagccgccggagcccgagaacgtatctttcgccgatgcggcttcctccaacctgcaggccaagcctgctaagcagcggcgccacattccccagtctgccgagaggaccctagacgccccagagcttgttgatgactactacctcaacctgcttgactgggggagcaacaatgtgctgtccattgctctgggagacacactgtacctgtgggatgcgtcgagtggatccacatccgagcttgtgaccatcgatgaggacagcggtcctattaccagtgttagctgggctcctgatggtcggcacatcgccgtggggctcaactcgtccgacgtccagctttgggacaccagctccaaccgactgttgagaacactcagaggtgtgcatgaggcaagggtaggttcactggcatggaacaacagcatcctaaccaccggtggcatggatggcaagattgtgaacaatgacgtgaggattagagaccacgttgtgcagacttacgaggggcacagccaggaggtgtgcgggctcaagtggtctggatcagggcagcagctggccagcggaggcaacgacaaccttctgcacatttgggatgtgtcgatggcatcatccatgccatctgctggccgcaaccagtggctacataggctcgaggaccacacggccgccgtgaaggcactcgcgtggtgcccgttccagagcaacttgcttgccactggcggtggtggcagcgatcgttgcatcaagttctggaacacacacactggtgcgtgcctgaactcagttgacaccggatcacaggtgtgcgctcttctctggaacaagaatgagagggagctgctgagttcacatggattcacacagaaccaactgactttgtggaagtacccatcgatggtgaagatggctgaacttactggccatacctctcgtgtccttttcatggctcagagtcctgatggatgcacagtagcgtcagctgctgcagatgagaccctccggttctggaacgtttttggagcccctgaagcgcccaagcctgctgccaaagcttcccacactgggatgttcaacagcttcaaccatatccgatag

SEQ ID NO: 17651 - protein, 471 aa, Sorghum bicolor
  misc_feature: Useful for making plants with modulated biomass
  misc_feature: Functional homolog of the protein sequence given in SEQ ID NO 13536
  misc_feature: Ceres ANNOT ID no. 8681154
  misc_feature (272)..(443): SWISSPROT Homolog: EC 2.3.1.48 Histone acetyltransferase
  misc_feature (267)..(305): Pfam ID: WD40 Pfam Description: WD domain, G-beta repeat
  misc_feature (406)..(444): Pfam ID: WD40 Pfam Description: WD domain, G-beta repeat
  misc_feature (183)..(221): Pfam ID: WD40 Pfam Description: WD domain, G-beta repeat
MDAGSHSISSEKSRAAAAPRPPLQEAVSRPYMPSLGSGCRNPSAKCYGDRFIPDRSAMDMDMAHFLLTEPRKDKENAAASPSKEAYRRLLAEKLLNNRTRILAFRNKPPEPENVSFADAASSNLQAKPAKQRRHIPQSAERTLDAPELVDDYYLNLLDWGSNNVLSIALGDTLYLWDASSGSTSELVTIDEDSGPITSVSWAPDGRHIAVGLNSSDVQLWDTSSNRLLRTLRGVHEARVGSLAWNNSILTTGGMDGKIVNNDVRIRDHVVQTYEGHSQEVCGLKWSGSGQQLASGGNDNLLHIWDVSMASSMPSAGRNQWLHRLEDHTAAVKALAWCPFQSNLLATGGGGSDRCIKFWNTHTGACLNSVDTGSQVCALLWNKNERELLSSHGFTQNQLTLWKYPSMVKMAELTGHTSRVLFMAQSPDGCTVASAAADETLRFWNVFGAPEAPKPAAKASHTGMFNSFNHIR

SEQ ID NO: 17652 - DNA, 822 bp, Sorghum bicolor
  misc_feature: Ceres ANNOT ID no. 8681152
  misc_feature: Encodes the peptide sequence at SEQ ID NO 17653
atggagagggccgggtacggcggcgctgggccgatgggcggggtggtgctgtcgcgggaccccaagccgcggctgcggtggacgcccgacctgcacgagcgcttcgtcgaggccgtcaccaagctcggcgggcccgacaaggcgacgcccaagtcagtgctgaggctgatgggaatgaaagggctcactttgtaccacttgaagagtcacctccagaaatacaggcttggaaagcagagcaagaaagacacaggtttggaagccagcagaggggcattcgcggcgcagggcatcaatttctccacaccagtacctcctagcattccatctacggccagtaacaatacgggagaaacgccacttgcggatgcgctgaagtaccaaattgaagtccaaaggaaactgcacgaacagctcgaggttcagaagaagctgcaaatgcggatcgaggcgcaaggcaaatatctgcagacgatactcgagaaagcccagagcaacctctcctacgacgcaaccggaggcgcaaatctagaagcaaccaggtcacagctgacggacttcaacctcgcgctctcagggttcatggacaacgtgacccaagtgtgcgagcagaaaaatggcgagctggcgaaagccatgtccgaggacggcctcagagcgagcaataatcttggatttcagctgtaccaccatggagttcaggacagggacgatgtcaagtgcgcgacggatgaagggctgctgctgctggacctgaacattagaggagggtacgatcaccgggcttcggcggatctgaagatgaatcagcacatgaggtaa

SEQ ID NO: 17653 - protein, 273 aa, Sorghum bicolor
  misc_feature: The sequence is a functional homolog of SEQ ID NO 1589 in the 11/479,226 US patent application
  misc_feature: The sequence is a functional homolog of SEQ ID NO 762 in the 10/412,699 US patent application
  misc_feature: The sequence is a functional homolog of SEQ ID NO 1062 in the 10/225,066 US patent application
  misc_feature: The sequence is a functional homolog of SEQ ID NO 2788 in the 10/374,780 US patent application
  misc_feature: Useful for making plants with altered alkaloid content
  misc_feature: Useful for making plants with altered lignin content
  misc_feature: Functional homolog of the protein sequence given in SEQ ID NO 13089
  misc_feature: The sequence is a functional homolog of SEQ ID NO 1097 in the 11/479,226 US patent application
  misc_feature: The sequence is a functional homolog of SEQ ID NO 2402 in the 10/374,780 US patent application
  misc_feature: The sequence is a functional homolog of SEQ ID NO 548 in the 10/225,066 US patent application
  misc_feature: Useful for making plants with altered terpenoid content
  misc_feature: Functional homolog of the protein sequence given in SEQ ID NO 13070
  misc_feature: Useful for making plants with modulated flowering time
  misc_feature: Functional homolog of the protein sequence given in SEQ ID NO 13579
  misc_feature: The sequence is a functional homolog of SEQ ID NO 2000 in the 11/479,226 US patent application
  misc_feature: The sequence is a functional homolog of SEQ ID NO 1995 in the 11/479,226 US patent application
  misc_feature: The sequence is a functional homolog of SEQ ID NO 1996 in the 11/479,226 US patent application
  misc_feature: The sequence is a functional homolog of SEQ ID NO 1997 in the 11/479,226 US patent application
  misc_feature: The sequence is a functional homolog of SEQ ID NO 1998 in the 11/479,226 US patent application
  misc_feature: The sequence is a functional homolog of SEQ ID NO 2001 in the 11/479,226 US patent application
  misc_feature: The sequence is a functional homolog of SEQ ID NO 1999 in the 11/479,226 US patent application
  misc_feature: Ceres ANNOT ID no. 8681152
  misc_feature (24)..(75): Pfam ID: Myb_DNA-binding Pfam Description: Myb-like DNA-binding domain
MERAGYGGAGPMGGVVLSRDPKPRLRWTPDLHERFVEAVTKLGGPDKATPKSVLRLMGMKGLTLYHLKSHLQKYRLGKQSKKDTGLEASRGAFAAQGINFSTPVPPSIPSTASNNTGETPLADALKYQIEVQRKLHEQLEVQKKLQMRIEAQGKYLQTILEKAQSNLSYDATGGANLEATRSQLTDFNLALSGFMDNVTQVCEQKNGELAKAMSEDGLRASNNLGFQLYHHGVQDRDDVKCATDEGLLLLDLNIRGGYDHRASADLKMNQHMR

SEQ ID NO: 17654 - DNA, 1254 bp, Sorghum bicolor
  misc_feature: Ceres ANNOT ID no. 8681174
  misc_feature: Encodes the peptide sequence at SEQ ID NO 17655
atggcgatctgcagcgcgcacactaccaccacctccctgcactccccatgcacgaccaccgtctccaacgcagctggcttcagacagaggcaagtcattttcttcaccagcagcagcaaccgtaggagctgcggcggcggcggcggcggcagaaggcatcacggaggggcacggaccagctgcttccaggtctcatgctccgtcgacaagccggtggtgattggcctggcggcggactccgggtgcggcaagagcaccttcatgcgccggctcaccagcgtctttggtggcgccgcggtgccgcccaagggcgggaacccggactccaacacgctcatcagtgacaccaccacagtgatctgcctcgacgactaccattccctggacaggaacggcaggaaggagtacggtgtgaccgccctcgacccaagggccaacaactttgatctcatgtatgagcaggtgaaggcgatcaaagatggccaggcagtcgagaagcccatctacaaccatgtcactggcctcctcgacccgccggagcttatcacgccgccaaagatttttgtcattgaaggtctgcacccaatgttcgatcagcgtgtgagggacctcttagatttcagtatctacttggacatcagtgatgaagttaagtttgcatggaaaatccagcgggacatggcagagcgtgggcacagccttgaaagcatccaagccagtatcgaggccaggaaaccagattttgatgcttatattgatccgcagaagcagtatgctgatgctgtgattgaagttctgccgacccagttgattcccggtgacaatgaagggaaggtgcttcgtgttaagctcatcatgaaagaaggggtgaagttcttcaacccagtttatctctttgatgaaggatcgagcatcagctgggtgccttgtggaagaaagctcacatgctcttaccctggcatcaaatttgcctatggcccagacacttactttggaaaggaggtatccgttctggagatggatgggcaatttgacaaactagatgagctcatctacgtggagagccatctaagcaacctctcgaccaagttctacggagaggtgacacagcaaatgctaaagcatgcagacttcccaggaagcaacaacggaactggtctcttccagaccatcattgggctgaaaattagggacctctatgaacagattgttgctgagagggctggtgtaccggcggaagcagccaaagtttaa

SEQ ID NO: 17655 - protein, 417 aa, Sorghum bicolor
  misc_feature: Useful for making plants with altered lignin content
  misc_feature: Functional homolog of the protein sequence given in SEQ ID NO 14562
  misc_feature: Ceres ANNOT ID no. 8681174
  misc_feature (1)..(417): SWISSPROT Homolog: EC 2.7.1.19 Phosphoribulokinase
  misc_feature (73)..(272): Pfam ID: PRK Pfam Description: Phosphoribulokinase / Uridine kinase family
MAICSAHTTTTSLHSPCTTTVSNAAGFRQRQVIFFTSSSNRRSCGGGGGGRRHHGGARTSCFQVSCSVDKPVVIGLAADSGCGKSTFMRRLTSVFGGAAVPPKGGNPDSNTLISDTTTVICLDDYHSLDRNGRKEYGVTALDPRANNFDLMYEQVKAIKDGQAVEKPIYNHVTGLLDPPELITPPKIFVIEGLHPMFDQRVRDLLDFSIYLDISDEVKFAWKIQRDMAERGHSLESIQASIEARKPDFDAYIDPQKQYADAVIEVLPTQLIPGDNEGKVLRVKLIMKEGVKFFNPVYLFDEGSSISWVPCGRKLTCSYPGIKFAYGPDTYFGKEVSVLEMDGQFDKLDELIYVESHLSNLSTKFYGEVTQQMLKHADFPGSNNGTGLFQTIIGLKIRDLYEQIVAERAGVPAEAAKV

SEQ ID NO: 17656 - DNA, 1482 bp, Sorghum bicolor
  misc_feature: Ceres ANNOT ID no. 8681171
  misc_feature: Encodes the peptide sequence at SEQ ID NO 17657
atgtgtgactacttcctgcaaaggatggagggcgaccagcatcaccaggccggggacctcacggacgtcgtccgagccggcggcgcgatgcatcagcagggagctatcgcggagctctcctcctccacggccacggggtggcagctcccggccgagccagctccagctgggcccggcctcttcctgccaccgcagccgtcgtcgtcggatggcggcgacggcttcgcggacgccttcgccggcctcccggacccgttcgccagcgacttcgtccgcgcctcttcctcctccggcggcggccccgtccctgctgccgacttcttcgacttcgaggcgcctgccgctgctgtcggtggtggcgccaggagaggcggaggcggcgtactggtggatagcggcggaggcggagtggtggtggagaggggggtgccgcagatgcccgcgctgtcgccgagggagatacggccgtacccggtgacgatgattggcggcgacaccgtgaagatcggcgtgccgacgatgatgcccgggctggcggttgggccggcctgtgcgttcgacgccatcgccgggttgcagatgccgtcgccgcacggcggcgggatcaagcgcaggaagaaccaggcaaggaaggtggtctgcatcccagcacctgcagccgcgggaggaaggaccactggggaggttgttccttctgatctctgggcttggaggaagtatggacagaagcctatcaaaggatcaccctacccaagatgcagcagctctaaaggatgcccggcgcggaagcaggtggagcgcagccggaccgacccaagtctgctggtcatcacctacaactcggagcacaaccacccttggccgacgcagcggaacgcgctcgccggctcaacacgctctcaccacgccaagaacagcaagaacaacccctcgcagcacaacctgcagaagccagaccttaaagccgaacctgagcatcatcaggcctcggcggcagtagtccctactggctgcgccaccaccgcgacgaccgcagccaccagcaccaccaccacagcgaccacgagcaccaccagcaacagcactcctccgccggcgacgatggcagtgaaagaggaggcaatggtggggtcggaaatggagaaagggatggaccatgacgcttctgtcttgctggatcacggtgatctcatgcagcagatgttcagccagagctactacaggccgatgataccggaggccggcggcggcggtggcggccaccacgccgatgacttcttcgctgatctcgccgagctggagtcggatcccatgagcctcatcttcccaggtggtggtgatcctggaaaggagaaggaaatgatgcccaacaagagcttgggcgccgatccattattcggcatgctagattggggtgccactaataatggtgttgctacttctgcagggagttcatttgagcaagacgagagtggttggtga

SEQ ID NO: 17657 - protein, 493 aa, Sorghum bicolor
  misc_feature: The sequence is a functional homolog of SEQ ID NO 1026 in the 10/412,699 US patent application
  misc_feature: The sequence is a functional homolog of SEQ ID NO 534 in the 10/374,780 US patent application
  misc_feature: Ceres ANNOT ID no. 8681171
  misc_feature (231)..(287): Pfam ID: WRKY Pfam Description: WRKY DNA -binding domain
MCDYFLQRMEGDQHHQAGDLTDVVRAGGAMHQQGAIAELSSSTATGWQLPAEPAPAGPGLFLPPQPSSSDGGDGFADAFAGLPDPFASDFVRASSSSGGGPVPAADFFDFEAPAAAVGGGARRGGGGVLVDSGGGGVVVERGVPQMPALSPREIRPYPVTMIGGDTVKIGVPTMMPGLAVGPACAFDAIAGLQMPSPHGGGIKRRKNQARKVVCIPAPAAAGGRTTGEVVPSDLWAWRKYGQKPIKGSPYPRCSSSKGCPARKQVERSRTDPSLLVITYNSEHNHPWPTQRNALAGSTRSHHAKNSKNNPSQHNLQKPDLKAEPEHHQASAAVVPTGCATTATTAATSTTTTATTSTTSNSTPPPATMAVKEEAMVGSEMEKGMDHDASVLLDHGDLMQQMFSQSYYRPMIPEAGGGGGGHHADDFFADLAELESDPMSLIFPGGGDPGKEKEMMPNKSLGADPLFGMLDWGATNNGVATSAGSSFEQDESGW

SEQ ID NO: 17658 - DNA, 777 bp, Sorghum bicolor
  misc_feature: Ceres ANNOT ID no. 8681175
  misc_feature: Encodes the peptide sequence at SEQ ID NO 17659
atgacgaatggaggcggaggagcgcgtggcggaggcgtcaagtcgcagtacgggttccggccggcggagcccgcggggttcggcggcggcggcggcaggggcgatgcgaccgtcgacatccccctcgacaccatgaacgattcgaagggcaaggcgaaggagctgtctcagtgggagtcagatctcaggaggcgagagtcggatatcaggagaagggaggaagctctcaagagcgctggggtgcccatggaggacaagaactggccgcctttcttcccaatcatccaccatgatattgccaatgagataccagcgaacgcccagaagttgcagtatcttgcgttcgcgagctggcttggtattgtgctttgtctcttttggaattttattgctgtcatagtctgttggatcagagggggagattccaagctatttttcctggctaccatctatggtatgcttggcatccctttgtcctatttgatgtggtatagacctctgtaccgagcaatgagaactgacagtgctttcagctttggatggtttttcctttgttacctgctccacattggcttttgcatatttgctgccattgctcctccaattatattccgcggaaaatcgttaacgggtatactggctgcaattgacaccttttctgatcatgcaatagttgggatcttttactttgttggatttgccttgttttgcttggagacacttgtgagcatatgggttcttcagaaagtatacatgtacttcagagggcacaagtag

SEQ ID NO: 17659 - protein, 258 aa, Sorghum bicolor
  misc_feature: Useful for biocontainment applications
  misc_feature: Functional homolog of the protein sequence given in SEQ ID NO 13043
  misc_feature: Ceres ANNOT ID no. 8681175
  misc_feature (84)..(258): Pfam ID: SCAMP Pfam Description: SCAMP family
MTNGGGGARGGGVKSQYGFRPAEPAGFGGGGGRGDATVDIPLDTMNDSKGKAKELSQWESDLRRRESDIRRREEALKSAGVPMEDKNWPPFFPIIHHDIANEIPANAQKLQYLAFASWLGIVLCLFWNFIAVIVCWIRGGDSKLFFLATIYGMLGIPLSYLMWYRPLYRAMRTDSAFSFGWFFLCYLLHIGFCIFAAIAPPIIFRGKSLTGILAAIDTFSDHAIVGIFYFVGFALFCLETLVSIWVLQKVYMYFRGHK

SEQ ID NO: 17660 - DNA, 1056 bp, Sorghum bicolor
  misc_feature: Ceres ANNOT ID no. 8681188
  misc_feature: Encodes the peptide sequence at SEQ ID NO 17661
atggcggcgaaggcgagggtctcgctgacggtcttgctcgccgccgcgacgttggcgtgcttatgtgccgtggccgcctccgcctccgccttcgacgtgccgtccgtggccttcgaggagcggttctcgccgctgttcggcgacggcaacgttgtccgctcctccgacgacaggagcgtccgcctcctgctcgaccgccggtcaggttccgggttcatctcttcggactactacctccacggcttcttcagcgcgtccatcaagctgcccaaggactacacggccggcgtcgtcgtcgccttctacctgtctaatggggacgtgtacgagaagacgcacgacgagctggacttcgagttccttggcagccggtggggcgggcagtggcgcgtgcagaccaacgtctacggcaacggcagcaccagccatggccgggaggaacgctacctcctccccttcgaccccaccctcgaggcccacagctactccatcctatgggctcccactcacataatcttctacatcgacgacacgccgatccgggaggtgatccggcacccggacatgggcggcgacttcccggcgaagccgatggcggtgtacgccaccatctgggacggctccgcgtgggccacggacgggggcaagtacaaggtcaactacaagtacgcgccgttcgcgtccgacttctccgagctggccgtcgtcggcttccgcgccgacccggtgctccgcgtcgcgcaccgccacggcgcccgccaggccgacctcctcggcctcatgacggccgactacgccgtcatgacgccgcagaagcgcgcggccatgcgcgccttcagggcgcggcagatgacgtacacggtgtgctacgacgccgtgcggtacgcggacgggccgttcccggagtgcgacaactcggacgaggagagggagtccttctccgcctggggggaatccaagaccgtcgtcatgaggccccgcgcccgaggccgccgccggggacgcaaggccggcgccggtgccagggtaccgccggctgacgtgtcaagcagctga

SEQ ID NO: 17661 - protein, 351 aa, Sorghum bicolor
  misc_feature: Useful for making plants with altered carbohydrate content
  misc_feature: Functional homolog of the protein sequence given in SEQ ID NO 14068
  misc_feature: Useful for making plants with altered cell wall content and/or composition
  misc_feature: Functional homolog of the protein sequence given in SEQ ID NO 13698
  misc_feature: Ceres ANNOT ID no. 8681188
  misc_feature: Down-regulated in root tissues in response to methyl jasmonate treatment
  misc_feature (72)..(303): SWISSPROT Homolog: EC 2.4.1.207 Xyloglucan:xyloglucosyl transferase
  misc_feature (38)..(223): Pfam ID: Glyco_hydro_16 Pfam Description: Glycosyl hydrolases family 16
  misc_feature (255)..(303): Pfam ID: XET_C Pfam Description: Xyloglucan endo-transglycosylase (XET) C-terminus
MAAKARVSLTVLLAAATLACLCAVAASASAFDVPSVAFEERFSPLFGDGNVVRSSDDRSVRLLLDRRSGSGFISSDYYLHGFFSASIKLPKDYTAGVVVAFYLSNGDVYEKTHDELDFEFLGSRWGGQWRVQTNVYGNGSTSHGREERYLLPFDPTLEAHSYSILWAPTHIIFYIDDTPIREVIRHPDMGGDFPAKPMAVYATIWDGSAWATDGGKYKVNYKYAPFASDFSELAVVGFRADPVLRVAHRHGARQADLLGLMTADYAVMTPQKRAAMRAFRARQMTYTVCYDAVRYADGPFPECDNSDEERESFSAWGESKTVVMRPRARGRRRGRKAGAGARVPPADVSSS

SEQ ID NO: 17662 - DNA, 1380 bp, Sorghum bicolor
  misc_feature: Ceres ANNOT ID no. 8681191
  misc_feature: Down-regulated in root tissues in response to methyl jasmonate treatment
  misc_feature: Encodes the peptide sequence at SEQ ID NO 17663
atgcagatctttgttaagaccctcaccggcaagaccatcactctcgaggttgagagttcagacaccatcgacaatgttaaagccaagatccaagacaaggagggcatccccccggaccagcagaggctcatctttgctggcaagcagctagaggatggccgcactctggctgactacaatatccagaaggagtctaccctccatcttgtcttgcgcttgaggggtggcatgcagatatttgtgaagactcttacgggcaagacaatcacactggaggttgagagctctgacaccatcgacaatgtcaaggccaagattcaggataaggagggcattcccccggatcagcagagactcatctttgctggcaagcagctagaggatggccgcaccttggctgactacaatatccagaaggagtctaccctgcaccttgtcttgcgcctgaggggtggcatgcaaatctttgtcaagacattaactggcaagacaatcacactggaggttgagagttctgacactatcgacaatgtcaaggccaagattcaggataaggagggtattccaccggaccagcagaggctcatctttgctggcaagcagctcgaggatggccgcaccctggctgactataatatccagaaggagtctaccctgcatctggttttacgcctccgaggtgggatgcagatctttgtgaagacacttactgggaagactatcacgcttgaggttgagagctctgacacaattgacaacgtcaaggcgaagatccaggacaaggagggcatcccacctgaccaacagaggctcatctttgctgggaaacagctggaggatgggcgcacattggctgattacaatatccagaaggaatccacccttcatcttgtcctgcgtcttagaggagggatgcagatctttgtcaagaccttgactggcaagaccatcacactcgaggtagagagctctgacacaattgacaatgtcaaggcgaaaatccaggacaaggaggggatcccacctgaccagcagcggctcatctttgctgggaagcagctggaggatgggcgcaccttagctgactacaacatccagaaggaatccactcttcatcttgtcctgcggcttagggggggcatgcaaatctttgtcaagacactgactggcaagacaatcacgttggaagtggagagctctgacaccattgacaatgtgaaggccaagatccaggacaaggaagggattcctccagatcagcagaggctcatcttcgctgggaagcagcttgaggacgggcgcaccttggcagattacaacatccagaaggaatccactcttcatctcgtcctgcgcctccgtggtggccgtgttaactga

SEQ ID NO: 17663 - protein, 459 aa, Sorghum bicolor
  misc_feature: Useful for making plants with modulated nitrogen use efficiency
  misc_feature: Functional homolog of the protein sequence given in SEQ ID NO 13585
  misc_feature: Useful for making plants with modulated cold sensitivity
  misc_feature: Useful for making plants with modulated flowering time
  misc_feature: Functional homolog of the protein sequence given in SEQ ID NO 14303
  misc_feature: Ceres ANNOT ID no. 8681191
  misc_feature (6)..(74): Pfam ID: ubiquitin Pfam Description: Ubiquitin family
  misc_feature (82)..(150): Pfam ID: ubiquitin Pfam Description: Ubiquitin family
  misc_feature (158)..(226): Pfam ID: ubiquitin Pfam Description: Ubiquitin family
  misc_feature (234)..(302): Pfam ID: ubiquitin Pfam Description: Ubiquitin family
  misc_feature (310)..(378): Pfam ID: ubiquitin Pfam Description: Ubiquitin family
  misc_feature (386)..(454): Pfam ID: ubiquitin Pfam Description: Ubiquitin family
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGRVN

SEQ ID NO: 17664 - DNA, 1029 bp, Sorghum bicolor
  misc_feature: Ceres ANNOT ID no. 8681196
  misc_feature: Encodes the peptide sequence at SEQ ID NO 17665
atgaccggcacagtaaaagtccacaatgtctcacttaaagcaacagagcaagaaattagtgagttcttttcattttctggtgagatagtacatgtagaattgcaaagttgtgacgagcggtcacagtttgcctacatcacgttcagagataatcaaggagcagagagggctatgcttcttacgggagcgactattgaacatatggctgtcatcatcacaccagccaccgattacaagctacctgcgtccgttttagctgatctagagtcaaaaaataccggtggcatggaattcgctcttcagaaggctgaggatatcgtaagttctatgctagccaaagggtttgttcttggcatggatgccgttgaaaaagcaaagacttttgatgaaaagcatcagcttacatcaactgcaactgccaaagtcgcttcccttgacaagacaatgggactaagccagaagttcaacaccgggaccttagtggtgaatgagaaaatgaaggaaatggatgagaaataccaggttgcagagaagaccaagtcagcattagctgcggctgaacagactgtctctactgctagttctgccatcatgagtaacagatatatccttacaggtgcagcatgggtaactgatgcctacaacaaggttgcaaccactacgaccgatgttagcacgaagacaaaggaaagggtgatggagaatgagcatcaagtgggtgaacgtcaaatgactaatgtagaggagaataaaaatcacgagggtgaaattgcagtagcccacatgcaagaaaacactgagacagctgagaatcctagctgccacgagagtgaagtatccaaggccaatgctcatgatagcattctaatgactgaacaaagtgagcgagagcataagcaacccgaagatgaatttgcaaagacccatgtcccaggaagccctgtcactattccggtcaccatgtccactattgacaggaactctagcaacagtcccaataagcctgattctgctgagggttttctatga

SEQ ID NO: 17665 - protein, 342 aa, Sorghum bicolor
  misc_feature: Useful for making plants with altered alkaloid content
  misc_feature: Functional homolog of the protein sequence given in SEQ ID NO 13167
  misc_feature: Useful for making plants with altered lignin content
  misc_feature: Functional homolog of the protein sequence given in SEQ ID NO 13052
  misc_feature: Useful for making plants with modulated biomass
  misc_feature: Functional homolog of the protein sequence given in SEQ ID NO 13029
  misc_feature: Ceres ANNOT ID no. 8681196
  misc_feature (5)..(72): Pfam ID: RRM_1 Pfam Description: RNA recognition motif. (a.k.a. RRM, RBD, or RNP domain)
MTGTVKVHNVSLKATEQEISEFFSFSGEIVHVELQSCDERSQFAYITFRDNQGAERAMLLTGATIEHMAVIITPATDYKLPASVLADLESKNTGGMEFALQKAEDIVSSMLAKGFVLGMDAVEKAKTFDEKHQLTSTATAKVASLDKTMGLSQKFNTGTLVVNEKMKEMDEKYQVAEKTKSALAAAEQTVSTASSAIMSNRYILTGAAWVTDAYNKVATTTTDVSTKTKERVMENEHQVGERQMTNVEENKNHEGEIAVAHMQENTETAENPSCHESEVSKANAHDSILMTEQSEREHKQPEDEFAKTHVPGSPVTIPVTMSTIDRNSSNSPNKPDSAEGFL

SEQ ID NO: 17666 - DNA, 1326 bp, Sorghum bicolor
  misc_feature: Ceres ANNOT ID no. 8681228
  misc_feature: Encodes the peptide sequence at SEQ ID NO 17667
atggcatccccggcaccggcgtcgcttaaggacaccgtgggcagcctcgaccgcgacggcttcgtcggcctcctctccaagctgatcggcgagaccgcgcacctgcagaacgacccgccgacccacaggcctcaggaggagcgcgtggcgcagcacgtcgtcgacgtgctccgcccggtgtccgcggacaccgggggcggccctctcctcgtgcggaagatcagctacgtcgagggcaggagcaacgtcatcgtcgagtaccccggcaccgtccccggccgcgttgtctccttcgtcggcatgcacatggatgtcgtccctgccaacgccagcgagtgggactttgatcctttctcactaacctttgatagcgaggataaggacaagctttgcggacgtgggacaactgactgtcttggacatgttgcactggtggctcagctaatgcggcggcttggtgaggtcaagccacccttgaagcattctgtcatcgctgtgtttattgccaacgaggagaactcatctgtcactggcattggtgttgatggcctcgtgaaggatggattgcttgacaagctcaagacaggacccttgttttggatagatacagctgataagcagccgtgcatcggcactggtggaatgattccatggcatctcatggcaacagggaagctgttccacagtggccttgcacataaggccataaatgcaatggagatgaacatggaagcgctgaaagtaatccaaaaacggttttacactgacttccctccacacgagaaagagaagctctataagtttgctactccatcgacaatgaagccaactaaatggagctatccaggtggggggcttaatcaaattcccggggaatgcacaatttcaggggatgtaagcacttctcatgtcatagagaagttgaaggaatatgtagaggacatcaatcagagatttgagacaatacttgatactcgtggtcctgtgtccaaatatattcttcctgatgaaaatctacaaggaaggcttgaaatcacttttgatggagatgtgatgaatggggtggcttgcaatctggagtctcgaggctatcatgcattatgcaaagcaaccaaggaaatagttggccaagtggagccatattccatcaccgggagtctacctctgattcgggaattacaggatgaaggatttgatgttcaaacagctggatatggcttactgaagacgtaccatgcgaagaatgagtactgcctgttttcagacatggcccagggctttgaggtgtttctgagcatcatttcacaactggaagaagaggtctga

SEQ ID NO: 17667 - protein, 441 aa, Sorghum bicolor
  misc_feature: Useful for making plants with modulated water use efficiency
  misc_feature: Functional homolog of the protein sequence given in SEQ ID NO 14002
  misc_feature: Ceres ANNOT ID no. 8681228
  misc_feature (16)..(439): SWISSPROT Homolog: EC 3.5.1.16 Acetylornithine deacetylase
  misc_feature (98)..(436): Pfam ID: Peptidase_M20 Pfam Description: Peptidase family M20/M25/M40
MASPAPASLKDTVGSLDRDGFVGLLSKLIGETAHLQNDPPTHRPQEERVAQHVVDVLRPVSADTGGGPLLVRKISYVEGRSNVIVEYPGTVPGRVVSFVGMHMDVVPANASEWDFDPFSLTFDSEDKDKLCGRGTTDCLGHVALVAQLMRRLGEVKPPLKHSVIAVFIANEENSSVTGIGVDGLVKDGLLDKLKTGPLFWIDTADKQPCIGTGGMIPWHLMATGKLFHSGLAHKAINAMEMNMEALKVIQKRFYTDFPPHEKEKLYKFATPSTMKPTKWSYPGGGLNQIPGECTISGDVSTSHVIEKLKEYVEDINQRFETILDTRGPVSKYILPDENLQGRLEITFDGDVMNGVACNLESRGYHALCKATKEIVGQVEPYSITGSLPLIRELQDEGFDVQTAGYGLLKTYHAKNEYCLFSDMAQGFEVFLSIISQLEEEV

SEQ ID NO: 17668 - DNA, 1164 bp, Sorghum bicolor
  misc_feature: Ceres ANNOT ID no. 8681224
  misc_feature: Encodes the peptide sequence at SEQ ID NO 17669
atggcggcagtggcgtcgtcttctcctcctgcaacaattgctgggccgcagccgacgtgggtgccctatgagccaaccagggactgctcccagggcctctgcagcatgtactgcccgcagtggtgctacttcatcttcccgcccccgccgccggccttcgacatcgccggacccgggagcggcgacgactcctccggccccaccttctcgcccctcgtcatcgccatcatcggcgtgctcgccagcgccttcctcctcgtcagctactacaccatcatctccaagtactgcggcaccttcagctccctgcggaacatgctcttcggtccccgcaggggccgcggcggcgtcggcggcggcgattcgcggagtctggagccgtggggcgccgtgccgtcggacgggctggacgagaccctgatcaacaagatcacggtgtgcaagtacaagcgcggcgacgggttcgtggacagcaccgactgctccgtctgcctcggcgagttccgggacggcgagagcctccggctgctgcccaagtgcagccacgccttccacctgccttgcatcgacacgtggctcaagtcgcactccaactgcccgctctgccgctgtaacatcgccttcgtcgccgtcggggtggtgtcaccggagccggagcgccgcggcgccacgcgggaggaccgcgactggagagacaacaaccaccccgagctgatcctgacggtcgacgagtcctcggagcccgcgcgtggcgtgccgcagagtcagagtcagaatcagaatgtggtcagcggcaacggcggtgacggcctggcgccgaaggaatttccggggagatcagaggaggccagcggcattgccgagataaaggaggactgcgcgctgccggtgcgggcgtcgtcgtcgctgtccgacacgcaccgcgaaggcccaatgtccatcgccgacgtgctgcaggccagcatggaggacgagctgatgatggcccgggagagcggcctcctggcaggctcgtcgggacggtgccacggggagcacagcaaggacggcagcggccgcagcggccgtgcaatgccggatgcagcgaagcgattgccgtctgttggaagatcgtgcttcagcagcaggaatggcaggggaaaggattcgattcttccaatgtga

SEQ ID NO: 17669 - protein, 387 aa, Sorghum bicolor
  misc_feature: Useful for making plants with altered alkaloid content
  misc_feature: Functional homolog of the protein sequence given in SEQ ID NO 12951
  misc_feature: Ceres ANNOT ID no. 8681224
  misc_feature (161)..(202): Pfam ID: zf-C3HC4 Pfam Description: Zinc finger, C3HC4 type (RING finger)
MAAVASSSPPATIAGPQPTWVPYEPTRDCSQGLCSMYCPQWCYFIFPPPPPAFDIAGPGSGDDSSGPTFSPLVIAIIGVLASAFLLVSYYTIISKYCGTFSSLRNMLFGPRRGRGGVGGGDSRSLEPWGAVPSDGLDETLINKITVCKYKRGDGFVDSTDCSVCLGEFRDGESLRLLPKCSHAFHLPCIDTWLKSHSNCPLCRCNIAFVAVGVVSPEPERRGATREDRDWRDNNHPELILTVDESSEPARGVPQSQSQNQNVVSGNGGDGLAPKEFPGRSEEASGIAEIKEDCALPVRASSSLSDTHREGPMSIADVLQASMEDELMMARESGLLAGSSGRCHGEHSKDGSGRSGRAMPDAAKRLPSVGRSCFSSRNGRGKDSILPM

SEQ ID NO: 17670 - DNA, 387 bp, Sorghum bicolor
  misc_feature: Ceres ANNOT ID no. 8681219
  misc_feature: Encodes the peptide sequence at SEQ ID NO 17671
atgtcatatcagattatcatacagttaattcatcagtttattcgttgtcttgactactacaaagttctggaggttgattatgacgcttctgatgacaccatcaagttgagttatagaagattagctttgatgtggcatccagacaagcataagggtgataatgatgtcacagctaaatttcaggagattaatgaagcatacaaggttttaagtgacccagctaagcgactagaatacgatgtttctggttgttatgagattgatcaatatactttgcgtgagtaccttgcaaaatttaagggtatgatacttacctgtaatggccttggcatagatcatccttctagtaaatgggcccgacatttgagggaactgaagccccattga

SEQ ID NO: 17671 - protein, 128 aa, Sorghum bicolor
  misc_feature: Useful for making plants with modulated heat sensitivity
  misc_feature: Functional homolog of the protein sequence given in SEQ ID NO 13683
  misc_feature: Ceres ANNOT ID no. 8681219
  misc_feature (18)..(80): Pfam ID: DnaJ Pfam Description: DnaJ domain
MSYQIIIQLIHQFIRCLDYYKVLEVDYDASDDTIKLSYRRLALMWHPDKHKGDNDVTAKFQEINEAYKVLSDPAKRLEYDVSGCYEIDQYTLREYLAKFKGMILTCNGLGIDHPSSKWARHLRELKPH

SEQ ID NO: 17672 - DNA, 759 bp, Sorghum bicolor
  misc_feature: Ceres ANNOT ID no. 8681222
  misc_feature: Encodes the peptide sequence at SEQ ID NO 17673
atggcaatagatcacgcgacgcctctcggactcaagagcagaggcgccatgggaggcggtgagtgcgactacgacgacgccgagaaccagcggtggccgccgtggctgaagccgctgctgtccacgagcttcttcgtccaatgcaggatccacgcggacgcgcacaagagcgagtgcaacatgtactgcctcgactgcatgaacggcgcgctctgctccctctgcctagcgcaccatcgcgaccaccactccatccagatacggaggtcctcctaccacgacgtgatccgggtgtcggagatacagaaggtgctggacatcgccggcgtgcagacgtacatcatcaacagcgcgcgcgtggtgttcctcaacgagcggccgcagccacgcccgggcaagggcgtcaccaacacctgcgaggtctgcgagcgcagcctcctcgactgcttccgcttctgctccctcggctgcaagatagtgggcacagcccgtggctaccgtcccaagaagaagcacggcatcggcggcggcggtcacaagaagaagagggcggcgcttaaggtcaaggacgtgcgctctgactcggaggattcgtgcaccagcaccagcggcgccagcagcgacaagagcagcgtggtgcagagcttctcgccgtcgaccccgccgccgacgtctgccagccaccgccgcccagggaacaagcgccggaagggcgtcccgcaccggtcgcccttcggcagcctcatcgtcgagttctga

SEQ ID NO: 17673 - protein, 252 aa, Sorghum bicolor
  misc_feature: The sequence is a functional homolog of SEQ ID NO 664 in the 10/666,642 US patent application
  misc_feature: The sequence is a functional homolog of SEQ ID NO 668 in the 10/666,642 US patent application
  misc_feature: Ceres ANNOT ID no. 8681222
  misc_feature (48)..(159): Pfam ID: PLATZ Pfam Description: PLATZ transcription factor
MAIDHATPLGLKSRGAMGGGECDYDDAENQRWPPWLKPLLSTSFFVQCRIHADAHKSECNMYCLDCMNGALCSLCLAHHRDHHSIQIRRSSYHDVIRVSEIQKVLDIAGVQTYIINSARVVFLNERPQPRPGKGVTNTCEVCERSLLDCFRFCSLGCKIVGTARGYRPKKKHGIGGGGHKKKRAALKVKDVRSDSEDSCTSTSGASSDKSSVVQSFSPSTPPPTSASHRRPGNKRRKGVPHRSPFGSLIVEF

SEQ ID NO: 17674 - DNA, 1821 bp, Sorghum bicolor
  misc_feature: Ceres ANNOT ID no. 8681236
  misc_feature: Encodes the peptide sequence at SEQ ID NO 17675
atgaagatgagggcgatcgtcgtggaaggaggggagatgagcgcgccgacgccgacgccgaagcaggacaagtgctgcgagtacacgctcgacggctccgtcgacatcaagggccgcccggcggtcaaggggaaatcaggaggatggcttgccggtgctctaatccttgtgaaccagggcctggcgacactagccttcttcggcgtgaacgtgaacctggtgctgttcctgacgcgggtgctggggcagagcaacgaagacgccgccaacaacgtcagcaagtggacgggcaccgtgtacatgttctccctcatcggcgccttcctcagcgactcctactggggacgctacaagacctgcgccatcttccaggccatctttgtgctcggcctcgcgctgctgtcggtgtcgtcgcacctctacctaatcaggccggacgggtgcggcatggagcacgcgccctgcggcccgcactccggcaaggagctggggatcttctacatcgcgctgtacatgatcgccttcggcaacggcgggtaccagcccaacatcgccaccctgggcgccgaccagttcgacgaggacgaccccgccgaggcgcactccaaggtctccttcttcagctacttctacctcgccctcaacctcggctcgctcttctccaacaccttcctcagctacctcgaggacaagggcagctgggcgctcggcttctgggcctccaccgccgccgccgccaccgcgctcctgcttttcctcagcgggacgctccggtatcgctatttccagcccggagggaacccgatcgggaggatttgccaggtcgccatcgccgcgtccaggaaatggaaggcgggcgcgtcgaccaccggagtggtcagcctgtacgagggcgacgagaaggcggatgccgccggtggcaggaagcttttgcacacgcaagggttcagtttcttggaccgcgcggcgcacgctgacacggactccaagctcggcgcgcgcgacccctggaagctgtgcacggtgacgcaggtggaggaggtcaagagcatcctgaggctcctccccatctggctctgcaccatcctctactcggtcgtcttcacccagatggcctcgctctttgtcgtgcagggcgccgcgatgcgccgcaccaccccgttctccggcttctccgtcccgccctccagcatgtcggccttcgacatcctcgccgtcgccaccacgatcttcttgtaccgccgcgccatctgcccgttcctggcgcggctcaccggccgcccggccggccccaccgagctgcagaggatgggcctcggcctggtcgtgggtgccctggccatggccacggccgggacggtcgagcacttccggaaggccagggccaccgcggcgatgagcagcgacctgcatatcatgtggcaggtgccgcagtacgcgctgatcggcgtgtcggaggtgatgatgtacgtcgggcagctcgagttcttcaacggccagatgcccgacgggctcaaaagcttcgggagcgcgctctgcatgatgtccatgtcgctcggcaactacttcagtgacgtcatcgtgagcgcggtcaccaggctcaccacgacgcgagggcggtccgggtggatcccggctgacctcaacgagggccacctcgacaagttctacttcctgctcgccgtgctggccgtcgcggacttcgcggtgtacctcgtgtgcgcgagccgctacgggagcggcaaggtggacgggaggagcagcgacgacgaggaggagggagcggccggtcaggtgacatccctgccggcttacgcatga

SEQ ID NO: 17675 - protein, 606 aa, Sorghum bicolor
  misc_feature: Useful for making plants with altered carbon content
  misc_feature: Useful for making plants with altered nitrogen content
  misc_feature: Functional homolog of the protein sequence given in SEQ ID NO 14559
  misc_feature: Ceres ANNOT ID no. 8681236
  misc_feature: Down-regulated in root tissues in response to methyl jasmonate treatment
  misc_feature: Down-regulated in shoot tissues in response to salicylic acid treatment
  misc_feature (117)..(517): Pfam ID: PTR2 Pfam Description: POT family
MKMRAIVVEGGEMSAPTPTPKQDKCCEYTLDGSVDIKGRPAVKGKSGGWLAGALILVNQGLATLAFFGVNVNLVLFLTRVLGQSNEDAANNVSKWTGTVYMFSLIGAFLSDSYWGRYKTCAIFQAIFVLGLALLSVSSHLYLIRPDGCGMEHAPCGPHSGKELGIFYIALYMIAFGNGGYQPNIATLGADQFDEDDPAEAHSKVSFFSYFYLALNLGSLFSNTFLSYLEDKGSWALGFWASTAAAATALLLFLSGTLRYRYFQPGGNPIGRICQVAIAASRKWKAGASTTGVVSLYEGDEKADAAGGRKLLHTQGFSFLDRAAHADTDSKLGARDPWKLCTVTQVEEVKSILRLLPIWLCTILYSVVFTQMASLFVVQGAAMRRTTPFSGFSVPPSSMSAFDILAVATTIFLYRRAICPFLARLTGRPAGPTELQRMGLGLVVGALAMATAGTVEHFRKARATAAMSSDLHIMWQVPQYALIGVSEVMMYVGQLEFFNGQMPDGLKSFGSALCMMSMSLGNYFSDVIVSAVTRLTTTRGRSGWIPADLNEGHLDKFYFLLAVLAVADFAVYLVCASRYGSGKVDGRSSDDEEEGAAGQVTSLPAYA

SEQ ID NO: 17676 - DNA, 5097 bp, Sorghum bicolor
  misc_feature: Ceres ANNOT ID no. 8681239
  misc_feature: Down-regulated in root tissues in response to methyl jasmonate treatment
  misc_feature: Down-regulated in shoot tissues in response to salicylic acid treatment
  misc_feature: Encodes the peptide sequence at SEQ ID NO 17677
atggccatatgcttctcagtgaccgacacctgtgtcccattgctaacggtggttgacgggatgacaattaccatccatcctcatcctttctaccaaacacaaaactgggattgttacatcctggaggacgaagattacgttgctgctgaagaagtaaaggatgacgaaacaactttgtctgaagaggaagaattggcaaagaaagaagatcctgatcatctggaagagattaagttactgcagaaggagagtgagataccactagaagaacttatcgcgaggtaccgaaaggatggctgtgcagatcatgaaacagcggagttggagaattcaccccattttgttgaagaggtcaatactgatatgtctttggatgatcaatctgtgaacattttggaatgtgctgaacaaaattttgtggaagagaataatctcactgatgttaatacagtcaatggagataagagtgatgatgtaattgctgatgccgcagctgctgcaagatcagcacaaccaactggcaacaccttcttgactacaaaagtgcgcacgaaattcccattccttcttaagcattctcttcgtgaataccagcatatagggctggattggttggttgctatgtatgagaagaggctgaatggaattctagcagacgaaatgggtttaggcaagacaatcatgactatctccttgctagcacaccttgcgtgtgagaaggggatatggggtcctcatcttattgtcgtgccgactagtgttatgctaaattgggagactgaatttcttaagtggtgtcctgcttttaaaatactgacttatttcggaagtgcaaaggaaagaaagcagaaacgtcagggctggatgaaaccaaattacttccatgtttgcatcacaacatataggcttgtcattcaggactctaaagtatttaagcgaaaaaagtggaagtatcttattcttgatgaggctcatctgataaagaactggaaatcacagcgttggcagactttgcttaactttaattcaaagagacgtattcttctgactggaactccactgcaaaatgaccttatggaactttggtccctcatgcattttctgatgcctcatgtatttcagtctcatcaagagtttaaggattggttctgcaatccaatttctgggatggtggaaggccaagataaagtaaacaaagaagttatagatcgattgcacaatgtccttcgtccatttatactgcgtcgactgaaaagggatgttgagaagcagttaccaaagaagcatgaacatgtcatatattgccgactttctagaaggcaaaggaacttgtatgaagattttatagctagctcagagacacaagcaacactggctagtgggaattattttggcatgataagcatcattatgcaacttagaaaggtctgtaaccatccagatctttttgaaggccggccaataataagctcatttgacatggctggggttaacatgcagctcagctattcagtctgcatgctccttgataagagtccattttctcaggtggacctgtctgatatgaattttgtgtttactcaaaatgaatttagcatgagttcctgggaagctgacgaggtcatctctgcctttccttcaagtatcacttccagggactgtgacctggatattttttgctctaataaggatcatcagggaagtaatttgacaaatatttttgaagatattcagaaagccctacaggaggagagaataaaagaatccagagaaagggcagcttccattgcatggtggaatagagttagatgccaaaagaggcctatctatggcacaaacatgagacaggttttgactgtaaatcatcctgtatcgaacattcttgataagaggaacaaccctttgtgccacatggactattcatcaagccttgcagatcttgttcttccatctgtggaacgctttcagaaaatgcttgatattgttgaatcatttacattcgcaattcctgctgctcgagctcctccccctgtttgctggtgcagcaaaggaaagtctcctgtttttattgatccggcatatagagaaaaatgcatgaacaagttttctcccattctgtctcctataaggtctgctattgttcgtcgtcaagtctactttcctgataggcgtttgatccagtttgattgtgggaagttgcaggaacttgcaattcttttaaggcgtttgaagtcagaagggcacagggccttgatatttactcagatgactaagatgcttgatgtcttggaagagttcataaatctatatgggtatacatatttacgtttagatggttctactcccccagaagagaggcagactctgatgcagaggttcaacacaaatccaaagtttttccttttcattttgtccactcgtagtggtggtgtgggaatcaaccttgtaggtgcagacactgtcatcttctatgacagtgactggaaccctgcaatggaccaacaagcacaggacagatgccacaggattggtcagactcgtgaagttcacatatatagactcattagcgaaagcactatagaggagaacattctcaagaaagcaaatcagaaacgagctcttgatgatttagtgatacagcgtggtagctacaatacggaattcttcaagaaacttgatcctatggagttcttttctgggcacatgtctctccatgcggaagatcaggagaaaaattgctctacaaccgtggaagcttcaaatgacgtggatctggctctgtcaaatgcagatgttgaagcagctattagacaggcagaagatgaagctgactatatggctctcaagaagctggaggaggaagaggccgtggacaatcaagaattcagtgaggaggttgctggcagagcagaggaggatgaattggttaatgaggaggatggaaaacccgatgagcacattaatgaagaacacaaatacaactcttctgatgtagagaaggagaagcacattactttgtctaccaagcgattaaatgatgaaaaggctcttacattggctgttggtgatgaagatactgacatgcttgctgatgtgaaacagatggcagctgcagcagctgcagcaggtcaagcaagttcatcttttgagaaccagctccggccaattgatagatatgcaatgcgctttatggaactctgggatccagtaattgacaaagctgctgtgaatcatcaagtaaacgttgaggaggaagaatgggagcttgaccgtattgaaaaactcaaagaggatttagaagcagaaattgatgaagaccaagaaccactgtcttatgaatcatgggatgtagattttgctacgacagcctatcggcaacatgttgaagctttaactcaaaagcagttgttggaagaacaggaaaggcaggctcaggaagcagcaaaggagttggaggagaagaatgataatatgagcagtcaccgcagaaagtcaaaaaagaacaaaaagaagacaggcaaattcaagtccctaaaaagagtgcgtttgtcgtctgaatcagaagtcttactggaggaaacctctgtagacacaatgagcattgatgacaatgcacactcacctgagcttataagtgatgaatcgccacaccattactctaacaagcgcaagaagattatgtctgctactgaggaagatagtaacagcagaagtttaaagaagtttaagaaaactactaagtcaagttttatttctgaagccttgtcacctaggctgaaggatgaccttaatgattcagatccaaaatcagtggctagaactaaaagtgatggcagaatttccatcccttgcatgccagtaaaacgtattattgtaataaagcctgagagattgaaaaagaagggaatatggtctcgagattgtgcttcagactcatggacatctgaggaagatgcagttctttgtggaactgtgcacgagtatggtcctctttgggaattggcaagtgattttcttcattccttgccaggtgggtcctataggggaagatatcatcatcctgtgcattgctgtgagagatacagagaactgttctgcaaacatgcaatatcagcaacagataattctaacagtgaaaaggttccttctgggactggaaaggctatacttagagtatctgaggatcaagctcagatgttggtgaatgtgaccagtgaacttcctaacaatgaattgcttctccagaaacacttcatggctgtaatttcatctgtctggagatcaaaatgtcgccgtgatccctgctgttttacgaatacttactctagtacattacatatgttttctcctgtgaagaagcctggtggatcaagtgggaactggcccatggtaaactttagaccaagcttcaatctagttaggaaagcccttgcagatgctcaggctaagtctacactaatggtgattccaccaccgtcaagaaatcaggaataccggcggaattatttagaattagagttagatttcttgaaagatcaacatgcttatgaggaaggcttcccatctgtagtaaatgtgtccatactggaaccagaaccatcgaaacaggcttcagagccagtggaacaatcgttattgtctggagtttcttgtagacaagctgagaacagactcaggttagcatcagaagcttgttacgatggtgaaagttctcattgggcatcatcagctttccacataaatgatgccacccgctataaatctggttcaaagtccataggaaagcacaaagcagcatcggaatctggtagacctcccaaatccaaagtccagaagattactgaatctcatcaggaagggccaattgtcatgagtaattttctccgtatgcctgctcaaatattgccaagtacagctgacttccacattagtgactccctatctgaatttggtatcagcgattctgaattcaactactctgaggatctctttcaagaggttgacgattttgagttcttcccagatcagggtgactctggtctccttcctggtattgaagagttagaacctctttcggatttcacagatatcggatga

SEQ ID NO: 17677 - protein, 1698 aa, Sorghum bicolor
  misc_feature: Useful for making plants with modulated flowering time
  misc_feature: Functional homolog of the protein sequence given in SEQ ID NO 14563
  misc_feature: Ceres ANNOT ID no. 8681239
  misc_feature (193)..(460): SWISSPROT Homolog: EC 3.6.1.15 Nucleoside-triphosphatase
  misc_feature (197)..(483): Pfam ID: SNF2_N Pfam Description: SNF2 family N-terminal domain
  misc_feature (766)..(844): Pfam ID: Helicase_C Pfam Description: Helicase conserved C-terminal domain
MAICFSVTDTCVPLLTVVDGMTITIHPHPFYQTQNWDCYILEDEDYVAAEEVKDDETTLSEEEELAKKEDPDHLEEIKLLQKESEIPLEELIARYRKDGCADHETAELENSPHFVEEVNTDMSLDDQSVNILECAEQNFVEENNLTDVNTVNGDKSDDVIADAAAAARSAQPTGNTFLTTKVRTKFPFLLKHSLREYQHIGLDWLVAMYEKRLNGILADEMGLGKTIMTISLLAHLACEKGIWGPHLIVVPTSVMLNWETEFLKWCPAFKILTYFGSAKERKQKRQGWMKPNYFHVCITTYRLVIQDSKVFKRKKWKYLILDEAHLIKNWKSQRWQTLLNFNSKRRILLTGTPLQNDLMELWSLMHFLMPHVFQSHQEFKDWFCNPISGMVEGQDKVNKEVIDRLHNVLRPFILRRLKRDVEKQLPKKHEHVIYCRLSRRQRNLYEDFIASSETQATLASGNYFGMISIIMQLRKVCNHPDLFEGRPIISSFDMAGVNMQLSYSVCMLLDKSPFSQVDLSDMNFVFTQNEFSMSSWEADEVISAFPSSITSRDCDLDIFCSNKDHQGSNLTNIFEDIQKALQEERIKESRERAASIAWWNRVRCQKRPIYGTNMRQVLTVNHPVSNILDKRNNPLCHMDYSSSLADLVLPSVERFQKMLDIVESFTFAIPAARAPPPVCWCSKGKSPVFIDPAYREKCMNKFSPILSPIRSAIVRRQVYFPDRRLIQFDCGKLQELAILLRRLKSEGHRALIFTQMTKMLDVLEEFINLYGYTYLRLDGSTPPEERQTLMQRFNTNPKFFLFILSTRSGGVGINLVGADTVIFYDSDWNPAMDQQAQDRCHRIGQTREVHIYRLISESTIEENILKKANQKRALDDLVIQRGSYNTEFFKKLDPMEFFSGHMSLHAEDQEKNCSTTVEASNDVDLALSNADVEAAIRQAEDEADYMALKKLEEEEAVDNQEFSEEVAGRAEEDELVNEEDGKPDEHINEEHKYNSSDVEKEKHITLSTKRLNDEKALTLAVGDEDTDMLADVKQMAAAAAAAGQASSSFENQLRPIDRYAMRFMELWDPVIDKAAVNHQVNVEEEEWELDRIEKLKEDLEAEIDEDQEPLSYESWDVDFATTAYRQHVEALTQKQLLEEQERQAQEAAKELEEKNDNMSSHRRKSKKNKKKTGKFKSLKRVRLSSESEVLLEETSVDTMSIDDNAHSPELISDESPHHYSNKRKKIMSATEEDSNSRSLKKFKKTTKSSFISEALSPRLKDDLNDSDPKSVARTKSDGRISIPCMPVKRIIVIKPERLKKKGIWSRDCASDSWTSEEDAVLCGTVHEYGPLWELASDFLHSLPGGSYRGRYHHPVHCCERYRELFCKHAISATDNSNSEKVPSGTGKAILRVSEDQAQMLVNVTSELPNNELLLQKHFMAVISSVWRSKCRRDPCCFTNTYSSTLHMFSPVKKPGGSSGNWPMVNFRPSFNLVRKALADAQAKSTLMVIPPPSRNQEYRRNYLELELDFLKDQHAYEEGFPSVVNVSILEPEPSKQASEPVEQSLLSGVSCRQAENRLRLASEACYDGESSHWASSAFHINDATRYKSGSKSIGKHKAASESGRPPKSKVQKITESHQEGPIVMSNFLRMPAQILPSTADFHISDSLSEFGISDSEFNYSEDLFQEVDDFEFFPDQGDSGLLPGIEELEPLSDFTDIG

SEQ ID NO: 17678 - DNA, 1050 bp, Sorghum bicolor
  misc_feature: Ceres ANNOT ID no. 8681260
  misc_feature: Encodes the peptide sequence at SEQ ID NO 17679
atgatcgtgagcgtagctggtgctcttgttcttactagcctcctgctgtcatcggccatcggccggccctctcacctcctgtccaatgtcagtcgtgtcgatgacagcaccgactgtcagcatctcccactgagcttctcgccgtccgagacagcttccacggtgatcttctgcgtcgacaagaatggctgctgcaacttcaccacagtgcaggcagctgtggatgctgttcccgacaacggccagaagaggagcatcgtgtggatcatcggcatcttcgttgagaaggtcgtcgtcaggaaacccaacatcacgtttcaaggccaaggcctgaaggtgagcatgatcgtgtggaacgacactgctacgactgcaggcaacacgcccaacagcgcatctgtccacatcgatgcacctggcttcgtggcgaaaaacatgagcttcatgaattcagcacctgctccaaaacctggagctgaaggtgcacaggctgttgcaatgcgggtgagcggtgaccgagccgctttctggggctgcggcttctttggagcccaggacacactgcacgatgatcagaacaggcactatttcaaagagtgtcttatccaaggaagcatcgatttcatctttggtgatgcaaggtccctgcacgagaactgcacacttcacagcgtggcgcaagaattgccccaagggcagcgctccatcaacggcgcgatcactgcacaaggccggcgtttcgccgacaacaacaccggcttctccttcgttgggtgcacgatcggaggaagcggctggatcctactcggcagggcatggcaggcgtattcgcgtgtcatcttcgcgtacacctacatgccggcggccatcgtagccacagcaggcacggtgttttacggtgagttcgactgcaccggagatggagccaacatggccggcagggtctcttacgcccggaagttgaacaagatgcaagctcagccatttctgacgacggcgttcatcgatggtcctgaatggcttaagccattcaatgacagcctaatgtga

SEQ ID NO: 17679 - protein, 349 aa, Sorghum bicolor
  misc_feature: Useful for making plants with altered carbohydrate content
  misc_feature: Functional homolog of the protein sequence given in SEQ ID NO 14564
  misc_feature: Useful for making plants with altered cell wall content and/or composition
  misc_feature: Functional homolog of the protein sequence given in SEQ ID NO 14565
  misc_feature: Ceres ANNOT ID no. 8681260
  misc_feature (49)..(317): SWISSPROT Homolog: EC 3.1.1.11 Pectinesterase
  misc_feature (59)..(339): Pfam ID: Pectinesterase Pfam Description: Pectinesterase
MIVSVAGALVLTSLLLSSAIGRPSHLLSNVSRVDDSTDCQHLPLSFSPSETASTVIFCVDKNGCCNFTTVQAAVDAVPDNGQKRSIVWIIGIFVEKVVVRKPNITFQGQGLKVSMIVWNDTATTAGNTPNSASVHIDAPGFVAKNMSFMNSAPAPKPGAEGAQAVAMRVSGDRAAFWGCGFFGAQDTLHDDQNRHYFKECLIQGSIDFIFGDARSLHENCTLHSVAQELPQGQRSINGAITAQGRRFADNNTGFSFVGCTIGGSGWILLGRAWQAYSRVIFAYTYMPAAIVATAGTVFYGEFDCTGDGANMAGRVSYARKLNKMQAQPFLTTAFIDGPEWLKPFNDSLM

SEQ ID NO: 17680 - DNA, 873 bp, Sorghum bicolor
  misc_feature: Ceres ANNOT ID no. 8681237
  misc_feature: Encodes the peptide sequence at SEQ ID NO 17681
atggcgtcaaaaggtccccggtcaaagctagaccatgagacaagagctaggcgtcagaaggctcttgaagctccaagggagcctcgacggccaaaagttcactgggaccatgttcttgctgagatggagtttgattctgagagaaaatggaagttgtccatggccaaaaaaattgctcaaagagcaaataagagcatagttgaccaagcaacaaagggcgagagaaaacagaaggaggaagaacatagaatgcgaaaagttgcccttaatatttcaaaggatgtgaagaagttctggattaaaatagaaaaactgggaaagcaggttgtttataagcatcaactggaggttgaggagagaaagaagaaggcacttgataagcaacttgatttccttttaggtcagactgaaaggtattcgacaatgttggcggaaaaccttgtggacatgccctattcccaaaacctagaaaacgggacttcgaagataaaccaaccatcccatcaagaggaagtagcagaagagaacataaatgcagccattcctgatgatcttgataatatggaagtcgatgatgattatgagagctccttggatgaagagccagaagatgatgagcacacaatcgatgaggatgaagctcagatcaccgaagctgagcggaatgaagaactagctgctttagaggcagaagctgacctaccactggatgttattctcaagatgtatacaaaaaccaaagattcttcgaaccaggctaatggctgtgatcatgaacctgctcactcttcaagtgacgatggcaattcttcagaggaagtggatgatggtcattcttatgctgagtttgtgaagaagagtcataccaattaa

SEQ ID NO: 17681 - protein, 290 aa, Sorghum bicolor
  misc_feature: Useful for making plants with modulated flowering time
  misc_feature: Functional homolog of the protein sequence given in SEQ ID NO 14563
  misc_feature: Ceres ANNOT ID no. 8681237
  misc_feature (23)..(89): Pfam ID: HSA Pfam Description: HSA
MASKGPRSKLDHETRARRQKALEAPREPRRPKVHWDHVLAEMEFDSERKWKLSMAKKIAQRANKSIVDQATKGERKQKEEEHRMRKVALNISKDVKKFWIKIEKLGKQVVYKHQLEVEERKKKALDKQLDFLLGQTERYSTMLAENLVDMPYSQNLENGTSKINQPSHQEEVAEENINAAIPDDLDNMEVDDDYESSLDEEPEDDEHTIDEDEAQITEAERNEELAALEAEADLPLDVILKMYTKTKDSSNQANGCDHEPAHSSSDDGNSSEEVDDGHSYAEFVKKSHTN

SEQ ID NO: 17682 - DNA, 285 bp, Sorghum bicolor
  misc_feature: Ceres ANNOT ID no. 8681272
  misc_feature: Encodes the peptide sequence at SEQ ID NO 17683
atgggaggagcggggcaccacgacgtgcatttcttggacgcgtgcttcctctgccggaagccgctcgccagcaaccgcgacatcttcatgtacagaggcgacacggcgttctgcagcgacgagtgcaggagcgcgcagatggcggcggacgaagcggcggagaggaacaaggccatggccagcgcggtgacacatggggcgctgcccgccagggaagcggaagcggaaggcccacgggaacgggagcgcggcaaggtccgggccgggtccatcctggccctgtaa

SEQ ID NO: 17683 - protein, 94 aa, Sorghum bicolor
  misc_feature: Useful for making plants with modulated biomass
  misc_feature: Functional homolog of the protein sequence given in SEQ ID NO 14566
  misc_feature: Ceres ANNOT ID no. 8681272
MGGAGHHDVHFLDACFLCRKPLASNRDIFMYRGDTAFCSDECRSAQMAADEAAERNKAMASAVTHGALPAREAEAEGPRERERGKVRAGSILAL

SEQ ID NO: 17684 - DNA, 528 bp, Sorghum bicolor
  misc_feature: Ceres ANNOT ID no. 8681264
  misc_feature: Encodes the peptide sequence at SEQ ID NO 17685
atggggaggcttcttgggtggaagcaggaggcgcggatcgtgctactaggcctcgcctgcgctggcaagacagccatcctgcacaagctcaagcacggccacgtcgtcaccaccggaccaacgatagggttcaacaccgagacgcttgaatacaatggcatcagcttcagtgtttgggacgtgggtggtagtcaaggcgagctcctacggctcttgctaaggcactacctctatgccgcccagggcgtgatattcgtcgtcgacagcagcgaccaggagtggtttcatcaagccaaagatctgctaaacatgattctgaacgaggacaagttcagggatcccgcgctgcttttgtttgcaaccaagcaagaccttccgaacgccatgagcgcagcagagatagcagacaagttggggcttcagtcactgctttgcaaccgtagacgatggcacattcaaagttgttgtgcgatctcaggagaaggcctccatgaggggatggattggctctgcgccaacatacaatag

SEQ ID NO: 17685 - protein, 175 aa, Sorghum bicolor
  misc_feature: Useful for making plants with altered alkaloid content
  misc_feature: Useful for making plants with altered lignin content
  misc_feature: Functional homolog of the protein sequence given in SEQ ID NO 12945
  misc_feature: Useful for making plants with altered terpenoid content
  misc_feature: Functional homolog of the protein sequence given in SEQ ID NO 13081
  misc_feature: Ceres ANNOT ID no. 8681264
  misc_feature (1)..(174): Pfam ID: Arf Pfam Description: ADP-ribosylation factor family
MGRLLGWKQEARIVLLGLACAGKTAILHKLKHGHVVTTGPTIGFNTETLEYNGISFSVWDVGGSQGELLRLLLRHYLYAAQGVIFVVDSSDQEWFHQAKDLLNMILNEDKFRDPALLLFATKQDLPNAMSAAEIADKLGLQSLLCNRRRWHIQSCCAISGEGLHEGMDWLCANIQ

SEQ ID NO: 17686 - DNA, 264 bp, Sorghum bicolor
  misc_feature: Ceres ANNOT ID no. 8681299
  misc_feature: Encodes the peptide sequence at SEQ ID NO 17687
atggattccttctcgtcctcgctgccgtcgtcaggtgccggcgccaacccggacgctgttatggaacagatcaaggcgcagctcgcgcaggcttacgcgcaggagtttcttgagaccgtcgggaacaagtgctttgaaaagtgcgtgaccaagccaggatcaagcttgagtggaagcgagagcagctgcatatcacgttgtgttgaccgctacattgaggccactggtattgtcagccgcgctctgttcagttcccagcgctga

SEQ ID NO: 17687 - protein, 87 aa, Sorghum bicolor
  misc_feature: Useful for making plants with altered alkaloid content
  misc_feature: Useful for making plants with altered terpenoid content
  misc_feature: Functional homolog of the protein sequence given in SEQ ID NO 14567
  misc_feature: Ceres ANNOT ID no. 8681299
  misc_feature (21)..(85): Pfam ID: zf-Tim10_DDP Pfam Description: Tim10/DDP family zinc finger
MDSFSSSLPSSGAGANPDAVMEQIKAQLAQAYAQEFLETVGNKCFEKCVTKPGSSLSGSESSCISRCVDRYIEATGIVSRALFSSQR
